United States Patent 7,314,974 (EXPRESSION OF MICROBIAL PROTEINS IN PLANTS FOR PRODUCTION OF PLANTS WITH IMPROVED PROPERTIES) - sequence listing, part 11

SEQ ID NO: 33380 - DNA, 2292 bp, Desulfitobacterium hafniense
atgggaacaggacttatgtcattaaccgcctgtagtcagaacgcttccttaaccggcagcgaagcagcttctgcaggagaacaaatcatccccaccgccagcacccaggactgcggggggcgttgcctgatcaaagctcatgtgaaagacggcgtaatcacgaggatcagtacccggggcgcttatgaagaggatgaacccggtgcgaatatgaaagcctgcctgaggggacggagctatcgcaaacatctctatcaccctgatcgcttgaagtaccccatgaaacgggtgggcaaacggggagaaggaaaattcgaacagatctcctgggaagaagccattgataccattgccaaagaaacccggcgcatctttgatcaatatggacctgaatcaagatactgcaacgtaggcactggggataccggcggcgtaatttaccgtatgggccttggcggccgtttcctaagcgccaccggcggtcatctcccgttgtacaattcggttagtatggggaatacgggcactgctactccttatgtctatggggtcgccgctaccgccagcagtctggacagcttaaaagacaccaagctggttattctttggggacacaataccaccgagactattttcggcgcctccaattattatttccgtcaaatgaagaaccgcggctgtaaatttatctgcgtcgatccccgcaactccaatacggctgtggcttttgccgacgaatggattcccttgctgcctaccacggataatgccctgatggatgccatggcttatgtgatcgtcagcgagaatctgcacgatcaagcttttctggatcaatacgtccagggctttgatgaggagcatatgcccgaaggagtacccgcccatgaatccttagtatcctatctcttcggtaaaaaggatggggtggagaaaaccccggaatgggcagaggctatctgcaaagttcctgccgaaaccattcgccgtattgcccgggaatacgccaccacgaaaccggcggcccttatccagggctggggcccccaacggcattcctgcggagagagaacagccctcggcgctaccatgctggcttccattaccggcaatgtaggcgttcttgggggctgggccggcggctatatcggtctgagccgcaaaggttgcgttggacttcctgacgtaccgaatccttatcccggagctattccaaccttatcctgggtcgatgccattgaatgccccgaaaaagtcaccccggcagaaggattgctgggtgtagacaaactgaacagcccgatcaaaatgctcttgaacttggccggagatttcatagccaatcaaaatcctgatatcaaccgcacgatcagagttttagaagatgagagcctcgtggaattcatcgtggtcagcgacctgttcatgactcccagtgcccgctatgcggacattctcctgcccggcaacaccttctttgagcgttataatatcggcgcaacctggaataatggggattacttcatcctctcccaaaagattgtggataattattatgaaagccgttccgaatatgattggttggctgaagtagcggataagctgggagcaaaggatgtcttcaccggcggcaagactgaggaagaatgggtgcgctggattgtcgacgagacccgggccaagtatccggagaccctttcctgggaggagctggagaaagtaggcatcagcaaattccattatgacggtccccgggtagctttccaggatcagatcgaagatccggtcaacaatcctttccccaccccatccggcaaaatagagctcttctccaagaccctttacgatatgcataaccccgaaattcctgctatacctgtttacgtaccggcctgggaaggaccggaagatgagttaaccgaaaaatatcccctgcagctgattggctggaaaacgaaagcaagagacaactccaccttctataataatccctggctacagcaagccatggtccaggaagtatggatcaaccccatggatgccaaacccagaaacattgttaccggcgaccgggtcaaagtatttaacgatcgtggcacgaccatgctccaagcccgggttacatcaagggttattcccggagttatcgccgcccccacaggatcctggtttactcccgatggcaaaggcggttgcactaacggcaaccttaacgtcctgactaccttaagaaaaactgctctttctcatggcaatactcaacataccagcctggtggaaataagcaaatta

SEQ ID NO: 33381 - DNA, 2046 bp, Desulfitobacterium hafniense
gagaatcagcaaacaaaccagaaatccttagatcttgatgccgctcgggtcagtcataacaaggggtatctcactaccaaccagggggtcggggttagcaatacggatgactctctcaaagcaggcaaacggggccctaccctcatggaggattttatctttcgggaaaaggttacccattttgaccatgaacggattcccgagcgggttgttcacgcccggggctcaggtgcccatggttacttccaggtttacgagaacctgtctcatctgaccaaggctcattttctcagcgatcccaatctgattacgccggtcttcgtccgtttttccaccgttgccgggtttcgcggctcttcggatacggtgcgggatgtccgggggtttgcggttaaattctacacacaggaaggcaattatgatatcgtgggcaacaacatgccggtattctttattcaggatgctattaagttccccgatctcatccattccctaaaacctgagcccaacaatgagatgccccaggcggcctcagcccacgacaccttctgggactttgtggtgaatactccggagaccatgcacaatgtcatgtggctgatgtctccccgcgctgttcccaaaagctttcgcatgatggaaggctttggcatcaataccttccgtctggtcaacgccaaaggtgaatttaaatttgtaaaatttcactggaagcctgttctgggtgtccattccctggtctgggatgaagctcagaaggtggccggcaaggatcctgacttcaaccgcagggacctttgggaaactattgagcatggccaggccgtcgaatttgaacttggcattcaggtgctgaagccggaggatgagttcaggtttgatttcgatattctggaccctaccaagctttggcctgaggaattaatccccgttcagaaaatcggcaagatgacactgaaccagaacccggacaatttcttcgccgaaacggaacaggtggctttttgtccggccaatgtagtgcccggtattgatttcagcaatgatcctttgctccagggccggctgttctcctatctggacactcagctctctcgtctgggaggtcccaacttccaccagcttcccattaaccgtcccctgcccaaggtaaacaacaaccaacgggacggcatgcaccgcatgaccattgacgagggacagaccagctactatcccaactccttgaataagggtgagcctcacgccgcccgcgctggggaaagtcacttcgaacactatcaggaaaaagtggatggccatgttatccgggagcgcagcgagagcttccgggatcactacacccaaccggctatgttttggaacagtatgtccgactgggaaagacaacacatcatcgatgctttccgattcgagctgggcaaatgcaagcataagcatacccaccaaaagcttgtggatatgctgggcaacgtggatccggagctggcccaaaaggtggcggagggcttaggggccacacctccggccaacggggccaatcccaccacggcttcttctcccgctctcagtatggccaataccgccaagagcccgaaaaccagaaaagtggctgtcctgcttgaaagcggtttcgataaagctcagtttgatgctcttaccgctacccttattgctgccggcgcttgttttgatgtggtgtcctgtaagctgggaccggttactgccggtgataacggcagggtagaaggcaaccaaacctacgctaccacagcttcggtcttttacgatgccgtttatatccccggcggttcccacactgaggccctcaaaggctcggcggatgtaaagggtttcctcctggacacctttaaccattataagaccattgggctaagcggtgaggcgtcggccctgctgggcctgttgccttccggacaaaagccggcgccaggtatcgtctgcgagtcggccggaaacatggaaatctatgccaacaacttcctggcagctctcacaacaggccgccatttcgagcggaatgtc

SEQ ID NO: 33382 - DNA, 1569 bp, Desulfitobacterium hafniense
gcagaacgtttacaatcttttggtgaaataagtctgagcaagcaagtgctgcaggcattatcagaaatggggtttgaggagccctctccaattcaaaaagcagccattcccgtggctatggatggtgtggatttaatcggccaggcccaaaccggtacaggaaaaactgccgcctttgggattcccatctgtgaaaaagtcaaccctaagtttcaggcagttcaagccttgattctgacaccaacccgcgaactggccgttcaggtgtcggaagagatcagcaagatcgggaaatatcgccatattaaacccttgcccatttacggaggccaatccatcgaccgtcagatccgggcattgcgcttcggcagccaggtggtggtaggaactccgggtcgtatccttgatcatttaaatcgcggaaccctaaaattgcagtatgtaaaaatggtggttctggacgaagccgatgaaatgctggatatgggctttgttgaggatatagaaacgattcttaagcaagttcccaaagaagagcgccaggtgatgcttttctcggctaccatgccgccggaaattaagaaactggctcagaattatatgcaccagcctaaatccgtagccgtaagccgtgatgagctcactgtgcctttgattgagcaagtcttttatgaagccagagacaaaatcaaagtggatgccctctgtcggattattgatatggaagatatcggtcaagccattatcttctgtcggaccaaaagaggggttgatgagcttgtggccgctctggaggcaagagggtattttgcagatgccctgcatggtgatttaagccaacagcagagagaccgggtcatgaagaagttccgtgacggcaaggttgagttgcttgtggctacggacgtggcagcccggggactggatatcgataacgtaacccatgttattaacttcgacattccccaggatcctgaatcttatgttcatcggatcgggcgtaccggcagagccgggagaaaaggccaggctattaccttggtttcttcccgggaataccgtcaactccgcttgatcgaacgtttgatcaagacccggatcatacgcaaagagttaccgaccctggccgatgtcagtgaacggcaagcggaaaatctcaagaatcagctggttaagattttgcagcgaagccacttgggaacctatcgctccatcgtgggatctttgctggaagagtatgattctatggatgtagcggcagcagccttgaaatttgctgttgagggtgttgaggagcgaagtgaagaggaagatgatattgcttttggcaatactggagcagcccctggtatggtccgcctctttatgaatattggccgtcttcaacaggttcgccctcaggacatcgtccgttggatagctgacgaaagcggaattcccggcaacattatcgggatgatcaacatctatgataaatttacctttgtggaaatccctgaacaacatgccagccgggttctcagctgcatgcatcagaacatgattaaaggccgtaaggtcaacgtggaa

SEQ ID NO: 33383 - DNA, 1218 bp, Desulfitobacterium hafniense
tgggtttccgggtataatgttttacccatcgggcttttagtgcttttgggtgtcgctttctggaaattcatgccccggtccatggtgggaggttccgagaaaggggtccgaatttccggcagcacggttgactttgaagacataggcggtcagaatgccgctaagaaagaactccaggaagccttggattttctgttatacagtgaacgcatgagggagctggggattcggcctttgaagggtatccttttatccggtccgccgggaactggtaaaaccttattagcaaaggcggcagcccgctatacggattctgtttacttagccatttccggcagtgaatttgtggaaatgtacgcaggtgtgggggcagagcgggtaaggaagctcttcaaaaaagccagagaatcagccaaaaaggaaaaaaaggatcgggcgatcatttttattgacgagatggatattctgggggccaaacggggcagcaatgtctcccaccatgaatacgatcagacccttaatcagctgctggtggaaatggatggactgggaaacagtgaacaaggtacccaaattctcctgattgccgccaccaatcgcgccgaagcattggacccggctcttttgcgtccaggacgcttcgatcgcctggtcaaagtggacctgccggataaagaaggacgcctggccatcctcaagattcatacgaaaaacaaacccctggcctcctgcgtggatctggaacagattgctcaggaaacctataatttttctggagctcatctggaaagtgtcaccaatgaagcggcagtctttgctttaagggatgatgcccgggaagttaacatgtttcatttccgggaggctgtggaaaaggtgctcttaggagaaaaactggatcgcaagcctacggatgaagaattacaacgggtggcgatccatgaagggggccatgctttgcttgctgaatttgtacggccccattccgtgtcccagatctccattcgctcccgtggcaacgccttaggctatgtgcgccactatcctaaagatgatttatatctttacacccaggccatgattgaagaacagattatggtcgctctggccggagccatagctgaggagaccatcctgggcacacgcagtacaggtgccgccggtgattatgaacaggccctgcatatggtggagaagatgctggcctccgggatgtcc

SEQ ID NO: 33384 - DNA, 1806 bp, Desulfitobacterium hafniense
gagatcaggcagctgctcgatattgtcattaattccctttatacggatcgggagatttttctgcgtgaattgatttccaatgctgccgatgcttcagaaaaagtaaggtatatgcaattatccggacaaaatgtcaaggatcaagagcttcccctggaaattcgcattactcccgatgaaaacgccaagaccttaaccattgccgatgccggtattggcatgaccaaggaggatttaattgagaatatagggaccatcgcccattccggctccaaagctttcgtgcagcgtttggcggaagcgggggataagaaagatgtcaatctgattggtcagtttggggtcggtttctattcggctttcatggtggcggataaggtgtcccttaccagccgctcctatgaacctgatgcccagggctatcgttgggaatccgacggaagaggcagttacagtatttctgaagcaatggatctgccccggggaaccagcatcacccttcacctgaaagaagatgctcattcctttgcccaggccgataccgtgaagcgcattattaagcagtactccagctttgtgccttatcccgtctatgtcggtgaggaaaagatcaatacagttcaagccttatggacgaagaataagaatgagatctctgaagaggagtacaaagagttttataagtatatcgccaatgcctatgacgagcccttaatgcgcatgcatttttcctcggatgctcccattaacctcaatgcattgctgttcgttcctaaatccaatatggaaaagttcggctttggacggatggaggccggggtcaacctctattgcaaaaaagtcctcattcaggaaaaagccaaggacattgtgccggagtggctgcgttttgcccggggcgtggtggacagtgaagaacttcccttgaacatttcccgtgaaaccatgcaggacagcgccttgatcgccaaactgaataaggtggtgaccagccgcttcctgaaattcctggatgatcaagcgaagaacgaaccggagatctttaaggaattctggaatgagttcagtattttccttaaggaaggggctgccaacgactttacccatcgtcaggagatcctgaagctgctgcgctttgagtcctcgaagacgggagaaggggagctgatatccttaggggattatgtgggccggatgaaggaaggacaagaagcgatctactttatcaacggtccgacccggcagattatcgaggagggtccttatttagaggtctttaaaaacaaagactatgaagtcatctatacctatgatggcatcgacgactatgtcttcgatatgatcagggaatatgacggcaagcgtttgctgtccgccgatcatggggatcttaacctcgctgatgaggatggggcctcggcagaggaaaagcttttatcagaagaggagcttaaagaatttaatgactggcttaaggaagtgctgggggagaaagtgacggaagtccgtgaatccaagcgcttggtggacagtccggccatcatcctcagtcattatggtacccacagcatgcagcggatgatgcagctgatgaacagggacctgcaggacgttccggccggaattctggagatcaatcccaagcatgttctgatccagcgtctcaacgatttaagaaagcaggaggattcctttgctcctctggccgctgagcagctttttgccaatgcccagattgcagcgggaatcatcgtggatccccggagcatggtcagccggttaaatgagatacttgagaaagccttg

SEQ ID NO: 33385 - DNA, 2376 bp, Desulfitobacterium hafniense
ttgcagaacaaaaccaaaatcagtcggcgtgcctttgtgaaatggagcgcagccgcaacagctactgcagcgatagccccctctctcgtgggttgcagcacacagactcaggccagtggcgagcccgcagtagtgcaagccggacagcgtcttgccggtgccgaggagaaaccttcgatctgctggcataactgcggcggccgttgtcagcttaaagcctatgtcaaggatggggtggtcgtgaggtttggcacggataatgtgggacctgataccccggaggacttgcaggcccgggcctgtttgaaaggcagaacccagcggcagcgactttatcatcccgaccggcttaaataccccatgaaaagggtaggagagcggggcagcggcgaatgggcccgcatcagctgggaagaagcttttgacaccaccgccaaggagctgcgcaggattattgatcaatatggcaatgaatcggtctattttaactatgcctgcggagcttacggcttactgaatcaaaccaactccaataactctctgcgccggcttcttaatatcatggggggctatctgcaaagctatggcaactacagccaggccaactatatgtatgcagttccctatatgttcggtaatccttatagcggcagttcccccaccactttccctgatgccaaactgattgttatgttcggggataatcctgcctgtacccgggtaggcggctttaactccacttattacctgaaattagccaaacaaaacggagcacgcattatcgttattgacccccgtcatagtgacacagtgagcacctttgccgatcagtggattcccatccggcccactacggacagtgccctggttgccggtatggcttatgttatgatcagcgaaggcctgcatgatcaagccttcctggacaaatattgccttggctttgacgaagaacacatgccggaagggattcccgccggtaactcctacaagagctacatccttggtgaaagtgatggcaagccgaagacacccgaatgggcttcagagatcaccgggattcccgtggaaaccatcaaacagcttgcccgggacattgccgggaccaagcccggttttatcctgcaaggacggggaattcagcgccatggcaacggagaatttcagtctttggcggttcctgtactgtcattcatgaccggcaatgtgggaattttgggcagcaatcctggcttgtatgaaggcggcccttccgtaaaaacgggcaactatcccattggaacgaatccgatcaagacaaagatctccatcttcatgtggaccgacgccattgaaagaattttgactaaagagcaggaccgcattgaaggtgcggacaaaacaaaatcgaccatcaaaatgatcatcaattacggcggcaataccctgatcaatcagcattccgattctggacggaccgctgcgctgcttaaagatgacagcaaatgcgagtttatcctgggtatggataattttatgactcccagtatgcggtattgcgatattgtcctgccgggtgttacccagtttgaagtcaatgacatgatcacccgttccatgggccatggggtggcttattacgggcaaaaactggtcgaacccatgtttgagtgcaagaccatcaatgaagtgggccgcgctttggcggaaagactgggtgtattggctcagttcgacgacggcaagtcggaagaagattatctgcgggaatttgtcggggtatcccaagccagccatcctgacttcccctcctatgaagaattcagggaaaaaggaatttataagaccaaagcaacgaaagtagtagcctacgaaaagttcattaaagatccggaggccaatcctctgaccactccttccgggaaatttgagattttctccaaggatctctatgacatccaaaacccgcagattccggccattcctaaatatatgcctgcggaagaaggtccggaagatcccctgaaggaaaagtatcccctgcaatgcattggtcaccataccaaacgccgcgtacactccactttcgataatatgccctggctggaagaagcggaagctcaaatgctgtggctgaatccccaggacgctgcggctcgggggatcaaagaccatgatctgattaaagtttacaatgaccggggtactgtgaaggttaaagtaaaagtgactccccgtctgattcccggagtttgctcacttcctcagggagcatggtacactcctgaccaaagcggtgttgatgtaagaggatgtatcaatactctgacgaaatggacgcctaatcccctttccaaaggcaatccccagcatacgaacttagttcaaattgaaaaa

SEQ ID NO: 33386 - DNA, 555 bp, Desulfitobacterium hafniense
atggcaaaacagtatggattttatatggatcaatccaattgtataggatgctttacctgtcagattgcttgtaaagataaaaatgatttggaagtgggacaatgctggcgcgaagtccacgaattccaagggggcgataccatcctggaaggcggggtgtatcgcagcaatgtcttcgcctactggctgtctatgagctgcaaccactgccaggaacctaaatgtgtgcaaaactgcccggctggagccatgtataaacgggaagaagacggaatcgttctggtggaccaaaataaatgcctgggctgtggctactgcacctggtcctgcccctacggcgctcctaaattggcagggaaaaccgtttccaaatgcaatttctgtatcgatctattggaacaaggcaagaatcccgcctgtgtcgatgcctgcatcatgcgggtcattgagtttgggccaatcgatgaattgcgcgccaaatatggcaatgtggacgaagtcaaagggttgccttcagcccaaattaccaaaccatgtatcgtcatcagccctcat

SEQ ID NO: 33387 - DNA, 1824 bp, Desulfitobacterium hafniense
attattctcattgcgattatgctcataagatttgccaacccaccggcgactcagcccttggatatggattacaccaaattttatgaggcggtggttacgggtcaggttgaagaagttgtaatcagtaccgatgataatgtcaatacctatgaagttaaaaccaaagacggtcagcaatatgtagtgctcggtgaagcaaaggatgttgatctgtctgcgcaaatgaacgagcataaagttaacgtgcgggtcaatccgccggtcaccactccttggtgggccggtttgatcaccacggtactgcctttcctgttaatcggcggctttatcttctttatgatgcagcagagccaagggggcggcaaccgggtcatgcagttcgggaaaagccgggctaaactggtgacggatgaaaagaaaaaggtgacctttgccgatgtggcgggagccgacgaggtgaaggaagagcttgaagaagttgtggaattcctcaagttccctaagaaatttaatgagttgggagctaaaattcccaaaggagtgctgctctttggccctcccggaaccggtaagactcttttggcccgggctgtggcaggagaagcgggggttcccttcttcagtatcagcggctcggactttgtagagatgttcgtcggggtgggagcatcccgggtgcgtgatttatttgaacaagccaaaaagaatgccccttgcatcgtgtttatcgacgagatcgacgcggtaggccggcaaagaggcgccggtctggggggcggtcatgatgagcgggagcaaaccctgaaccagctgctcgttgagatggatggttttaatgggaatgaaggcatcatcattatcgcggccaccaaccgccctgatattctcgaccccgccttgttgcggccggggcgtttcgaccgccaagtagtggtggatgttcccgatgtcaaaggccgcgaggaaatcttaaaagtccatgttaaaggcaaacccatgcacaacgatgtggagctggatgtcttagcccgccgcacgccgggatttaccggagcggatctggccaaccttgtcaatgaagcggccctgctgtctgctcgccgcaatgaaaaagagattaaaatgaatgctctggaggattctgtggaacgggttatcgccggaccggagaaaaaggcccgggtcatcagtgactatgaaaagaaattggtttcttatcacgaagcaggtcatgctttagtgggagaaatgctgacccatacggatcccttgcacaaggtgtccattattccccggggacgggccggcgggtataccctgctcctgcctaaggaagatcgcaactatatgacaaagtctcatttgttggatcaggtcaccatgctcttaggggggcgggtggcagaagccctggttctccatgagatcagcaccggagcctccaatgacttggagcgggctaccggtcttgtccgcaagatgattactgaactgggaatgtccgaggagctgggaccccttacctttggacagaaggaaggtcaggtgttcctgggccgggatattgcccgggatcgcaattatagtgaagcggtggcttactccatcgataaagaagcgcgccggatgatcgatgaatgctatttgaaggcgcagaccattattcaggagaacatgcataagcttaacgcgattgcccagactttgatggagaaagaaaccatcgaagccaaggaatttgccgagctgatggcccgctttgatcaaccagtggaaaccgcacaagtctcggagccgtcggagactgaaaataatacaacggaa

SEQ ID NO: 33388 - DNA, 447 bp, Desulfitobacterium hafniense
atggaaaagaccttcatcatgctcaagcctgatgctgtacagcgggggttggttgggcaaattatcgcacgctttgaagcaaaagggtgcaaactggtaggaatgaagcttatgagtgttgatcaggctttggccgagcaacattatgccgagcacaaagggaaaagcttttttgagcccacggttcaatatattatgtcttctccggtggtggctatggtttgggaaggcaaaaatgtcgtggctctggctcgggaactgatgggagccaccaaccctgccaatgccaatcccggctcgatccgcggcagctttggcatggatatcagccgcaatgtgattcatggctcagattctgtagccagtgcagaacgggagattgccctctattttagacccgaagagctttgtgattatcgcaaagctggagaagagtggcttagcgag

SEQ ID NO: 33389 - DNA, 594 bp, Desulfitobacterium hafniense
tcaccaataagaacctaaggagttgagaaaatgggaaaacggtatgccatggtgattgacctgcgcaaatgtgtaggctgtcacgcttgccaagtggcttgtaaaagtgaaaacaatgtgcctcttggtgttttccgcaactgggttgatgagcttgagaccggaaagttccccaatgtttcccgccagcggttgccgcgtctttgcaaccactgtgagaatccatcatgtgtcaaagtatgtccggttaaagccacaactcaaaaagaagacggtacggtggtcattgactatgatctctgtatagggtgcaaatactgtattgccgcctgtccttacgatgctcggtttattaaccccgaaagaagaactgcggaaaagtgtgactactgttatgccagggtcgaagcgggattacaaccagcctgtgtgaatacttgtatcggtggggctcgcatcttcggagatttaaatgatcccacaagcgaagttgctaaatttgtggcaaccaatccagtcaaagtatctaagccggaaacgaacaacggaccgcagacctactacattggcgcagatgaaaaaacccttcgccct

SEQ ID NO: 33390 - DNA, 504 bp, Desulfitobacterium hafniense
atggatatgattcccagtttctttaccttagggaatttattttttggatttctgtccttgctctggacgatgaatggcggatataaaatggctgccgggtttattcttttatctgtgcttatggatagtatggatggcaaggtagcccgtaaactctccgtgagttcagatttcggcaaagagctggattctttatgcgatgtggtctcctttggcgtggcgccggcgattttaacctatcagctcgtgctggccacccatatgggagtttggggcatgcttcttgctgccgcttttgctttatgcggagcagtccgcttggcacggtttaatgttctcaatatcagcacccattttttgggcgtgccgattacctttgccggcgggctgatggccttaatggtccttttttacagaaatctgccttggttggtttttcctgtggctctggcagtgttggccgttctcatggtctccacgttcaaagttcctaagttggggaaa

SEQ ID NO: 33391 - DNA, 825 bp, Desulfitobacterium hafniense
cagcaccaggataagcagcccggactggaaaccttaatgaatcccagccccatcttcgaggacctgaactatcggcccagcggcaagttacagggcaaagtcgccttgatcagcggcggagacagtggcatcgggaaagcggtagccattctctatgccaaggaaggtgccgatattgccatcgtttatcttgatgaacaggttgatgcccaggcaaccaaggagagaattgagcagctggggagacgctgcctgctgatcccaggggatattggcgaggaaaatttcagcaatcaagctgtgcaaaaaaccttggataccttgggaggattggatatcctcgtgaacaatgcagcggaacagcacccccagaattctcttctcgatattactgctcaacaaattgagcaaacctttcgcaccaatattttcggcatgctgtatctgaccaaggcagcacttcctcatctcagatacggctccgtgattatcaatacagcttcgattacagcttataaaggggatgccaaacttatcgactattccgcatccaaaggagcagtcgtggctttcacacgttctctttccgaatcactgatcaaacagggcatccgtgtcaacggcgtagcacccggccccatctggacgccgctgattccggcatctttcgacgccaatgaggtttccacctttggcagcactactcccatgcagcgggccggacagccggtggaattggctccggcctatttgttccttgcttgcgagggttctgcctatatgtcggggcagatgctccatgttaatggagggacgatagtcaac

SEQ ID NO: 33392 - DNA, 1143 bp, Desulfitobacterium hafniense
atgaatacttacggccgtctgcctatggccattgtcaagggaaagggcaccactgtctgggatatcgagggcaagcagtatttggattttgtcacaggcttggcggtcagctccctggggcatagccatccggcggtggtggaggccatccaaaagcaggctgaggagattttgcatacttccaacctctattggattcctaaccaaatcgccctggcggaaaaattagtggagcattcctttgccgatcaggtttttttctgcaacagcggcgcggaagccaatgaagcagctataaaaatagctcggaaatacgctaaagagcattacagcgaggataaatatgaaatcctgactctggtcaattccttccatggtcggactttagccaccttgaccgctaccgggcagaccaaataccaaaaagggtatgcgcctttgccggaaggattcacttatgtgcccatcaatgacctggcgcagctggaagagaaaatgaatcctaaagtggctgctgtcatgctggagcctattcagggggaaggcggggtattccccttggaagtggaattcttagccaaagcccgcaagctttgcgatgattacggggcacttcttatctttgacgaaatccaggtgggattagggcgaaccggcaagctttttgcctatgaatggagcaatgtagtcccggacattatgaccttagccaaagctttagggggtggagtgcccatcggagttatgctggctaaggaaaaagttgcctccacctttaagcccggggatcatgcctcaaccttcggaggaaaccctctggctacagctgtaggctgtgcggtaatggatgtgctcaccgaagaaggattcctggaagatgttcaaaaacgggctcagtattttaagcaggagctgcaaaagctggcggacaaataccaaaccggcacagaaatccggggacagggttttatcctgggctggcctcttgaccgtctgggagcggagattgtggaaggagccagagaaaaaggcctgctgattaactttgtgggaggaaaagccttaagatttttaccccctctcaatgtttcctatcaggaaatagatgaggccatcaccatactcgatcaaatttttgctgag

SEQ ID NO: 33393 - DNA, 864 bp, Desulfitobacterium hafniense
ttggataaagccagagtgctcattgaggcactgccctatattcagaaattcgccggcaaaacagtggtgatcaaatatggcggtcatgctatgttggagcaggacctcaaggaaaaagtcatgctggatattcttctcctgcactccgtcgggattcgcccggtggtggttcatgggggaggtcctgagatcaattcaatgttgaccagggtcggaaaagaaagccattttgtgcgggggctgagggtcactgataaagagactatggaaatcgcctccatggtcctggtgggaaagctcaacacagaaatcatttccttgctcaaccgtttcggcggcagagccgtagggctgtcgggaaaagatgcccagctgctccaggcggttaagaagcccatgcagtttcagaattcccaaggggaactggaggatgtggatttgggctttgtaggtgagatcgagcagatccgtccggaaatagttacctctcttgtggagcaaggctatattccagttatctcaccggtggccggcggtgaggatggagaatcctataatatcaacgccgatacagccgcaggggaaattgccaaagccttgaaagccgataaattcctgctgcttaccgatgtgcctggagttctcagagatgtagaggataaagattccctgctttccgtgatcaaggaagatgagatctcagggctgatcgatttgggtgtgattagcggcggcatgattcccaaagtagaatgtgcccgggcagctctgcaaggaggcgtgggaagtgttcatatccttgatgggcgaatccctcacgccattctcttggaactctttacagacggcggaatcggcaccatg

SEQ ID NO: 33394 - DNA, 1187 bp, Desulfitobacterium hafniense
cctcggggattccgggcgacgggagtcaaggcggagattaaatatccggataaatacgatgtggctttggtttattccgaggtgccggctcaagctgcgggagtgtttacccgcaataaggtgaaagcccatccactaattctgaccaaaaaacatttggagaatggtatagctcgggctatggtggctaacagcggcaacgccaatgcctgtgtgggaaaaccgggggatgaggccgcttgggctatggctgtgaagaccgccgaggtgctgggaattgcccctgaagacgtgcttgtggcctccaccggggttatcggtgtggaattgcctgtagagagtgttaccagggggatcgagaaggcttctttggagatcgctgagaaaatttccccagaggaaatgacgcagaattcccatcaggcagcgttggctatcatgaccaccgacaccgcggtcaaagaggcagcctgtgaattgtccacagagaatggtgtaatccgtctgggggcaatggctaaaggctccgggatgattcatcccaatatgggcaccatgctgggctttatcaccacggatgctgccataccggcctctgagctgcaagagctcttaagagaagcggtggaagacagctttaatatggtgaccgtggatggagataccagcaccaacgacatggtattggttctggccaacggaaagtcggggattaccttaaatcccgaagagtgggcggagtttcgccggatgttttgggctgtgtgccagaagttggctcaggacattgcccgggatggagaaggggcgaccaaattcctggaagttcaggtccttggggcggccgcagtggaggacgcccgtaagattgccaaaagcatttgcggctccagtcttgtgaagatagccctttacggagaggacgccaactggggaagaatccttgccgccgccggctactccggagcagaattcaatcctaaccaagtagagatctacctgggccatgttttggtggctaaggaaggtcaggggttcatttctctgaagaggaagccaagaaggtcctcagcaggaaggatgtgctcatcaagctccttcttcaggaagggcaagcccaagccacagcctggggatgtgacctgacccatgattatgtcaccattaatggagattatcggacttga

SEQ ID NO: 33395 - DNA, 1053 bp, Desulfitobacterium hafniense
gtgaaagtaggaattatcggagccacagggtatacaggccaagagctggtgcgtttactccaaaatcaccctgaaatagaattagcctacttaggctcatccagtaatagcggagcagtctatggggagatgttcccacagttttcagggctaagtgccagcctggatgcagagtcagggttaggaacagggaaactggatgatgaacaggtgccggatttggacgttttattctgcgcccttcctcatggtcttaccgcaggccgaactgcccaatggctgagccgggggatcaaagtcatcgatttgggagcagattttcgtcttaaagatggagcagtttatgaagcctggtacaaagttcagcaccccgctcaagagctgctgcctgaagccgtctatgggcttccggaattatatcgggataagattgccggaaaaactctcgtagccaaccccggctgctatcccacagccaccctattggctttggccccactgctgcggaaggggctgctgcaaaaagatggactgatcatcgatgccaaatccggagtttccggagccgggcggggcgttgctttaggaaaccatttcagtgaagtcaatgagaattttaaagcctatggggtagccagtcaccgccataccccggaaatagagcagcaattatcggaggctgccggagcagagctcctggttaattttacccctcatcttgtgccgatgattcggggaatccttgccaccatctacgctcaggttacgcccggcgttacagaggctgaccttaaagcctgctggcaggagcagtatgaggaagaggagttcgtccatatccttccggagggaatctggccccagacaaagttcgctttaggaagcaatcatagttttctccagcttaaaatagatccgcgaaccgggcgggctatcctggtctcggcgctggataatttggtcaaaggcgcttcagggcaggctattcagaatatgaatctgatctgtggactgccggagaatatggggcttaaaatgagagggctttggcca

SEQ ID NO: 33396 - DNA, 1203 bp, Desulfitobacterium hafniense
atgactaaaattcaaatgaatgtccccctggtggaaatggacggagatgaaatgacccggattatctgggactatatcaaggaaatcctgctttatccctatattgaattgaagaccgagtattatgatctgggtctgcagaaacgggatgaaaccgatgaccagatcaccgttgatgcagccttggccaccaaaaaatatggggtagcggttaaatgtgcgacgattacacccaatgcccagcgtgttgaggaatacaatctgaagcaaatgtggaaaagccccaatggaacgattcgggccttgctcgacggaacggtctttcgcgctcccgtcttggtagaagggatcaagcctttggtcaccacctggaagaaaccgattaccatcgctcgtcatgcctatggcgatatctataaaaatgtggagtatcgggtgggtggtcccggcaaggcggagctggttttctcaggtgaacatggggaggaatcccgtcaaaccatctgtaactttgaaggcaagggaattctcatgggcatgcataaccttgatagctccatcgagagctttgcccgagcgtgctttaattatgccctcgatgtaaaacaagacgtgtggtttgctaccaaggacacggtctccaagcaatatgatcatacctttaaagatattttccaggaagtttatgacaaggaatataaggaacgctttgcagcggctcagcttgaatacttctatactcttattgacgatgctgtggctcgggttattcgctctgaaggaggctatatctgggcttgtaagaactatgacggggatgtcatgtcggacatggtagcgactgctttcggaagcttggcgatgatgacttcggtattggtttcgcccgaagggaatttcgaatatgaggcggcccatggtacggtaacccgtcactattatcaacatcttaagggtgaagagacatccaccaaccccattgcgacgatttttgcctggacaggcgcccttaagaaacggggagagctggatggtttgccggatttagccgactttgccgctcagttggaggaagcctcattaaagaccatcgaagccggaattatgaccaaggatctggctttgatctcggaactgcccaatatcaaaaccgtcaacaccaaggatttcctcgaagaaattaagaaaactctcgatacgctc

SEQ ID NO: 33397 - DNA, 783 bp, Desulfitobacterium hafniense
gaaagcatgaactattctctttccgcagggggtaaacgcatccgccctgttctggctctggccgcggcccatgctgtgggaggggactgtgaagacatccttccggcggtctgtgctttggagctgatacatacctattcattgatccatgatgatcttcccgccatggacaatgatgattatcgacggggacgtttggccaatcataaagtttttggcgaagggcaggccattcttgccggtgacgcccttttaacctatgcttttgaactgcttgctcagcccatgagtggggtagattctcaacgtcagttgcgggctgtcagggaagttgcccaagcagcggggccggagggaatggtcggcggtcagatgctggatttggaagctgaagaaaagcagttaaaccttgctgagctggagcaggtccatcgtctgaaaaccggagcgatattggtggttgccgcccgtttaggagcaattctcgccggaggaacggaagagaagatcgaagcgttgaccagctatgctcaagccatcggtctggctttccagattaaggacgatattcttgatctggaaagcgatagcgagaccttaggcaagcctgtacatagcgatctccgccagcataaatccacttatccctctttaatgggtttggcaggcgctaagctggaattgaagataaagaccgatgaagctcatgccgccttggcggttttaggagagcgggcgggtttcctgcatgaattggctgattatatagctcaacggaagtat

SEQ ID NO: 33398 - DNA, 1803 bp, Desulfitobacterium hafniense
ctcgcaaaaattgagcagccccgggatttaaaaggactgacttatcctgaactggaacagcttgctcaagaaatccgcgctgaaatgatcgatgtggtctccgccaatggagggcatctggctcctaatcttggcgtcgtagaattaactcttgccttgcaccgggtctttgacagcccgaaagataaaatcatctgggatgtaggccatcaagctatgtcataaacgtcacaggcgcaaagaattaaagcttaagcttataaaggtctgtccggcttcccgaaacgctgtgaaagccctcatgattgctttgaaacaggtcactccagcacgtctatttccgcggcggtaggctttgccaaagcaagagatcttcgtaaagagaagaatcaagtggttgccgtcatcggtgatggagccatgaccgggggaatggcttttgaagcattgaatcatgccggtcataccaaaaccaatatgattgtggtccttaatgataatgaaatggcgattgcccagaatgtgggagccatgtcttcttaccttaaccggctgcgtacggacccccgctatgatcgcagcaaagacgaaattgaaaatctgctgaaaaggattccgggaatcggttccaagatggccaaggcagcggagaaagccaaagacagcttaaagtatctgctggtgccgggactcttatttgaagaaatgggttttacctatcttggcccggttaacggtcatgatcaaatcgctttggaacaggtttttgaacaggccaagatggtcaaggagcctgtacttgttcatgttttgactcaaaaagggagaggctatgagccttcggagaaaaaccccgctctctttcatggggtgggacctttcaataaggtgaccggggaagtgatcaaaaaaccggctccccccacctatacccaagtctttggtgaggctctgtgtgaacttgcggaaaaggatccgcggattacagcgattacagcggccatgcccagcggcaccggtcttaatctcttcgctcagaaatttcctgatcgtttctttgatgtaggaattgcggagcagcatgcggtgaccttttccgcggccttggcttttggtggcatgaagcctgtggtgtccatttattctaccttttatcaacgtgcttacgaccaggttctccatgatgtctgtctgccccatgccaatgtggtcatggccattgaccgggccggagtggtcggggatgacggaccaacccaccatggagtttttgatatttcttttttaagagtgataccgaatttggtgtttatggcgccgaaggatgagaatgagctgcgccatatgctgtatacttctttgcagctggacggaccggtggccttgcgttatccccgttctgtgggccaaggggtggagctgactgaggagctgagggagcttcccgtgggtaaagccgagatccttcaagaaggtaaggatattactctgatcggggtgggcccgatggtgtatacctgcctggctgcggcggttgagcttcgccaccggggagtggaagccaccgtcattaatttgcgttatattaatcctttggatagagagtcaattctgcgctatgcccggatgaccaagcgtatcatcactgtggaggaccatatgctggccggcggtatgggcagtgccgtcatggaagttttgggcgatgaggggttaaccgatgtggtcgtggagcgtttaggctatgacgagtatgtggatcagggagccatctctctgttgcatcaagggtatggattgtct

SEQ ID NO: 33399 - DNA, 1098 bp, Desulfitobacterium hafniense
atgaaactatttgaataccaggctaaagaactgtttgcagaaagcggtatccctattccccaaaatgccttaatcggtgatataagtgaactgaacagtgccttggaaaagatcgggttaccctgtgtcttgaaggcccaagtcctgcagggcgggcgaggcaaagcaggattagtcaaatttgtgcgtacaaaagaagaagcccaaaaggaagctgagcggattctggaagccaccggcaagaagctgttggtcgaagaggctgtgccttatgaaagagaaatgtatgtctccattaccgtagatgccgcttcaggcttagccatggttatggcgtgcctggaggggggcgtggatattgaacaaatcgcccgtactacgccggaaaagattatcaaggaaaaagtggatatgtctctgggcctgatggcttatcaagcggataatatcatgtacggtctaggattagaacagagtgcagctaaagaaggaagcaagattctgctcaagctttatcagctttttgtaaaatataacgctgaattagtggagatcaatccccttatgatccttagggatggaacaatggcagctgctgatggcaaatttaatttggatgataatgctctatataagcaaaatcgtttctccctgactcgtgatcattataaaagcgatttcgagtatgaggcggcactggatggaattccctatattgccttcgaaggggatatcggaatgatggtcgcaggagcagggctggctaatgtcgtccttgatttaatccattattatgggggtaccgtggccaactacttggaatttggcggaccaaactaccacaaagctcagcaatgtatgaaaatgatgctgaaagcaaagcccaaatgcatccttatcgcgactttcggtacaattgcccgtgctgatgttatggctcagggaattgttgaggcagtcaaggagttgaagccggaaattccgattgtagcagtaattcgcggtacaggggaagaggatgctcaaaagttgctgcgcagtgcagggttgccctccttaagcgatacagaagaagcggtcaggaaagcagtcgagata

SEQ ID NO: 33400 - DNA, 909 bp, Desulfitobacterium hafniense
ttgagcataatcattgatcatactacccctgttttgattcaaggcataaccggaaaggaaggaagtttctgggcgaagcacgccaagaattatggcacccacattgtagccggagtcacaccgggtaaggaaggtcaggatgttgacggtattccagtttatcataccgtccgtcgggctgtgcaagagcatcccatagaagcatctttattggttgtaccccctaaagctgccaaaggagctgttttagaggctcttgacagtggaataaaagtaattgtggttacggctgaaggaattcctcttcatgagatgatgcagctgagaaaaattgctttagagaagcaagccatggttattggcggcaataccacaggaatcatttctacaggaaaggctatgatgggttttttcccttattggttggatagagtatataaacctggacgagtaggggtcatgacccgcagtggttccttaaccaatgaggtgacggcggagattgtcaaagcgggctttgggccgagctcaatcgtaggcgttggcggagatcccgtgcccttaacccgctttgccgagatcttgccgttgttcgaaaaagatccggatacggatgctgtggtcatgatcggtgagatcggaggaactatggaagaagatgtggctgaagcaattgaacaaaggattttcactaaacccttgattggctttatgggaggccggacagcgcctaaaggtcaaaaaatgggtcacgcgggagccatcattacagcaggaaaaggcacagtagaagataaggttgaagctttagccaaggcaggcgctctggtggcagatcggccgagtatgattggacagttgctgcagaaggttttgtaattagaaagaagagcggagcgaaaagagact

SEQ ID NO: 33401 - DNA, 1038 bp, Desulfitobacterium hafniense
ggcgcaaacagtttgaataagctgcctgaggtaataagccgcaagggcatcagcaaaatcctgattgtcacggatcagggaatttcctccttaggactggtgaatagctttcttcaagatcttgataaggcaggagtcaggtatactgtttatgataaaaccgtgccaaatcctacccttgataatattgaagaagccctgaaattgtaccaggaacagcagtgcgaaggcattgtggcctttggcggcggttctcctatggactgtgctaagggggtgggtgccagagtagccaatccccataagagcatctcgcaaatgaagggcgttcttaaagtgaggagaaagcttccacctttgtttgccattcctaccacagccgggacaggaagtgaagccacccttgccgccgttatatcagatccccgaaaccgtgaaaaatacccggttaacgatacggctcttatccctcactatgccgtcctcgatccgttgctgactgtgggtctgccgaaacacatcacttccacaacaggcctggatgcccttacccatgcggtggaagcctatatcggcagaagcaatacccaggagaccacggaattaagcaggaaagcagtgcgcttgatttttgataatctctatatagcctattcccagggagagaacgtaaaagcccgggagaatatgctcaaggcctcctattatgccggagtggcctttacccgcgcttatgtgggatatattcatgctctggcccatgctttgggagggttttacggagtaccccatggattggctaatgccgtaattcttccttgtgttctggaatactatggagaagcggtccatgaacggctggctgaattagccgatgttctggaaatgggttcacctggggatagccatgagcaaaaagcaaccctattcattgaggccatcaaggaactgagtaagaaaatgaacattccccgaaaaattgacggtattctcgccgaagatattcctttgctggtagagcatgcctggaaggaagcc

SEQ ID NO: 33402 - DNA, 1329 bp, Desulfitobacterium hafniense
atgccggatataaaagaaattttagtcaaacaaaaggcttttttccagaccgggaaaaccaaggagcttcagtttcgggtggatatgctgaataaactgcggtcagccataaaaatccatgaggaggagattatggcggctttgaaggctgacctgaataaagcgccttttgaagcctatgccacagaagtgggcatggtactggaggaactcaactatacgcttaaacatatctcaagctgggtcaaacctaaacgtgtgcggactcctctggtgcactttccttccgccagctatctttatacagaaccctacggctccgttctgattatgtcaccctggaattatccctttcagctggccttggctcctttggtgggggctataagtgcaggaaactgcgccgtcctcaagccttcggagtattcggccaacacttccgcaatgatcgagaggatagtcaaagaaatctttgacgagtcctttgtggctgtggttcgtggaggcagagaagccaacaaaaccctgctcaatgaaaagtttgactatatcttttttaccggcagcgtcggggtgggaaaaacggtgatggaatccgccgccagacacctgaccccggtaactctggaattgggcgggaaaagcccctgtattatcgatgacactgccgatcttgaattggcggccaaaagaatcgtctggggaaaatttctgaatgcgggacagacctgtgttgcgccagattatctgcttgtgcataggactgttaaagaaaaactcatccaggagatcaagaaatccattactgccttttatggccatgatcctttaggcaacgaagactatcctaaaatcatcaatcagaagcacttcgagcggcttctaggcttgctgaaaagcgggcgggttgtagaggggggccggtccgatgagaaaaccaggcggattgcgcccaccattctggatgatgtaacctgggaaagcccggtgatgcaggaagaaatctttggacccctgctgccggtgctggaatttgagagctttgacgctgcccttgctatggtcaatcagcatcccaagccgctggctttgtatctgttcaccagaagcaaggatcatgaggcccaggccatcagcaaaacgtccttcggcggcggatgcatcaatgatacgattatacatctggctaaccccaatctgcgctttggaggtgtgggggagagcggcatggggcagtatcacggcaaaggaagctatgacaccttttcccatacgaaaagcattatgaagaaatccaataagctggatatcccgcttcggtatccgccc

SEQ ID NO: 33403 - DNA, 1041 bp, Desulfitobacterium hafniense
aagattattattctcttcggaggtcaatccggagaacatgaggtttccctgaactctgccagttctgtacttaaggccatcgatcaagaaaaatatgagatagagacgattggcattgccaaaaacggccaatggcactggggaatacgtcctgaacaatggcagcaggaccccgcgctggagggtattcctgtcattcttgcccacgatcctacgaacccccgctttatcgctttagacggcagttcccttcctcaagatgggaagtttgctttgattttccccgttcttcacggacccttcggagaggatgggaccattcagggcttgtttgaaatggccaatattccttacgccggctccggagttctcggctccgctctgggtatggataaagaccgtatgaaagcagtttttaccgaagcgggcctgccccaagccccttatatcaccgtacttagaaccatgctccagaaaccgatggagcaactgctggataatatcgaacactctttgggttatccttgttttgtcaagcctgccaatttaggctccagtgtaggcatttccaaagcacggaacagggaggagctcatccaagccctccagcttgctgcggagtacgatcgcaaactggtcgtagagcaaaatatcgtgggacgcgaaattgagttgagtgtcctgggcaatgaggatgcccaagccagtatcccgggagagattcttcccgccaaggatttttatgattatgaagccaagtacatcgacaccggctctcagctggtgattcccgctcctttggctcccgaggtcgtcaggagtttgcaggaaaaggctgttgccgccttcaaagccgtcgaagcctgcggcttaagccgggtggatttcttcgtcacggagggcggtcagatctacatcaacgaaatcaataccatgccggggttcactcagatctccatgtaccctaagctttgggaagctagcggcatcccttacaccgaattgatcacccgcttgatcgaactgggcttccaacgcttt

SEQ ID NO: 33404 - DNA, 513 bp, Desulfitobacterium hafniense
agtatgtttaaaactattattgaagtcatcgagattgtgattattgcctttgccttgtcctgggtcattcgcacctttgtgctggaggccagattagtccccaccggctctatgctgccgacgattcagctccaggaccggattattgtcgataagttcttttttaagcattttggtgattttgaacgaggggatattattgtttttcatccgccttccagcgcccactcttccgacgattttatcaaacgtttgattgctttgccgggagataccattgagatcaaggatcataagacctatatcaatggccaggaagtggaagagccttacgttatggagcctcaaattaaaaatcttgagcctttggtcgttccggaaggttccgtttttgttatgggagataatcgcaacagcagtgccgattcccgggaatggggttttctgccgattgaaaacatctccgggatgacgttatttcgttattggccgcttaaccatattggaacaatc

SEQ ID NO: 33405 - DNA, 1025 bp, Desulfitobacterium hafniense
taccctgttttcctgggggccaggctggaggagctgggtgactatctgaccacccgcatcggagctggggaacatcttctggtgattactcaccctaatgtcggcgattactatctggatactttgcaaaaagggctaagctcctttatggtcaataccctgattgtacctcagggtgaggatgagaaatccctggaccgcctcagtgatttaaccagtgaagccattgcctgcggcgcggatcgcaagaccgtggtcttggctttggggggaggggttattggagatttggccggcttcttcgccagtgtctttatgcggggaatgcgttatgtccaaattcccaccacccttctggcgatggtggatagcagcatcggcggtaaagttgcggtaaatcatgctgcaggcaagaacctgctgggagatttttacccgcctctggctgtatggacagattttagtacattagagaccctgccctgggaagaaatgcttaatggtctggcagagactatcaagcatgctgtcattgccgatgaagagcttctctcttttatcgaaaaacaccaggaagaaatcatggcgcggaagcctgagctatacaaggagttgacttcccgctcctcggcggttaaagtcagactggtctctgaggacgagacggaacagggcaagaggatgtttcttaattacgggcatagctttggtcatgctcttgaggctgaggtggcctaccaagggattacccatggacaggtgtcagcatcggcatggtagcagctgcccatctggcccaagaacggggactgatgaacagtggagaagtggaacgcttgattaagcttctcaaagctttcggtttgccggtaactgtcagagctaagaatccccgagtgttaaccgatcttatgggggcagataaaaagaattacaaagggcagaaagttttggtcctgcctaaagggataggacaggggatcgtgattcgtgacgccaacgatgaggaaattctaagagcttgg

SEQ ID NO: 33406 - DNA, 498 bp, Desulfitobacterium hafniense
gctcataatgataatattgtgcttgtaggctttatgggtaccggcaaaagcactgtgggcaggcgtttggccaagctcctgggacgggagtttattgatacggatctggagatcgaaagactaacggaaatgactgtatcggaaatttttcgccgccatggcgagacccgttttcgttcggaggagcggctgttggtgaaacgtctggctgaacataaagggtatgttattgctacagggggaggaactgtgctgaatcctgagaattggcgggatttggcacaaagcggtgttattatcggcttatatgcgccccttgatgagatttacaaacgaattggctatcgcaatgaccgtcctcttttgagaggagatcgccaagtggttgaagagctgtgggccaagagacaacctatctataaccaggcgaattggactatcgatacgactcataagggaattgaacaagtggttgaagagatattcagcctatatgaa

SEQ ID NO: 33407 - DNA, 846 bp, Desulfitobacterium hafniense
cgggaagtccttctgcccgatggaaccaaactgcccaaactcggccaggggacctggtatatgggggagaaaagccggctatggcagcaagaggttaaagctctggccatgggaatcgagtacggaatgaccctgatcgatacggctgagatgtatggagagggagcggcggaggaattagtgggagaagcgatcaagccttatcctcgggaaaccctccatatcgtctcgaaagtctatcctcatcatgccgggcgcaagacgatcttcaaaagctgtgaggcttctttaaggcgtcttggcctggactatcttgatctgtatctgctccactggcggggaaatatcccccttgaagagactgtggagtgcatgaacgagttagtggctcaaggaaagatcaagcattggggcgtgtccaattttgatacggaggatatggaagagctttggcaaacacccggaggggatcggtgctcaacgaatcaagtgctctaccacttaaattcccgggggactgaatatgatttgcagccatggctcaaagcgcaccggctgccgatgatggcttactgccccatggctcataatctgagcacacggcaaagaatagcccaaaacccagtagttcaggagattgcccaaaactatggcctgactgtggagcagatactcctttgctttgtcttggggcaggagaatgttatggccatacccaaggcttctcaacccgaccatgtcaaggataatgcccaggtttacgatatctcgatccatgaggaagattggcaaagaattaatctcgcttttcctgccccccaacataaaacttatttggatatatta

SEQ ID NO: 33408 - DNA, 2361 bp, Desulfitobacterium hafniense
cttaaaataaccggtatgacctgtgccaattgtgccctgaccattgaaaagggaatggccaagctgccgggggtcaaagccgctacggtcaattttgcctcagagaaactttccttggattatgacccggcacttctcgatgagaaaactatccttgagaaggtcaaggatttgggttatggggcttatatggaaagggatgaaggaaaagcccagtttaaagtgagcggtatgacctgcgctaattgtgctcttaccattgaaaagaaattgcgcaatacaccgggaattcagactgtagccgttaattttgcgacagaaagcgtcacggcagaatatgatcccaacctgatcgatctggagaccatctatgaacaggtcagagatgcaggctatacccccattgagaataaagaggaatcccgtgaggataaccatgtgaaatcccagcgcaactgggtcatcttcagtgcagtgctgtcggcgcccctgatgcccatgatgtttatgcccatgacccatggcatcatgtatactatgtttattctggccaccatcgttcaatttacggctggcttgacattttatcggggagcttaccatgccctgaagaaccgctccaccaatatggatgtgctggtcgctatgggtatcacagctgcttatggctatagtgtgatgacaacctttccccatattttcttcgagggggataccttctttgacacatcggctcttctgatcacctttgtgcgtttcggcaagtacctggaagcaaaagccaagggacgtgccgggcaggccctaaaacgtctccttgagctgcaagcggatcgagcccgtctgttgattaatggagaagaaaaggaggtccccgcctccagtgtcaaaatcggggatatcgtcctggtgaagcccggtgaaaagattcctgtggatggagtgattgttgaagggcaagccagcatcgatgagtccatgattacgggagaatcgatacctgttgataaaggtgccggtgaaaatgtgatcggagcaaccatcaaccgttcgggaagcattaaagtctccaccaccaaaacaggcaaggacagtgtcctttccggaattattaaaatggtggaggacgcccaaggagttaagccgcccattcaacgtctggcagataagatatccaatgtctttgtgcccgtggtggtagctatctccatacttaccttcatcatctggtatgtatttttggacagtgcctttgtcttcgccttcaccgccgccattgccgtcctggtcatagcctgcccctgtgctttagggttggcgacgcccacagccattatggtggggagcggtgtcggtttaaaccgggggatcctcttcaaatcagctgccgtgcttgaaggaatagccaaagtggaggctattggctttgacaaaacaggcaccttaaccaaagggaaaccggaagtaacccatcttatggcctatgaaggatatgcccaaaaggacctgctcaggattgctgcggcaggggagaacccttccattcatcccttggctcaagctattgtccaaagagctaaagatgaagggatcgaggtggaggaagttcaggactatcatgaagaaagtggtcacggcaccctttgctcttaccaaggcaagaaattgctcatcggcaataaaaagctgatgctcaaagagaatattcccactgaagcagtagagaaggattttcaggaattggccaatgaaggaaaaaccaccagctttgtggcctatgacgggaaagtcattggcatcatcgccttggccgatgtcttaaaggagagtacgcaagaagcgattaaacgcctgcacggcctggggattaaaaccttcatgattaccggggataataagaaagtcgccaccgtcatcggcaatgaagtaggcatcgacgaagtggtggcggaggtcctccctcaggacaaaattgagatcatcaagaggtaccaaaatgatggcctgaaagtggccatggttggggatgggatcaatgatgcccccgctttagctcaggccgatatcggcatcgccatcggctcaggaacggatgtggccaaagaaaccggggatgtggtcctggtgcgcaatgatcttctcgatgtggaacgggccattcgccttggccgcaaaaccttaaccaagattaagcagaatttattctgggctctcatttacaatacactgggaatccccattgccgccggagtgctttttccgattaccggagagctcttgcccccggaatgggcgggcctggccatggccttttcctcagtgtccgtagtgaccagctcgctgctgctctccaggtatagt

SEQ ID NO: 33409 - DNA, 3545 bp, Desulfitobacterium hafniense
gttttcttgaaatccattacaatccaagggtttaagtcctttgcggacaaagtgaagctggaattagggcagggcttgagtgtggtagtggggcccaatgggagcggcaaaagcaatgtggccgatgccatccgctgggttctgggggaacagagcgccaaaaacctcaggggcagcaagatggaggatgtcattttctccggcagcagtgtgcggcgcccggtggggatggccgaggtttccttattttttgataactccacggggatttttcccctggagtatcaggaagtgatcatcacccgcagagtctatcgggacggagagggacaatattttatcaaccgctcctcctgccgccttaaggatatccatgaactttttatggataccggtgcgggcaaagaagggttttccattattggtcaaggccgggtcgaggagattctcaatctgcgctccgaagaacggcgcaccttgatcgaagaagcttcaggaataaccaaataccgcatgcgcaaacgggaagcacttaagcgtttggatgaaacggaacataatttagagcggatcaggatatcctggccgagatcgaagggcaattaggacctttggaagagcaagccaccatagccagggaagctgtggagctgaccacagaacaaaaagccctggagatcgagatggtggcctttgatttaaaagaggtgcgccataagctgacttcctccgttcaggaaacggaagaacttcagtcggccatcgccgcggcagtagcggatctaagccagaaggaaagcggcatcctcagcaacaaagtgaagctcaatcttctggatgagcagatccagaagcagcaggaaaccacctaccaattggatcaagcagtcaaccaaatcgttcaggagttgcggctccgccaggagcgggaaggctacctcggcgagcagattaatcgtgtcaccacggagctctccaatcatgaggagaaggttcgccagagtacagaacagctcagagccttagaggacagaaaagccctcttacataagactctggaccaggctaatcaggctttggcggcggatgaacaacgcttggtcgaggctaaagccaggaatggcttagaggaaattgaaatcctcaggggcagtctctcccatctgcagagcaagctggccgagtccagcgcagaattaaaccgccttacccatcagttggctaccctgaattcaacccatgagcaattgattaaagaaaaaaaggataaagaaggagccctgctctctcatgagcagcaggaggcccaggttcaggagcagcttaaaacccaggaagggctgcagacggatatccggctccaggcagagaaggcccagcaggaaaatgctcagttccgtgagcagagcaaagcagggcagagggagctccaggaactgaatcgggacctggagaaaaaatcagcccgctatcatgccctgaagaacctggaagactccctggaaggctatcaacggggtgtccgggagctgatgctggccaagaaaaaaaaccagccttcctgcggagatctctgcggcaccctggcggatcttcttcaggttgaagagcgttatgaggtggccatcgaggtcgccctgggggcaggtattcagaatatcgttaccgcaacggaacggggtgccaaggaagccgttcattatctgaaaagccacaatctgggtcgggccacttttttacccctggatgtgattcaagggggcaaagccgctgtggccaaagaggcggccaaggaccccggcttcatcggcgtggcggtggatcttatcaccttcgccgaaaaataccgcaaggcctttgaatcccaactgggcagaaccctcatcgtcacggatatggaggcggccacccgggtggccagagcctcgggctatcgcgcccgcatcgtgaccctggagggggatcaggttcacccggggggctccctgaccgggggcagcctgcaaagaaaaggctccaacatcttgggacgttcccgggaaatccaggaactccggcaggagtgcgacgaaagacgcacccagcaaaaggaactggagctcaaagcaggggctctcagcatccaaatccaaaaaggtgaggaaaaccttaagcatctgatggctgaagagcaggagcttaaatccgctctggccgtgttaagaactcaggagcttaatctccgggcccaggcccaaaggattcgtgatgaaataaccgccgtaaccatccgtgtggccgggatagagcaggaacgggatgagctgcaaagccataaggccctggaggcagaagagcaaagcaagcttacagacagcatccaagaggctcaggaagccttggcccggcaggaagaaaagaatcgccaggccagccgggagatggaacagcttcaagaaagactgacccaaaccaaggtgcaggcggctaagtgggagcaggagctcaagcaggctgtggagcgcctggtccaggatcaggccctgctgggggagaacaagcatctcctggagcgcaagcgcaaggatttgcaggatttagaagagagcaaagcccgtctggccttcgaacagggagactgggagagccgccgcagggaagcaggagagcagcagcagcaagcccaggaagtcctcatcgctttgcgcaaagagcgggaggttctgtccaaggagctgatggatcaggaaggcctcgcccaaaagaaaaggcaggagcagcagaccctggaacaaaagctgcacaacctggagctgaagacggcccgctgggatgccgaatgggaaaccggctccaaacggttactggaagaattcgacctgacttgggaagaggctcaagcctaccaaagtgaaagaaaccgtgccgagctggcggccagagtccaggagattaaactgcggatggagctgctgggccctgtgaaccaggcggccattgaagaatatccgaagcttcaggagcgctttgattttctatcggtgcaaaagcaggatctggaggaggccaatgaatccctccagcaactcatcgccgaactggataaaaccatgtcggaacgtttcgaagaaggatttatagcggtcaacgaagcctttaaagtggtcttcaaggaactgttcaacggaggctatgcggaacttcgcttagtagacccggccaatcttctggatacgggggtagagatcatcgcccagcccccgggaaaaaagccccagctgctgtctctcctttccggaggagagcgtgctctgacagccatcggactgctcttcgccctgcttaaggtgaagcccagccccttctgtgtccttgatgaaatcgaggcttccctggatgatgccaatgtcagccgctttgcccaatacattcaccgcttggcaaactccacccagttcctggtcatctcgcaccgcaaaggaaccatggaagcagccgatgtcctctatggcatcaccatggaggagtcgggtgtatctaagctgctctctgttcagttggaaggc

SEQ ID NO: 33410 - DNA, 1563 bp, Desulfitobacterium hafniense
gattttaacgcggtcttcaatattggtatgctgcttgtctgtttctatgcagcctcaggtatcttcagctttgccgagaattttatcatggctacggtaactgctaaaatatctaaaagcatgcgcactgacatcgccaagaagatcaacaaactgcccctcaaatactttgacaaaacaagttacggcgatgtcatcagccgcgtgaccaacgatgttgacgccattggccaaaccctcaatcagagcctcgataatttggtgagggcagttaccatgtttgtcggttccctgatcatgatgttctacaacagttggattctggccttggttgccatcggctccactttgatcgggtttgttctgatggcgctcatcatgtccaaatctcaaaagtattttaccgtgcagcagcagggactcggcgatatcaatggccatattgaagaaatctattcgggccacaatgttgtcaaggcctataacggcggcagcaaggcgaaaaagacctttgaggagatcaacacgtccctgtatgacagcggttggaaatctcaatttatgtcggggatgatgatgccgattatgggcttcatcggcaacttcggctatgtggcggtgtgcgtggtcggcgcggccttggctatgaaaggcacgatctccttcggcgtcatcgttgcctttatgatctatatccgcctctttacccagcctttgtcccagttggctcaatctatgcagcagctgcaaagaacagccgccgccagtgagcgtgtctttgaattcttcgccgaagaagagttggccggggaaagccagcagctcaaaaagctggagaatgtcaaaggccacgtggagtttcagaatgttcactttggctatgagaaggacaaaaccattatcaataatttttccgctcagatcagagccggccagaaggtcgccattgtggggcctaccggtgcgggaaaaacgaccatggtcaatctgctgatgcgcttttacgaaatcgacagcggcgagattcgcatagacggtatccccatcagccatgtgagcagagaaaacgtccatgaccaattctgtatggtattgcaggacacctggctctttgagggaactatcaaagaaaacatcatctacaacaagcagggcgttaccgatgaagaagtgatcgccgcctgcaagtctgtgggcatccaccactttatccgcaccctgccccagggctatgacaccatcctcaatgataaagccaacctgtcggcaggccaaaagcagcttgtgaccattgcccgcgcgatcattcaaaattcaccccttctgatcctggatgaagcgaccagctcggtagacacccgtacggaaaggctcgtacaggatgccatgaataagctgacccaggaccgaacctcatttgtgatcgcccatcgcctctccaccatcaaagatgccgatctgattttggtgatgaaagacggcgacatcatcgaaagcggcgatcacgaggaactcctcggcaaaggcggcttctacgccgagctttataacagccaatttgaa

SEQ ID NO: 33411 - DNA, 1743 bp, Desulfitobacterium hafniense
atggtaagaatcttcaagtatctcaaggcggaggaatggctgatggcaggcatcagcctgatcttcatcgtcgcccaggtttggcttgatcttaaactccccgattatatggcggaaataacaacgctgacccagacgcccaacagcgccatcagtgacatctggctcaacggcggttatatgctgttgtgtgccttgggaagtctggctgctgcagttgtcgtcggtttttttgcggccaaaatagccgcctccttttcccagcggctgcgcagtttattattcaataaggttgaatccttttccatggaagaaatcaaccgtttttcaacctcaagtctgattactcgttccacaaacgacatcacccaaattcaaatgctggtggtcatgggcctgcaattggtgattaaagctcccattacagcggtatgggccatcaccaaaatctcgggcaaaggcttcgaatggaccatggtcacaggggttgccgttttgattatgatcataatggttacctttctgctcatcgttgccctgcccaaattcaaaaagatgcagacccttaccgataacatcacccgggtaacaagagaaaatctcaccggcctgcgtgttgtccgcgcctacaatgctgagaattatcaggaagagaaatttgaaacggccaacgaagagcttaccagcacccagatgttcaccaaccgcgccatggcagtcatgatgccggtgatgagtatgctgatgagcgggctgtccctggcgatttactggataggcgcctatttgattgatgcggcaggggcgctggataaattaggcctgttttccaacatggtcgtcttttccagctatgccatgcaggtcatcatgtcctttatgatgctggtcatgatcttcattatgctgccccgcgccagcgtttcggccaaacgcatcaatgaagtgctggatacggaaccccggattttagacggaacaaaaaccgagggccagccgggcctgcgaggtgaagtcgtgtttaagtctgtcagcttccaatatcccgatgcagcggaacctgtccttgaagatatcagttttacggcctcccccggtgaaaccgttgcttttatcggctcgaccggaagcggcaaatcaactcttgtcaaccttgccctccgcttctttgatgcaacccagggggaaatattgattgacggcgtcaatgtgcaagaatataagctggaagcccttttcaataaaatcggctatgtaccccaaaaggctgtgctgttcaaaggcacggtagaatccaatgtggcttacggcgataacggcggcgaaggctatcctctggatgaagtgaagaaggccgtacaaattgcccagggcgcagactttgtggagaaaatggacggtcaataccaagccgctattgcccagggcggagccaatgtatcgggcggtcaaaagcagcggctggccatcgcccgggcggtgtgccgcaagccggaaatctatatttttgacgattctttctcagcccttgattacaagaccgaccgggttctgcgcagtgtgcttaaacaagaaaccgcaggtgtcaccagcctgatcgtagcccagcgcatcggcaccatcatggacgccgaccagattattgtgcttgatgaaggcaaaatcgtcggcaaaggaacccacaaagacttactccgggactgcactgtctatagagaaattgccatgtcgcaattgagcgag

SEQ ID NO: 33412 - DNA, 1257 bp, Desulfitobacterium hafniense
atgaagatttgtgtcgtcggcgcaggatatgtgggcttggtctcagccgcgattctggctgactggcagcataatgtggtatgcgttgatcacaatgaacaaaaaattgaggaccttttggctggtaaactgccgatctttgagccggggcttcaggaattggtggaacttaataggcgcaggcaatatctgcgctttactgcagaaatggcggaggcactgaggggatgtgagatgatcatcgtcgccgtgggaactccccctgcagaaaacggacatcccaatctggaagacttttgggcggtagtcaaaagtttccgggagaatgtgggcaataatgtgatcgtcatgatcaaaagcactgtaccggtgggaaccggtgaggcggtttccctgtatttaaatgaaaaggtcagtcatacattttccgtagtctctgcaccggaattcttgcgtcagggaacagccgtccatgactttcttcatcccgaccgtctggttgtgggctgtatgtcaccggaaatcagggagcaaatgaaggaactgtttcagcccttggattgtcctaaggttttcaccgactggcatagtgcggagatgattaaatatgcttccaacagttttttggccttgaaaatttcttatatcaataccattgctaatttatgtgaagctgtgggaggcaatatccaggatgtggctgcagcggtcggtctggaccaccgcattggtcaggcttacctgaagccgggagtaggcttcgggggctcctgtctggctaaagatacccaggggctgatcgctcagggtgaggttcacggtgtcaatgtctggatgttcaaggatgtgctggaggtcaactatgagcagcgggtacacattgttcagcggctgaccgaggtgctgggcaacctgaagggcagaaaaatcgccatcctgggtctggccttcaaagccaatacggatgatctcagggacgctccttcggtaacgattattgcccagattatcaaactgggaggactggtcaaagtctatgatcccgttgtggatagttcgagcttgcctaatatcatttctgtaagtactgcggacaatccctatgcagcatgccagggcgtcgacgccgtaattgtgctgacggaatgggaggaattcctggatcttgatctgaagcgtctgcaaaagagcatgaatgcccctgtatttatcgacgggcgttatctctttgaacggaaaagattgctggaggcaggc

SEQ ID NO: 33413 - DNA, 1281 bp, Desulfitobacterium hafniense
ccgcgaacatcctgcgcattgggaggggctctggccaccatgagtgctctgcccagggtggtgcccataattcacagcgccctcggctgcggaggcaatctcagcggtgccgcggcttttggagccggatactgcggttccagctatgccagtggtcaaagtgcgcctaccagtgccgtgaccgagacggaaattgtctttggcggcagtgaccgtctgcatgaggaaattcaatccacgctggaccttattgatgccgacttattcgtcgtagctaccggctgcatgaccgagatgatcggagatgacgtgcagggtgttgtcagtgaatttgccggcgggagaaagcctgtcatcgccatcagcactcctagttttaagggagatgcctatgcgggctattccatcaccctggaaggtatttttaacaagtatttgcccaggtctaactctaaaaaacctaaactggtcaatctttttggtttggtgccctcttacgacccgtttttccggggagatctaagtgaaataaaacggctattagaaaagctgggcctggaagccaataccttctttaccccagatcagaccttcgccaaccttaccagtgctccgtcagccactttaaatattctgttttcccatgtgtggggagtggagtttgtgaagaactttgagcaaacacatggaacaccctactggattactgatttgcccatcggccctgaagccactgaccattttctgagggaggttgctgaaaagctggagatagaaccgcaaagggttgaagaggttattgcccaggaaaacaaagagtattatggctatttccaacgggctgtggatatttttaccgatgctgactacaaattttatgcagccataatcactaactccaactatgccatcccctatgccgagtttttagaaaaggaattggggtgggtacccaaagatattttcataaccgatcttcttcatgacggacaaaaagaaagactcagggaggcatttcaggcgaagaatttactgggtgagttgatatttgaaagggacaccagccgcatcggtgtgactctcaggcaaaggcatcctcaggaccaggggcagcgttactttgatgcctatgcacctctttatctcttaggcagttcactggagaaggagctggcagtcggccggggtctccattacttaagcgtcagcttccccgtatacaaccgcatcattgtggaccgggggtattcaggataccggggcgggctgcacttatttgaa

SEQ ID NO: 33414 - DNA, 1404 bp, Desulfitobacterium hafniense
ttcagcggttgcgggaaagaactgttggactgcgcccaatcgggatgcatgctgcaaaaaaacaggaagttttggcaagccggtgcctgccagatgcagttgtccctgatgatggccgcaacggtggagaattcagtcatcattatgcatggtccggtggggtgcggaagcacactgcatagtcttgggcccgcagccaataaaggcaaagcgaagcggggaaagaagccgcaggccctggtctggctgtcaaccaatttgcaggagtcagacgtcatcggcggcggggaaaaaaagcttagagaaacggtcgaatatgcggacaaaaccttccgtcctgagatcatttttgtagtatccacctgtaccccaagcatcattggtgatgatgtggaagaagtagttcatcaaacccagaaaggagttgctgctcatctggtctccattcattgcccgggctttcgaacccgtgtggtggcaacggcttatgattccttttatcacggactgcttaagcatcttcctttagaaccgcttcccgctgaggcttttattccccttaaggaaaatgatcccggatatgagttggcagctcaacaatttgcttaccggaaaagccgcacggtcaatttgtttaacgccacctccatcggccctgccgatgaggaagaactggtgcgtttgttaaaggccttgaaccttaatgtacaggtttacacagaatacagttccttggctgagtaccgtaaaatgtctcaggctgcgttgaatatcagcatgtgcaatgttcatgacgattatctgcttgcttatttgcaggataaatacgctctaccctatgtaatccaaggaatgcctatcggtacgaaagcagtgagaaaatggctccttgcggtggcagagcatttcgacctggaagagaaagctaatcggctggcagaccaagaggaaaagcaggtgaacgaagcccttcagcccttcctgccggccctaaagggcaagcgtgtattgatcagcggcggggtcatccgcgtagccgaagaagcaaaagttctcaaggacctgggcctggaagtcatcggtgtgagagcctatcactatgataacggtgcagagcctgtttatggctccttggttgatgagttgcccgaagttcacgtgtcggtaagcaaccaactgtttgaattggccaatcaaatcgcccggtatcagccggatttggtgattgcccacaacggcacccagggttgggtagcgaagatgggggtgccggccattcagttattcgatgtggatcgggcctactttggatacagagggctgttctccctggtcaaacggatcgcttttgcctttgagaatacttcattgcccaggcgtttggcccaacatgtgaaccttcct

SEQ ID NO: 33415 - DNA, 528 bp, Desulfitobacterium hafniense
atcttggcacaaaaaggattttactacgaccaaactacctgtatcggctgcaaagcttgccaagtggcctgtaaagataaaaacgactcagccgtcggcgttcgttatcgccgggtctatgatgtcgagaccggaaaattccctaatcctcgtcgtctccatttctccatcagctgcaaccattgtgaggaacccaaatgtgtagcgaactgccccacaggtgccttggaaaagcgcaaagaggatggcattgtcattcatcactacgataaatgcatcggctgccgtctttgcacctggtcctgtccttacggcgctccccaatacagggaggaagaaggaaaggtcggtaaatgcgatatgtgtgctgacctgttggctaaaggagaaaaccccgcttgtgtggatgcttgtgtcatgagatgtctcgactatggagacattgatgagctccgccagaaacacggccaaaatgccgatgctcccgcattgccgagctccaagacgaccaaacccaacatcgtgatt

SEQ ID NO: 33416 - DNA, 492 bp, Desulfitobacterium hafniense
gggtttcttttcaatgtggatcgctgtattggctgccatgcctgtgttctcgcctgcaaaaatgaaaacaagacagcggcgggagtatcctggcgccgcgtcaccaacaccggcgaagggcactacctctccatttcctgcaatcactgctcaagtccggagtgttttcgggtctgtccggagcatgcctatataaaaagaagggatggcatcgtgctgatcgattccaatcgctgtgcaggctgccaaacctgtgtgggagcctgcccttatggggcgccccagttcgaccccgtcgccgacagaaccagcaaatgcgattactgtattgaccggcaaaaggccggcctgcttccagcctgtgtaaccgcttgccctaccggggccctgcaggtccatgagttcgataaatacagtgagaaggatacagtgccgaccgtagaaggatttccggatatccgcctcaccaaaccctccatccgcttttatcct

SEQ ID NO: 33417 - DNA, 1293 bp, Desulfitobacterium hafniense
caaattttccataatgtctgccctcgtaattgttatggaacttgcgggattctctccactgtggaaaacgggaagctccttaaggttgaggggaatcctaagcatagttatacccgcggccggctctgtgccaaaggctatgcctacacggaatatgtctacagcccgcggcgcctcaagtatcctttgcgccaattccccagaggttcaggaaattggcagcgcctaagctgggatgaggccttggagatcatagcctcgaaaatgatcgagcttcacgaccgttacggttcgaatctggcctgcggctataataaattctccggcaacctgggaattctccattacgccacagaaggaatgttcaggggcttggggtcttacaccaaggtccatggcgatttatgcttgtcggccgaaggggatgcactgaactataatcggggccggggggagctgctgcgggatcccgaggatatggccaaagccaggggcattgtgctgtggggggttaatcctgcccgcaccgctgtccatcagtggagttttatcaaccgggccagagataaaggggctaagctgttggtcgtcgacaccctgtttactcctacggctgctcaaggggacagttacctgcagattcggccgggtaccgacgggctgctggccatggctgctcttaaatatttatggcaaatggatcgcctggatatggattatattcaggagcatgttcatggctgggaggcttttgcaagctatctgcaggaggaggtctcccttgaagaagccagtgccatcaccggagtgcctcttgagggaatcaaagaactggctgaaatgtatctggaatccccctgcgctacctgggtaggattcggtctgcagcgttattccaatgggggccagagcgtgcggggcatcgatgccttggttactttaaccaagaatcagaaccaaccaggagggggattatactattttaatttcctcgatatctttccccttcatattaaaaactttccccgccccactgagcaggaaaaggcctctgtgcgaagcctcaatattatccattttgctcaagaggcgttggctttggaaaatccccccttaaagctcctctggctggcaggccataatcctttcagccagggccagaacttccaatactggcaaaagcttgtcaaccaattggaactcatggtggtggtggatttgttcatgaatgaaaccacggcccaggccgacatcgttttgccggcggccagcccttttgaagagtatgatttg

SEQ ID NO: 33418 - DNA, 366 bp, Desulfitobacterium hafniense
gaattaaagtacagcaaatctcatgagtgggctaaggtcgaaggaaatactgtgactttggggattacggctcacgctcaggacagcttaggagatgtggtctttgtggagctgcctgataacgataccacggtggtggccggggaggcctttggaaccgttgaatccgtcaaggccgtgtcggatatgattgctccggtcagcggcaaggttatcgattataatcaagaggtgctggattctccggaacttctcaatgatgatccttatggtgagggatggctgattaaggtggaagtggatgatctgacggtattggatgaactcttatcagccgcggaatatgaggcgtttcttgcggaggag

SEQ ID NO: 33419 - DNA, 819 bp, Desulfitobacterium hafniense
gctcaattgctggacggaaaagagatttccaaagtcttaaaagaagagatcaaggaagaagtaaagaggtggaaggaacagggggttaatcctaagctggcggtggttctcgtgggagacgacccggcttcggtggtctatgcgaaatccaagcaaaaagtgagtgacagcttaggcattgactttgaactcaccgtattgcccgccgacagttcagaagagtccattctggccctgattgattccctcaatgccaatccggatgttcatgggattatgatcgagctgcccttgccgaaacatatttccaaagagcgtgtcatggcagccgtgcgccctgataaggatgtggacggagttcatcccattaatcgtggctatattctcagtggggaagaaggtctgttcccggcaactccggaaagctgtatcgaaattatgctccgttcgggagttgaaatcgccggcaagcatgtggtcatcgtgggacggggagagacagtcggcaagcctttggttttcctgatcctaaaacataatgccaccgtgaccatctgccattcccgtactccggatctgggagcttttacccgtcaggcggatattatcgtggccgctgtaggtaaagcaaaacttgttaagaaagatatggtgaaaccaggtgccatcgtcgtcgatgccggtatcaatgagatcccgggcggaatctgcggggacgttgattttgaggaagttaaagaagtcgcttcccttatttcaccggtgccggggggcgtaggctcattaaccaccgccttgatcatgaaaaatgttctgaag

SEQ ID NO: 33420 - DNA, 987 bp, Desulfitobacterium hafniense
aggcttttagaagcaagtggtgtgccggcaactgatgccggaattgtttcttccatattggtggatacgagtctggagggtatcgatacccatgggattagccgcttaccggtttatctgaagtgtctgttaaaggggcgcatcaacccaaagcccaagatccaggaaaccattgatgctgccgtggcccgtgtggacggtgataacggactcggccaattagttgcttatcgcgctatgaatagtgctatcgacctggcaaaaatctatggtattggttttgcaacggtgaagaacagcaatcattttggagcggcttctacctattgcaaattagctgccgcgcaacaaatgatcgggcaagcctataccaactcacccagcggtattccgccttggggagggagggctccctattttggcaccaatccaatctcatatggatttcctcatgccgagtatccggttgtcgtcgatatgtcttcatctacggtggctcgcggcaatattattttagcggctaaaaacggtgaggagattccggagggctgggcgatggacaaagacgggaaagcgacgacaaatgccaaggctgcactggagggtgcggttttgcccatcggcggagcgaaaggctataccttggctttggcagccgaggtgatggcgggcatcatcagcggttctgcttacggatctcatgtgggctggatttatgatgaaggcagagaaccggtgaatatcggtcatagttttttggccataaatattgccaaactgatgccggttgaagaattcagccaaaggatgggtgatatgatccgggaagttaaggcaataccgaaggctgaagggattacggagattcggattccgggtgaaaggcggcaggccaacgccgagcagcgcaaacaagacggaataccggttgccgaggggctgttgcaggagcttaatatgctggctgaaaaattggcaatccctata

SEQ ID NO: 33421 - DNA, 732 bp, Desulfitobacterium hafniense
atgaatgtagaaggtattggaagaatctgtaacttgggaacgggtacagttggtcctggtataaccctaacattcgctctagctggatatgaagttaatatgtatggccgctcgaatgatagtataaagcgtggtatgaatgcaattacggatatgcttaaaaaatttcgggaacatggtttagttaaagactcagatattccggaaatcattggacgaataaaaggcgttacaacattagaagaagcagctgatggtgttgacttcgttatcgaatcaattgtcgaaaacctttcagctaagcaggaaatatttgctaaaatggagaggttatgtttagttaatactatctttgcttcaagtacctcgggtctaaccacatcggcaattgccgaaagcctggaatataaagaacgttttatcgttgcccatttttggaatccaccgcatctcataccattagtagaaattgttcctggacaatacacttcccagaacaccactaatattacgtcaaaattattacttaagattggcaaaaaaccagtaatcttaaagaaggaagctttaggttttatcggtaatcgtctacagtttgctatgcttcgagaggcactttctctaatagattcaggggttgccacgaaagaagcaatcgatacaacgattaagtatgctctaggtcgtcgcttatctacaactggtccacttgagagcgccgatttaagtggc

SEQ ID NO: 33422 - DNA, 1326 bp, Desulfitobacterium hafniense
tggcttaaaaaacaggctctggaaaaaccccataagctgtttttaaatgagctgtcctttcaggaggtggaccggcgtgtcagcgacctggccggccggatctatccctttgttaaagctgaagacagagttgctctttatgctcataattctgtggagatggccctgtttttcatggccctgcaggctttgcaaatggaggtgttcatgatgaatactcgcctgactggggaggaaagagcaaaaaagctaaaaacattaaacatccgggtgactttttccgacgatgatacctttattccctttgggagggtgctggccggtgactatgatgaacaggcacgctgccgggaagaggaggccccggagaaaattgcggtgattatggataccagtgccaccagcggtgactataagtcggtgcccctgcgccggaagcagctggatgctcatgtgcaggcctcccggcaagttctgggggtcagggaagaagataactggctgctcgtccttcccatgtaccatatcggcggcttagccattttaatgcgcagtttgtataatggcacccgagtcaccttgatggggaaatttgatgaagagcagatcttaaaagggatcgaagagggctcgctgacgatgctctccctggttcccaccctgttgatgaggattgtcaaccgcatccgccaacatcgtttgcgggtggttttggtgagtggggaattcattcctaagtccttggtggaaatttgtctggcgaaaaggattcccatctataaatcctacggcatgacagagaccaccagccaatgcacgaccttttgtgtggcggaaaatcctgctaagcttgatgcggtgggcttgcccttgccgggggtcaccctgcgtattgttaatccggatgcagagggaatcggggaagtagccatccaaagccccatggttatggacgggtatctggggaaagaggcggtggaggggttccttaacacccaggatatgggctatgtggatgaggagggatatctctacatcctggatcggcgcaaagatatgattatctccggaggggaaaacatctatccccgggaaattgagaatgtgctgtatgcccatcctgagatatctgaatgtgccatggtggggatgaaggatgagaagtggggacaggtaccggttttgtttgtggtttcttctttgggagatgaggagctcagggattatctggccgggaagctggccagatataaattgccccggaaaatagtgcatttacggtcactgccgaaaaatgccacgggcaaaatactgaaaaagaatttg

SEQ ID NO: 33423 - DNA, 1263 bp, Desulfitobacterium hafniense
atggcaatgaccatcactgagaaaattcttgccgagcatgccggtctggataaggtggtacccggtcaattgattactgcccagctggatctggccttggccaatgatataaccggcccggtctccatccgggaatttgagaagttcggtgtggaaaccgtttgggataagaccaaggtcgccttggttcccgaccactttacccccaacaaagacatcgcttctgcagaattaagcaaagctttaagagaatttgcaaaaaaacaagggattgttcattattgggagcagggaagagtgggtgttgagcactgtcttcttcctgagcaaggcgtgaccctgcccggtgatgtgatcatcggtgccgattcccatacctgcacctacggcgctttgggtgcttttgcaacaggagtgggcagcacagatttagccgccggcatggctaccggggaagcctggttcagaattccggaatccataaaattcatatttaaaggaacgaacttccagccctgggtcagcggtaaagatttgattctttacaccatcggcaaaatcggggtggacggcgcccgctatcggtctatggaattcactggggaaggtatcgccgccttgtccatggacggccgtttaaccatgtgcaatatggctgtggaagcgggagccaagaacgggattatcccgcccgatgaaaagaccctggcttatgtgaatgaacgggccaaacgcccctataaagtctatcacagcgatcccgatgctcagtatgtggaagtctatgaatgggatgtggcagatattcctttgcaagtggcttttcctcatctgccggagaacgccaaacccgtcagtgaagggaaaggaattaaaatcgatcaagtggtcatcggttcctgtactaatggccgtctggaagatatgcaagtggcggcacagatcctcaagggccaaaaagtccatggggatgtacgcttaattgtcatacctggaactcaggatatttataagcaagccatgcaggaaggactgatcgatatctttatcgatgcgggggctgtggtcagcactcctacctgcggaccttgcttgggcggatatatgggaattctggccaaaggggagcgggcgctttccaccaccaaccggaactttgtcggacggatgggacatccggaaagtgaggtctacctgtccggaccggctgtggcggcagcatcggcagtaaccggggaaatctcacatccagaggaggtatta

SEQ ID NO: 33424 - DNA, 1386 bp, Desulfitobacterium hafniense
atgttaaaagcggaagctttgaatgaactgatccaagtcctgggcaaagagaatgtggtcacggagcatgaagaactcctgtcttactcttatgacgccacagcagctatgcctcatcaaactccggatgtctttgttaccccaaagaccacggaacaagtctcggaagtcatgaagattgccaccaagtatgatcttcccgtttatccgcggggatcggctaccaacctcagcggcgggaccattcctattgaaaaaggaatcgttatgtccatgctgcatatgaaccagatcatcgaggtggacgctgagaacctgacggcgactgttcaacccggtgtgatcattcaagatttaaatgatgcggccttagagcatggccttttctatcctcccgatcccggtacagtaaaaactgccaccatgggcggttctgtctccgagtcctccggtggtctgcgtgggctgaaatacggggtgaccaagcattatgtgatgggcatgaagctggttcgcgctaatggggatatcatcaaatggggcggcaaaacagtgaaaaatgtgaccggttatgacctgaccgctttatttaccggcgctgaagggaccctgggtatcatcaccgagatcattgtcaagctgaatcccgtacccgaagccagaaaagcactcctcggcgtatttgatgatatcgataaagcaggaaatgccattgccgccattatccgcaacaaggttattcccgcaaccctggaaatcatggacaatatcaccatccgcacggtagaaaacttcacccatgccggacttcctgtggatgctgaagcaattttgctctgtgaagtagatggctataaggaagccgttgagcgtgaagcagctctggtagagaagattcttaaagagcagggcgctgtagaaatcaatgtggctaagaccgatgaagaacgggacaagatctggctggctcgccggaatgccctgcctgccctggctcagcgcagaccgaccactgtactggaggacgctactgttccccgcagcaagattccccacatgattaaagctatccgccaaatcgctgaaaaatatgatctcttgatcggaaccttcggtcatgccggtgatggcaatctccatcccacgattctgaccgatgagaacaacaaggaagaaatggaacgcgtggataaggctgtcgaggaaatcttccaggtagccgtatccttgggcggaactctttccggtgagcatggtatcggcatggctaaagccaagttcttgcctctggaattcggtgaggccggtgtaaagctcctgaaagatatcaaagaagcatgtgaccctgattatcgcattaaccctggtaaaatggtgaggagggac

SEQ ID NO: 33425 - DNA, 849 bp, Desulfitobacterium hafniense
cggattagaaaggccattattccggcagcaggcttgggaacccggtttttacccgctaccaaagcccagcccaaagagatgcttcccatcgtggataaaccgaccattcaatacattgtcgaggaagccgttcactccggaatcgaagatattatcattgtcaccggccgcaataagcgggccattgaggaccattttgatcgctccatagaattggagacctttcttcagaaaagtgagaaggaagaactcctggacatggttcaggatatagcccggatggtggatatttattatgtgcgccagaaagaagctttggggctgggacacgctatttattgtgccagaaaattcatcggcaacgagccctttgccgtcctgttaggcgatgatattatccattccgaagtaccctgcctcaggcagatgatgcatgtctacgaacggcatggggccagtatcgttggcgtccaacaggtacccctggaagatacctcaaagtatggaatcgttgacgcggtacctcttgatgattccttataccgggctctggacctggtggaaaagccacagcctgaggatgctcctgaggcccgtttggctatcatgggccgctatattcttaatcccgagatttttggcatcttggagagtatcccccccggcaaaggaggagagatccagcttacggacggtttaaaagaactggccaggttccaggagattcttgcttatgagttcgacggacagcgttatgatgtgggggacaagctgggttttgttcaagccaccattgaatacgccctgcgccgggaagatctcgccgaacctctcatgcgctacctcaaa

SEQ ID NO: 33426 - DNA, 2181 bp, Desulfitobacterium hafniense
gctaaaatccacatccttgatatacaagccgccaatcaaatcgccgccggcgaagtggtggagcgccctgtttccgtggttaaggagctgattgaaaacgctctggatgcccaggctactcaaatcgaagtgatcattgagggaagcggggtggaaaggatcagggtccaggataacggccagggaatatctgccgaggatctgcccctgaccgtcctccgtcatgccaccagcaaaatccggaccattgatgatttgaaccgtttacgcaccctgggctttcgcggggaagctttacccagcattgcctccgtctccaggctggagatcatcagccgcccccctgaggaaatttccgggcgggttttgcggattcaggggggagagcagctggagttctccgaaaccggctgtccgccgggaaccaccattaccgtcgatgatctgttttataatacgcctgcccggcggaaattcctgaaatccaaaaacacggaatttggtcaaatctccgatgtcatcgggcggctttctttggcccggcctgatgtttcctttaccctgaagcatccgaaagtccttgtcctgcagactccgggcaaaggaaatctgctggagagcatcggggctgtccttggccaggccacggcccgccgtctcctgcccctgtcctgctccctgggggattggcggctggagggttatatcagtccgccggatctggttcgttccaccaaacaaggggagaccttgatcgtcaatgagcggattattcgttccaacagcatcagccgtgccatttccgaagggtatcataccttgatccctgctaagctttatcccatcaccatcctgaaactgcatatcccgccccatgaatacgatgtcaatgttcatcctaccaaaatggaaatccgctttcacaaagagaaagaacttatggagtttattgccgagggagttcgcaggacccttctccaagcccgtcccatcgccccctttgtcaaggtcaagaacactccatcccctaaagaatctctccccggcgctgacaaggttgacagacctgttcagggcgccctcaattttgctcctaaaagccctcacagcctgtctcagggcaaaactatccccataccttataaacactccagttactctcccttggggcctgcaaatgggctttctgcttcgcaaagagatcgtgagttaaatgccggcaatgaatttaaggcaggtcataaacttaatgcacatgagtttgctgagacagcaaagttcctcatcaaggacttaaacccccaggaaaggccgccggttaatgagcagaaactctttcttgagtctcaggaaccttttcaagtcacccctctgaaagctgataggttagaacctgatctttccttggagtcggatgcttttttaggagcgaatatttcgggaaccgatatttcaggggctgatactttggggagagctgatgctcctttggctgaagaagaggtgggggcagggtcaaccgctgagttggagctatccgttgccgaagagaaccatgaaagcaatgaaattaccgaaatcactgataaaatcaaggagcaaagtcctcttttggccttgcggcccatcgggcaggtttttaatacctatataatggcaacggatggggagcagcttgtcatcttcgaccagcatgccgcccatgagcgcattaattatgaacgcctgctggcagagcaccaaaacaatcccggcaacagccaaatgctcttgattcctctgaccatggaatttacacctggggaagaagaggctttgctggagcattttctgctgctcaacgagatggggttcatccttgagcactttgggacccgaacctatctcctgcgcggcatcccggcctatagcggcccttaccagggggagcagcttctgcgggactttctcgaccaggtcatgctcaaccacattccccccactatggataaattgttggaggagtggatctatatgttggcctgcaaagcatccattaaggccaaagagaacctgaccctgtttgaaatggagcagctgattgttcaattgagtaagactctgaatccctatacctgtccccatggccggcccaccatgattcaactcactaaagaagagctggaacaccgcttttatcgt

SEQ ID NO: 33427 - DNA, 2526 bp, Desulfitobacterium hafniense
acaccgatgatgcaacaatacaaatccataaaatctcaagcccctgacgccattctcttcttccgcctgggagacttctatgaaatgtttggcgaggatgcccggaccgccgcccctgttctggaaattgccttaaccggccgtgattccggaggcggggagaggattcccatgtgcggtgttccccaccatgctgtagatggctatctgctcaagctggtttctgccggttataaagtggccttatgcgagcaagtggaggatcctcaagccactaaagggatcgtcagaagagagattatccgaatcatttctcccggtactatgacggattccttagtggagcaagccaataattttttagccgcggtctatcatgatcaggactggggattggcctttgtggatgtttccacaggggagtttacggtttttcagactgaatccatagatatcttaaccaccgagctttcccggattcgtccttccgaattgctgctcccggcggaactcctcaaagcaaagcactggcggccctattatcttactcagcgggaaaagaaaacctatcaacacaccttgctggaacagcgctttacggaacaaaccgagttatttcaggaatttccgacggctatgaaagccgccaatgggctttggcaatatatcctggaaacctcacccggtatcgatccctcccatattctgaagatcaatgcctaccgtcctgagcactggatgctccttgatccctggacccgcagaaatctggagcttaccgagtccattcgcggccaagggaaaaaaggaactttattatccgttctggacttcaccaaaaccgccttcggcggccgcctgctcagacgctggatcgagcagcctttgctccttaaagaggagattgaaaagcgcttggattatgtggaggccttggttgaggatagctttttacggggggaccttatccagctcttcaataaagtgtttgatctggagcgcctcatgggcaaggtttcctatggtaccgccaatgcccgggacttattatccttagctcagaccttaggcgtgctgccccaactccgggctttgctggcggaaggcaagtcggcatccctgcaagcctttattccggccttggaaggtctggatcctttggctgtgaccttagagcaagctattaatccggaagcccccatctccctgaaggacggaaacctgctgaaagccggttattcagaggaaatcgacgaattgcgcagcatatcctccggggggaaagcctgggtagccaaattggaaagtatggaaaaggaccggacaggaattcgctcccttaaggttggatataataaagtatttgggtattatatcgaagtgacacatgccaattcccacctgatacctgctgaatatattcgcaaacaaaccttagccaatgctgagcgttttatcaccccggaattgaaggaatatgaacaaaaaatcctgggcgccgaagagaaagtcacacagctggagtatcagctctttctcgaactccgggaaacagttcgcgggcaggccgctaggattttagaagccgcccatgctctggctgaaatcgacgtctatgccagcctggcggaagccgctgtgcgccatcattattcccgtcctgtgatgaagggagaaggggggctcactatcatcgaggggcggcatcctgtggtggaatccatgcttcaggacacttcctttgtccccaacgataccatcctgactgaggataaacatctggccttgatcaccggccccaacatggccggtaaatccacctacatgcggcaggtagccctgatcgtcctgatggcccagattggcagctttgtacctgcacagcaagccaccattcccatcgctgatcatatctttacccgggtgggggcttccgatgatctggcctcaggacaaagcacctttatggtggagatgtatgaagtggcccatattctgcgccatgtcacaccccatagcctgatcattctcgatgaagtgggacgggggacagccacctacgacggcctcagcattgcctgggcggtggctgagtacttagccggtcaggagaacaaacccaaaactctctttgctacccattatcatgaactgaccgatttggaggaaacccatgccggtatcttcaatcttcatgtcggggttagggaacatggggaagagattgttttcctgcataagattatccccggccgtgccgatcgcagttatggcattcaagtggcaaagctggccggtttgcctgccaatctgctgcacagggccaaaatcattctgcatgagctggaatcctccgccaaggaaaaccgccaggagcatttgctaaataaggagaaggcaacccaactgtccttgttcgaagttcagcccctggaccccctgttgcaggaagtcagcgagctttctgtggaggatttgactcccaggcaggccttggattacctgttcgatttaaaagaacggatt

SEQ ID NO: 33428 - DNA, 3047 bp, Desulfitobacterium hafniense
atggaagtaactcgtcgtgggttccttaagctttctggggcatccctgtttgctttggcttccggtcttggctttgatccacagatcgcccaagcccagggatttagtcttagaattgaaggaacaactaagattcctagcatttgccatttctgttccggcgggtgcggtttgctgcttcatattaaagacgaaaaactcgtttatctggatggagacccggataatccggtgaattccggtgccttgtgtccgaaaggggccagtttgggtcatgtggccaatgccaaggaccgtgtcacaaagcccagatacagagctcccgggtccagcgattggcaggatatttcctgggatgaagcgattaataagatcgcctcaaagatcaaggaagttcgtgacacaacctggatggctacggaagaaattggtggtacagcctacaatgtaaaccgcgctgatggcattgccgttctcggttcagccgaagtggataatgaagaatcctacctgatcaagaaactgtccgagctcatcggaacaccttataacgaacaccaggcccggatatgacacgctcccacggtggcaagtttgtcaccttcatttggccgcggagctatgaccaattcctggacggatatgcaaaacacgaaatgcttcctgattgcgggcagcaactgtgcggagaatcatcccatagctatgcgttggatcaataaagccaaagaaaacggcgccaaggtgatcgtggtggatccgcggtttacccgtaccgcctcccaagcagatatctttgcccaggttcgtcccggtgcggatattgcttatttaaatgcaatcatcaattatatcttagagaacaaactctatgatcaagactatgtactcaaccataccaatgggctgtacaagatcagtaaagactttaaatttgccgatggactgttttccggatttgatcccgagaccaaaaagtataattttgacagctgggcttatcagcttgatgccgaaaacaaaccggtgaaagcggaaagtctggatgatcctgattgcgtatttggcaagcttaaagagcatttctcccgttacactctggaagtaggggccgatatcagcggtatacctgctgaaaaaattaaagaaattgctgataccttctgcaataccagaccaggcagcattctttatgcactgggcatgacccaacacaccaccggcgttcaggaatccgcagttacgcgatcatccagctgcttttgggcaacgtaggtaaagcaggcagcggcatccaagccttgcgtggtgagcccaatgttcaaggctccaccgatatggccaatctctttaataacctgccgggttacttgccggccccggttcatacggataaggatctgcgcagttatctggtgcgcagcggctcggcttttgaaaggcatattatctctcagctcaaagcttggtttggcgaaaatgccaccaaagaaaatgattattgctttaattacctgcctaagtacaactcaggcaagaactacagcatggtaaaactttgggaagctgccaatagcggacaattcaaaatgctgcttaattttggctcgaattccatggtatccatccctaaccggcaaatcgtccgtgaaggcttggcaaagctggatatgctggtcatcgcggatgtttatgaggttgaaactgcccaattctggcgtgaaaaggatccgaccacaggcgagctcctggtcaatccggccaaaatcaacacagaagtcatcctgcttcccgcagctttcgtctatgaaaaagggggcacgctatccaactccggccgctggattcagtggaaggatgctgctctgaagccgccaggggaagctaagcctgacctggatattctggatcatatctaccataaacttaaagaactttatgccggcagtaccgatcctaaggatgaacccattctcaaggcccggtgggactatggtcatgaaccggatccgctgaaagttctccaggagatcagtggttatgatgaaacaactggtaaagtgctgcctaccctggctgattatttaaaagctcctatcggctcagcttcgtcaggctgttggatttatgccggtgttacaggcaatggcaacctggctgcccgccgggacaacagtgatccctcggggcttggtctataccgcaattggagcttctcctggccgggtaacatccgcatcctttataatcgcggctcctgtgatatgaacggtcagcctctggatgagaaccgcaagctgatttggtgggatgcggccaagaattcctgggaaggcaatgacggtgccgatgtgccggacaaaaccaaaggcccggataccccggaagggaaacaggttttccgcatgaatcctgaaggagtaggccgcttattcactgcgaaatatttcagtggaattcctgccacacctgcagcagatggcttgccccatattggcgttagaccggccggtcaatgtaatgacggtcctttgccggagttttatgagccggtggaaagtccgacggtcaatagtctgcatccggatgtaagctctaatcctaccgtgcccatcccgaacttcctgcctggtgttacgaaccatggcagcaaggaagatttcccttatgtactaacgacctatgccttagttgagcatttctgcgccggcgggatcacgagaaatatccccatgctcaatgagctgatgcctcagccctttgccgagatcagcaaaaatctggcccaaaagatcggagtcaaagaaggggacatggtagaagtatcttctgcccgtggcaaagttcaagtagtcgccctggtaacggacagaattcagaccttaaagatcaacggtcaggattccgaaaccattggtatgccttggagttggggcttcgcatccctaagtcccggaccgacgaccaacaacctgaccatcagcgccatcgatcccactgcaggcaccccggaatataaatgctgcctggtcaacataaggagggcg

SEQ ID NO: 33429 - DNA, 3264 bp, Desulfitobacterium hafniense
ttttctttcctttcgtcggttctttcccatggagccgcctataaaatcctgtttgagctgcgtatgaaatttgcagggcacatttcccagctgcccatgggctttcataccagcaattcgacgggaaagctgcgtaagctgatggatgaaaatgtggagaagctcgaactctttatcgcccaccagctcccggatgcagtgggttccttagcttctccggtcgtaatgctggtcgtattattcctgttcgactggagaatggggctggcctgccttgtacccatcgtgctgagctttatggcccaggccggcagcttagccaaccccgaatcaaaagaatttatggagagcttccaggatttgcaggataaaatgaacagctcggctgtggaatatgtgcggggaatttatgtggtcaaggccttcaatcaaacggtgttttctttccgcaaattccacgataccatcctggcctataaggacagcgccatccgctatacccactcggtaaaaaactcctattgcgctttcctcgtcctgctcaattcggtgtttctgtttctgctgccggtaggaatcctgattggcagccgcgccgccgattaccaggcctttgccatagctttcctgttctacctgattttcagcatgggcattgccgggccggtgtcaaagctgatgtatgtgttcgtgcagggttttatggtatcgtcgagcatcaagcgggtgcggggcgtatttgatacgccggtactcagcgttggggtgaatcgggaaaaaccccgggggaacggcatttcctttgagcatgttttcttctcctataacaaagacgatgcaaaggggaccctccatgatatcagcttcacggcggagccggggcaggtgacggcgctggtggggccttcgggcagcggaaaaagcaccattgctcagcttatcccccggttttgggatattgacagcggccaaatcgctataggcggcgtcaatatcaccgatatagcccttgacgacctgatgcaatcggtcagctttgtttttcaggacgtcttccttttccagaaaagtattctggaaaacattaagatcggcaatgaaaccgccagcgatgaggatgctgtgtgggcggcaaaggccgccatgtgccacgaatttatcgagcgcctgccggatggataccattccgtattgggcagcaaaggcacttacctttcgggcggggagcgccagcgcgtcgtcatcgcgcgggctattttgaagaatgctcccattgtcatactggatgaagccaccgcctttgctgacccggaaaatgaacagaaaatccagctggctctggaaaagctgatgaagcataaaaccgtcattgtcatcgctcaccgcctgtccaccatcaaaaacgccgataagatcatcgtcgtggacgaggggcggatcgccgaacaaggcacccatgaggaactgatccgatatggcgccaagtacgggcacatgtgggacgtttacagcaaagcccttaactggaagctggcctaaggagggaatcacatgctaaaaaaattgcttgcgctgacggataaatcccataaagaactgaaaaaatccatcctggcctcgtttctcgcccagctcagcctgtcattgccggtcatgatcctgatgatgacctttatcgagattctgcagcccttctggggaggggaagtggagtggcccaagctttggattctcgccgctgcttcggtggtggttgtggtgctggctttcatagcccatcgctatgaatatgggaaaacctatgtgaccgcctatgaagccgccgaagaaaagcgcaccggccttgccgagcatttgcggaaactgcccctttcctattttggcaaaaaagatctgaccgaaatcaccgtcaatatgatgagcgactgcggcaccatcgaacagagcttttcctccatcatccccgcctttggcggaaccctgatcaacttgctgttcacctgtgtgctgctggccgttttcgattggcgcatggccctggctatttttatcagcgttcccgtatccttcggctttttattgctttgccggaccatgcatgaccgcatcgggcgggctcatctgcagagcaagctggacgcctccgaacagatgcaggaatatctggagggtattaaggtcattaaagcctttggtttgggtggcgacaaatttaaaagcctggaagaagcttaccgccaactgatgaagatcagcacaaagacggaaacggtcaacggcgccctaaccaccatctccatgatgatgctgcgctttagtatcccgctcaccatcttcgtagggctgagcctggtcacggcggggagcttggatctcctttacttcctcctgttccttattttctccagccgcatctacaccagcctttccacccccttggctttatggggggacttgctctactccttgcttgctatcaaacggctgcatgaggtctacgaagaaacacccatggggggaagtgatggggtggtcttgcagcattataccattgagtttgatcatgtcagcttcggctatcaggaagaagcggtgatcaaagacattagcttctccattccccagggcaaggtcacggcgctggtgggcccttccggcagcgggaaaagcaccctatccaagctgattgcccggttttggaatgtggacgccggcagcatccgcattgacggcacggatatccgcaaaatcgacccggaacgcctgctgacctggatatcctttgtgtttcaggatgtggttctgttcaatgataccatctacaacaatattgccatcggcaaaagcggagcaacccgggaggaggttgaggaagcggcccgccgcgccaactgccatgattttgtctcccggctgcctgaggggtacgataccctggtcggtgaaaacggcagcactctgtcgggcggggagcggcagcgcatttccattgcccgggccctgctcaaggatgcccccatcatcctgctggatgaagccaccgcttctctcgatccggaaaatgaactggagatccaggaagccctctcccagctgatcaaggacaaaaccgtggtggtcatcgcccacaggctgcgcaccatagccggggcggacaacattgtggtgctggagaacgggcggatcgccgagcagggctccgggccggagctcttgcgggcaggggggctttatgcaaagttgttcggcatccagcaggaaaca

SEQ ID NO: 33430 - DNA, 1170 bp, Desulfitobacterium hafniense
atgcaggatgtagttattgtgagcggtgccagaacacctattggggatttcaatggagcacttaaagattttaaggccgtggatttgggaatgattgctctgaagggggcgcttcagaaatccaaccttgagccggctcagatcgaagaggtgatagccggccatgtctatcaggcgggatgtaaagggaaccccgctcgtcaagtggctatgggagtcggttgtcctgtagaaacagtggcggccactatcaatcagcaatgtccttcatccatgcgggctacagagatggtaagccaggaaattatgctggggaagatccagattggagctgctgtgggaatagaaagcatgaccaatgtgccctatctcctgctcaaggctcgcggaggctatcggatggggtctgatacccttcacgatggtttactgtatgatgctctgattgatgccttctataactatcatatggggattacggccgagaatctggcggagatgtacggcatttcccgggaagagcaggatgagcatgctttggaaagccaccggcgggcctgtcgggctctgaaagagggaaaacttaaagaagagattgttccggtggagatcgtaaccaagaaagaaacccgccttattgctgaggatgagcatcctcgtgaagatgtcacgctggagagctttgccaagctgaggccggctttccaaaaagaggggacggtgacggcggggaatgcctccagtctcaatgatggagcggtggctttgctgctgatgtccggggaaaaagctcaggagctggggtttaagcccttagcccgaattgtggccacggcgtctgcttccgtggatccaaaaatcatggggtttggtgtggtaccggctgttaggcgtgctctgaactttgcccggatggataccaaagatattgacctctgggaaatcaatgaagccttcgctgctcaattcctggcctgtaaccgggaactgaagctggatctggataaggtcaatgtcaatggctcgggaatctccctgggccatcctgtagggatgaccggtgcccgccttattttgaccttgatccaggaaatgaagcgccgccgcaatcagtatggctgtgcctctctttgtgccggaggaggaccggctatggcagtcgtggtggag

SEQ ID NO: 33431 - DNA, 870 bp, Desulfitobacterium hafniense
agattaaacgctgccattatcggtccgggcaatatcggtacggatctgatgtataaaattctgagaagatccgagtatttggaactgaaactggttgccggcattgttgccgaatccgaggggctgcgcctggccagggaagaaggcgttgcgacgagcgctgcagggatccaggctattctggacagaaaggatattgatatcgtttttgatgcgaccaccgcccacgcccatgcacagcatgcacccttgctgaaggacgccggaattatcgcagtcgatctgacgcctgcggcagtggggccctatgtgatgcccgtggttaatctggaggagcatatcgacgccatgaacgttaatttaatcacttgcggcgggcaggccacgatccccattgtttatgcgatcagcagggtggtccctaccgcttatgccgagattgtggcgacgattgccagtaaaagcgccggacccgggacccggcagaatattgatgagtttacgctgaccacggctaaaggtattgtggatattggcaatgctcaaaaaggcaaggcgattattttgctcaatccggccgatccgccgatgatgatgaacaatacgatttatgccttgatcgaccaggtcgacccagccatcgagcaaaagatcacagaatcggtggaagaaataattaaagaagtccaagcctttgttcccggttataaactgaaaatcccgccgatgtttgacggcaacaaagtaaccgttatgatcgaggtcgaaggttccggagattatttgccccagtacagcggcaatttggacttggaaacctgtgcggcattggccgtggctgagaaaatggccaagcacaaattggctgcg

SEQ ID NO: 33432 - DNA, 1251 bp, Desulfitobacterium hafniense
attcaaggtgaaatagaggtccctggagataagtccatatcccaccgggctgctttgttcggcgggatggctcagggtgaaacccatattaccaattttttgctgggacaggactgcttaagtacgctggcatgtctgaagacactgggtgtggaatgggaacgacgggatgcggaagtctggatcagaggccggggctttgagaattggcatgagccccaggatattttggatgtggggaattccggaaccaccatgaggctcatgctgggtgttttagcaggctgtcccttcagcgcgaccttaaccggggattcttccatcaggtcccggcccatggcccgggtaacccttcctttgcaggagatgggggctcgcatcctcggccggcaggagggaaaatatgcccccttgaccattcaaggcggcctcttacaggggattcaattccgttcacctgtggcttccgctcaggtcaagtctgccattcttctggccgggttaagagcaaaaggggagactatggtcacagaaccttgtctttcccgggatcatacggaacgaatgctgaggggctttggtgtggatctgaagagtgaagggcgcaccgccaaggtaaggggaggagccgccttatccgggcaagaggtagcggtgccgggggatatttcctctgcagcctttttcctggtcctgggaaccctcattccccaaggagaacttctgattaagaatgtggggatgaatcctacccgaacagggatcctggacgctctttggcaaatgggggcagatatccaggtagaagaggaacgggaagaatgcggtgaaccccgggccaatctgcgcgtacggccggcccagctccatggcatagagatccaaggcgaaatgatccccaagctcatcgatgaagttccagttctggccgtggcggccagccttgcccaaggtgaaaccgtgattcgtgatgctgctgagctccgggtcaaagagacggaccggatacagacggtcgtccagggcctgcaggctctgggtgccaacgctcaggagcttcccgacggcttgcggattcaaggggctaaaagcttgcgcgggggagccgctcatagtcatggtgatcatcgcctggccatggcttgggtggtggcaggcctgcttgccgaggaagggataagtctgcaaggcatcgaagcagcagaggtttccttccctaactttctggaactgatccatgagatagctgaa

SEQ ID NO: 33433 - DNA, 1011 bp, Desulfitobacterium hafniense
atgattatcgtattaaagcgtggagccggtgaggcagaggttcaggaaatcaatgagcgtttaagccaggaaggattcaaaattcacctctcccaaggggtggagaagatcatcatcggtgctgtaggggatcgctcacggctgaaagccctggatctggaagccctgccttgggtagagaaagtggttccgattctggcgccgtacaaacttgtcagccgtgaatttcagagtgggaataccattatcaagatcggcgattatgagatcggcggcgaagaaattcacgtgatggcgggaccctgcagtgtggaaagccgggcccagattatcgagactgcccatgctgttaaagaagcaggagctaccttcttgagggggggagccttcaaaccccgtacttccccgtatgcttttcagggcttggaagaggagggcttaaagcttcttgccgaggccagggaggagacaggattgctggttataaccgaagtagtggatgtgcgggatgtggaacttgtagcccattacgcagatatcctgcaaatcggggcccgcaatatgcagaacttcttcctcctgaaagaagtagccaaaaccaataaacccattctcttaaaacgaggaccctcggcaactcttgaagaatggatgatggccgccgagtacattatggatggcggcaactaccaggtcatgttctgtgaacggggaattcgtacttttgaaacctatacccggaataccctggatttaagcatggttcccgctcttcaatccctttcccatctgccggttattgtcgatcccagtcacggaaccggtcgctggaacctggtgcctcccatggccaaagcggcggtagcagccggagcggacggtatcattgttgaggtgcatccccaaccggagaaagccgtatccgacggcaagcagtccttaactccggataattttgcctcgatgatggcagagctggagattctggctcaggcactgggcagaccggtg

SEQ ID NO: 33434 - DNA, 1497 bp, Desulfitobacterium hafniense
ataggcttgctttcccccttggggctctatagtttggccgtcgctctcggtaaacatggcataaatatcatggctttattgagtttggcggccaaggtatatggtgaaaagatcgggttaatcgatgaaaaggaagagttgacctaccgggaactgtatgcccggtcccgccgcatcgctttgcttttgcaggagaagtatcagctgcaaagagggaataaggtagggttgatctgcaagaaccatacttctttgatcaaagccttattcgctgttgcccaatccggtgcggatatctatttgctcaatgcggaaatgagcagcagtcaattcaatcagttagcagagcaaattgacttcaacctggttatctacgattttgaagcaagccccttgctggaggcttcagtctatcaaaaaggtaagcttttgagctatcatgagcatttgccggcgctcaataaccttgctgagcaaagcttcccggaaaatctgcaaatccagccttcctcaagcggcaggctggtgatactgacaggcgggacaacgggaaaggccagggcagcggctcatcaaccttccctttacaactatctgaaccccttcctgaccttaatcaacaggttgaagcttacccattatcagaccgcttatatagccacccccctttatcatggctatggcctggcaattttactggtgttgatcaccttggggaaaaaggtcgtgattcaaaagggctttgatcaggtgaaagcctgtcggctgatccgcaagcatcaggttgaagtagtgaccgtcgtacccttgatgattgataaaatgctgaagcaaaatccggaagatttgcaatccctggcctgcattgtttccggcggggcggaactcaatcctaagcttacccgggagacaacggagaagctgggggatgtcctgtacaatctgtatggaacctcggaggcggggttaaatataatcgctaccccccaggatttaagctatgcggccaatactctcggtaaaatcatcaaaggtgttcggctcaaggtaatggatgataataaacatgaagtccccatcggcagtgtgggccaattctgtattaagaacgcctggtccatgggcaataaaagcgggccgtggctggaaacaggtgatttaggttatcgggatcatcaaggctactacttcttatgcggccgagtagatgacatggtggtttcggccggagaaaatgtttatcccgccgatctggagcaggtgctgagaaatcatcctcacatcaaagaggtggcggtcatcggcatcagcgatgaaagattcgggcaaagactgaagggttttgtggttagggaggaaggcgcctgcttaacccaggaggagcttttggcatggctgcgcccccgggtggcccgatttcagttgcccaaagagatagtctttgtccagcaactgccttatacacccttgggtaaaatcgataagcagcagttaagg

SEQ ID NO: 33435 - DNA, 707 bp, Desulfitobacterium hafniense
ctcgggcgctcaacagaagcaggctggaggccaagcttaggggcaagacaattctgatcaccggcgccagttccggcatcggggaagcgctggcttaccagttggcagatagtgagtgtcatttgattttagtggccagaacagaggccaagctcttccaggtcaagcagaacattgaacagaaaaaggctgcagtaagcattttcccggctgacctcagagagcctgaacaggtgaaagaattgctgaatttcattgagcagttgcccgctggtttggatgtgttcgtcaacaacgccggtttatccatcaagcgcgggattaaggattctttagaccgctatcatgattttaccagaaccatggccatcaattatttggcgccggtgcaattagccctctcccttattcccctgcttgagaaaaataagggacagatcattaacatatccaccatcaatgtcctgctcctgccgctcccccattgggccgcctatcaggcctcaaaagcggcctttgatacctggttccgctcggcggctgcggagctgaatgcgatgggcattgccacttcctcagtctatctgcccttggtcagaactcccatgatcctgccgaccaaggaatatcaaaaactgccggccatgagccctaagcaggcgggaaagattgtcgccaagctaatttatacacaaagatccaaatac

SEQ ID NO: 33436 - DNA, 1738 bp, Desulfitobacterium hafniense
gaactgaaacggatggccaatcaaatacgtcaggatattattaccatgcttgtgccggctaaatcaggtcatcctgggggcagcttatcggcagcggatatattggccgccctgtatttttatgaaatgaaagttaatccggaggatccccattgggcggagcgggatcgctttgtattggcgaaggggcatgccgcaccggtcctttatgcagcccttgctgaaaagggctacttccccaaagaggaaatcctgggactacggcaaaccggccgcatcctgcaggggcatccggatatgaggaaagtccccggtgtggatatgtccacaggctctttgggccaaggcctttccgcagccaatgggatggcccttgccggaaaagcggacaagaaggattttcgggtctatgtggttttaggagacggtgaaatggcggagggtcaagtgtgggaggcggctatggctgcagcacactacaagctggataatgtcaccgccgttctcgactacaatggtctgcaaattgacggaaccacagataatgtgatggcttctgatcccttggacgacaaatggcgggcctttggctggcatgtcatcgaggtggatggacataatatggaagagctgctggctgcttttgccgaagctaaaactattaaaggaaaaccgacgatacttattgcccggacggtcaagggtaaaggggtgtcctttatggaaaaccaggtaggctggcatgggaatgcccccagtgctgaacaagcagagcaagccttaaaggaattgagagaggaggcggcacgccttggctaaacaagcaacacgggatgcctatggtaaaactttagtggccttaggagcagaaaataaggatatcgttgtcctggatgcggatctgtctaaatctacgaagaccgcggattttgccaaacactacccggaacggttttttaatatgggaattgctgaagccaaccttatgggcacagcggcgggtttggcagcggcgggcaagatccccttcgccagcacttttgctatttttgccacaggacgggcttttgagcagattcgcaattccatcgcttatcccaaactaaatgttaagattgccgccactcatgccggtgttaccgttggggaggacggaggatcgcatcaggcggtggaggatgtggccattatgagggctgtacccaatatgaccgtattggttcctgccgatggggtggaaactcagcaagccatccgggctgccgcagcctatgaaggccctgtttatattcggatgggccggcttgatgttcctttgctttttgacgatcagtatcagttcgagatcggtaaagccaatgttcttcgggagggctcggactgtgttgtttttgctaacggggtcatggtggcggccgctttggaagctgctcaagaccttgaacaggaaaatatccgggttgcggtggttaatgtagcctctgtaaagcctctggatgtgcagaccatcgtcgcttgcgcccaaaagaccggtgcggcggtgactgccgaggagcataacattattggcggcttgggaagcgcagtagccgaagccttaagtgaacaggcgcctacgcccttggtccgggtcgggattaaggatacctttggcgaatcaggccgccccttggagttgctggagaaatacggcttaaccaaaaaggaagtggtggcggcagtaaaggtggctatagcc

SEQ ID NO: 33437 - DNA, 852 bp, Desulfitobacterium hafniense
atcgtgacccaaattcttaatgccaagccggtggttcaggccatgaaggagaacctccgtcaggaagttgcggccttgcaagcggaaggaaaagcgccgacgctgggaattatccgggtgggcagccgccccgatgatgtttactacgagaataatatcattaagaattgtgaaactgtaggaatcgccaccaagacctaccccctcgatctgaatatcagcatggaagaatttactgccgttatgactcaggtcaatgatgacccttctgtgcatgggatcatgcttttccggcctctgcccccacaattggatgaagaagtcattaagcacctcatttcagcggacaaagacattgactgcatgagccctctcaatctggagaaggtctttgaaggggatatgagcggccttttgccctgcacaccggcagccgtcatggccatcctgcgccattatgacattgagctgaaaggcgccaatgcggtggtgatgggaagaagcttagtcgttggcaagcccttgagcatgatgctgctccaggacaatgccaccgtgaccatctgtcattcccggaccaggaacctgccggaagtcgctaaaaacgcggatatcgtcattgcggccatgggcagagccagaatgatcgatgacaactatgttgcggaaaacagcatcgtcatcgatgtgggcattaatgatgccggtgacggcaaaatttgcggcgatgtggactatgatgccgtagtggacaaggtcaaagggatcactcctgtaccgggaggggtgggttcggtgaccaccaccattctcttaaataatttagtgagagcctgtaaaagccaatgatct

SEQ ID NO: 33438 - DNA, 561 bp, Desulfitobacterium hafniense
atgcagttgatagaacaagcaaaaatcagggaagcagtactcatgattttagaagcaatcggagaagaccctgagcgggaagggcttaaagatacgcccgaccgggtagccaggatgtatgctgagatttttagcgggttggcagaagatgcgggagtttatttggaatgtgtatttacagaagaacatgaagaaatgatcgtggtaaaggatattcctttttattcgacgtgtgaacatcacctggttccttttatcggcaaggctcacgtcgcttatattcctgccggcggcaaagtcaccggactcagtaaactggccagagtggtggaaagtatcgccaggcgtccacagcttcaggagcgcttaacccgggaaattgccgatgtcattatgaaaaagttaaatccccagggagtggccgtggttgtagaagctgagcatttatgcatgagtatgcggggcatcaaaaaaccaggctccaaaaccgtgacttccgcagtgcggggcctgttcaggaaaagtgccaaaaccagagcggaattcttatccttgattaaa

SEQ ID NO: 33439 - DNA, 549 bp, Desulfitobacterium hafniense
atggccaaacaattgggtttctttttggatgtgaaccgatgtctggggtgcggagcgtgcatcaaagcctgcgccaaccataaccgcctgcctccttccctgacctggcggaaattgcggcaggtggaagatgtggattatgaccggggtcagatttcccgcttttttctctccacagcctgcaatcactgcgccaatcctgaatgcctgcgggtctgtccctacggagcctatgccaagcggcgggacggtatcgtccttcattttccggacaaatgcggttcctgcaaatcctgtgtggcctcctgccctttcggcgctccccaaatcaatccccagaccggcaaagccggcaagtgtcagctttgccatgagcggctggataaagggaatgcaccctattgcgtgcaggcctgtgtcaccggagccttgcaactcagagaaattcagggcaatccgacggacaggattctgcgcctgacggctcctttgccgacgttgcgtttaacaaaaccctccactttttattacccgcccagaggaacaaaa

SEQ ID NO: 33440 - DNA, 867 bp, Desulfitobacterium hafniense
atgttcaagcttcatggtatatatgctcccattcctaccccctttaaggataataaaattgcccttgatgagttggccggcaatatggaattctggctggcttcccaactggagggaattgtggtcatgggctccaacggtgaatttatcatgctcagtccggaagaaaagtgtcaactcatcactgccgtctgcactcaggcaaagggtaagaaaccggtcgttgtcggaacggggtgtgagtccactcaggaaactattgagttcaatcattttgccgccggagcaggggctgacgcagccctggtattaagcccgaactacttcaaaaaagccatgaatgatactgtgctgaaaaagttctacctggaagtagcagaggccagcccgattccgatcattctttataatatgccagggaactccggcatcaatctttccgccaaattggtagccgaactggctgaccaccctaatattatcggaatcaaggattcgggcggcaatattgtccaaatcgcggaaattattcactccgcaccggatgactttgcagtttttgccggttcggccagctttctgttcgccagcttggccttaggagctgccggcggaaccctggctttggccaatgtgttccccaacgagtgcgcccggcttcaggagcttgttgacaagggtaaatttgctgaagcaaaggagctgcaattgaatttgatcgaagccaataatgcagtaactacccgctggggtgtcggtggtttgaaagcggcccttgagctgattggtctgtatggcggtgaaccccgcaagccgttgatgcccttaggtgacgaagacagggagctgctggcggccattattaag

SEQ ID NO: 33441 - DNA, 1224 bp, Desulfitobacterium hafniense
attcgggacatcggattggcaccgcaaggacaattaaaaatcgattgggtgcaggcccatatgccggttctcaacaccttaagagaagagtttgagaaaacccagccttttcaaggcaagaaagtgaccatttgcctgcatttagaagccaagacagcttatctggcgaaagtggttcaagcgggcggagctgaagttactgtggcggccagcaaccctttatccacccaggatgatgtggtggctgctttggtagccggcggtgtccatgcccatgcctggtatggtgctaccgatgaagagtaccatcagcacctgcacaaggctttggattttgagccggattatattattgatgatgggggagatttggtatccaccctgcacaaggagcgccgggagctgctgcctaaggtcctgggaggtgctgaagagaccacgacaggcatcctcagactgcgcgccatggagaaaaacggtgaattggccttccccatgatggcggtcaatgatgctgagatgaaatacctttttgacaatcgctatggcacaggccaatcggtctgggatgggatcatgcgcaccacgaatctggtggtggccggcaagacgatttgcgtagtgggctatggctggtgtggcaaaggtgtggctttacgggccaaaggcttaggtgcccgggtgattatctgtgaagtcaatccgattaaagccaatgaagcttggatggatggcttcgaagtgatgcccatgttggctgccgctcccttaggcgatttcttcgtcacagtaacgggaaataagaatgtcatctcaggtgagcacttccaagtcatgaaggatggagcaatcctcgccaatgccggtcacttcgatgtggaggtcaataaagtccagttggcggctatggcccaaagttgtcatgaggttcgccgcaatattgaagaatatctgcttcaggatgggcggaagatctacctcctggcagaaggacgcttggtcaatttggcggcaggagacggtcatcccgccgaagttatggacatgacctttgctttgcaagccttggccttgcattatcttgctacagcaaaaacccccctggagcctaaagtttactccgtccccacggaaatggatatgcgagtggccgagttaaaattaaaaaccttaggtttaagcatcgatcaattgtctgaggaacaaaaaagctacctcgccagt

SEQ ID NO: 33442 - DNA, 2253 bp, Desulfitobacterium hafniense
ttagaggatttgaacccggttcagcgccaagcggtagagcatcgggaaggtcccctattaatattagcaggggcaggctccgggaaaacacgggttttaacttaccgtatcgcccatttaatcgcccaaggcgttgagccctggcacattctggccattacctttaccaataaagcagcccaggaaatgcgtgaccgggtctacagcctggtaggcagtgaagggagagggctttgggtagcaacctttcactctgcttgtgtgcggattttaagaagcgagatcggctatttgcccggatattcgcggagttttgtcatttatgacagtggggatcagctggcattgatcaaatcctgcatgaaagaactgaacctggatgagaagaaatttgcaccccgggctatcgaagcggtgatcagtgatgccaagaataagctgctgacaccggaggatttttcccgccgggccaaggattattttgagcaaaaggcagaacgggtctacgaactgtatctaaagaagctcctggccaataatgctctggatttcgatgacatcatcatgctgacggtccggctgttccgggagaaccctgaagtattgtcccagtatcaggataaattccgctacattcttgtggatgagtatcaggataccaaccatgcccaatacgctttggtcaatcttctggctaagaaataccgcaacctctgtgtggtgggggatgacgaccaatccatctatatgtttcgcggggccgatgtgcagaatatcctggattttgaacgggattatcccgaagccaaaaccttgaagctggagcagaattaccgttcaaccaaatctattctccaggccgccaattcagtggttcagaacaatacggagagaaaagaaaaatccctatggacggaaaatgaggacgggcagcctattgtctattacgtggcagacaatgagcatgatgaagcccgttatatgggtgagcgcattcaacgcctgctcaatgtggaaggtcgcaaatttaatgagtttgccgtactttaccgcaccaatgctcaatcccgggttattgaagaacgctttatgaaggaaggaatcccatatcggattttttcgggacttaagttctacgaacggatggaaatcaaggatatcctggcttatctgcgcattcttcataacccggcggatcaagtgagcttttcccgggttttgaatgttcccaagcggggcttgggagagagcactttagaaaagattctcgattatgccaatgaacaggagatgcctgttctggatgcgatcatggaggccgactatatacctgagctgcagtcacgggccaagaaacctttgctggcttttgcccacctgatgcaagagctcagggccttagccgccgcggagagctcagtaaccaaattggttgaagaagtattaaaacggaccggatattgggataatctggttagtgataaatcgccggaagcggaagcccggctggaaaacctgcgggagtttttatccgtgaccgctgaatatgacgagaaagcggataactacgaaaccgcggtggtccaggaggggattgaggatgccctggttcccggactgacagggtttttggagcaagtgtccttagtagctcagatcgactctttggatcaggcagatgatgctgtggtgatgatgaccatccacagtgccaaagggctggaattcccggtggttttcctgggcgggatggaggaaggaatcttccccagcagccgctccatgcttgatccggtgcttttggcggaagagcggagactttgctacgtggccataacccgtgcccgggagcgtctctatctggcctatgcccagcagcggatgctttacggaagaactcaatacaaccgcccttccgagttctttcaggaaattcccacccatgtcctggtggaccgggatcctattgatcccccgcccacccgggcccagaaggcccattcagctgcggcaaggccggcagcgacgccctcgggaggcccatcaccctggagaaccggggagagaactattggcaatcccgtccaggatgcccccggggtggactataaagtgggagaaaaagtggaacatgccaaatttggcaaaggtgtgattgtagctatcaaaggcgaggggagttcggctgaactttccgtggtctttgggggcgagatcaagaagcttatggcggaatatgccaggcttgttaag

SEQ ID NO: 33443 - DNA, 558 bp, Desulfitobacterium hafniense
atggctgactatgtaatgttcattgaccccaaccgctgcacaggctgcaatgcctgccgaatcgcctgccagacccagtgggggttagcgccaactctgaagtttaacagcctcatcgaacaggagacagggaaatatcccaaggtgcagcggctgattacccccgttcaatgtcagcattgtgacgacgctccttgtcaaaaggtttgcccaacgggggcgacttacaagcgggaagatggaattgttttaattgacgcccagaagtgcattggttgtaaatattgtatggtagcctgcccctataatgcccgggtcatcaatgagcacggagtgccggagaaatgccgcttctgtgccgagtatgtggtcaatggggaaacaccagcctgcgtatccacttgtatgaacgatgtgcgcgtttttggcgacctggacgaccccggcagccctcttcatgaactgctcaagaaccaagaccttatccaactccgggctgatctccagaccaagccgagaatctactatgccaagagtaaacgtatttaaggaggtgag

SEQ ID NO: 33444 - DNA, 2151 bp, Desulfitobacterium hafniense
atatcacgtcggtcgtttctaaaacttgctgctgcgaccacgacagccgttgctctgccccaagcattgaagatggatttccaagcttttgccgaagaggctaagcatgcagaggtcacacgggttccatccctttgcaatggctgttccagctactgtggagtgtgggcctatgtgaaaaacggcagattgtggaaaattgaaggcaacgacattcatatgaaatccagagggcatatctgtgcccgggggcatggaattgctcagaatgtgtataaccctggacgggtaactcagcctatgaagcgtgtggataacaaaaacaatttccaacccatcacctgggaggaggccttccaggaggtgggtgcgaagatgaaagccatcgttgaagaacatggcggcgacaagatggtctgggcctgccatgggggcaaggaaagttatgcccagcaattcatggatatcatcggttcttctacctatataactcattatgcgacctgcttttcagcaaaaaccaacatctggcaaaacatggtgggcggtatgtttaatccggacttcgatcaggccaaaaccatgctctttgtaggcagaaactatgccgggggaattattcccgctgctatgaaacggatcacggaagccaaagccaaagggggaaaaatcatcgttgtcgatccccgcttctgtgaattggcgaccatcgccgacgaatggattcccattcggcccggcacagacctggctttctttttaggaatcgcccacaccttgattacggaaaacctttataatcagagttttgtggagcaatatgtttatggctttgacgaattctggatgcataataaggacttcagtgccgatcaggcagccacgatttgcggcatcgccgccgataagattcgtgaagtggccagggaattggccggaagtgctccccatgctttcctggatcccggctatcacggattggccgcccattaccaaaactccaatgagaccatgatgctcaatattattatcaatgctctgctgggcaacttctggaaagccggcggattgttccccgccgccagtaccacctttggtcatcctgaggccacctattacggacctgtcgccgctaaaggaatccgagccgacggagccggtgaggtaggagaatatcccttagtggaaccttcccggggtattccgcaaagaatccccgacatgatcgaaaaaggcagagccagaatggtgttcttctactcctacaaccctttgcgctcagctcctgagccggaataccaaaagaagattaagaatgcggatttagtggtaagcattccctatgactggaatgagacctctctctacaccgcccattatattttgcctgagaaccactatctggagcggacggaacatcccaaggtcatcaatggcaatatctattggccggctactcaagtggctacccgctttaaagctctggagagcaccacttcaagcctcgatctgttggatattatgaaaggcttgaccaaggcttatggaatcgaaaacctctacggctataccgtggaggaagaattggaggtggctctgggtcccattggggtcagtgtggatgagctgcgggaaaagggctgcatcgagctgatgccctcagtgctgcctaaagaggaaggcttaaccttcggcacctttaccggaaaaatagagttctctataggagcctggagaaaagaaggatacctgggtgtacccacttgggtgccccctctagtggagccggcggaagtcaaccaatttcgtctgattcatggcaagcaaccctggcattcccacatcatgaccaccaacaacccctatttaatggccattaccgaagagaaaaagggaacctatatgtggatgaacagttcccgggccggtgagttaggtatccaggagggggattgggttacagtgtccagtgatataacctccaaacaggtgcaggtccatataacggaaggccttcacccggaatgtgtttggctgccctcaacctacgggaccttttctgaaaaactggaacttggctatggccagggtgtgaattacaacgattttattcctgcccgtatcgataagaagaccggtcatgtgatggga

SEQ ID NO: 33445 - DNA, 2664 bp, Desulfitobacterium hafniense
gaatggcttaacttaactattgacgaaaaagaagttgtcgtacccaaagggagcacggtcttggaagcatgccgtatgtacgatattccgattccaaccctttgccaggatccggaactcaccaatgccggagcttgccgtctctgtattgttgagatcgcaggtatgcgcaatctgccgccttcctgcgttacccaggtgacccaggggatggttgtgaagacccagacaccaaaggtgcgcaagtcccgcaaggtgattctggagctcttagtggcgaaccaccctttggattgcatgacctgtcagaaaatgggagactgtgcgctggctcagtatgcctatgaatatggtgtgactggcgaagattaccggggagaacggcgtgagctgccccttgatgacagcaacccctttattctcagagatccgaataaatgcattctctgcggcaaatgtgtgcgggcctgtgaagagattcaggggcgaagtgtgttggatttctttaaacgggggtttgactcccaggtgggaccggcctttgatgttccttatagtgaatcggaatgcgttttctgcggttcctgtgtttcggtttgcccagtgggagccttggtggagaaaaagatggtcggccaggctcgggcctggaacatcgaaaaagtacagaccacctgccctttctgcggcacaggctgtaattttgacctgaatgtcagcaatggcaaagtgatcggggtaacctccaatccggagtcaccggtgaacggtaaagccctttgtgtcaagggccgttttggcatggatttgatccacagccctcagcgcctgaccactcccttgattaaaaaggatggagaattcgtcccggcaggctgggatgaagcccttgatttaattgccgcaaagttctcccagattaaagaggattatgggccagattcttttgcagcactcagttcagcccgctgtaccaatgaagaaaattacctgatgcaaaaatttatgcgcgcagtgatcggaaccaataatgttgatcactgcgcccgtacctgacacgctcccactgtggcaggtcttgccacttcatttggttcaggagcgatgactaattctatcaacgaaatccctaatgccgaagtcatgtttgtgattggttccaatactacagaagctcatccgattatcggcaccaagatgaagcaggctctggcccggggagccaagcttattgtagctgatccgcgggagatcgaactggccagggatgctcatatctggatgagattgaaaccaggtacggatattgccctgatcaacgggatcatgaacatcattgtcgagaacggctgggaggatcgcgcttttattgaggagcgaaccgaaggctatcaagaactcagggaaaatctcaagaaattcccgccggaagaagtcagcaaaatcactggagttcccgtggagctgatggcagaagctgcccgtctctacaccagtgtggagcgagctcagattttctacaccctgggaatcacggaacatgtttgtggtacggataatgttatgtccctggccaatctggccatgctgaccggaaatatcggcaaagaaagctccggggtcaacccgctgcgggggcagaacaatgtgcagggagcctgcgacatgggagctctgcccaatgtttatcccggctatcagagtgttaccaacccagaggcacgggctaagtttgaagaggcctggggagtttcccttaatcccaatcagggcttcatgattccggatatgtttgattcagcagtcaagaaggaattgcgggccatgtatatcatgggcgaagatcctgtgctgaccgatgccgacgccaatcatgtgcgtaaaggcctgaaggccttggactttctggttgttcagaacatctttatgtctgagactgccgaattggccgatgttattttaccgggggccagctttgcggaaaaggacggtactttcaccaataccgagcgtcgggtgcaacgggttaaccgggcgattaagcctatcgccaatacgaaggcggactgggaaatcatctgcgagctttccaaccggatggggtacccgatggcttacccatcgcctgcagagatcatgctggaggttgcctccctggcaccgcagtttgccggagttacctatgagcgtctgggcaaaaaaggcctgcaatggccggttcctcatgccgaacatccgggcacgaagttcctgcaccaagggaaatttacccgcggcaaaggcgtgtttacggtgattgagcatcaactgccggatgagctgcccgatgaagagtacccattcctgctgaccacgggccgcaagctgcagcattataacatctccacccgtttctcggcggcgctggatgagcatgcccccgaggaattggctgagcttaatcctaaggacgcccggcgattggggattcaggatggtgagaaaatcaaggtagtttcccgccgcggtgaggtagtgaccaaggtttgggtaaccaaacgagttccgccaggggtgctctttatgaccctgcactatagggagtcaccgaccaatgtcttaaccaatggggcgtatgataaagtaaccaagacctacgaatataaggtctgtggtgtacgggtg

SEQ ID NO: 33446 - DNA, 1479 bp, Desulfitobacterium hafniense
atgaagaagtacgtccttgccttggatcaggggacaaccagctgccgggccatcctttttgatagggaaagccaaatcgtcggcgtggcgcaaaaggaatttacgcaaatttacccccagcccggctgggtagagcatgatccggaagaagtatggagcactcaatacggggtcattgccgagctgctggcccgctatcaagtaaccagcgaagagattgcggggatcggaattaccaatcagcgggaaaccacggtggtttgggacaaacatacgggaaagtctgtaaccaatgcgattgtctggcagtgtaggagaacggctcccctctgtgatgaactaaagatgaaaggattagagcctttgttcaaggagaaaacaggcttagtcttggatgcctatttttcaggcactaaaatccgctggatcttagatcgggtgccgggtgcccaggaaaaggccgaaaagggcgagctgctctttggcaccatggatacctggctggtgtggaatctgaccaagggccgcattcatgttacagactactccaatgcctcccgcactctcctctataatattaagaccttggcttgggacccggatctgcttcaggtgctcaatattcctttagccatgctcccagaggtaaagccctccagcactatctacggagagacagccgccgagggccttttcgggcatcctattcctattgccggcattgccggggatcagcaagcagccctcttcgggcaggcctgctttgcaccggggatggccaagaatacctatggcaccggctgctttatgctgcttaatacaggagaagaactctatgaatcccggcatggcctcatcagcaccatcgcctgggggctcgatgaaaaagtaatctatgccctggagggcagtgtctttatggctggagcggtaatgcaatggctgcgggatgaattaaagcttattgaaaccgctggggattcggaatacttcgcaggcaaggttgccgacaatggcggcgtttacctggtgcctgcttttacggggctgggggcaccttactgggatatggacgctcggggggccattgtgggcttgacccgcggcagcaataaaaatcatatcattcgtgccgctttggagtccatggcttatcagaccagggacattctggaggctatggaggcggattctcaattgcctctccaacttctcaaagtggatgggggagcggtggtcaacaacctcttgatgcagtttcaggcagatattttgggtgtggaagtggaacgcccccattgtattgaaaccacagccttaggagcggcctatctggctgggctggcgataggattctggagcagcaaagaggaattaagagacaaggcaaaaatggaacgctcttttaaacctcagatggcagaggagcgcaaagaaaagtattatcaagggtggcataaagccgtcagacagatcatg

SEQ ID NO: 33447 - DNA, 2388 bp, Desulfitobacterium hafniense
gccaatgaagaaggaacatggattacagcggcttgctggcataactgcggcggacgctgcctgaacaaggccttggtggtggacggcgtcgttgtccgtcaaaaaaccgatgacacccatccggacagcccggattatccacagcaaaggggctgcgccagagggagatcccagcgccagcagatttttggcgccgatcgcttaagataccccatgaaacgcaaaaattggaacccaggggacggcggcaagagagagctccggggtaaagatgagtgggtaagaatttcctgggaagaagccctggatcatgtcgccgccgaattaaaacgtgtcaaagaaacctatggcaataaagccattctcgctaaaagcacgggtccggctcttaatgcttacggcggagctatgacctactggggttgtacttcagatggagcatggccaaaacctcagcaatttatgaacggcggccgttccagaggctccaacgaccgcttggatctgagaaactccaaactcattgtcttgtggggagctaatcccgtatggagcagtggcggcaatcctgcctataactttaaacaggccaaagaagcaggggccaaattcattatcgtcgatccactctataacgacacagcccaactccttgccgatcagtggattccggtaagacctggaaccgatacggccttattgttgggaatggcccattatatgatcaccaataacctccatgatcaggaattcctcgataaatactgcgtgggctttgatgccgagcatatgccggaaggtgctgatccgaaagagaactttaaggattatgttctgggaacctatgacggcacacccaaaactccggaatgggcttccgagcattgcggaaccgatccggatctgatccgctctttcgctcatgaggttgccgtgacgaaacccatgaccttcaccagttcctcggcagcggccagaacctccgtaggggaacaattctgccaggccttcctgaccgtgggctggatgaccggaaatgtagggaaaccaggggccagcgtctgctccaataaccgtcataatacccaaagctatggcggaccggctcttgtcaaagcgggaggtgccggcggcaaatctccggctaatcctgtctataaagagcctaccttccccggccccgatccttttaaaacagactggcatggcatcgttatcgacgaagcctgggacgcggtgatcaatggggagtacactgcaggagtaagaggcaaacagccctgcgatatccgcatgatttggaatatcggctcgggcaatgtgctcaaccagaataccgatatcatgaaaggaatcgaagccttccgcaaagttgaatttgtggtaacatcggcccatttccttaccgccacggcccaatatgcagatatcgtgcttccggctaccaccgagtgggaaagactgggcggtttcttaacgggcaacccggaaatgatcattttctacagccaaatcacccaacccatgtttgaggccaaagatgatgattggatgtatgccgagatcggcaagcggctgggcttggatcctgctgattttgatcccctttcccctgagcagaagctcttcaatatggtgtccggctgcaccgtgatgaaggaagacggctcaggctatgagaagctggtgaccattaccgctgaggatattgccgccctgggagtgaaagggactccccaggaaggccgcatcagctatcaagaatttaaggaacaaggagtctatcaggtgccccgttcccctggagaccaatacacctatattgactataaagacttcattgaggaccctgaaaagaacccgctgggcaccgaaagcggcaaattccaaatccacagccaaggcttggccgatacgatcaatgcttatggctggaacaccttagctcccatccctaagtatcaatatgttactgaaggttatgaagagaccttcgccaactttgagaagaaagagaagagcggctatccgctccagctcaccacgatccactatgcacgccgcagccattccaccttggataatatctcctggctcagagaggcgttccaaaacagactttatattcatcctgccgatgctgccgccagaggaatcgctaaaaatgatatcgtgaaaatcagcagccgtcatggccaagtgatccggcctgtgtatatcacagagagaatcatgccgggaacccttactttaggtcagggcgcttgggcggaagtggacgacgaaaccggtatctgtaaggcaggcgccaccaatgtactgaatggaggacttcctaccggacaaggggtgcaggcatacaacacatgtaatgttcaagtcgagaag

SEQ ID NO: 33448 - DNA, 1086 bp, Desulfitobacterium hafniense
gattttacttggaatttgtttaaggaaagcggtgccgataaggggaatgtcatgatctcagcaccctctgtctatctggccttagggatggctttaaatggtgccgacggagagaccagagaagccatgctcaaagctctgtctgcccaaaacataaagctggaggatcttaatgcaggtttgtccgcatggagcaattccttgatggataagaaaaataagactgatgtgcgtattgctaattcgatctggattcgcaatggttttgaggccgatccggcttttctgcagaccaatggggattattatcaagcaggcataagaagtcttgattttgccgatccctcggcccctaagatcatcaatcaatgggtggaagagaaaacagagggaaccatcgataagatcatcgagacgatggatgatgatttaatgatgtatcttatcaatgccatctactttaaaggggattggcaggagccgtttaaggcgggaagtacctatacaggaaccttcgccgctccggcgggcggtgtagaaactccatttatgagacgaagcggaaatatggattatattcaaaatcaaggggctacgggggtcattctcccttacgccgatgagcgctttgctttcgtagggatcttgcctgaagaagggaaatctccccgggattttatcaacacgaccactgcggcggatatgctgaaattaatcagcacgaaaaagatcaagaacgttgatctttctctgcccaaatttgccagcagctatgaaaacgaactgcgggatgaactcaatgccttgggaatggacgtagcttttgatcctttccgtgctgatttctcattaatgaataaggcccataacaaggacctttttatcgggggagtaaagcataaaacctatattaaagtggatgaaaagggaacagaagccgctgcagtaacaggagtggaggtcaacacgaccagtatgcccatcgatcttacccaagtcgtatttgatcggccttttgtctatgccatcatcgattggcagacaaatagcccgttgtttgtaggaatcatggaagatccaactatt

SEQ ID NO: 33449 - DNA, 1296 bp, Desulfitobacterium hafniense
gaggattttcattcctcaatctcctttgaccaacggttgtacaagcaggatattcaagggagcatcgcccatgcgcggatgctgggagagatcggggtcctgacctcggcagaagcacagcaaatcattgaaggacttaaaggcattttaaccgacattcgggagggaaaaatccaattcgagatcggggccgaagacattcatatgaatgtagagaaactgctcacggagcgggtagggaccgtagggaagaaagttcatacgggacgcagccgcaatgatcaggtagccctggatctgcgtctgtttctgcgggaagaaattgaccatacccaggagctgctgattgctcttctacggaccgttttggaccttgccaaagagcatcaggagacctatatgccgggctatacccacctgcaaaaggcccaacctatttcctttgcccaccatatgatggcctatgcgcaaatgtttctccgtgacttaggccggctaaaggatactcgccaacggcttaatgtatcccctttaggctccggagctttagcgggaaccacctttcccttagagcgggagatggtggcccaagagctgggttttgacggcatcacctggaattccctcgatggggtgagtgaccgggattttgctttggaattcctcagtgcggcttccatcttaatgatgcatctcagccggctttgcgaggaattggttctttggtccacgggagagtttcaatttgtgattatggatgacggttactccaccggctccagcattatgccccaaaagaagaaccccgatgtggccgaattagtccgtggcaagacgggccgtgtctatggtgatctagtcgctttgcttaccgtaatgaaagggcttcctttagcttataataaggacatgcaggaagataaggaacaggtttttgatgcggtggataccatccagaaatctctccttgtggtagagcccatgctccgcaccatgaaggtcaataaaaaagctatggctgaaggtgccaagggtggcttcaccaacgccacggatttagcggattatctggccaagaaaaatgttcccttcagagaagcccatgaaatcgtgggcaagctggtcctttactgttctaaacggggctgtggcctggaagatctcactttaaaggagttccaggagcattcggacgtatttgctgaagatctttttgaaagcatcggcattgagtactgtgtccgtcaacgccatattcccggcggtccttctcccgaaagcgtggctcaagctatt

SEQ ID NO: 33450 - DNA, 2169 bp, Desulfitobacterium hafniense
acagcgccgggctgccacaattcctgcggagtattgttatataccaaagacggtaaactggaaaaagtggagggagaccctctcaatccttttaacaatggcaagttatgcatgagatgtttgaacttagtggaagcggtggaccatcccgaccgcttaaaataccccatgaaacgggtcggcgaacggggtgaaaacaaatggcagcgcatttcctgggatgaggcctatgcaatgatttgtgaaaaggtaaattattataaaaagaattttggaccggaatccatcgtaggggttcacggtaccggccggaatattaactggcagctgcccatgctgtttaatgcgggaatccagacccctaatatttccactttgttcttttccggattcgcctgctatctgccccgtatcgtgggcagtaccgccgtcaatggggatttcatgatcgtggatgcttcggtgcagcatcctgaccgttatgccaatgctgagtggcaggcccccgaatgtgtgatcgtgtggggcaacgaccccttaaagagcaatgccgacggatttctgggccattggctggttcagtgcatgcagatgggcaccaaaataatctccgtggacccccgcctgacctggtggtcggccagagcggaagtctggctgcccatccgtccgggaaccgatgcggccctggccattggcatgctcaatatcattattgaagaggatctttatgatcacgactttgtggaaaactggacctatggttttgaagagctggccgcaagggtaaaagaatatcccgtggctaaagttgcggaaatcaccgggttaccggcggaaaagatccaaaaggccgcccgcctcttcgcccaggccaaaccggcggcgattcaatggggtctggcttttgaacagcagatatcctgtatgtccttggttttagcggtggccgatctcatcggcatcaccgggaatatcgatgttcccggcggaatgctgctggtcagacatgcctttaacgcccaccgtcattataattgcggcagcgagttcacccctccggaagtagccgccaagaaactgaatggggcagccaagggggttgccgagaacagtattgttccccatgctgattcggatgtcatcctgcgggctatggaaacgggcaaaccttatcccctaaagatgctttgggtgcaaagcagcaattcactggcctgtcccgccatggatgctccccgggctctggaggccatgaagaaaatggagtttattctcgtagccgatcccttcctgaccccgacggccgtagccgtggccgatatcgttctgccggtgggaatgggacctgagcgcaacagtgtccgcaactggtggacacccatgcgggcccagagcaaagtctgccaatactatgaagccaaaggggacgaggaaatcgtggtggaattcggcaaaaggctgaacccggaagccttcccctttgagaatgatgtggatctcctcaactggtatctgaccatggacggggattatccggggaattggagcgacctgcgtgagaagacctgggagtattgggattgggatgcggcctaccgcaagtatgaaaaaggcatgctccgtgaagacggtgagatgggcttcaatacccccaccggcaagttggagctggcccctctgatgtatatgcagtgggagctggacccccttcctttccacatcgagcccccggaaggaccggtgaccacccctgagctctacgcagagtatcccttgattctgaccacaggggcccgctcctatgagttcttccattctgaacaccgccagctgcccaccatgcgggaattccatcccgatcccctggtgaccatgcaccccgaggtggctgcagccaatggcatcaaagaaggggagtgggtctggatcgaaagcccccggggccgctttaaacaaaaagcctatctgacaccgggcatcaatccccaggttattaacgcggagcacggctggtggttcccggaacaaggtccggaaaattggttcggcgtattcgacagcaatcccaacaacctgacccgggccgaggtaaccgggcaaggtgggattggttcaccgatcaagagcatgctgtgcaaaatctataaagtcgaagaaggagtcaat

SEQ ID NO: 33451 - DNA, 897 bp, Desulfitobacterium hafniense
aaaatatcagtgatcggatccggattcacaggtacaacaactgcttttatgctggctatgaaagggttgggagatattgttttactggatacccaggcaaacgaaaatccgacgaaagggaaagctctggatatcatggaagccggtcctttgactcgttccagtgtccgcgtaacgggtacctcagattatcaggatacacttgattcggatgttgtggtgatcacggccggtatcgcccgtaagccgggaatgtcgcgcaacgaactatgcgatatcaatgctggaatcgtcacccatgtcgtccggcaggttgttcaacattcgcccaatagtactctgatcattttaagcaatcccgtggatattatgacctacgttgctttcaaagagtcggggtttaaacggaacaggattattggacaatcgggagttcttgattcagcgcgtttccgctattttgtagccagcgagcttaaggtatctgccgaagatgtaacaggatttgttctgggggttcatggggacgatatggtaccgctggtacgctattgttctgtccatggtatacccattcagcagctattgccggaagctgaaattgaaaaaattatggaacggacacgtcaggccggttcggaaatcgtcaatttattaggcaatggcagtgcttattatgctcccgctgccgccttaacagaaatgatcgagtctatcctgctggataagcatcgggtcatgccttgtatagttcacttggaaggtgaactgggctatcaagacctggtgctgaatgttcccgctgtgattgggcggcagggagtggaaaagatattgcccatcgatttactgccggaagaggaggacttgatcgaacgctctgttgcatccataaga

SEQ ID NO: 33452 - DNA, 1755 bp, Desulfitobacterium hafniense
agaatgagcgacttaccaaaaggggggagctttctcttcggggaaaccaggtttcaggatgtttttacccctgaggactttacccttgagcataagatgctttatcgaacggcgatgggctttgtgacggatcgcgttttggcggttatggaggagttggaagagaagcgggatggtctgaacaaacagcttatccaagaagctggtgaattaggacttaatgggctggatattcccgaggaatacgacggtttggatctggataaaatcagcaccaccattgtcgccgagtgcataggaaagggcggttccttcgccatgacccaggggggacataccggcatcggcagtatgcccatcgtcatgttcggcacccatgaacaaaagaaaaagtatctgccggggatcgtcagcggagaaaaggcgggggcttatgctttgacggaaccgggagccggctccgatgccatgtcggcgaaaacccgggcggatctgagtcccgatggcaaatattatctgttaaacggaaccaagcagtttatcaccaattccgcctttgccgatctttttattgtttatgccaaaatcgctggggataagtatacggcctttatcgtcgatgccgattccgaggggctgtccctgggaccggaagaaaagaagatggggatcaaaggctcctccaccaggcaggtcatcctggataatgtcaaagtacctgtggagaatattttgtttgaaattgggagaggtcatattgtcgcctttaacattttaaacttaggtcgttataagctcgctgccaatgccttaggagcttccaagcatgccttggaattagcggccgcctatgccaatgagcgcaaacagttcgggacccctatcgctaattttggcttgatcaaggaaaagctggcgaagatggccattaaaacctatgtgatggaaagtatgctctaccgtacgggaggtcttttggacgggatactccatggcttggatacttccggtgagaacgggggacaggttgccgccaagggaattgaggagtacgctctggagtgttccatgaacaagatttttgctacagaggcccagggctatgtggtggatgaaggtgtccaaattcacggcgggtacgggtattgctccgaatacagcatcgaaaggctttacagggatgcccggatttaccggattttcgaaggaaccaacgagatcaaccggacgattataccgattaccttattgcggcgggcggacaaaggggatttgcccctccaagaggctgtgcaaaagctgaaagagtacattgctgccgggggagcggcaagggaagatgaagccggattaatccaggcagcaaaggatatgttcctgctgaccatggctgccggcctgcagaagtacggaaagaatctccagaaggaacaagagattgtcggtaaactggcagatttggcaatccaggcttttgccatggagagcgcctggctgcggacccagaaggctgtagccaatgagggtgagactaaggcaaaactgaagagttggatgaccagtgcctttatttatggaacgataggataccttgagtccatcgccaaagaaatcttatccgctctggccgagggtcaggagctggagagcttgttgaaggatttgcaggcagtgacccaatgcactttggggaacaccatcgctctgcatagagatatcgctgcggcagtatccgaggcaggtaaatacgcggtc

SEQ ID NO: 33453 - DNA, 1332 bp, Desulfitobacterium hafniense
aaaatttcgatttccgatgtagtggatcaaataggcgtctcaaagtatacgtataaaacctactttttagtaggccttaccctcattttctgtggattcagctatatgattgtttcctacaccatgcctcagatgtctgcagaatggggactgaccaaggttcaaacggggagtctggcatcatggagtcttttggggctgatggtgggcggaatgatcgcaggaattatttccgacagtattggccggaaaaagggtctggccattttcaccatatggttttctttactcacctttcccatttattttgttaacagctttgaagcttttgctattttaaggatcttaggcggggttggctttggtgcttgcatccccatcgccattactttgatggcggagaatgtgcccacgaaaaacagagggtttttcatctcttccatcatgtccttctatgttttgggttgggtcgtggccggtgtggtggcgatttatgtggttcccacctttggctggagagtgtgttatttaatcggagtgcttcccgttctctacgccttcgttttaatggcggctcttcaagaatctccccattggttattaggtaaagggagagagaaagaagccattgaggttcttaagcgcattgagatggtaagcaaaggaaaagccaacgactatgctccgggcagcttgttcttgcctcctcgcccgaaaaaggttggcgttggagcccttttctcccgggagtatagccgggcaaccatggccctttggatcatttattttatgggttccgtggtgatttatggcatcaacggctggctgcctactctgcttgtggataaggggtacggcttggtcaaaggatattccttcgccgtcctgcaaaatgtttttggtgccatcggaggtctgtgtaccggttatgtggcggatatcatcgggcggagaaccaatgtgattatcggttggatagcgacagcggttgccatacttctgctgggggttgcctcaaatcagtggatggtagtgatctgtgggatgttggttggcctggctatgaactggggtctgagcggaacacagcccctgctggctgaggggtatcctacggaattccgaagtacgggggttgcttcggctcaggctttcggacgggttggaggatttcttggccccatcgttgccgggtatgttcagcagctgggggtaggcttcacaggcacctttgtcttctttgccgttccggcggtgattgcctcttttgtagccttattctttgtggttgaaaccaaaggaaaaagtatcgaaagaattagtgccaacgcc

SEQ ID NO: 33454 - DNA, 906 bp, Desulfitobacterium hafniense
agaagtattatcattgaacacaataacctgggcacggtcttaatgctgcaaaatgtggacgcgttgcaaaaaacagagatcgatgtgcgccagaaattaaacaagaaagggttagcggccaagtacacctttgatgcgatcatcggtcagagtgaggtggtccagaaaatcatccgcgtagcccaaaaatatgctgttgccaactccaatgtgctgattatcggcgaaactgggacagggaaaaagctttttgcgcaaagtattcataaccacagcatgcggcaaaaccagccctttgtggccatcaattgcgcagctctccccgagcagctgctggaaagcgaactttttggctatgtggcaggagcttttaccggagctgccaaaggagggaaggtgggcctttttgaattggcccataaagggaccctctttctggatgaaattgccgaaatgcccatgggtttgcaggcgaaactcctgcgtgtcctccaggaacgggaaatccgtaagctgggagatgataagattatccccatcgatgtacggattatcgccgctaccaacgaggatttgcgcttaaaagtgcaagaaggtaaattccgccaggaccttctctaccgtatcgatgtgttgagtttaagcattccacccttgcgggagcgccgcgaagacattaaggccattgctaaaacctttttggctgaattttcccaaaaccgtcagcagtccatccgcttaagtcaggaagggctcatggaactgatgcgctatgactggccgggcaatatccgggaaatgcgcaatgtctgtgaacggctatccgtgctctctgagaacaaaaccagcggagttcacgaagtaaaagaagtattgaatataaaaaaagagccccctttgaatctg

SEQ ID NO: 33455 - DNA, 1008 bp, Desulfitobacterium hafniense
agaaggtttatggagcaagcctttaccgcctgcggggtatcagaagccgatgggcaaattgtagtagataacctgctctacgcggaactgcggggaatcaagagccatggtgtaagccgttttcctgtgtatttgcgacgcatccaaatgggcgcggttaaccctcagcctcaaataagcatggagcagaggactccggtacttcttaaagtggatggggataacggcttgggttccgtggttatggtgcatgctctgaaccggggtatggagctggctgagcagttgggaatctgtgccgtcgggatcaaagggagcaaccattgcggagcttccggctactattgtgagcttgccgcggagcaaggcctggtctccatcgttctaacggacggtcctccggctactccgccttggggaggccggaaggcttatttcggaacgaatccaatggcctttggcctgccgcgggcacaaaaacctcatatcatagtggatttggctacttcattggcggcccgggggaaagtcatccgggcggcggctcagggagagaaaattcccgaagggtgggctcttgatagggaaggcctgcctacgacagatccccaggctgccttggccggggttttactgcctatggcaggtgccaaaggctatgccttgagcctggttgtggagcatttggccggcgttctggtgggagccggtttcggcaaagatgtggcatggcaatacagtgaggggaacaaacccgccaatgtaggccattttattattttagtcaaggctgatgcttttatggagatggcagactatcacaagcgcacggaacagtttgttgaagagattaaaaagattcccttagctcctggcacgaaagaaatcaaactgcctggggaacgttcctgggaacaacagcaaaatacagaggcccaagggattatccttgacgctgacttgcaggcagccctgcaaaccattgctcaggagttaactattaattta

SEQ ID NO: 33456 - DNA, 888 bp, Desulfitobacterium hafniense
agaaaggtgcgcatcataggagtgcctatcgacttaggagcggatcggagaggggtggatatgggtcccagtgctattcgctatgcgggtcttcatgagcgcttaaaaaagctgggctgggaagtggaggatgtgggtaatatcgatgtaccgatcgccgagacccgggaaattaaagatcctctgctcaaatatcttcctgagatttcagaggtcaatcaaaagctctatcccctggtggctcaagccattaaggaggaggtcattcccttaattatcgggggggatcacagcttgggaataggctccttagcggggtgtgccgccagcggcaagcagtttggcgttatttggtttgatacccatggggattataattccatggaaaccacctccagcggcaatattcatggcatgcccttagctgtggccaatggtattggcgttaaggagttaaccagtattggcggagccgcccggaagatcaaggaagaaaacaccgtgattatcggggcccgggattttgacgatgaagagcgggctatgatccgccaatccgggattacagtgtttaccatgagcgatattgaccgcttgggtatggaggcggtggttcggcaagggctggaaatcgccaatcgaggtacccacggagtccatatcagctttgacctggatgtattggaccccagtgaagcccctggtgtgggaaccccggttcagggtgggatgacctatcgggaagctcatttggctatggagatggtcgctgattgccgatgcctgttgagcatggatgtggtagaggtcaaccccattttggatgcgcagaataagaccgcggaattagcagtgggtctcataagctcggcttttggacaaaaaatt

SEQ ID NO: 33457 - DNA, 3492 bp, Desulfitobacterium hafniense
atgagacccattaagcttaagatcaaagggctgaacagctttatcgatacccaggaaatcgatttttcccagcttaccagcagaggcttattcggtattttcggacccaccggcagcggcaaatccactatcctggacggaatgactctggctctttatggcgcagtggcccggggaagcaccaattatatgaacaccaactgcgaatcgttgcaggtcagctacgaattccagattgccgagaaggacaccaaaacttaccgggtggatcgggagtttcgcagagataaaaagtcaggcaatgtgcgtacccattcagccaaaattcttcttataactgcaggaggagagacggttttggaggaacaggtcagggaggttaccaaaaagagcgaggaaatcatcggcttgacccttgaggatttcacccgcaccgtggttctgccccaggggaaattcagcgagtttctgaggctggagggaagagaccgcagagaaatgctggagagattgtttaatttgcaacgatacggcgatgaactgtcctcccgcctaggagcaagaatcaggcaggagctggataaggccaatgtcctggcaggtcagctcaaatcctatgaagagtgcagtgaagagcttcttgaagcaaagaacaaggaattaagctcccttgaagagcggctggttcagttccaggccgaattaaaaaaggcggccgaggattttcacaacgggaaagaagtatgggagctgcaggaggaattaaaccggcaggaagttcaaaaaactgaacttgaaaaaacagaagctgtgattaaagaaagtgaaatccaagcgactctcggtgaacggtccctaagggttaaaccttatctggatcaatatgaagataccctggggaagatcgccacaactcaggtccaagtagcccaattagagggggacactgcagctttatctttgcagaaaaaagaagcagaggcgcaatgggaacaagcaggagctcaaaaagacaaggtgctccccgctttaaggctgcgtgagcagagtgctgccgacgctatcctggagaaaaagaagctggagagcctcatccaggaaaaaaagtctcttcaagagaacattggccggctggaacaagaacgggaggagaagcagggccgagtccacaagggtgaagagtttattgccaaggtcaatgctgatattcaggagaaagagcaaaaggtggaagctttaaccatcgaccaggagtttaagcagaaaatcaatgaagccctccttaccttcagccgttgggaagaagccgggcaacaggtggtcagcttaggctcagaagtcaaaatcattgatgagaagcttcaagaggctcaggaaaagggactgaaattttcacaagagctggaggccaagacggagatactccaaggatttgctttaaccctgcagaatttagaggaaacctgcccgggagactcggagaccctggttaccttgcaggaaaagctcaatcaagtcaaggagcaatgggccaggcatcacgagtattctgccgccatcagtcgtagcgaagcgggtattcgagatcttttgcccaagctggacactgcccaacagcaaaaagctcaattgacacagaaaatcactgagctggagagcgctctgaagaaaattgaaagagaaaacctggcctatgctttgcgtgtggccttggttgagggagaagcttgcccggtgtgcggatcaactcaccatcagcctgatcatgggaatgctgctgttggtactgaaaagcttgaagagatccaagctgctttaagggaaaagaaggagcatgagcaaagtctgtaccaggaaatgattcaggcccaggaacagatcaaaaccctggaaagcaccgtgaaagattgtagagaaaaaactgccgccttgggagaagcgtacaaagcctatgaccctgaggcgatgcagaaggaatttgagacattaagggacgggatatcccgctatacgaagcaaaaaggagaattggaagcagaaatcaaccggctgactcaagagaaaaaccagctggctataaagcttaatgagcaaaacaccattaaagcggaaacaaaggcccaactggagagcaggggaaagaatctcgaactggcaaaggctaaatacgaagcttatgagcaggagctaaccgctcttagggctgaactgaatatccaggaccttaagcaggagcaccaggagattgccgccaaggaaaaagagaaggccggactggagagtgagttgaaaggcttaagagatactttaaaaaaagctcaggctagaaaagaatttctcagcacggaattgtccgccctgacagaatctttgaaggaaagcctgggaaccctcaaagagaaggagagcagcatacaagacaagcatactgccataaaagccaaagtgggtgaggtggagaatatagagacctatcaaaaggaagtcctcagccaaataacccggatcgagcagatctatgcccaggccgaaacaaggaaaaacgagacggaaaaacagtacaacgagtgctatgtccgtctgcaatcagcacacaccagccggcaaggtctggcggaaagaagtcaaaaggataaagagtccctggataaggttttacaggaggaacagatcgagaatattgaagaagcgaaaagtcacctgctgagcagagatgagatagagaaactcaaaaagcaggtcaaggactatcaggattccctgactcagatctttggcgccattgggaatttgcaaaagaaacttggagggcggagcttgaccgctgaacgatgggagcagctgcaaaggcacaaggaagaaaaagaaatcctctgcaaagggctggaggagagcaagatcgagatcgagactcatgtcaagactatgaaggagaatttggtgaagaaaaaagacctcctgaagagtcaggcagagttggaacggcagctgggccttttgcgggatctggagaaattattcagagggaagcgattcgttgaatttgtggcggcccaccaactgaaatacgtctccatggaagccggtaaacggctcagagagattaccgggggcaactatggtctggaagtggaccagaacggaaaattcctgatccgggattataagaacggcggtgcccaacgggatgccacgaccttatccggaggggaaacctttctggcttccttatctttggcgttagccctgtccgaccaaattcagcttaaaggaacagcccccttagagttattctttttggatgagggcttcggaaccctggatgacaacctcctggaagtggtgatggactccttggaaaggctccaccatgaccggttatccgtgggcatcatcagccatgtggattcgatcaagaacagggtgcctgtcaagctcatggtcacacctgctcaagccgggctgggggggagcaaggtggccatcgaagtc

SEQ ID NO: 33458 - DNA, 1749 bp, Desulfitobacterium hafniense
aaaggcggcggcttcctgcttgccgaagtaactcccgagcaagtttatgtaccggaggaattaaacgaggatcatttacagcttaagaaaatgacccgcaactttgtggaaaaagaaatcgggcccaagatcgaagctctcgaagagcaggaagacggcctcatccgtgatttcatggcccaagccggtgagctgggactgctcggcttagaggttcccgaagaattaggcggcatgagcatggataaattctccactgtggtcgtcggtgaagaaatcccccgcggtgcttcctttgccgtagccttcatggcccataccggaatcggcaccctgcccatcgtctatttcggtaccccggaacaaaaggccaaatatctccccggtctggctaccggagaaaaaatcgccgcttactgccttaccgagcccggttctggctccgacgccttaggcgccaaggctacggccgttctcaatgccgaaggaacccactaccttctcaatggaaccaagcaatttatcaccaatgctggttttgccgatatctttctggtctacgctaaagtggagggcaagcttaccaactttatcgttgagcggacgatgcctgggctttccttcggaccggaagagaagaagatggggatcaaaggctcctccacccgccaagtcatcctggaagatgtggccgttccggtggagaacatcgtcggtgaattgggccggggtcatgtggttgccttcaatattctgaatgtgggacgtttcaagctggctgccgcagccatcggcagtgctcagcttgctttggaagtcactctgaaatatgcggctgagcgcaagcagttcggcgttcctttaagctccttcggcgctattcaaaccaaatttgccgaaatcgccgctcagacctatctggctgagagtgtggtctaccgtactgccgggctgatggaagaagcctgccaggatctggatgtcaccggcgattgccgtaaagaagccggcaaagctattgaagagtatgccattgagtgctccctgaataaagttctggcctctgaagtgctggatctggctgtggatgaaggggtgcaaatccatggcggctatggcttcattgccgaatatcccattgagcgtatgtatcgggattcccgcatcaaccgtctcttcgaaggaaccaatgaaatcaaccgtctgctggttcccggcactttgctcaaacgggcgatgagcggcgagcttcccctcctggcagcggcgaagaacgtcagcaaagatctgatgtccgccggtttaggttcagaggaagaaggattggcagctcttctgaatatgactcaaaaagctaagaagctttgcttaatggccgccggaattgccgcccagaatctgggcatggagctcaaagacaatcaatatgtgcttctgggcctggccgaaatggttctccaagtctacgctatggaaagcggtgttctccgtgctctgaaagttcaggatatggatgtcaccgaggatcataagctctttgtggaaaaggccgccaccctgggtgcttatagcgccatgaatatcattgagcagcatgctaaagaagtcatttgcgccgccgagcagggtgactccctgagcaccgttctggcaggaatgcgcaagctcttacgccgccccaccgttgatatgatcggacttcgccgggagatcgccaagctggtggtggaaaagggcaagtatccggtt

SEQ ID NO: 33459 - DNA, 1164 bp, Desulfitobacterium hafniense
atgaaagaagcattcattattgaagcgaaacgtactgccatcggcaaagctggccggggctccctggctcatatgcgtccggatgatttggcagcctttgttattcaggatgttttgaaaagtgcccccaatctaaattcggcagatattgatgattgtgtcatcggctgctccttccccgaaggagaacaagggatgaacatggcccgggtgattgccctgcgggcaggtcttcccatcgatgtatccggactcaccatcaaccgcttttgttcctcaggactgcaggctatctccctggcagcagacagaatccggctgggagaagcccatgccatgctggccggcggagcagaaagcatgtccgcggtgcccatgggcggcggcaaaccagcccccaatccctacatgatggagcattgtccggaagtctacctctccatgggacttaccgccgaaaatgtcgccaagaaatatgaaattacccgggaacaacaggatgagtttgccgcagccagccatcaaaaggcccacgcggcccaagtcggcggccgttttgaggaagagatcgtccctgtcctcatcgccagcggtaaaaagggagaggtatggttcagtaaagacgaaggaatccgtgccgatagtaccgtggaatccctcggcaaactaaaaccggctttcaaaaacggcggctgcgtcacggcggggaactcctctcagaccagtgacggcgccgcggccaccctccttatgtccgaggagaaggtcaaggagctggacctgaaaccccttgccctatggcgcggtttcgctgtggcaggagtcgaggcggaactcatgggaatcggccccatcaaggccatccccaaagttctcaagcaagtgggcttaacccttgagcaaatagacctctttgagctcaacgaggcttttgcctcacagtccctggccatcatcaagaccctgggcatcgacccggccaaggtcaatcccaacggcggcgctatcgctttcggacaccccctgggctgcaccggagcaaagctcaccgccaccctgctccatgaaatgaaacgccgcggtctcaaatacggtatggtgaccatgtgcatcggcggcggcatgggagccgcaggagtctacgagcttctgtagtgggacaca

SEQ ID NO: 33460 - DNA, 2391 bp, Desulfitobacterium hafniense
atgaatatggccatctataaagtggcggttttaggctcaggggttatgggaagcaccatcgcggcccatctcgccaatgccgggattcccagtatactgctggacatagtaccccctagtttgttgccggaggaagaagcggccgggctgaccttggcatccccccaagtcagaaatcgttttgccgcatccaacaaagccaaactcatcaagatgaaccctgctccgctgtttgtgccggaatttgcggatcgcatcgaagtcggcaattttgaggatgatctgccccgtttgcaagaagtggactgggttattgaagtggtcgtagagcgtttggacatcaaaatcgacctctttaagaaggtggcccagcatgtccgcccggggaccattgtaacatccaacacttccggtatttctttaaaatccatgacagaagggcttcctgaagaatttaccaagagctttttcggcacccacttctttaatcctccccgttatatgaagctttttgaactgattcccggacccaacacggatccgaccgttattcaggagatggaagagtttgccgagcgggtgctgggcaaaggggtcgtctatgctaaggatacgcccaacttcatcgccaaccgcatcggcgtctttggtttggcggcaaccatcagagagatgcagcgttccggcttaaccatcgatgaagtggatgctttaaccggaccggtgatgggacgtcctaagtcagcctccttccggaccgtggatatggtgggtctggacacctttgtccatgtcgccaataacgtgggagataatgtccctgaagaaaaagagttcttcgtcatgccggactttattcataccatgatcaaaaacggctggctgggagataagagcaagcaggggttctataaaaaagtcaagacagcagaaggcaaagaagtactggttcttgatccccataccatggagtatgttcccaagaagaaagtcaaatttgcctgcctggataaagccaagaatgcgggcggtcttaaagataagatgaaaaccttggtcaacggcaaagatcccggggctgaattcgcctggaatgtcttgaaggaagttctcctttatgcggcccgcctggctccccaaatcgccgatgatcttacagctcttgatgccggtatgaagctgggcttcaactgggaaatgggaccatttgagacctgggatgccttaggcgttaaagccaccgcggagcgcatcgcagctgagggcgggaccttgcctgagatcgtggcaaaactgctggctgaaggcaaagacagtttctatgagaagaccgaaggcggggacactctgtactatgccggaggcgaatataaggaaaaggccgccagcccctattccttctcccttaaaaaggcccataaacaaggcaaaaaaatcttcggcaattccggtgccagcttagttgatatgggtgacggtgtagcctgcctggaattccattcaccgaacaactccatcggcggggatatcatgaacatgattcacaagtccttggcagaggtggaaaagaactatttagggatggtgatcggcagtcagggtaagaatttcgccgttggtgccaacctgatgctgattatgatggaagcggaagaaggcaattgggatgacctggatctcatggtccgcgaattccaaaggggaaccatggccctgaaatacgccaagaagcctgtggtagccgctccctatggcatgactttaggcggtggaactgaggtttgcctccattcccatgccatccagcctgcggctgagacctatatgggcctggtggagctgggcgtgggcctcatccccggcggcggcggcaccaaggaaatggccctgcgcgctatggaaggaattcttcccggcgtggtcgttgctccggactatttcttcgccaaacgcttcgaagtagtggccatggcccaggtttccaccagtgcggaaatggccagaaagcttggcttcttaagggcaagtgatcgctgcagtatgaatgccgaccatgttctcctcgatgccaaggcccgtgtccttgatctggcaagagacttccgccccatcattcctcagaaggtcaaagcagcaggaccgggagtctgtgccttcctggaaatggccctgtatggcatgaaagaggggcgttatatctccgaatacgatgctcacttagggaaaaaactggcttatgccatgaccggcggcgatgttctggccggaactttggtggatgagcaatatctcctggatctggaaagagaagtgttcttaagccttgccggagaacccaagactctggatcgcatccggcatatgctcaccaagaataagccattaaggaat

SEQ ID NO: 33461 - DNA, 1296 bp, Desulfitobacterium hafniense
ctaaaagacaagctccaggaccattctgcaacagtgggggttatcggtcttggttatgtaggactccccttagccgtagaaaagggaaaagtaggcttctcagtcatcgggtttgatattaacgccgctcgcgtagctaaagtcaacgccggagacaattacatcgctgatgtcaaagatgaggaacttctggaactgacccaaaaaggaatgatcacagcgaccacggattacgcgaaactcgctgagtgcgatgtggttgtcatctgtgtccctacccctctgaccatcacccgggatccggatatctcctatattcaggcctcttccgagcagatcgccaaatacctcaagcccggacagctggtaactttagaaagcaccacctatcccggcaccactgaggaagtcattctgcccatgctggaacaaagcggccttaaagtgggcaaagactttttcctggccttctcaccggagcgggtcgatccaggcaacaaacgctttaccaccaacaatacctcaaaagttgtggggggtatgaccccagtctgtctggaagtcgcctataccttctatgctcagaccatcgtcaatgtggttcccgtatcctcaccggctgccgcggagctcactaaagtctttgagaatacttaccgtgccgtgaacatcgctttggtcaatgagctgatgctgctttgtgatcgcatgggcatcgatatctgggaagtagtggaggccgcaggaaccaaaccctttgggattcaaaccttctggcccggcccgggagtgggcggacactgcattcctatcgatcctttctacctgacctggaaagcccgcgagtacgacttccacacccgctttatcgagctggccggcgagatcaatgtcgaagtctcctaccatgtgatcaataaagtcattcgtgctctcaataatgaaaataagagccttaaggatgccaaagttcttatccttggggtagcctataaaaaagatatcgacgatgtccgtgagtcaccggcccttaagatcatggagctgctcaggaaaaacggagccaatatcgcctaccatgacccctatatcccggttatcgagcctcacggcggctccacagtccatctggaaaacactgagctgaccgacgaagccctggctgctgcagactgcgtcctcatcctcaccgaccacagtgttgtcgactatgagcgggtcgcagaaaaggcccccctcatcgtggatacccgcaacgccaccagaggcgtcgagaacaacagagaaaagatcgtc

SEQ ID NO: 33462 - DNA, 720 bp, Desulfitobacterium hafniense
aatcagacaataattaaggccaaagatgtttccatgtgttttcagatgtcttatgatcgaattcaaagcgtaaaagagtatattgttcaaacctttaagggaaaagtccgctatgaggaattttgggctttaaaagatatcaactttgaaataaagaagggagaagttgttggcttggtcggtagcaatggcgcaggcaaaagcacattgctaaagataatttctggcatattaaaacctacgagcggcaaaattcaggtaaatggaagtattgtaccaatgctggagctaggaagtggctttgattttgacctgaccggacgagaaaatatttttctgaatggagcagttttgggctatagcgaaaaatttctcaacaaaaagtatgatgaaattgtgagcttttctgagcttggtaaattcatagaagtaccgttacggaattactcctccggtatgatagccaggttggcattttctatcgctgctatggtcgagccggatattttgatcgttgacgaaatactcagtgtcggtgatgcagcgtttcaaagaaaaagtggtgaacgaatgaaagagatgatgaacggcggcacgacagtgttattggttagccacagtatagctcaaatacaggaactgtgcgacagcgcgatctggttgcagaatggtcaacaggttttgtcaggcgatgccgatattgtttgtggtaactatatc

SEQ ID NO: 33463 - DNA, 867 bp, Desulfitobacterium hafniense
acaatgaaggggattattcttgctggaggttcgggtacgcgattgtaccctttaaccatggtaacatcaaaacaattactgcctgtttatgataaaccgatgattttctatccgttatccacccttatgttggcaggaattaaagatatacttattatttcaacgccacaagatttgccgaactttgaacgactattaggtgatggtgcaaactttgggattaatctctcttataaagagcaaccatctccggatggtctggcccaagcctttatcatcggcgaagaatttatcaatggcgacagttgtgctatgattttgggggataatattttttatggtagtggcttgacaaagcacttgcgtgcagcagctgagcaaaaagaaggagccactgtatttggctattatgtggaggatccagaaagattcggtgtagtggaatttgatgaaaaagggaaggcgatttccgtggaggaaaagccgttcaacccaaaatcgaattatgctgtgaccggtctgtacttttatgatagtaaagtatgtgagtatgctaagtgcattaagccgtctgcccgtggagaattggaaattactgacttgaaccggatttatctggagaatggcagccttgatgtgattactctggggcgtggttatgcgtggctagatacaggaaccattgactctttgacggaagccgcagaatttgttaaagttctcgagactcgtcaaggtgttaaaatatctgccttagaagaaattgcttatcataatggttggattaccaaaaagaaattgctggaatcagcccaaaagtatgggaaagctgcttatggggaacatctaaagaaagtagctgaagga

SEQ ID NO: 33464 - DNA, 1263 bp, Desulfitobacterium hafniense
caacgaagtaaagaagcttttgcccgggccaatggcgtccttcccggcggagtcaactctccggtaagggcttttaaatccgtagggcgggagcccatatttatcgccaaaggacagggggcaagactatgggatattgacggcaattcctatctggattacgttttgtcctggggaccgctgattcttggtcatgcccacccggtggtggtgggggccattaaagcggccgcggagcggggaaccagctatggagcacccactgagattgaaacggaatgcgctgaagaagtgattaaagccttcccctccatggaaatggtccgcatggtcagctccggaaccgaggccaccatgagcgccttgcgcttagcccggggagtgacaggccgcaacaaaattattaagtttgaagggtgctatcacggtcatggtgattccttgctgatcaaagcgggcagcggggctttgacctttggcgtccccacctctccgggtgtaccctcttcagtagcttcacaaactattgtagctcaatataacgacctggaaggtttaaaagagatttttaaggaatgcggggaagacattgccgcagtgatcctggagccggtgaccgggaatatgggcgttgttttacctcaacccgggtttttggcgggcttgcggaccctgactcaggactatggcagcctgctgatctttgatgaagtgatgacaggcttccgggtgagttatggaggggcacagggccgctatcaaatcgatccggatttgacctgcctgggtaaagtgattgggggggggctgcctgtggcagcctatggcggcaaaaggaagtacatggagcaggtagctcccagcgggccaatttatcaagccggcaccttatccggtaatcctttggccatggcggcggggctggccactttaaagctcttgcagcaggagggggtctatgagggactggagaagaaaaccgcccgtttagctgagggcttgcagtccatcgctcaggaattagggttccccatctgggtcaattccgtgggagctatgttctccgccttctttaccgatcaacctgtaattgactttaaaagcgcctgctcttccgatgtggagcgttttggttccttcttcagaggcatgctggagcgggggatctacttagcgcccagccaatatgaagcggtattcctttctgccgcccatacggatgcagatattgactataccttggaacaggccagggatgtcctt

SEQ ID NO: 33465 - DNA, 954 bp, Desulfitobacterium hafniense
cgccccaggagattaagaagcagtgcagccatccgcagaatggtccgggaacatcatgtccggattgaggatttgatttacccgatgtttgtcacgtttggggagaagaaaaagatccccgtttcctccatgcccggagtgtataattactccttggatgagtatatagtggctctaaaggatgtggtggaggcgggaattccggctgtcttgctctttggtctgcccgagtccaaagatgcagcagggaccggggcctatgaccagcacggtatcatccaggaagctgttcgtctgaccaagaaacattatccggacctttatgtgatcaccgatgtctgcctctgtgaatacacggatcatggacattgcggagtgatccaggatggccgggtgctcaatgatcctaccctgaaattgctggctcagacagcggtttctcatgctgaagccggggcggatatggtagcgccttcagatatgatggacggcagggtgggagcgatccgggaagctttggacgaagccggctatacggatattccgattatgtcctatgcggccaaattcgcttctgccttctatggaccctttcgtgaggcggccggttcggcccctcaattcggagatcgccgcacttatcaaatggaccctcctaacggcaatgaagccatgatcgagacggccctcgatgtcgaggaaggggcggatatgctcatcgtcaagccggccctggcctatggagatatcacctatcggaccaaagagcagttcgggctgcccatcgtcgcctataatgtcagcggtgagtatgccatggttaaagcagccgctgagaaaggctggattgatgaaaaacgtgtggtcatggagagtctggtcagcatgaaacgagcgggagccgatctgattattacttatcatgccttggatgccgcacgctggataaaggag

SEQ ID NO: 33466 - DNA, 900 bp, Desulfitobacterium hafniense
agcgttaaaataggtacacgggatagtcagctggccctttggcaagccgaatgggtgaaaaggaaactggaagagtattacccggaaagagagtttgtcctggtccccatgaaaacaaagggagataagattcttgatgtcccccttgctaaaatcggcgacaagggtctttttacaaaagagttggaagttggtcttctcaatggggagattgattgtgctgttcatagcctcaaggatctgcctacggtcttgcccccaggattggaaatcgccgctttttgcgagagagaagagccgcgggatgtttttttaagtaaagacggcacgcctttagggtcattaccggccggctcaatcatcggcaccagcagtttaaggcgcaaagcccagctgcagaattatcgctccgatctgtcttttgcggatttgcgcggcaatctccagacccgttggcggaagctccaggagtccgatatggcaggtatcgttctggcagcggccggtgtgaaacgcttaggctgggaagaccggatcaccgaatacatctctgaagagattatgctttcagcagtaggccaaggagccattgctgtggagattgctgcccaacgggctgatgtcagggaaatgcttgacttgctgaaccatggggatacggaaagagccgtcaaagcagaacgggctctcctctaccgcttggaagggggctgtcagattcccatcggagcctgggctgtgacagagcagcaacagattgttctgaagggaatggtcgcttccttggacggtcaacgcatcctgaaggtcactctgtcgggagagcatcctgaagaactgggcaggcaagctgccgatctgctgattgctcaaggagccctggagatcctgcaggagatt

SEQ ID NO: 33467 - DNA, 1328 bp, Desulfitobacterium hafniense
  unsure (1)..(1328): unsure at all n locations
gtgtttccaatcactattgggttgaaccataaaacggctccagtagagattcgcgagaaggtcagctttcatccttcggagatcaataaagccttaatggaattgaatgaactatccgccttaaacgggatagtgttgttaagcacccctgcaatcgtttgggagatctatgccgccnactcccagaagntngggaactgggagtcagtgtgattaagaaatttctgggcccgngcatttgggaagcttcgcgaaagaagatattannatcaatanntctttatgtnnccatactctttatgaaattccgtanncgccatcttttccggtggtcgntnncgccggnncctggacntnnccatggtgaaatggnnngtgaanactccnananattncnncntngnngnngncncnnagngntnanngcggagngnncctacgaaaaatcatcacagcttaatctaagcaataaaattattcatgccatttttcaaaatgccttggcagtgggaaaaagggtccgctccgagacacaaattgaccagcatcccacctcggtttcttacacagcggtagagttggccaagcaaacctttggcgatgtgcaaggcaagagtattttgattttaggggcaggggagatgagcgctctgacggccaagcatttggtggccagcggagcggatactgtattggtgtccaaccgttctatgcagcgcgctcaagccttggcagaggaattctcaggaagagccattccttatgaagaattggatacggccttggccgaagccgatatcgttatttcggcaacggctgccgctcattttgtcatcaagccggagcgcatgaggcgggttatggaacagcgccggcagcgggctttattgctgatcgatatcgccgtaccccgggatattcatcccaatgtgggagaattagaaggtgtgactttgtttgacatcgatgacttgcggggagtagtggactcccatcaaaaagcccgggaggaagcagccctgcaggctgggaggattctcgaagaagagatgggacgctttgtgaagtggcataattctttgtatgtagttcccaccatcgttgctttgcagcgtcgtggggaggaggtccgggagattatgctgaaaagcgccttgaataaactgggtcctatcgatgagaaacaggagaagattatccggtccatggccaactccatcgtaactcatcttctgcatgctcctattgccaatttgaaggaagcagccaataccagccaaggtcatctttatacggaaatacttcagaatttatttgacttggatggt

SEQ ID NO: 33468 - DNA, 1347 bp, Desulfitobacterium hafniense
ttgaatttaggtcataaattgcttcagtatgaagctcagaagctgatttcctttcatactccaggacataaaggaaaagcggaattttttacggatttgcattttcccgatcaggatcttacagaactgccgggcttggatatgctgcactcccccgcgggggtgattgctcaggctcaggcccgggctgccgctgtgtatcaaagtgatgccagcttttatctgatcaatggggcaacggtgggcaaccaagggatgttcatggctttggccggtaccgggaagcggggaaaggacctgcagctgcctaaggttctggtggagaggcagtcccaccgttctgtgttttcggctttggtgttatcgggatgtgaaccggaatatatccccagtgtggttcatccggagttcgggctgcccttgggactgaaatccattgctgaagtggatttgggtgaatttctgggggttcatctgacctatcccggctattatgggaccttgccggatttggcaatgatcgcggcccaaagggatcgccaggcagttcaagtgagcattttggtggatcaggctcatggttcccattatttgagcccgctcttccccaaaggagccctggcttatggggcggatctggtgctgtgcagcacccataagaccttaagcgccttgactcaggcggcgatgcttcatgtacagggctcgcggattcccttgtccgctcttaaggaggctcttgagctgctgcaatcttccagccccagttatctcctgatggcttctttggaaagggctgtcgaacatgctttggaaagcaggcgctgggagctgcttcatgaagcggtgcaggaactgcatcaccgtgtgggcggatccttgcggatcttaaaccctcaggatgtagggacttacgggattgctggactggattggacgaagatcatgatcaatacccaaagactgggggttgcggctccccgttgtgtagagcatttgcgtaagagttatggaattgaccctgaattatgggatgacaaaaatattttatttctgttagggattggcaatactcccgaagaggtagagatccttaccaagggtttattaagcttagcaagcctgaacaaagatgtcgtggcatctcccgaggagatggttttcgagattcctctgccgccggtcagactcactccccgccaagcctattttgcccggaagcgcaagatcccccttgcggagagtgtggggcacatcgtgggtgagagcatttccccctatcccccaggcattccttggattgtgatgggagaagagatgactcctgagatcttagagcttctgacc

SEQ ID NO: 33469 - DNA, 1260 bp, Desulfitobacterium hafniense
ttaaacgaactaaagataatcaatccgattcaaaaggcgctggcagcgcaaggatattcagaggcaacccctatccaggctgaggcgattccgcacctgcttgaggggctggatttgttgggatgtgcccaaacaggcacgggcaagaccgccgcttttgcaattccgatcttgcaaagccttgccatggggcagggtttgctaaaaggcaaaagacagatcagagccttagttctcgcaccgacccgggaactggcgactcaaatcgcagagtccttcactgcttacggagtcaacctgcccctaaggacgctggtcatttttggcggtgtagggcaggccccgcaaacaaggaaactggaaaagggaattgatatcctggtggcaaccccgggcagactgcttgacttaatcaaccaaggatttatcgatttaagccatgtggaacattttgtgcttgatgagactgatcaaatgctggatatgggtatgcttcacgacgtaaaaaggattatcacttacctgcccagggaaaggcagaacatgttgttttcagcaactatgccggttgaaatagaaaagctcgcggataccatcttaaaaggacctgtgaagattgcaatgacgccggaattttctccgcttgatatcattgaacaggaagtttattttgtggataaggccaacaaggcggctctgttgacttattggctgaaaaacaacgaatatgattctgtgctcgtattttcgcggacaaaacatggtgcagataaaatagtaaaagaactgaataaaaagggatttacagcagtagcaattcacggaaacaaatctcaagccaacagggagcaggctttgcatgcttttaaaaaacggaaaacaagaattcttgttgcaacagatattgctgcccgcgggctggatatccaagaactttctcatgtcatcaattacaacctgccggaggttcctgaaacctatattcacaggattggtcgtacaggcagagccggcctcggcggcaaggcaattacgttttgtgactttgaagaaaagcccttattgcgcgacattcaaaaacgaatcggtaaaacattacccgaagtgaaggagcatccctatccattggtcaacaccgttatcgtgccaaaagcaaagacatctcagcaagcagctgcggcaaggcctcaaaagcccgccacagccaagacggcagcctattcccaacaaggtgcacatagagcaaagccaaatccccgg

SEQ ID NO: 33470 - DNA, 2164 bp, Desulfitobacterium hafniense
agctgctgcactgttaactgtacctcacgctgtcatctgaagggacatgtgcaaggcggcaaaatcgtcgccgtcacccctgggctcttgccggggcgggatgattatcccaatgcctgtctgcgtggaatgagttatgcccaacgcctgcaggaccctaaggagcgtgtactctatcccatgaaaagagtgggagagcggggagaagggaagttcgaacagattacctgggatgaggcttatgatatcatcgctgaaaagcttaccgagaccaaagaaaactatggaacacaagcggcatccttttttaccatgtcagggaatctggccaagctggcctgggaatccaccacccgtttaggtgcatgtttcggcggcacgacgtacatcacagaagggctgatgggggaccacggcgccagtatgggcatgaggctggtcttcggtcaggagcgtggcggccatgatacccgggactatctgaactccaaactggtgatcatctggggccgcaatcttgccgatacccataccagcgaattgcgttacatcattaaggccagggaaaacggcgccaaaatcatcgttatcgatccccgccaatccagcactgcagcggtcgccgaccaatgggtccccatccggcctcagactgatccggccctggctctgggcatgatcaactacctcatctcccacaatctgcatgacacagcctggcttaaagccaatagctgcgcccctttgcttgtgcgcaacgacaatggccaatatctgcgcctgggtgagcaatatgctgtttgggacgaaaactcccggaccattgtccctgcggatacccccaatataaatcctgcccttgccggggaatatacctctgccgagggcctgaaatgccatccctcctttgtcgatttggttgacgaagctgccaagtataccattaaagccacggctgaaatctgcgggctggaagaagcggttgtggagcaactggcccatgagtacgcgaccatgaagccggccggtatccgcatgggtcaagggatgcagcgggtgtatcattctttttcacccttccggacagtggccactttggcagccgtagccggttatatcggtgtttccgggggcggagcttcccatatgggcggaacctcttccatcaaccctattcccggtgttaccgtacctgatttcaattttaaggaatggaccgatattggcggcaaaccgattaccgagagaaaaagtgcccatatctatgatatggctgaaaaaggggaaatcaaattcctttggattggggtctccaactttgtcaatcaatctccggatgccaatcgcgtgatcaataaggttctgccgaacattccctttatcgttcatgtggatcccttctggacctggacaggcaaatatgccgatctggttctgccgggcaaaacccattgggaagtttgggacattctagtgcgctctccctgggttatgctcgatcagcccgctatccccaccatgggcgagagcaaatccgattgcgaaattgcttccggtgtcgccgaaagactgggtttcgggcatctctggaataaaaccgatgaggaatgggtgcgtacttttatgacttccgagcatcctgccttcgcttcctttaattgggataaattcgtgggagaagggattttcacccgctctgacggtatctttgaccctgtctattccttcaaggatcaaaagtataagaccccaaccggcaaattcgaattttacacggaaagactcaaagagctgggtgagcatgttccgacctataagcccatgctggagaatccccggggagaacttggcaaaaagttccccttggtgtgtatcaattatcatgaccgcctgaatgtccacactcagcacatgctttaccccgccttgcgcatcgtgcaatcagagccggaaattcagatcaatccggtggatgccgcagccaggggcatcacccatggggataaggtcaaagtcttcaacgatcggggccattgcgtggtcaaagcctttgtgacggaaggcattgtgcccggagttactgccatagccagcggttggtcgccggattactatattgaagggaatctgcaaaacttaacccacttaacccttaatccggttg

SEQ ID NO: 33471 - DNA, 549 bp, Desulfitobacterium hafniense
caatacggaatgttgattgacaccacaagatgcgtaggctgccaaacttgtgtcatcggctgtaaaatcaatcataaagtcccgggagacgctcattggagcagtgtggagatgatcggcagccggatcatgtatcagccggccggaaactatccgaatccggtgctggccttccggccccggctgtgcaatcattgtgcagatccggcctgcgttaagaattgtccgacaggagcgatgcacaaggacgataacgggctggtttcagtcaatcaggatgtctgcatcggctgtaaatattgtgtctggacttgtccctacgatgccccggaatttgatacagagaaaaaagtgatgagcaaatgcaccttttgcatggaactcattgccaagggtgaaaaaccctattgtgtggaatcctgtcccggggaggcgcggatcttcggggtgatcagcgatccggacagtgagatttcccgtcttatcgccgccaaacacgcccagccctttttgcccaaattcggaaccgggccgtccgtttattatgtg

SEQ ID NO: 33472 - DNA, 657 bp, Desulfitobacterium hafniense
cttttggcccatgtggtggaaaaaatcggtccggcgcggattgctctggcttccagcctttccattgaggatcaagtactgacccagatgctattaaagatcgatgcccgggcccggatcttctttatcgatacaggccggaattttcagcagacttatgatctgatggaagagaccatgagtcgctatgagtttcattatgaggtatacgcgccggagaattcggagctggagccatttctggcggaatatggccccaacgctttttatgacaaggttgaactgcgccaaaaatgttgtgagctgagaaaagtcaggtccttgcagcgggtcttatctaccgtagatggctggatttgcggactgcgcaaggagcagagccccacccgccaggaaatcggtttgctggaatgggattcccgccacgctatctataaagtgaatcctctggcggcctggagcgaagagcaggtttgggcttatatccgccgggaaaacattccctacagttccctatacaacaaaggtttccgcagcattggctgtcagccctgcacccgggcggtggcccccggggcggatgtacgcagcggcaggtggtggtgggaagatccctctaaaaaagaatgcgggctgcatccatccctgaacccgcct

SEQ ID NO: 33473 - DNA, 852 bp, Desulfitobacterium hafniense
attaaagtagaaggtgcattctataagtatccgggcgctccgcgggatgttattcaggacatcagcttcacagtcaggaagggagagatttttggctttctcggtccgtcgggagccggcaaaagtactttgcaaaaaatcctcacaggagtgttgagagactatcaaggccgggttcaggtcttaggcacggaaatgaaacaccgtaaaagttcattttatgaaaggattggcgtggattttgaattccccaatttctacggtaagtttacagccctggaaaacctccagtattttgcctccctttaccatcaaaaaaccctggacccgctgaccttattggagcaggtgggtctgcagcatgatgcccataaaagagtagccagctattccaaagggatgaagatgcgtctgggttttgtgcgctgcctgctgcacaatccccagctgctttttttggatgaacccaccagcggtcttgatcctgccaatgccagaatcttaaaggatatgatgctggagcagaaagcagggggaaaaaccatcattcttacgacccataacatgcatgatgccggggaattgtgcgatcgggtggcgtttattgtggatggtaaaattagagccctgaataccccccaggcttttcaggtggatcggagcggcagtgcggaggtcaattattcctatagaagggatggccgaacggtggacagacggagcaccctcacccaactgggccaggatgatgagtttgttaaggctttgcagaacggttcactgctaaggattcactccaaagagcggaccttggaggaggtttttatagctttgacggggaggcagctgcaa

SEQ ID NO: 33474 - DNA, 828 bp, Desulfitobacterium hafniense
tctattcaattgcttaacaaggccagacaaggacattatgccgttccagccttcaatttccataacttagagataatgcaggctatcattaaaacagctgaaaaacaacagtctccggtaattctccaaattactccaacctatctggaaaagatcggggatatcgctgcgacggcgatggcccgcgcagcagccaaagaggctaaagtccctgtcgctttgcatctggaccacagcaacagcctgtcgtggattaaatgggcattggctcatggttttacttcagtcatgattgacgcctccacacttcctttaaatgaaaatattgcctatgcccggcaaactgttgagtgggctcatgcacatggggctgcggtcgaggcggaattagggcatatcgggggaattgaggatgggcaggaaacgggaactaaccctaacatgggtctagccgaccctgtcgaagcagtcaagctggtaactgagagcggtatagatgcttttgctcctgccgtaggcaccgcccatggcttgtataaacttccgccgaacattaatttttccttgatcgatacactttcttccctagttaatgtaccattggttctccacggcggttcgggaattcctgatgatatgatccgcaaggccattgagaaagggattgccaaggtcaatatcggtacagaattaaaagtaacttgggccaaagccatgactgaagccctaatcaccgaacaggaaccctggaaaacagctctcaaggtgcatgaagaagtaggacaagtagttgcgcataaaatcagcttatgcgggtctaacggcaaa

SEQ ID NO: 33475 - DNA, 1353 bp, Desulfitobacterium hafniense
gtaattaaccctgcaaccggtaaagttttttgtgagataggatacggcgaggttgatgacgctttatcagccgtagatgctgctgatcgcgcatttggagcatggtcaaaaacatctgtacgggaaagggcagatatcttaaatcggacagcagaccttttgcggcaaagagcagatcacatcggcctgattctggctgcagaatcaggaaaacccgtccctcaggcagttggtgaagtgaagttttctgccgaatacttccaatggtttgcagaagaaatacgcagaccgtatggtcaatcaattcccagtgatgcagccaataaacggcatcatgtttatacacagccagcgggagttgcgctgtgcctttctccctggaatttccccgtctctattcaagcacgaaaattggctcctgctctggctgcaggttgcaccgtcgtggccaggggttccgaagtagctcccctgagcctcatagagctgtttaaatgtttgcaggatgcgggtattcccaagggagtagccaattcaatccaaggaccggctgcggtcacaacagcggcgatgatgaaacaccctgcagtacgtgtcgttagttttacaggctctactccagtgggacgcagtttaatgcgtcaagcggcagatggtgtaatacgtttagctttggagttaggcggaaatgctcctttcattgtctttgccgatgcagatatagaaaaggctgtggaaggcgccatgatagcgaaattcaggaataacggacaatcctgcatcggagcaaaccgtttttatgttcatgaaaggatttatgacaaatttacggctctttttgctgagaaaattttgcggatgaagattggcaatccgactgaagaggtagatcttgatctggggccaatggtaaatctaaaggacaaagcaagaatcgaaagcttaatccgtgaggcggaagcacttggagctaagcctttagtgcctaaagcagaagtgcctgccgagggctattatgttccgccggttattctggaaaatgtaccggaaagcgcagcgctcgccagagaagaattatttgcgccggttgcgccactatttaagtttgcagatgagaatgaggttattgaaaaagcaaatagttcggatatgggtttggcggcttatgtctacaccaatgatttatctcgatctatccgggttactgaatctctcaaattcggaatcattgggctcaataatgccttgccatcagtggcctatgcgccgatgggcggggtaaaacaaagcggcatcggacgggagggtgcaagaataggacttgaggaatttatggatgtcaagtatgtcgca

SEQ ID NO: 33476 - DNA, 1008 bp, Desulfitobacterium hafniense
atgagtgttcgcgttgccattaatggatttggtagaattggccggctgacattgcgggcgatcctgaagcaatccctcccggttgaagtggttgccatcaatgatttaggaagtccggatttattggctcatctgtttaagtatgattcgcttcacggaattctccctaattcagtggaaattgacggagatacaatgctcgtcgatggaaaatccattgctattttatcggagagaaaccctttggatctgccttggcgcaaactgggagtggatattgtcatcgaatcaaccggacgttttacaaagcgcgctgccgcgtctcaacatctgacagcgggggcaaagaaagtcgttatctctgctccggctaaaaacgaagacattacgattgttatgggagttaacgacgatcagtatcagccccaggaacaccatattatttccaatgcttcttgtacaacgaattgccttgctcccgttgccaaagttttattggatgcttttggaattgagcaagggatgatgactacgactcattcagttaccaatgaccaacggattttggatctggagcattccgactggcgcagatcccgggcagcctatcaatccatgattccgaccaccacgggtgcagccaaagcggtaaccttggttataccggaattagcaggaaaaatgaatggactggccgtcagagtccctaccccgaatgtttctttggttgattttgttgctaatctaactaaatcaaccagcaaggaaggggtcaatgctgccttgcgtgaagcggcagagggtaaattgaagggatatcttgaatatacagagctgcctctcgtttcccgcgattttaatggcaactcagccagctccatcgtcgatggcttatcaacgatgataattggcgagcgcatggttaaagtgttggcctggtatgataatgaatggggctattccaaccgtattgtggatctggtgaagttgattgtcatgaaaggtctc

SEQ ID NO: 33477 - DNA, 1908 bp, Desulfitobacterium hafniense
aatcttgaggctttgctggaagaggatagacagttcatccccagtgaggaattccacaaaaacgcactcattcaaagcgcggatatctatgaacaaggtcaaagcctcggcttttgggaggaacaggctaaacaactctcctggttgagcccttgggaaaaaaccctggagtggaatcctcccttcgcccagtggtttgtcggcgggaaactcaacgcctccgccaactgtctggatcgccacctccaggattggcatcgcaataaagccgctattatcttcgaaggcgaaaacggggacagccaggttcttacctaccaggatctccatcgtgaagtctccaaattcgctaatgtcctcaaagccaatggggtgaacaaaggtgatcgggtcaccatctatctgcccatgattccggaagctgtgatttccatgctggcttgcgcccggattggggctccccacagtgtggtcttcggaggcttcagttcggaagctttgcgggatcgggtcattgatgctcaggccaaagccgtcatcacttccgatggcagcttccgccggggcaacaccatccccttgaaagataataccgatatcgctttggacggcgtggactgcgtggaacatgtctttgtcattcaacgaaccaaacaaaccgtacaaatgaaggaagagcgggacctttggtatcatgaagaaatggccaaggcctccccggtgtgtccggcggagcccatggatgcagaagatatgctctttatcctctacaccagcggtaccacaggaaaacccaagggtgtagtccataccacggggggctatatggtaggggtatccaccacccatcgctgggtctttgatctcaaggaagaggatgtttactggtgcaccgcggatgtgggctggattaccggtcactcctatattgtctacggccccttggccaatggagccactgtccttatgtatgagggaagtcctgattatccgaaccgggatcggttctgggaaatcgtcgagaaatacaaagtcaccattctttataccgcacccaccgccatccggacctttatgaagtggggtccccaatatccccagagccgggatctatccagcctgcgcttgctgggctctgtgggtgaacccatcaatccggaagcctggatgtggtactacaaatacatcggcggggaacggtgccccatcgtggatacctggtggcaaaccgagacgggtatgattatgatgacccctctgccgggaattacttccttaaagcccggttcctgtaccgtacctttcccaggagtcagaatcgaagtggtggacagcgccggccatcccgtccccaagggaggcggcggctacctggctatcaaggagccctggcctgctatgctgcgcaatatctacggagatccggcgcgcttcgagcggacgtacttcggcaactggccgggagtctacttccccggtgatggcgccaagtgggataaggacggatatttctggatactgggccgggtggatgatgtcatcaacgtttctggtcaccggatcggcaccatggaagtggaaagcgctttagtggatcacccctctgttgccgaggctgccgttatcggtaaaaaccatgaagttaaagggcaggccctggcctgtttcgtcactttaaaggaaggcatcgaaatcactcccgatctggaggacgaattaaagaaacatgtggcaaagaagatcggagctctggcccggccggatgatatcttctttaccgccgaactgcccaagacccgcagcggtaagatcatgcgccgcctcctcagagacattgccgagggacgtgctatcggtgataccaccactttggccgatgcctctgtggtcaatacccttaaagccaat

SEQ ID NO: 33478 - DNA, 900 bp, Desulfitobacterium hafniense
aaagatttactgcatattgaagatttgcctgccaaggaaattcaactcatcctcaatacagccaaaccgatgaaagaaatcatgtcccgggcagtcaagaaactgcccaccttccgggggaaatcggtttacaacctgttttttgaatcctcgacccgcacccggacttccttcgagacggcggcgaagattctcggtgccgatacctccagcctggcggtggcccaaagcagtctcaataaaggagagaccctgctggatacagtgaggaccttgcaagccatgaaaccggatcttgtggtcatccgtcactccagttccggtgccgcccagtttctggccaaagagctcaaggccggtgtgatcaatgccggggatggccagcatgaacatcccacccaagccctgctggatttgtataccatgcaggagcgcctgggcagtgtggaagggcgtaaaattctcctggtgggggatatcctccattcccgggtagcccgcagcaatgtctgggctttgaagaacttaggcgcggaagtggttctggtggggccccccaccttgctgcctcctgaaatcaaatcctggggagtgaaaacgacctttaatctggatgaagaactgcccggaagcgatgtgattatggcgctgcgcctgcagctggaacgccagcagtcgggacttttgcccagcttgcgggaatactctcagctctatgggattacggccgaacgggtcaagaagacaggcaaacagaccctaatcatgcatcccggtcctgtgaaccggggcgtggagatcgagagcagcattgccaattccagtcaatcggtgattgaagaacaggtaaccaatggggttgcggtgagaatggccattatgtatttattattaggagga

SEQ ID NO: 33479 - DNA, 1074 bp, Desulfitobacterium hafniense
ctcgtattgcaggacggtacagcttttgaaggagaaaggtttggagcctggccggaagataaagaacaaaaagttcaagccggggaggtggtgttcaacacctccatgtcgggatatcaggaaatgattaccgacctttcctacacaggtcagattctggtcctgacccatccccaaatcggcaattacggctggcatgatgaagaaaatgaggcggataaaattctgctcagagggctggtggtgcgggagctttcccagggagaaggcagtgcccacggggatcgttctctggaagagttttgcaggctgcataacatctggggattgaaaggaatcgatacccgggccttgacccgccatatccgcaaccagggcaccctgccgggagtctttgcccagaccctggaacaaggaaaaaagtattggcaagagtacgccgacatttcctcggctgcggaaaaagagccccattgggtttatcaggctacagtcaaagagagttatgaaattccggggagcggtccttatgtggcggtccttgattgcggagcgaagcgcaatattctccgcgccctgcagcaaagaggattaagaatcagagtgttccctgcgtggagcagtgcggaagagattttagcctcttcccccaagggagtgttcatcagcaatggacctggggaccccagcggactgcccgagctgattgagacggtccggacactgctgccccagctgccgatcatggggatttgcctgggtcatcaaattctggccctggccgccgggggaaaaacctataaactccccttcggtcatcggggagggaatcatcccgtccaggatctgcgcacaggtcaaaccaccatgacggcgcagaatcacggctatgccgttgccgaagagtctatggccggaacaggatttcaaattatattgcgcaatttaaatgatggcacggtggaaggaatggagcatactcagtatcccgtttactccgttcagtatcacccggagggagcgccgggtccggaagagaacgggatgctctttgaaggattttttgccgcgata

SEQ ID NO: 33480 - DNA, 3129 bp, Desulfitobacterium hafniense
aataaagtgctggtgatcggttccggtcctatcgtcatcgggcaagcggcggaattcgattatgcgggaacccaggcttgccgggccttgcaggaagaaggggtggaggtggttctggtcaattccaacccggccaccatcatgacggaccaggaagtggcggatcggatctatatcgaacccctgacggtggaatttctggagagaattattgaaagagaacggcctgacggcatcatcgccaccatgggggggcaaaccggcctgaacctggcttttcagctggcggaaaagggaattctccagcgctgcggcgttcagctgatgggaacttcgctggatagcatcaccaaggcagaggatcgggaacatttccggagcctgatgagagagcttggagagccggttcctcccagcgttatcgtatcggatcttgaagaggccctcagttttggcgaggagatcggataccccgtgattgtccgccctgcctataccttgggaggcacaggagggggcatcgctcataaccgggagcagctcaaggaaatcgccaaaagcggcttgcaggccagccttatcgatcagattctggtggaaaaaagcgtggcgggctggaaggaaatcgaatatgaagtgttgagagatagtcaggggaattgcatcaccatctgcaacatggagaatatggacccggtaggggtgcatacgggggacagtatggttgtggctccttgccagaccctgacggatcgggaagttcaagccctgcgcacctcctcccgcaaaatcgtggcggctttaggtattgaaggaggatgcaatgtccaatatgccttgcatccggaacggctggagtatgtggtcattgaagtgaatcctcggctgagccgctccagcgccctggcttccaaagctacgggctaccccattgccaaagtggccgccaagatcgctttaggatacactcttccggagctgaccaatgccgtcaccggcaaaaccagcgcctgttttgaaccggctctggactatgtggtggttaaaatcccccgctggccttttgataaattctccgatgcggaccgccgtctgggaacccagatgaaggcgacgggggaagtcatgggcctgggccggaatctggagaccgctctgcaaaaggctgtccgttctttggaaatcaaagcctttggtctgctgctccccgaattccaggagcttaccgatgaagagattctggagcgctgccaaaagcctgatgatcaattgctgtttattctcgccgaggggttgcgaagagggttgagccttgaacagattcagaaggccagcagctggaacccttatttccttacagccattgaacggattgtcaggatgagtgaaaccctgcaattctctccctggaatggggagcttttgttaaaagccaaaagaatgggctttgcagatcgggagctggcccgcctctggcagaccacggaaaaagaaatatatgcttaccggcaggaaaaaggtttgcagccggttttcaagatggtggatacttgtgccggcgagtttgaggccttgaccccttatttctactccagctatgaccaggaggatgaaggaatacccacccagaggcgcaaggtggtagtcctgggctccggtcctatccggattggccaagggattgaattcgactattgctccgttcactccgttctggctttgaaaaaagccggtgtggaaaccatcattatcaataataatccggagaccgtctccacggattttgacaccgcagaccgtctctattttgagcctttaaccttggaggatgtctcagctgtcctggagcgggagcagccggagggtgtgattgtccagttcggcggtcaaacggccatcggtctggccaagcccttagctgaaagaggatataacatcctgggcaccggcattgaggatatcgaccgggctgaggaacgggggcaatttgatgaagtgctccataccatcggcgccaagcggcctaagggaggccaggcctcttccctggcggaagcggttgaagtggcagcccgcatcggctatcctctgatgatccgtccttcctttgtcttgggaggccgggccatggagattgtttactcagcctcagaactggaaaacgtggtgaaccgggccatggccgatttcccgggccaggagctatggatggatcagtacctggtgggcaaggaggtggaggtggatgccatctccgacggcaagaatgtcagcctgcccggaattatggagcatctggagcgggccggagttcactctggagactccatcgccgtctaccctccccagactttgtccgaacctttaatccagcggattaccctgctgactacggaaatcgcccgggctttaaatgtgattggcctgcttaacattcaatacgtcatctttcaggatgaagtgtatgtgattgaggttaacccccgctccagccgtacggttccctttatcagcaaagtgaccggactgtctatcgtggattatgccaccgaggtcattctcgggaagactttgacggaattggaactgcccttaggcttgtggcctctcccggaacgggtggctgtaaaggtccctgtgttttccttttccaaactccatcgggtggaaccctccctgggtccggagatgaagtccaccggagaagtgatgggagtggaccggacttatgaaaaagctctctacaaagccctcctggcgggaggattcaatatgtccgcccacggcagcctcttggtgaccttagcggatcgggataaggcagaggggatacccttggtcaagaaatttgccgacctgggcttccgcatcttagccacggaaggaacggctaaaaccctccgggaagaaggaattcaggttgcgccggtggccaagctccatcaggggtccacggaaattaccgatgctatccggcagggtgtgattcaatgtgtcctcaacactaccactcacaacaaaaagcaggaaagcgacggcttcgccattcgccgcacagcggtagagcaagggattccctgcttcaccagcctggacaccgcttccgcctgggttcatgtgctgatgtcg

SEQ ID NO: 33481 - DNA, 2301 bp, Desulfitobacterium hafniense
agcaaagagagagaattaccattgctccccttgagagggattttagtctttccatatatggttattcatttggatgtgggccgggagcggtctatggctgccattgagcaggccatgatggatgagcggctcattctgttgtctgctcagaaagagacagagattgattcgcctgaccccgatgatatccacaccatcggtactttagcagagatcaaacagctcctcaagctgcctgggggaactatgcgcgtcctcgtggaagggaagagccggggaaaaattcttgaattcataacggatgaaccttattttaaagtccgggtcgaagaagttgaagagggagtcaaagagaacaccccggaaatcgatgccctgactcatggggtcatccaccagtttgaagagtatgctaagctcagtaaaaaggttccccaggaaaccctgggaacggttctgggggttaacgattccgggcgtttagcagatattgtggcaagtcatttgaatcttaagctgggagataaacaggctattctggagtctctggaggttgcccaacggctggagcgcttgacggaaatcatcatgcgggaaaatgagattctggagctggagcgtcgcattggtctgcgggtgcgcaagcagatggaaaaaactcagaaggagtactatctccgggagcagatgaaagccattcagaaggaactgggagataaggacgaaaagcaggccgaagtcgaggaatatcgagaaaaggtcgctcaggctaagcttccggaagaagtggcagagcgggctttaaaggaaatagatcggttggaaaaaatgccccaggcttcctcagaggggacggtagtgcgtacttatttggattggattctggctcttccctggacgactatgagcaaggataaaacagatattaaacgagcggaaaaaatcctcaatgacgaccattatggcttggaaaagatcaaggagcgaattctcgagttcttagcgattcgcaagctgacaccgaagatgaaaagcccgattatttgttttgtgggaccgccgggagtagggaaaacctctctggccaaatcggtggcccgtgctttggatcggaaatttgtgcgtatgtctttgggcggtgtccgggatgaagcagagatcaggggacatcggcggacttacatcggtgctcttcccgggcggattattcagggaatgagaacggcggggaccgccaatccggtctttttgctggatgaaatcgataagatggcttcggatttccgtggggacccggcggcagccttgctggaggttctggaccctgagcagaatttcagtttttccgatcattatttggatttgccttatgacttatcccacaccctgtttatcatgacggctaattctctgtacagcattccccggcctcttttggaccggatggaggttatctctttaagcggttatacggaggatgagaaggtcaatatcgccaaacgctatctcgtacctaagcagatgaaagcccatggcttaaaagccagccagcttgagattggtgacaaggttattttgaagcttgttcagggctatacacgggaatcgggagtgcgtaatctggagcgtcagatcgccaatctgtgccgtaaagtagcgacccgagtcgtgaaaaaggaatggaaaacagcggagttgaggccggagatgctggaagagtttctgggttccccccgttatcagttcgaaaaagcaagaattaaaccggagattggtgctgccacagggctggcttatacggaagtaggcggggatgtcttaaccatcgaggtgattcctctgcctggcaaaggtcaactgaccttaaccggtaagctgggagatgtgatgaaggaatcagcctatgcgggccggacgtttgtccgctcccattcccgggaactgggcattccggatgatttctatgaaaagaccgatcttcatattcacgttcccgaaggggcgattcctaaggatggtccctcggcaggaatcaccatggccacagccatggcttcggctttagccaaacgggcagtgccttcggatctggccatgaccggtgagatcactctgagaggcaatgttctgcccattggcggagtgaaggaaaaagttctcgccgctcaccgggccggaattaaacaggttattttgcctgagcaaaaccgcaaggacttggaagaagtcccggaaaatgtgcgcaaagagctggaattccatttcgtcagccgcatggaggaggttatcaagatcgccctt

SEQ ID NO: 33482 - DNA, 2595 bp, Desulfitobacterium hafniense
caggaagaaacgcttaaagagctcaatgtaaaccctgccaccgggctcaccagccaggaagtccaagcccgcctggagcaatacggaaccaataagcttaagggaaaacccaagaaaagcttaatcgccttgttctttgcccaattgaaagatatgctgatttatgtcctgatcggtgctgcattaatcactttctttatcggggaatatgtggactccatcatcattctcctggtggtggtcctcaacgccgccattggcgtttttcaggaattcaaagccgaaaaagccattgaagccttgcagcaaatgactactcctaaaacactggtccgccggaacggcgaggtcctggaaatccaatcggaggaactggtgcccggagacattgtcctcatcgatgccggccgctttatcccagccgatctgcgcctcatcgagagtgccaatctccagattgaagagtcggctctcaccggtgaatccgttcccacggaaaaagtggcccaggaagtccttcaggaccctaaaactccccttggcgatcaagtgaacatggccttcatgtccaccttagctacttatggccggggtgaaggggtggtggtgggcaccgccatggaaacagagatcgggaaaatcgccaagattctcgatgaggagatcgatgagatgacccccctgcagaagcgaatggaagagctggggaaggtcttgggctatctggccatcggcatctgtgtcctcatctttgtcatctcctttttccagaagcgggacctctttgagatgttcctgaccgccatcagcttagctgtggccgccatccctgagggtcttcccgctattgtcgccattgtcctggctctgggggtcacccggatgtccaaaatcaatgccattgtcaaaaaactgcctgctgtggaaactttgggctctgtaaatattatctgttcggataaaaccggaaccctgacgcaaaaccaaatgacagtggtcaagtattacacactgaataatttgcaggaggtgccccgggagggctcagattttgacgcaagcattcaggccaaagagctgatgaagacctttgtcctttgctcagatgctacttatgaacagggccagggcacaggagatcctacggagattgccctggtggtcttaggggagcgctttaacctgggaagaaaaaccttgcatgccgaatataagcgggtaggagaaaatcccttcgattccgaccgcaaactcatgtccaccctcaatgaagaaaacacaggctaccgggtccataccaaaggagcgattgacaatcttctcaagctttcaaccaccgccttagttgacggcaaggtggtcctccttacagaagagatgaagcaggagtatctccgtgtggctgacgaaatgtccgacgctgctctacgggtgctgggggccgcttacaaagatgtggacagagtgatcagcccccaggagatggagcaggctctgaccctcatcggcatggtgggcatgatcgatcctccccgcctggaagtcagggattccatccgggatgccaagctggccgggatcacaccggtcatgattaccggagaccataaaaacaccgctgtggccatcgccaaagaattaggcatcgctgagtccatcgaggaaagcatgaccggcgctgagatcgatcaattgtccgacgaagaattttcccggcgcatcggcagtttgcgggtctttgcccgggtatctccggagcataaggttaaaatcgtcaaagctttcaaatcccatggcaatatcgtctccatgacgggggatggggtcaacgatgctccttccttgaagaacgccgatatcggtgtggccatgggaatcaccggtacggatgtctccaaaggcgccgccgatatgatcttaaccgatgataatttcaccaccatcgtccatgctatcgaggaaggccgcaatatctataacaacatcaagaaatcggtgattttccttctctcctgcaacctgggggagattgtcgccatcttcttctccgtcctctttttctggcccgttcccctgctcgccacccagcttttatggattaacttaatcaccgataccctgccggccattgccctgggtgtagatcccggtgataaagaagtgatgcggcaaaaaccccgcaaccctaaagaaagcttctttgcccacggttcaggcatcagggccatcatcggcggtgtcttgatcggtgctttaaccctggtagccttctacatagggcttcgtgaatacggctataccttaggatcgacggatatccccgctgatatcctcacctatgcccgcaccatggcctttgtggttctggcggcttcccagcttttctactccctgtccatgagacatgccaccaaatccatttttgctgtaggcatcttttccaaccgctacctgattgcggctattatcgtcggtttattgctgcagctgatggtgatctccgtccccttcctctccagcgccttcaagctgcagatgctctctttaagagattggggaattgtcctttgcctggcggttatccccctcgttctt

SEQ ID NO: 33483 - DNA, 2247 bp, Desulfitobacterium hafniense
gtcatccggacttccgtatggtctcccccgggttgtcatccggtgggctgcggactgaagctctatgtgaatcaagcgggtattctcgagaaaatcgaaggggacgagaacgatcccatcaccaaaggccggctttgcgtcagatgcctggatcttaaagaagtgatctataatcccagccgtattctctatcccatgaagcgccatcctcaggatcggggcaaggctgacaaatgggaacgcaccacctgggaagaagcctatgcaatgattaagcagaagcgggattttgtcatcaaaaattacggtgtggaggcgattgccgcttacagcggtaccggccgcaacggcggtattatggtacaggaatttgcccatgaggtgctgggcacacccaatgcctgctatactcagtccggctatgcctgttacactccccgtgccgccgccacggcggcgatcacgggctgttattacccggagatcgactatgggggcggtgtggaagggacctatgataaccccgactacaagattccggaagtgattgtgctttgggggaaggagccgttgccttccaacggcgacggtctctttggccacgccttgatcgatttgatgaagcggggcacccaaataatttccgtggatccccgtgtcaattggctggcgacacgatccgctgtccatctgcgtctgcgcccgggtacggatgcggctatggggatggcctggcttaatgtgattatcaatgaagagctgtatgatcgggatttcgtggaaaactggtgttacggctttgacgaactgaaagagcgggtggcggacatgactccggaaaaggcggcagagatctgccaggtggatggggagatcatcaggaaggccgccagaatgtacgccgttgccgcccaggcgggaattgcctgggggctggccattgaccagaaccagaacggcacccaggctgcccagtgtatcttaagtctgatcgccattacgggcaatctggacaaacccgggggccagctggtgggagaagccaaaccggcagtgccggaagccgaggatggtatgacctccacctacgcggctaccggacatcaattggacggctgggtcgccctgggggaagaactgagaaataaaaccatcggcatgcaggagtatcccctgtacgtcaattccatccgcaatgcccatgccgacctgatgctggactgcctcatgacggataaaccttatcggatcgtcatggccatgattcagtccaccaatattattgccccaaccaactctgcggaaagcaaaaagtggcatcaagccctgaagagactggatttcatatttgccaccgatgtgtttatgacacccaccattcaggcctgtgccgatttgttcctgcccttgaaatgtgccccggagcacgacagcattaactatacccattattccggctcccagattcattttgggatcaccaataaggccattgaagtgggccagtgcaagagtgatgtggagattgcggtcgaacttggcaaatacctgggccgggagcagtatgtgacaagacacacggatgaaaaagcgtggctcaacaaccggcgtgcccaaagaaatctgatgggcggcggcaaggaagatttcgatacaatccgggaaaaagtgcacatccagcagggacgcaaatattacaaatataagacaggtcatctccgccctgatcgtcaaaccgggttcctgaccacaaccgggcgggtggagctttattcctacatgtttgaaggggtgggctcagatcccctgccttattaccaggagcctcccttcagcccctattccactcctgaattagccaaagaatatcctttcatcctgaccaccggcgcccggacttacgcctacttccacagcgaacaccgtcaggttccgctgttacgtgaattaaatccgaaccccctgctcgaggttaacccggaagatgctgctgctttgggtttgctggaagggcagtgggtggaaatctccaaccagttcggggaagccaagtttaaggccaaggtaacccctacagtacgccaaggtacggtcatggcacagcatggttggtggttcccggaacaggaagccgatgagcctaacctctccggggtatggcattccaatgtcaatactttgattcctaatcattacaatggctccctgggatttggagccccttataaatgcatgatctgcaaaatc

SEQ ID NO: 33484 - DNA, 2262 bp, Desulfitobacterium hafniense
cgctgataatgtaaggagaggatgaagcaaatggctgtaaagtataagaaaggcacagaaaaggattacactgtgagaacctgtgcctggtctgccccaggttgtcatcctacgggctgcgggctgcttatgcacgtcaaggatggcaggctggtggaagtggaaggcgatcccgagcaccccgtttctcagggacgtgtctgtgtaagatgtctgtcactcccggaggctgtttaccatccggacagaattctttatcccatgaagcgtgccggcaaaaaaggcggggataaatgggaacgcatcacctgggatgaagcctatgacctgattgaagagaaggtcagatattatcaaaagcaatacgggccggaatccattgccatgatgggcggcaccggccgtgaagccaccttttacttccctgccttatcctacgcggtgttgcagacacccaacaatgtgggggttttaagcggcctttcctgttatggcccccgctgtgccgttaccgaatatgtcttaggagcaggttatccggaaattgactatgccgcttactttgccgatcgctacgacaaccctgaattccagcttcccgaatatatcatcatttggggcaaaagcccccttgagtccaattccgacggattcttcggccatgctattgtggatatgatgaagcggggtacgaaaattatcgccgtggaccccagggttacctggctgacctcccgtgcggaatatcacctccagcttcgtcccggtacggacgcggccttggctttaggcatgctgaacgttattatcaacgaggatctctatgatcacgaatttgtggaaaagtggacttttgggctggatgctctgagagagcgtgttcaggaatattccccccgccgggtagcggatatctgctggattaaggaagaaaccattgtccaggccgcccgtgcttttgcccaggccggcaattccagcattcagtggggcgtagccctggatatgaactggaacggtattcaggccattcaaggggttctttacctcatgaccctgaccggcaatcttgacgtcccggggggcaataccctggccgaacctgccagcttcatgggtaaatggcgctatgatacccacaagcagattcctgaggaaatttatgagaaccgcatcggcaataaagagttccccttcttcaattatggcctgatggcctgcagcccggacaataccttggaatactttgaacagcagcagccttaccccattaagatggtgtggtccaacagccaaaacccccttgccaatgcggcaccggtgcccaagcgctggtatgaggcctttaagaaaatagagttttgggtctgccaggagctctttatgacccccacggtggctgcttatgccgatattgtcctgccgatcgccacctttgccgagcatgacggtgtggtcattcctcattttggacgcaattccgctttcctgggggcggttaaccagtgcattgaacgggtgggagaatgtaaatccgacctggaaatctgctttgaattaggcaagcgtttaaacccccaagcctggccctggcaaaccgtgtccgacttctttaccgagcagattgaggagaaaaccggactggattatcctggccttaaggataaggttgttcaacagcagcactatgtctacaggaaatacgagcaaggcttattgcgcagtgacggtgaaccgggttttgagaccttgaccggcctcatcgaattaaaagccaccatctttgaaagctggggagaagatcccctgccttatttccaggaacctcccttcagcccttaccgcacccctgaactctttgcccaataccccttggtcctgaccaccgggggcagaaaattcacctccttccattcggagcacaggcagattccttctttaaggcaaatcaccccctggcctacggttgaaatccatcctgataccgccgccggcctgggcattcaagacggggactgggtggccattgagaatcatcttggccaatgccgcatgaaagctctggttcagcccacggttcacccgaaagtcgttcatgccctccacggctggtggtacccggaacaagccggtaccgaacccaacctgttcggtacctttaaatccaatatcaacatgctgatgccccacaaaaaaatcggcaagcttgggttaggcgccaactacaaaagcaatctctgcaaagtatacaaagtaagcggt

SEQ ID NO: 33485 - DNA, 1272 bp, Desulfitobacterium hafniense
aataatatgcttcataaaatgagtgatttggatttaatcgtctcccatggccgggtggccaaaatcgtcggactgatgattgaatccgatggaccccgggtcagcgtaggggaatattgccggatccatactcagcaagggaaggagattccggctgaggtggtgggctttcgcaactccactaccttactgatgcctttagcggaattggaaggaatcgctccgggggatcgggtggtccctcagcagcataaactggaagtcggagtcggtcaggcccttctgggcagaattctcgacgggctgggcagacctttggatggacgtcctatggttacccagagggattacccattgcaaaatgctccccccagtgcttttctaaggccaaggatcagggaccccctcagtgtgggagtgcgcacagtggatgggatactgaccattggcagaggacagagaattggcatcttcgccggttccggagtgggtaaaagcactttgctgggcatgatggccagaaataccacagccggtgtgaatgtgatcgctttagtgggggaacggggaagagaactgcgggacttcatcgagaaggatctgggcgaagaaggcttagagcgctccgtactggtggtggcgacctccgaccaacccgccttggttcgccttaaggctgctttcacagccacggccattgccgaatacttccgggaccagggacaggatgtgctcttaatgatggattccgtgacccgttttgccatggctcaacgggaagtgggcttgaccgccggcgaacctccggcaacccgcggctatccgccttcagtatttgcgatgctgcccaaacttcttgaacgctccgggatgagcgagatcggaagcattacgggtatttacaccgtccttgtggatggggacgatcataatgaacccatcgccgacacagtccggggcatcctggacggacatattgtcttgacccgggaactggccatgcagaaccactatcccgccattgacacccttcaatccgtgagccgggttatgaatgacatcattgccccggaacacaaggagctggccggaaaacttcgggaacatctggcagtctaccatgatgccaaggatttaatcgacatcggagcttatgtaacaggcagcaatccccgcatcgatgccgccatccggcatattgaaggaatcaatggtttccttcgccaggatgtggaagagaaagtttccttcgaccaaatgctccggcagctt

SEQ ID NO: 33486 - DNA, 780 bp, Desulfitobacterium hafniense
aaaaagatcagttttatcggggcaggaaacatggctgaggccattatcaaagggctgatggtgacgggaagctacgaaattcgggtgaccaatcgctctaaccaggctaagctggcccaaatgaaagaggactatggggtcattcccgtctcttttagggaagcggtcaaggattcggagatcatccttttagcagtgaaacccaaggatgttggggaagcgttggcccaaatcagggagggtataagctcaaaccagctcctgatcagcgtggcggcaggaattcccctggccttgctggaaaaacatttgcctcattgtcccattattcgggctatgcccaatacctcaagcgccgtcttgcattccatgaccggcttggtcaaaggtcagggtgtcaatgaagcgaagcagagggatgtggaagatatttttggggcagttgggaaatatatctggataactgaggaacagattaatcccctcatcgccatgagcggaagcgggccggcttatttttatctttttactgaggctttggtcaaggcaggggttgatatgggcttcagccaggaggtagccgagaacctggccaaagaaaccttaatgggagcagctaagatgctggctcagagcgggaaatcccccggtgaattgagggtggccgtaacctcgcccaaaggaaccacccaggaggctttggaggtcttccgggagcaggggttagaagagcttgtggcccaggccgctaaagcctgcaagcatcgtgcacaagcaatg

SEQ ID NO: 33487 - DNA, 1230 bp, Desulfitobacterium hafniense
gaactgatcacaatcggccaaaaagccaaagatgccgcccgcaagctggcttatgccggcaccgccgctaagaacaaggctcttctggcgatggcggaggctctgctgaatcatgaacaaaaaattttggaggccaatcggaaagatgtagaggcagctattcaaaagggaaccaaaaaatccttggtcaatcgcctggctttgacctctgaaggaattcgccaaatgagtgatgcccttaaagaagtggtgaatttaggcgatccggtaggggaaggggagttctggacccgtcccaatggtttgcgcattcagcgtacccgggtccccttaggtgtggtggctatgatctatgaagcccgccccaatgtgacagtggatgcggcggctctctgcctgaagtccggcaatgcggtcattctccggggaggctccgaagctattgagagcaataagattctgagcaaggtgatcgctggggcagcggaaagccagggcatgcccacagcctgcattcaactcctggagaatacgaatcggcaatgggttcagcagctcatgaaaatgaacggctatgtggatgtcatcatccccagagggggggcagggcttattgagactgtagtcaaggaagccactgttcccgtcattgagaccggtaccggagtatgccatgcttatgtcgatggggaagccgatctggctaaaggggtcagcattgtcttcaatgccaaaacccaaaaacccggcgtatgcaatgctctggaggctgtcttggtgaatgaggcggtagctcaggaatttctgcctctgctgggagaaaaattccgggattatggggtggaaataaggggatgtgaaaagacctgtgccatcctgccttacgctgccaaagccaaggaagaggattggggaatagagcatctggatctgatcatcagtgccaaggtggttcaaggtgtggatgaagccatggaccatatttatcagtatggaaccaagcattcagagacgattatcaccgagaactacaccacagctcagcgattcttaaatgaggtggatgccgcggctgtttacgttaatgcttccactcgtttcaccgacggcgggcgtttcggctttggggccgagatcggcatcagcacccagaagcttcatgctcggggacctatggggctgcaagcgctgaccactatgaaatatatggtctatggtgaggatcatatt

SEQ ID NO: 33488 - DNA, 2172 bp, Desulfitobacterium hafniense
acaggacccggttgtcacaacggctgcggtgttctctgctacaccaaagacggtaaattggaaaaaatcgaaggtgatcccaatttcagctataaccaaggcagactatgcctgcgctgtattaacatggtggaacaaatctacaacaacgatcgcctgaaatggccgctcatgagagttgggaaaaaaggcgagaataaatggaaacgggtttcctgggatgaagcttacgactggattgaagcaaagcataaagaaatctcacagaaaacaggtccccaaggcatcgtatctttagtcggaaccggccgcaattgcatgtggcagccggcgatgattacccgcgccgtattcggcagccctaacctttcctttggcttcctcagcgccgactcctgctaccagccccggatgacagccaatctgattaagcagggagactgctgggttctcgatgcttcccagtttcatcccttgcggtatgacaaccctgaatggaaagtaccggaagtcgttgtcgtctgggggaatgagcccttagcctccaatggggatggctttgtcgggcactggctggttgatttaatgaaactgggcaccaaactgattgtgattgaccccgccttgacttggctggcagctaaagccgatctatggttgaaaatccggcccggtaccgattgtgccttggctctgggtttcctcaatgtcatcatcaacgaagacctttatgaccatgattttgtggagcagtggacttacggctttgatgaactggtcgagcgggttcaggaatattctgtggaaaaagcagcggaaattacctggattcctaaagagcaaatcacagaagccgctcgtatgtatgctaaagccaaacccgcaggaattcaatggggtctggccatcgacatgcaaattgccggtatggaagcctctgcagccatttcggatatggtcgcaattacaggaaacctggatgttcccggcggcaatattctccttcgctatgcttataacagttcgaaaaaatatggctgcggccttgaatgcatttctgaagaaatgctgcaaaaacggattggaacttatgaatctgccatccacgaatccggatatacaccgtttattccgcctgataaacttctggagaccatggaatccggcaaaccttacccggttcaaatgctttgggttcacggcagcaatcctatcgccaatatggccggtgaagcgcccagagtttatgcggcctggaagaacgtgccttatacggttgtggtcgattactatatgacacctactgcagtggcctttgccgacttagtcctgccggcagccatgagcgtggaacgcgatagctaccgatcctggtggcagcctttaagagccattaccaaagcagccgaaccctattttgagagcaaagccgatgaacagatcgtgctggatctgggcaagcggatcaatcctgaatactttaacaagtacaaagacgttcgtgatctgctcaccgatatgctctacgatgatggcaacggtgtggactatgactttgaagcattgacccataaagtctatgactggtgggactggaaccatacctacaagaaatatgaaaaaggcctgttgcgccaggacgggcagccgggctttgttactgcgacagggttatatgaagtttcttcgcctttgtttgatgtttggggatttgatccgctgccccaccatatggagccctatgaagggccttactccactcctgaactcatgaaggagtatcccttcattctgaccacaggacaccggcagattgggctgttccactctgaacaccgccagctccccacgatgcgggaagttcatccccagcctgagatggacattaatccggaaacagcgcaaaaactcggtcttcaggaaggtgattgggcctggattgaaaataaacggggtaaatgcaaacagcaggttaaatttaattatgggctggatcccaaagtggtcagggcgcgtcatggctggtggtttcccgaaaaggaaggtgcggagccggtcctgtttggagtatttgacagtaactcgaacaacttaaccaccatgggagtccatggtccgacccattatggtgctccttataaatccacgatctgcaaggtttacaaggttgag

SEQ ID NO: 33489 - DNA, 852 bp, Desulfitobacterium hafniense
attatgacggcaatggtcacaccctttaatgacaaaatggaagtgaattacccggaagccgagaagttagctaattatctcatcgagcatggtaatgatggaatcgttgtttgcggtaccaccggtgaatctcccacagtatcagccgaagaaaagattgaacttttcaaaacggtcaagaaggctgtaggcagcagagcaacggtaatagccggaattggctccaataccaccgacgggagtattaatttagcgcgccaagcggagaaaaccggagtagatgggctcatggctgtggtcccctactacaataaaccttcacaagaaggattgtatcaacattttcgagctattgctgaagcaatatccctgcctttgatggtgtacaatattccgggaagaacatccattaatcttcttccggaaacggttctgcggctaagtgaaattcccaacataacctccattaaagaagcagccggctccatggatcaagtcagcgaaatgagacgtattttaccggaagacttcctgatttatagcggtgacgattctttaaccttgcccatgctgtctttaggctgtgacggcatcatcagtgtagcggctcatgtggtcggtgatgaaatcaaacaattggttgatgcctggtttaatggcgaaccacagactgccctgcaatggcatctaaagcttatgcctatgttcaaaggagtgtttgtgaccaccaatccggttcctgttaaatatcttttaaagaaagcaggcatcaatgcaggaggggtaaaactccccttagtctgtgcggccccggaggaagaagctttcttggatgatctctaccaaaagatc

SEQ ID NO: 33490 - DNA, 1218 bp, Desulfitobacterium hafniense
gtgcgtgttttggtccaaaagtttgggggaacttcagtatccagtgctgaacgtcgggcccaggttgccgcaaaagtctctgaagcagtgcgggaagggtattcacctgttgttgtagtttccgccattggacgcagtggggatccctatgcgacagatacctttatcaatctggtcaacggcattacccttgaatcacccaagcgggaaatggatcttttgatgagctgcggggaaatcatctccggtgtggttttgaccagcaccctaaagagcatggggcttgaggcaatcctgttaacaggtggtcaagcaggaattataaccaatgattgttatggagatgcccgcatcattcgcgtagagccgaaagggatccttgatcatctaagtgagggaagagttgtcgtcgttaccggctttcaaggagttaccgaagatggccaggtcaccacattaggtcgcgggggaagcgatactacagcttcagctcttggtgttgcattaaatgccgaggccatcgatatctatactgatgtggaaggaattatgactgccgatccgcgtattgttgaggatgcccgtatcttagatgtggtaacctataatgagatatgtcatttggcccatcagggagccaaagtgattcatccccgtgcggtggaaattgctatgcagcgcaatattcccatttggatcaaatgtacattttccgatgcccgaggaactttagtaacaagtatacagcccgacatgggagcgggaacagatattacgggagaccgaacgattacggggattgcccacacgcccaatgtgacccagattcaagtacctacccatgatgtagccgatgtgctgcaagtcgataaacagatctttaagggaatggctttagcagatattagtgtcgactttataagtgtgcagccggagagtgtgctttacaccgtacctgatgaaatagcggaaaaagcaatgaagattctcgataatttaggatttaagcctacagcggtccctggatgtgccaaagtctccatcgttggagcgggtatcgcaggagttcccggtgtgatggccaatatggtggaggccttatccgatgcgggtgtccgtatcttgcagtcagcagactctcacacaactatatgggtacttgtcaataaagaggatatggttccggcagtgcaagcactccacaagaagtttctgttg

SEQ ID NO: 33491 - DNA, 978 bp, Desulfitobacterium hafniense
gttgcaattgttggagctacaggtgcggttggacaagagttcttaaagattcttgtggaaaggaattttcctgtggaggaattacgcttattagcgacaaaacgctccgcaggcaaaaagatcctttggcaaggcagggaaattgaggttcaagaaactacccatgatagttttaaaggtatcgatatagcattatttgccggaggatcatccagtacagaattcgctccttccgcggttaaaagcggggctgtagtgattgataacagcagtgcttatcgtcttgatcctgaggtccccctggtcgtacctgaagtcaacccggaagatgtaaaatggcataaggggatcatcgctaatcctaactgttcaacgattattatggcagtcgccttgaaacctatctttgatctggcagggattaaaagggtggttgtgtcaacctatcaggccgtttccggagcaggacgtgaagggatcgaagaattggaagatcaggttcgcaattgggtgcaaggggaagaagtgaagagtcagacattcccttatcaaattgcttttaacttgattcccagaattgatgtattccaagaaggagattacaccaaagaagagtggaagatggttaaggagactcagaagatttttcatgtggatactatgccgattacggcaaccacagtccgggttcctgtgttaagaagccattccgaatctattaacatagaaacagagcggagtgtcggcttggatgaggtcaaggcagctttccaaaaggctccgggagttatcgttgaggataatccggcagaagatcgttatcccatgccttggtttacttcagacaccgatgaagtctatataggccgtatccgtaaagatttttccattgaaaatgggatcaatctctgggttgtgggtgaccaaattcgtaagggagccgccaccaatacgatacagattgccgaactcttatta

SEQ ID NO: 33492 - DNA, 792 bp, Desulfitobacterium hafniense
attcttgtttttgtttctggagccggaggaaaaatgggcagggaagtagttcgcactatcctcgaccaggaagatatgcagctggttggtgcttcagatgcacgtcagcaaggcagggatataggagagcttctggccatggctcccttagggattgagataaccggccctctggaagtggcgcaccttaaagagacccgggcagatattatggtggattttaccaatcctcaatctgtactgaaaaatgccaaatgtgctttggcggccggagtcgttccagtcttagggaccacgggcttagatgaagccgatatttcggaaatccgggatcttgtggatcaaacgaaagtgggggcttttattgccccgaattttgccataggcgccatactcatgatgcgctttgctcaggaggctgcaaagtatttccctcatgtggagattattgagctgcatcatgaccaaaagctggatgcaccttccggaacggctctcaaaaccgtagagtggatatcagaagtaagaaaacccctggtgcagggtcatcctaatgagtacgaaaaaatcaagggctcacggggcggtgatgtggacggaattcatattcattctgttcgcttgcccggatttatagctcatcaggaagtcattttcggcggcctcggacaagctttgacgatccggcatgatgccctttcccgggaaacctatatgcctgggattatgctggccgtccgcaaagcaagccaactctcaaatttggtaataggactagagaatttcctcgaa

SEQ ID NO: 33493 - DNA, 1224 bp, Desulfitobacterium hafniense
atgtatcaaaaaaccgttttacctaacggagttcgtatcattacggaggaaatagattatgtacgctcagtagctgtagggatatgggtaggagcgggttcccgggacgagagggaagggtatgaaggtatatctcattttatagagcacatgttttttaaaggaacaaaaaaccgtactgcccgtgatatcgctgaatctttggaagctgtgggggggcagctcaatgcctttaccacaaaggaatatacctgttactatgccaaagtgctggacgaggacatggatttggccatggatgtgctcaatgatatgttttttgagtctctctttgatgaaaacgaaatagaaaaagaaaagaaagtcgtcatcgaagagataaaaatgtatgaggattctcccgatgaattgattcatgacctgttttccgatcatgtctggaatgaccatcctttgggaagacccattttagggaccgaggagagtgttaaaggactaagccgcgagaaaattcttgattttatggatcatcactacgctccggataatctggtcattgccgtggcgggcaaaatcaagcatgacgaggtcttgaagaagcttgctcctctttacggtgaattcaaacggggaggaagacgaattctggaagagacccccaaaggtcagcaggtgcaggaaatgatcctgaaagataccgaacaaatgcacctcatcctgggagttcccggtttagggcaggaagatgaggatctctatcccatgcatatcctcaataacatcctggggggaggcttaagttcccgtttgttccaagaaatcagggagcagcggggaatggcttacactgtgttttcctatcattccacttatgtggataccggtttgtttgctatttatgcaggaaccaccccttcaaattctcaggaagtagtagaatgcgttctcgccgagattttagatattaagaagaatggcatatcccaatccgagctgcaacggaccaagtctcagattaagggcggactttatctgggcttagaatcagcaagcagcaggatgagccgtttaggcaagacggaattgacctataatcgggtgatctctcccgaagaagtggttgaaaagctggaacgtgttaccgttgaggatacgaagcgagtcatcaaccgcctgtggaagcgggataaaataagtctcctcatgttaggtccggcagggaat

SEQ ID NO: 33494 - DNA, 1566 bp, Desulfitobacterium hafniense
attgccgaccggagtgtggatacggccaggctggtttccctgctgctgattattttgagcctgtatctcggcaatctgctcctcaatctgctcaacgggaccatgacgctgcggatctcccagaagctggtctatactctgcgccaggagttttttgccaaaatgcagaggcttccactagggttttatgatacccgctcccatggggataccatgagccggatcaccaatgatatggataatatcagctccaccatcgcccagaccaccacccagctcatcgccagcatcctgacccttgccggttccctggcggtcatgctcagtctgaatgtgcctctgaccttggtggtgctgctctgtgtacctttggttttcgtattgaccaaaaccatcgccacccgcagccgggcttattttttggctcagcagggaagcctcggggccctgaacggggtcatcgaagaaaatattctgggtctgaaaatggtcaaagccttcaacaggcaggaggaggtactccgccaattccaggaaatcaaccagggcttgcgtgcaagcagctataaggcccaggtttggtccggctgcatgatgcccctgatgaatgtaatcaataatctggtctttgcagctgtggccatctgcgggggaatcctgaccttaagccaggggctggcggtaggaacggtggtcagctttttaacctattccaagcaatttgcccaccctcttaactccgtagccggtatgtttaataccatccagtcggctctggccggggcggagcgggtttttgaaattctggattatgaggaagagagggcagatgaggagaatgccctggaaatggaacatcctgccggtgccgtaacctttgacgaggtcagcttctcttatgacaagacccagccgattcttaaagaggtgagttttcaggtcaatccaggggaggtcgttgccctggtgggagaaaccggtgccgggaaaacaaccatcgtcaatcttttaacccgcttttatgatgcggacagcggggagatcaggattgacggggtgccggttacccggatcaaacgggccagcctgcgccgctgcttctcagttgtgctgcaggataccagccttttcagcggcacgatcatggacaatattcgttatgggaaagaggacgccaccgaggaagaggtgatcagggcggcgcaaatcgcccatgcccacggctttatcactaagctcccccaaggttatgggacccgggtctccgcagctaatgataatctgagccaggggcaaaagcagctgatctccatcgcccgggcgctgctctgcgacagcccgattctgatcctggatgaagccaccagcagcgtggataccaagacggaaaaagatatccagaaagctctggtcagcctcatgcagaaccggaccagctttctgattgcccaccgtctttccacgatccgggatgcggaccgcatcatggtgatcggggaggggcagatcctggaatccggcaatcaccagagtctgatggaaaagcaaggccgatattatgaaatg

SEQ ID NO: 33495 - DNA, 1683 bp, Desulfitobacterium hafniense
tataactatttaggaaaatataaaatcccctttttgattgcggtgctctgtgtgactctggaagcagtctgtgatttgctgggacctaccctgatggcccgcattatcaatcaaggaatcgaaaagggctccctggccgaggtctattactggggggccttgatgctggcggtaaccctgctgggggcctgttttgctgtaaccagaagcaatctgtccagctatgtttcccaaaggatgggcggggatttgcgggcagatttatttgggaaaatcatctcctttgccgagcagagcggagataaaatcgacggcgggtccctgatcaccagaatgaccaatgacacttcccaaatcgttcagttcgtcaatgggatgatgcgtattttcctcaaggctcccctgactggtatcggcagtgtgatcctggccagctggctgaatttccggctcagccttattatctatggggtagtggctgtggtttccttattgatttatgccagcatgaagttcagctatccccgcttttatcaattgcaaaaggctgtggaccgggtcaatctgaaggtccaggaatatttaatcgggatccggctggtgaaagcctttgggacctatgagcaagagacggaaaaatttgccgaagccaaccgggagctcatgcagaaggggatctcctcccagatggtgattaccgtgatctctccctttcttactctggtggtggggaccggaactgccgcggtgatctttttgggcagccgcctgtttatgctggatttggctgatcttggcgatatgatggcctttaccatttatatggcccagattttgacctcgttgattatgctcaccactgtttttactacgttcgtacggaccaaggcttcaatggagcggatcggggaagtgctggactgtgccgaagattttccccccagcggggcagggagaaagctgcaggggaagatcacctttgacaaggttacctttgcttatcctaacggcagcggggtcccggccatccgggaactttccttcaccgtcaatcccggcgggagcctggccattatcggtcccaccggcagcggcaaatcaaccattgcctggctgctgctgcgcttttatgatgcggacaggggcaggatcatgctggacgattaccctatccaggagctgggcgccgacgaaatccgccataatatcgctatcgttccccagaagcccctgctgttttccggaacggtagcggaaaacctccgctggggggataaacaggcctccccggaggagctcaggcaggcggcggaaaaggcccaggccgactttatcgggcagatggcggaggggtacgacagcctcctgggcagcgaaggggtcaatctgtccggagggcagaagcagcgtctttctctggcccgggcgatcctgaaaaaagccccgatcctgatcctggacgatgccaccagtgccctggatgcggtgaccgaagctaaggtaagggaaaatcttaagcataatgactaccggcaaacgctggtgatgatcacccagcgctgcggaacagccatgtcggcggatcagattctggtcatggagaatggccggccagcgggcttggggtctcatgaggaattgatgaggacctgtgctatttatcaggatatttatcatacacag

SEQ ID NO: 33496 - DNA, 3352 bp, Desulfitobacterium hafniense
tttgcgcgcagtgatttgcaggctattgtcgccccggtcctaatcgcgctggcagcggtgcttctgcgcggatttttgagccgtatgatggagagctacagcaaggtagtggccgctaaggtcaagaacaagataaggcttttggtcttcgacaagatactccatctcggtccggggtatctgagcgataagcggagcgggaaggttcagtccctggtgctggatgggatcgaatccctggagccgttcctcgtaaactatattccccagataataaccatatccatatccggtcttgccatcggtatttatctgacgtccctcgatgtggtgacaggcctgatcatcattgtgtccatgctgctctgcgttattgtcccctatttaaccgtaccgctggtcagccgcagcattgtgacctactggcgctcctatgcgaccctcaacgcccaatatatagatgctgtccaggggatgtccacattgatggcctttaaagccagccgggccaagggccgtgaactggctgaaaacgcccagggcttttatgtgcaggccattcgcaatacaaccttctctctgatcgattcaggcctcatgatgctgctgacttcggtcgcgtcggcaataaccgtggccatcgccgcctatcgggcagagtcagggatctttcccgtgatggcgatatccactttcctgtttcttgccgcggaatgcgcccgcccgatgtcggagcttaacggccactggcacaacagctttctgggcttgtccgtggcggaggagctttttgaaatcgtggatgaagagctgaaaatcacggaaaaagagcatgccgatactgtttcgctggatggtcccctgccggcagttcagtttcaggatgtgacctttgcttataacgaagaggcgaagccggcccttgcaggaatcaatctggagatcaaaggcggtcaaaccattgccgttgtcggcaaatccggatcaggcaaatcaaccatggtcaatctgctcttccgcttttatgagccgacccagggcagcatcttgatgaacggcataaatataaaggattacggcatcagttatctgcaaagcaagatcgccgtggtgtttcaggatacctatcttttttacggaaccgtgtttgagaatatccgtatgtcccacaccgatgctgctgatgacaaagtcatagccgcggccaaagcggccggtgcccatgaatttatcatggagcttccccaaggctatgctactgtcgttggcgagcggggtgtcaatctttccggaggggagaggcaacgactggcgattgcccgtgccatcctgaaggatgcgccgctgctgatcctggatgaggcgacctcaagtgtggatgccaggaatgaagccctaattcagaatacgctggattcgctcaccaaggggcgcaccaccatcatcattgcccatcggctttccacagtgcagaatgcggacaagatagttgttttggatcatggtgagctggcagaggcaggcacccacgaagagctattgctgaagggcggcatatatgccgatctcgttcgtgcccagagaggggatgagaacaatgcctaacggggaaagcaagcatgaaacgacgcgcattaaaaataccctccgccttatcgcctccatgaagccctattccttggagatgatagccaccatcgtcaccacctttttaaagcacatcgggacaatcggctccgccggcatcgtggcctacatggcggccttggccatggaaggcagacttttgcctgaattccgcgtgctcttcagctggctttgtgtttgtattgttttgagggctgttatgtattacggagagatgtggttcggtcatgatgtagcttaccgggtcttgagagatttcaggatcaagctgtatgacaagatggaaaccatctcgccggccttcgttttaaagaagcgttccggtcagatcggggccacgctgatgagtgacgtcgaaattctggagtggtttctggcccataccttcggaagcttcctggtcgcggtggcaattacgatcgtgctgcttgtcctgctggccaagattcatatcctgctttctctgctcatgatgatattttccatattaaccatatggacaccctttctgctgcagaaaaaggccgatgagcagggcaggcaagtccgtgaaaaagcagccgaagccaatgcggtcaccatcgaaggcattcagggattgcgcgagctgctgactctgaattatctggagcgctacaaagggagaaataaggagagcatgcagagtctctacgatgcgcaattgacatacggtaaacgggcggggacggagagtgccctgatgcagatttttgtgggggtctttactgttgtcgtcatggctgtgaccgccgtattcgtatctcaaaatgttttggcttttgaggtctatcccatggtcgtcatgctctccgcattgctgttcagcccgatcattgaagtatgcggcgtcgccagaaatcttggcaatgtttttgccgcagccaaccgcattcagacggtttttgataccgctcctgtcgtaaaagacgatgggaaggatatggattgctcctcgcttcagcatagggtcgtcttcgagcatgtttcatttcgctatgatgatgacctggacaaggtcctggacaatgtgagctttgccatagagccaggccagactgttgccctggtcggcccctccggtgccggcaaaagcacatgtatcaacctcctgctgcgttattgggatgctgaaggcggttccatacgcataggcggcgtcgatatccgccacatgtctctggataacctgcgtgacttaaccgcggcggttctgcaggatgtttttctttttaatgtttccatcagggagaatatcaggctgggcaggccggaggcgacggatggggaaattgaagaagcggccaaagcggcctatgctcatgatttcattatggagctgcccaatgggtacgatacgattgccggggaacggggtttttgtctttccgggggacagcggcagcgtatcgctattgcccgtgccgtactgaaaaacccgccgatccttgtcttggacgaggccgtttccagtctggacagtgagaacgagaaatttattcagcaggcgctgcatgataaattaggcgacagaaccacggttgtcgttgcccatcgcctgtccacgattatggctgcggacaagctggtggtgctcgacaaaggccgcgtcgtgcaggttgggcatcacagcgaattgatcgctcaggaaggcttttacaaagatctggttgccaatcaggttgat

SEQ ID NO: 33497 - DNA, 2166 bp, Desulfitobacterium hafniense
tccagctgtaccatggaatgcctgcatcacaatctgaaagcttacgtggtggatggaaaacttgtcaaagtggagagctgcgaagcggatgaaacggtcgcctgcctgcgtggtctggcccgaacccaatgggtcaaccatcccgagcggatcaagatgccgatgctgcgggatggcgaaaaaggctccaatcgttggcaagagatatcctgggacgaggccctggatctgatcgtggaaaaaattaaagaaacccaggccgaactgggcaatcaagggatctgcctgcgttccttttccggtaacttcggctctctcagcaacgctgtagcggcatcgttcttcaattatttgggcggatttacccccgttgtcggttccctctgctgtcaggctgtcaccgggagcatgactcccatcttcggcagccgttacgaagatacgcgggattcgattcgggatagccgttatctgctggcgtgggggaacaatcccgccgtcaccatgcaatcttactttaaatggtaccaggaggcccaggctcagggggctaagatggtcaccgtcgatccccgcttcagcgagacggcagctcagtcagatgagtgggtgccgatcattcccggcacggatacggcattggctctggggatgatcaagatcatcatcgaggaaaacctgtatgatgccgatttcatccgcgcccacagcagtctgcctttcctcgtcgcggaaacgagcggcaagcctgcccttgaggacgaagaagatcccacttccttcctggttctggacgaagcaagcgggcagattacccggcatgatgggcccggtgttgttccggctttgacggtcaggaacacagcctgggcaagtcaatataagacccaattcgatatcctggcggatgaatgccggccctggaccccggaagaagtggagaaagagaccgatgttcccgctgcgtcgaccatccggatggcgcgggactatgccaccatcaagccggctatgctcatccagaatatgggcggcttccagcgcacggagtgggggtcctacgcggcggcggcgcatatgtatctggcggttttgacagggaacatcggcggccgcggcaatggcatctgcgacgccggcggggtgacgacctctatcaaagtgggcaatgccatcccttcgcccaagccccaaggcgagttcggcgcggtgcggggagcacgctttggccgggatatcctggaagataagcccaataagatcgggtttctctggaccatgaccagcagcattatgacccaaaaccctaacacgggcgcggtaaaagaagccctgaagaagattccctttgtggtcacagtggatagcctgatgacgtccaccgctctctattccgatctcgtgctgccctgtaccaccatctttgaaagtgaaaatgtcctcgcttcttcccgcagccattacgtgcagctgatggaaaaagccgttgatccgcctggcgaggcccacgatgacttgtggatctttacccagctcgctaaaagattgggcttcggcgacgctttcgacaagccggtggccgagcatatcaaagccgtcctggagcccacagggatcacctatgaagagttgctggaaaagaaatgcatcaatcccctgccggaggtctatataccttttgagaacgggatcttcaagacgccgacccagaaagcggagttcttcgtctacgattggcatgagaaggggttcaaccctatgctcgcctatatccgcgctgaagagagcgtcaaggggaatccggaattggcggccaaatatcctctggcctgcgtccaacgcaaaacaaaccgtaccatccattccaccttcgggtccctgcagtggttgaaccaagctgtatccgatgttcctcacgtgatgattcatcccgacgatgccggcccccgcgggatcgcccacgacgattgggtcatcctttacaacgaccggggccagcaccgctgcaaagccaatgtcagcgcccatatcaagcggggtgtcgtaacggcggagaacggctggtgggagcagcaaggcggcagcagcagctatatcaccagcgattttgtcgaacatttaagcggcggccaaagctgcaacaatacactggttcaagtacgaaag

SEQ ID NO: 33498 - DNA, 2079 bp, Desulfitobacterium hafniense
ggagcggcatctctggctatgattctggcttattacggaaagtatatcactctggaggaattaagaattgcctgcggggtatcccgggatgggagtaaagccagcaatcttctgaaagccgccaggaattatggcctggaagcgaagggttaccgaaaagaaccggaagccctgcgcaggatgcccctgcctctggtcattcactggaatttcagccacttcctcgttctcgagggcttccataaaggaaaagcagtcctgaacgacccggcggcaggtaggagaaccgtttcggaggaagaattcaatctggcttttacgggtattgttctttcctttacaccgacaactgaatttcaaaaggacagcagaaagcctggtttgagcctggccttaagaagaaggcttaaaggctcggagcaggccctgatctatatcattctattgggtctggccttagtcattcccggcttgataatccctgtgttttccagagtatttgtcgatgatatcctgttgggcggtctccattcctgggtgtggcccttgctgctggggatgggcattacggcaatgctcaggggagttttaacctggatgcagcaatattatttgcttagattggagacgaaaatcgccttagccacctccggtcagtttctgtggcatatttttcggctgcccagtgaattcttttcccagcgggcggccggtgagcttacgtccaggatacaaagcaacgataaggtggcgaagctcttgtcaggtaaactggccactacggcactgaatgtcctcatgattatgttttactttactttaatgctcacctatagctggattttagccttggtagggttggcaatcgctttcatcaatgtaggttacttgattgcggtttcggcccggagagtcgatttgaatcgcagattacttcaagatgaggggaagctgattggctcgagtatggcgggtctccaaattatcgagactctcaaagccacaggctcggaagccaacttctttgcccaatggtcgggatatcaggcgaaattgctcaatgctgaacaggagctgggagtttcttcacagtttttatccgtattccccagttttctaaccggcatcaataacgcccttgtcctggtgatcggcggttttttgattctcgatggtcaaatgaccatcggcatgctggtagctttccaaagcctgatgagcagcttcatgacgccggtcaccggactggtgggtctcggcgctgagcttcaggaaatgacaggtgagatgaatcgtttagatgatgtattaaactatccactcggtcgggaccaaggggaccaggggggtcggggggagcaggagggtttaggggggacagccgaacccccggcagggcagaagctatccggctacgtggaactcaggaacattacctttggctatagcatcttggaaccgccattgatcgaggatttcagcctaagcctgaggccggggtcacgggtggcgctcgtaggcggctccggcagcggaaaatctaccatcgccaaaatcatcgccggcatccaccatccctggtcaggtgaaattctctttgatgggcaaccccgcgcctctttcaccaaggaagtgctcagcaattccctagctatggtggatcaggaaatatgtatgcttcaagggacggtcaaagagaatattaccctctgggacggaaccatttcggagttcgggatgatccgggctgccagggatgcctgtatccatgatgagattaccgcccgaccggggggctatgaacaaatggtggaggaaggcggtaaaaattatagcggcggtcagaggcaaaggctggagatcgccagagctttagcccaaaacccggtcattctgattatggatgaagccaccagtgcacttgatcctataacagagaagaatgtggatgaatatattcgttatcgggggtgtacctgcatcattgttgcccatcgcctcagtaccatacgggattgtgacgagatcattgtactggaaaaggggaagattattgagcggggaacccatgggtccctg

SEQ ID NO: 33499 - DNA, 723 bp, Desulfitobacterium hafniense
agtgaaacaggctgcgtacgcaaaaataatgaggatgccttccttgctctgccggagtacggtgtgtatgcagtagccgacggtatgggcgggcatctggcaggggaagtagcggcacggacagccctggacgaattgatcaagggtgctccccatctgggggcccaagagaatgaggacctggagaaccaggtcagggagattttggtgcgggccaaccgggaagtgtatatgagctcgacccgcaaccctgccacggaaggaatgggtacgaccttgaccgttctggtcttcagagagactaaggttgtcctcgcccatgtgggggatagcagagcctatgtatggcgcaatgagcaactgattcagctgactcgtgatcattctttagtcggtgagctggtgcgtctgggacagatctcttcggaagaggcggatagccatcccaagcgtcatatgttggtaagagctgtgggagccggatgggatgtggaggtggactctcagttcctggagttgcagacgggggatatctttttcctctgtacggatggggtatccaatgtgatcagcgatcgggagttagaggaggagttcttgcagaaaggttcatgggaagagcacctggagcgccttcatcaactgatcatagaacgaggtgcacccgataattttacagctttatgctgtattacggagtgacaaaatgaaaagggtctggat

SEQ ID NO: 33500 - DNA, 1548 bp, Desulfitobacterium hafniense
cgtcgagctgtgctcagtgtctccaataaaacaggtcttgtggagcttgcccgaggacttgtggaattgggctttgacttgatttctaccggcggcacctttaaaacgttgaccgaagcggggctgcctgttcgctatgttaccgaggtcacgggatttccggagattctggatgggcgggtcaagacccttcatcccaggattcatgggggtattttggccagggctacggcagagcatttgcagcagctggaggacaatggcatcgggttgatcgatcttgtggtggtcaatctctatccctttaaggagaccattgccaggccgggggtttcgttccaggaggctattgaaaatatcgatattggcggtccttccatggttcgtgcggcggcaaagaatcaggagcgggtgagtatcgtcgtcaatccggagcggtacccggaggtgcttcaggccctgcgtgagcaaggggaaatctcttatgatatgcgtaaacgtttggcggcagaggcctttgcccatacagccgaatatgatcaatgcattgccgggtatttgactgccgcacttgctgaggaatccgtttcctcttcttcttcacctttccctgcaaccataacacttgggggccaaaaggctcaggatcttcgctatggggaaaaccctgctcagaaggcggccttttaccggggggcggatgcagcgggcaccttggcctatggtgaacagattcagggtaaagaattatcctataacaattggatggatatggacgcggcctgggggattgttcaggatttcagtgagccggcctgtgctattattaagcataccaatccctgcggtacagccttggggaaaactgctttggaagcttatgaaaaggccctggcagcggacccggtctcggcctttggcggaattattgcctttaaccggaccgtcgatgctgaatgtgccgcctcacttaaggctcacttctatgaagttatcgttgcccatgagttcagctctgacgccagggcaatactacaggaaaagaaaaaccttcgtctcgtcaaagtagcacaggacgggaagccagcccatacgccctggaaagttcgttccattcaaggaggatttctaattcaggaagaggatgaggggactacgccgatctccgcatgggaagtcgtcagcaagcgccaacctgaacctgaagaacttcgtgaactggactttgcctggcgggtggtaaagcatgttaaatccaatgccattgtactggccaaagccggtcaaacccttggcgtgggagcgggacagatgaatcgggttggctcagttaagattgctttagaacaggcgggggataaagcccaaggggcttatctggcctccgatgcttttttcccattccccgattccctggaggaggcggctaaggcaggagtgcgggctgtggttcaaccggggggctccgtcagagatgctgaggttatcgaagcggctgaccgtttgaatttgattatggtgtttacgaaccgccgtcactttaagcac

SEQ ID NO: 33501 - DNA, 1589 bp, Desulfitobacterium hafniense
ggatattcttatcggcaggccggggtggacattgatgcaggaaaccaggcggtggaactgatgaagccggcggtaaaacggactgttcgaccggaggtcatgggcggactgggtggatttggcgggctgtttgccctggatcttaaaaaatatccggaaccggttctggtctcgggaacggacggtgtgggaacgaagcttaagctggcgtttcagatgaaccgtcatgataccattggccaggatgcagtggctatgtgtgtcaatgatatattagttcaaggtgcggagcctttgttctttctcgattatctggccgtaggaaagctggttccggaacgggtagcccaggtggtcggcggaatcgccaagggctgtgaattggcgggctgtgccctgattgggggagagacggcagagatgccgggcttttatgacgaaggggaatacgatattgccggttttgctgtgggggctgtgaatcggcctgacctgattgacggttcacaaatccaggcaggggatgttctgatcggacttccttcttcaggatttcatagcaatggctattccttggttcgtaaaatttttactcctgacctatgggagaaaaactatccggagctgggagaaaccttgggtgaagctttaattaggcccacccggatttatgtcaagactgtcctgcctctgatcgaaagccgcaaagttcttggtatggcccatattaccgggggaggtcttacggaaaatattccccggattctccctgaaggattgggaataaaaatcgctcgttcggcttggcaggtcccggccctcttcacccttttgcaaaggctgggtgaggtggaggaagcagaaatgctgcgcacctttaatatgggtattggctttgtgctgatcgtccatcctgaagatgtcgattttattcagactcagcttcaggcagccggtgaaaagtgctttgtcttaggagaggtaagcgggcaaagcgaaggagtgagttatctttgatgcggatcggagtgcttgcgtcagggcgcgggagtaatttgcaagccttgattgaagcctggaagcttggcgaattaaacggggaactggtggctgtgggttcggatcatgaagaggccctggctctcaaaagagcggaagaggctggaataccccatggtgcctttcccttgagccggttttcttcccgccaggagcaggagaaagcgatcctgacctggctgcgggaacaaaaggtggagattttggtcttagccggatttatgagggttttaagcaaggagtttctccaggatattcagattcctgtactcaatatccacccctcccttttgccctctttccaaggattgcatgctcaaaggcaagcccttgactacggggtcaaaatctccggatgcacagttcattttgtggatgaaggtctggacagcggccccattattgcccaagaagcggtgccggttttgccgggggatacggaagattccttgtctgcccgtatcttggaagccgagcaccgtctttatccggaagcggtaggatgggtggtcggtggacggatcaaaaga

SEQ ID NO: 33502 - DNA, 1158 bp, Desulfitobacterium hafniense
aatatgtatgtacctacccgttttgtctttggcagcggccgcctgagggagctgcatcagcaaaaaatgcccggtaaaaaagcgctgattactatctccaacggcaagtctgtccgggaaaacggcgccctggaccgcacacaggagcagcttcgtcttgccggggtggcaatggttgtgttcgacaaaataggggccaaccccaccaagaccgccgtaatggagggggcaaaatctgcccgtgaccacggctgtgattttatcgtggctttaggtggcggcagtgtcatggatgcggccaaagccatagccatgatggccaccaacgacggcgacctgtgggattatgtggggggcaaaacaggcaaggggcaggccctccgccatgagcccctgcccctggtctgcattacgaccacggccggaaccggcagcgaggcggaccaatggggcgttgtgactaacgaggaaaccaatgaaaagatcggtgtcggcggctatgatgccagtttcccggtagtgtcgatcattgaccctgagctcatggtgtccgtgcctcccaagtttaccgcctaccaaggatttgatgccctgttccacgccaccgagggctatatttccaaatttgccagccctatgagcgatatgtatgccctgacggcgattgagaatgtggggaactatctggtccgtgcctgccgggatggcagggatatggaagcccgggaagggatggcctttgccaacaccctctccggtgtggtgatgactgtcagtgtgacaacggcggaacactccttggagcacgccatgtccgcctatcaccctgagcttcctcacggtgcgggactgattatgatttcccgggccttttacgaattctttatcgaaaagcacgcttgtgatcagcgctttgtccgtatggcccaggctttgggcatgaaggatgctgccaggccggaagactttatcaccatgctggttaagcttcaggaaaactgcggtgtggccgacctgaaaatgagcgattacggtatgactcccgatgagttcgacaagctggcagccaatgcccgtgagaccatgggcggtctgttcgcagcgaatccctatgcaatgactcatgaggactgcgtggaagtttacagaaaatcatat

SEQ ID NO: 33503 - DNA, 633 bp, Desulfitobacterium hafniense
atggctaaactgggaataaccatagatcagagtcgctgtgtggggtgcaatacctgtgcagtggcctgcaaaatgcaaaataatgtccccatgggcatgctctggaaccgggtgctcaccgaaagcggcgaaggcctggacagtgcggaaggggagtatcctcatctgacgaaaaactggctgaccgtggcctgccagcattgtgaaaatgccccttgcgtcaaagtctgcccggtaggggcaacctataaggcggaggacggcagggtcttgatcaactatgaccgctgtatcggctgccgttactgcatggccgcctgcccctacaatgccagggtgttcaactggcagaggccggttcgtcagcctgatttcagttgcggggacgcccccgtccggccgtcaggtgttgtggaaaagtgctccatgtgcaaagagcggaccgaccaggggctggaacccctgtgcgttgtggtctgtccggccaaagcccgcaaattcggcaatctggatgacctcaacagcccggtctcccaagcaatccgcgggaagaattcataccggcttctggaagagttgggaacaaagccgcaagtttattacttgcgttaaaggagatgagaatatggacaa

SEQ ID NO: 33504 - DNA, 2349 bp, Desulfitobacterium hafniense
atggagatctcaaggcggaactttattaaggccagcggcggattggccgctttcggaatgataggtaccggatcattgaaccgttggattcgtccggcagcagcggaaggggcggaagaggagaagattgcctatacctttcatccccccaactgcggaggccgttgttcaatgaaatgcaccgtccgtaagggcaagttggtgaaaattgagcctaatgaatggcccgacggccatcacaaaaaagtgtgcctcaggggcctcagcgaagtagaacgagtgtacagcccggatcgtttaaagacccccctgaaacgggttggggaaagaggagaaggcaagtttgtagctatctcctgggatgaagccctgacgaccattgccgacaagcttacggaaatcaaaggcaaatacggcggaaaatcgattttatggtcaaacagttccggcgtccagtatcccatgagtaccttggccgccctgatcggcgctcaggagcatggtgctttggatttcggcatcgacatgagtcaggccggcgggcaatccatcgttatgggacccttcaatataaccaataccaatgagattacggactgggtcaattccaatctggttctgttggtgggcaataacttattggaaacctcactcactgatgcggcctttttctttgacgctaaggaaaaaggcacgaagatggtctgcattgatccggtgttttccacgacagcggcgaagtgcgatcaatggattccccttcgccccgggacggacagcgccttatatttaggcatgatccatctggtcctgaataatcaatggtatgatcaggagtatgtcagaagttataccagtgctccctttctgatccgggaagacaaccaaaggattttacgggatgaaggaaataactatctggtctgggataagaattccgattccccccgacctgttgatgcaccggggattctgccggaattagaaggagagtttacggtaaatggagttaaagtgaaaacggttctgacagcattcactgaacatatccggcaatataccccggcctgggcggctaaagtgacggagataccggaagaggtcatcacggatttgaccagggaatacgcccttggcggcccggccagcatccaatggggtttgggcggcccggataaatggtatcattccgataccaccggccgtctggctaccatcctcgccggcctcaccggaaatatcggccgtgtgggaggcggagtcgggcaaggcactcagcatgtaacctgctggtcctgggtcaccgctatgggcagctgggatttgccgccggagtttgctccagccccggctgaagtgccttttagtgacattcctacggcttccacctccatcaaggctttcttttttcagggaaatatgctccatcagatgatacctgattacaatacatccttaaaatgggccgactccctggaatttatcgctgtggtggacaaccagcattgtgacagcgtcaattacgccgatattgtcctgccggcctgctcaagttttgaatcggagtatgacatcgcttatttgatcaatgagcggaatcacattctgctccagcaaaaagtcattgaacccttatttgaaagcaaatccgattttcaaattgaaaaggaactggctcaaaagctgggccttgaccaatatctgcctgagacaccggaagattatgtgcgggcgctcttgaactcaccggacccggccctccagggaatcacggtggaagcgctgaaagccaatcaatgcatcatgaggctgaatgttcctgatcagccttacgtagcctatcttgaccgggtattcggtactgagtccaccaaactggagttttacaatgaattattcctggaagaccattgcgctttccccgtgtgggaggaacccaacgaagcgtcgccggccaatcccctctatcaaaaatatcccctcatgttaggttcaccccatgctcgtttccgtgcccattccacattctccaatgctcgctggctgttgcagattaataatgaacctcttgtccggattaatcccatcgacgcccaggcccggggaattcaaaataaagagtttgtggaagtgtttaatgaccggggaagcttccagtgccgctgccagatcgtcaatgatatgcgcccgggaatggttcagctttccgaaggatggtggtcccgctatttccaaaaaggagacttgcaggaagtcaccaatcccaacaaaaatccccgcggcaagaagctgctctatggtccgattgttgcttttctggataccttggtcgaagtgaagaaagtggag

SEQ ID NO: 33505 - DNA, 555 bp, Desulfitobacterium hafniense
cttatcggtaaagaagtaaacgagttcaaggtgcaggcttttgtggaaggtgctttcaaggaagtaaccaaaggggatttgctgggcaaatggtcggttttcgtattctatcccgctgattttaccttcgtttgccccacagagctgggggatttggccgatcaatacgatgaattcaagaaaatcggtgtggagatctactccgtgtccaccgacactcattttgtgcataaggcttggcatgatgcctccgacaccatcagaaaaatccgctatccgatgctggccgacccaactgccaagctggccaaggactttgaggtttatattgaagaggagggcttagctctgcggggcagctttgtggtcaatcctgaagggaagatcgtagcctatgaagtcaacagcaacaacatcggccgtgaggcctcggaattgctgcgcaaggtccaggctgcccagttcgttgcggagcatggggatcaggtttgcccggccaaatggcggcccggagcggagacgctcaaacccagcctggatctggtagggaagctg

SEQ ID NO: 33506 - DNA, 1260 bp, Desulfitobacterium hafniense
atggatcgctatgtcattaccggaaaacaacagttggaaggtagactgcgtaatagtggagccaaaaactcatccctacctttactggcagcttctttgctggtttcgggaaaaaccacgttattggatattccccatttagcagatatcagcaatatgatcgaagtgctggaatatctcggtgctcatgtggaagatcaaaaagaggctttgcttgtagatgcttcagacctggcccgctgggaagtggatgaaggactgatgcgtcaaatgcgagcctctaatcttatccttggtcccatactggctcgcaacgggcgggtgcgcatctccaaaccgggcgggtgtgcgattggttcgcggcccatggatcaacacatcaagggcctccaggaactgggggtcaaggttaaagaaaaacatggttatatcgaggcttgggcggatcagctccaaggggctaagatttatttggatctccccagcgtaggagctacggaaaacctcatgatggcggctgtcctggctaaaggaaccaccactatctacaatgcggccagggagccggagattatcgatctgcagaatttcctgaacaagatgggggcaaaagtccgcggtgccggcatggatgttctgcgcattgaaggagtgagcaagctctatcctgtggagcatacggtgataccggatcggatcgaggcggggacccatatggtggccgccgtaatgactcagggagatattgaaatcagcaatgtgattcctgagcatttagagcctgtgacggctaaactgctgcaagcgggggcggagatcatcctcggggatgacacgattcgggtcaagggcaagaggagaatcaagggagtggattgcaaaactatgcctcatcccggttttccaacggatatgcagcctcaattcatggccctgctgtccatggctgaggggaccagcatcattactgaaaccattttcgaaaaccgttttcagcatgtggatgaacttcgccgcatgggggctcaaattactgtggaagggcggacagctattatccgcggtgtgaaaagtctggagggcgcctttgtagaggctacggatctgcgggcgggagccgcactttttctggcggctttagctgccgaagaagctactgtgctggaaaaggtgggacatatcgatcgcggctatgataatctggaggaaaaataccgcagtgtaggtgccaagctcaaacgggtcaaatcttagagtgcc

SEQ ID NO: 33507 - DNA, 3530 bp, Desulfitobacterium hafniense
aactatgtagctaaaatgggaggcgctcttctccttgccgccttgatcagcctggctttcggactgttggcggggaggactgccgccgttgcctcagcaggctttgcccagaatctgcgtcaagacatgttttataaagtccagagcttttctttcgtcaacatcgacaagttctccacagcaagcatcgtgacccggctgaccacagatgttaccaatgtgcagaactccttccaaatgctgacccgtatggctatacgcagtccgatcatgcttttctttgccctctttgtctcctttagtatcgatcagaagctgtcactgattttcctggggagcatccctattctgggcgtggggctatggctgattatgagcaatgttcatcccatcttcgccagggtcttccggacctatgataagctcaataatgtcgttcaggaaaatctccggggcatgcgcgtggtcaagtcttttgtccgcgaagattttgaaacccaaaaattcatggctatttcccaatccatttataaggactttaccaaagcggaacggctgctggtctttaatatgccgctgatgcaattttgcatgtatgcctgtatccttttcgtatcctggtttggcgcccgggccattgtggcttccggcggcgatcctgtggccggactttccaccggggaacttttgagtttgattacttatgccactcagattctcatgagcctgatgatgctttccatggtctttgtcatgctgaccatctcccgggcttctgccgcgagaatcgtggaacttctggaggaagagagcaacctgcaaaacaaggaccacccggtttgccaagtccccaatggcgatatctcctttgaaaatgtcagcttcagctatagcaaagatgcggataaaccggtcctggataggatcaatctggacattcgatccggtgagactcttggcattctggggggaacgggatcctctaaatccacgttagtccaattgattccccgtttgtatgatgtgactgagggcaaggtcaaggtgggcggtgttgatgtcagggattatgacctggagacgctgcgcaaccaagtagccatggtcctgcagaagaatgtgcttttctcaggaacgattaaagagaatctgcgctgggggaatgagcaggctactgaggaagagatgattcaggcctgcaagctggcccatgcccatgatttcatcgccgggttcccccaccaatacgataccctgatcgagcagggaggggtcaatctctcgggagggcagaagcagcggctctgtatcgcccgggctttgctgaagaacccgcaaatcctaattctcgatgattcaacaagtgccgtggatatggagacggatgcccagatccgcaaggcgctggctgagcacctgccggataccaccaagctgatcatcgctcagcgggtttcatcggtccaggatgccgaccggatcatcgtcatggacgatggaaaaataaaggctgtaggttcccatgaggaattgctgcagaccagtgagatttacaaggaggtctatgagtcacaagcgaaaggaggggaagaaggatgatgggattcagaggcgggccgggaaagagttcggctcatggcaggggacttcccggcgggaaaccgccccatgacaaattcaacccccagacagccaaacggcttttgtcttatttgcgggattacaaggtgcaaaccttcttcgttatggtcgctattctgatcagtgccctggtcggggttctgtcttccgtattccttaaaatcctgatcgatgattatattgcacctcttcttctggaggccgttcccaactatgccggattgctgcggatcataatggtgatggcagggatttacctgattggcgttctggccaccttaatctacaactggattatggtgtcgatctcccaaggcatcttaaagaaaatccgggatgagatgttttcccatatgcagaagctgccggttaaatactttgattcccatactcatggggatgtgatgagccattacaccaatgatacggataccttaagacagatgatctctcagggtatccctcagaccttttcttccttcattacgattgtggcggttttctttgccatgctttacctcagtgtctggctgaccgtgtttgtggtcttgtgtattttcctaatcctaaaggttattggcagcatcgccggcaagagcggcacctattttatgcagcagcagcaatccctgggaactctcaatggctatattgaggaaatgatccatggccagcgggtggtcaaggtcttcaactatgaggaaaaaagcaaagagtcctttaaccgcaaaaatgaagagctttgcgcccatgccaccgccgccaattcctatgtcaatatcatcatgcccatgatgagcaattttggctatctcctttatgtagcgttggccattgtgggaggtctcctagtgattggaggagtgaccaatctgaccatcaccgggaccaatgcactcaccctgggaaccattgcttcttttctgcagttgtcccgcagttttatcatgcccattgcgcaggtgtcccagcagttgaatgccattattatggctttggcaggggcggaacggatcttcaaactccttgatgaaaagccggaaaaggatgaagggcaagtgaccttggtccatgtcaaacaagaaaggggccccatagttgaaaccagctcgcataccgatgggtgggcctggaaaattcctcaggaagatggcatggtggactatcgggagcttaaaggagaagtccgtttcttcgatgtggactttggctacgaggagaacaagatggttctgcacaacatcactttgtatgccgaacccgggcaaaaggtggcttttgtgggggctacgggagcgggcaagaccactattaccaatctcatcaaccgtttctatgatctggccgacggcaagatccgctatgacggtattaatatcaataaaatcaaaaaggaggacttgcgccgctccttaggtatcgtgctccaggatgtcaatctgtttacagggtcagtgatggaaaatatccgctatggccgcctggatgccacggatgaggactgtatcgcggcggccaagctggccaatgccgacggttttatccgcatgctcccccaaggttatcagacagttctttccggggacggcagcggtttatcccagggtcagcggcagctcatctccattgcccgtgctgcggtagcagatccgccggtgatgattctcgatgaagccacttcctccatcgatacccgcaccgaggccatcgtccaacggggcatggactccttaatggaagggagaacggtctttgtcattgcccacaggctttccaccgtcaaaaactccgatgtgatcatggtacttgaggaggggagagttattgaacggggcagccatgagaagctgattgctgaaaagggcaaatattatcagctttatacagga

SEQ ID NO: 33508 - DNA, 2688 bp, Desulfitobacterium hafniense
tggcatgttttgccctggctggatgtggttaaggctttggaggtgcatcctggcaaagggttaaacctgaaggaggttaaccggcggctgggcgaagtggggagaaacattctggagaccaaaaaaggggttcatccggtctttctctttctcggacaattcaaggattttatggtcttggttcttttggctgcgaccatcgttccgcactcttaggggaaatcgccgatgccgtaacgattatggccatcctggttctgaatgcagtcctgagctttatccaggaattccgggcggagcgctctaattgaatccttaaaatccttaacggccccggaagcccgggtcttgcgggatggcctggaaagcaggattaccgcagcggaccttgttccgggagatatcgttctcctggaggacggggatcggatcctgccgacatcgatggatcaggccgtgaatgtggaagtggaggaatccgctttgaccggtgaatcccacccggtggccaagcggttggctcctttgaccgatgagctgacccccatggctgatcgggtgaatatggggtatatgggtacctccttagtcggcggccgcggggccggggtcgtggtggccacgggaatggagacggaaatgggcgttattgccggcatgatccagagtgtggaggaggaagagacccctctgcaaaagcgcctggcccaactgggcaaatatttggtcattatcagtattatcgtctgcggtattgtagtcctgaccggggttctgcggggggaaggcttctataagatgttcctggccggggtctccctggctgtggcggccattccggaagggttgccggctatcgttaccgtagccctggccatcggggtgcaaagaatggtgaagcgcaaagccatcatccgcaagctccctgctgtggagaccctgggttgtgccacagtcatctgttccgataaaaccgggaccctcactcaaaatgaaatgaccgtacggcaaatctatacggatcgcacaatggttgccgtaaccggacagggctatgatcctaaaggggacttccatggggcggatcccaccaaggaaaaaggccccttacagtcagctttgaaaattgcttccctgtgcaataattcctccctgacccgcaagggggtgcaggtggcgggaatgttccgggccgcgggcaaggattctccctggggaatcgagggagaccctacggagggcgctctgctggttgccgccgccaaggcgggaatctggcgggaaaccctggagcgcaaggaagagcgggttggggaaattccctttgactcggatcgcaagcgcatgagcgtgatctataaaggcaaacgggaaaagaaggcctatgtcaagggagctcctgatgagatccttaggcgctgccgccatgagctgacttccgaaggcattgtggaattgaacgagctgagaagaagggctattctgagggccaatgatgagatggctaaaaaagctttaagggttctggccttagccgagaaacccttgcaggaaaacgagcggattgacgaacgggtagaggaagatttgactttcgtagggcttatggggatgattgacccgccccgggccagcgcggccaaagcgatcaaagtgtgccgaagagccggcatcaagccggtgatgatcacaggggatcaccgtctcacagcagaggctgtggcccgggaactgggaattctcaaaggcaatggcgacggcatactgaccggctccgatctggaccggatgtccgatgaagcgctggaaaaggaagtcatgaatatctccgtctacgcccgggtcacccccaaggataagctcaggatcgtccgcgccctcaagaagaacgatcaagtggtggccatgacgggggacggagtcaatgatgcccccgccgtcaaagaggcggatatcgggatctccatgggcaagacggggaccgacgtcaccaaagaagcctcggccatggtcctggccgacgataatttcgccactattgtggccgccgtggaagagggccgggccatctacgataatatccgcaagtttatccgttacctgctctcctgcaatatcggtgaagttctggtcatgttcctggccgctttggtagggttgcccttgcccttgctggctatccagattctctgggttaacctggtgaccgatggtttgccggccatggctttgggtgtggacggcatggataaagatattatgaaccgcaagccgcgggaacccggggagagtatctttgcccgggggttggcacggaagatcatggtccgcggtctgatcattggcttaggctccctgctggtatttgtgactgccatgttcttgggagtgaatatgctggcggcccggaccatggcctttaccaccttggtattctcccagctcttccatgtctttgactgcaaatcggaaacccggggcatttttgaggtgggaatcttctctaatccttatctggtagcggcagtgatcggctccaccctgatgcagctcagtgtcatttacctcccgcctctccaggccatttttaaaaccacacctttaatgggctggcaatgggcattgatcttagcggtagccggcggtccttccattttgattggcttataccgtttagtccgcaatacc

SEQ ID NO: 33509 - DNA, 828 bp, Desulfitobacterium hafniense
aaaatgcacggcctgggcaatgattttgtctttatcgatcactttcagggcgccccggcagagctccccgattatccggagttggcccgtaagctttgccaccgccagttcggagtggggggagacgggctgattatggttctgccctcggataaagcggacgccaggatgcgcatcctgaattcggatggctcagagccggagatgtgcggcaatggcattcgttgttttgcccgctatatctatgatcagggctatgtttcccaaaaccccctccaggtggagaccttggccgggattcttaccctgcagctcagcatcaccggagatcaagtcaccggggtgcgggtggatatgggggagccgatcctcaagtcggaacaggttccagtacttattcagggcgatcctgtagtgggagccaggcttgatgtggatgggcaggaattcgaatttacggcagtgtccatgggcaaccctcactgcgtgctctttgtggaagattacgaaacccttgattttgagcggatcggcccggccattgaaaaacatccactctttccccgcaaaaccaatgtggagtttatcatcgtcaacagcccccgggaactgaccatgaaggtatgggagcggggagcgggtcccaccctggcctgcggaacaggggcctgcgcttctgtagtggccgccgtccttaacggcaggacggagcgtaaggtcaccgttcatttgccgggaggcgatctcctgattgaatggggagaggataaccgggtgtacatgaccggaccggcggcctatgtatttaaaggggttttgctggaggat

SEQ ID NO: 33510 - DNA, 525 bp, Desulfitobacterium hafniense
caaaagggcttttattttgatatgaccgcctgtgtcggctgccggacttgccaaatcgcctgtaaagataaaaacaatttgaatgtaggcactttcttccgcaaagtgcgggcttatgagacgggcgtctttccccaacccggcatttatcactattctgaaacctgcaatcactgtgaaaaaccgaaatgtgcggaaggctgccccaccactgctttgcacaagctggaaaacggcattgtcgatcatgataaaaacaaatgcattggctgccggttctgtgtctggaactgcccctacggtgtcccccagtttatcgaagctttggggcagatcagcaaatgcgatatgtgtaaagatttggtcgaggaaggtgcaaatcctgtctgcgtggacgcctgtcctctgcgggctattcattggggagagctggaggaattaaaagctcaatacggcagcggaagtgtccgcgatttagccatcctgcctgattcctccatcacacagccttccctgcttgttaag

SEQ ID NO: 33511 - DNA, 2514 bp, Desulfitobacterium hafniense
ataagccgcagaacgttcctggccgctaccgcagccggaactgccggcttggcgcttgcgggctgcagtggtaatatcctcacccccgcaggagccaatcttgatacagcaaaagaaggcaaatgggtctcagccacttgctggcataactgcggcggccgttgtgtcaataaagcttatgtggtggatggggtcattgtccggcagaaaaccgatgatacccgcccagacacaccagatgctccccagcaaagaggatgtctgagagggcgctcacaaaagcatcaggcccaaggtgtggaccgtttgaaataccctatgaagagaaaaaactgggaaccaggcggcggtaaaaaggaactgcgcggccaggacgagtgggtgcggatttcctgggatgaagctctggatattcttaccagcgaactgcaacgcatcaaaggtgcttatggcaatgcttccattcttgttccgggagaagcgaacagtgaagttatgaatttaatgagtatctacggtggttttgttccctcttgggggacgatgtcctttggctcctggttcataacccctcatattattggtttcgctgataatttattcgatcccaaagcccttaacgaccgttttgatatgcgaaaaaccgatcttgtcgttgccttcggcatcaatccggcctggagttccctgggtaatcctatgtatcatttcctgcaaatgaaagaagccggtacaaaattcattattattgaccccttttatactgatactgctgccactttagaagccgaatggattccgatcaaaccggccacagacatgaccttgctcctggctatggcctataccctaatcgtcgaggacgatccggtcaataaacctttaatcgattgggatttcctcaatcgctgtactgtagggtttgatgttgagcatatgccggcagatgccgaaaccaatgaaaacttcaaggattatgtcttgggcaagtatgacaatatccccaaaaccccggaatgggcttcggaaatctgcggaatagaccctcacaccattaagtacctggcccgggccatcggcatgcagaataaggtcagtatcctggccagctgggcatccgggcgagctcagaattccgacaatctcccccagatgtttatgactctgggggccatgaccggacatttcggcaaatccggccatatgaccggtgcctcctgctggaactatgcaggcaaccccggtcccgcccttgtcaaccctggcggcagcggcgaaccatttctgggcagccccttgaaagaagtcctctgtgaagcagacatgtggaccggccttctccgcaaaaaatatcttcccaatagtatcatgaaaaccatcaaatattccccgccgacttggcaggacaccgtcaaaggagtggatctgaagactcgtgtgcaagaggaggatattaatatccaaatgatttggcatacttctgaagccaccctgcaaacccgggatgggatgaacaaaggaatcgaggctcatcgggccgtggagttcgtcgtcagccaatcccatttcctaaccaccaactcgaaatatgccgatctggtcctgcccgttaccaccttgtgggaaagagccggcgatatcgatggcttgttcagcaaccgcgatgtgctcattgtctcttcccaagtcattgaacccattttcgaggccaaagatgataactggattgctgtggaggtaggcaagcgcttaggattggatgtttcccaaatagttgtcagcgaccgcaagcagcagctctttaataaactggctggctccacggtggtaaaagaagacggcaaaacctttgaacctttagtagacatcactgctgaggatatttctgaatggggagtttcgggacagcctcaaacaggacgcattcccctgacgaagctccttgaagatggtgtctatcaggtagaacgtcatgagggagacaattatggctttattgcttatgaagatttccgcaaggatcccgaaaagaaccctgtcaattcagtcagcggcaagctggaaatctacagccaaacccttgccgatatcataaataaccttggttacacgaaaatttctccctaccccaaatatgtcccgcccatccaagggtacgaagctaccttctctgattggcaaagcaaggccaaaggggcttatccctatcagttgattacgccccattaccttcgccgctctcactccatctttgataatattctccagctaagagaggcctgccccaacccggtattcctgtcagctcaggatgccgcagcaaaggggatcaaggacaaagataccgttctcatcaccagcgaattcggccaagtcctgcgcaacgcctgtgtcaccgaacgtctggttcccggcgttgtcgccctcccccatggttcttggtgtgatgtggatgaaaaaacgggcatcgatcatggcggagcagacaatatcctttccggtaacgtccccacc

SEQ ID NO: 33512 - DNA, 2427 bp, Desulfitobacterium hafniense
ggtattattaataaacaaataaatcgcaggaattttctaaaagccagtgccatcggcgcagccggcctggctttacccggctgcagttccagtacgctcaccaataccggagttgacgcaacggctgacggcaatgagggtcaatggattacggcagcttgctggcataactgtggcggacgctgtctgaacaaagctttagtggtggatggagtggttgttcggcaaaaaacggacgatacccatgaagatagtccggacttccctcagcaaagaggctgtgcccgcggccgttctcaccgcaaaatggtgatgggcgccgatcgtctcaaataccctatgaaacgcaaaaactgggcgccggggggcggcaacaaagaacttcgcggccaagacgaatgggtgcgcatttcttgggatgaagcccttgatattatggcttctgaattaacgcggattaaggatgcctatggcaaccgcgccatttttgcacctgtaggcggctccgacagtcttcaagctgtgccccgtctgctcagtgcttttggcggttatacggcccgttggggaagtgtgtcctggggatcatggcctacagtctattccaaggttaccggccagcctcacaacggagccagcgacggcaacgatcgtttccgcttgagagagtccaagctgatcattctctggggagctaatcccgctcaatccagtcagggtttgccggcttataattatctgcaggccaaaaaagccggggttaaatttatcgtgattgatcccatttactcggaatcggcgagagttttggccgatgaatggattccgatccgtccggctacagacacagccttgatcttaggtatggcctactacatcattaaaaataatctgcttgaccaaaatttcctggataactgcacaattggctttgatgccgatcacttgccggaaggtgccgatcccaaagataatttcaaagattatgttctgggaacctatgacaatacgcccaagactccggagtgggcttccgaaatctgtggtgttcctgctgtcaagatcgccgaatttgcccaagagtatgcaaccacgaaaccggcggcgattatttccggcggagccccggcccggatcaataatggcgagcatttgccccatgccatgatgaccttggcctatatggtaggaaacgtgggtattcccggtgccggtgtcagcccgaatatgcataattcggccaccaacgccggaccggctttggttaaagcaggaggcaacggtctgccgaaaatagtcaatcccattgatgacagtatcaatagcggcgaaatgtatgacgccattcttaatggcaaatacatcaagcaaaaaggagaaatcagagacatcaacatccagatgatttggacctggttcagccataaccttaatcaaagggcagggtccagccagggtatagatgcgtatcggaaggttgagttcgtggtcgctcagaacatgtttttaacagctgacgcccaatatgccgatctggtgctccccgtgacctccgaatgggaacggctgggcggactcctgacaggcaaccgggaaatcctcatccattatcgccagattgtcgagccccaatatgaagccaagagtgatctgtggattgtcaaggagattggcaaaaagctgggcatcgatccgacgaaagtttgccccgtatctgaagaacagcaaatgtacaatcagttggcaggggctgaagtcatcaaagaagacggctcaggatatgaaaagctgctcaccctgacggctgaggatatcaaggtcttgggtgccgagggcgaaccacagaccggccgcatcacttaccaggaatttaaggaaaagggcatttatcaagttccccgtcacaaaggagataagttggaatttaccagctttgaagattttgtcgccgatcctgccaatcataaagtaaatactcccagcggtaaatttgaaatttactgcaagtctttggcagacaatatcgaaaaggtgggcttcaccagcaaatcccccattcctaaatatgaaccttctgtggaaggttacgaagatggccagaaaaacggctatcccttccaattgatcacgattcattacttcagaagatcccactcaactctggataatgtaacctggctcagagaggctttcaaccaggaatgccgcctgaatgcccaggatgcggctgaattgggaatcaaaaccggcgatattgtcaaagtgaccagccagcatggttctgtcattcgccctgtctatgtcaccgaaaccattacccccggtgtcgtatcccttggggaaggggcctggattgatatggatgaaggcaatggcgtggataaagcaggctgtaccggaattctcaacgggccgattgccacaggt

SEQ ID NO: 33513 - DNA, 1131 bp, Desulfitobacterium hafniense
ttgaactttaatcttaccgaagatcaaaagatgatgcgaaaaatggtcagagattttgtggaagaagaggtcattccccaggcggctcataccgatgagacccatgagtttcctttggccttggtacataagatgcgagaactgggactgctggggatccctattccggaggagtatggaggggccggctccgattttacctcctataccttagcccttgaggagatcgcccggggctgtgcctccacggccgtcattatggctgttcacaccacccttggcacctttccgatatattattttggcaatgaagaacaaaaacagaagtatttgccgaagcttgccaaaggagagatgctgggagcctttgccctcacggaaccgaactccgggtccgatgcctccagtttagtcaccaccgccaagcgccgcggcgaccactatgtgatcaacggcagcaaacgctttatctccaacaccggctatgccggaatctatacagttctggcttccaccgaccgcaccaagggttcccggggaattacggcttttcttgtcgatgccgatactcccggtcttatcatcggcaagaaagaaaagaaaatgggactccacggttcatcgacccgtgaattgatttttgaggatatggtggttcctgtggagaacagattaggagaagaggggcaagggtttaaaattgccatggccttgcttgacgatggccggatcgggattggggcccaggcggtagggattgcccaggcagcttttgaggctgccctggcctatgctcaggaaagggttcaattcaagcaggagattatgaatttccaaggcatccaattcatgcttgcggatatggccgcccaactggaggcagcccgcttattggtctatcaggcggccgtcaggcgggtggagggggtgccctatagtaaagaggcttccatggccaaattattcgccagtgaaatggcggtcaaagtgaccaatgatgccatgcagatcttcgggggctacggctacacccgggaatatcccatcgaacgctatctgcgggatgccaaaatcactcaaatctatgaaggcaccaaccagattcagcggattgttattgctaaacattta

SEQ ID NO: 33514 - DNA, 837 bp, Desulfitobacterium hafniense
atgaaaacgattatgatcatcggagcggggcaaatgggctccggaattgcccaagtagcggctcaggcagggtacacggtcatcttaaatgatatcaaggaggaatatgtagcccgtggtctgaaaggaattgagaagaatctggaccgcagtgtggaaaaaggcaaactcaccgctgaagaaaagtccaagatcctcgggcagcttcaggccagtgtttctcttcaggatggggttctggctgatttagtcatcgaagcggcagttgaaaacatggcgattaaacatgatattttccaaactttggatagggtttgccctgaacataccatcttggcttccaatacgtcctcattgccgattacggaaatcggcgcctgcaccaagcgcccggacaaagtgatcgggatgcattttatgaatccggtgccggtgatgaagcttgtggagatcatccgcggcctggcaaccagtgatgaagtgtataccgagatcgagaacctgagtgtggccatggggaaaaccccggtggaagtcaatgatgccccgggcttcgtcgccaaccggattctgattccgatgattaacgaagccatatggacccttaacgagggcattgccaaaccggaagctatcgacaatgtcatgaagctgggagccaatcatcccatgggtcctttggctctggcggatctgatcggtttagatacggtcctggccatttgtgatgtgctccatgaagggcttggcgataaataccggccctgccccctgttgagaaaatatgtcaaggcaggctggctgggcagaaaaacgggcagaggtttctacacttat

SEQ ID NO: 33515 - DNA, 1137 bp, Desulfitobacterium hafniense
atgatttttgagttgagtgaagaccatgtgatgatgaggaaaatggtgcgggattttgccgagaatgagtgtgcggcaggcgccgaagagcgggatgaaaaagaagaatttccccgtgagatatggaataaactggcggaactgggcctggcggggatcacctttcccgagaaatacggcggtgtggaggccgactatttatcctatgccatcgcggttgaggaattatcacgggtggatgcctcagtcggggtgactgtgtccgctcattccagtttatgtgcaaatcccatttacctctttggtacggaagaacaaaaacaaaaatatctcgttcctctggccagcggcgaaaagatgggagcatttggcttaacggagccaatggccggctccgatgcttccggaacccggaccaccgcagttaaggatggggatgattatatcatcaatggcaccaaaatttttatcaccaacgcctatgaagccgatacttacgtggtcacggcccagatggataagagcaaagggaataagggcatcgccgcctttattctggaaaagggtatgccgggctttagctttggcaagaaggaaaaaaagatggggatccgctcttcggccacctatgaattggtctttgataatgtcagggtcccgggagaaaacctcttaggtcaggaaggacaaggatttaagattgccatggtcactctggacttcggcagaatcggcattgcctcccaagctttgggcatcgcccaaggggcttatgagcaagccaggaaatatgctaaagaaagagttcaattcggccagcccatcgcacaattccaagccaaccaatttaagctggcagatatggccacccagatcgaagcagcccggttattggtttatcaagcggcttatctggccacccagcataaacctgtctccaaagcttcagctatggctaagcttcatgcctcagagacagccatgtgggtgaccacccaggcggtccaaatgcacggcggctatggatatacccgtgagtatcccgtagagcggatgatgcgggatgccaagatcacagagatttatgaaggcaccagtgaagtacagcgtatcgtcatcggcagccatatcttaaaa

SEQ ID NO: 33516 - DNA, 1167 bp, Desulfitobacterium hafniense
gtagtgattgtcagtgctgtccgtacacccctggggtcctttgggggagctttagagaactttacaggagccgaactgggagctatcgtgatcaaggaagcgatcaaacgggccggaatcctgcctgcacaagtggaagaagtcattatggggaatgtactcagtgctgcggcaggtcaaaaccctgcccgacaagcagcaattaaagcaggaattcctcaagaagtgcccgcctggaccctgaataaggtctgcggttccggacttaaatcggtaatctgtggagcccaggccatcctggccggtgatgcggatattattgtggccggcggcatggagtgcatgtcctcatcggcttatgctctccctaaagcaagaaaaggctatcggatgggcaatgacagcctggtggataccatgatcatggatgggttaaccgatgctttccataatattcacatgggattgaccgccgagaatatcgctgagcagttccagatttcccgggaggatcaggatgctttggcgctgcgcagtcaaaaccgggccgaggccgcgatccaatccggattattcgatgaagagattgtcgctgtggaaattccccaaaaaagaggagagcctctggtgttcagtcaggatgagtttccccgtttcggcaccactgccgatactttgaccaagctgcggccggcctttaagaaagagggtacggtgactgcgggcaacgcttcagggatcaatgacggggctgccgcagtggtggtcatgtccaaagagaaggctgaagaattgggattagcagtcctggccaaaatcacttcctgggcttctgccggggtggatcctctgatcatggggaccggaccgatccctgcgacacgaaaagccttggccaaagccggactgactattgccgatattgacctggtggaggccaatgaagcctttgccgcccaggccgctatcgttacccgggagctgggactggatgtggaaaagaccaatgtcaacggcggtgccatcgccttggggcaccccatcggtgcttccggcacccgcgttctggtcacccttcttcatgaattgaaacgacgggacggacagcgggggctggccaccttatgcatcggcggcggtcagggcgtcagcctgattgtagagaga

SEQ ID NO: 33517 - DNA, 1122 bp, Desulfitobacterium hafniense
gtgaattttgaactgagcggtgaaacattgatgatcagagacatggtcagaaaatttgcccaaaaccaactggcaccgctggccccggaattggacaaatcccatgagtttcccatggctacatggaacaaaatgagagaacttggccttacaggctttcccattcctgaagaatgggggggcggcggcggttcttacctggattttgccattatcgtggaagaactggccaaagcctgcgcatcgacagcggtgattaccagtgtccacaccggtttaggctgtatgagcatgtacctctatggcagccagcagttaaaagaaaaatacctggagcgattggctacaggggagattatcggagcttatgccctgaccgagcctaacgccggctcagatgccggggcgctccgctgcaaagctgaagaccggggggatcatttcctggtcaatggcggcaagatattcatcaccaatggcacggtggccacgactttctgtacttttgtcaagaccgatcctacccagccgaaagggaaggggatcacttgcttgctgatcgaaaaagatctgcccggatttaccatcagcaaacctgtcgagaagatgggcatgcatggctcacctactgtagagcttatttttgaaaatgtcaaagtccccaaagaaaatgtccttggggagatcaataacggatttgccgtggccatggggctgctggccgggggacggatcaccattggggctcagggtctgggaattgctgaaggcgcccttgactacaccatcaattatatcaaagagcgacagcagtttgataaacccctggctgccaatcaaggggttcaattcatgatcgccgacatggccacgaaaatcgaagcggcgcaaatgctcatctaccgggcagcctggctcaaagatcatcaactgccccataacaaagaagcatccatggcgaagctttttgctaccgacgtggccatggaagtcaccacgaattgtgtgcagttattagggggttatggttattgttccgaatacccggtggagcgcatgatgcgggatgctaagatcacccaaatctatgaaggctccaatcagattcagcgtatgatcatc

SEQ ID NO: 33518 - DNA, 1212 bp, Desulfitobacterium hafniense
cgccaggtcgtctgtgtggaagcctgccggacaccctatggcaagtcgctgggggccctgctggaatacgatgcggctcaattgggagcactggctattaaagaagttctccggcgaaccaagggaaaagtcgccccaggtgaagtggattatgtgatcatgggtcatgtcgtccaggcgggcagcggtcaggtctccagccgccaggccactcttttggcaggattgccggaacatgtcccttccattacggtcaataaagtatgctcctccggtgtcaaaaccattgacctgggggcgcaaatgattgccttaggcagggcggaaatcgtcattgccggtgggcaggagagcatgagcaatattcctttctcactgccggacatgcgcagaggcaggaagatggggcttcccactattgactgtgttgatctgatggtcaaggacggactttgggattccttctatgagcgccatatggccattcacggttccgaagtggccgatgaattcggctacagccgggaggagcaggacgaatgggccctccattcacagctcgccgcctcggcagcgattgccgccgggaagcttgatgctgaaatctttccggtggccgttaaaacgggcaaagaaaccctggaaaaagatgaaggcccccgtgccaatactaccctggaaggcttggctaagcttggccccgtttttgatcacatcagtgctgtaaccgggaagcctggcagcgtaaccgccggcaatgccccgggaacaaacgacggcggggatgtctgtctcctgatgagccgggcgaaagccgatgaactcggcctcaaaccgcttttctccattgtggactatgccgaagtctcccagcccaccaaggatattgctaccgttcccgggctttccatcaagaaggtcttagaacaaaataagctgacccttgaggatataaagctcatcgaaatcaatgaagcctttgctgcggtcgccctggtgagtgcccgcacgattctgggcatgaccaaggaacaaatgtatgaaaaagtcaatgttaacggcggggccattgcctatggtcatcccattggagcgaccggagccagaattgtcatgaccttagcctatgagctcaagcgccgggggggcggttatggagtatgtggtatctgtgcagggcacgcccagggcgatgccatgctcatctatgtg

SEQ ID NO: 33519 - DNA, 837 bp, Desulfitobacterium hafniense
atgaaaaagatcatggtcatcggtgcaggacaaatgggtggtggcatagcacaggtcgccgcccaagcgggttattccgttattctcaatgatcttaaagaggagtttgtgacccgcgggctgagtgtgattgagaaaaacctgagacgcaatgtggaaaagggaaagcttgaagccacagaatctgcagcaactttagggcgcattacccaatccaccgctttgcaggatgcagcctcggctgacctggttattgaggcagccgtagaaaatatggtgatcaagagtcagctgtttacccaactggatgagatttgtccggagcataccattctggcgacgaatacatcctctctccccataacggagattgctgcctttactaaacgtcctgaccgggttatcggtatgcactttatgaatccggttccggtgatgaagctggtggaagtcattcgcggcctggccaccagcgacgaagtctataaaaccattgaagccttaagtcaggaaatgggaaaaacccctgtagaggtcaatgatgcccctggatttgtagccaaccgcatcttagtccccatgatcaatgaggcggtttataccctttatgaagggattgccacggttgaagatattgatcaggtgatgaaactggggatgaatcatcccatgggccccttagctttggcagatttaatcgggttggatacggtgctgtccatctccgaaattcttcatgaaggactgggggacaaatatcgtccctgcccgcttctgcgcaaatatgttaaagccggctggtacggaagaaaatccggtcgtggtttttaccaatac

SEQ ID NO: 33520 - DNA, 1443 bp, Desulfitobacterium hafniense
cgcatgagctatggggagctgaaaagagaggccggacagctggcaaaggctctagcttgtttaaacattcaggcaggggataaggtactggccattctgcctaactggcatgaatttattgttctattttttgcattggccaaaatggaggcggtcctggttccctgcggagtttctttaacagcaaaggaaatcagtcaacgctgtcaaatgattcagcctaaactggcatttgtttccggccatgatcaactgaggtggctggaagcagaggctggatgctgtaaaataattgcggtgcgttttgaagataaaaaagcaatggggtattcggaattattggccttaggggaaaaaaaccgagagcaaaagctcccgggaaaaaggcaagacgaggttatgtgcaccattatctttacttccgggacaacaggtgctcccaaaggtgtggaactaaccgacaggagtatcatgcaaacggccataagcatcggcatacgtttagagagttcccatagggatgtattcctggtacccctcccctgcacacacttgtttggcattgtgacaggaatggtggtgcccttgtatgttggcgccaaaatcgtgatcatggaaaggtttagggccaaggaagccctgaagctcattgaacaggaacagatcaccgtccaccatggcgtgcccaccatgtttattcgggagctggaagactataaaggacatgaagtcaacctccagtccttgagaacaggcgttgcagcaggtgcaatctgcagcgaagaggtgctgaagaaaatcacggacatatttaagtttaaccttatggttgcctatggacttaccgaatttgtaggggtttcaatgacaaccttaagtgatactatagaagatagattgaagacggtggggaagccttatgaggggatacaggtgagggccgttcacgagagcgggaggacggcagaaccgggagaagtgggggaactttgctgcaaaggatatggcgcaatgaagggatattatcagctgcctgctcaaacccggaaagtattggatgcggagggctggctgcacaccggagacctggccaggatagatgaacgcggctatatcacaatcgtgggcagaaagaaggaggttatcatccgcggaggatataatatctatccccgggagatagaagaagtctattataaccatcctgaggtcatggaagcatgtgtcataggcctcccccatcaggatttgggagaacaaacggttgcttttatccaattaaaaagccactcccaacagacagccgcccttttgcgcgaatatgccaaagggaagatagccaagtacaaggtgccggatcgggtccttctagtagagcagctgcctaaactcagcaacggaaagatcgacaagagagaattggggaagatggcagtttcccta

SEQ ID NO: 33521 - DNA, 1143 bp, Desulfitobacterium hafniense
atggattttagaatgagtgaagaacaagagctcttgctggagagcctgtgtgaattgatcgccagagaagttacggaagccgatgtgaaaacctggtatgaaaaccatgccgtatccgagaaattcaataaagccttcatcgaagcaggctttggttttctgggcattcccgaagaacatgggggcacaccggccgatgtcaccaccctcatgctggtgtcagaagaagtggttcatcaaacctgcgcgacgattcccctcttgtctaatatcttgaatatgtatgacgtggtcgagttcgggactccggagcaaatcaaactgaccatggatattaccaaagaaaccggcagcccggctttcctgctggctatttctgaacctcaggcaggatcggacaatatgagaatgacgactaccgccgttcataaagatggaaaagtgattctcaatggcagcaaaacctggattacccatggaggagtggcaccttacgccctggtatttgccaaagaagacaattccgacttaaccaataaggcgatctccatgtatcttgtccccagcgatacccctggcattaaattcgcacccctgcataaaattggccagacaaccactgtcttcgctgaaatgtatctggataatgtagtttgcgatgaaagctgcttagtgggcaaaaaaggggaagggtttatgcagctgatgaaaaaccttgaagtagaacggctgttgatttcctccttctctttaggtttagcccaagccgctatggatgatgccgccgcctatgccgggcaaagaatgcagtttggcaaaaccatcggcagcttccagctgattcaacaaaaattgacggacatggaaatcaaaataaaaaacatgcgcaatatgctctatgaagcggcctggaaagccgacaacggtatttcaattaagctggactccgctttagccaagcgttatatttgcatgacggcaacggaagtatgctatgaagcaatgcaaatcttcgggggactgggctataccacggaaacccgggtttccagagcttggcaggatgccagaggctgggaattcgcaggcggtaccaatgaaattatggttcacattgccggcagagaaatcgtcaagaaatac

SEQ ID NO: 33522 - DNA, 1362 bp, Desulfitobacterium hafniense
gaatggctgaatagtgttgaataccgtgaaaagaattttgcccgtgaaaagctggtcatcaatcccgcaaaagcctgccaacctctgggtgccttgctttgtgccttaggaattgaaggatgtctgccctttacccatggttcccaggggtgcaccgcttatttccgcagcaccttatcccggcatttccgggagccggtagcctcagtctccgattccatgaccgaggattcggccgtatttggcggtcaggcaaattttatcgaagggctgaaaaatgcctatacggtatataaccctaaggtgattgccgtttacaccagctgtatggcggaagtcatcggtgatgatatcagctcctttttaggcaatgccaaggaccagggggcggtccccatggattttcccgttgccctggccaatactcccagcttcaagatgtcccatattgccgggtatgacatcatgctcaagggactgattgagtgcctggcaactccgaggcaggaagatcaaatcaatgagcggctatacgttgtgccaggctttgatacctacccggccaatcttcgcgagtataagcggctgctgaacatgatgaatgtaccttatacccttctgccggactacagcaatgtggtggatactccgaatttgggtaaatacgaattatatcccggcgggacccctcttgtggaaatggaggaagctttaaatgggttgggctatctgttatgtcagacctattcgacttcaaataccaaaaagtatttgacaggtgaatcgattccggtggaagcgatccctatgcccatcggcatggcgggcacggaccgattcatcgaagccgcggcgaaattaacagggaaagaggtctccgaagaaatcacctatgaacggggactggccgtggatgccatgaccgatgcccatcaatatatgcatggccggaaatttgccctcttcggtgacccggatctgctgctgggcttagtctccttcctgctggaaatgggaggggaacccgtgcatattgtctgctccaattccacccctttgttcaaaaaggacatggaaaggctccttgcctccagcccttatggtcagggcgccaccctataccccaacaaggacctttggcatctgcggtcacttttagtcaccgaaccggtggatatgctcattggcgattcccatggcaagtgggcagctcgtgacgccggtattcccctggtcagagtagggttccccttttatgatcgtgtgaatctccaccgttatccgattgtcggttattcaggagtaatcaacctgatcaccatgatcgtcaatacctttttggaggagaaagacagggcttcc

SEQ ID NO: 33523 - DNA, 1290 bp, Desulfitobacterium hafniense
ggagcaggttctccccaattgtgcatgaaggccctgcccggtgaaggggcagaacgcagctgcgcctatgacggagcgcgggttgtgctgatgccgattaccgatgtggcccacctcgtccacggaccgattgcctgtgcagggaactcttgggataaccggggagcccgctcctccggttcccagcttttccgccgggggctgaccacggatctgatggagaatgatgtagtttatggcggtgaacggaagctcaaggaggcgatcctggaaatcgccgcccatcatcgcccccaagccatttttgtctatgccacctgtgtatccgccctgatcggcgatgatgtcagcgcaatctgtgaacaagcggagcaggaattgaccattcccgtcatcgccgtcaattgcccgggttttttgggcgataaaaacatcggcaaccggattgccggggaagttctcttcgaccgggtcatcggcaccggggaaggaccggatgaaaaggtgcccctttccgtaaacctgatcggagagtataacattgccggtgatctctggggtatcctgccggattttgagaacctgggaatcacggtgcaggcaacaattacgggtgatgccaaattcgaggacatcgcttccgctcaccgggcttgtctcaatgtgctgatttgttccaaaagcctgaccaatctggcccgcaagatggaagaaaaatacgacatcccctttatggagggctccttttatggaatccacgacacctcggagactttaatcaatattgccaaagccttgggagaccttgatttactgaagagaacaaaaacctatgtgcaaaagaaggaagaggaaacacgggagatgattgccggctataaaaaatgcctggagcataaacaggccatcttgtttacagggggagtaaaaacctggtccatggtctccacactggctgaactggggatcaacattctggcgggagggacgcaaaactccactcccgatgattttcaacggatgaaagcactgatggatcctacggctcagatcattgaggataccagtccggcgggattccttaaaattattgctgagaaaaagcccgatcttatcgtcgccggggggaagacaaagtacctggcccacaaaacaagaactccttttttagatattaatcacggccgaaaactgccttatgcaggttacgaggggatggtcacctttgccgggagcctggcccggacggtgaacagtccggtttgggaacttttaaaacaggaatttccc

SEQ ID NO: 33524 - DNA, 1266 bp, Desulfitobacterium hafniense
aatccgcaaaaaaacagcccggctctgggcgccaccctggcttatctgggaatcaacggactgctggccctgctgcacggttcccagggctgctcctcctttatccgcctgcagctgaaccggcattttaaagagtccatccctcttaattccaccgctttgctggaggactcggtcattttcggcggatgggagcatttgaagaaagggattgccgtggcagcggataaatacaagccccaaatcatcggcgttatgagctcaggtctcacggaaacttatggggatgatatggccagcgctttagccagcctgtactcggaaagaccggacctggaggatctgcctgtggtattggccagtaccccggactatatagggtccatgcaggacgggtatcaacggactgtcgaggccttggtggatgcccttgtcggtttaaatcatcattctccagcgtcagctttaaagacagatattcaggaagctccttatctcgctttattgcccggctgtcatctgactccggctgatgtggatgaactgaaagagattgtcagggatttcggcttcaggcccattaccctgccggatctctcagtttctctggacggtcatgcggagctggaggccgcccccgtggtccagggaggcaccttgttggaggattttcagcttctgcccaggtccagggcgtgcttatcctttggcctgagcatggagaaagcaggggaaacccttaaggaggcctatcatattcctcactataattttccttctttaagcggacttacggccaccgatggcttgatattgaccttggctaagctgtccggtaagactatcccggaaaagcagctccggcaaagaaaccgcttgctggataccctggccgattatcatgatcaactgggtaagcttagggtagccatcgccttggaaacggatctcctctatagcttagggtccagtctggtggaggttggagcggagctgacggtggctttggcagcatcccaggcaggtaccgaccgcttgtccctgcctgtccccatggaggtaggagatttggaaacccttgaggagcgggccggccaaagcaagctcatcattgccaactccaatggccgtcaggcggcgggacagcttaagctgccccatctgagggcagggctgccggtttttgaccgggcgggttatccccagacctgttggatcggctatgaagggacacagcgcttcctctttgccacgttaaatgcagta

SEQ ID NO: 33525 - DNA, 897 bp, Desulfitobacterium hafniense
atggctgatattatcaaaacacagggtctgtgtaagcactatggcaagacgccgggagtcagtgatttggatctgtcggttgccgagggagccgtctacggttttcttggtcccaatggcgccggcaaatcgacaacactcaaaatgattctggggctggttaagcccactgccggcagcattacggtattcggcaaaaccatgaatcaccgcagccgcatgtccattctcaaggatgtgggctctttaatcgagtcccccagctattatggccatttaagcggctacgaaaatctccggattattgccacccttaaaggtactccggaaaaagacatcggccgagttctggagattgtccggctggaaaaccaaaaaaacaaaaagacaaatcaatattctttgggcatgaagcagcgtttggggctggcctgcgcccttttgggcaatccccggcttttaattctggatgaacctaccaatgggcttgatcccgccgggattcaggaaatgcgggagctgatccgttccctgcccaaggagtacgggatcacggttctggtctccagccatttgctcagtgagattgagcaaatggcgaccaatctgggcatcatcagcaagggccggcttgtttttcaaagcagcctaggggccctgcaccaaaaaagcagccccagcatagccatccgcactttggataaccaccgggccgccgctgttctgagagaacaaggtattgctgttcagtgccagcaggattacctgctcctcccagcctttgcggatggggaattgtcccgtttaactctgaacctgtttgaacagaaggtaggggtcgtgcggattgagcagcgcgaaaaaagcctggaagatatcttcctagaactgacggga

SEQ ID NO: 33526 - DNA, 1362 bp, Desulfitobacterium hafniense
aaacaaagacgtttagggggaaaactgaatatgacctatgttcaagaagttctggaacaagccgttaagcgcaatcccggtgaagctgaatttcaccaggcactgagagaggtcttggaatctctcgaacccgtgttggaaaaacgtcccgatcttaaggaagcaggaattctcgagcgcatcgtcgagcctgaacggcagattctcttccgggtcccttgggttgacgaccagggcaaggtccaggtgaaccgtggtttccgtgtggaatacaacagtgccatcggaccttataaagggggcctgcgtttccatccttcggtgtatttaggtatcataaaattcttaggcttcgaacagatctttaaaaactccctgaccggtttgcccattggcggcggtaaagggggcagtgattttgatccgaaaggaaaatccgaaggagaaatcatgcggttctgccaaagcttcattacagaactttatcgctaccttggtgccgatacagacgtcccggcaggggatatcggtgtcggcggacgggaagtgggctatatgttcggtcaatataagcggattaccaatagatatgaaggtgttctcaccggcaaaggcttaacctttggcggcagcctgggccgtacggaagcaaccggctatggattggtttattttatggaagaagcccttaaagccgtgggcaaatccttcagcggcgctactgtcgttgtttccggctccggaaacgttgccatttacgcgacccaaaaggccacccagctagggggcacagtcgtggccatgagcgattccaacggctatatctatgataaagacggtattaatctcgatacagtccgccagttgaaagaggttgagcggaagcgccttaaagactacgtcagcattcatcccactgccgaatattatgaaggctgtgcaggcatctggaccatcccctgcgctatcgcactcccctgtgccactcaaaacgaattggacggggaagcggccgaagttcttgttaaaaacggctgctacgctgtcggtgaaggagccaatatgccttccactccggaagctgtggatgtgttcctccagcacaaaatcatctatggtccgggcaaagcagccaatgccggaggtgtggccgtatccgctctggagatgtcccaaaacagcatgcgctattcatggacttttgaagaagtggatgccaagctcaaaaatattatggtcaatatctaccacaatgccagcaaagccgctcaagagttcggctttgaggggaatttggtggcaggggccaatatcgccggcttccttaaggtagccgaagctatgaaggctcagggaacggtg

SEQ ID NO: 33527 - DNA, 2640 bp, Desulfitobacterium hafniense
atgtctaagaagtttgtttatttatttcgtgaaggtcaggcttccatgcgggatttattaggcggtaagggtgccaatttggcagagatgaccaatatcgggctgcccgtacctccagggttcaccattaccacagaagcatgcaatgactattatgccctgggtcgcaacctgccggaaggactatgggagcagattggtccggccttaggagatatagaaaaggccacagggaaaaaattcggggacaaagacaatcccctgttggtctctgtccgttccggcgcgaaattctccatgcccggtatgatggataccatccttaatctcggacttaatgatgagacagtagagggtcttgctgcctctactcagaatgcccgttttgcctatgacagctaccggcgttttattcaaatgttcggtgatgtggtgctggaagtagagcatcatgaatttgagagaattctggaagaagccaaggaaaaacaaaatgtcaattacgactcggagcttacggcagagagcctcaaaggagtcgtggaggggtataaaaggctcattcagcgccgtacaggcagccctttcccgttagagcctatgaagcaactggaacaggccattttagccgttttccgttcctggaacaatgatcgggccattgtctatcggaggatcaatagcattcccgataatatcggcacggcagtcaatgtgcaatccatggtctttggcaacatgggcaacgactccggtacgggagtggccttcacccgcaatccctccacaggtgagagagttctttatggtgagtatcttatgaatgctcagggtgaggatgtggtggcaggtatccgcactcctcagcctatcaaaagcctcgaagatgagaaccaggcgatttatgctcaattcgtaaagacctccaatagcctggaagcccattatcgggatatgcaggatattgaatttaccattgagcggggacggctctatattctccagacccggaatgggaaacgcactgctccggcagccatccgcgtcgccgtggagctgtgccgggaaggagttatctctaaggaagaagccattgcccggattgagcctggtcagttagaccaattgctccaccgccgtatggacagtgaagctaaattagaggttattgccaaaggacttcccgcttcaccgggggcagcctccggcaagatcgttttcgatgccgatgaggctgagcgcctgggtcacaccggcgagaaggtcctcttggtgcgaactgagaccacaccggatgatatccacggaattttggcagcccaaggcattctgaccagccgggggggcatgaccagccatgccgctgtagttgcccgccatatgggtaaacctgcggtatgcggctgtgaggccctgcggattgattatgcccataatacagtgactatcgatggggttacttatccggaaggaaccttattctccattgacgggacgaccggccgtgtcattaagggagcggttcccatgattgatccggagctcagcgaagagttcaaggagttactgggctgggctgatgagattcgcacacttaaggtcctggccaacgccgataacccccgtgatgctcaaaaggcccgggattttggagcccagggcatcgggctttgccggactgagcatatgtttatggatccggcccgtatacccatcgttcaggaaatgattctcgcccagactctgccggaaagagaagtagccttagcgaaacttctgcctatgcaggaagaggatttctacgggattcttaaagttatggccgggttcccggtcaccatccgtcttctcgatcctcccctccatgaattcctccccaatgtcgaggaactggtggtggatatcaccaagctgaaactgcagggagatcgtgaagaagaactgaatgagaaagaagttctcctgagaaaagtccgtgccctctccgaaatgaaccccatgctggggcatcggggctgccgtctggggatcaccttccctgagatctatgctatgcaagcccgggcaattttccaggcagcggcccgccttgtcaaggaaggctatgagatctatccggaggttatgatcccgctggttattcatgtcaaggaactggcaaaactccgcaaagtcaccgaggaggcggcccaaactgttatggcagaacagggcgtaaccttcgcctataccataggcaccatgatcgaagtcccccgggctgccctgaccgccgatgaagtggctacagccgccgatttcttctcctttggcaccaatgacctgacccagaccaccttaggcttctccagggatgacgccgaagggaagttccttccggcttatctggagcaaaacatccttgagcacaacccctttgccgttcttgaccgcattggcgtgggcaagttgatgaaaatgggagtacaacttggccgggaagccaatccaggcctcaaagtgggcatctgcggtgagcatgggggagatccctcatccatcgaattctgccaccaaatcggcctgaattatgtgtcttgttcaccattccgggtgcctatcgcttgcctggctgcggcccaggcggctgtaagcagcaag

SEQ ID NO: 33528 - DNA, 1083 bp, Desulfitobacterium hafniense
ttattaaaaacttatgaggtagatgcaatgtatgatgttcttataataggggcgggaccggcagggtctagtcttgcgcggttaattggtgacaaatataaggttttattaatagataaacgggatttggccaatgagaatccccacaatcttgccggaaaatgctgcggaggattattagcccctgatgcccagaaaatgattgcaaagctgggcttaggaatacctaaagatattctggttaatccgcagctttttgctgtaagaaccattgatttaacaaataacctggagagactctatcagagattctatctgaatatggatagggagaaatttgatagatggttggtttctatacttccgaaaaaagttgataaaaagtttaatgcagtttttaaagactttgttgaaataccgggcggatatgaggttaagtatattcataatggacaagaaatatcggcaaagacaagagttattataggtgctgatggggccttttcaaagttaagaaggtttcttaatcaagatatcaatggtcctgaaaagtacattgcaattcaggaatggtatgaatgtccccatcatgtcccctattttacagcaatttttgatgaagaaataagtgatttttactcttggatcataccaaaggagaattatctgttattaggttcggcccttaaacctaaggagaaggccagggaaaagtatgaactgttaaaaacaaaactaacccagcggggctttaattttgataacaaaataaggacagagggcgcatatctctataggccgaaaaaggtatcacagttttatgccggcagggatagcatagccctggtgggagaagcggcaggtgggattagccccagctctgcagaaggaatcagctacgcattaaagagctctgcatatttagctcagagtcttgaagagggaatcgatggatttctggatagatataaacttaaggtaaagggtatcaaattaaatctgctgcttaaaaatttaaaatccccggctatgtataatccattgctcagacagttggctatgaaatcaggtctgcaaagtatt

SEQ ID NO: 33529 - DNA, 2184 bp, Desulfitobacterium hafniense
gccagctctggcgaagcggtttttagtggagcttgtcggggtaactgtgcgggaggatgttttttaaacattcatgtacgtggtggcaaagtggtgcgtacttctatgagggaaatgcccaacccagactataaccggatctgtgttaaggggttaacccatatgcaaagaatctaccataaagaccgcttaaaatacccgatgaagcggatcggcgagcgcggtgccggtcaatgggagcgtatcagttgggacgaagccgtaacaacgatagcggataagtggcaagaatatcaaagagagtatggcaaagaagcttttgcgatttactggggttcaggcaattacggagttttgagcggtcaagggatggggtgtactaccagtcgattgcttaatgtgacgggggcatccaatatctcaatgacggtcgatgccgctcatggtcatagcgcgggtaacgcccttgggtgggggccgaacttcacccttaatgaactggccgaccttaagaatgctaaaactatcctctgctggggtgctaatccggtcatttcccagcagcaaagtactcattttttgatggaagctaaggaaaacggaacaacgttcattgttattgatccgatctacaatattactgcctccaaggcggataagttcgtcccggtgcgccctggcacagacggagcattggctttggggatgatgaatatcgtggtaagagaaaactggattgatgttccctttttgaaggcctctactgtagcccccttcctggttaaagaagctgatggtcactatttgcgccttagcgatttaggcctcctcgctgaaggccaaagggatgatattgtcgtgcgcagtgccgagggaaagatgggacttccccaagagattactgatccggtgattgaagggtcctttgaaatcaacggacataaagtcaataccgcctataccttgcttcttcagcgtatcgcggaatatcccccggagaaagccgcggagatctgcaatctttccgtcagccaaattgaagaaatcaccaaaatttacgccaccaacaagccttcgacaatttatcagtattttggtattgatcactatgtcaacggacactacagcatctttgatatttacgcacttgctatgattacaggaaatttgggtaaatccggagctgcctgtggcatgggcgaaaccttgggaattaattttacgaacctggcaggcactcttttccccgctggtgccacaggtccatccctgaccatgtcagccacgcaaatggactctgtcatgaatgagcataagtatggcaataaggatgttaacgtgaaaggcatctatattaccaatgccaatgtggttgccaatagcgcagagagaaaatataccttggactggctcaataaaatggaattcatcgccgtagcggatatgaatatgaatgaaactgcccagtatgctgatatcttgctgccggtatcccattggtttgagcaagaggaggctttctgcaattacagcactcatccctatgtgatttttcaggaaaaggccattgatcctctctatgaatgcaaagcggattttgaaatcaataaactcatcgcccaaaagttgggttatggggagcagtttaatctgactgagatggaatacctgaacttatggcttgataacgacgaagccaggagattagggatcactctggaggctcttagggaaaagaaaattcttaagtgcctgcctggtgacctttatattaacggtgaaaatggtgtgtttggtacgcctacgggccgtgcccagttctatgtggaaaatcccgcccccaatatgaattatgatcaacagtgggatatagaaaaagaacgcctgccctattgggagccacctaatgaggtatggcatgagaaccccttgactaaaaaatatccctttacgattatttccgatcatgtccgtttccgcacccatacccaatggtgggatgtgccggcattgctggagcttgatcctgaacctatcctgaagatcagttcggaagatgccgctcaatatggtattaagaccaatgacctagttaaaatctataacgaccggggccatgtcgtcatgaaagcggcaatcaatgatggattgccccaaggggtccttacagcaccaaagggttgg

SEQ ID NO: 33530 - DNA, 618 bp, Desulfitobacterium hafniense
atgatgcgttatgccatggcaatcgatttaaaacgctgcgtaggctgtcacacctgctctgtagcatgtaaaatggccaacaatctgcccaatgaaatttggtggaaccgcatccttacggtaggcggggaagctatggatacagctgccgggaccttcccgaacaataccttggagtatctgccggtcaattgtcagcactgcgctaatccggcctgtgtgaaagcctgccctgtgggagccacctatcaacgggaagaagatggagtcgtcatccaggattatgatcaatgcatcggctgtcgttactgcatggtggcttgcccctacagcggagttcgtcaattcaactggaagaaacctgaataccatgtggattttgccgtaggggatgccaacatcactccgcaccaatacaataccgtatccaaatgtaccttctgtgttcaccgattagcggaagggaagaaaccggcctgtatggaattatgcattggacgggcccgttatttcggcgatattgatgacccggaaagcgaagtcagcaaggcgatccaaggccgtacctacttccacttgctcgaagaaaaaggtaccaggccgcatgtctattattta

SEQ ID NO: 33531 - DNA, 2157 bp, Desulfitobacterium hafniense
gaacaaatcttcagcggcgcctgtcgcggcaattgtgcaggcggatgttttctgaatatccatgtgcggaatggcaaagtggtaagaacctcagcccgtgagatgccgaatccggaatataaccgcatctgtgttaaaggattaacccatgtccagaggatttatagcaaggagcgcctgaaataccccatgaaacgtgccggggaacggggcgaaggaaaatgggaacgaatcacttgggatgaagccatcagcaccatcgcccagaagtggaaaggctaccaggatgagtttggcaaatatgcttttggagttatgtggagttcaggaagctatgctgcgctgagtggcgtcgggattggcagcgctatcaaccgcctgcaaaatgccaacggggccttgaatattacagcagctgtagatatggcacggggacaaggaacgaaaccggctctcggtcaaggtacatttgttacagctaatgaacccgcggacttaaaaaatgccaagacgattttctgttggggggctaatcctgtaggcgcccagcagcaaagcacccatttctttttagaagccagggaaaaaggtgctaaaatcgtggtcattgatcccaatttcaacgccttagcggccaaagcggatatctttgtcccggtaaggccgggctctgatgcggcgttggccctggggatgatgaatattgtggtccgggaaaactgggtggatgagccttttttgaagaaatccacaggggcccctttcttagtcaaggaatctgatggaaagtttttgcggcaaagtgatttaggaatccatatccctgaaggagccaaggatgagctaatcgtctggaaccaagactctgacacttatggaacagccgataccgtcagtaacccggcgttgcggggctcttatactatcaatggggttaaggttacgacagcctatgacctgctgttggagcgcatcgctgaatacccgccgaaaaaagcagcggaaatctgtaatattcctgtagcgcaaatcgaagaaatcacggaactttacgcgaccaataagccttccgcaatctatgagtttttcggcatcgatcattatgtcaatggccattacggctattttgctatggcgatcttagccattctcaccggaaatctcggtaaaccgggagctttttgcggcatgggtgagaacctggccactgattggatcaatatggcgggaacgatgtttcccaatggagcgaagccctctctttccgtacctgttaatatgctcactgaaattctggaaactaaaatgtatggtaaaactcccatcgatttgaaaggtatctactttacccatgtcaatcagatcggcaacggcgccgagcgcaaagcgaccctggaagttatgaaaaagctggattttatcgcagtcgccgatctgaatatgaatgaaacggctcagtatgcagatattctgctgcctgtagcccactggtttgaagtggatgatgtttttgtcaattacagcacccatccttatgtgatattgcaggagaaggccattgagcctctctatgaatgcaaatcggactttgagatctatcaattgctggcggaaaaacttggctgcagtgatgcctttgccatggatgaagaggactatatgcggttgtggatggatacagatggagccagaaaattagggattactttagagaagcttaaagaagagaaaatactcagggctttacccggagatccctatatttatgctgaaggcggagcatttgccacacctacagggcgggcccagctctataatgaggcccctgctcccaataataattatgatcaggtgtttgatctagccaaagagcgcctgcctcactttgaaccgcccctggaagcctggcatgaaaatcccctccatgcgaaatatcctttctcggtgatccaagacaagggaaggtggcggacccactctcaatggtgggatgtcccgatgctcaaagaactcagcccgaaaccctttgtgaaaatcaaccctgccgatgctgccgcccgcaatgttaagactggtgatatcatcaagctctacaacgatcggggctatgtcaagattaaagccattgtggatcgcggaattcaacctggtgtttta

SEQ ID NO: 33532 - DNA, 615 bp, Desulfitobacterium hafniense
atgcgttacgccatggcaatcgatctaaaacgctgtataggctgtcatacctgtgctgtagcatgtaaaatggccaacaatctgcctaacgaaatttggtggaaccgtattcttaccgtaggtggggaagctatggatacagctgccgggaccttcccgaacaataccttggagtatctgccggttaattgtcagcactgtgctaatccggcctgcgtaaaagcctgccccgtcggggctacctataaacgggaagaagatggcatcgtcatccaggattatgataaatgcatcggctgccgctactgcatggtggcttgcccttacagcggcgttcgtcaattcaactggaaaaagcccgagtaccatgtagactttgccgtaggggatgccaacactgccccgcatcaatacaataccgtatccaaatgcactttctgcgttcaccggttggctgaagagaaaaaaccggcctgtatggagttgtgtattggacgggcccgttacttcggggacatcgatgacccggaaagcgatgtcagcaaggccatcaaaggccgcagctatttccatttgctcgaagaaaaaggcaccaagccaaatgtctactattta

SEQ ID NO: 33533 - DNA, 511 bp, Desulfitobacterium hafniense
atggctggtcagaaagcatttctttacaatcagaattattgcgtaggatgccattcctgtgaaacggcatgtatggtcaagaaccaagtggatgtaggtgtaagctggaggaccctggatagctttgaggttgagatcaacggcagaatggtggagcgttatctttcccattcctgtatgcattgtgcggaacctcaatgtgcttcagtatgtcctaccaaagcctataccaaacgggaagatgggctggtgattcaggaccacgataaatgcgtggggtgcggatattgcatctatgcttgcccgtatcaggcaccgaagatgaatccccatactaaaaaggtggaaaaatgcacaggctgttatgacttgattgacgcaggggaacaacccatgtgtgtccgggggtgtccggttcaagtcttaaaaatagaggatatcgataagctcgatgctgagggagcggttaaggaagccatcggtttccaggcctttgccaccaatccatcca

SEQ ID NO: 33534 - DNA, 1920 bp, Desulfitobacterium hafniense
tgcccccgcaattgctatgatacctgttctttgattggggagaaggttgatgggcggatcgtcaggattgtcggcgaccctaagaatcccataaccgcagggacgccttgtgtcaaggggcaaacccacatcaatgtgctttaccatcctgatcgtattttacatccccttaagcgtgtcggtaaaaaaggggaaggaaaatgggaaaagattacctgggatgaagcctatgctacgatcgtccaaaaacttaaggaagccatcgaccaatacggttcagaatcgatcatgccctataatttttcggggaccatcgggtttgttcatcagcatggtgttccctggcggtttttcaataagatcggagcgaccaatattaccagaacggtatgcaataccggtggcaaggcggcgctgccctacacttatggcgatttctcatccatcgatccggaaacctttgcgaaaacaaagtgttatgttacctggggaaccaatgaatcctataccaatgtccattctgtgaaattcattcaacaagcgcgggataatggggccaaactcattgtggttaatccccatcgccatcccctggcctcacaagcggatttatttattcagcttaaaccgggaaccgatgccgcctttgccctgggcgtccaacatattatcatcaatgagaacctttatgacaaggactttgtcgaaaactacacgatgggcttcgaggagcttaaaaaacaagtccagaactatccgcccagtaaggtggctcaattatgtgaagttaccgaagaagaaataagggaatttgtgaagatgtatacccaggctaagccctcgatcattagaatgggctttggttttgaaagacggacccatggcggggggatggtcagagctatttcatttctccccgccttgatgggagttgtcggtgtcgaaggtgggggattcagctatgttaactacaatcactatccttttgacaacagttatacgaaacgaccggatttagccccccgcaagatgcggaccattaatatgaatgaattaggcaaggcgattgccggagagcttcccaccacgaaggagaatccggtgaaagtattgatctgcttcggcggcaatccgattccttcggctcccaatgtgaacttgatcaagaaaggattggcgagagaagatttattcacagtggttcacgaagtatttatgacggatacggcggactatgccgatattatcctccccgctgctcattttattgaatttgaagatgtcattgccgattatctcggttggtatgtccgctacagcgaacaagggctggagcccatgggagaatccaaatccaatgtgcagttgtttaatgagctggccaaacaaatggggttcactgatgaatgtttcaatgaaacatccaccgatatcattaagaaggggattctgaataagcccatctttaaagacatcacttatgagaatctgaggagaaatcactggatcaaggtggatttcggaaatgttttcagtgaccacaaatttaatacgccctcggggaaaatcgaattttattctgagaatatcaccaaagcaggactgcatccggtggcggagtatctgccggaagaagagagtcaggacggttctccggacttatttgcaaaatacaccattaacctcctgaccccggcttcaccccaattgctgagctcacaatggcataatgtcccctatatccaggaaaacctgggtgagccctttgtcaccattaatgccaaggacgcagaggacaggggaattaaagatggagattattgtctgattcaaaatgacagggggcaggtcaagctgaaagcaaaggtcagcaatagtgcagttaaagcaggcgtggcggtgagcttcaagagctattgg

SEQ ID NO: 33535 - DNA, 606 bp, Desulfitobacterium hafniense
aaattaggaatggtgattgatttaaagcgttgtacaggatgcaccacgtgcgccaatgcgtgcaagatgcagaataatgtccccatgggcatgttatggaaccgtgtgctcacggaaggcggggaagagtatgatacggccgcaggggtctacccccatgtgcaaaggcgtttcctgccggttgcctgccagcattgcgaaaatgccgcctgtgttaaggtctgcccggtaggtgctacctataaagatgagtcgggcagggtagtgattaattacgacagatgcattggctgccgcttctgcatggccgcctgcccctataatgcccgggtatttaactgggaggaaccggtgcgtgatcctggctttaactatggggataaagatgtgccccttcgcaaagtgggtgtcgtggaaaaatgctcaatgtgcaaggagcgcaccgacactgacttagaaccgatgtgtgtaaagtgttgcccggccaaagcccggaaattcggtgatttgaatgatccggatagtgaagtttcccgcttgattcgggagaggcatggcgagcagcttttagcggaaaaagggacgaagccgcaagtatattatttg

SEQ ID NO: 33536 - DNA, 2295 bp, Desulfitobacterium hafniense
atgaacatttcgagacgtaacttcattaagggtggtgtggctggaacagcaacactgggattgtccggcagcttgctctttgccgacagatggttgcgccccgccaccgcggcaagcgattctgaagaaaggatagcctatacgtatcaccccccgggctgtggtggccgctgtgcgtataaatgcacagtgcgggacggtaagctggtaaagattgaaccgaatgattggccggatcaccggtattccgtgctctgcacaagagggctgagcgaactgcagcgggtgtacagccctgaccgtctccaaactcctttgaaaagagtaggggaaaggggggaaggcaaatttgttccgatctcctgggatgaggcgattacaacggttgcggacaaatttaaagaattgcacagccaatatggcggcaaatccattttgaagatgatttcggcaaatcaggaatatacgatgccccttttgtcatccttgttaggaattcccgttgccctggaaacgtccatcgataccggaattgccagcggggttgaagaagtaaccggggatgctccttttggttatgccatgcatgagattacagactgggtcaatgccaagaccatcatcctgatcgcctgcaatattcttgaaacgacagtcgccgactcccaattcttttttgacgctcaggaggcaggtgccaaaattattgtcatcgaccccaactacagtacgacggcgacgaaagccgaccaatggattccgatcagaccaggttccgacccggctctgctcttagggatgattaaccacatccttgccaatgactggtataatcacgacttcatgcagaagaatacctccgcgccctttttaatcagagaggataatcagcacttgctccggcaaaatgactctgccgacgggcctgcccagaatccgtttatggtatgggacgcactcagcaattcggcgcagccttataacgctactggagttcagcctgaattagaaggagaattcacggtcaacggggtaaaggtcaaaaccgtcatgtcggcattaaaggaacaaatgaagcactatacgccggcctgggccgctgagatgacagaaataccggaacagatcatcatcgacttaacccggcaatatgctcagggcggcccgggctatctgggctgggggtttggcggagcggagaagatttccaacagcgatatctttgggcatgccgcagccatcctcggttcgctgaccggtaatttcgggcgggtcgggggaggcgtgggcaatgcgctgtttcataagtacaattggggcttggttacaaaacttggcgcctggtctttgccgcctcagtttaagatcccgcccatggaaatccctacgacccttatggggactcagccgaattctgtcaaagccgttctcaaccttggcaacagcttccagcagcattttgctaattttcatcatgctgaggcatggttaaagcaattggaatttgtggttacggtggacatatttgacaatgccagtgtcgcctactccgatattgtccttcccatcggcagctgttttgagagcaactatgagatcacccgcttccaagtgaacagaaaccatgctcttctttctgaaaaagtcattgaacccctctttgaaagcaaaagcgattttgagatcgaaaaactattggccgcccgatttggacttgaagaatacatgcccaaaactccggaggattatatacgagcccagttgaattcccccgatccttttttgaagggaatcacagtggaagcccttaaagccaataagttcattatgcgtttgaattgcccgacggaaccttgcataggccacttggatcagaagtacaagacgccatccgggaaactggagatctataatgaagccatgatcgagttcgcgcaagctttaccggcctatgaagaaccggtggaattgagttcggagttaaagcaaaagtatccgctgcaatttgctcagtaccgttcccggttccatgttcattcccagttcatgagagtttcctggattcggcagttttgccccgaaccaaggctggagctcaacccccttgacgccaagagcagaggattggccaatggggatctggttgaggtgttcaatgaccggggcaaactgaaggcccgctgcaagtttatggactccctccgacccgggtcggtcaggatggaagaaggctggtggtcgaaagatatgcctgagggagatatcaactatttaaccaatgacacttttaatccc

SEQ ID NO: 33537 - DNA, 2067 bp, Desulfitobacterium hafniense
atggctcagacctactgcaatgtctgcactgccgattgtcccgcctcatgccgcctcctgaccgatgtcgccgacagccggattatcggcataaaaggtgatccccgggatccttatacccgggggaaaatctgcgccaagggctatgcactgaaagagctggtctactctcccgaccgggttctttatccccttaaacagcaaggaaaagggagtggaaattggcagaggatttcctgggaacaggctttcctggaaatcgggaacaaactggtgggcatagcacaagagtatggcagtctattgccggtcagtatgaataaattcttgggaactaccggtcttttaagccagagtgtagaaggttttttcagttccttgggtccgatcaccgcccttatgggcaacccctgtgtatctgccggaaccgacgcttttattctgaattatggtgctctaaaaaaaccccttcctgaagatatgaagaactcccggctcattctcatttggggggcgaatccggcctggacggccatccaccagatgcgttatatttttgaggctcaggaccaaggagccatcgttgttgtgatcgatcccatcttcacctctaccgctgcccgcagtgatatttattatcggatacgcccgggagcagatggcgatctggctttggggcttgccaagatcctggttgaggaaaatctcatcgaccatgaatttttagataacttcacctttggctggcctgaataccgtgattatttggaaaccgtcgatctcaaccaggtttcatcttctacgggtattcccctcgccgaactgtacgagttggcacgtttgtatggtaccatcaaacccgctacgatcaggttgggccctggcattcaacggggtccctccggcggacaaaacgccagaatcattgactgcctggccgccttaaccggcaacatcggtatttccggcggcaatgtgcattatacttcctatgaacagttactccatgccggtaagtacggtcagcttcgtttgccttacggaataaggcagggtttatctgaaaacaatgaaggtaacaccggccatcggattctggggaccgattggtatacgcatttggatacccttgatccgcctttaaaattcctgtgggttgccggacgcaacccggtggcccaggaccccgacccggcacaacttatccaggccttgaaaacgattgatactgtggttgtcgctgagcaaactctctcggccaccgcccagatggctgattatgtactgcctgtttcttctccttttgaatttgaagatgtggtgatatcattttggcattatggtgcggcgattaatcagcaagccattccccctttaggagaaagcaagtcggattttgccataatgcacgggctggcctccgtgcttcatcagctcaagccgggtttaagctcttttcccttgcacggagatccccggacatggctgacccaggaatttacttcactcaatgattttctgggcatcaccgactaccgcgaactggcccataaccctgcccgagtgaacctgccggctgtcccctggcaggatcgtcaatttcctacggcctccggactctatgaattttactcctttacagccgccttccatcaaacccctcccctgcccattcctgttgaccagcctgtctcatcacgttcttatccattccgtttaatggtttcccgctcccccatcactctaaactctcagttttacactatcgatttattgcggcgtttggaaaacctccctttactcctcattcatcctgataccggcaagcaaaagaacctggcggaaggggatctggcgaaagtatataatgaaatgggtgaactggaattgcccgtttccttctccctcagcctcccacctgatatcgtgctcacttatatggggacagaagatatccataacacactaatcaataccctgcttagttttgagagtaccgatctgggacaaatcttctcaggaagccctggcattgcttataacaattgtttcgtcaatttggtcaag

SEQ ID NO: 33538 - DNA, 1395 bp, Desulfitobacterium hafniense
atgttatcgcaaacggttatcaagcgcttgaaagaaatagtgggggagaagaacttcgttacaggcaaagcggacctgttcccctacacttatggtttttgcaccttattatccggggacccgttaggcgtcgtttcgccgcaaaccacggaacaagtagttgagctcgtcaaatacttaaacgagcacaatattaaagtaattcccagaggtgcggggacgaatgtgatcggtggaaccattcctgcggaagaatcagtggtgatcagctttactcggatgaataagatcctggagattgacacagagaattttgttacggtggttcaaccgggagttgtcaactttgacctgcagctggaactggaaaagagaggcttctattatcccccggacccgtcttccgctaaggttgcaacgttgggaggaaatctcgcggaaagctcaggcggagcccggtgttttaaatatggagtgacccgggattatattctgggtgtagaagttgttctccccaatggtaaagtcattaacacggggggacgtaactttaaaagtgagcccggttatgatctaacccggattctcaatggttcggaaggaaccttgggcttggtcacgaagattatcctccgtgttttgcccctccccatggccaggagaatgatgctggctgtttacgacaaagttgaagatgctgcccagacggttgacggtatttttgcggccggaattgccccggcaacgctggaaatgctggacaatttctttatcaatacgacggaggacttctgtcccaccgggattccccgtgacgccggagctgccctcattattgagattgacggctatccggaagatatgaatgagcaagtcaggattattggtgaaatcaccaggaaagccaaggcgagagactttaagattgccaggtctatgggtgaagttgagcaaattttgactccccgcaaggttggtttcggatcgattgccagcataacaccgtcctatagtattaatgatattgcagttccccggagtaatttctcacaagcgtttgcgggaatcaaaaaaattgccaaggatcttaatgtgaagattggcgtattggcccatgccggtgacgggaactttcatccgttcattctttatgatcaacggaataaggaagaagttgagcgggttcacgcggctgagcaggcgctctgtgaaatggccctcagtttcagcgggacaatcaccggggagcagggagtcggaattgccaagagaaagcatcttgataagcagtttaagcccgaagccatggaagctttccggaaaatcaagagaagctttgacccgcaaaaccgctttaaccccggcaagatatttgatagttaacagcgcctgata

SEQ ID NO: 33539 - DNA, 1152 bp, Desulfitobacterium hafniense
ctgatcttagcgatggatgaagaaaaggtgatctatcccaaagagtacttaatggacctgggtcaggccagacttctggggttgcgctttgctgagcggtacagcggacgagggctgcaatgggtggatgaagtttcagttctcgaagagatcggggttttgggtacgagtttggcgtgcctttattccttaccttccatcgtcggcgaagccattaatcattttggctcagaggtgctgaaagatcgttatttaaagcctactttagaaggaaagctgtacactgctgaagcattgactgagccgagaggaggatcggatttttttggggcaacgactttagcccggcgtgagggggatgtctatattctcaatgggcaaaagcgttttgtggtgggagcagagggggccgactattttatggtttatgccaagaccgatccggaaggacctgcccatcagagtatcagtgcctttatcgtagaccgtggtcccggagtggaagtggaacatatctacggcttaatgggaacccgtggaggcggggcaggccgggtagttttcaaggatgtaaaagttcctgccgaaaaccttctcggtgtggaaaacggtgcggcagacattttttatcagatgatgatcccggaacggttaaccagtgccgcgggagctttggggatggcccgggcggctctggaagtagcttctgattacagcaccaggcgcaaagcttttggcagaaaaattaaagattttcaaggggtcaactttaaagtggctgactcgatcacccgcctggatgcagcccgctcacttgtttataccaccgcccgggccgtggattctggagtgccgggccatgtggcacgccgtttggtctccgaggcgaaaaagttcgccacggattcggcctgggcagtggtcaacgatgggatgcagatcatgggggggattggttataccaatgtcttccccatcgagcgattgctgcgggatatccgtctcatcatgatttggaccggtaccaatgaagtgatgaatctcattatccaacatgagtattacaaagaacgccgggggaatttacaattccatcgctccctagaagaagatgcggtgaatgctcatttgacggaggaaaaagtatatgag

SEQ ID NO: 33540 - DNA, 1719 bp, Desulfitobacterium hafniense
ccctggagagctcaatacgaccaacaggttccccattacctaagctatcctgaagagacggtggatgggttattccgcaaaagtgtgcaaaagaactccggagaggttgccctaatctattttaataagaaaatgagttacagtgatttgggcaataaagttgaacgcctggcaggttccctgcaaaagctgggtattgatcccggggatcgggtggcccttttgctggctaattgtccccaatacgtgattgcttattacgctatccttgccattggcggggtggtcgttcctgtcaatcctctcagtaccgaatcagaattattgcatatttttcgggatgctcaggtcaaagcagccatttgtctggaccttctggccgagcggctggaaaatgtgagagacatttgtcatcaggccggagagacccaattgctgaagcataccttctatacggctctcaatgagtatatgccttttcctcttaaatttctttatccattcacacggaagctgtccccgggaggtaaggaacgcctcaaagttgccgggaggtttaaggatctgctgaatgagggcaacggtcccgtgctaaaagattatccgtcccaaaaagtggatgttcgtaaggatatagcggtcctcatctataccggcggcactaccggacgccccaagggagtgatgctttcccattatggtttgcttgccaatgcttatcaggcgatagcctgggttcaaatgggcagcaaggatcgtttggtcactgttctcccggcctttcatgggtttggcatgtccgtgtgcatgaatgctcccttattctccggagcttcaacgattctgattccccgctttgaagcgaaagatgtcctgaaagccattcacaagcataagcccacgtattttgccggagttccgacgatgtatataggcatgattaattacccccaattaaaacgctatagcctttcctccttagtggggtgtttcgtgggggcggctgctctggcccccgaggttaaacgaagcttcgaagagcttaccggagccaggctgatggagggatacggtctcactgaaggggtcaatgccctctgctgcaatcccttgcggggggaaaacagaaccggcagcatcggttttcctttcccggatgtggactttaaaatcagggacattgacaccggtgaagaggagctgcctcccggtgaatcgggagaactggtgattcagtgtccggacttaatgctgggctactataaccggccggaagagacggcctacgctttaagggatggctggctatacaccggagatatcgcgaccatggatgaagacgggtatttttatcttgtggaccgtaaaaaggatatgattatcaccggtggcttcaatgtctatccccgggaagtagaggatgtgctgtatgaacacccggcagtcagggaggcctgtgtgatcggggttaaggacggttacagcggggaaaaggtagtggcttttgtcagccttaaagatggagctgccgctacagagcaggatgtcatcgccttttgccgcaaacacctggtcccttataaagttcctaaaaccgtagaattccgtaccgatttacctaagacggctattggcaagatcctgcgccgggccttacgggatactcctcctgcagaaggggaagcaaaacagagtgccaaggaagcggcagcgacgaag

SEQ ID NO: 33541 - DNA, 975 bp, Desulfitobacterium hafniense
atgcctaagagagaagatattaagaagataatgatcatcggttccggccccatcgtcatcgggcaggctgccgaatttgactattcaggaacccaggcttgcaaagccctcaaaaacttaggttatgaagtggtgttggtgaactccaatcccgccacgattatgacggatgccggtacggctgatgctacctacatcgagcctctcaatgtccagagaatcaccgagatcatcgagaaagagcgccccgatgcccttctgcccaatttaggaggacaatccgggctaaatctgagttccgaactggccaaagcgggaatctcgatcactatggcgtgaaagtcatcggggtacagctggatgccatcgagcggggggaagaccgcatcgccttcaaggagaccatggaacgcctgggtatcgatatgcccaaaagcagccctgcttacactgtggaagaagccgagaaaatcgctcaggagctgggctatcccgtggtgattcgtcctgcttacaccctgggcggcaccgggggcggcctggtctacaatgtggaagaattaaaaaccatcgtgaaccggggcatctccgccagcatgatcggacaggttctggtggaagaatccgtcctgggctgggaagagctggagctggaagtggtccgggactccaaaaaccaaatgatcaccgtctgcttcatcgaaaacatcgacgctatcggcgtccataccggggattccttctgcagcgcccccatgctgaccatctctcaggagcttcaggaaaggcttcagaaatacgcctactctatcgtggaagccatcgaagtcatcggtgggaccaatgtccaattcgcccatgatcccaaaaccgaccgggtggtgatcatcgagatcaacccccgtacctcccgctcctccgccctggcttccaaagccaccgggttccccattgccctgatctcttccctgctgg

SEQ ID NO: 33542 - DNA, 807 bp, Desulfitobacterium hafniense
attcaaaccagagaaggaaccaggatctattatcggcaaagactccccgcccatcctaaggctgtggtgatgatctgccatggctatgcggagcattccagcttttatgttcagtttatggagtttttggctgagcatgactatggggcttatgctttggatcatcggggccatgggcattccgaggctgagcggggtcatctggaccgctttgaggtgttcctggaggatctggatgttttcgtggatcatgttcgggagcttcacccaacacagcctctcttcatgtttggccacagtatgggaggattaatcagctttaattatgggattctccacccgggaaaattgcaggggcagattttcagcggagctgccttggccaggcctgtgggaacggaatatattccgacttttctctttaaactcttgaatgtagtattgaagcggctcagaattcgccctaaattgagcggcaagacaacccggaacatggctgtgcgcaaaatttccgatggggattctttggttctaaggtatgcaactctgggttttttctatcagtttgcctgtcggggagtggcctttgctcaggaaaaagccggccgctatcaattgccctgcctcatactccatggaaccggtgatcgactcgttccttatcaggcctcccaaaggatattcgctgagattttctctcgggataagaccctcaagctttatgaagggctttatcatgaattgattcatgagccggagcgggaagaggttttggcggatattgtggactggttggagcgacgggtg

SEQ ID NO: 33543 - DNA, 2001 bp, Desulfitobacterium hafniense
aataaaaagcgtgagcaattagagccgtttattcacgaatcagaaggaaagaaaatgacatcgaatgaaggaatcacgatttctgatgatgaaaacacattgacggccggcgagcgcgggccaacacttattgaagattttctttcccgggaaaaactagcccactttgatcgtgaacgtattcctgaacgtgtcgtccatgccagaggatatggggcacatggagagttccagccctatgaatccttagcagatttaacgatggctgattttttgcaggaccccaataaaaaaacacccttgtttgtccgcttctcacaagtcgttggctccaaaggctgtaatgagaccaaccgggatgtccggggtttttccattaagttttataccgatgagggcaatttcgatttgattgctattaacatgccggtgttctttattcaggatgcgattaagttccctgacttaatccatgcggtgaaaccagagccggacaatgaatatccacaaggtcagacagaccacaacaccttctgggactttatggcgaacaacaaagaaactgcccatatgtctttatggattgcctcgaatcgcgcctttcccaaaagctttagaaccatggagggatttggggtacataccttccgtttagtgaataaggatggaaaatcccactttgttaaatttcatatcaagcccttgctgggcgtccattcattaatctgggatgaagcccagcgtcttggttcagatgctgactttcaccgcagagacttatgggaaaatatagagattggcaactatccggagtatgagatggctattcaggtcattaaagaggaagatgagtttgcctatgattttgatctgttagatccgacgaaattgtggccggaagaagagattcctttacgcagaatcggcaagataatccttaaccgcaatgtggaaaatgcttttgctgaaaccgaacaaagcgcctttcaccctgggaatattgtgagagggattgacttttccaatgatccgctcctgcaagggagattgttctcctataccgatgcccagcaggcacggcttggtcccaatcatcaacaactgccgatcaatcgtccggtctgtccatttgccaataatcagcgtgacggtgcttcgaggctggttattgatcgcggaaaagttgcttatcatcgcaatgggcttgcgaataatagcccgtatacggtaccaggcacccaaggcgggtttgtcacgtatccatccaccgtagaaggacataaggtaagatcaacagctccttcctttaaggatcattactctcaggcaaaaatgttctggaatagtatgagtgaggttgaaaagcgtcagattatcggcgcttactgctttgaacttggcaaatgcggaccctttgtccggcaggaatgggttgatgtgctcgctcatatcagcacggaactggccaagagtgtttccaaggaattaggcacaactgtgccggcggatgtcgaggaatctcctgtgacaaagtcctctccggcgcttagcctgcataatacgatttttgtgccggataccttgcgcgtcgcggtgttcctcgctcaaggcttcgatggccccggtgtaagcaaagtgttggaaactttggcggaggccaaattaagagtggtcattgtccacgataccttggggaaggtcagtggaaccgagggagtaacctatgaagtccatgacagctttttaacgggttccccccttgtctatgacgggatacttatcgtgggaagcggcaatatcaccccctattttacgtatacagcacagaaattcacaacggatatctacaatcacttcaaaccgatcggcatcattcaaaagggtgatgctgtactggaaccgctgggcttattggctgatgaggggatcgtaacggattcaggtccggactttgcaggcagatttatcaaggccatggccaagcagagattctggaaccgt

SEQ ID NO: 33544 - DNA, 1527 bp, Desulfitobacterium hafniense
atgaccgtaggggactttctgaccctgaattcagccagataccctgacaaaattgccctggtctgcaaggataagcgcttaacgtatcaggaattgaattgcagggtaaacgccttggctcatgcactcctggatctcggcattggcaagggggataagatcggctatcttttccccaactccatggaaatcgtcgagttattctttgccattgctaagatcggtgccattgccgtgcccctcaatcatcggctggtagccagagaaattaaatgtctgctggattcagtggaatgtgatgtttttgtctacagccggttgtatgatgggccggtaagtgaggtaaagggcagcttcaggacggtaaagcatattatccgtctgggagaacccgctcccggcgaatattctttcgaaaaactgctggagcataaagataccagtgaaccggatattgccgttgacagtggggatttattcagaattcagttcacgggggggaccacggggcgttccaaaggagtgatgcgcactcacgaggctgacctcttccagacaattggggttatgacttccaataaaatgggagccagcccggatgaggtggtgctgacccagtcccccctgcatcatcagggcgggataacctggatgctttgcgttatggtgaccggtgcgcaatttgttatttgcgacggatttgatccggtagaaattctgaggcagattgagcaggaacgggtaacctatatgctgctgctgccgccgagcacctatctgcgcttaatcgatgcaccggtttttagagattatgatgtaagctcggtcaaggtggttcacacttccgcaggaggtacctctccggccattatccagaagatggctgaggcttttcccaactgtgaagtgtattacggctgggggcaaaccgagacaggagcggggaccgttcaccggatcaccagggaaatggccttgcatcacccggagaagacccaaagcataggcaggccgatgccctttttccaactgagaattgtggatgaggcaggaaaggatgttcctctgggtgaggtgggggaagggattgccaaaggaccggctattttttcaggctactataagcaaccggaattaacggacgggaccatcgctgatggctggacacgtaccggggatatgatgaggcaggacgaggaaggcctctactatatggtggatcggaaaaaggacatgataaaaaccgggggggagaatgttttcgctcaggaagtggaagccgtcatccgcaaacaccctgcggttttggattgctcggtgattggggtgcctgaccaaacctttggggaggccgtcatggccgtcgtcaaactcagggcgggatacaccgctgcggcggcagacattcaggaacactgcaaaagagatttatccagctataaaaagccgcgctatgtggagtttctcgatgagtttcccgtggatagtgccggcaagattcagaaattcaagctcagaaaaaaatac

SEQ ID NO: 33545 - DNA, 1170 bp, Desulfitobacterium hafniense
tggcttgtatttctatctttggccctgttgttctttgccgcattaggaatgcttgggaataccaatggtctgtatctgactccggtatcccaggaaatgggctggagcaggaccgatgcctcctggtatctgaccatctatatgttaaccatggctcttactcagcccatagccagccgacttctttataaagtcaattccaaagtgctgctctttatcagtatgactctggtgtgcgccgctaccggtgctgcctctcagttccaaaccgtcatggcctggaacatctccggtgttctcatgggtttgggttattccgttattatgtacctgactcttccggtcatcatcagcaactggttcagcaaaaagaccggtatggttttaggtatcgccctggccatcggaaccctgggttcagccatagccaaccccgttgccggcatgctgattacggagtatggctggagaaccgcccgcctggccatgtccatcgcggcctgggttattgccgtccccggtattctcttatttgttaacttcaaacctgccgatgtgggtctgaaaccttacggctatgaagaaggggccacggggcaggcgaaagccgctatatctctgaaaggggtatctgccgccgattccctgaaatcccctgctttatatatggttatgttcatagcttgtgcggtggttctgtattcctccatgaacacccagattccgggatatgctagttcaatcgggctggcgactgcttttggggcttatgccatgaccattctcaacctggccaatatgggcggcaaaatcttctggggctggctaacggaccgcaaaggcttcctgccctctatggttgctgccctgtcctgcgggattgcaggggtcctgattattctggccggcggctccaatgtaaccatattttatgccggtttggttttcttcggcatttgtttctcctcgctgaccgttatgctgcccttgattgtcaaaggaatctttggcgaaaaagattatgggaaaatctatgccaatgtaaccttggtacagcagttaatggccgcttcagctgcaattatctatggcagaatcttcgatatcacccaaagctttgtctttgcctggcagatgaatattgtgaccctggctattgccatcgttatg

SEQ ID NO: 33546 - DNA, 1152 bp, Desulfitobacterium hafniense
ttaatggattttagactgacagaagaacaggaattacttctcgaaagcctcagagaagtcatggccagggattgtaccgaagactatatgaaagaatgctacgaaaaaggcgagcatcccacaaagttcgttcaggcccttatggataatggctttggcatgttaggggttccggaagaacacggcggcaccccggtggataacttgaccatgatgctggtcgctgaagaaatcaccaagaacggcggtcctcacttcgtgttcggacaggcattatccattgccgatatgctccactttggttccgaggagcaaatcgccgataccatggctgtggtgcaaaggggcggagttgccttcgtcctgggatttacagagcctcaagccggttccgacagcagtgccgccgccaccacctatacccgcagaaatggcaaggtctatatcaacggtcacaaaaccttcatgagcggagcgctgcgggcaccctatatgctctgcctggcccgcaattcggaagaggccggcaatgccgacaaacgcaacgccttcagcatgtggtgggtgcctatgaatgctcccggcattaagatcgaaaagctggaaaagatcggctggcatatgcaggatacttgtgaagtttacctagaagatgtggaagtcgaagaaaaggatctcgtcggtgtggaaggcaacggctttatgcaagtcttgtacaactttgagatggaacgcttgttgatggcggcctcggtgctgggcatggcggagtgcgcttttgaagatgccgtccgttacgccaaccaacgggtgcagtttggcaagaccattggctccttccagctgattcaggaaaaaatcacctttatgaaagccaaaatcgagaatatgaaaaatatggtctacaaatgcgcctgggaagtggacaacgggctgccggtgcaaatctcttcggcgattgccaaattatattgtgcacaagcggccaatgaagtcattgatgatgccctgcaaatcatgggcggaatcggttacaccaaagatgcccgtatctccaggttatggctggatgcccgggtcttcaggatcggcggcggtacggacgaaatcatgattcacgccgcgggaagagccattttaaagcactataaa

SEQ ID NO: 33547 - DNA, 735 bp, Desulfitobacterium hafniense
caaaatgacggtatcgcttatgtaattattaataaaccggaacgcagaaatgctatggatgccgatttgatggtgaagatggtacaagttttggagcaactggatcaggatacggatgtcagggttatcatcctcaaaggtcaaggggatcacttcagctcggggggcgatttgaaagcgggggtcggcggtgagcccactgttgagaattccagagcagccttacaaaagtttatttttgccgcaagaaagatccaagagatggaaaagcctgtcattgctatggtcaaaggctatgctgtgggcggaggcatgagcttagccatggtttgcgatattgtgtttgcgtcggaggatgccaaattcagctccaatttcctcaaagtaggaattacaccggaaatgggtgctatgctgctaatgcccatgatgatgggtgctcaaagagcaaaggaattgtggtttacaggaagagttattgatgcagcggaagcaaaagagttgggatttgttaacagagtctatactgcggaagaaattgagaacgctacccggaactttgccgcagacttagcccaaatgcctgctcttccggtcagaatcaccaaacggattaccaattcaactctgtttaatttattgaactcggtgatggaagcggagcttcaatccactcctttttgcacccagacggaagagcataaatctttaattgaagcgtttaaaaaccggaaa

SEQ ID NO: 33548 - DNA, 1275 bp, Desulfitobacterium hafniense
gaggatatcgtttgtgtcagtgccgtgcggactcctttcggcaaattcggcggctccatgaaggatatcgatgtctacgaactgggggccattgccatgagcaaggctatggccaagatcagcctggacccggccctcatcgatgaggtatggtggggcaacggcgataccagcagcaccaaagatcccttcacaccggtggtggcgcgccagaccatgcttaaagccggcatctcaccggagaccccgtccatcacctacgaccaggcctgcacctcagccctgagcaccgttaaatacggcgcccgcagcatcaaactgggggaagcccaaatggtcatgaccggaggttccaccagcttcagcacggtgccctttttgctccgggatatacgctgggaaggaaaaaagcattcttcctttctggtggaagacccgattattcccttgggctataaggattatgcacctgtagcggtagattccggcaatgtcgctgtggagtatggggtatcccgacaggaacaggatgagctggccctggccagccatgtcaaatacgggcaggcctgggaacggggatttttcaagggtgaaatggagcccctggagattacgaaaaaggacaaaaaagggaaagttctctccgctcaactcctggctaaggatgaacaataccgccctgagatcagtatggagaatctggcccgcttaaaacccattttcgacaacccgacctgtaccgcaggcaatgctccgggaatgaatgacggagctgccgctcagatcattaccaccagagaacatgccgagcaattggggctgccgattctgtatactctggtgggaatttccgccatcgccctgcagccgagaattatgccggtatcccctgctttcgctattaagaaatgcctggatgaggccaagctgactatcgacgacctgaaggtcatcgaaatcaatgaagcctttgcctgtgttcccttggtctccctgaagctcctggccaatgaacgcttcttaaccagcgactataaggcgatggtcaaagaagcttcagcccaacccatcctggatcatgatcctgagcgctatctgaagctgaaggaaaagctcaaccccaatggaagcgccatcgccgtaggtcatcctaacacggccagcggggcccgcctgatgatgacagcggcctatcagctccaggaaacgggcggaggctatgccgcctgcgccatctgcggcggtttaacccagggcgccggagcgatcatc

SEQ ID NO: 33549 - DNA, 1083 bp, Desulfitobacterium hafniense
ttcagatattttatgcccaccgaaatatattttggtgaagatgtggttttgaaacatcaagaagtgtttaaaacaataggcagtaaggctttaattgtcacagggagaagttctgcaaaaaacaatggttcctacgatgaagtgacgaaagccctttcagaaacaggagtagaatacattctctttgatgaagtagagcagaatccatctttagaaaccattgaaaaggctggtgccataggtaaagcaaacaaggcggattttgtgataggcataggcggcggctcccctatggatgctgccaaagctatcgcagtatttataaagaatcctgaaatcactaaggataatatctttagcggccaaaagcttgccagcatccctgtggtcgtcgtggcaaccactgcagggacaggctcggaagtcactcaatacagtatcattacgtcaaacaaagaaaggacaaagaagaatttagggcaaaggattttccccaaagttgcctttttggactgcaaatatacctatgacttgccttatgatataacggttaataccgccttggatgcttttacccatttagtggaaggatatttaagctctaaaagtacgcccatgtctgatatctatggtgaaaaggggtttgaattatttaaagactgctttgatagattactcaataatgaactggataaagaattccgcaggaagatgatgctggcatcaaccttggctggaatgctcatatcccaaagtggcacttccctgccccatgggatgggttatgcccttacttatcataaggggctgccccatggactggcgaatagtattttaacaatggagtatttgaaatccttccaggatcaaagaaagattaaaaaaatgctgagcattttgcagctggatgacttgacagaactggaaggaatctttaaaaaattgctcaaggtaaggattgagatagcagaggaagaaataagggagtatgcaaagaattttatggccaataaggataagttgaaaaatcatcccgaagcagtggagctggaagatattgtggggatttattacaggagcctc

SEQ ID NO: 33550 - DNA, 1266 bp, Desulfitobacterium hafniense
atcaaaagcgttaaggcacgtcaggttttcgattcccgggctaatccgactgtagaagttgatataaccctaaaggatgaaacagtcggacgtggcatcgtcccctccggcgcctcgacaggtctctttgaagcggtggaattaagagacggtgaggaaaccttcgacggtaaaggtgtaagcaaggctatccatcatgttaatgaacagctggcaccgctgcttctggatatagatgttcgcgaccaaaaagccattgacagcaggctgatagaaattgatgggacccctaacaaatcccgcctgggtgccaatgcgattctgggatgttctatggctgcttgctgggcaggtgctaattattataaagtacctctttacagatatctgggaggttcggcggcgaataagctgcccgtgcccatggttcagattataggtggaggcgcacatgccgacaacgccatagatattcaggattttctggtcatcccaaccagtgccccaacctttagtgagggctatgagatggtggtcaatgtctataacgccgctaagatgatctttaagggggccggcaaacctgtctctatagctgatgaaggtggtttatggcctacggggttccaatcaaacgaagaaggattaaaactcctctgtgaaagtatcgaattggccgggtatacgccgggtcaggatctggggatagcattagatatagcctccagtgaattttatgatccagagcggggcacctaccgtcttgagctggaagagaaaactctgaccaaggaagagatggtgggcatgctctctgattgggtggataaataccccatcatttccatagaagatggaatgagcgagctggactgggagggcaaccttcttttaacgcaaaaactgggcaaaaaaattcaattaatcggggacgacttgttcacaaccaatatagagcgcattagaaaaggcgttgagatgaaggttgacaatgccgttctgatcaaaatgaaccaaatcggaacgattacggaaaccatcgaaaccatcgaatttacacaaaaccatggttatttaccggttgtatcggccagaagcggagaaacggaggattgcaccatcgttcatcttgccattgccaccaatgccggacagctgaaagtagggtcggcagcccgcagtgagagaacagctaagtggaatgaagtgttgcgcatcgaggaggctttagggtcttcggcaagatatccatcgaaaggggtgttt

SEQ ID NO: 33551 - DNA, 828 bp, Desulfitobacterium hafniense
gtgggactcatcatcaataaggatacccatgttatcgtccagggggggaccgggaagcagggttcctatcacgtaaaagccatgctggagtatggcactaaagtggtagcgggggtaacccccggcagaggggggaatcaggtcgggggtcttcccgtttatgatacggtccgagaggccaaagaaaggcataaaattgacgccagcctgattatggtaccggctccctttgtattaagcgcggcaatcgaagcaatcgacgcgggagtgccgctgatcgttatcgtaacggagcatatacccgttaaagataccatgaagataaatgctctggcccaggaaaaggggtgcaggctgctggggcccaataccatcggcgtcattaattgccgggaaaaagtaaaaatagggattatgcccggtttcctttacggttccgggaggattggactcatatcccgcagcgggacgttgagccatgagaccgcttccaatctgatgttcaaagggttaggggtaagcacggtgattggcattggcggggaccagattattggcaccgactttgtcgacgctttaaaagactttaaagaggatcaagatacggaagccgtcgtgatgttgggggaaatcggcggcaaccgtgaggagaaagcagcggaatacctgcaaagctgtgattatggaaaaccggtcttctgctttattgctggccgtaacgctccccccggcaaaaaaatgggccatgcgggtgcgattatccagggaagtgcaggaacagtccaaagcaaagaggataagctgagacaagccggagtacgaattgcc

SEQ ID NO: 33552 - DNA, 1080 bp, Desulfitobacterium hafniense
atgtacctttatgaatatgaagccaaagaggtttttagtaagtatggcataccccttgggcaaaacggcatagctaccaaccctgctgaagccggaatgatctgtgccggaatcggcaaaccggttgtagtaaaagcgcaggtcatggcaggcgggcgtggcaaagcgggattaattcttccggcagctgaccctgaagcagccgcaaaggcagcggcccaaattttgggcaaggagcaccatggcgagcaagtcaaaaagctgttgatagaagagcagattgagattgcccgggaggtttatgccagcattaccatggactttactgaagggaaacccgttatgatggtatcggcccaaggcgggatggaaattgagagcttggcggcagccaacccggagctgctgatcaaagagcatatcgatccctggcgggaggtgttcggccaccggttaagggatttgtggcgcagagcaggctttcgcggcggacaggttgttgaattggagaatattttaggcaggctggtaagggtttttctggaaacggacgctctgaccgcagaaataaatccgctggtgatgacacaggagggaaagatcatagcggcggatgccaaattgatcctggacgatgaagcttctttccgcagtgaaatcatcaggaatgcttcccgcccggagatcaatccactggaaaagagggccggggatttaaatgtgacttatgtgagcattgaggaagggggagatatcggaattatcgccgggggagccgggctatccatggcgaccatggatgcggtctatgggatcggggccaagccggccgctttcatcgatcttggcggcgggatatcccgggaaagaatgaaagaaagcctgcttttgatgacggagaccccgaatctgcgggggatcatcatcaatgtattcggcgggatcaataattgcctgaccatggccgcggggctggcggattttctggatgaaaagccaaccgatgttaaaattgttgtcaaaatgcggggacatgaacaggaagaaggctggcggatcttggagcggtatggtattccg

SEQ ID NO: 33553 - DNA, 1584 bp, Desulfitobacterium hafniense
gatgttttagtggtagggggcggttcggcagggacaatggcagccctggaggcgcgcaagaccagtcaggaagtggccctggtggacaagggcggaatttatcgcagcggctgtggcgcggcggggaacgatcactttctggcagtcctggagtccggtccggattgggatacccctgaggtttttctccaatggtataagcgtcttacccagggcctgagcgacattaagattgcggacaaggtttttgtgcgaaggatcaaatccctggtcaaagaattggaagaaatgggaattcccatgaaagatcccggacataaagagtatatccgcacccgctcctttgcccagccgggagattattttatcaattttgacggacgagccttgaaaccgatgatttccaagagagcagagcaggccggggtaaagctttatgctcaaatcgctataaccgatctgttggtaaagaaaggcaaggcggtgggggcggttggttttcacatcagaacgggagatttttatgtgtttcaggccaaagtggttgttctggccacaggcaatgcgaccagaatgtatgaaaatccgtcgggaatggccttcaatacctggcatagtccgtacaataccgggaccgcccaggcgatgaccctacgggcgggcggcgaggtaaaaaatcttgaatttgtcaactatacgattacgccgaagaatttcagcgcttccgccttgaacgctgtggtcgggatggggggacacctggttaatgccaagggcgagcgctacgtctttacataccacgaaaaaggggagcagggaccccgctgggccatgccatgggggacttatatagaggagcaggaaggccgggggccatgctattttgatgtcaggcatctttcggaaaaggataaaaagcacctgcttgagcatctgctgcccgtggataagaataccttcatggattattgtgaacaaaagggcatcgaccctggtgtggacctgatggaaatacaaatcagcgaagggcagcatcctgccttcctgggttcggtcagcggaattttcgtggatgagtgctgccgcacaaccctgcccggccttttcgccggcggggcctgcgccgtaggaatcggcagtttggccggctccatgtgcttcgggcaatcggcaggggccgaggccgctcagtacgcgctgcagaacaggaaaggggccgaaccttccccggaacagattgccgaattaaaacaaaccgtctacgccccttatcaaagcaggggagattacacctatcaggaagcggaagacaagctgcgtcagattatgagcgattatctcagcatcaaccggtcggcggaaggtctgaaaaccggctggcaggaattgaataagctgcaggaaaccttcggtctggttaaagcagagaatggacacgatctgatgagaattcatgagctgagagatcttcttttaatcagcaagggtattgctttcggggccctgaccaggacagaaagccgttttggcttgtcacattatcgccgcgattatccggagacccgggcggagtggcataagtca

SEQ ID NO: 33554 - DNA, 855 bp, Desulfitobacterium hafniense
atgattcctcccaacggactgcgcgaaagggaggactttaaagctgttttggctgaagctcatgtctgggtggtgggtattaacaaagtatacgccgaggacctggaagccgcccccaatctgaagctgatcatcaaacatggtaccggtgtggacagcattgacttaaaagcggctgccgccaggggaattaccgtagccaacgcccccgggaccaacgccaattcagttgccgatctggccttcggctttatgcttagtctggccaggcagattgtttcggcggataagcgtacgcgggacggcttctggggcactgtcatgggcaaagatgtttacggcaaaaccctgggcgttttagggctgggacagatcggcaaaggagtgatccgcagggcgagcggatttgatatgaacatcttgggctatgacctggtccatcacagtcaatttgaaaaggaataccgggtgagggctgcgactttggaggaaattatgtccgaggcggattatatttccgtccatttgcccctcctggagagcacaaaaaatatcatcgaccgcagtttgctggaaaaaatgcgccccacagcctttctcatcaataccagcagaggaggcgtggttgacgaaacagccctctatgatctgctgaaggaaaaaaggatagcgggagccgctttggatgtctttgccacagagccgccccggcagtcaccgttttttgaattggacaatgttattgtagcgccgcatatgggcgcctatacagaaggggcaatgggagccgtcagtgaaatcttggcggagagcattgtccgggttttggcaggaaaagaaccactatcggtcatt

SEQ ID NO: 33555 - DNA, 720 bp, Desulfitobacterium hafniense
agagttgctgtgattaccggcggagccaaagggatcggggaagcgattgtcagaaagttttatggggaggaagcaaaggttgcggtgcttgatgtggatgctgccggcgcccggcaattggctctggagctggatcccagcggcgaaaaggtgatcggtctgggctgcaatgtggtcagccgtgagggtgtgaaggctgcttttgcagagattatggccaagtttgggacggtggatatccttgtcaataatgccggaattacccgggatgccatctttcataaaatgacggagcagcaatgggatgatgtgatggccgtcaacggcaaaggtttgtttaactgcacccaggaagcctggctgattatgagagagaaaaagtacggcaagatttgcaatttgtcctccaccaattccagcggcgaagccgggcaggccaattattccttcaccaaagcgggcaccattgcctttaccaagagtctggccagagaagggggaagatacaacatcaacgtcaactgcgtgcgcccgggggtgatcgacacggagatgatgcgggccgtgccggagcaggctttggaagattacatcaacaagaccgcctttaaacggatggggcagccctcggaagtggcggacgtcatcgcttatttgtgcagtgaagagtcttccttcgttaccggcgaggaaattctggtggccggcggctatatctac

SEQ ID NO: 33556 - DNA, 1173 bp, Desulfitobacterium hafniense
ttgcaggatgtcgtcatcgtcagtgcggttcgtacccccatcgcctccttcggaggcgctttgcaggggtatggggccgttaatttgggagcattggttattcgggaagcggtgcagagagcaggtattcaggggaagcaagtggatgaagtcattatgggcaatgtgctgcaagccggactggggcagaatcctgcccgccaggcggccttgaaagcagggctgcctgtggaaacgacagcccagaccatcaatgtggtttgcggttcaggacttaaagcggtcattgccgcggcccaggccattagggccggggatgccgagatcgtagcggcaggcgggatggaaagcatgtcggatgcggcctttctcctggaccaggccagatggggccagcgcatgggccatggcacccttgtggacagcatgatcaaggatggcctgtggtgtgctttcaatgagtatcatatggggattacggcggaaaatgtcgccgaaaaatatggcatcagccgcagggagcaggatgagtttgcggcctggagccaggctaaggccgtggcggcgatggaaaaaggccgctttaaagaggagattgtcccggtggcgatcccccaaagaaaaggggaaccggttattttcgacagggatgaatatccccgggccggcacaacggtggaaaccttagccaagttaaaaccggcctttaaaaaagacggcacggtaaccgccggcaatgcttccggtatcaatgatgccgccgcggcctgtgtgctgatgagtaaagaaaaagccgctgccctggggattccttatctggcggccattaaaggctacggcatggcaggggtggacccggcgattatgggtgtcgggccggtcaatgccgtgaaaaaggctttgcagaaagcaggcattgccctggatgagcttgatctgatcgaagccaatgaagcctttgccgcacaggctttagctgtcaccaaagaattgggcttccccggggagaaggtgaacgtcaatggcggggctattgctctggggcatcccatcggcgccagcggcacccgtattctcgtcaccttagtgcacgaaatgaaaaaacgccgggataagctgggcctggccaccctttgcatcggcggcgggcagggcatcgcccttgttgtcgag

SEQ ID NO: 33557 - DNA, 1491 bp, Desulfitobacterium hafniense
atgtcagcgaccctagtagaaacccgctttggtctggtggaagggattagggaaggcggggtcagcatttggaaagggataccttatgcggccccgccccttcactctctccgcttccgtccgccccgggaaccgggggcctgggcaggggtgagggaagccaaagagtttggtccggcggcactccagggggagagcccctccatgaagtttttgggtgactcgccgctgcataaaagggaggattgcttatatctcaacatctggtccccaggcgccgatcggaaaagacggcctgtgctggtttggatacatgggggttcctttatgtatggctccggttcaagccatttgtataacgggaaatccttcgccgaacaaggggatgtggtggtggtcaccctcaattatcgcctgggtgtgtttggatttctccatttaagcgatatagggggtgaagcctaccgggggtcaggaaattgcggacttctggatcaagtggccgccttaacatgggtcagggaaaatattgaagcctttggcggtgatccccataatgtgacgattttcggtgaatcggcgggagctgtcagtgtgggcaatctgttggccatgcccctggcccgggggctttttcacaaagccatcctgcagagcgggacggcccgctgtaaagtaaccctggaagcagcggtgaaaatgacggaacagctccttgctcagctccagattgatcggcaaaatttatccgaattggcagaccttcctgcagaaaagattatcgaggccagcgggattttgccgcgccgggcctttggtccggtcggcgacggcattgttatcgccgaacatccggaaaaagtgctgtatgcagggttggccaaggatattccggtattggtgggtaccaacgcccatgaaaacaagctgtttacatatttcgatccggcgtggaaagacatggatgaaagtgaaatcaaggtttttttggaacggacatttggctcaagctgggcggctggttcccacagtgctgcccaggcggacgccttgaatcaagccttgagcaaagcattgaaccaggcctcgaatcaggcaggctatgaagatgcgatgactcattatgtctttacctatccggctatttatttcagtgaaggccaggcaaagcatggtgcgcctgtctggatgtatcggtttgactatgcaagcaaggccttaggaggagaggccaaggcttttcatggcctggagattccttttgtctggaataccttgcttgctcaggaaacggaagagctgacaggaaaagatccctgccgcttccaactggccggactgatgcatcgagcctggattgctttcgcccgccatggcgatccgaacataccgggattgcctgattggcccccctacgatgaggaaatccgggccaccatgcttttcaatactcataatgaggtcgtcaatgaccctgacggccgccaacgc

SEQ ID NO: 33558 - DNA, 2175 bp, Desulfitobacterium hafniense
tgtcacggggtgggttgcggcctgcgtattttcgttaaagatggcgagcttcagaaagtggagggcgacccggatcaccccatcaccaaaggccgtctttgcgtccgctgcctgaccatgaaggaatatttctatcatcccgatcggatcaagtatcccatgaaacgggtcggccagcgcggcgaaaacaagtggcaacgcattacctgggatgaggcctacgacatcatcgtggaaaattatcaggcctgtgcggaaaaatggggcgtcaactccgtctccgtctggtccggcaccggccgggaagcctgtcgttatcagactcccctctgcctggacgttttcggcagcaaaactatcgtccatcccaacagcggctggtcctgcctcgttccccgcatggcggtgatgagctggattctgggcagcgcttacgtggaatacgactatgccaacggtctgcccttgcgttacgatgatcctcgctgggaaccaccgaagtatatgctggtctggggccgggacccactgcgctgcaatgcggacggcctttggggtcattccatgattgaactcatgaaacgcggcaccaagctgatctctgtagatccccgcgccaactggctggcgacgcgggcggaataccatctccagctccggcccggcaccgacgctgctttagccctggctctgctccacgctgtcatcaaaaccggtaaatacgataaggaatttgtggagaaatggtgttatggctttgaggagctggcggagagagctaaccagtataatccggaatgggccgaggggatcaccggtgtggcggccgcagatatttacgcggtagctgagtgcctggttcagaaaccctccagcgcctgcatcggtctggctatcgaccagaaccccaattgtatccagattgggcatgccctctacagtattttcgccatcaccggtaacctggatattcccggcggtttgttcatgggacagccgaccttttttgcgggtgacgtcaacaatgatccgaaccagaaatctgaagaagcagaagcagagtttgaagggatcggttacaaagaatttcccgccatcccgatgatcgtaaataccacccatcccgactgtacgctggatactttggaaaccggcaggccgtatccgatcaagttcgcttttatccaaagcaccaacttcctcgcttcctcgattgtcgtccagcccaaacggtggtatgaagcgatgcgcaaactggactttattgtggcttccgatattttcatgaatcctacgattgccggcctggccgatctggtgctgccgatctccacttccctggaacacgacgggatcgtcatgaacagcatggcttcccagcccggtcagtacggtgcgctggtgaaaatcatcgaagattttggagaaaccaagagcgatctggaaatcctcctagatttgcatcaccgcctgcacccggacagccaggaccccagatggaaggataccgacagctatctcagccatgatatggcccccatgcccggcgtcgacattacctttcctgagctgaaagaacgggtcatcgcccaatacgaactggagtaccgcaaatacgagaagggcctgctgcgtccggacggccagccgggagtcaatacgcccaccggcatgattgaattgtacagcaccatgctggaggcgctggatgaagacccgcttccatattatatggagcccaagttcagcgccgtctccaggccggatatcgccggggattatcccatgatcatgaccaccggcgcccggcgctttacctcctttcactccgagcaccgccagatcaggaccttgcgggaaattcatccctggcccacggcggagatcaaccccaagaccgctgctgccaaagggatcaccgaaggatcctggatctatgtggaaaatccctggagcaaagccaagctgtatgcccacctgacgcccatcgtcaaagaaaatgtcgtttccatcgatcatggctggtggtatccggaaagaggcccggaaaaaatgtttgatgtctgggaatgcaatattaacaacctgatccctaataaggaaaacggcaaactcggtttcggcacccacttcaagagcatgccctgcactatctaccgggcggattaagggaag

SEQ ID NO: 33559 - DNA, 2028 bp, Desulfitobacterium hafniense
aagacattccgcaatgtctgtccccgcaactgttatgacacctgtgcccagatctcgtatgtagaagacggggtgctcaaaaaagtggagggagaccccaagagcacctataccaacggcaagctctgtctcaaaggctataactatacccgccgggtttacagcccggaccggattaaataccccatgaagcaaactccccggggttcagggaactgggagcggatcagctgggatgaagccatgaacaccattgccggaaagattctcgatctgaaaaagcgttacggctccaccttgcccatctgtatgaataagtactccggcaactttggcattacccactacggtattgaaggaaccatgtccagcatcggctataccaccagagccatcggaaccccctgctggccggcgggcatcgattcccaaacctatgattttgggaccatcgtcaacaacgatcctgaggattttgtcaatgccaattacatcattctttggggctccaactgcgcctggacgggagtgcacagcctgcccttcatcaccaaagctcaggagagaggggccaaagtagtggctattgatcccgttctgacctccacagcctccaaggcggatctctatattcagatcaataccagtaccgacggggctctggctctcggcatggcccgctatatactggatcatgatctggtggattgggattatgtccaggccaacagcatcggctttgcagaatgggcggactatgtaaagaaaaacatcaccctggattgggccgcggaaaaaaccggcattcccaaagaaatcatcatccagcttgcccatgaatacgccactgccaaaccggcttccatctgggtgggctacggtatgcagcgccacaccaacggcgggcagaatgtccgcatcatcgacgccttaggcttgatgaccggcaatatcggcaagtccggcggcggcatcaactatgcccatctggagacctggggttttaactaccatgccatggtcatgcctgccccggaaggctcggtggggatggcaggacctgacggcactcatacggaccgctctgtcaatatgaacaattttgccgccgatgttcaggctctgacggatccgccggtcaaaatgctctggattgccgcccggaatccggtgtcccaggatcccgatacccatgatatcatcaaaatgttcaattccatggaacttgtggttaccgtagactctttcttcaataagacggtggagcagtcggatatcgtcctccccgccaccactcattttgaggactgggatgtcatggccagctactggcatcactgggtcggagtcaatcagcgggccatcgaccccatgtacgagtccaagagcgatgtggagatcgccatggccttgtccaaggccatgaatgccctggaacccggctcctgcacctaccccaccgagggtgatcccgaggaatggacagctagggagttcaatgacggagtctataacatgctgggaatcaccgattataaggaattattggctggaccccgcaaagctaaattctcaccggcagcctgggccgatggtaaattccgtactccatccgggaaatttgaagtccacagtgagcgcgccgctcaaaatggtctgcctgccatccccatctgggtggaggaaatgaaggctcctgcccaatatcccattcgctttatgaccccccatccccaacacggtatccactctcaattccagaacctggactggatgatggctgccaatccggagccccttctggagattcatcccgagctggctgcccggcacgggatcgccgaaggggatcaggtccgggtctacaatgacttaggtgaagtcacgattaaggctcatctgaccagaaccacctccccggatgtgatcgtcagctatgaggcctggtataaggattctcccttcaatgtgaactataccgtcaaggccattcccgcggatatgggcaagctggccaccggaatggac

SEQ ID NO: 33560 - DNA, 1842 bp, Desulfitobacterium hafniense
atggatactttacatcatcatatctgtccccgaaactgttatgacacgtgcagcataatcagcaccacccgccatggccggttggcctccatcgagggcaatcctgcccactcctatacccggggcaagctttgccccaaagttatggatgagattcataaagtatacagcccgcagcggatccgctaccccctgcgccagcgcaaacgcttttcggggcaatgggagcggatcacctgggatgaagctctggaaaccatcagccggaagattcttgaccttaaagataagtatggaaccaccctgccccttgctcacaataaatactccggcaacttcgggatccttcataatgccctggaggcttttctgacaggtcttggtcccaccacccgggccgtgggctctccctgctggtcggcaggggtggaggctcaagtcttcgatttcggggccttcttttgctccgatcctctggatatggagaaggctaagctcatctggatctggggagccaatcccgcctggaatgccgctcaccagatgcccattatctttcgggctatggaccaaggggccaaagtcatttgtctggatacccatttttcagctacggctgcccgggttcatcaatttgtgcgggtgaatccgggtacggatgggctcttagccttaggcctggcgaaaattatcgtcgatcatcagcttacagatccggagctgcccgactattcactggggtataatgaatttatagattatctgaaggcggagattgatctccggaaatgctcggcagtgacgggggtttccctggagaccatgaaggaactggccctggagtatggggcggtgaaaccggcctgcatctgggcgggctttggactgcagcgctataccaacgggggacagaatctgagagccatcgacgccttaggagccctgaccgggaatatcggccggcccggcggaggagttcagtacgggcattttgaaacctggcgttttgccgggcccttagcccattcccaatgcggccatgctcaggaccgggagttggatatcaatcaatttccccagctggccttagcagccgatcctcctgtgaaaatgctctggatcgccagccgcaaccccttccagcaggatggcaatcatgccggctggcaaaaactcagtgaaaccttggagcttatcgtggttagtgacctctttcacacccgttcctccgccgcggccgacctctttcttcctgtgaccacccattatgaacattgggaccttcatgccagctactggcattactatattgggatcaatgaaccggccgttgagccggtgggggaagcccgctccgatctgcagattgcctgggatttgtcgaaacgccttaatcaaagctcaccgggcagctcggcttttcccacagaagggtcggaaaaggagtgggtcctcggcgccatcggaccggagatgctggccatactgggaattgactcggctgaggagctgcttaagggtcccaggcgggtaaactatcccgggaccgcctggcagggacggcaattccaaactccctcaggcaagtatgaattttatgcggagaaagctcaggaatggggcctcccacctttgcctgtttaccggccgccacgtcaagcacccccggaaactcctctgcgcctgctgaccccccatcatttatccgggctgaattcccaggtctatctctattccgaagagagcgactccttattgaaagcccggctccatcctaaaaccgctgaaggctatggcttgaacagaggagacaaggccatcctatggaaccggggcgggagt

SEQ ID NO: 33561 - DNA, 3414 bp, Desulfitobacterium hafniense
ttaacacccaatgcccgggtcattctggaaaaacgctatctcaagcaagagaatggcgaagttgcggaaagcccggaagatatgctttatcgggtcgccagcatcatagcccaagtggaggagacctttggcaaaaccaaaaaagaagtcaaagaactggccaaatccttctatgagatgatggctaaactggagtttatgcctaattccccaaccttaatgaatgcaggacgtgatctgggtcaactcagcgcctgctttgttttgcctgtggaagatagtatggaggaaattttcgatgccataaaaagcgcagcgattattcataaatccggcggtggaacaggctttagcttctcccgcctccgccccaaaaacagcacggtccgttccaccggcggagtggcctccggccctgtgtcttttatgaaggtcttcaacgcagccactgaagccgtgaagcagggcgggacccgccgtggagccaatatgggaatcctgcgggtggatcatccggatattcgggaattcatcacctgcaaggaagacaataaagagattaccaatttcaatatttccgtagggattacggaagagtttatgaaagcagtccaggaaaaacgccattataacctgatcgaccctcataccaaggaagccgatggacagctttatgcacctgaagtcttccaattgatcgtagatcatgcctggagaaatggtgagccgggaatcattttcctggatcgtctgaaccgggacaaccctacccctcagttaggtgagatcgaagctaccaatccctgcgtaaccggagatacttgggttcttacagaggaaggagctgctcaggttagggatctcctgggcagtcaggttaaattagcccttaacggcgaatatcatgagacatcaaaggaaggatttttcgcaacaggggtcaaacaggttctgaccctaaagacccaacaaggatatgaattaaaggtgacagcggatcatctggtccgtgttgcttcagatatgacccgttataaagtaacccaggaatggaagccggctggggaactcaagcctggggacaccatcgtcctttccaataaccgtagtattcaatggcaagggaaaggaacaaaggaagagggatatctgcttggtcttcttctcggagatggaacccttaaggaagagggagcggttatctctgtctggggtgagggagaagaggcaaagtccatgatggaagctgcggaaaaggcggcctttagtttaactcatcgccaagacttccaaggcttccaaaaggaaatcagcgagagacatgaacatcggatgaggtttgcggccttaagggatcttgcccagcagtatgggattcttcccggcagtaaagcaatcactcaggaattagaaaagacagggcaggatttttatcagggactgttgcgagggctctacgatacagatggcacggtaacaggaactcaggaaaaaggcgtatcggtccggctctggcaaaccgatctggcagggcttaaggtcgtacaacggatgcttcaacgcctgggtatcatttccacactttatgaggagcgtaaaccagccgggcaaaagcttatgcccgatggtcaaggaggctctaaagagtacccagtacaggcggggcatgaattggttatctcccaggacaacatagaaatctttgccgaaaaggttgggttcagcaactcgaagaaggcccagcttcttgccgagaagctcaatgtctatcaacgttccttaaacagagaacgttttgttgacaacatcgtggcctgtgtccctggcgatgcagaggaggtctttgacgcccaggttccggggatcaacgcttttgatgccaatggcatctatgttcataattgcggcgagcaacccctgcttcccaacgaagcctgcaacctgggttcgattaaccttaaactcatggttactgagaaaaacggcaaagtcgtagtggactgggagcgcttagggcagattacccgtctggctacccgtttcctggataatgtcattgaagccaacacctacccccttccgtccatcgaagagatggtgaaaggcaatcgcaagatcggtctgggcgttatgggctttgcggatatgctgattcttcttcagacctcctatgcttcagaggatgccgtggagtatgccgaaaaggtcatgaacttcattcagactgaggcccgcctggagtcccagcgtctggctgaagagagaggcactttccccaactatcaaggctccatctatgatggcgtccgtcctctgcgcaatgccaccttaactaccatcgcgcctacaggaaccatctccatgatctgcggtgcttccagcggagtggagcccctctttgcggtggcttataccaagacggtcatggatgggacacccttaatcgaagtcaaccccatcttccaaagccttgctgaagactatggttttaactccccggagcttatgcgcaagattgcggagaaagggactgtcctgggcttcccggaagtgccaaactgggtgcaggaggtctttgtcactgctcaggagatcgagcccgaatggcatatccgcattcaggctgcctttcaaaaatacacagataatgccgtttccaagaccattaactttgctaatgaagctacccatgaagatatcgctaaagcttatgagctggcccatgaactcaactgcaaaggtctaaccgtttatcgggacggcagccgggaagaacaagttctctccacaggaatcaccaagaaggctgaagaaaaggctgaggaagccaagacacaagtatccattcctaaggtgcctttcattccggaagtgaataccgtattgccccgtccccgtcccacgaccaccacaggagttaccgagaagatccgcattggctgcggtaatctctatgtcagtgttatggctgatgagaagggaatctgcgagatcttcaccaacaccgggcgggccggaggctgctcctcccaatccgaggctacagcccgcttgatctctatcgcccttcgttccggaatttctgtggatgccatcattgagcaggtcaaaggtattcgctgccccgcctgcattcgccgggaaggggttaatgtcacctcctgccccgatgctatcgcccgtgtgattaaggaatatgtagaactgggtaaaggcaaggttaattccgtaaaggttacttctcagccggcagtggaagaaaaaccggtacaaagcaagagcgcttccatcaccaacccccaaaagacccgagccacagtagctgaaggcaatgcctgccctgaatgcggtatgagcatcaatcacgaaagcggctgtgtcgtctgcacccactgcggatactctaaatgcggg

SEQ ID NO: 33562 - DNA, 3245 bp, Desulfitobacterium hafniense
tgttcccatgtggtggctttccgcacggaaaagaatttaaagatggccgtcctcacccatctggccaaaatgcccctgggctattttgatcggaatcccagcggcaagctgcgtaaaatcattgatgataacagctttcagacccaaacctttattgcccaccagctcccggatttagtgggagctcaggtgacgatggccgccagtctcgtcctcatgctgctctttgactggcgggtgggtctgccgctgctgctgctgtttggggtgggcttttttctgcaaggttccctgaacggcaaagagagcatgaagtttatgcaaagctatcaggacgctctggagaccatgaatcatgaggctgtagagtatataagagggatctcggtggtcaaggtgttcgggcagacggtgcattccttcagcaaattcaatgccgctatccaatcctatcgggatgacgccctggcctttaccatgtcctgtaaaaaagggatggtggcctttaactccatcgtcaattccagctttctggtgctggtgccggcggccttgctcatcgggctggtttctcccgatttgccgggctttatgcagagctttctgttttacctgatcttttcgccggcctgtgccgtcatgctcaacaaaatcatgtatatgaccagctacaaaatgcaggccgaggaatccatgcgcagaattgatgggattctgagcgccgagccccaaagggaagcggcccggccccagacggccggcggccatgagatctccttcgcagacgtcaccttcaggtatgaggggacggaccatccggcggtgtcccacctcagctttatcgccaagccggggaccactacggccctggtggggcattccggttccgggaaaagcaccacggccagcctgattccccgtttttacgatgttcaggagggtgtgattaagatcggcggggtggacatcagagagatggcctctgaggatttgatgagaaaggtggcttttgtctttcaaaaccccaggctgttcaaggataccctgctggccaatattcgcgccgcccggccggaggccaccagggaagaagctttgcaggcggcccatctggcccaatgcgatgatattttagccaagctgccccaagggatcgatacggtggtgggcagtaggggggtttatctttccggcggtgagacccagcggattgccatcgccagggcgattctgaaggacgctcccatcgtcctgctggatgaggccaccgcctatgccgatccggagagtgagcagcagattcagcaggcctttaaggggcttaccaagggcaaaaccgtggtcatgattgcccaccgcctgtccacggtgcgggatgccgggcagattgtggtgatgaagcagggcgggattgtggaaaaggggacccatgacgggctggtggctcagggaggggaatatgcccggatgtgggataactatcaaaaatccacccaatggcatattggaggggaggtaaggtcatgctgaagggcatgtttgccctgagcgatcagggagcaaaggatttaaacaaagggatcgccgccactaccctaagcaatatagtcctgattcttccggtcagcctgctgatcctggtggtcatggagctgctcaatgggatggggggagaaaccgccggactgcaaaggaccgtttccttgatgcccttgtatggggtgctcacagtggtgctgttcgtgatggtctttgccacccaatggctgcagtacaacaagacctatacggtggcctatcaggaaagcgccaaccggagaattgtgctggcggaaaagctccgcaagctgcccttatctttctttgggcagaagaatctggccgatttgacggcgaccattatgggggattgcacagccctggagcgggtcttcgccaacgcgattccccagctgttgggaacagtcttcatgtttattctgacggtccttggcttagttatcctggattggcggttgggcctgtgcattgccctgcctgtgccggtggccgccctggtggtcatcgccgcccgtaaagctcagcagaaagcggaaagggccaatctggatgccaagcgcactgcttatgacggggtccaggagtacctggagacgattggggagctcaaagcctgctcccgggaaaaggagtatctggaggggctggaacaaaagctggatcaggtggtgcgctgctccttccgcaatgagctggcccctggcgcggccaccacagcagcccagtttattctgcggttcggcttggtcgctgtgctgctggtggggggctacctggttgccaagggttccctttccattcccatgttcattctcttcctgttgtttgccggccggatttatgatcctttcaccagttgctttatgatgttggcggaagtcttttcgtcactggtcagtgtggggagaatgaagcagatcgatgccacaccggagcaaaccggggaccccgtttgcaacaaccagggatatgatctagagttcgaccaggtggtattctcttataacgatgagcccgtattgagagggatttcctttgtggccaaacagggagagatcacagccctggtgggcccttcgggcagcgggaaatccaccgtttccagactggccgcacgtttctgggatgcggattcaggcaggattaccctgggcggagtcgatataaccaaggttgagccggaaactctgttcaggaatttcgccattgtgtttcaggatgtgatgctgtttgatgatacggtcatggagaacatcaggctgggccgccgggaggctacggatgaggaagtcagggcagccgcccgggctgctcagtgtgaagaattcatcgagggcctgccggaaggctaccggacaaacatcggcgaaaacggcagtgccttgtcgggcggggagcggcagcgtatttccattgcccgggcgttgttgaaggatgcgccggttgtcttgctggatgaggcgacggcttccatggacgctgaaagtgaaaccctggtccaggaggccttgtcggtcttgttggaaaataaaaccgtgatggtcattgctcatcggatgagaaccgtcgccaatgccgataagattgtggttctggacaacggccatatccgtgaacagggtactccggcccaattgataaatcaaggcggactttatgcccatttggtatctcttcagcaaatt

SEQ ID NO: 33563 - DNA, 8325 bp, Desulfitobacterium hafniense
agaaattgtctataaaagaaagtgagggagttcatgactggaaatctgaaggagagtctggaaagcttctatgctgccaaggtgtgggaagatatcaccctgggcaaagcgctgtcggcttggagtgaaacatatggggacaacatcgccttaaccgaagcggacagacaagtaacctatcgggagctggaaacggcagccaggagaatggcggccggttggcaaaggcggggatttggcaggggggataagatcgtcctgcagcttcccaactccattgagtttgtcgtcagcgcttttgccctgttcaaattaggagttattcccgtcatggctctgcctgcccaaagaaaaacagaaatcaaagggattatcgaaaaatccggggccaagggctatgtgatcaaggaaaaatacttggggtttgactataaaagcctggccagggaaatccgccgggaaatcgaaaccgatctggcggtgatcgtcatcggcagaagcgacgaatttatagcttatgaggatttaggggaaggcccggaattaagagatgaaccggagataggctccggggaggtgggtttgtttttattatcgggaggaacaacgggaatccccaagctgatcccccgaaggcatgccgattatttatatgtggcgcaaaagactgcggagcgctgccgcctggatcaggagtccgtctatttggcggccctgcctgtggcccacaatttccccctgggttgtccgggtttgctgggtaccttgagtgtgggcggcagagtcgtgatttgtgcggtggccagcccggatgaaatcatccccctgattgaagaggaaggggtgaccataacgggcctggtgccggccctggcccatatgtgtattgagtttttggagctggatggggagtgcgatatatcctcccttaaagtcatccaggtggggggagcggtcctggattcctatttagccgccaggatcgaaaaggcttttgcttgcaccttgcagcaaatattcggaatcgccgaaggcttgatttgttgtacggatttggcagacagggaggagatcaggtatcacacccaagggaaacccatctcggcatacgatgaaatactgattgtggatgaaaaaggccaggaggtcccggagggagagtatggtgagctgacggtcaggggcccctataccatctatggctactataatcttgaagaagtcaaccaaagctgcctgtcggatcagggctattttaaaaccggagacaaagcgcgctggcaggatggcaatctccaggtggcaggaaggctgaaagagatgatcaaccgggccggagagaaaatcaccccgtcggagctggaagagctgctgctgagacatgaagacatagaggatgttcaggtggtgggggttgaggatcaagagctgggggagaggatttgcgtatttataatggctcagaataaggggttgaccttgaatgctctgcgcaattatttagtggggcagcaggtggcttcatacaaactgccggatcagctggtttatttggaggcctggcccctcaccaatgtagggaaaatcgacagaaaccaattaagagtcttgggaacacagagaggtaatcaggaggtttttcatggaagataagaatccgagaacagcagccatggagtttgtgggccaaaaggtccgggacctgttagctgcggagcagatcgccgccgacagcaacctcattgaagaggggctcagctccctcatgatcatgcagattgccggcggcctccgcaaatacaagctcaggatttcctttgccgctttaattgaaaagcctaccctgagggactgggctgaactcatcaacaaggcaaagctcaaggaagccgggcaggtcccggaaggggcggtggaacgggtagtggaagaggcggtggaagaggcagcgggggaggcagcggcagcggaacgggcagtggaacggacagcgggggagcccgggggccaattcccccttacggatgtgcaatatgcctactgggtgggcagaaatgatgaccagcctttaggcggggtaggatgccatgcttatctggaatttcatggacagtctatcgatcccctcaggctgaagctggcctggaatgcgctgcagagacatcatcccatgctgagggcgaaattcttccccaatggccggcaggccattatgccttccccctacagtgaggagattgaggtgtttgagctgggaggattggccccagatgagctgcaagaggagcttttatccctaaggtccgcccggtctcaccgcaaactcaaggtggaagaaggtgaggtggccggccttgctctggctcttcttccggacggtaccggccggcttttcctcgatgttgacctgctggtcgccgatgttttaagcctcagcctgatcatccgggatctggcggaagcttatctggggaagaggcttggtgaaccgccggaatatacctttcaggattatatccgcggcagagaaggggaagcggaaaaccaggagcgggaggaagataaacggttttgggaagggaagctgcaggccatggactgggaagggctgcggatgcccctgcaaaccaagcctgagttgatcagcaaaaccaggttcagcagaaggcaggccatcgtaggccgggaggattggcagagaatcaggcaaaccgcggcccgctaccaatccaccccctccatgatcctgctgacggcttatgctctcgtcctggaaagatggtgcagccaggggagttttttcatcaatattcccttattcaaccgggatctggaggacgggaggatcagcgccatggtcgcggattttaccaatctcctgctggttgaatttatgaagaaaccccaggaaacctttctcatgaccatggaacgggtaaaaagcacatttttggagaatgtctcccacagcggttattccggtgtgcgtgtgcaaagagatcactttggcaagatgggggggacgggttttgtggcaccggttgtgttcgcctgcaacatcgactaccccctggagacccccctatcgcgccgggcctttggcggggtgggctatatggtgtcccagacacctcaggtgtggcttgattttcaaacttatgtccgtgatgaagagctgatgctctgctgggatgccgtggacgaattattccccgagggtttagtggatgatatgttcggcgccctgcaggacctgatccaggggctggctcaacatgatgactggaatcaggggttcgatgttctgccgcccagacaaaaagcacaacgggccggggaactggcagatctccttcccttaagccctccccctaagacactgctgagcggctttctgagtcatgtccgccaaaaccctgacagcatcgccctcattgacggccggacccaggggtcaatcacttacggggaattataccgcagagcattggccgtggctggattattggttcggaaaggagtccaacccggcgactatatgggcattttattgccaagaggatgcgggcagatctatgccatattgggtattctcatggccggcggggtttatgtgcccatcggcatcagccagccggaggggcgccggcagaaactatacaggcagatagggttaaaagggattataacccatggggaaaccatccccagcgggcatccggatcatgagggtatcctggtggtggagctggaagaggggatgggcaagggaggtctggaggaggggatgggcaaaggaggcccgggagtggggacggacaaaggaggtctggaaaagccggtcatggcttccccacaggacagcgcgtatgtcattatgacctccggaagtaccgggagccccaaaggagtggagatcagccatgagggagcggtgaataccattgaggatatcaatggcaaattcgggatatcagccagggattcggtcctgatggtttccgccattgattttgatctttcggtgtacgatctctttggcatgctctcggaggggggcagggtcattgtcctggacgaagagaactataaagatcctgatgtctggctgaggcttatgcaacactattccctattggtttggaattcggttccggtcctttttgatatgttggtgaccatggcggagcggcgggaggcgccccttgacttaaggctggtcatgctttccggcgattggatagggcttgatctgccccggcgattctatgagctgaacagaaacgccacggtggtggccctgggaggggcgacggaagcctccatatggtccaattatcaggttgtgccggagaggcttccctcagactggatcactattccttatggtcaacccttaaaaaaccaaatctacaaggtcatggacaagtgggcaagggtctgccccaattatgtggccggagagctctggatagggggagccggtgtggccaaaggctataagggtgacgaggaactgaccgggcagaaatttaaaacggacaccatccgctggtacaaaaccggtgattcaggaagaatgtgggaagacggcaccattgaattattgggcaggctggacaatcaaatcaaaatcaagggttaccgcattgagaccggagaagtggaaagtgccttgatgaagctgcccggtgtggcgaatgccgtagtatgcctgagcgaagaaaatgaggataaggtgctggcggcctatctggtggccaaggaaaaggtcaaggcagaggaaaaaaggtatgcggaggtggagggggtaaaagaggctctggcggcctgccttccccactatatgatcccggcggtctatgtttgggccggggagctgccgttaacggtcaatggaaaacctgataagcggcaaatcagtgagctgttaaagaaccgttggcagaagacgtctttctcgccgccggagggggcgctggaagggcagatagccaaagtgtggcaggaggtgctgcataaaaaagagctatcccgccatgataatttctttaaattaggcggggatagtctgaaagcggtggagatcgtcaccaaagccggggctgtgttaaagcttcccctgaccctatccatccaaaccctgttccgatgccccaccctgagggaatttgccctggaaatagctaagctgggcagcggctatgaagaggaaatcatctgaagaagttcatgctaggttagaggaggttgccgtcaatgacgattgaaaaaagaatgaaggaattccgtaaccaagggattgttttatggcctgaagggactgccttgaaattcaaagcaccgaagggtgtggttacggaagagataagaagctttttaaaagaaaacaaacagaggattatccagtacctggaggggaatcagcaggctgcttgggcaaggaacagggcgggcaggttcaataagtttcccttgaccgatatccagaattcttatgtggtgggccgcaataagcactatgaattaggcggggtggcctgccacggctatttggaaatcgagtttgaggaaatcctggatatagagagattggagacagcctggaataaggtcatccaaaagcatgatatgctgcgggccatcgtctacgatgtgggctaccaaatcgtccaggaaacggtgcctctggtaaggattccggccattgatctgcggggcggggggaatgacaagggccgggaagccttgcggaaaagtctggcccataagcaataccccttgggccagtggcctatgtgtgatgtggcggtcagcattgatgaagaaaaatcggtggtccatttttcagtggatatgctgatcgctgatttttccagtatgaacattatcctcaatgatctggagcatttttacagaaatcctgaggagcccatcagctaccccaccctttaccgggatagtgtcatgtatcaaaatgaccggaagatgctgaacccccaggagcggcaggctgccgaagcctattgggagcaaaagcttccttctctgggtgaagccccggagcttccggtcatcaagaaaaccggactgacggagcatactttttcccaaaaaaagctgttcctggagagggaaaggtggcaggggttttgtgagcgggccaaagatgctcagattacgccctcggtgctggtcatggcggccctggcggaagtgaccgccttatggtcctcaagtcacaagttcagcatcaacacaaccatcttcaatcgtcctcctcttgccgaagatatccatcaggttgtgggggattttaccgacgtcattgtttcctctatcgatctggatttcagtatcccctttagccaaagagcccaggctatccaaaaggatctttggacggatttggaacacagcgctctatccggggtggaagtgctcagaaaaatgaccaaagagcgcaaaaagaacatcattatcccggtggttttcacaagtacggcagggatcgccggcaaggaggacgccacggtccgcagaagcatccgctacaagatcagccaaaccccccaagtgtatcttgactgccaggtagcggatgaaaatgggggggcgaaaataaattgggatgtccgggatggggtttttgaagagccggtgatcagcgacatgtttgagagtttttcccgcttaatcagctccctttgtgagcctgaacagcaggttttggcagactattttccggtggaattgcccctgggaaccagggaggtaagaaacatcaccaactccacggccagggagtatcctccccggatgatggaggaggggttccttcatgccctgaggcactatcccaacaagacggctctgattacagaccgggaagagtttacctatgcatctttttcccgctatgtgaagaccgtggtggatctgttgaaggaacaggatgtgcggcccggggacagagtgggtatcagcatcgataaaaatcaatggcagattgcggcggtcatggccgtcctgttggtgaaagggacctatgtgccgattgatgttcaccaaccctctgcccgccaggaaaagatcattaagggagccggcattaaagtgctgttaatccaggatgaggactactcttcccagaagggccatcccgcccgggaaggctgctctgcccagggaggctgcccaccctgggagggctgcaccacgatcaatctgcagggggtatccctgggaaatgagcctttggatgtctttacgtccgatcctgatgactccggctctggtggccccggctctgctgctcccggctctgttgccctcggctccgcctcctctggccccgattatgaccggccggcttatattatttttacttccgggactaccggggagcccaagggggtggttatttcccaccgggcggccatgaataccatcatggatgtcaatcaccgctatgggatagacgaatccgatgtgtttctttgcttagccaatctctcctttgatctgtcggtctatgatattttcggctgctttgcggcggggggcaccctggttatgcctgcttcgtcacagatcagggaccccaagtatttgtatgatctgatcctgctgaaccggatcagtgtgtggaactcggttccggcacaaatgcagatggtggtcaattatctggaatctgtggagagcatgaagaagaaaacctccttgagcaaggtgtttttatccggggattggataccggtcaacctgcctgagcgcattggcgccatgtttccccaggccagggtggtcagcatgggcggggccacggaggcctccatttggtcgatttattatgacattgccaaaggtgaagtctttgggaaaagtgttccctatgggaaacccatggccaatcaaaggttctatgtgctcaacggtgaggggcggccctgcccggattatgtggaggggaacctctatatagccggtgacggcttatccctggggtatttgaacgatgagaagctgaacggggaaaagtatggcaggctgccggcgacgggggaaagaatttaccggaccggggacagggggtactacaggcgggatggcaatatcatgttcagaggcagggaggccggtgatgagcagatcaaaattcacggccaccgcatcgagctggctgaaatacgtacggccttaaccgactatcccctgatcgattcagctctggctttggccgtagggacaccccccgatgaattgaagatcagtgcggtgatgacgcccaaacgcaggtcggaacagcaggatatcgagcca

SEQ ID NO: 33564 - DNA, 744 bp, Desulfitobacterium hafniense
gttgaaaaacaagatagtggaatcgccacccttgttctgaacaaaccccagcgcagaaatgccatcgatcccgggatgatggagcagctggccgggattctggaaagcctggatcaggatgaagccgtcaaagtgatcattttgaagggagaaggagaacatttctgctcagggggggacctgaaggccggggcgggaaccacacccaccatcgagaattcccgggcgtccttgaaaaaatactgccgggtggtccaaatcattcagcagatggagaagcctgtcattgccatggtcagggggtatgccgtaggaggaggtatgagcctggctctggcctgcgatttgctcatggcctcggaaagtgctaaattctcctccaactttttgaaggtgggcatcgtgccggaaatgggtgccctgctcttcctacctcagaccatcgggctttaccgtgccaaagaactttggtttacaggccgggttgtggaagcccgggaagcctggcagatggggttcgtcaatcatgtttttcctgacgccgagattgaagaggccaccatgtctttggcccaaggattggcgggaatgccttccctgcccatgaaaatcaccaaacggattaccaattcaaccattaatcagctgctgaatgccgtgatggaagccgagcttcagtcttcgcctttttgcgcccagacagaagagcataaagcttacaaggctgctttgcggaataataag

SEQ ID NO: 33565 - DNA, 1138 bp, Desulfitobacterium hafniense
aagtgaagaacaggaattattgctggaaagccttaaagaactgatggagcgggaatgcccggaagactatgtcagaagatgcgatgaagaagggcggttcccggtggaattcgccaaagctctggtagacaacggcttcggcttactgggggttccggaagaatacggcggcaccccggtggatctcctgactcttctgctggtcaaagaagaaatagccaaaaacggcggtcctatcaatgtctttacccaagcttttcagctggacaatatgctcacctacggctccgaagaacagaagaagatcaccatgcattatgtaaaacagggacaggtcccgttttgcatcggctttaccgaaccccaggccggttcggacacttcagccattcagaccacctatacccggagaaacggcaaagtgtaccttaacgggcacaagacctttatcagcggcgcgctgaccaatccctacctgctttgtatggcccgcaattgtgatgagacagacaagaccaaagcctttaccatgtggtgggtacccatgagtgcgccgggaatcaaagtggaacagcttcacaaaatcggctggcatatgctggagacctgcgaaatctatctggaaaacgtggaagtggaagaaaaggacattgtcggtcaggaaggccacggcttcctgcaattgatgaagaattttgagacggaaagactgctgatggccgccaccattttaggaatggcagagtgcgcctttgaggacgcagtgcgttatgccaatcaaagagtccagttcggcaagcccatcgggaccttccaattgatccaggagaagatcacttatatggccctgaagattgagaatatgcgaaatctcatctataaaacggcctgggaaaaagaaaatggcatctcaactcagattacttcggccctgaccaagctttattgcgctcagtcaggaaacgaaatcatcgatgatgccctgcagatcatgggcggaattggttataccaacgattgccgtatctccagattatggagggatgcccgcaattacaggatcggcggcggaaccgatcaggttatgatccatattgcaggaagaaatattcttaagaaatacagataaagacatcac

SEQ ID NO: 33566 - DNA, 1530 bp, Desulfitobacterium hafniense
cttcatataggatttcttttgaccttaaatgctaatcgatatccgcaaaaaacggcaatcgtctgtaaccggcagcgcatctcttatgctcaattaaataggcgggttaataagctggctcacggtcttttggagctgggagtgacaaaaggggataaagtagcttacctgctgcccaatggactgcggattgtcgaactttactatgcggtgcaaaagatcggagccgtctcggtagccataaactatcgcctggcttccccagagattggctgcctgcttgagcaggcagattgccaggtgttcgtctatcatgagctttttgatgataaagtccggcaagtcaaggagaatgttaagacgatctccttgatgatacgggtgggtgaacaaccaatacagggagagtatgcttttgaggccttgacagaccatgaccatgaggaagaaccggatatactgatcggcgaagaagatttgtgcagaatacagtttaccggaggaacaaccgggcgttccaaaggggtgatgagaacccaacggcaggagattttccaggtgatcggcatcacaacagccttggaactgggagggcctgaccgggtgatgctgacccagtctcctttatgccaccaggccgggctctcctggctgaatgtggccatcggagcgggcaacacgttgattgtctgtgaccgatttgaaccggagaaaattctgcggcagattcaggaggagagcgttaccaatgtcatgctgctgccgccctcttcctatcaccggatttttgccttgccctcacttgcggaatacgacctgagttccgtcaagtccgttcattcatcggcggggggtacttcgccggagattgtccgcaaactctataaggttttccccaactgtgtcgtccggtgcggttatgggcttactgaaacaggcggggtaggcaccacctttgtgctgacccgggaggtgctcgaaaacaacccggagctgaccaaaagtgtagggaaagagatgtctttcctcgaattgcggcttgtggatgagagcggccgggaagtcccggttggcgaaaccggtgaatgcatcgcccggggcccctcggtgatgaccggttattataatcaaccggaactgaccgaggaagtgatcaaagagggctgggtctataccggagatctgctgaggaaagatgaaaagggctattactatttcatggatcgcaaaaaggatatgattaagtccggaggagaaaatgttttcgctcaggaagtggaaggggttatccgtactcattccgccgttgatgactgtgcggtgattggggtaccggaccccaggtttggggaagccgtgatggcggtgattaagactaaacccgggcaggctgtaacgggggaagggattcaggaacactgtaaaaaatacctggccggctataaaaaaccccgcctggtggaatttgtggatgaatttccggtggatcaggcggggaagattcaaaagtacaagctccgggccactttt

SEQ ID NO: 33567 - DNA, 1059 bp, Desulfitobacterium hafniense
aactttattgatttgtccgctaatattaatccatttggccctcctcagggagtttgggaagcccttcaaaaaggagttgccaatataatccattaccctgatccgaattatcggcgcctccgggggaagatggcagaatattacgctcttaacgctgaagagatacttctgggcaatggagccggtgagttgatttttctgattctccatggtctccggccccgcaaagtgctgataccccagccggcctttagtgaatatgaacgggcggccctggcctgcggcgcagaggtaaataagcttatccttggcgtaaaagggtggggggagctttcttttcagaacgaagaaagtcatagagaatgggagcaagccctcgcggaaaatgagctggtgtttatcaattctcctcataatcctaccggcagtgccctgtcgaagcagcagtttgaagtgattctcaacctggccttaaaacatcagacttgggtcgttttagacgaatcttttgttgactttctggaggatgagagccgctggtcaggcaaagggtatttacgaaggtatcccaatctgttggtgttatattctttaaccaaattctatgctattccggggctgcgcctgggggcagtttttggggcagccaaactacttggccgtctgcaggatcaacgggacccttgggctgttaacagtttggcggaagaagccgggctggctgctttggctgatgcagagtatgggaagcgggtaaggcggctcttgcaggaaagcaaagagtcattttaccggagttttgctgaagggcgcaagggaaagaagtattggggcttgcgtctatattccagtaaggttaattttgccctgattcaagtcctagaagcggaagattcaggtaccgatcgggacgatgccggcaaagggaaaaaaaaccttattcaggagttggggaaacagggaattctggtcagggattgcggaaactttgcggggctggagggaaactatataagggtggccatcaaagatcaggaaagtatgaactcattattagca

SEQ ID NO: 33568 - DNA, 1767 bp, Desulfitobacterium hafniense
ttgttgattcttctgcttctgaatgcttttgtgtttccgcacttgctgaaaagacaggttacccaagtggattatggctctttcctgtcctatcttgagagtggaacgatttcggaagtcgaagttcaggataatcagattgcctttatgaccaaggattcaacaggcaaagaaacgatttttgttacgggcgccatggcagaccctgaattggttaatcgtcttaaggctgccggggtggataaatattctcaggttatccccaaggagaactcccccctcatgaacattctcttaacctggattctccccatgattctcttatttggactttggatgctgctgggaaatctgatgcagagaaagatgggcggcggcatgaacgccatgacctttggcaagagcaatgctaaaatctacgttcaagcccagacaggtaagacctttgccgatgtggccggtcaggatgaggcgaaagaagctctgactgagatcgtggattttcttcacgaccccagccgttatgccgccattggagccgatctgccgaaaggggctctcctggtgggtcctccgggaacggggaagaccttgctggccaaggccgttgccggagaagcaaaagtgccctttttctccatatccggaagtgaatttgtagagatgtttgtgggtatgggcgcggccaaagtcagagatctatttaaacaagccaatgaaaaagccccctgcatcgtttttatcgatgagattgataccatcggcaaaaaacgggatggaggctccttcggcggaggcaatgatgaacgggagcaaaccttgaaccaacttctgtccgagatggatggttttgacggcaagaagggtgtggtgattctcgccgctaccaaccggccggagtccttagacaaggctttgctgcgtccggggcgcttcgatcgccggatccctgtggagcttccggatttggcaggccgggaagccatcctgagagttcatgggcaaaaggtaaaaatggactcccctatcgactttaaagccatcgcccgggccactgccggagcatccggagcggaattagccaatatcattaatgaaggagctttacgggctgttcgctgcgggagaagccgggtgaatcaaagtgatttggaggagtctgtggaagttgtgattgccggttatcagcggaagggggcagtgatttctcatcgcgagaaagagattattgctttccacgagattggccatgctttagtagccaccaaacaaacggactctgctcctgtgcataagattaccattattccaaggacttccggggccttaggctataccatgcaagtggaagaagatgagcgcgttctcatgagcaaagaagaggccttcaataaaatcaccacctttacagggggccgggcagccgaagaattgatctttggaacctatacttcaggagcctccaatgatattgaacaagccaccaaaattgcccgggccatggttacccgtctggggatgagcaagaatttcgatatgatggctttagagacagtgaataatccttaccttggcggcgatacttccttgatgtgttctccggaaaccgcagccaggattgatgaggagattttatccattatcaaaagcgcccacaaaaaagcctttgaaattttaaaagaaaatattgaaaagcttcatgaattagcacgttatttgttggaaaaggaaaccatcaccggagaagaatttatggcggtgctctcc

SEQ ID NO: 33569 - DNA, 2049 bp, Desulfitobacterium hafniense
atggaattcagtagaagaaattttctcaaaacctgtgcaatttcggcagcaatgatgacagtaggatgtaccagtcaaaccaagacgattcaggttgacccgcctgaaccagcccccagcgcccctaagcagatagatgtggatcaatgggttaaatccgtatgcagatattgcggaaccggttgcggtgtgctgatcggtgtgaaggatggcaaagtagctgccgtaaaaggggatccggataatgaaggcaataaagggctgctctgcgccaaaggctattatttgccacaggtcattacccatagcgaacgtgttaccaagcctttgatacgtaaaaatggcaaattggagccctgtacttgggacgaagccatggaactggttactgcaaagtttaaggaatccattgccaacaatggtccggattccgtagccttctatggttccggacagcagttggcggaagaaggttatgtggccaataaactcttcaagggagccatcggcaccaataatattgacgggaatccgcggctttgcatggccagcgcggtaggcggttttaccactacctttggtgccgatgaacccatgggatgcctcgaggattttgaacatgccaatgtgttctttattatcggctccaatattgcggaagcacatccggttctgtttggcagactgacggataaaaagaaaaaagatcctgataccaaaataattatcgccgatccgagacgtcatcgctctcatgaaattgccgatatttcgctgcaatttgtaccggggaccgatatggcccttctccacgccatggcttatgtgatcatcgaggaaggaatggcggacgaggagttcatcgctaaacatacgagcttttccaatggcaaagaagctataacctttgcagcttataaggagttccttaaggaatttacaccggaaaaggctgaaaaagtaacgggccttccagctgctcaaatccaagaggttgcccgcctcttcggtgaaaaaggcaagaacaccatgtccatgtggacgatgggtattaatcagcgggtagccggtgtctgggctaataatcttattcataatctgcatctgcttaccgggaaaatctgcaaacctggctcaactcctttctccctgaccggtcagcccagtgcctgcggcagtgtccgggaaacgggagcattatctcatttactccccggacatcgtgtcattgctaacgagaagcacaggaaagaagtggccgagctatggggcgtgccggctgatcgcattagtcctcaagccggtctccataccatggagttatttaaggcctgcggggacggccgggttaagtgcctctatgttatgtgcactaatccggctcactccctgccgaatgtcaatgcttatcaggaggggtttgaaaaggtcttcctggtggtagcggaggcgttccaccccacagctaccaccaagtatgccgatgtggttcttccggcagctttctggtgtgagaaagaaggggtgtacggcaatacggatcgccgtacccagcatttggctaaagccatcaacccccccggtgaagctaagccggatttggatattcttctcgaccttgcccagcgcctgggctatggggagctgtttcccttcaaaactcccgaagatgtctggaacgaataccttaaatgtacaacagggactcatatggaactggccacctatccggcccttagggaggcccatggcattcagtggccggttaaggatcaccagggcaataaaggggccgtgcgccgttatgtggctcccgaggatccctatgtcaaagaaggcattgatttctattccgcaaaggatcacaaggcggttatctttgccagaccgtatctgggtcctgcagaagtggtggatgaggagtacccctactatttaacgaccggccggattcttgaacactggcataccctgaccatgacaggcaaatgccctaccttaatgcgggcggtgcccaaacagtatgtggaattaaatccccaggacgct

SEQ ID NO: 33570 - DNA, 474 bp, Desulfitobacterium hafniense
aaattaagatttgcggaaatcaatgacgctccgctaattctggaattgataagggaattagccgactatgaaaaaatggcccatgaggttgtagcgacagaagaagtattaatagagtctctatttgaacgcaaaatggctgaggttgtaatcggtgaatacaaaaatgcaccggttgctttcgccttgttctttcataacttttccaccttcctgggcagaccgggtatttatctggaggatttatatgtgaagcctgacatgagaggaaagggtatcggcaagatgatgcttgctttccttgctaaactggctttagagagaaactgtggaaggttggaatggtggtgcttggattggaatgagccgtccattcaattttataaacagttaggtgcggttcccatggctgaatggacagtgtatcgggtacacgatgaggccttagctgaattggcagtgaaatttgatgga

SEQ ID NO: 33571 - DNA, 531 bp, Desulfitobacterium hafniense
atgaaaaaagtgtatcttgtgcgccatggtgatatcggattaggcaggaataaacggtatatagggattcaggatctttccttgagtgaagaaggcagggagcaggccttttccttaaaagagcggctgcgggaggttcctttggacaggatctattgcagtgctttaagccggtcccgggagaccgcggcgatcataactgaggctcattccttatctttgaccgttcttcccgagctgcatgagatcgggatgggggaatgggaaggccggcttttcagtgagatacaggagcggtttccggcggagtaccggctgagaggggaggatattgtccatcaccgtcctcccggaggggaaagtttcctccagtgttcccggcgcgttatccccttattcgaaagcattgtccgctctgatgcccaaaccagtcttattgtcgggcacgccggggtcaaccgggtgattttatgccatgccctgggattgccccttcaggaactctttagttttaagcagagttatggatgc

SEQ ID NO: 33572 - DNA, 1857 bp, Desulfitobacterium hafniense
agtgacaaggttaaaacctcaatttgctgcctttgtaacggtgggtgcgggctgaaagttcatataagccctgagggaacgataaaagctatttatggggatccggataatccctataataaaggcaaaatatgccccaaacccatcgagattattgaaaacctgcggggaccggaacgggttcagtatccaatgatgaaagtcaatggtgaatttgtgcggatcagctgggaggaagccatcgataccatcgccaagaagtataaggagttctccgacaacttcggcaccggttctgtgatcggcattacctctaaaattggcggctccttcagcaagttcgccctgaagatctttggcgaaatagccggttttgccaactatggcaccggacccatttgtttcagctcagaggaaaaagtcagaaaagaaatgttcggcaaggctgcggcttcagccccccttcatgatgtcatttactcgaagctggtcttaaacgtgggcaataactgtgcccaaacgaaagcgggacaatttcattggctgcaggaaggccaaaagcatggcgccaaaatcatcaccatcgatacccgttatacggaaaccgctcagctcagcgatcaatttattcaagtcaacccaggcaccgatgctgctttaggcatggcccttctgcacctggtcattaagcataagcactatgacgaagcatttgtccgggatcaagtgaatggctttgcggaactggctcaagcggtagaagattttacagcagagaaggcggcggcgatcaccggggtacccgaaaaggtcattgaggagctggcctatgagctgggcaccaaaaaaccggccatcatgtggccgggacggggcatcgtcatggtcaataatggggagcaggccttgatggcctttgaatccttatttgccattctcggcaatgtgggcaaaccgggtgcgggagtggtttcccatattaatgggtatggacagcccgctgatttgatcaaaccggaacatgtcgtcaagcccagcttcaaacttccggctgacaaggtcattgaagggatggagaccggtcagatcaaaatgatctatattgcgggcaacccttgtgctaattggccggaaagcgcccgtatgaaaaaggccttagggaagcttgattttgtggtatcccataccttaacccttgatgactccgcctgtttagcccatatcgtcatcccggcaacccactggctggaagaagcgggtatgcagccgggaattcacagagtcatgcaatggcgggataaagccgtggagccttatggggaatcaaaaccggctgctgaagtcttcaagttgcttgcggcaaaaatgggtctccccacagagtattttgccgatacgccagaggaagcctgggatatggagcggcggcatattgccggcatcagcgccattaccgttgccaaaatgcaggagaagccgggtggcgtccattatccttatcctgaaggcggggaagaaagccacaggttgtatagcaagggcttcaataccccctccaagaaggttgaattattaagagggaaagggagtgtacttcactacaaagatcccttgcaatctccgggaaatgaagggttaagcattgaagactatccttatttcatcagctccgttaaggtagcggcccattatcatacccaatgtcaatacagcagattggcacgggaattcgagaagccctatgtggaggttcatccccagacagcacttaagcttggggttaaggatggggaggcgatccggattgagacaccgaccggggccatttccctgcctgctaagttaacttactccgtg

SEQ ID NO: 33573 - DNA, 1275 bp, Desulfitobacterium hafniense
cgaaaaataaacgtaaataaggttattgatgaggctaagttcaaccgttattttctgattatattcgttctgctgctgcttgctttgatatttgacgggtatgacatggggatttacggcgttacccttccgtcggtcatgaaggaattaaaccttaatgccacccagaccggtcttttggccagtgcgggcatgttcggcatgatgtttggcgccttgcttttcgggatgctgtccgatgtgatcggccgcaaaaaaaccattatcatcggcatttttgtgtattctgtctttaacggtatagttgcatttatccacagtgcctccatctttgcagtcgtgcgctttatcgccgggatggggatgggcgctttgactccggtggtcataagcctgctgtctgagtacacgcccaggtccagaagaaccctgcttctgaccatggtcatggtagggatacccctcggccagctggttgcttcactggcaggcgttgcctttctggaatccatcggctggcgtgttctgtatctggctactttaatcgccttgattatgattgcttttgttgtttggaatgtcccggaatctatgaaattttatgttcccagaggagaaacaaaaaccattaagaaagtactggctaaagccaacccggactttgagcagactgaggaagatgtatacgaattaagcattgtcaaccagcaaaaggcttccctggggagcttgttcaaatccggttatgccaaaaacaccatttatatctggatcgcctttttctgcaacctgtatctcttcttcggaatctccacctggcttccgaaactgatgaccatgctgggctatcctttgaaatccagcgtgatgttcctggccatcttccttctggggggagtcctcaccaccccttttgtgggcatgctgggcgataaatacggctacaaaaaggtcatgccggttctctatgccatgtcggcggttttggtcagcctcctgagctttcagatgagcacgtttatcttttatacactgctgtttctggccggatgcgctgttactttggttcaaagcatgactctggcagcagctccggacttttatcccatagctttccgcggcacggccatggggtggggctccgcagtctcccggttgggaagcgccgttgccccgaccgttgtcggtgtattgcttacggccaatcttcctgtaaggggcgttttcctgactttcattattcccgccgtgattgcttgcatcgcaatcctgctt

SEQ ID NO: 33574 - DNA, 2139 bp, Desulfitobacterium hafniense
ggttgcggtatgattctgactgtcaaagaaggcagactcatcaaggtagaaggagatcctgaacatcccatcaccaatggcagactgtgcgtgaggtgtctgactctcccagaatatactcatcatccccaacgggttatctatccgatgaaacgccttggtgccaaaggagaaaacaaatggcaacggatctcctgggatgaagcatgggataccatcgtcgacaaaatcaattatttcaaagagaaccatggtgctgaatccatcgttgtctttggcggaacgggccgtgaagcctgtctgtactattaccccctgggctttgcttccatcggcacaccaaacgtttgctacccgcaaagcggttggtcctgctacggcccacgctgtgctatcaccgactatattctgggtgcaggctatcctgaaatcgactttgccggtcactttgaagaccgctataaccatccgggctggaaggctcctgaatatctcatgctctggggtaaagaacccctgaagtccaatcccgacggcttcttcggtcactctgttattgatatgatgaagctgggaaccaagatcatcatggttgacccaaggatcagctggctcgctaccagagctgagcatgtccttcaactcagacccggttcggacaccgcccttgctttaggactgcttcacgtaatcattaaagaagagctttacgatcatgattttgtagaaaactggtgctatggctgggatgaattcgtagagcgggttatggaatacccacctgagaaggtttccgaaatcacctgggttcctgctgaaaagatttatgaagtggcccgtgtcttcgccaaagctaaaccggcaagccttggctggggattagctgtcgaccagaatcccaatggggttcaactgggtcatgccttactggctatgattgcgatcaccggtaaccttgatgtacctggtggagtaacaatcggaccacctgcatcccttatgggcaaatggcgtgttgaatcacgttcaaatctctccgaagaactttggaataagagaattggggcagagcaatggccagcagtgagcaccgctttggcgacaactcaccccgatgaaaccttgaatactttggaaacaggtaagccttacaaattgagaatgggctggttcaacagcagcaacttcatcacccccaccaactcagctcaaccggatcgttggtatcgggccctgcagtccttggagttcagtgttgtacaggataccttcatgacacctacggccatggcttttgccgacattttcttaccgctgcccacctttgccgagcatgatggcgtggttctgactcactatggacggaatgccgtatttgcaggcgctatgaacaaagccttaacggtgggcgaaacaaagtctgacctcgaagtctgttttgaactgggtaaaagactcaatcccaaagcctggccttgggacaatgtttccgatttcttcactgagcagcttaaacctgatacagggtttggctttgaagagctgcgtgaaaaaggcctctatcaacccggctatacctataaaaaacatgaaaagggtctcctgagatttgatggcgagcctggatttaatacggttaccggaatggttgaattgtgctctactctgtttgaatcctggggcgatgatgctctgccttatcatgaagagccgccttacagcccttacagcacaccggagcttgctaaagaatatcccttgaccttaacaaccggcgccagaaaatatacctccttccattcagaacacagacagctcaaaaccttgcgggaaattgatcctaacccggaaatggaaatccatccggaaaccgcggctgagttaggcatcatcgaaggggactgggtcgttattgaaaacatgtttgggaaggccagaatggtcgctcatcttactgaggccattcatcccaaagttgtccatgctactcatggctggtggttcccggagaaagaagctgcagaaccgtccctctttggcgtgtgggaatccaatatcaataccttgatgccccaccaacataatggaaaactcggtttcggcgatacctttaagagtattctctgtaaggtttacaga

SEQ ID NO: 33575 - DNA, 1194 bp, Desulfitobacterium hafniense
gttgttttcggagggtttttaacccagattattctcatgtgcggcgtccaatttgttcctatcctgatggcgccgattaagcagtccctggaattatcgaatacatcggcaggcactatcgtatccgtctttggcctttgctatgccggctgttcctttatttggggatatctggctgaccgggcaggggcgagaacagccgtatctctggccggtctggtcttaggcattgccgtcatactttttggactgcttgccgacagcttcctcaaagcagtgctgatcattgctctggtcggtttcggggcggccggtgtctacagtgccacgattcccaagttgattggtgcctggttccatcccagcaaacggggcagagccatgagcaccattacggcagggggcgtgctgacgggagcagctttcggaattgtgctgccccaattggctaaggcctatggctggcaaacagccgctgtcattttaggagtgctggccattatttgtactgttgtaatctatttagtcgtcagaaataagccttctgaaaaaggtttgattccggtgggaacccccgccgatcaggttgtgaaagctgctccggctatgaaagatgccggcttcaaagatgtgcttaaaatgaaagttacctggcatgtgtccagtatgttcattttctggcaggttgcttatatgacagccacggctttcgttgcggtatcctttgtcaatgccggttttacggctgtacaaggtggtttggctgtaacgatttataacttatgccagctaatcgggcaacaaatatgggggcccctgtccgatcggttggaacggaaaacggtgatctgcattgcaggcatctggtggactgcagcaaccttgggttacatgtttatttatggcagtacattgaacgccatgtatatcctcatcggtgtgatgggagtgggcatgggcatggttccggtcatcctggccagtttctcggattatttccccacagaagtcggcggctccggtgcaggggttgtttccaccatgggactggtgggccgtttctttggccccatgcttgccggttatgcggctgatgctacgggcagcattacaggcgcctttggcgtaggagctgcagccatgctgctggcatccctggtcgccttttcactgccctcattgaaaaagcaggcg

SEQ ID NO: 33576 - DNA, 1074 bp, Desulfitobacterium hafniense
ttagtattagaaaacggaaaaatattcagaggagagtcctttggcgccggcggtgaaattcagggagaggtggtcttcaatacagggatgaccggctatcaggaagtcctcaccgatccttcctataagggacagatggtatgcatgacctatccgctgatcggtaactacggcatcaattccttagataatcagtccccacagatccaggtccagggatttatcgtcaaagaagcagcccgtaacccccatcattggcaactggaaaagaatatctccagagccttggctcaggcaggggttgtcggaatcaagggtattgatacccgggccttaacccgcattatccgggagcatggcgtgttgcggggaatgattaccacagaacttggggagctggaccaaaaagcactggagctgaagaactgggagattcctcaggatgcagtggcacaggtgagcaccagggagacctacaagctgccgcccctgggcaaaacggattcccggaaacctttccatgtggtggtgatggactttggcattaaaagcagtattctcagggccatgcaggaagaaggctatgccctgactgtggttccttactctgcttctgctcaggagattattgctctgaaaccggatggtgttttcctctccaatggccctggggaccctaaggatgtggcggttggaattaagaccattggcggattcgtgaacaagcttcctgtctttgggatttgcctggggcatcagctcctgaccttagctttaggcggggacacctataagcttaaatacgggcatcggggaggtaatcagcccgttcaggatttacgcacgaaaaaagtccatatcacttcgcaaaatcatggctatgctgtggctgaggggagtttggccgatacccttctggaagtcacccatctcaatctgaatgatcagaccgtagaaggtgtccggcataaggagctcccggtattttccgtgcagtatcacccggaggccggaccgggccctaacgactcactctatctttttaaagagttttccaccttgatgacggaatgg

SEQ ID NO: 33577 - DNA, 3168 bp, Desulfitobacterium hafniense
atgccacttaatccagcctggaaaaaagtactcgtcattggctcaggtcccatcgtcatcggtcaggcggcagaattcgactatgccggcactcaggcctgcaaggctttgcgggaagttggcatcgaagtcattctggtgaacagcaatccggccaccatcatgaccgatgaacagatggcggatcgcatctatctggaaccccttctgccccagaacctggaaggaatcctggctcaggaacggcctgatgctctcctccccaccttaggcgggcagacgggattgaatttggctatgaagctccaggaagaaggaattctggagcgttacggagttgccctgatcggatgtaacgcggaaaccatctataaagcagaagaccgggaagctttcaaggaaaccatgctggaaatcggtgaaccccttgccgaaagtgccatcgtcaccagcctggaagaaggtctggcatttaccgcccgccggggatatccggtgattgtccgtccggcttacaccttagggggtacaggagggggctttgccaaaaatgaaaaggagcttctcgaggtgcttcaccggggactgcaagccagccccattcatcagtgcctcttggagcgcagtgtggcgggctggaaagaaattgagtacgaagtgatgcgggatgccatggataactgcattaccgtctgcaatatggaaaatatcgatcccgtaggaatccatacgggggatagcatcgttgtagctccctcacaaaccctgaccgatggcgagtaccaaatgctgcggtcatcttccctgaaaattatccgggccctgggtgtgaatggaggctgtaatgttcagtttgccctggaccctgagagcagggagtatgtggttattgaggtaaacccacgggtcagccgctccagtgccttggcgtccaaagctaccggctatcctatcgccaagatggccgctcttttagccgtgggcttcaccctgccggaactgcgcaacccggttaccggtcacaccagcgcctgctttgagccggctctggattatgtggtggtcaaattcccccgttggccttttgataaatttccggcggcggataatcacctggggacgcaaatgaaagccacaggcgaagttatggccatagacaggacgctggagggagctttgctgaaggctgtccgttctctggaaatcggagcggtgggcttaagaattgccgactcagggcgttggacggagatggagatcgaacataagctggcccaggcggatcatgaacgcttctttgctattgccgaagctttccgccgggattggaccatcctggaagtccagatgctgactaagatcgatccctttttcctcaacaagctgaaagagctggtgcttttggaacgccgcctggggagtgagccccttaccctggagctgctgcggtcagccaaaagccaagggttttccgaccaggccatcggtcgcttaagaggcgtaacccaggaagagatccggcaggaacggtgccgctatggcttgaagcctgtctacaaaacagtggatacctgtgctgccgaattttattcctccaccccctattactattctacttatgaggaagaggatgaagtggcagttcattccggccccaaagtcattgttctgggctcgggaccgattcggatcggacaagggatagaatttgactattgctccgttcatgctctttgggccttacaagagctgggaattgagtccatcatgatcaacaataatccggagacggtttctacggatttcgatacgggagataagctttattttgaacccttaaccttagaagatgtcctccatattattgagaaagaagaagctgatggtgttttggttcaatttggaggtcaaacggccattaacctggcgagtccgctgcaaaaagccggggtaaggattctgggcagtcaagtcgatgccatcgataaggccgaagatcgggaacgctttgcccagctgcttcttgaactgggaattcctcagtcggaaggctgtgcagcgacctcagtcagtcaggccagggctattgctggggaactgggttttccggtgctggtccggccttcctatgttattggcggcagagctatgcaggtggtggaggaccttgccgagctggaaggctatctgacccgggctatcaccctatccccggaacatcctatccttgtggaccgctacctggaagggaaagaagtcgaggtggacgctattgctgatggtgagatcacggtcattccggggatcatggagcatattgagcgggccggagttcattccggagacagcctggctgtctatcccacccaaagcctcactcctgcagaaatccagcagattcaggattatacctgccgcatagctaagggcatggaggttcgtggtctgctcaatattcagtttgtggtggtcaacggtaaagtctatgtgattgaagtgaatccccgggccagccgaaccgtacccattctttccaaagttacaggaattccgctggttgctttggcggtgcgggtggctatgggtgaaaaactggcggacctggggtatgctcatggcctggccccggagattccctttgtcgtcgttaaggccccggtcttctcctttgaaaagcttacccaagtcgaaacctctttaggtccggagatgaaatctacaggagaagttttgggtatggatgtgaattttgggcatgctttggccaaagcctttgcggcatcccatgttcctctgccggacaagggagatattttggtggctgtagcggaaaaagaccgcccggaagccatcgccatgacccgggaactttcccggctgggctttggggtaaaggccaccgggaatacagctaaagcgctgctcttttgcggagttcctttagaagaggtaagagaagccagcaccgaacttaaggaagccgtccgccggcaggaattctcctttgttctcagcacccccagcaaaggagattctgaagagcggaccgggtacttattgcgtcgtttggctgcggagcaccgggtaccttgcctcacctccatggatactgcccaagcggtggtgcgcgcccttaaggagatccgcaatcatactgcgccgcaaacc

SEQ ID NO: 33578 - DNA, 1851 bp, Desulfitobacterium hafniense
acccaagaagagatgtatctctttaattgtggtgagttttattatagttaccgcaaactcggtgctcatttcctagagcataaggggcggtggggaacgtattttgccgtatgggctcctcaggccaggcaagtctctgtagtaggggattttaacggctggtgcggaatgaaccattctctgcaaaaatgggaggaacagggaatttggacactctttattcccggcctgcccacaggggagatctacaaatatgaaatcctcaactcttcaggagagtcggtgttgaaagcggacccctacgcctttttttccgaagtgcggccccatacagcttcggtgatctattccctggaggattatgcatggggggatcaggcttggctggctcagcgcaaaaccaggaatcccaaagtgctgcccttgtccagctacgaaatccatttaggctcatggagaagaacagaagacggacggttccttaattatgctcaactggtaaccgtgttgatcccctatgtaaaatcgctgggctatactcatatagagatcctgccgctgatggagcatccttatgacggctcctggggttatcagatcacgggattctatgcctgcaccagccggtatggcaccccccatgatctgatgtacctgatcgaccaatgccatcaggcgggaatcggtgtgatcctggattgggtcccgggccatttttgcatggatgctcacggtctgggcaaatttgatggaagtcctctctatgagagagaagttcatgagcaatggggtacttataaattcgattattcccgttcggaagtccggagcttcctgatctccaatgcagtcttttggctggacgtctttcatgtggatggcttgcgggtggacggagtgagcagcatgctctatttggattacgggaaagaaaaaggagcctggcagcccaacagatatggcggccgggaaaatctggaggccgtcggctttataaaacagctcaatgcaacccttcatggcctttatcccgacgccttgctcatagccgaagaagctacggattggcagggggtgaccgggcctcttgatcaggaaggactggggttcacgtttaaatggaatatgggctggatgaatgataccctccgttatattggcctggacttcaatgaacgcagatcctttcatcagctcttaacctttcccatgatgtatgcctatgctgagagctacattctcccgttgtcccatgatgaggtggtccatggcaagaagtccttactggataaaatgccgggagattacggacagaagtttgcaggtttaaggggactaaccacctatttcatgaccagtcccggcaaaaagctgctctttatggggggagagatccctcagttcatcgagtggcgggaagatcgggagctggactggtttcttatggattatgagctgcatagaaaataccatggctttgttcaacagctcaatgggctgtatttgcgggaaaaggccttatgggaaatcgatggggactggaccggatttgaatggatcgatgtccataaccatgaacagggagtgatagtcttttgccgcaagggaaagtcctttcaggacaggctggtggttctgatcaattttcagccttataactatgaaaggtatcgaatcggagtggaaatggccaagggttaccgggaaatactgaacaccgactcgacagacttcggtggatggggtatgaccaatcccgggcttttaaaagtagagggagtaccgtggcatggccgggaattttccctggaaattcgggttcctgctctgggtgccatgatattaaagccc

SEQ ID NO: 33579 - DNA, 2418 bp, Desulfitobacterium hafniense
atgttctcagacaaaaatggttttaaagatgcctatctggagaaattcgccgaaatcaaggggaaatccattgaggaaggaactctctgggataaataccataccttagtggtgctgctcagggaagagatcagccttagccgcgcctttatcaactatgccgatcccaaaaaccgccctgccaagcaagtctattatttttccatggagtttctaattggcaaattgctgcataattatcttattaacatcggcattcaggatatcgttgcggaaggtttggaggagctgaatattgacctccaggagcttttggctcaggaatgcgatgcaggattgggaaatggggggctggggcgtttagcggcctgcttcctggattcaatggcctttctgggcatagccggccatggcaatggcattcgctataagtatgggctcttcgaacagaaaatcgtcaatggctatcaaaccgaggtggccgaccattggctgaagaacggttacccctgggaagtgcgcaaaccggataaatccgttgtgattaaatacaaagggaaggtacgggtggaaaacattgatgaccggctggtattccatcatgagaattatgagccggtgctggccgttccctacgatattcccatcgtcagctatgagaacccctttctggtcaataatctaagactatggagcgccgagcctttatcttccgaactggacctggccttattcaatcaaggcaactttactcaggctctgagcaataaatcagaagtggaggccatctcctacatattgtatcctgaagacagcaatctggccggaagggagctgcgcctgaagcaagagtatttctttgtggcggcgggactggcaacgattgtgcgcaactacaaaaagaaccatggttcgctcagagacttttcccagggggtgtccatccatatcaatgatactcacccggccctttgtattcctgagttaatgcggattctcatcgatgaagaaggaatggattgggaggaaagctggaatatcaccgtggatgccatttcctacaccaatcacaccattatgccggaagccttggaaaaatggcctttggacttattcaggaatctcctgcccagaatcaccatgattattgaagagattgaccggcgtttcaaggagaagcttttaagacggttctttaacagcgaggaactgttcaggagcacccccatcatcaaagagggacagatctatatggccaatctggccatgattggcagccattccgtaaatggggtggctaagctgcatacagagattctcaaaaaacatgtcttcaaggattttcatcggatcttcgggtataaattcacgaatttaaccaatggcgtgaaccaccggcgttttctcttaacggccaatcccttgctttccgagctgattaccgaggggatcggtccgggatggaagaccaatgccggcgaattggcagagctgcaccggttcaaagaagacagcgcctttcttgaccggctggctcaggtgaagtaccaaaacaaattgagattggcggagatcattgccatggggcagggaatccagattgatccccattctctctatgatgttcatgtgaagcggattcatgcctataagcggcagcttctcaatgtcctgaaagtcatggatctctataaccgcctgttggcggatcctgggtcggttcaagggacgtatacctttatcttcggcggcaaagcggctcccggctaccattacgccaaaagcatcatcaaactgattcatgttatagctgacaaaatcaatcaagagccaaggatcaaagagcagctgaaagtggttttcatggagaactttaatgtgtcttcagcagagagaatctaccctgcggcagatctcagtgagcaaatctccacagcgggcaaagaagcctccggcaccggcaatatgaagtttatgatgaacggagccctgaccatcggcactttggacggagctaatgtggagatcagggaggcggtgggcgaggaccatatctttatcttcggactgacggccgaggaaatccttgcccataatctgaacagaacctatcgctcctgggatgaatatcatgccaatccgtgcctggagaatattctggaacaactgatttccaagcagtttatggaaaatgattgggaattccgcaccgtctatgattccctgctcctctacaacgatgaattctttgtactcaaagattttgcagcttatatgaagaccttcggggaagcggcggatcgttatgcagcgcaggagcaatggctccggtcctctttgcacaatattgcggagtcgggagtcttctccacagaccgaaccatcagggaatatgcccatcaggtttggcgggtgcgc

SEQ ID NO: 33580 - DNA, 1053 bp, Desulfitobacterium hafniense
aagaaagaatgcatcgccatgctgctggcgggagggcagggaagcaggctgggctgcctgactcgtaatattcctaaacctgccgtatcttttgccggcaaataccggattatcgattttagcctcagcaattgcagcaattccaatattgacacagtgggggttttgactcagtataagccctttgccttgaatacctacatcaatatgggttccgcttgggatctaaattgcttaaatggaggaatccatatccttcccccctttgtcggtgaagctcagggaagctggtacaaaggaactgccaacgccatctatcagaatatggattttatcaatttttacaacccggagtacatcctgatcctctccggtgatcacatctaccaaatggattattatgagatgctgtcctgccacaagcaaaagcatgcggaagtcactctctccgccattgctgtgccttgggaagaggcttcccgtttcggagttatggtgacggatgccgggggccggattatccggtttgaggaaaagcccccccgtccggaaagcaatttagcttccatgggcgtctatatctttaattgggatgtgcttaaggaagctctgctggaagacgagagggaccctcaatcggatcatgacttcggcaagaatgttctgccccggcttttgcagcaggggagacggctttactcttatctttttcatggctattggcgggatgtggggacgattgaaagctattacaatgccaatatggaagttctgcaggaagaaagggtggataagtttttcgagttgaagcagcgggttttctccaatgaagagattctcgctcctcaacaccttggtgagcgggcgaagatccacaatagtctcattggcaatgggtgcacgatcctgggagaggtccgcgactccgtcattgcctcaggagtctatgtgggggaagggagccttattgaacagtccatcttgctgcccaattcagaaatctatgaggatgtccgcctgcacaagaccatcctcggggagaatgccattgtc

SEQ ID NO: 33581 - DNA, 1101 bp, Desulfitobacterium hafniense
atcggcatgatttttggcaatctgaattcaagtgcgttacaagggctggaccccaaccgacccataggaacagttccttttggagggcgctaccggcttttggactttgctctctccagtatggtcaattccggcatccacacagtaggtttaatcacacctcagcagtaccggcctatgctggatcatttgggggccggcagggactggtctttggaccgcaaatcgggaggtttgtttttcctccccggagttattcatagtctgaaccataccgttcattttagcttgcaggatattgctgtcaatattgattttctggagaaagattgtgcgaagaatatcatcatcagcagctccgaccaagtattcaacctggatttccggcctgttttagaggagcatgaacaggcgcaagcggatattactttggtttataatcaatcggttcatcccccggaggggagcgagcggatttacttaaggatgaatgcccataaaaaggtgacggccatgtcgaaaagcaaagaagtggcaggcttgcagagcccctggaactactttatcgatatcctgatcatccggcgggagcttctgctgcagatgctcaggggttatggcagcatcggtaccattgaattgagcgaagtcatcgcccatcatcttgacatcattaatgtacagggctatttttgcggcgggtatgtgggacggattcgttccgtgcaggactatttccttaataacatggctttattgcaggaagaagtccgccgggatctctttattaatacccggccgatccggaccaagatcagagataacccgccgaccaaatacggcaagcaggctcaggtcaaaaactccctgatttccagcggctgcactctcgaaggaaaagtggaaaataccatcctttcccggggggtagtgattgaagaaggctgtgaggtgcggaactgcatcatcatgtccaaatgcgtgatcggcaaacattccgttcttgagaacctgattatggataagttcgtggaaatcaatgagggaagtgttttgaaaggtcagcccaataaactgatggtcatacccaaaaaggccgtt

SEQ ID NO: 33582 - DNA, 1398 bp, Desulfitobacterium hafniense
atgaaggttctttttgctataactgaagctgagccttttgtcaagacaggaggcctgggagaagtaggacgatatctccctttagctcttcaggagcagggtgtggagattcgggtcattcttccccaatacagcagtattccccggaattatttgcagaagatgaagacgattaaagaattcacagttcctctggcctggagaaatcaatattgcggattaaaggaattaaagtatgagggcatccattattattttttggataatgaatattacttccggcgttcaagatgctatggggacggggatgaaggagagcagtacgcctatttcagccgggcggtcctggagagcgtccgttacctgcctgagtttaaaccggatattatccattgtcatgactggcatacggccttggtgcccctgtttttaaaagccttttatgcccaggataccctttattacaatataaagaccttattcaccatccataatctgaaatatcaggggatatttcctcgggaggtccgggaggatgttctggggttgagtggagagctttcttcttcagcccagcttgaattttatggcggagtcaattttatgaaggccgggatcatgcacagtgatcaggtcaccaccgtgagtcccacctatgcccgggaaattcagcatccctattttggggaaggcctccatggagtcattcaggggcggaaagattccttgctggggatacttaatggtgtcccccggccttggccttccccaactttggccgataaaagagcaaacaggatgaagctccaggagcagctgaattttacgaacaatgaagagatccccatcctcagtatgatttcacgcttggtagaacagaaggggctggacctgcttctgcatgtgctggatgagattctggccttggatatccggctggttgtcttaggcacgggagacgcccattatgaggagcgcctgcaaaggtttgcggaagggtatcccggcaagttacgagttatattaggctatcaggaagaactggcccacaggatctatgccggggcggatatctttctcatgccttcccggtttgagccttgcggtatagcccagatgatcgccatgagctatggcaccattcctatcgttcgggagacggggggtttaaaagatactgtcaggccctattccccaatctcgggggaagggaatggattcacctttactgattacaatgctcatgaactcctctatgccattcaaaaggcggtggagatgttccggaatcaaaaagatacttggcaaaagcttcaggaaaatgccctgagttcggatttcagctggaaccgatccgctgcccggtaccgggatgtctacgagagcttgtattattct

SEQ ID NO: 33583 - DNA, 1797 bp, Desulfitobacterium hafniense
cataattctcacgatcccttcttccgcagcccctttggggctgttccatgcggcggcctgctgcgcttaagactgcttatgcagccggaggattcttctggtgcgggcagtccggttcaggaatgctttttgcgcttatgggtgcaggaccgggaggagcggctgcccatgctcagggtggaagagccgatcctgtgggagataaatagggaaggaactgttacaggggaagaggctattacaggggaaggggtccttacgggagaaggagtcgtttatgaggtggaatatcctcttccccatgaaccgggaatcatctggtattactttattttcagggcagggggagaaacctgtttctatggcaataatcaggaagaactgggaggcgtgggtgagcttcgatcctccgagcctcccggttatcaaatcaccgtttaccggcccatggccttgccaggctggtacacccagggcatcatgtatcagatctatgtggatcgcttctttaacggggatgaacagggaaaagtcctcaatccccgcccccgctccctgatccatggggactggtctgatacccccttctatattaaaaatgaaaagggcgaagtcctacgctgggattttttcggcggcaaccttgccggtgtgatcaaaaagcttccttatcttaaggaattaggagtgagtatcctttatttgaaccccatcttcgattcctccagcaaccataagtatgacacgggggattatctcactcttgatcccatgtatggggacgaggagatctttgcccaattgatcaaggaagcccaaagcttaggaatcgcgattattctggatggggtgttcagtcataccggtgatgacagtatttattttaaccgttatgggagatatcctggtctgggcgcctatcaatccccggattccccctattactcctggtatcaatgtcatggggaaggacaggaaaaagaatattcctgctggtggggagtgtccactctccctgaagtttgggagatggagccctcttatcgcgagtttatcattcactctcctcaaggagttctccaatcctggatgaaacggggtattaaaggctggcgtctggacgtggctgacgagcttcccgatgaatttatccaggagttccgccaaatgatgaaaacaatggaccctgagggagtcctgatcggtgaagtctgggaggaccccacccataaattcagctatggcaagctcaggcagtatttctggggggaagaactggatgccaccatgaattatcctttgcggaatatctttctccagtacttccttgggcagatcgatgccggtcaggcccataaacgcatcatgaatctctatgaaaactacccccgggaaaactttttcgggcagatgaacttgatcggcagccatgaccgggcccggattctcaccctcctcggtgaagcgccgccgccggagcagctctccgccgtggaacaggagcagtatcgcttgcctgcccctgcccgggatctggctgtccagcggttgaaactgctgactttgctgcagatgagctttcccggtgttccctgtctgtactacggtgatgaagcgggctgtgaaggatatcccgatccctataaccgggggacctacccttggggaagggaagatcaggagatcctccaatggtttaaacgggtgcttcgttatcgccgggaatatgaggtgctgcggcaaggcgagttctcttcctggttcgagggaaaagagatctatgtcttgcaaaggaag

SEQ ID NO: 33584 - DNA, 1551 bp, Desulfitobacterium hafniense
tggaaacgtttcaaggagtatttatattatgatcaagagctggaattgcttttagatataagccggatgaattttagtgcagaatttttgacggaactggctgagccgatgagagatgcctatcaccagctccagctcctggaaaagggcgctttggctaacccggatgagggccggatggtaggccattattggctgcgtaacccggaccttgctcccactgaggaaatcgctcaggatattaaagagactctcaaagagatccttgattttgcggagcagattcatagtggcaggcttcagggagaaaagggaaacccttttcgcaacatcctcttagtgggagttggcggctccattctcggcccccgctttgtcgccgatgccctggcttcttcccgggataaaatgaaggccttctttatcgataatggagaccctgatggaatcgaccgggtattaagccggattggcgaggaattgccggccaccctttgccttattatctccaaaagcggtgggacgattgaaacccggaatggcatgctggaggtaagaagggcttatgaggaagcagggctgtcttttccggatcatgctgtggccatcactcaacggggaagccaactggataagctcagccaaaaagaagggtggctgagagcttttcccatgtgggattgggtagggggaaggacatctcttctttcggcagtgggactcttatccctggctttgcagggaattgatgtggcaggccttttacaaggggctaaagactgcgatgggcgaacacggcgcccggataccttagctaatccgggagcgcttttggctttaatgtggtattacagcacccaaggccaagggggaaagcaaatggtagtgcttccctataaggaccgtctggaacttttcactaaatatctgcaacagttgattatggaatctctgggcaaggagaagaatcttcagggagaaacggtccatcaggggataacagtctatggcaataaagggtcctctgatcagcattcttatcttcagcagctcctggaaggacccgacaatttctttgtgacctttatcgaggttttgaaagatcggcaaggctcctccgcttatatggaagaaaatagcaccagcggcgagtatttgcaggcctttcttttaggaacacgggaagcgttgacccaaaaagggcgtgaatctctgaccatcacagtcaaagaggtcaacgcctacaccattggggtattgattgccctattcgagcgggctgtgagcatttatgccttgttagtgggtattaacgcctatcatcagccggctgtggagatgggtaaaaaggcagccggtcaggctatacaattaaaaaacaacatcgtagagtgtttgaaaaaacatccggataaaagattctctgtccatgagatcgctctggccatcggggaagaggcgcaccaggagatggtgtttaagcttttgctccatttaaccactaaccctgagcatggggtgaacatggcagcagggcatcctctgccggag

SEQ ID NO: 33585 - DNA, 1065 bp, Desulfitobacterium hafniense
agcaatttacgggtgttagtcatttccgctgcctttggtgcaggccatatcaaggctgctgaggcggttattgaggcaatctgggctaaaaggcccaacactgagatctatcatgccgatttcggagcattcttgaataaagcctttcatttggtgattaaaaccgcctacatcgatatgatcaaatatactcccaagctttggggggaattctattacaggacatcggatatcccgtcggattccttgttccagcgtttcttaaatggtttggggcgccaggagtttatcagctatatccattctgtgcagccggatcttattgtctgcacttatccgaccatagccggcgttttggctcagttgaaagaaaaacggatcctaaccgttcccctggctgccgtggtaaccgattatgccattcacaaccaatgggttcatcaaggtgtagacttgtacctggtgggctcacaagaggttgcggatggattggctcaacggggcatcaatccggggtgccttaaggttactggaataccggtcagtcccaaatttgaaatcaaactggaccgggaagagctggccagaaaattcgggctcgatccgggtcagcccactatactggtcatgggaggagcgtatggggttctggataacgccacaggcatctgccggttgatcatgcaaaacaaacttcctgtccagctgctgatcgtttgtggcagggataaacgactgtacagtaccctggaaccgctggtccgaaaagcggaaaacagagtgctgctcttcgaatttgtggagaatgtagaagaattgatgacagtttccgatcttatgataaccaaagcagggggcctgaccgtgtcagaagcgttgaccaagcagctgcccatggtgatttacaagcctatccccggtcaggaaaaagcaaactcagagtttttaagaagggttggaacaggaaaaattgccgctaccgagggggagctcctgcaaattctgactcatcttctggaaaatccggaggaaatcaaactaatgagtcatgcggccgccaaactg

SEQ ID NO: 33586 - DNA, 867 bp, Desulfitobacterium hafniense
accctgaccgtaagcaccgatcatggcaccaacgctacggtgggattgagttttgaagttacgacggctcctacttataccatcatcgctgacccggtaaccaaggattttggttctctgacaatcggctacagtgccccggcagcgcagaccgtgaccatcacaaataccggaaactccagcgtgatgctgacccagccgaccagcaccaactataccatcggtgcactcagtaccaccacactggcggcaaacggcacagccacctttaccattacgccgaaaactggtcttgcaatagggaatcacgatgaaaccctgaccgtaagcaccgatcatggcaccaacgctacggtgggattgagttttgaagttacgacggctcctacttataccatcaccgctgacccggtaaccaaggattttggttctctgacaatcggctacagtgccccggcagcgcagaccgtgaccatcacaaataccggaaactccagcgtgatgctgacccagccgaccagcaccaattacaccatcggcacactcagtaccaccacactggcggcaaacggcacggctacctttaccgttgcaccgaaagctggacttgcagtgggtaattataatgaaacgctgaccgtaagcaccgatcatggcaccaacgctacggtggaattgagttttgaagtgacggcggttccctacaccgtcaccttcaacccgaacggcggcacggtcagtgaagcttcacgctcggttgcatctggtacggcggtaggggcactcccgacaccgacacgctccggcagttacagctttgacggctggtatacggcggcaagcggtggaactcaaatctccgcaagc

SEQ ID NO: 33587 - DNA, 534 bp, Desulfitobacterium hafniense
atgttaaagggagcgatagctcagcggtatgcccaagccttgtttgaacttgccgtccaggaaaatttggatggtatcgaggctgaacttcaggagctggtgcagtgtgttgaacagaatgctgaggtagcccacgtcctttaccatccgcacatttctctttccgagaagaaagatctgatgaacaagattttcgccggtgaattaagtgtcactgtgcgaaatttcctcaacctgctgatcgatcgcagaaggcaaaactatcttctggagattgcccgggtctttgcacgtctggctgacgaagcccgcaatattgtggaggctaaagttgccagtgcaattcccctgagtgagactcaagagcagcgtttgcatcaggagttggcccgcatgaccggaaagaatgtacggatggttaaggaagtacgtccggagttaatcggcggtgtcatgattcagatcggggaccgtgtgatggatggaaccgtggcctttaaattacagaggattcgccaaagcctcagccacgct

SEQ ID NO: 33588 - DNA, 1500 bp, Desulfitobacterium hafniense
atgaatttacgtccagaagaaataagttcaattatcaaacagcaaattgaacgttatgatagtgcagtggaggtagtggatgtaggtaccgtaatccaagttggggacggaattgcccgggttcatggtctggaaaaggctatgtccggcgagcttctggaattccccggcggcatttacgggatggccatgaaccttgaggaagataatattggctgcattatcctcggtaaatttactgagatcagagaaggagaccaggtcaagcggaccggtcgtattgtggaagttcctgtaggagaagccatgattggccgcgtcgtcaatgccctcggtcagcctattgacggaaaaggtgaaatcaaaaccgataaattccgtcccattgaaaacattgccccgggagtcgtctatcggaaatccgttcatgaaccactccaaacgggactcaaatccattgatgccattgttcccattggccgcggccagcgggagttgatcatcggtgaccggcaaaccggtaaaacagcggtggccgtggataccatcatcaatcaaaaaggcaaggatgttatctgtatctatgtcgctgtaggacaaaaagcttccacagtggccggggtggtaaaaaccctggcagatcatggcgcgatggattacagcatcgtggtttccgccacggcctccgagcctgctcccatgctttatatcgcaccctattcaggatgcgccatgggtgaagaattcatgtacaacggcaagcatgttctgatcatctatgatgatttgaccaaacaagcggccgcttaccgtgaactgtccctgcttttgaaacgtcctcccggccgtgaagcctatcctggagacgtcttctatctccattcccgtttgcttgaacgggctgccaaactctccccggatttgggcagcggttccatgaccgcccttcccattattgagactcaagcgggagacgtttcggcttacattcccaccaacgttatttccatcaccgacgggcagatcttcctggagactgaccttttcaacgccggcttccgtccggccattaacgtggggatttccgtatcccgggttggcggctccgcacagattaaggcgatgaaacaggtggccggacaattgcgcttggatttggctcagtatcgtgagctggcggcttttgcccagtttggctccgacttggataagatcacccaaatgcgcctcacccgcggagagcgcatgatggaaattctcaagcaaaaacaatatgaacctatggtcgtcgaagagcaggtcgttgttctctatgcagcggttaaaggcttcttggacgatatcccggtggataaaatcaagagctttgaagaagaatatctgcgcaccatgcgcaccactaaagctgatctcctcgcgaaaatccgcacggaaaaagcccttaacgatgagctgaatgctgagattgagaaggctatcactgaggttaaggaaggtttc

SEQ ID NO: 33589 - DNA, 843 bp, Desulfitobacterium hafniense
gtggcaagtgcacgtgatatacgacgcaggattcgtggcgtacggaatatgcagcagattaccaaagccatgaaaatggtggctgcatccaaattacgtaaagctcaggaaaaggtcatcgctgcccgcccttatgcccgccaattacaggaagttctggcacgtcttgctcaggatcaagcggatgtaacccatcctctccttatggagcgtcctgtgcagcgggtaggctatatcatcattacatcggatcgaggcctctgcggagggtataatacgaacctgattcggatgaccaatagtagtattgcagaagaaactcacgacgtaagactcgttgccgttggacgcaaagggcgagatttttaccgtcgtggcaaaattgagaccattgccgaattcgtagggctaggcgataacccatcctatggacaggctaaggaaattgctcaagaagtgatcggtctttatgaaagcggagaattggatgaagtctatctcctctataatgaattcgtcagtgcaatttcccaacgtcccacccggatcaagcttcttcccattgaaaagcctaagcaggtgtccaacacggagtatattttcgaaccttccgccgaggagattctaaccactctccttcctaaatatgtggagactcaggtattccgcaccttgctcgaaggcaaagccagtgagatgggagcaaagatgaccgcgatgggggctgcaacggacaacgctaaagaggctatcgagcggctgaccctgcagttgaatcgtgctcgccaagcggcgattaccacggaaatttccgaaattgtcgggggcgccagcgctctcgaa

SEQ ID NO: 33590 - DNA, 1389 bp, Desulfitobacterium hafniense
gtgaatatcggcaaaattgtgcaaatcatgggagcggtagttgacgtagagtttgcttccgaggcactgccagagatttatagtgctgttaaagtcacggttcccgagaagaagatcgatctcacccttgaggtcgctcagcacttgggcaacaatacagtacgctgtgtggccatgtcttctaccgacggcctgcagcggggcatggcagctctcaataccggagctcccattaccgttcctgtaggaccggcgactttagggcgtatttttaatgttctgggaaaggccattgataatggggaagaagtccacacggacacctcttatcccatccatagacctgctccagcctttgtggatcaagatccatcaacggtcatgctggaaacagggattaaggttatcgacttattagccccctactccaaagggggtaagatcggactcttcggtggtgcgggtgtaggtaaaaccgtattgatccaggagctgatcaataacatcgccatggagcacggcggtctctctgttttcgccggcgtcggcgagcggacccgtgaaggaaacgacctttggaacgagatgagagagtccggggttatcgacaaaatggccatggtttttggtcagatgaatgaaccccccggcgcccgtttgcgggtaggactgaccggattgaccatggcggaatacttccgtgatgtgcagaaccaggacgtgctgctctttatcgataacatcttccgctttacccaagcgggttctgaggtttccgccctcttgggccgtatgccctcagcggtaggttaccaacctaccctggccaccgaaatgggtgccctccaggagcggattacatccacccggaacggctccatcacttccgtacaggctatctacgtgcctgcggatgacttgactgaccctgctccggctaccgccttcgctcacttggatgccaccacggttcttaaccgtgccatctctgagaaagggatttatcccgctgttgaccccttggattccaactcgcggattctttccccgcagattcttggtgaagagcattataaggtggcccgcgatgtccagcagattctgcaaaagtataaagaactccaggatattatcgccattctcggtatggatgagctttcggaagatgagaaactcgtcgtctcccgggcccgccggattgagcgcttcctgtctcagcccttccatgtggctgaagtcttcacaggctcacctggtaaatatgttccgatcaaggaaaccatccgcggctttaaagaaatcgtggaaggtaagcacgataacctgccggaagcggctttccacatggtgggaacgattgaagaagctattgaaaaagccaaagcattg

SEQ ID NO: 33591 - DNA, 1242 bp, Desulfitobacterium hafniense
ttgagcaaaattattgttgctggcggtagttccttagaagggaaaatcaccgtaagcggagcaaaaaacgcagtactgcctttaattgctgccagcttgttgtctccggagccgatacgcattgacgatgccccgcatttactggatgtggacgtcatgtgtcaggttataggagcatttggtgcatcagtgaggcgagaaggatcgcaattgtatataaatacaccggaaatcaccagcctggaagcgccccatgatttagtatcccaaatgagagcatccatcgttaccatgggaccggtgctggccagaacggggagggtgcggatttcccaccccggaggatgtgccatcggttcacggccgatcaattggcatctcaaaggcctggaagctctgggggcggaaattcgcatggatcatggctatctggatgtgagtgcgacaaaattaaggggcgcccgtatttatttggattttcccagtgtgggtgcgacggaaaacattatgatggccgcagtcggcgccgaaggcaccacctttattgaaaatgctgcccaagagccggagatcatcgatttggcgaatttcctgaaccaaatgggcgggaaagtccggggggccggtaccagtgtgattcgtatcgaaggtgttcaggagttgcatggtgccaatcacaccgtcatcccggaccgcatcgaagcaggcagctatctgctcatggccgccgccgccggcggcgatatctttgttcaaaatgtgatcgccgaccatttgaaacccctcctggccaagatagaagaggcaggggtgtatttccgtgaggaagatgatggcatccgtgtggtaggtgaaggtgtctataatgctgttgatattaagacccaggttcatccggggttcccgacggatctgcaagcgcccttcctggccttcttaacccgggccaatgggacgggggtggtcacggagacggtgtttgagaaccgcttcatgcatgtggatgagctcaaacggatgggcgccgaaattaaaattgaaggccgcagtgccatcatccaaggaaattcaaatctaacggcagcccccgtcaccgctaccgacttgcgtgccggtgcagccctgatccttgccgccttaacggcagacggtgaaacagaaattcaaggggttcaccatatcgaccgcggctatgagtatgtggtggagaaattaaccgggattggtgcccagattcgcaga

SEQ ID NO: 33592 - DNA, 2187 bp, Desulfitobacterium hafniense
atgggaaagagtttagttttaacagaaaaaccctcagtgggtcgtgatattgccaaattattaggctgcaatcaaaaaggcaacggctgcttcatcggctcccgctatatcgtcacctgggccttggggcatctggtgacccttgccgacccggaagcttatggagagaagtataagcagtggcgtctggaagacctgcccatgctcccgaaagatatggaattggtggtcatcaaggaaacctccaagcaatacgccgccgtcaagcagctcctgcgccagcctgatgtggaggaactgattattgccaccgatgccggccgggagggggagctggtggcccgttggattatcgggaaggccggttggaaaaagcctatcaaacggctctggatttcttcccaaacggataaagccatccgcgaaggctttaataatctcaaaccgggcaaggcctacgaatctctctacgccgctgccgagtgccgtgctcaggcggactggtatgtgggcctgaatgtcacacgggccctgacctgtaaatacaatgctcagctctcggcaggaagagtgcagactcccaccctggctctggtagtggaacgggagaaggagattcaaaactttgtccctaagggttattggacgatcaatgcccgggtgcaagggttttcattgagctggcaggataagggcaatggccaaaacagaatgtttgatcagagaaaagcagaacagcttgtgcagaagctaagggggcataagggccaggttgccgagatcaagaaagaagcgaaaagggagcagcctccccaggcctatgatttaaccgaactgcaaagggatgccaaccgaaaatacggattctcggccaagcaaacttcatccatcatgcagcagctttatgaacagcataagctggtcacttaccccagaacggattcccgttacctttccgaggatatcgtccctactcttccggaacggctcaagaccattgccgtagggccttacagtgaactggcccgccgggttctgcgcaccaaaatcacccctacgaaacgattggtggataactcgaaagtcacggaccatcacgccattatccccacggaacaaacggtgttcctcaataaactcagtccggaagaggccaaaatctatgacctgattgtgcgccgctttatcgcggtcctgtccccggcctttgaatatgagcagaccacggttaaagtggagattcagggagaactgttcaccgccaaaggcaaaatcgtcaaacaaaaaggctggcgaagtgtctatgaaggcagggaggctgctgacgaggaggccgaccatgaggagcaggaacaaaatttgccggatctccagcccaagcagacccttgaagtccttgacctgaaacttttgccgggcaaaaccaagcctcccaagcgctacaccgaagccaccctcctttcggcgatggaacatcccggacagcgggtgaatgatgaggccctgcgggagactctggaaaaaaccagcggtttgggcactccggccacccgggccgatatcattgaaaagctctttagttctttctatatggagcgcaacggcaaggaaatcgttcctacttccaaagggattcaactgattggcttggttccttctgagctgaaatctccggagctcaccgccaagtgggagcagcagctcagtgaaatcagcaaagggcgggaagaccggcagcgtttcatccaggggatcaaaagctatgccacccagcttgtctcggaagtgtccgggagcggccggacctatcgccatgacaatatgacccgggccaagtgcccggagtgcggtaaatttctcctgcaggtcaagggcaaacgcggagaaatgctggtttgccaggatcgggagtgtggttatcgtcaggggctttccgtacaatccaatgcccggtgtccccaatgccataaaaaaatgaaactgcagggagagggagagcacaagatctttacctgtgcctgcggatatcgggagaaactgtccgcgtttaacaagcgccgggaacaagaaggaagcaaaggctcctacaataaaagggaagtcaatcactatttgcagaaacaggaaaaggacgctcctttaaatacagcgctggctgatgcccttgctaaattaaatctacccaag

SEQ ID NO: 33593 - DNA, 528 bp, Desulfitobacterium hafniense
cgttacggcatggtcatcgacttgcgaaaatgtgtgggctgcaacgcctgcactgtttcctgcaaaatcgagaacaatgtgccggatggaaaataccgtacttgggtcaaggaaatggaaaagggaacctatccgcaagtgtcccgtcatcgcttgccccgcttatgcaaccattgtgataatgccccctgtgagtcggcctgccctgtccgggccacttaccggacggaagacggcactattctgatcgattatgaccgctgtattggctgtaaatactgtatggcggcctgtccttatgatgcccgctttgttaacccggtgcgcagaacggcggagaaatgcaccttctgctatcacagagtacaaatgggactgctgccggcctgtgttaccacctgtgtaggaggagcccgaatttttggggatctgcatgatcccaacagtctcgtttcccgactgatagccaacaaccctgtgcagattctcaagccggagatgaatacccaaccgatgatctactacatt

SEQ ID NO: 33594 - DNA, 1374 bp, Desulfitobacterium hafniense
gaagaaatgattgagcttaaacaagtatcttttgcttatggaaacggtgagagagacagcgggcttgaggatattgagctgaaagttgaagagggcgaatttctcctgctgtgcggcggctccggctgcgggaaaaccactttaacacgtctgctcaacggtttaattcccaacttttatggaggggtccttaagggacaggtatgggtcgggggcctggatgttgctaaggcccctctctatgagacggcggggaaagtaggttcggtgtttcagaatccccgcagccagttttttaatatggacaccaccggtgaattggcctttggttgtgaaaatatgggtctgcccctaaaggagatttgcgcccgggtggagaggattgcccttgaattaggattagagcctttgctggatcgcaatatctttgccttatcaggaggagaaaagcagaaaattgcctgtggcgctgtggcggcgctggggcctcaggtttatgtcttagatgagccctcttccaatctggatgctttggctatcgaagaattacgagctcttttgaccaagctgaaggctcagggcaaaaccgtgatcattgctgaacatcggttgtactatctccgtgaattggtggatcgggtgatctatatgaagaaaggacggattcagcaggaatattcaggtcaggaattccgcgctttgccaaggggggaactggatgccatggggctgcgttctttatccttggagggtttactggagggcgccccggtacatttaccaaggactgagggggccattgccttgtccggcttttccttcgcctatccccggggaggccggagcctggacatcagggaaacatcgttcccccaaggggcggtggttgcagttaccggccacaacggagcgggaaaatccactctggcacggtgtctatgcggtctggaaaagaagtgccgcggcaggatggggatgcagggggagagtctgggaaggaaggaacgattaaagcgttcttatatggtcatgcaggatgtaaaccatcaattatttacagagagcgtgctggatgaggtgctgatttccatggggcatccggatgtgaagcagggggaggaaatccttaaaggcctcgatctgttgcagttcaaagagcgccatcccatgtccctatccggaggccaaaaacagagagttgccattgcttcggcgatagcctcccggcgggaattgatactttttgatgaacccaccagtggactggatctgctgcatatgcagggagtagcccggagtctgtctcaattagccgggatagggaaaagcgtcttggttgttactcatgatccggaatttatcctgtcctgctgc

SEQ ID NO: 33595 - DNA, 3254 bp, Desulfitobacterium hafniense
tcacaccgatcagcctatcagatcttagaaaatatccgtctgggagcgacagaaagactgatgtccgctcctttaggggaggtcctatcccaacgggcaggaaaaatgaagaacatcgttgtggaccgggtagaaaccattgaactgccgctggcccatatgattcctgagggcatttccaattttctctttcccttagctatttttatttatcttgtttttatcgattggcgaatggccttggcttccctgatctgtgtacctttgggagccatcgtctacgggataatgatgagaaacttcaacagtcaatatgccgcctatatggaggccagcaatcatgtcaacagcatcattgtggaatacgtggaggggattcaggtgatcaaggcttttaatcaatccacggaatcctatgagaagtttgccggagcagtctcctccttccgggaattcaccttagcctggtttcagagcacctggaagctgatgaatctgggcaatgcgattcttccttccactttgctgggagttctgcccgtgggagtgctcctttatatcgaggggagtctgactcctgctgaactgaccctctccatgatcctgtccttaagtatggtggctcccgtaacctggtttaccgttgccgtcaatgaatggaaggctgttcagtatgccgttaaggatgtcaatgagctcctggagctccccagtcttccggatacagcttgcccggtccagctggcctcttttgatgtagagcttaaagacgtttcttttgcctataaagagagcaaaggggatgtgctccggggcatcaatctccaaatccctgagggcagctatacggccttggtcggtccctccggcggggggaaatccaccattgcccggctgattgcccggttctgggatgtgggtaagggctctatcaccatcggcggcacggacatccggaaaattccccttgcccagctttcccagctggtcagtttcgtcactcaggataatttcctcttcaactgctctctgctggagaatatccgccttggccaacctacggccagcgacgaggaagtccatgcagccgcccgagctgcccagtgtgaagagttcatctcccgcctggaaaaaggctgggctactcccgccggtgaagccggcggcaagctttccggaggcgaacgccagagaattgccatcgcccgggccatcctaaaaaacgctcccatcgtcattctcgatgaggccacagccttcaccgatccggaaaatgaggataagctgcagcgttcccttgctgtgctgaccaaggggaaaacattgctggtgatagctcaccggctgtcgaccataaaaaacgccgaccaaatttttgttctgcaagagggaagagttgttgccggggggacccagcaggaacttctggaaaaatgcgccctttaccaggacatgtggcgggctcataccggagcaagggcttgggcggccaacagcggcaggaagggggaaatagcccatgcttaaaaccatgcgccggctgattgcctggaccgaaacccggaaaaatcgtctgtactgggggtttttttggtcttttctcgccaccttattcacggctatgcctgttatggcggctgcttatgtccttaacctgatgcttgaggatcaggccggccggtttgaactgactcctatctgggctctttacctgctgatttttatggtgtttatgattttaggacgattcttcttctcctatctaagggctgtttttcaggaaagtgtagcctatgaagtgaccgcggaggaacggatgagcatcggcaacctgctcaagagggtttctttaggtttctttgatcgcaataccaccggggagttggtgggggcagtgaccaccgatctatcctttgttgagatgttcgccatgaaaatgatcgactctgtgatcgggggatatgtcagtgccctggccatgatcctctgcgtagccttttacagctgggaggttgcagtgatttcagtcctgggcatcctattatcggccttggccctgggtctgatgggatttttcagccgccggaatgcgcctgttcatcaaaaggcacaaaatgagatcattgcggctaccctggaatatatacggggcattcctgtagttaaggcttacgggaaggagggagtctcggtggaaagcatacgccgggcctatgggaagcaccggcagatcaatgtcaagattgaacaggagtatgttccctgcaactgcctccatcttttggctctcaaatcggcatcggtggtcatcgtggcgatgtccgcttttcaggcggtccaaggaagtctgcccatccctgtctttctgatgttggcggtgttttcctttatgatttttaaccatgtggaacagatcaacaatgccacccacgttctgcaggtgattggcccaaccctggataaactggaaaagatcaaggaagcagagtttattgatgagaagggcgaggacaaggtattggacaactacaccatagagatggcggatgtggtctttgcctatgagcaacgcaggattctggacggagtctctctgactgttcctcaaaatacgacgacggctatcgtagggccttcaggcagcggcaagaccaccatctgcaatttgattgcccgcttctacgatgtggattccgggagtattcgtattggaggtacggatgtgcgggagctgacctgtgatagtctcctgagcaatatcagcatggttttccagaatgtttatctgttccaggacaccatagtcaataatataagattcgggaagccggatgccaccatggcagaggtgactgaagcggccaggcaagcccgttgccatgacttcatatcagctttgccggagggctataacaccatggtgggagaaggaggctcctccctttccggggggagaaaaacagcggatttccatagcccgggctatcctaaagaatgcccccattgtcattctggatgaggctaccgccagtgtggatccggaaaatgagcattttattcagggggctctcagtgccctgactcagggcaaaaccatcatcgtcatcgctcaccgtatgcccaccattgaacatgccgatcaaattcttgttctggatgaggggcgcatcattcaaaagggcacctataaggagctggtggcccaggaggggttgttccggcgctttatcaccattcgccggcaggctgaaagt

SEQ ID NO: 33596 - DNA, 771 bp, Desulfitobacterium hafniense
atgaaggttgttattcttgccggtggatatgggacccgcattagtgaggagtctcatctaaaacccaagcccatgattgagattggagaacgtcctatcttatggcatattatgaaactatattcccgctatcggtttaacgattttgttatctgcttaggttataaagggcatatgattaaagagtattttgctaactattttttacatggttcggatgttacgtttgatttggccaacaataccacctgcactcattccagtgccgaagtggaaccgtggaaggtcacactggctaataccggcctggatacccagaccggcggccggcttaaacggattaagaaatatattggcgaagagacatttctgtttacctatggtgatggagtcgctgatattaatatcgaggaactggttgctttccataaatcccacggcaagctggccacggtgacggctgttcagcccagcggccggtatggggtactggggctgaatgaggatgccagtgttctggagtttatcgaaaagcccaagaccttggatgcctggattaacggtggttttttcgtcttagagccggaagtctttgactatattgacggtgatgggactgcttttgaaggggaaccccttaccaaactggccgaagccgggcaaattatggcctaccatcatagtggcttttggcggtgtatggatacgcaaagagatagggttatcctggaaaatttatgggcgagcggtcaagcgccttggaaggtatgg

SEQ ID NO: 33597 - DNA, 640 bp, Desulfitobacterium hafniense
attacatctgacaaatgctatgaaaaccgggagtgggtctacggctatcgggaaaccgaccccctgggcggttatgacccctatagtgccagcaaaggttgtacggaactggtcgtctccgtctttcgcaatagtttttttgaacagcggagtaagtctggccatggtcggagcaggaaatgtcattggcggcggtgattgggcggaggatcgcctgttgcctgattttgttcgagcagttgtggaagatcagccgattcggatcagaaatccgcatgctacccgtccttggtagcatgtactggagccactgtccggttatctgctgctgggagcattactttcggctgagccggaaaagtacagcggtgcatggaatttcggcccaagagatactgatgtgttggcggtagaagagattttcaagctggcaatcgccgaatggggagcgggaaggatagaaaaagaaactgtcaggcagcttcatgaagcgactttgctgaagcttgatattagcaaggccgaggtatatcttaattggcatccggtcttttcctgccgtgaggcaatcgagaggacggttgcgtggtacaaaaggcactataaagagccatctggtaatatgttttcctttactgtg

SEQ ID NO: 33598 - DNA, 549 bp, Desulfitobacterium hafniense
attatgagtcaatacggattctattttgatatgacctcttgcatcggctgccgcacctgtcaggtgtcctgcaaggataaaaacgatctgaacgtgggaacgatcttccgtcaggtcaaagcctttgaaaccggttcctatccaaagccagggatttttcactattccggcacctgcaatcactgcgaaaaccccaaatgtgtcgagggctgtcccacccaagccctgcacaagctggaaaacggcattgtggatcatgataaagccaagtgcatcggctgccgctactgtacctggaactgtccttacggcgtcccccaattcatccccgaactgggacaaatcagcaaatgcaatatgtgcaaggatctcatcgaagcaggggaaaaccctgtctgcgtggatgcctgccccatgcgcgccttagaatggggagacttagaggagctcaaggccaaacacggggacagtgtccaggaactccccttcctgcctgctgcggcggtcaccaagcccgctctgctgattcaagccaaaaacaacgccaag

SEQ ID NO: 33599 - DNA, 657 bp, Desulfitobacterium hafniense
aacgagcatatagcgctgaataacatcagcctctccctggcccaaggtgaatttgtgaccctcatcggttccaacggtgccggaaaatccaccctctttaacgccatcggcggcactttctggctaaaccgcggccggatttttctggaagaggagaacatcacttacctggctgagcataaacgggccgccatgatcggacgtttgtttcaggatccactgaagggaaccgctcccgatatgaccatcgaggagaatctggccctggcttataaccgccaaggccggaatggtctgcgcctaggcgtgcaccctcaggatgtgaaaatcttccgtgagaaaatcgcccaattggatatgggccttgaaaaccgcctgcggaccaaggtaggactgctctccggcggccagcggcaggccctttccctgctcatgtccaccattgccggcccccgcctgctcctgctcgatgagcatactgcagccctggacccggcagctgccgaaaagatcatggcgattacccgggacatcgtcagtcaggagggcatcaccaccatgatgatcacccacaatatccagaccgctctgacaaccggctcgcgaaccatcatgctggaccagggcaagatcatcctggatctcgcaggtgaggag

SEQ ID NO: 33600 - DNA, 3597 bp, Desulfitobacterium hafniense
aattttagctaaccagagttgattacttgaactaactcaaaaaagagctgttcactgaaaggggagatatctgttatgtcatccgctgggaagcaaaaaaccggcacggcgcgtctgctcgaacttgccggtaccaaaaaaccgctgatcattggcgccggagtattgtcggccctggcatccattgtgagctttgtgccctatatcgctatctatctgattgtgaaggaagtcttaaccgctttgccggatctggaggtcctgaacagtgctctgatgattcgctatggctggctggcctttggcggagtggtgggaaatatcctgctttatttcggggccctgagctgctcccatctggcggccttcggcaccctgtacgaactgaaggtcaactttgccacccatctggccaaggttcccctgggttttcatgtgatgatcggcagcggcaagctgcggaaaatcaccgatgataatattgaaaaggtggaagggttcattgcccaccaactgcccgatctggtggccgcttttgtggcgccggtggtgatgatcgtgattctgctggcggtggactggcggctggggctggcggccctggcgggagttatcgtcgcttttttgatccagatgtccgtctatggcaatgaagggtccaaggccatgatgaaaaaatatcaggcctctctggaggatatgaacaacgcttcggtagagtatgtgcggggaatttcggtggtgaaggctttccggcagacggtctattccttccgccgtcttcatgacaccatcaaggcctatacctccatggtcatcccttacaccttaagctggcaaaactctttttcggcgtttgtcgccctggtcaacaatatctatctttttgtggtgccggtgggaattttcatcgggatgagaaccacggactatatcggctttttaagtaattttattttctatttgatttttgtccagtcggtggccacgattttgatgaagatcatgtatgtcaacggcaacgccatgaagatcatcggcggggtggaggccatggacagggtcttggcggaaccggagctccctcagccggctaatccccaaacggtgacccaatatgatgtgaactttggggatgtggtgttttcttacgacaaagacaagaaaaccgaggctctttccggggtgagctttgtggcgaagcaggggcagatcaccgcgattgtgggcccttccggcgggggtaaaagcaccatcgcccatttgattccccggttttttgatgtcagcgggggacagatcaccatcggcggtgtagatgtgcggcagatgaacagccattacctgatggagaaggtgacgtttgtctttcaggatgtgttcctttttaaacaaagtgtcatggacaatatccgcatgggcaacccccaggcttccgatcaggaggtcagggaagcggctcaagccgcccaatgccacgattttattatgaagctgccccaggggtatgacacggtgatcggcaccagaggagtgcatttgtcgggaggtgaaaagcagcggattgccatcgcccgggctatcgtgaaagatgctcctatagtggtactggatgaggctacggcttttgctgatccagaaaatgagcacctgattcaaaaggcttttgaaaggctgatgaaggataaaactgtgattatgatcgctcaccgcctgtctacggtgcagggtgcggataagatcgtggtagtggaggaaggcaaggtgtgcgaggaaggaacccatgaggaattgctggccaggggcggcaaatacgccgctatgtggaagacctatatggacaccgccagctggacgatgagtcaggaggaggttttcgctcatgcctaaattacaagccgcctttatgctgaccgataaaggctacaaggatctgaaaaaggccattgccgcctgcaccctgagcaatttttctatgatgctttctttatcgtcatgatccagatgattatagaattgatcaaacctctttccgggggagaggtagcctggacgaaaatgtggatgcttttgggggccgggattctggcggccttgctcatcttcctcagcctgagaaacgattataaaaagacctatatcgtgtcttatctggaaagcgagaatacccgggttactctggcggagcagatccgcaagctgcccatgagctttttcaatgacaaagatatttccgaagtcaccacccatctgatggatgatgtggccaccagcgaacatgtcctcagccatgtggtgccccagattgcagcgaatgccatctcggtcaccgtgatttgtgtgatgatggccttctatgattggcggatggctttggccatctttatcacggtgcccctggccttcgctattatttttatcagccgcagattctatggcaagcttcacaaaaagcacctggaggccaagatggcggcggccggacaggtgcaggaatatattgaaggaatcaaggtcattcgcgcctgcaatctggacggagagaagttcagcgccttggaaaaagccctgcggaccatgaaaaaactggccatagctatggagttcggtaccggggtgttcgtgaccggggctcaggtggttctgcaggcgggtatcggtcttaccgtcctggtgggaacaaccctgctcaccgggggccagattgaatttgtgcctatgctgctgtatatgctggttgtggtgcgcatctatggtcccatcgtaaccgaactggctcttttgccggagtttctgtatcatcgcatcgccgtaaagcgcatgcagaagctgatgagcatccagcccatggaagggaacaaggagctggagcttaaggactttaccattaattttgaaaaggtggatttccaatataaccgggaaggggaaggggccatccacaatatgaccacaaccattcccgctgggggaataacggccctggtagggccttccggcagcggcaaaagcacggtttccaagctgattgcccgcttctgggatgtgagcgggggccggatcacagtggggggagtggatgtcaggaccttggacccggagcatctgatgagctatatgagctttgtctttcaggatgtggtcctgttcaacgatacggtgtacaacaatattcgcatcggcaacatgaaggcctcccgggaagaggttctggccgccgcccaagctgcccgctgcgacgagtttatcagccggatgcccgaggggtatgatacccttttgggtgagaacggttccactttatccggcggcgaacgccagcgcctctccattgccagggctttgctgaaggatgctcccatcgtcatgctggacgaagccaccgcttctctggatccggagagcgaggccgccatccagcaggccatttcccgtctgatccggggcaaaacggtgattgtcatcgctcaccgtctgcgcaccatccgcaacgccgacaagattattgtcctggaccaggggagagtggctgaagagggaactcatgagagcctccttgagaaaaacggtctgtataaaaagctctttaacatccag

SEQ ID NO: 33601 - DNA, 2187 bp, Desulfitobacterium hafniense
accgctccgggctgtcacaactcctgtggcatactctattacctcaaagacggcaaagtagccaaagtggagggcgaccacacccatccgtttaaccggggaaaaacctgtatgcgctgtctgaatctgccggaaatcatgtatcatcccgagcgcctgaaatacccgatgaaaagagttggcgaacggggcgaaaataaatgggaacgtatctcctgggatgaagcctacgccctcgtaaaggaaaaatcaagccaatataccaaggaatttggcgcggagagcattgcgaccatcaacggtaccggtcgtaatatctgtatccagtcctctgctttgaattatggagggttccactccccaaatatttccctggctttcctcagcggctcctgctgctatattccccggatgctggctgctgccaaagcctgcggcgccagaacaattatcgataccgctgcccagcatccggtcggctacgagcaccccgagtttgaagtgccggaagtcatcgtcaactgggccaagaacggcctggcctgcaatgccgacggtacgctgggtcactggatcgttgacctgatgaaacagggcaccaagctgatcgtgattgatcccagtctgacctggctggcttcccgtgccgacgtctggctgagaatccgccccggcaccgataccgcgctggctctgggtatggccaatatcattatccaggaaggattatatgataaagagttctgcgacttgtggtcctatggttttgaggaatttgccgcgcgctgtgccgaatacccggtggaaaaagtagccgacatctgctggtgtcccaaagaaaaaatcatcgaagcggcccgcctgtatggcaaagccaaaccggccagcatcgaatggggactgccgctcgaccagtgtaagaacggaatggcggccagccatgcggttcatcacctgagagccttaactggtaatctggacgtgcccggcggcgacctattaattcgccacaccaatgctctggattcccaaatgaattcccttatcgagtatgttcctaaagaagatctggaaaacaaacgcctgggtgccaatgtttcgccctttaccgtcggccatcagggcgcaaccgcccagcctgacgccatcttaagggccatcgaaaccggcgacccctatgcaataaaaatgatcgtcctattcggaaccaaccccatatcaaacatggcggctgaagctcccagagtcagagaagcgctgaagaaagtcgacttcgttatgagcttggattactacatgacgcctaccaatatcgcctgcgccgatctcgttctgccgattgccatgagcgctgaacgcaatgccgccagtcataactttgtcccgctcaagatcgaaagcaaattcactcaatactatgacgccaaaagcgacgaccaaatcactgccgagctgggtcatgtgctcgatcccgaaggcggattcaaaaacatcaaaaccgacatcgactttgtcaacgcttacctgagacagtgggcagagcccagcgagggtgatctgaccttcgacgatgtcgttaatggtcccaacctgggttacgtgtatgacgattggaacgccacctactataaatacaaaaaaggcctgttaagagccgatggccagcccggattcaatacgccaaccggcagatatgaattctatgtgacagcttacgccgcctggggcaaattcgacccgctgcctgctcacgaggaaccgccggaaagcccttacagcacgccgcagttattcgaacagtatccactgatcttcactgcaggccaccgctcctatgaattcttccattccgaaggacgcaatcagccgaccatgagagagttccacccctggccgctgtgcgagcttcatcccgataccgccgcaaaatacggcctggccgaaggtgactgggtatggatggaaaaccagcgcggcaaatgcaaacaaaagctgaaactaaatccttccctcgatctgcggcagtgccgggccgagcatgggtggtggtatccggaaagagcaggcgcagaaccttctctgtatggaacctttgacagcaaccccaataatttgatcccccaatatcaatttggtccgaccgcttacggtgccccctataagacccagctttgcaaggtttacaaa

SEQ ID NO: 33602 - DNA, 2196 bp, Desulfitobacterium hafniense
gaatataccgtaacccgaacctgccaatggtctggtccaggctgccaccagggatgctcagtactgttttataccaaagataataaactgatcaaagtcgaaggcgaccccaacagcaatatcaacaacggcagactttgcatgcgctgttttgccgtaccggaggcaacctatcatccgacccggattatccatccgcaaaaacgcgtcggcgaaagaggagaaaataagtgggaacaaattacctgggatgaagcttacgacatcattgagagcaaggtcagaaagatctgggaagaatatacgcccaaatctattgtgacttgcttcggtaccggacgcaatgcaacctggcagtccccggttttgagcctggtaggatataagagccccaatatcggcggcggattcctaagcggtgactcctgctatgcaccccgtttaatggctatgcacaccttcttgggcggttcttttatcgccgaccttggccagctttttgaacaacaatatgatcatccggaatgggaaccgccgaaatatattgttctctggggctgtaacccgatcatgagcaattccgacggcttctttggccactgggtcgtcgacgccatgaagctgggaagcaagctgattacggttgacccccgtctgacctggctcgccgccaagtcggaggtttggctgcaaatccgtcccggcaccgactgcgccgtggcgatgggtatactgaattatatgatcaatgaaggtgtctatgatcgtgagtttgtggacaaatggtgctatggttttgaagagcttaaggaagcggtcaaagatatgaccccggccagagcagccgagattgcctggacttccgaggaaaagattatagatattgcgaaaaagctgggcaccaccaaaccctgggccatgcagtggggcgtgcccattgaccaggccaagcacggcgtcgctacctcccaggctatcgtttccatcatggcgctcagcggcaacatcgacattccgggaagcagcgtcctggtggacaccggctatatccaatccgatgtcagagccgctatgatgcacaacgtcagtcctgatatttccaaagaccgcttcggcgatgaattccccatccgtaaatatggttttatcaatcagcatatgaccgactccatgctggccgctatcgaaaccgggaaaccttacccggtcagaatgctgcatatcatgagcacgaataccttcgccaatatgggcgccgaagcgaaaagagtttatgacgccatgaaatccgttgatttcattgtggtggccgacttgttcatgacgccgactgccgtagcctgtgccgacatttttctccccgtggccatgagtccggaacgttggggcctgcgcggctggtggaatcctctgcgcacaattaccaaagttattgacggcggggatgtcaaatccgatgaggaaatcgcgctggacctcgtgaaacgcctcaacccggaggatgcaccctgggctgatgtcccggagcttctcaattatgttctgacggatttgcagagcgctacctataaaggaacttttgatgaactgaaaaaactgggcccttccggctattataccgaagttcactatcgcaaatatgaaaacggtttactgcgtcccgatggacagcccggtttcaatacgcccaccggaagaatcgaactcaaagcgaccatgtttgaagattttgatcttcccgctgtaacgtattgggcggagcctaccgagagcccggtttccacgcctgaactgatgaaagactatccgtttgttctcaccaccggacaaagatgttatgaattcttccactccgaacatcgtcagctggagtccatgcgggaattccatcccgatccgatcacggaaatcaacccggaagacgctgcggctttaggcatcaaagacggagattgggtgtatctggaaaacaaacatggcaaggccaaactaaaggcgagactccatcccggcatgctcaagggcgtggtgaacgctgagcacggctggtggttcccggaaagagaagcagcggaacccagcctttacggcgtgtttgagtccaatgcaaattgtttgaccacacagtttgattatggtccgacttcttacggtgcgccctataaaaaccagatttgtaaagtctataaggcttaa

SEQ ID NO: 33603 - DNA, 1302 bp, Desulfitobacterium hafniense
agtgctccaacctattttgacgatatgaagctcacttcttctcataagagaatgttatggttggcagcaatatgttacatgtttgaccagatggacgtaggtacctttgcttatgcagcaccggtattggttaaaacctggggacttacgatggaacaaattgctcaagtaaattcctacggttttgtgggaatgtttttgggagctatttttggcggctggattgcggacaagataggacgaaagaaaacgatcatcttatgcgttgccatattttcactcggatccctgggaaacgctctggcattcaattttcatacattagcgatcacccgtttttttaccggcctgggtgttatcggtatgttggtcgtggcgatggtttatatagcggaaatgatgccaagcgagcataggggaagatatcaagccctaaccatggcctgtggaacgatcgccatccctgtgggtgcggcatttgcccggtgggttgttccgctgagtactgaaagctggcgttatattttcgtcctgggcggcaccagtattttattattgccgttttgtttcattgtttttaaagagtccccgcgttggctggtgtccaaaggacggataacggaagcagaaaaagttattcgcgaaattaccgggcgagaggttgatttaagttcggaagtcccggagaaaattaaaaaaagcagcagtctatccaccttaaaactaatactcagtaaggaatatcttaagcggaccattatacttgttattatcacggatggagtagtattgggggcccagatgttaggcggtttttatcctgctatcctgcaggaatatgctgggtttcagttaacattggtgttgtcgatcatggccttatcctggtggggaataccttttggcgatctgtccgcttctttggtttccgataagggcggtcgcaaggggcctttggctttattttcaattattaatgggatgacctttgtcgtatgcggcttttttccaacaccggcagtcattatcgcagcggtatttttaagcagggtctttggcggcggctcggtgtctatcctttatacttatctggctgaatcctatcctacccacatcagaagcaccgccgtagggttaattatgggacaagtccgcatcctgtccgccgtcattgtgcttatcgtcccgccgatcttggcgacatatggctggttgggggttcacttggtcaatgcaggaataataatcgtcacagcaatcgtcgctttgatatttggacagaaaacaagcaaaagaaccttg

SEQ ID NO: 33604 - DNA, 2187 bp, Desulfitobacterium hafniense
aggtgaaggcgtatgagtgaaagaaaagtcgttccgaccaactgccgcttctgcggctatcaatgcggactcctggctacggtggagaatggcaaagtccgcaaagtgcagccggattcttcccgctatccccataatgccgggatcatgcggggctgcaagcgttggccgttgattagcgaagtgatggagcatccccaaagaatcaactatcctcttaagcgggtcggggaaagaggcagcggccgctgggaaagaatatcctgggaacaggccctggacgaaatagccgctaagctggccggtctcaaggaagagtttggcccggaggtcctggccaccagtatcggcggaccccacaccaccttctggcctttgcaccggtttttggctctttttggcagtcccaacaatatgggcatcggtcaaatctgctggaaccccggcatctgggccaataccctgacctatggctggcctgtggatatggagctggacccggaggggacggaatgcgctatcctctggggggttaacccctctcagtcggataactctttgttctggcataccgttcaggaatttaaacgccggggcaaacccttaattgtggtggatccccgtttaaccgggacggcacaggaagctcagctgtggctgccggtgcgtccggggacggatgcggtactggctttagggcttttgcatgtgattgttcaagagaaactctatgctgaagagtttgtgcagaattggtgtcatggttttgagcggttatgtgaccatctcattccttatactcccgcttatgtggaagaggttacgggtgtgaaagcagaggatgttgtcaaagctgcccgcctctatggaaaaagtaccccggcttgcctgtacagcggcagagggatcgatcaactgggcttaaacagttttcccacccatcgtgccctggccatcttaagagccatcaccggcaatctggatgtgcccggggcttcccacttgagtgagatgcctgattttattccggagttggagctggaactcagcgaaccctatgccgcaacatctcctcggtcggtatcccaggagaagctcctgttgcaatcctatcaaggctatgccaaagttcgcgagcagaccatgaagcacaagaagcgcctgcccatgcgctatttaacctctgcccatccccatcgcgtctggaaggccatgctgacaggagagccttatcccatccgctccatgatcgtgatggcttccaacccactcctgactcaagccgacactcagctggtctacagagccttaaagagtctggaccttttggtggtattggagctgtttgaaacccccacctccatgctggcggattatgtgctgcccagcgccggggtgctggagcggccccttttggagactaaggccggggtggccaatattgcttatggaggggatcaggccgtcgggccttattatgaacgccgcccggactatgatttctggagagagttaggactgagactggggcaggaaaaggcatggccttggcagacttaccgtgaagccctggaatacagtttatcccccctgggcactacctgggatgatttttccggcagcggactttattatcaggacaatgagtatctgaaatatgaggagcccgatgggcagggaaaaccccaaggatttgccacggtaagcgggaaggtggagatctacagcgaactgctccgggaaatgggagcggatcccctgcccagtccccgggcacttccccaaggaaatgcagacttttccctgatgctcatgagcggtgcccggttccagccttactacgcttccagctatcatcagctggaaaagttgcggcggctgcatccggagccgattgcggaaatgagtccggtgacgggagagaaactgggcatcgaggaaggctccctggtggatgtggagacagagagagggaaagcccgtttcaggacccggtttgttcccatgtgcgatcatgtggtgagcgtggagtatggctggtggtatccggagatgaaggcgtcggaaccggaactgggggggatttggctggccaatgccaatctgctcaccagtggggattttgacgcttcggatcccttagtagggacctggacctataacgggattccctgcagggttgccaag

SEQ ID NO: 33605 - DNA, 543 bp, Desulfitobacterium hafniense
atggcacgttatgcaatggttattgatacacggaaatgtacgggctgtcagtcctgcacagtggcttgccgggtcaataatgaactgcccatcgatatgatttataatccggtcatgacccatgggcccctgggaaaatttcctcatgtgaggatggtccatattccttctttatgtatgcattgtggcaattctccctgtgtggatgcctgccccaccggggcatcccagcagcgtgaagacggcatcgtctgggtggaagaaaacaaatgcgtgggttgtaaagcctgtgtcatggcctgcccttatggggcccgtgtgtccaatggggcaaagggaaccgtccagaaatgcaacttctgtaaggatgaccgggttgatcaaggcaaagtgccctggtgtgtgcaaacctgtcaccaaaaagcccggatttttggcgatattgaggatcaggacagcgaagtattcaaactggtcaataaaaccaagaccacagggcgcttgttggaagaactggggactgaaccctttgtctattatctt

SEQ ID NO: 33606 - DNA, 2187 bp, Desulfitobacterium hafniense
gtcaaaaaagcctgctgctatttctgtcaccagaactgcggctgcttggtttatgtcaaagacggcaagatccttcatttcgaaggagacacggagtacccaaccaattccggcggtttatgctgtcgcggcaatgtcaatctcatccatctggaccatgaagcaagggttaatttcccgttgaaacgcaagggggagcgtggttcgggggaatgggaaagaattacctgggaacaagctatcgatgaaatcggcaccaaattagcagagattcgccaacattatggagcagaggctgtagccacagccggcggaacttcccgtaccgatgactgggcacggcggcgctttatgaatcttttcggcagccctaacggtttccacaacgcccatttatgctggattcccacctttatgatcgaaacagccgtttatggctggagtccttttgaaattgacctgggcagcagccgatgtctggtcttgtggggacagaatccggcaatatccactttgcctgaaatgagcggcgtcagcggccttaaagcgaacgggctgaaagtcatcgttattgatccacgctatacggaaacagccgccaaagcggatctctggatacccgtacgccctggatcagacctggctttagccttggcttggatcaatgtcatcatctatgaaggcttagctgattatgattttgtctatgaatactgtcagggttttgatgaattgactgctcatgtggaagaattcactcctgaatgggctgaacctttgaccggagtcagcgccgatcttattcgtgaaggggcacggatgtacgccatgaacaaacccggcaatatccagtggggtacggctcttgaccaaatcggcaaacctgccggcgctacccagcatgcccgggccatcttaagagccattaccggcaacctggactgccccggagcggatcttctcaccggccccagtctggaatttgtgactgacgaagaaatggaactcaatgagttcttaacggaagagcagcgggccaagcaactgggctcggataaattcaaactggtaacctggcccggatacggccgcatcgccgaaatagccaagaagtattggggcaaggcgcctaccgcagaatggatgtgtgaggcccatcctcccacagtctttaacgctatcctgaccggagaaccctatccggtgaaagctttgctggtttcggcgacgaatccggtcaattcctatggtgaaagccaaaaggtcctggccgccttaaaagcggtggattttatggtaacctgcgactattggctgacccccaccgccatgctttccgattatgtgctgcccatggcgggctcctttgagcggccgacgattacctccacctatggctgttcggatttcttaatgtgttcacaacgggccattcagcccatgtatgagcggcacagcgattttgaattctggcgggatctgggcatccgcctggggcaaaaagagcattggccttgggaaactcttgaagatgcttatttttaccggattaaagatctgggctatggtgtggaaagttatgatgaattcgtggagtattaccgtttccacttcccggaacgggagtatttcaaatacaaagaaaaaggcggatttggcaccccttcgggtaaagtggagatctactccagtgtgttggaggaattaggctatccccccctgccaccctatatagctcccgttgaaaatgaggtggattatccggaacttgctaaagagtatcctttaatcctaaccacaggggcaggtgtaatgccttttcatcattcggaacacttcaatattaaggaactgcgctttatccgccatgaaccccatatggaaatcaatcctgatactgcggcagagtatggcattcaggaaggggattgggtctgggtggagacccggcggggccgcattaaacaaaaagccagcttaaccgaaggcatcaggcccggcacagtcttcacggaacggggctggtggtatccggaaagagatctgcgcaatccggaattgggtggttgtctggaatccaacaccaacgttcttaccagtacggcagatgaagattgtgatccattgagcggcagctgggccaaccgcggtctcttgtgcaaggtctataaggtaagcagctcagac

SEQ ID NO: 33607 - DNA, 648 bp, magnetite-containing magnetic coccus
gtcgctctgatcactggtggcgcacgtcggatcggcaaagcgatcgtgcatcacctgcatgcacatggttatcgcgtcgccgtccacgcacaccagtctggccacgaactgcatgcatttttaactgagctagaacgcaggcgtccatccagcacactcgcattgctcggagacctgcacgaaaacgcagtcccagaaacgctgatcgcacgctgtgctgggcatttcggacggctggacgtgctcatcaacaacgcctccaatttctatccaaccccactgggcgaagtgacaccagcacaatgggatgatttatttgcaatcaatgccaaggcccctttcttcctcgcgcaagcagccacaccactgctgcgcaaacatcgcggggcaatcatcaacctgacagatctacatggcacgcagccactgcgccaacatgctgtctataccgcagccaaagccgctctggagatgttgactcgatcactcgcactggaactggcaccgcaagttcgagtcaatgccatcgcacccggggcgatcctatggccaacgcaaggcatagcggaagcagcgaagcaggcgctgctggcacgcaccccattagcacgtaccggcacagtggaagagatcgccgaagcagtgcta

SEQ ID NO: 33608 - DNA, 603 bp, magnetite-containing magnetic coccus
atgatacagtatctgaacgtctttttttacgacatctacccctacatctgcgcgacggtcttttttctcggcagctggctgcgctatgactacggccagtacacctggcgcgcctcctccagccagatgctggataaacgcgggatggtgatctggtcgaatctgttccatatcggcatactcggcattttctttggccatctgttcggcatgttaacgccgcactggatgtatgcctggtttttacccattgcggtcaagcagcagatggcgatggtgctcggcggcgtctgcggcgtcctgacgctgattggcggcgccggtttgctctggcgtcgtttgaccaaccagcgcgttcgcgccacctcgaccgcgccggatatcatcatcatgagcattctgctgattcagtgcctgctcgggctgagcaccatccctttctcggcgcagtatccggacggcagtgaaatgatgaagctggtgggctgggcgcagggcatcgtcaccttccgcggcggctcgtcagaaatgctcagcggcgtggcctttgttttccgcgtgcatctggtgctggggatgacgattttcctgctgttcccgttc

SEQ ID NO: 33609 - DNA, 913 bp, magnetite-containing magnetic coccus
aagatatgataatgttgcgtgaatgatcttacccccaagcttcgttggcgcactgcttaagtatgactcggtaatgggtgtattgaatgctgaagtaagcgccacagagaagggtgtttctgtggatggcaaagagatcactgtctttgaagagcgtgatcctgccaaactgccttggggcgagttaggtgttgattatgtggtagaatccacaggtttgttccgtaagcgtgagactgcgggtgcgcatcttaagggtggtgccaagcgggttattatttcggcccctgctggtggggatattcctacctttgtgatgggtgttaacgagaacgactacaaccctgcgacggatgacattgtttccaacgcttcgtgcacgaccaactgtttggcccctatggcgaaggttattgatgacaagtttggtattgagcgtggtttgatgaccacggtgcatgcatacaccaacgaccaagctttgttggatcagcctcacagtgatttgcgtcgtgctcgtgcggcggcgctttcgatgattcccaccaagaccggtgcggcggcggccattggtttggttatgcccaacatgaagggtcgttttgatggtttggcggtacgtgtgcctacccctaacgtatctttggtggatgcggtgatggaggttcgtgctgagaccacggctgaggaggttaatgcggctttgaaggcggcgaccacccgtttcttgggttattttgatgcgcctttggtctccattgacatgcagggtgatcctcgttcttccattgttgatggtggttgcacccgggtgaatggtaagcagatcaaggtgatgagctggtatgacaatgagtggggttattccaaccgtgtgttggatttgattctgcacatggcctctaaggcataa

SEQ ID NO: 33610 - DNA, 1041 bp, magnetite-containing magnetic coccus
cgcaccctgcgggttgccatcttgggcgcaactggttacaccggtggtgaacttatccggttattgcatcgacaccctggcgctgagttgagctttgtgagctccgaacggtttgcgggtcaatccattgccaaggtctatacccatcttcaagcggtgggacatttgatctgccaacccatggatgctaaaaaggcttgcgaggcggcggactttatcttctgtgccttgccccatgtcacctccatggaggtggtgccagagctgttacagcggggggctaaggtggtggatctatccgccgacttccggcttaaaagcgccgagacctatgcccattggtatggtacacaacatttggccccggaactgctgccacaggcggcttatgggttgcccgaactgtttcgtgaatccatcaaaggggccaacttggtggcgaaccctggctgttatccaacctcggtgcagctgccgctctttccgctcttacaagagggcatgattgatccagcactggtcattgcggatagtaagtcgggtgtgagtggggcggggcgttctcctgcgcagggcacgctgtttgctgagttgtcagaaggatttaaagcctataaagtagaggcacaccggcatatcccagagatggagcaaaatttggctttggcagcggggaaagagattaaaatacgttttaccccccaccttttgcctcaaagccgtggtatactttcgacctgctatctacgcccaacaagtggggtgaatgcacaacgggtgcgggatactttaatgacacgctaccgggatgagccttttgtgacggtgttaccccatggggatatgccggccacctccgatgtgcgcggcagtaatgcttgccatatgggcgtgacagaagatctacgtagtggatggttgatcatcgtttcagttatcgataatctggttaagggtgcttctggggctgcggtacagaactttaacctgatgaccggatgggatgaaacaacggcgcttgacagtttgccgatgtttccg

SEQ ID NO: 33611 - DNA, 1287 bp, magnetite-containing magnetic coccus
tttgcttcgttgaatcttgttaaacccctccttaatgccttaactcaagctggttacaccaccccaacccccattcaagcacaggctattccgcatctgttggcaggtcgggatctgctgggcattgcccagaccgggacaggtaaaaccgcagcttttgcactacccatactcaataagttgagccaaattaaaggtcgccccgcgcccaatgcgccccgcgccttgatccttaccccaacccgtgagctcgcttcacaaatcggcaacagcatcgccgtttatggtaagcatgtgccaaccacccacaccgttgtatttggtggcgtgggcaaacagccacagattcgcgccctctcccgtggcgttgatattttggtcgctacccctggccgcttactggatcttatgggggagcgccatgttcgcctggatcagattcaggtttttgtactggatgaggccgaccgcatgctggacatgggctttatccatgatatccgtcgcatcattaaggtgatcccagctaagcgccatacgctgctcttttctgccaccatgcccaaggatattgcagagctggcagagggcttattgaccaatcccgccaaggttgaggtcacgccagaatccacgacggttgagcgtattacgcaaaaggtgctgtttgtcgataaacagaacaagcgttctttgctcaaaaatgtgcttgagcatgagtctattgagcaggttttggtctttacccgcaccaagcatggggccaaccgggtggcggagtatcttgacaaacaccgcattgcctctgcggcgattcatggcaacaaatcccaaagcgcccgcgaaaaggcactggatggctttcgcaaaggcaagttaaaggttttggtagcgacagatattgcggcgcggggaattgatgtggcgggcattagccacgtgatcaattttgacctgcccaatgagtcggaaagctacgtgcaccgcataggccgcacagcgcgcgctgggcgggatggcaatgccatctctttttgcgatgctgaagagcgcggctatctgctggatattgaaaagaccatccgccagaccgtgccggttgatattgaccatgaattccattgcgaagtggttgccaacgcagccccaatcaaacccagccgcaaacgcagcagcggccatggtgccggtggtggcaatccccatggtgggggacatcgtcgcggcaaccccagtaccgccagcaaaccacgtcagcatagcggacgtcgcaccccatccagcaag

SEQ ID NO: 33612 - DNA, 1260 bp, magnetite-containing magnetic coccus
tccttggtggtgttggggctgctgtttgcactgtttctcacgccggtccatgcggccccccaggtgactcgggtggtgctgcccaaccagttccacggggtattggtagagagccatagcaatcccatggtagaggtgtgtctgtatatacgggccgggtcggtcatggatccgcaggggcaagagggcaccgcctatatgttgggttggttgataaatgaaggggcagggcaacaggatagtacccagtttcagcaagccatggacaactatggaataaccctcaatggcacagccagccgggattatctaaaagtgaccatgcgggctttaagtaaggatatggtctacgcctttgagttgttgggtgcggccattaatcagccccgtttggatcaagaacccattgagcgggccaaacgagagatggtggccagttttgagcagaaccgcgaagatgccgatgtacgggtggaggaacggctagaggcgctgttgctggggcaacacccttatgggcgacgggtggagggggatccagagagcattaccaagatctcgcgggagggtttgcggcgttttcatgcccaggcgatgcgtggccccaacatggttttgagtgtggcgggagatatgcgacctgagcagtttatggcgctggtgcatcaacattttggggggctttcagccgatcctggcccctttggtgcgaccattcccaccgttgcctcccccgtacctcaaccctggcaggttgagcatgtggaaatggataaagctcagagtgtcattgcggtgggatggccagggcccaaccgtcaacatccggactattacgccattacggtgttggatcatattttggggggatcagggtttggcagtcgtttgacggagcgcttgcgcgaagagcagggtttgacctactcggtctactcctatttttcaccgtgggaagggcaggggatttggcaggttgctatggcgaccaagccggaaaatgtgccccatgcggtgtcagagatccgtaccattctcagtcaactggccaaggatggggtgcaagaagatgcgttaaaacgggcgaaggaaaatctattgggtgggtttcccatcgcactggacacccttggcaagttggcatcaacgtggggtttgatcggctattataaacggggctgggactatcttgatcagtggcctaagcgtattgagcgggttacgcaagaagatattcagcgggtggcgcgcagctttttt

SEQ ID NO: 33613 - DNA, 735 bp, magnetite-containing magnetic coccus
atgaaagatcgcgtcgcgatggtgtctggtggtgccggtggcattggtaccgagattgtgcgcagcttgcatgcccagggttacaaggtggcctccacctgtacggtgatggagtgcgcccgcgtacaacagtggaaaaaagagcgtgagcttgagcatgtggaagtggtgatggtagaagtggatgtacgcaattatgaatcctgcctcaaaggggttgaagaggttgagagccgccttggacccatcgacgtattggtcaacaatgcgggcatcaccaaagatggggtgatgaaaaagatgagtcccgagcagtggcagagcgtgattgatgtcaacctgaccggtacctggaacatgaccaaagcggtgttggatggtatgttggagcgccagtatgggcggattatcaacatctcatcggtcaatggtcaaaaggggcagtttgggcaggttaactatgcggcggccaaggctggcatgcatggcattaccatgtcattggcccaagaggtggctcgtaaggggatcaccgtgaacaccgtctcccctggctatattggcaccgatatggtgatggccattgatgaggagattcgtaacaaaatcattgccaccatcccggtaggccgtttgggtaagcccgaagagattgcccgccttgtgacatttttggcggcagaagagtcgggctttatgaccggggccgatttttccatcaatgggggcatgtac

SEQ ID NO: 33614 - DNA, 1038 bp, magnetite-containing magnetic coccus
  unsure (1)..(1038): unsure at all n locations
gggctaaagccttgtcacgttcaggtcgtgcatcttgggggatgcctggtcatcttcttataagagcacagcccagctatgaccacttaacaaggtgtgtggttcgggtctacaggcggttgctcttgggcgcggctcncaaggctggagtgcaatgttgtggtgatgcccaactaatattggccggtgggcaagagaatatgagtgcctccacccacgtgttaccctcactcccgccatggtcagagcatgggggattggaaagcggtggataccatgatcaaggatggtttgtgggacgcctttaacgattatcatatgggcaacaccgccgaaaatatcgccgaacagtatgggtttagccgtgaagcgcaggacgcctttgccgccgcttcgcagcaaaagaccgaagcagcacaaaaggataaccgctttgccgaagagattatccccatctcgatcccacagcgcaaaaaagagcccatcatttttgataccgatgagttcccccggcatggcaccacagccgaatcgttggctggcttgcgccccgcctttaaaaaggatggtacggttacagcgggcaatgcgtcaggcatcaatgatggtgcggcggcggtgttggtgatgtccgccagcaaggccaaagcgttgggcctgagccccatggctaaagtggtggcctatgccagcgcgggggttgaccccaaagtgatgggcacgggacccatacccgctgtgagcaagtgtctggagaaggcgggttggaaggtgagtgatctggatttgattgaggcgaacgaagcgtttgccgctcaggccatgtcggttaataaggatctaggttttgacctgagcaaggtcaatgtcaatggtggggccattgcccttggccaccccattggtgcttctggggcgcgggtgctggtgacactgctgcatgaaatgaagcgtagaggtgcccaaaaaggtttggcaaccctttgtattggtggtggtatgggtgttgccttggcggttgaaagcctttaatgcggt

SEQ ID NO: 33615 - DNA, 1908 bp, magnetite-containing magnetic coccus
  unsure (1)..(1908): unsure at all n locations
gaagtccgcgagtttcaaaccgaagtgagtcagttgctggatctaatgatccacgccctgtacagcaataaagagatctttctacgggaattgatctccaatgcctccgatgccaacgataagctgcgtttcgccgggctctctgatgatagcctgtttgaaggagatagcgagctaaccatcaaattggaatttgataaagaggctggcaccttctccatcatggataatggtatcggtatgagccgtgatgaggtgatctccaacattggtaccatcgccaaatcgggtaccaaggagttttttaaatcactcaccggtgatcagcagcgtgatgcccacctgattggtcaatttggggtcggtttttactccagctttattgtggcagacaaagtaactttggagacccgtaaagctggggctggcgctgagcaaggggtgcgttggatctcggcgggtgatggcagctacaccttggaaaatatggaaaaagccgagcgtggtacccgtattaccctgcatatgcgcgaggatgaaaaagagtttctggatgcgtggcgtctgcgctcgattgtgcgtaaattttctgaccatgtgacgtggccggtgaaaatgctcgaagagctgccacccgccccacctgcaaaagagggcgaagagcccgagccccctaaaaccccagagtgggagacggtcaataaagccagtgcgctgtggacgctctcgaaaaatgacatcacggaagatgagtataaagagttctacaaacatgtgggtcacgattttgaagaccccatggagtgggtacatgcgcgtatggaagggcgtatggagtataccctgttgctctacatcccgggtcgtgctccctttgatctgtgggatcgggatcgtcgcggtgggctgaagctgtttgtgcggcgtgtcttcatcatggataccagtgaagagctgctgccccgctacctgcgctttgtgcggggtgtgattgattccgccgatctacccctgaatgtctcgcgcgaaatattgcagcagaaccgtcaggtcgaggcgattaaaaagggcttggtccataaagttttgggtatgctcgaagagatgctcaaaaatgatcctgaaaaatatgccaccttctggaaagagtttggcatggtgctcaaagagggcatgatcgaagattttgccaacaaagagcgcatcgccaaactgtgccgctttagcaccacccatgacggtgagcgggtgccaaaaatcgccctagcggactatgtggagcgcatgaaagaggggcaggaggcgatctattatgtaannccggnncgaggagctttgnnaagcctgctcnaattctagcccccacttgnngagatcttcccgtaaaaaaggcattgaggtgctgctgctttcagaccgggttgatgagtggaccgttactcatttgaccgagtttgacggcaagcctttacaggccatcaccaagggtgagttggatctctccaaattcgcaggtggtgaagaagaagccaaagatgaagaggctgaaaaagcgcaggaagaggcgcttaagccgatcaccgagcggatggctaaagtactggaaggtcaggttaaagaggtgcgattaagtcaccgtttgactgaatcccccgcctgtctggtgggggatgcgcacgatatgagcgccaccctggagcgcttgtcaaggagccgtcagaggtgcccanccgnnctanaaggcgtattttggagatcaccccagccatgccctgctcaagcgttaccgatgaggctgacgatagatgaagtgttggcgatgttgatcccatgtgttgcacgagtcaagcgctgttcgcggtagggggggcatactgaatagatcccagtcagtttgtcatactgtct

SEQ ID NO: 33616 - DNA, 435 bp, magnetite-containing magnetic coccus
acagatcccatctccttgcaggaaatcatgtcgtttctgccccatcgctacccttttttgctgattgaccgtattgtcgaagtggagcagggtaagcgaattttggccattaaaaatgtgtccttcaatgaaccccattttcagggccattttccagaccatccggtcatgcctggtgtgttgattctggaagccatggctcaggccggtgcgctgttagcgggctatactgatcccgactctgtgcgcggtcaattggtctattttatggccatcgacaaagcccgtttccgcaaacccgttttaccgggtcatcaactgaatattgagatgaccctgctcaaacggcgccgcgaggtttggcgctttggggggaaagcgatggttgacggagaggtcgcttgtgaggccgaggtgatggcaatgacgcgaaag

SEQ ID NO: 33617 - DNA, 1395 bp, magnetite-containing magnetic coccus
atgcgtacccgttttgccccttcacccactggatttttgcatgtgggtggtgcccgtaccgctctgttttgccatctgcaagcccgccatgtgggcggtaccaccgtgctacgcattgaggataccgatcgtgagcgctccaatcaggcgctggtggatgccattctggatggactgcactggctggggttggatcctgatgagggccctctgttccagtctgaccatacccaacgccataccgatatggcgcttaagttgttggaagagggtaaggcgtacaaatgctactgcaccaagcaggagttggatgatatgcgcgcggcccagcaggcccgtaaagaaaaaccacgctacgatggccgctgccgccaccgtagcgagcccccctcggatcaaccctatgtgatccgttttaaaaccccgttggagggtgaagtggtgtggccggatatggtgcagggtaccatccacatcgccaataaagagctggatgacctaattttgctgcgctcggatggctcccccacctataacctagcggtggtggtggatgatcatgatatggagattacccatgtgattcggggcgaggatcacaccagtaatacccctcgccagatccatctgttccaggccctagggtgggatgtgcccagctatgctcatatccccctgctgcatggcgaggatggctctaagctgtctaaacggcatggtgcggtgtcggtcttgcagtttcgcgaagagggatttttggccagtgctctgaataactatctggtgcgcatgggctggtcccatggtgaaaaagaagagttcaccatggatgaaatggtggcgctgtttgatgtcaacaatgtgggacgcagtgcggcgatttttaatacctccaagctgttgtggcttaacggtgtgcatattcgccagtcagggcctgaacagttgcggggcgagttgatgtggcacctgcaacgcctaggggtggacaaccccaaccctaattttattgatcaaattatccccggtatgcaggagcgggtgaaaaccatgttagagatggcgcaaatggccatgttctactttaaagcgcccaccgagtatgccgaaacagccgtggccaaacatttgcacgccgatatcttgcccgcttatgccgctttgctggaaaaattgcacaccgttacagcagatgagtgggataacggtgggttggagcgcgcctttaaagtggttatggcggaaacaggggcgaaaatgggtaacatcgggcagccggtgcgcatcgccataactgggagtgatatagcgccgcgtatctctgatatactgcaactggtggggcggcatgagagctagcggcggattgaggtgctgttaagcttcatacaagca

SEQ ID NO: 33618 - DNA, 828 bp, magnetite-containing magnetic coccus
atggcactgaagaattttaaacctacttccgacggaaaacgccatcaggtagcaattaactacagtgagctgagcaatgagggccctgagcgctcgttgttagcccctctgaagcgtaccggcggtcgtaataataatggacgcatgactgttcgccatcaaggtggtggtcataagcgtcgctaccgtatcatcgactttaagcgtaataagtttgatgtgccggctaaggttgctcgtattgagtatgaccctaaccgcaccgcctttattgcgttgctgcactatgcggatggcgagaagagctacattcttgcgccgcagcgtttgcaagtgggcgatactgttgtatcggccaaaaccttggacaatgtggatgttaagcccggtaactgcatgcctttgcgggtgatgcctatcggtaccatcatccacaacgtcgagcttaagcccggtaagggtgggcaggtcgcccgtagtgccggtaactatattcagctgatgggtaaagagggcaaatatgcccaacttaaaatgccctctggtgaaatgcgtttggtgtagttagagtgcatggccacggttggtatggtctctaaccctgacaactcgaacaccaaaattggtaaagcaggacgtacccgctggatgggcaagcgtccctctgttcgcggtgtagtgatgaaccctgttgaccacccccatggtggtggtgaaggtcgtacctctggtggtcgtcatcctgtgacgccctgaggtgtaccgaccaagggtaagaagacgcggtctaagaccaaagcttctgaccgtctcatcatgcgtcgtcgt

SEQ ID NO: 33619 - DNA, 1182 bp, magnetite-containing magnetic coccus
ctgaaacagagcgagcaggcgctgttgcaagccaaagagttggcggagagtgccaaccgagccaaaagcgattttttggccaccatgagccatgacatccgcacccccatgaacgcggtattgggtatggtcgagctgttgggtgaatcttccctggacccagagcagagccattatctgaaaattattcgccgcgcgggttctaccctactctcactcatcaatgacattttagatctttccaaaatcgaagcggggcagcttaaattggagttggacgacttcaccttggcagaaacggtggagcatgtgatggacattctgcgtcataaggccagtgaaaaggggttgcaactccaaacccatctgcacatccccccgcaacaaagggtgcggggggatgcccaacgcttacgtcagattttacttaatttactaggtaatgccgttaaatttacccagcagggcagtgtctccctaaccttacagcaacaacctgatggccaatactctttccaagtagccgacacggggccagggatcgccccccaccggcagaagatcatttttgaaccctttgtccaagaagagagtggcacccatcgccattttggcggcagtggcttgggtttaagcatctgccataaactggtgacggccatgcggggcacactttggctaaagagccaattgggtcatggcagcattttttacttcacccttcccctcgctacggctatggagccagcccccgacgaagtttcaccgcagagcgttttacacgcacctgtgagccttacgcaactggtaaacaagcgtttactggtggtggatgatgccgaggataaccgtaatttaattcaagcttttttaaagagttgtcaaatgcagatccagatggccgaagatggtgagcaagccgtacgtctgtgccaagagcaacgctttgacctgattttgatggatatacagatgcctatcatgaatgggctcgaagcaacccgcttgatccgccagcatgagcaaatgcagcataaatcccgcacccccattattgccctcagtgcccatgccatgcttgatgttaacaatgatgccttggcggctggttgcgacctgcatttatctaaacccattgccaaaaaacggctactggaagcgctctgtcatcaactgtgtccc

SEQ ID NO: 33620 - DNA, 722 bp, magnetite-containing magnetic coccus
ccctttttatccgtgaatgggatttttttgatggaaaaactgcccgatctggctaccttgaaatataatgaacaaggtcttatccccgccattgcccagcagtatgacacgggcgaagtgttgatgatggcttggatgaaccaaacctctttggcagaaaccctaagtaccggcgtggcctgttattggtcccgcagccgcaatcggttttggcgcaaaggggagagttctggtcaagtacaaaccgttaaggccgtgcgtctggattgcgataaagataccctgctgctgttggtggaccaacaaggcgtggcctgccacacgggccgccacaactgtttctatttagaggcccaggatggtagctggaaaaccatcaccgacctgagattgaccctgaggagctgtacggaaaatgaacaatctaagccccccgatctacggtggatattctggagcaggtctatcaggtgattcagcaacgcaaatctgcgccagatcctgaagcctcctatgtggccaagctgttccacaaaggggatgatgccatccttaaaaaagtgggcgaagaggccaccgaattggtactggccatcaaagggcgcgccgcccgcaacgaagtcgcccacgaagccgccgacctgatttttcacaccttggtggggctggccattatgaacatccccccgacagaggtgatgaatgtcctttccagccgcttt

SEQ ID NO: 33621 - DNA, 780 bp, magnetite-containing magnetic coccus
atgatggccaaacgcattatcccctgcctggatgtcaaagcaggtcgtgtggtcaaaggggtgcagtttgaaggactggtcgatgcaggcgaccccgtagaggccgccaaacgctacgacgaagagggcgccgacgaactcacctttttagacattaccgccacccatgaagatcgcggcattatggaagatgtggtgcgccgcaccgccgaacaggtcttcattcccctcaccgtgggcggaggcatccgcaccaatgatgatattcgccgcatgctggtggccggtgcagataagtgctccattaactccgcagcggtcaagcgccctgagtttgtgcgagaagccgccgaacagtttggttcgcaatgtgtggtggtggccattgacgccaaatgcgtcgaacatgacaaacatggccgccctattcgctgggaaattttcacccatggtggccgccagcccaccggcattgatgccctggagtgggcacaccgcatggagagctttggcagtggcgagattttgcttacctccatggataaagatggcaccaaaagcggctacgccctggagatgacccgcgccatctctgatgccgtcaccattcccgtgattgcctctggcggtgtgggcgaacccaaacatttgctggaagggcttcgccaagggggcgccgatgcggttttggccgcatccatttttcatttccgcgaatataccattccccaagttaaacgctatctgcgtgataaccatatcgcggtacgactctaaaga

SEQ ID NO: 33622 - DNA, 1620 bp, magnetite-containing magnetic coccus
acccaactgccccaatggcaagccctgcaaacccacttagaagagaaccgttcggtgcagatgcgggatctgtttgatcaagattcacagcgttttagccgtttttcgctgcaacagggggagctgctgtttgactactccaaaaaccgtatcactgcggagaccatggcacggttgctggatctggcccgggcacaggatgtggaggggtggcgcgaccgtatgtttgccggtgaggccattaatgaaaccgaggggcgggcggtgctgcatgtggccctacgcaaccgctcagggcgtcctatccgggtggctggcgaagatgtgatgcctgctatcaaccaagttttgcagcagatgcgccagtttagcgaggctgtgcgcagtggcgcatggaagggccagagcggacaagccattaccgatgtggtcaatattggcattggcgggtcagatttagggccggtgatggtgtgtgaggcgctcaagccttatcatcagccgggtttgtcggtgcattttgtctctaatgtggacggcacccatatggccgagaccctaaaagggctaaatgctgaaaccacgctgtttattgtggcctccaagacctttaccacgcaagagaccctaaccaatgcccatacggcgcgggattggctggtggctcaattgggtgaggcggcggtacgtaaacattttgtggccctctcaaccaatgccgaggcggtctcggcctttggtattgataccgacaacatgtttgccttttggaactgggtagggggacgctatagcttgtggtcagccattgggctgcccattgccattgcggtgggatttgagggctttatggcgctgcacgatggcgcctatgccatggatgaacactttcgcaccgccccactggcgagcaacatgccggtgattaaggcgctgattgggatttggaaccataattttctgggggcagaatcgtttgccgtgctgccctatgatcaatatttgcaccggttggcggcctatcttcaacaggcggatatggaatctaatggtaaatatgttacccgcgatggtgcgcgggttgactacaccacgggtcctgttttgtttggggagccaggtaccaatgggcagcactccttttaccaattgatccaccaaagcacccgtttggtgccggcggattttatcgcggcggcgcacacgcataatccggttggggatcatcatgccaagctgctctccaacttttttgcgcagaccgaggcactgatgaccggtaaaaccgccgctcaggtgcgccaagagttagaggcggccggtctgcatggtgcagcattggaggcccttgtgccccataaggtctttgatggcaatcgccccaccaactctatcttggtgcggcagtttaccccatacactttggggcagttgatcgctctgtatgaacacaccatccatgtgcagggtatggtgtgggggattaatccctacgatcaatggggggtcgagttgggcaagcagttggcgaaaaaaattctccccgaacttaccactccaggtgaggttcattcccacgatggctctaccaatggcttaatcaaccattataaagcgtgg

SEQ ID NO: 33623 - DNA, 1359 bp, magnetite-containing magnetic coccus
aaaaaatggttttttattgccatgttggttggcgcgttaatgatctgggtgatgcctctgcccgagggtctgacggaacaggggcgcatcgttttgacgatgaccgtggtggcaaccacgctgtttgtcaccgaaccggtgccgttgcctacggtggcattgctcattgtggtggggcaggtgctgctgttgaagcacaactcttctgacgtggcccgcaccctgatgagcgattcggtgctctttatcatgggctcgttaatgctggccgtggcggtggtaaaacagaagctggataaacgtatcgccctgtttatcatacgctttacaggcacaaaaacctcgcgaatcgcctttggtatctcggttatgtcgggtttgttggcctcgtttgtgggcgagcacacggtggcggcgatgatgctgccggtggggattgccctgatcacgttgacctcggacgacccagccaaggtgcgcaacttggccgctgtgttgctcttctccatcgcctacggctgttccgtggcgggtgtgggtacgccgtcgggtggggcgcgaaacgcgattatgatcggctattggagtgatttctatggcatcgttatcgactatgttaaatggatgctctatgcctaccccatgtttttgttgcaactaccctttgtcaccatgatcctgctctttaccttccgtccagagtttgacgatctcacccctgcggtggaaaagttgaaagctcaggtcgaagccgaggggcctttaaaacagcgccactttgtctcgattgcgctcttttttcttatcctttacggttgggtggggctctctgaaggggtgggtatgggcaccatcgccgtactgggtgcctcggcctttttggtggggggcttggttaagtgggaagatctaaataatggtgtaaactggggcgtggtactgctctatgcagcggccatctccttgggtgtgcagatgaaagatagtggcgccgcggagtgggtcgcgaccagctttttggagatgttaacccccttcggggcggacaaaggcatggggctgtggttggcggtgtcggccctgaccaccggcgtgaccaataccatgtccaatggtgcggcggtggcggtgctggggcctattgtgctgaatatggcagcggctgcccaagagagccccgtggtgattggctttattaccgccatctcgtcggcctttgcctatttgacggtggtgggtacccccgcttgtaccatcgtctatgcgtcaggctacctgaaaacatccgattttcttaatgttggttggcgaatggcggttatgtccacactcttgatgctgctgtttgcctcgctctat

SEQ ID NO: 33624 - DNA, 932 bp, magnetite-containing magnetic coccus
atggcccaagctgagacagccattcttttggtgcaacttggcacccccgatcaaccgactgaagaggccgtgcgccgctatctgcgtcaatttttaagtgaccgccgcgtggtggacatgaatcgtctgctctggtggcctttattgcacggtattattttgcgctcacgccccagtaaaagcgccaagctttacaaaaaaatctggcgggatgataaaacctcccccctactccactacactcgcgcattgcaacaggagatggcccgccgctttcagggacgccacagcagcggcgtgcgtgtggattttgccatgcgctatggtaatccaggttgcgttgtaaagtcggctcactggtgcgcgaaggggtacgcagactgttaatcgtgccactctttccccaatatgccggtgccacggtcgcctcggtgatggatgaggtgatgcgccccatgcacatccaccgccttatgcccaccctgcgggtgatgaccccctattatgctcaggatgcctatattgacgccttggttgccagcctagagggtgttgacctgagtgagccggatcatcgcctattgctctcttaccatggcctacccaaacgccatgtggatgagggcgacccctatgaaaaccactgtcagaccaccaccctgctgcttacagaagagttggatctgcgccacgatcagtggatgatgagctatcaatcccgctttggtagcgagccttggttggaacccaacaccgatatgctctttaaaactttacccagtcagggtattaaaaagctgacagtgatgtgcccaggatttgccgccgactgtttagagaccttggaagagatctctgaaacaggccgacaaacctttctcaaggcagggggcagccattttaactatattccttgcctcaatgacgagccc

SEQ ID NO: 33625 - DNA, 1860 bp, magnetite-containing magnetic coccus
gttgttctactggatattgcagaacctgggcagtcggccaaaccccacgaggcacgccccgaggatatgcggcgggtggtggggattgatttggggaccacctattcgctggtggcggcaatagatcaggagaataagccgggttgtattcccctgcccgagggtgggtttgccattccatcggtggtgcattatggggccgatggtggtgtgttggtgggccatgccgcgcgggagctggcggtgagccatccccacgcgacggtgatttcagccaagcgttttatggggcgtggtttagaggatgtgcagggcgagggcaagcgcaccccttaccggttggaagcgggtgaagggggcatggtgcgtatggatacgggggtgggtaaggtatcaccggttgaggtctccgcagaaattttaagttatttaaaagcccaggctgagcaggctctggggggtgcgttgtatggtgcggtgattaccgtgcccgcctattttgatgatgcccagcgccaggcaaccaaggatgcggggcgcttggcggggttggaggtgatgcgcttggttaatgagcccaccgctgcggccttagcctatgggttagaggcgggcaaagagggcatgtatgcggtatatgatctggggggtggtacctttgatatctccattttaaagttgagcaagggggtgtttcaggtgatgtccaccggaggtgattcggcgttgggtggggatgattttgatcacgctttgggggatctgtttttgcgggagatgggggttgagcagcccagtgccgagcagcagcagcaggtgatgcgcagtgcgcggctggccaaggaggcgcttaccgatgctgagcaggttgaggtggtgatcggtgactatgggcgcacactgagcaaggctgagtttgagggggcgattgatgcgctggttaagcgtacgggtctgccctgtcggcgggctttaaaggatgccggggtgaagccgggggcgttgcagggggtcgtattggtggggggttcgacccgggtgcccaaggtgcgtgcctatgtggcggagctgtttcagcgggagcctttgagtgatctggatcccgataaggtggtggcgttgggggcggctttgcaggcggatctgttggcgggcaaccgacgcggtgaagatttgctgttgttggatgtgacgccgctgtcgctgggggtggagaccatgggggggttgatggagaagattattccccgcaacagccccacgcccacggcgcgcgcccaggagtttaccacgtttaaggacaatcagacggcgatggtgattcaggttgtgcagggtgagcgggagatggcggcagagaaccgcagcttggcccgttttgagttgcggggtattccacccatggtggcgggggcggcgcgtattcgggtgacctatcaggtggatgcggatgggctgctgacggtatcggcggaggagatgaccactggggttaagcagacggtggaggtcaagccggcttatggtttgtcggatgctgagattgagggcatgctacgggacgcgctgagccatggtgaggcggatatggaggcgcgtcggttgagtgaggcgcgggttgaggttgatcgggtcttgaatgcgctggatgcggcgttggctaaggatgtggatctgcttagcgaggcggaggtgcagggcattaaggcggcggtggagcagttggtgggcgttgcggcgggcactgatgcgacggccatcaatcagggcattgaggcattggacaaggcgaccaccttttttgcccagcggcgcatggatcgtggggtgcgtcaggtgatgacggggcagagtctggat

SEQ ID NO: 33626 - DNA, 2103 bp, magnetite-containing magnetic coccus
cagaagcccgattccgggctgctctgtgtgatgctgcttgcgcgttttcaccagattcccagctcacgggatgggctgcgccatgaacatggtcagccaggggagagctttggacatttggaggtactcaaggcgctcaaggcgttggggctgaaggccaaggcggtaaaaagcgccaagaagcgtctaaataaactaccgctgcccgccatcattccttccgctaaggaggggggctttcaaattctggctaaggccgaagggggcaaggttctgctgcacgatcccaccgaggccaagccggaggtgatggatacagaagtgtttttggaacagtgggatggctcggtcattctagccgccacacggggtaaagatcccaccggtggtaagtttgatatcacctggtttattcccgccgttatccgctaccgtaagctcttctccgaggtgctctacgcctccttttttctgcaagttttcgccctgatctcgccgctcttcttccaggtcatcatcgacaaagtgttggtgcaccgcggcctcaccaccctggatgtgctggctctaggcatgctggtggtggcgctgtttgagatgtttctggggggcctgcgtacctacctactcagtcacaccaccaatcgtatcgatgtggagttgggggctaagctctatcgccacctgatgaatctgcccatgtccttctttggctccagacgggtgggggactcggtggcgcgggtgcgagagctggagaacattcgtaattttatcaccggctcagctatgacggtggccatcgatattcccttcacctttgtctttgtggcggtcatgttttggtatagccccaccctgacctacgtggtggtgggggcgatccctttctatattttgctgtcggtctttgtctcccccatccttaggaaacgggtggaggaaaaattcgcccgtggtgctgaaaaccaatcctttttggtggagtcggtcaccggcgtacagacggttaaagcttccgcacttgagccgcagatggggcgccgctgggatgaacagctggcggcctatgttcacacctccttccgtgtcaccaatctgggcaactgggccagtcagattgcagggttgattaataaaatcaccaccctgttgattctctggtttggggcacatctggttattgacggctcgttgaccgtgggtcagctggtagccatcaacatgctctccggccgggtcagtgggccgatcctgcggctggtgcagctgtggcaggactatcaacaggccggggtctccattcgccggctgggggatatcctcaacaccccctccgaagcaacctccgaccccagccgtgcggcactgcccaatctaaaagggcgggtgaccctggagcgcatcaacttccgctatgacccagagtcccccgaagtgattcgggaactctccttggatatccgccccggggaggtgatcggcatcgttgggccgtcgggttccggtaaaagcacggtgaccaagctggtacagcgcctctacaccccagagcggggccgggttttggtagatggggtggatttagggcaggtggatcccgcttggctgcgtcgtcaggtgggggttgtgctgcaggagaactttctgtttaagcgctcggtgcgggagaacatcgccattggcgatcccggtattcccatggagcgggttattgcggcggccaagctggccggggcggaggagtttatctccgagcttaagcagggctatgagacggaactggatgaacatggtggcaacctctccggtggtcagcggcagcgcatcgccatcgcacgggcgttggtcagtgatccacgcattttgatctttgatgaggccaccagcgccctggattacgagtcggagaagatcattcaggagaacatgcgctccatctgtcaggggcgtaccgtgattatcattgcccaccgtctgagtgcggtgcggggttgtaaccgcatcatggtgatggataaaggggtcatcatggaagagggcggttatgcagagctgctacagaaaaaagggtggtttgcacgtatgcactaccatcagtcg

SEQ ID NO: 33627 - DNA, 1935 bp, magnetite-containing magnetic coccus
ttggcggtgcccgttaccctgcaaggtgagcgggtggggcttttttatcttagagtcgaccttaaacactattggtccatgttgtggcaagatctctatctgacgctgctgtttctgttgttggcggtatcggcggcttacgtgatcgcccaacggatgcaccgttttatcaccacccccattcaagccttggcggcggtggcacaacaggtaagcagagagcaagactatgcggctcgtgcgccacaaattcacacccgtgacgaactgcaactgctggtggaaggctttaatggcatgctggacgaaatcggtcggcaggatgatgccctgcgccagcatcgggattcgttagaggcgcaggttgctctgcgcaccaccgaactgacggtgcttaacggtgagttggccacggccagagatcaggctttggagtcggttcggttaaagtcagagtttttagcaaccatgagtcatgagattagcacccccatgaatggggtggtgggcatgctggagttgctggatgagaaaaccctctcaccccaacagcaggagtatgtggagatcgccaaacactctgctgaggcgttgctggcgattattaatgatattctggatttttcaaaagtcgaagctgggcatttggtgctggagtcaatcccttttcaacccttaatggagatggaagaggtggtggccctgctggctccgcgtgctcaggataaaggggttgcgttggttacagaggcccaatggcaggttttgcctggacaggtggtgggggatccgctgcgttttcggcaggtgttgaccaatctgatcggtaatgccatcaaatttacccagcagggtgaggtggtggtggcgttgggttggcaagcggggcaaggtacggcgggggtgctgcacttttcggttaaggataccggagtgggtattgatgccgacacccaaaaaaaattattccaggtctttacccaagcagacggctccaccacccggcgctttggtggcagcggcttagggttggccatttcacgccagcttatcgagttacagggtgggcagattggtgttgagagcgacctggggcaaggggcgcatttcttttttagcgtgcccatgctggccgcggcggcgccgattttagagccctatatggagagtgggctggccgatccaaacagaccggtgtggctgttagagcgtcatgaggccgccgcaaccgccttgcaagccttgttgcacgccttgggtctctcttcgcagcgcttagacgggttatccgctatcctgactttgggcaaggagccgccacccctggtgttgattaaccttaacgattctgcccgtcctgacgtgctctcttggttgttggcgcatccgcaggtatgtagccgctatgaaatagcgcttatggggtgggcgacctctttacaggaggcgcgccatcaccttggtgagagtgtgcattatctacccaaaccggtacgcttgggggagataactcggctgctgcaacaacgcataagggccgttcccgacgcgccggcacagccgctaccgttgcgaggtcagcttttggtggtggaggataacccggttaaccaaaaggtggcgctggctatgctcagtggtatgggggtttcggtacagatcgtcagttctggggccgaagccttgcaatggttacagaagcaagcctttgatttggtgcttatggatctgcatatgcccacgatgaatggtattgaaacctgccgacagttgcgtcaatgggagcagcaacaggggcggcaatcggtggcggtggtggctttgaccgccagccaagatcttgtcgaacagcagcactgtttggatgcaggcatggccgattttttaagcaagccgctgtcggtggagcaactctaccaagcgctggcccgttgg

SEQ ID NO: 33628 - DNA, 1395 bp, magnetite-containing magnetic coccus
gctatggagcccgaacctgtggaaaaaactttacatgccgccatgcaactgattctggattttctacaggaaaaccaaaacagtacccttcgaattgtggattttctcccaccccaacaactggccgagcagttcgatctgaccatccagcagcagggtctggccaatcatcaggcgctcatccccctgctgcacgcctatctccaacacagcgtcaaaaccggccacccccagttttgtaaccaactcttcgccggctttaactttccggcctttctgggcgaggtctttaccgccctcaccaacacctccatgtacacctacgaggtcgcccccctggctaccttgatggaacgctttctcatcgaaaaaatgggcaaattggctggctttactaaccatgatggcatcttctcctccgggggcagtaactccaacctaatcgccatgctctgcgcccgccaacagcgcttcccccatatcaaacagctgggcaacagcaacgcgccacccttggtctgtctggtctcggatcaagcccactactcctttcaacgcggggcgatggtgctgggcatgggcttggataatctggtcaaagtcgccagcgacccccaaggccgcatgcaacccgccgccctagaggccgccattctccacgccaaagccgccggtaaacagccctttatggtggccgccaccgccggcaccaccgtgctgggtgcctttgaccccctcccccagctccacgccattgcccgtcaacacggcctctggttccatgtggatggcgccttcggggcctcggtgctgctcagccaacgctggcgccaccacctcgatggctgccacttggccgactccttgacctgggatgcccataaaatgatgaacatccccctcatcagctcggtcattctggtgcgcgaacccggcctgctgcgcgaagcctgcggctctgaagggggccactacctcttccacgaacacgattatgatgtggatcagtttgaactgggacgcaaatccctcgcctgcggtcgccgggtcgatgccatgaaactgtggctggcgtggcgctactatggagacctgggctatgccgcccgcatagatcacctgttcgaactaaccgcctacgccaaagattgcattctcgcccaccccaaattaacgttgatggtcgaaccccaatcggtgacactctgctttcgctaccagcccgacaaaaccgtggatctggacgcctttaccgtccgtttgcgggatcgtttggtgcgcagtggtgattcgctggtcaactactccctgttacagcagggggtggccattcgcatggtctttgtcaatggtgacatgcaaacttcagattttgaccactttctggaacgcctg

SEQ ID NO: 33629 - DNA, 1296 bp, magnetite-containing magnetic coccus
ttacgcgtaggcgttatggggtatggcacggttgggcgtggcgtagtgcgtatgttgttggatcatgccgacctgctggaggcccgaaccggttgtgcggtaaccctacgttatattgccgaccataataccgagagtgaccgaggtgtggtattgccagagacggttacgctgctaaacgatgcccataaaatgatcgagtccgaggatgtggatgtgatctgcgaattgatcggcggcaccggtattgccaaaaccctcgtgctcaaggcgctgcaacagggtaaacatgtggttacggccaacaaggcgctcattgccacccatggcaatgagctgattgccgctgccgatgcctcgggcgtagagctgatgtttgaagcctctacagcgggcaccatccccatcattaaatccctgcgtgaggcgctggcgggtaatgagatccgggagatttatggcattcttaatggcacctgtaattacattcttaccgagatgcgcgagaaggggttgccctttgagacggtgttggccgatgcccagcaaaagggttatgccgaggctgaccctacctttgatgtcgacggtattgatgccgcccataagctgaccattttagcctccatcgcatttggtatgccgctctcttttgatgcggtttcggtggaaggcattcggcatgtctctgcggtggatattgcttgggccacggagatgggctatcgcattaaactgctgggcattgccaagcgttgcgatggtaaggtgcagctacgtgtgcagccggtgttggttgaagaggagagcatgctgggcgccgtagaaggggtatttaatgcggtgtttgtcaacagcgactttgctggttctaccatgtattatgggcgtggcgctggcgaggagcctactgccagcgcggtggtttctgatctcattgatattgctcgcaatgtgcaagcaggggcgaagatgccgcgcatttatcccctcggtcagcctacggcccagcttagcatgcccaccatgtgcccggtagaagagatgcgggatgcctactatctgcgtctgtcggtattggatagacccggtgtgttggctgatattaccgcgatcttaaaagagcaccgggtctccattgatgccattgtgcagaaggagcgctcgccggtggagcatgtgcctttggtgattgtgacccatgaggtgacagagcggcagattttggataccgtggcggccattgaaaagatggattcggtcagtgataaaccccgcatgatccgcattgaggat

SEQ ID NO: 33630 - DNA, 1161 bp, magnetite-containing magnetic coccus
tttcatcgcattaaacgtttgcccccttatgtatttgccgttgttaacgagctaaaatacaaggcaagaaaccgtggtgaggatattattgacttcggtatgggcaatcctgatcagcccacgcccaagcacattaccgataagttgatcgaagcggtgcaagatggacgtaaccatcgctactcgctctcccgaggcattggtggtttgcggcgggcggtctgtgcctattacaaacgccggtttggggtggatctggatcctgaatcagaggcgattgtcaccatcggctccaaggaggggctctcttctctggcgatggcgattaccgaaccgggtatgaacgtcattgtgccgagtcccacctatcccatccacgaatacagttttctcatcgcgggtgcccatatccaacgggtaaaaataagtcgggataacgattttatcgaggatatgaaggttgcggtgcgcaaccattggccccgtgcccaggtgttggtggtgaactttccctccaaccccaccgctcaagtagtggagctggatttttaccaaaaggtgatcgactttgccaaagagcataacatctgggtgatctcggatgtggcttatgcagagatctgctttgacggctataaagccccctccattttgcaaattcctggtgccaaggatattgcggtggagttctattcactctccaaaacctacaacatgccgggttggcgggtgggtttttgcgtgggcaacccccaccttattaaagcgctgtcgcggattaagtcctatctggattatggcatgtttcagccgatccagatcgccgccaccgtggcactcaacggcccccaggattgtgtggccgagatcaatgaaatctaccgtcaacgccgcaatgtgttgattgatggtttggctcgggctggttgggcgattgagcgccccaaggcctccatgtttgtttgggctgagatccccgatgagtttaaggccatgggctccttggagttttccaaactgctgcttaaagaggccaaagtggcggtaagcccaggtgtcggttttggggtgtatggggatgatcatgtgcgcattgcgctcattgaaaacgagcatcgcacccgccaagcgctgcgcagtatgcggcgcttcttaagtgcc

SEQ ID NO: 33631 - DNA, 801 bp, magnetite-containing magnetic coccus
atggaacaggatttttacagacggcttaatgtgcccagcagcgcgacccctttacagatacgcgatgcctatcgccgtcttgcccgtcaatttcaccccgatgtgagccccatcccccaggctgaagatctgttcaaggcgctgggcgaggcgtatgaggtactgcgtgatccccaaaaacgcgctcagtatgatcgcacccagggttcttatatctggccaaatacccgtcagagcccaccaaaaagtggcacaccggcaggcaaaccgcatcatgtagaggccaaactgattgtgccactagaggttgcttaccggggggagattcatcaggtacggctgaatttacgggagcttgggggggatcgtctgattcaggtacaaattcccagaggggtggtccatggtgaccgcattcgggtctacaatcaggtccgcgccaatccgctcaaaggaatcagcggtggggacattttgtttaatgtcgaaaccccgcctcaccctcatttccaattagaggggtatgatctctacagcagcctaaccctgagcccctgggaggccgctttaggcgagccggtgcagtttaaatcgttgggcggcaccattcgggtgcatattccggcgggttccagttcgggccaacttatccgtatccgtggtcgggggtttcccaaacccgggtttggtcagtgcggggacctctatctgcgtctcaacattgccctgcccaagcagttaaacaatgccgagaaacgtctgtatcgaaagcttgccaaaaagtcagacttcaaccctcgc

SEQ ID NO: 33632 - DNA, 1029 bp, magnetite-containing magnetic coccus
ctgcgttcccgtattatcggaaccggaagctacctgccagagcgtcgcctgaccaatgacgagttggcggccatggtagagaccaccagtagctggatagaagagcggactggtattcaagagcggcgcattgccgcccccggtgaaatgacctccgatctggcggtcaaagccgccgaacaggccttgcaagctgcgggcattgcagcttgggagttggacctgatcttggtggcgaccacaaccccagacctgatttttccctctaccgccaccatcgtgcagaaacgtttgggggcagataaaacgcgtatccctgccttcgatatccaagcggtttgtaccggttttatctatgccctgaccacagccgaccaatttatccgggccggtagtgctaaacgggtgttggtgattggggcagagaccttttcgcggattatcaattggcaagaccgggggacttgtattctctttggcgatggcgcaggagcggtggtgttggaggcccatgaagcggtggatcaggggattctctccacccatatctatgccgatggcagctatctggatctgttgcgctgtaccactggggtttcagatggcggtagccgcgtgccagggggcgatgctcaaccccaatcgacggatgcgcgtggggtgcaggccatgctggagggctttggttatgtcaccatgcgcggaaatgaggtgtttaaacgcgcggtgatggctctggaacagatcgtggatgagaccttagaggcaaataatctgagtaaatccgatgtggattggttggtgccgcaccaagccaatatacggatcattaacagcaccgccaagcggctgggaatgagtatggatcaggtcgtcgtgacggtagaacgccatggtaatacatccgctgccagtgtgcctttagcgctagacgaagcggtgcgggatggacgtattaaaccgggtcagttggtgttgatggaagcctttggcgggggctttacctggggtagtgtgctggtgcgctgg

SEQ ID NO: 33633 - DNA, 2403 bp, magnetite-containing magnetic coccus
caagccatacaccgacacgtggtgaccaccttgggtaatgatgttttccccccgcgcaaagagacctactacaaggggttggcttatgcggtgagggaccgtttaatggaacgttgggttatggcccagcgtgatttttatgatcaaaaagccaaacgggtctactacctctccatggagtatctgccgggtcggtttttgatgaactacatcaccaacctggagctggaacaagaggtggaggcggccattaaggatatgcccttcaccctacaggcgttggaagaagaggagtgggatgcgggcttgggtaatgggggattgggtcggttggcctcctgttttatggactcgatggcgaccttgaagattcccggatatggttatggactccgctatgattatggcatcttttttcaaaagatcgtcaatggttatcaggtagaaaaaagcgataactggatacggaatggttttccctgggagatcaaacgcaccggttttctctacgatgtcaacttttatggccgctcccaagcctatattgacagtgtgggcgagacccgctatcgctgggtagatacccaacaggtacatgccatggcctgtgacattatgatccctggttacggtaccaagcatgtcaataacatgcgcttgtgggagtcggtttcggatgaagcctttagtctaacccactttaatgatggcgattacaccggtgccatgcaggctaaggtgcgggaggagagtatcaccaaggtgctctatcccagtgatgagaaggccgagggacgtgagctacgcttaaagcagcaatattttatggtggcggcgaccctgcatgacatcttccgtcggtttaagaaaaaacatggtcaggagtttcaaaaattacccgatcaggtggcgattcaactaaacgatacccacccctccattgccgtagcggagtttatgcgacgtctgttggatgaggagatggtggggtgggatcaggcctgggagattgcggtcaaaacctttgcctataccaaccacaccgtcttgcccgaagcgttggaaacttggccggtggagctgttggggcgcttgttgccgcgtcatctggagatcatttacgagatcaaccatcgctttttagagatgctacgccaggatttcccccaccgtcctgatttgcagaacaagctctccatcatcaaagaggggccaacccgtctggtgcgcatggcccatctggcgattattggtagccatgcggtcaatggtgtggcagagctgcactcgcgcattattcgtgagagcctgtttagggactttaacaccatctatcccgaccgtttgaccaacgttaccaacggcattaccccacgccgctggttgcggcaggccaaccccgagctttcgcaactgatcagccaagccattggggacgcgtggattgcagatctggaccaactgaaaaggttgattccccttgccgatgatgccgcatttcagcagcagtggatcgcggttaagcgcatcaaaaagcagcagttaagcgcgtatatccagcgtaagttaaagtttagccccaatcccgatgcgctgtttgatgtgcaggtaaaacgcatccatgagtataagcggcaactgctcaccattatgcacggtattgccctataccggcgcttgttgatcaatccccagttggatatggtgccccgcaccattatcctcgcgggcaaggcggccccagcctaccatttggcgaaaaatatcatcaaattggccaatgcggtggcggagcagattaataacaatcccatctgccagggtaagttaagcatggcctttttgcccaactattgcatctcgcaggccgagaaggtgatccccggcgcagacctgtcggagcagatctccaccgcaggcatggaggcttccggcacgggtaatatgaagtttgccctcaatggtgccctgaccattggtaccctcgatggcgccaatgtagagattatggaggaggtgggtgccgagaatatctttatctttggtttgaccagtgaagaggttgagcagtggcgagagggtggtctgtataatccccgctggtatgtggagcgggatgaagagctgcgcggcgtgttgcagatgatctccagcgacaccttttgcccaggtcaacccggtctgtttgagcccattcgggccagtctgctggagcggggggattattatatggtcattgccgatttccgtgcctatctggatagacagcaagaggtggcagagacctaccgcaataccggcgaatgggcgcggcgctccattttgaacaccgccaacatgggtaagttttccagcgatcgggccattcgagagtatgcgcgtaacatttgggatgtagagccc

SEQ ID NO: 33634 - DNA, 2748 bp, magnetite-containing magnetic coccus
cataccacctgctatatgtgtgcctgccgttgcggagtacgtattactttgcgcgatggtgaaatacgtcacattcagggcaaccccgaacaccctctaaataagggggtcatttgtgccaagggctcatccggtgtgatgaagcagctctcaccggcgcgtctgctcaaccccctcaaacgtaaagagggcagcgagcgcggtaatccagagtttgaagtcattagctgggatgaggcttttgacctcatggagaagcggctgggtgccatccgctccaccgaccccaaaaaattcgctatgttcaccggtcgtgatcagatgcaggccctaacaggcatgtttgcgaaaaattttggtacgcccaactttgccgcccatgggggcttttgctccgtaaacatggccaccggcatgatctataccatgggcggctccttctgggagttcggtggtccagatctggagcgtgccaaattgtttgtgatgatcggcaccgccgaagatcaccactccaacccgcttaagcgtgaaattggccactttaagagccatggtggccggatgatttcggtcaacccggtgcgtacaggctattcagcggtagcggatcagtggattggcatcaaaccgggtaccgatgcagcgctgtttatggcgatcatcaacattttgatcaaggaggggctctacgataaagagttcctgcgtgaattcagcaatgctgctgaattggtcattttggatgagggtcccgaacagggcatgctgctgcgcagtggtgctgagaaacctgcgggttgttttgatcccgaagatcgcatgtggtatgaccgcaatagcaaaaaaattgtgcctatgcgtacggaaggagccaaccctgccttcttgggtgagtacaccaccgaagatggtaaaaaggttaaaccttcgttccaattgctcatggaacaagcggaaagttgcacccccgagtgggctgcggagatcaccggtattccggctgaaaccatccgtaatctcgctattgagatgggtgtcgtcgcccgtgatgagcgttttgaactgcccatcgcttggaccgacgcctggggccgcaagcatgaaaaggtaaccggtgtgccggtggccttccacgccatgcgtggtttggcggcgcactccaacggttttcagaccattcgtggtctggcgatcatcatgtccctgttgggcaccattgatcgtcctggcggtttccgccaccgtgcgccgttccctcgtcccgtacccccagggccgaaaaactgcaccacaccggaagaggtccaacccaacacccctctgccccatgcacctgtgggttggcctgccaatcctgaggagctgttccttactgcggaggggggaccggtccgtatcgacaaggcgttctcttgggagcatccgctgtcagcccatggtttgatgcaaaatgtgatcaccaacgcttggcgtggcgatccctacaccattgataccctattcctgtttatggccaacatggcttggaacagctccatgcacaccagtgatgtacggcagatgcttaccgataaggatagcaacggtcagtataagattccgttccttattgtggcagacgcttatcattctgagacggtggccttcgccgatctggtgctgcccgacaccacctatcttgagcgctacgatgtgatgtccatgttggaccgtcccatctccgagtttgagggtccggtggatgcctgtcgtgtcccgatcatgccccgcaagggtgacagcaagccgttccaggatgtgctcattgaattgggttcgcgccttaaattcccagcgtttacccatgcggatggcagccgtaagtttgaagactacaaagatttcatcaccaattttgagctggtccctggtatcggtttcctttccggatggcgcggtaaggatggcgataaggtgatgcggggagaacccaaccccgatcagtggaagcgctatgaagagaatggctgctaccactttaataaactgcctgaatccatgcactttatgcgcaactggaaccgggagtatctggattgggccaaagagaataatttgatgggcttcagtgatcctatcaatattcatctctattcggaaatcttgcagaccttccgtctggccgctcaaggcaagcgccctggtcgtcaaccaccggatcatctgcgcagccgggtcgagaaatattttgaccccctgcctttctatcacccgccgcttgaggatctgttggtggataccaaaacgtatccctacaacgctctgacccagcggcccatggccatgtaccactcctgggattcccagaacgcatggctgcggcagatccatacctacaactatctctatatgagcccccaggttggtcgggataatggctttgacgatggagattgggtggatgttgagtccatgcatggcaaaatccgctgcatggcgcgtttcaccgaagcggttgaacccgggactgtgtggacatggaatgccattggtaagagtgccggtgcatggggcctctctaaggatgcctatgaatccaaacggggtttcctgcttaaccatgtgatttccgaagagctgccagcccacgaagcgggtgagcatgtctccaactcggacccggtaactggtcaggctgcatggtttgacgtgcgggttaagatcaccaaggctgaggattgcgagccggtctctcaaccccagttt

SEQ ID NO: 33635 - DNA, 663 bp, magnetite-containing magnetic coccus
atgacccaactggctctagtgatcgatcttaatatctgtgtaggatgtcacgcctgtgtaaccagctgtaaaagttggaacacctctggctgggctggccctctgacagacgttaacccttatggtgaagatccccatgggacctttttcaaccgggtgcagacgtttgaggctggcacattcccggatacggagaccattcacttccctaaaagctgtctccactgcgaagatgcgccttgcgtaccggtctgccccactgaggccagttataaacgcgaagaggatggcatcgtcctggtggactatgacaagtgtattggttgtaaatattgctcctggaactgcccctacggtatgcgggagtttgatcctggtgagaaggtgatgaaaaaatgcaccctctgcgtggatcgtatctacgatgtcaaactgccggaagcagaacgtaagccaacctgtgtgatggcctgtcctgccggtgcccgcgtgtttggggatattcacgatcccgcatccaaggcatcccagcagattcgtgaaaatggcggcttccagctcatgcctgaattgggtacccaaccggctaaccactatctgccccgtcgtcgcaaccatgcgcactttaacgaggccgatgtgacccgcttggataacccgatg

SEQ ID NO: 33636 - DNA, 2148 bp, magnetite-containing magnetic coccus
agccaggagattcatctgttgctggaaggcatccattgtgcggcctgtgtttggctgaacgaaaaagtattgagcaatctaccgggcgtgatagaggctcgggtcaatttttccacccatcgggcgctgcttaggtggcggcgggatgtgttgcccctttcagaggtgattgaggcggtgcggcgcattggctacaaagccgagccttatgaccccgaaagtggtgaaagctcacaccgcaagcgggatcgggatctgctgttgcgtatgacggtggccggttttggggcgggcaatgttatgttgatcgcggtggccctctatgcgggctactttagcggtattgaggcacaatataaaaattttctgcatctaatctctctgcttattgcaacccctgtggtgttttttgcgggctggccgtttttgcggggtgccgtcaatgggctgcgggcgtggcgcttgaccatggatctgcccatcgccctgggtgccatcatcacctatagctacagcgtctatgttaccctgcgcatggagggcgaggtctatttcgactccgtcaccatgtttctgtttattctgcttaccgggcgttatttggagtcggtggcgagacgcaaggcggctggtgccacggagcggcttatcagcctggagccgcgcacggcggtggtactgcgcgggggtgaagaggtgacggtggccctgcgtgaggtcgccattggtgagcatgtggtggtgcgtccgggcatgcagattcccttggatggctgcatcattgatggggtgagcgcggtggatgagtccatgctcaccggggagagcatgccgatccccaaaaaagcgggagatcgggtgcccggaggggcgattaacctggatggtggttttaccatgcgcgtaacacgggtggggcaggattccgccatcgcccggattattcgcatggtggaacgggcgcaagcctcacgaccccccatccaaaccctggcagatcgggtggcaagctggtttgtggcggtcatcctactgctggccagcgccagttttgccttttggatgtggtttgatccctcgcaagccttggaaaacaccgttgccttgctcatcataacctgcccctgtgcgctgggtttggcgacgccggcggccattgtggtggcgacgggcgtggcctcgcgcaatggcttgctgattaaagggggcgaggttttggaacggttagccaaggtttcgcaggtggtgctggataaaaccggtaccctgaccaccggcaagccgaaagtgacggcgctgctgccccagccgggggtcaccgcgcagcagttgttgagctgtgcggccagtttggaacgtctctctgagcaccccttggccgccgctattgtcgcggccgccaaagcgcaggaactgaccattttgcaagagggcgtgacccttaaaaactatcctggattaggcgttgtgggccgatgggcgtccacgaccgcggtgataggccgggttggttttgtgcaagagtatgcaggtattgaactgccaatggaggatgctgaacaggctgttacccgcgttgccgtggtggaaaatgggctgtttttgggttggattgaactggcggatgatcttaagtccgacgcttatcatgcggtatcgcgtatccatgaaatgggtatgagcacgctgcttttgtcaggggatcatgcggcggtggtgaaaagggttcgtcaacaggtgggtgcgcaagggggcattggtggcgtactgcccggggacaaggaacagcagatcgccgctttgcaagccgatggtagcgtggttgctatgatcggggatggcattaacgatgccccagcaatggcacgcgccgatgtggcggtggcggtggccaacgcctcggatatctccatggaaaccgccgatgtggtgttgcttaatcctcgtctggagaccgctgtggatgccatggcgctctcccgcgctaccatgcgggtcattaagcagaacctgcttttctcactggcttacaatggcattgtgatacccttggcgatggcggggctggtgctgcccatcgtggcggctgtgaccatgccggtctctagcttgattgtggtggggaatgcactgcggcttaaccgtatg

SEQ ID NO: 33637 - DNA, 1899 bp, magnetite-containing magnetic coccus
atgaacaagcgtaccatccgtgatattgacatcaaaggtaagcgggttttcatgcgtgtggattttaatgtgcccctcaatgaggatggcacggtccgcagcgataagcgcattcagggtgcgctgcccaccattcgttatgccattgagcagggggctaaagtaattttggcttctcacttggggcgcccctcaggggataagtttgaacccgaattttcactaaagcctgcgggtgaagcgcttgccgcgctgttgggccaaccggtcaagctggccccagattgtgtaggggccgaggtcgaagcaatggtggccgccatgcaggatggtgatgtggtgttgctggagaatgtgcgttttcacaagggtgaaaccaaggcggatgttgagctttccaagggttttgccaagttggccgatgtggtggtaaacgatgcctttggcacggcacaccgggcccattcgtccaatgtgggcattaccgagtttgtgcgccctgcggtggccgggtttttgatggccgatgagatggactattttgataaggtattgggtgcgcccgagcgtccggtcatggccattttggggggggccaagatctcaggcaagattgatgtgatcgaggcgctgctggacaaaatggataagatcattattggcggtggcatgtccttcaccttcttcaaagccatgggttatgaaattggcaactcgttgtgtgaagatgagatgttgccggtggcagaaaaaaccttggctaaagccaaagagaagggggtatccctgatcctgccagtggattgcgtggcggcggacgcctttcgtgaggatgccaatacccagatctgctcggtagaagcactacccgctggctggatggggctggatatcgggcctgagagcgtcaagctgtttgccaaggcgttggagggggttaaaaccgtcatttggaacggccccatgggggtgtttgaaatggccccctttgccagtggcaccaaccatttggcccatttgttggcggagagtgattgtctttcggtgatcgggggtggtgatacggcggcggcggttaaacaagcgggcgtggccaagcaactctcttacatctccactggtggtggggcctcgctggagttgatggagggcaaacagctgcccggtatcacctcgctggatgataaatagagcagcataatggtcaagagagccgggcaagatcccttggccttggcgttaaaaaatagggggtaggcacacctgtatcgacctgcttgagcctgcttttacaagcgggcagggtgtgttgcccccctcgattatcccattttaggtacggagtcggagacgatgcgtcgagctttaattgctggtaactggaagttgaacggtacgacccaagcggccacagccctagccaccgctgtgcgggatggtgtggccgcaaacaagcccgattgcgatgtattggtgtgccccacctttaccgtgctcagtgcggtgcagggggttgtggccggttcaggtgtggatcttggtgcgcaaaatatggctgttgccagcagtggcgcgtttaccggtgagatctccggtgagatgctcaaggatgttggctgtagctatgtgatcctgggccattctgagcggcgcacgctgtttggtgaaaccaatgaacaggtggcacaaaaggtagcctctgcctatcgggatggtttgacccccattctttgcgtgggtgagaccctagagcagcgtgaagcggaacagaccatgcaggtgttggagcaacaactgctggcctgcttgccggtgctgcccgctgatgcggcaaaacagcagcaactggtggtggcgtatgaaccggtttgggccattggcaccggaaaagtggccagc

SEQ ID NO: 33638 - DNA, 2087 bp, magnetite-containing magnetic coccus
atgattctctatctttgcgaaaagccctctcagggtcgggatattggccgcgttttaggggctaccagccgtcatgaaggttatgtggcaggagcaggggtgtgcgtaacttggtgtattggtcatcttatggagatggtggcccctgatggttatagacccgaatggaaaagttggcggctggataccctacccatcattccccaacagtggcagctggagctcaccgcccgtgggcgcaagcagtttaaggttatccaagggttactcaagggtgtaacggaggtggtgctcgccaccgacgccgaccgcgaaggtgagaccattggccgtgaagtgttggagcgctgccaataccggggtaagatctctcgcctctggttatctgccctggatgatgccagcattcgcaaagcgttgggcaacctgctaccaggggagcaaaccgagcccctctaccaagccgggcttggccgatctcgtgcggattggatggttgggatgaaccttacccgcgcctatacccttttgggtcggcaggggggctatgcagggtgttgagcgtggggcgcgtgcaaacccccaccctaaaactggtggtggaccgggaccggctgatcgagaactttaaacccgtcgactattttgagatttttgccttacaccgcgttcactcagggacgttcatcgccaaatgggtaccgccccctaagccttgcgatgccgagggtcactgcttggaccgcaccctcgccgaaacggtcatacacaaggtgcaaggccacagcggcaccattacaaaagccgagaccaagcgcgtcaaagagccgcccccgctgccattggagctctcgactctgcaacaagaggcttcgcggcgctggggcatgggtgccaaacagacccttgagattgcccaatccctttatgaaaagcataaagcggtgacctatccccgcaccgattgccgttatctacccagcaaccagtttaaagaggccccggcggtactacagggattgacaaccaacgatgccagcctcacccccttggtggagggtgcagatgcacagctccgctccaaggcgtggaacgacaaaaaaatcaccgctcaccatgccatcattccaaccgccgccaagataaacatcgacgccctcagccgcgaagaggctctgctgtatgatctgattcgccgtcactacttggcgcaattttacccccccttcgagtatgaccgcacggtaatcgacacccaggtcgccatggaaacattccacgccacaggccgggttgagctcattccagggtggaaaagggtgctggctgccaaccaagaaaaaaaagagggcgacgaggatgagcaaacgttacccgtggtacgcagcggcgaagctgccaccattgagggggctgaactgaaacaaaagcagaccaagcctcccaaccgttataccgaaggcaccttaatccaggcgatgaaaagcgtcggcaagctggtcgaagatgcccgtctacgcaagattttaagagagacctcgggcattggcacagaggccacccgtgccgccattctggagaccttgattaaacgcaatctgctggccaagcagggcaaaaaaagtcttgttagcatgcccgccggtcgtctgctggtggatgccctaccccatagcgtcaccgaccccgccaccaccgcagtctgggaacagaccctggatgatattgcccatggtggaggatcgctggagacctttttagccaaatccgagttatggcttaataagcttattcacaatgttcaccaacgccagcagctgggactaaacccctttcgaggtctccccccttccacgtcgcataccgacccagcccagcccactccgcgcaggcaacgccgctctaaagcagaggtcacacccaccccaaacgccgcccccctgtgcccccagtgtggcgggcctatgttacagcgtaaaagcccgcaaggcgctttttggagctgtgcagagcaagcaacctgtacgggcacacggccagggagcccccttgcagcccactcgccccttatgcaacccaacccagag

SEQ ID NO: 33639 - DNA, 1743 bp, magnetite-containing magnetic coccus
tcacgacgcttggatgccgaacagaaactgcgcctgtccgagcggcatttccgcactttggtacaagcgttacccggtactttttataagtgtgccccagatcccttgtgtaccatgtacagcttgggtgacaacattgccgagctgacaggttatgcagctgacagctttattgaaaatcatgagcgtagttttagcagtgtggtgcatgccgaggattggcccagggtgagagaagccttggatcaagcactggcgcagggggttgtgtatcacctggagtatcgtgttaaccacaccgacggcaaaccacgttgggtgatggatcgtgggcaagcggtctatgatgaagcgggtagggccgaggtgctctacggcgtcttgctggatatgaccgagcgtaaacagtatgagcagcgcttggagagtgcccgccagcaggccgatgcaggcaaccgcgccaaaagtgagtttttagcggtgatgagccatgagattcgcactccgcttaatgccattatggggatgggggatctgttgggagagaccgcgctcagtccggtacagcgccactatctgagcatcagccagcatgcgggggaaaccctggtggagttgattgaagatattctggatctctcccgtatagaagtgggtgaactggagctggagcctgcaccgtttgaggtggaagccttggtggaggaggtgtgcgaggtggtaacatcctcggcccatgataaagggctgattctactcatgcgcatcgacccgctgttaccaccggtattgatcggagataaaaaacgtctgcgccaaattttatttaacctgttgtttaatgccgtcaagtttaccaagcatggcgaggtgatgttggatattcgccacgatgctgcccgttcggcggcgggggctgttctgttacaggtgcgcgataccggggtgggtatggccgaagagatgatcgagcgggtctttgaaccctttacccaaggggactccaccattacccggcagtatggtggcagcggtttgggcttgaccatttgcaagcgcttggtgagcaaaatggggggggatattcaactggagagtgcgttgggtcggggtacgaccgcgacggtacagttggtgttgccggtgggacgccatggcatggtggcggctgttcgtcagcaggtgccgctacacggggcgaacctgttgttggtggatgataacgccaacaaccgcgaaatttatacggagctcttgcagcaagagggggcccgggtggtgggctgtgccacaggcgagacggccatgcaacaggtgagcgaggcaaactttgatctggcggtgttggattttcatatgccctcagaggatggcttaaccctggccgggcgtatccaggagatggtgcccaacatgcctctactgatgctgagttccgatcaacagccggcggcggcggcgcgggccaacagcatgggtgtgacctttttgttaaagccggtcaagcggcagctgttacgtcaaaccatcgcccagttgatgcagtcaggcaagggtgtcaaggatgctcctgtacttgggcagggcgtggagtccgggccgcagaaagggcttaaaattttgctggccgaggatgtgccagaaaatgccctgttgattgaagcctatttggaagaaacagggcaccaaatcagtgtggtgggggatggtcagcaggcgtttgagcgttttcaagaagaaccg

SEQ ID NO: 33640 - DNA, 963 bp, magnetite-containing magnetic coccus
gaagcgtttgccgcttttaccattgtaccggcactggtgatgaccctcatcagtttccgatttgtttatgaaggctatctggcccgcagcgccgcctttgaggtgctctttttggccatctgctttgtggggggcgccctgtttgtggcgtggcactatggtcgcgcactgcaccgcgattgtaccgcgctaaccgaggccctacaacaggttacgcagggccattttggcgtgcgggtagacagctcacgggctgatgagttgggcagcatggcccagggcttaaatgagatgggacagggcttactgttacgggagcgcatccgtgatgcctttggccgctttgttaatcctcaggtggccgatgcctttatccagcgttttagccaaggcgagcaggccattcaaatgggcggagagcgtaaagagatcaccattatgatggcagatttacgccaattcaccccactctcggagtcgctcccccccgaagccctcaccgagctgctcaacagctatttgagcgtcatggtgcaggttatccagcagcatggtggtatgattgataaatttattggcgatgccatcttggcgctgtttgggctcggccatcatgaccagcccgcccagttgcaagcggtgctggctgcccaagccatgcaggtcgccttagccgattttaatgaaaaacaacgggccaagggggcacccacccttaataatggcattggtttgcaccatggcgaggtggtggcgggttatatcggcagtaccgaccgtttggagtttaccgtcatcggtcacaacgtcaacatggctgcccgcattgagtccatgaccaaagcccccaatcccagcttacttttctcccaatcggtggccgatgcggtggcccacaccctgcctgtgcggcaagtcaccatcgcaacgttaaaaggcatttccgagccaatccccctctac

SEQ ID NO: 33641 - DNA, 2112 bp, magnetite-containing magnetic coccus
tgtggtatctgccccgctgggtgttgggtgcgggtccactatgcgggtgaaaccatggtggcggtagagcccagacccgaccatcccctgggtatgatctgtcgtatcgggcgtaaatcccccaatattgtttatgatccccaacgtttgcaaaccccccttaaacgggttggccccaagggcagttatgcgtttgaacccatctcctgggatgaggcgatggccaccatcgccagccgcttacaacagactaaagcccaacatggtgccgaagccaccgccatctataccggtcggggcagctttgatatggccatgtgcgacctgtttcaaccggcggatgtggcggtctcttcggccagcagtgtgctgtttccctttggctcgcccaacaccctaggggtgggggcgctctgttatgtctcttttgccatgatcgccccccatgtcacctttggggagatgctcatcagcctagagaccgacctgccccaatctgaacttattgtcctatggggagccaatcccgccaccgactccccccccatggcccatgggcagattttggcggccaaacagcggggggccgaggtgttggtgatcgacccgcgccgctccgaaagctgtgtcgaggccgatgcccagtggtaccccatccgccctggtaccgatggtgccttggctctgggcatgatccatgtgctcatcgaagaggaactctacgatgaaaactttgtgaaaaattggacactagggtttgaggagcttgcgcaatatgtgcagcactttcacccggatgtggtggccgaaatcaccggcgtgcccgctgaacaggtgcgcaacatcgcccgtaaaattgccaacgcggcaggagcctgcccggtgatgtataccggcttggagtattccgacagtggtgtgcaggcgatccgcgcagtgtttaccctatgggcgctggccggtcagctggatgtacccggggggctgctgatccgcatgaaggagaaccagtttccgcaaaatcgcacacacctgattaaaaaccccggggcggataaagcccttgggcgggaccgttttccggtctattcggcctatcggggcgaatcccacgccattgcactgccccaatcggtgctgcaaggtaccccctataaggtgcgcgatctgattgtcttggggggatcgttgatcacctcctggcccgatccggaattgtggaaacgtaccctgaacgcactggagtttttggtggtgatcgaccgctaccacaccgccgattcggcctatgccgatattgtactacctgctaccaccctctatgagtgccgctcctttatgcgctatggaccaatgttcgccatacgggaaaagttggtaccgccggtgggcgaggcgcggaatgattttcttatcctagcggaactggcgcagcgtttgggctatgggcacctctacccccaaactgaagcggcaatcttagaacgggcgctggagggcagcggctttaccttagagcaggtgcaggcagccggtggggtggtgcagcttgagagccagatgatgcagtataaaaaatgggaaaaggggcggctgcgggaggatggtaaacccggttttgccaccccaagcggaaagtttgagatcgcctcttccctattggtcgagcatggctacgacgctttgcccgtctacacagagccccaggaggggccgttggcgcgtcccgatctggcccgccactttcccttggtgctgaacaccggtgcccgcacctattacgattttcgcagtcagcaccatggggttaagggcttggccgagcaacagcccgaccctagggtgaccatgaaccacgaagatgccgcccaacggggcatccaaaatggggattgggtatgggtgagcagcccccgtggtgaggtgaaataccgagcccgtgttaccgatgcgattgtaaaggggagtgtggatgccaacatgggcgggggtgggccggtgggtccagcgccgtggcaggcttgcaatgtgaatgccttgaccgatcctgaacactacgatcccatttccggctttcccatctacaaaaccttgctctgccaaatccgtaaa

SEQ ID NO: 33642 - DNA, 2061 bp, magnetite-containing magnetic coccus
aaaaccacctgctaccagtgtgacatgaactgtgcgtttgatgtccactatcaagccgacggcagcttggagcgacttaccggtcccagttgcccacggggtgcggtgcaaatggagatgcagacccaccccgagcggctacgtacccccttaaagcgggtggggccacggggtggcatgaactttgagcccattggctgggacgaagccttggagatctgtgccagccagttggatgccattcgccagcgagacggggcagaggcgtgtgcctttttcagcggctacaccaaagaggccagacctcatttgcaacggctggcccatctttttggttcccccaactatatgaccgaatcgggctgctgttttaccgcgaccctggtatcggaacagctaacctacggctaccggcttaaaacctccagtttgcaagaggccccagagacccgctgccgcctgatctggtccaccaacccggtacactcggtgctgccctatggcgagcaccccattattcgccccaagccaggggtcaagaccattgttgtggaccctcggtataccgaaacggctcagcgcgccgatctccatctgcccatccgccctggtaccgatggcgcattagccctcgccatacacaaccagctgtttgccaacggctgggctgatgaagcctttttggccaagtgggccaatggcattgaggcctttaaggcctatgttagggcgtttacccccgcccgggccagtgagatctgctgggtacccgaagcggatattaaacaggctgctcagtggtacgccacccatggccccgcccaactggtcttatcggccacctccaccacccaacacagcaatggtttccaaaaccatcgtgcggtcattttattagccgcaacggcgggttatgtggatatccccggtggcaaccgcttttttatcgacaaggtggtccctaagggcattgatctgtttaaggagcttatccacaccctgcccccacgggtgggacaaaagcgctttcccgtctggagcaaccgctacccagcggcccacagcatgctgctgggcgaggccattgaaaagggtgaccccacccccatacgcggattgtttgccttgggcataaaccccatcatgtggccaaacaccgaccgttttatgcgtgctttggaaaaattggactttttctgcatggtggatttctttcacacacccggcagcgtgctggcggatctcattctacccgccgcgacttcgttggagcgcgaggctcttattaccgccagcagttgtcaataccgtggtgtggtgcagcatcggcgggtggtaacgccaccccagggcgaggcccgccccgatgcgcaaattgtgctggatcttggctgtaagctgggtatggcagagcagttctggcacggtgatctgcacgccagtatcgaagagcaagcccaggggttgaccccccatctttggcaacgggtgcagcaagagcccggtggcctgaccgtatttggtaccgcggttatggatgacgatgtggatgaggtgacggaaaaactctatgaggtgaggggctttcccacccccagcggcaagattgagtttgatgccgaggagttgcgtcaggcgggttatgatgggctacccacctacaaagagccggtggagagcccccttgctacccccgctttggcccaagcataccccctggtgctcaccacgggggggcggtcggtggcctacacccactcacaacagcgccgctttgcctctttactggcgcgagatcccctaccacgggtgcagatccacagccatgaagcggccaaacgggccattgcccatggtgatacagtcaccctctcctcaccccgaggggccattaccatggtcgcccaggttgatgacaccatccgtcccggcattgcccatgcctatcatggttgggcccaggccaatgtcaaccgcctgaccgaggatgatctttcccttgatcccatcagcggctttccggcctttaaatcttcgctctgccagattgccaaggccgac

SEQ ID NO: 33643 - DNA, 852 bp, magnetite-containing magnetic coccus
gagcccgcaccacttatctatgcggcgcccgccaagcttaacttaaccctacgggtggtgggacggcgtgccgatggctatcatctgttggaaacggtgatggcctactttcccttgcaggacacgttgcagtttagcttggatagaggcggtggaatccatctaagctgtgaaccagcggtaacggccagtgtggcggataacttggtctatcgggcggcagaacgcttaaaaacaggctttggggtggagcagggggtggcgattcaactgcgcaagcagattccccacggtgccgggctgggtgggggttcgtccgattgcgcaaccaccctgttggcgctcaaccggctctggggattgcagctaagcgcggcagaattggcggaaattgggctggggttaggcgcggatgtgcccatttttctctaccagcgggccgctttggcgcagggtattggcgaacgactcagccccatgccagccttgccggcttggcatctggtggtggtcaatccgggtgttgcgctctcaacggtggcggtgtttaaggcccatgccgcgcaggtggggggctgttatacgccgcccggagcggcacaggcgtggcttgatgggggtattcagcatgcccatcagttgcataatgatctccaacaggcggcggtgcagctctgcccgcaggttgggagcgtgcttgaggcgttgctggaacagggggcggatggggtttgcatgtccggcagtggtaccacctgttttggggtttttgacgacgaagtgaacgcggtgaatgcggcgcaaacgttacgccaaaataatgctcaatggcttgtaatcgaaggtaaaatg

SEQ ID NO: 33644 - DNA, 924 bp, magnetite-containing magnetic coccus
atgcgcatcttctccggtacggctaatcccgagctggcagaacggatctccgactatttgggcacaacgcttggtgaggttacggtccgccgtttctccgatggtgaaatctttgtccagatcgacgaaaatgtgcgagggcgggatgtctttatcattcaacccacctcggcccccaccaatgccaatttgatggaactgctgattatggttgacgccttgcggcgcgcctcggcaggtcatatcactgcggtgatcccctattatggttatgcccgccaagaccgtaaagaggctggacgtacccccattacggccaaactggtcgctgacctgctgcatgctgctggggtacaacgcaccctgacgctggacttgcacgctgggcagatccagggctttttcaatatgccggtggataacctctacgcctctccagtgctgttggaggcgatccgtgccaaggggctggataatgtggtggtggtctccccagatgttggtggggtagtgcgggcccggggttatgccaagcgtctcaatgttgatctggcgatcattgataaacggcgcccagcacccaaccaagcggaaattcaccatatcattggggaaattgccggtaaaaactgcttgattgtggacgatatggtggacaccgctggtaccatgtgcgcggccgccaacgccctgttggaacaaggggctaactcggtctatgcagcctgtacccatggcgtgctctctgggccggccatcgagcgcattgaaaaatccgccatctcccactttatgattaccgataccattcgcctctctgagcgtggcttggcgtgtgaaaagattgaggtttacaccgtggccaacctgctgggtgaggcgattcgccgcatttctgatgccgaatcggttagctcactattc

SEQ ID NO: 33645 - DNA, 1410 bp, magnetite-containing magnetic coccus
aaaaaagcctatgtggccggccaatgggtagaaacaggtacgcagctaaaggtatataatccctataacgatcagttggtagacacggttgcccagtgtggtccgcacgaaatagaccgggctttggatggtgcggtggatgcgctggagcagaccagccgtatgcaaccctacgaacgggccgcctgtttggccaaaatccgggatggtatcgccgctaggggtgccgaatttgcacgggtgctaagcttggagaatggtaaaaccctcgccgaatctaccctagaggtggcgcgtgcggtggccacttttgatattgcggtgggtgaagccacgcggatctatggcgaagcctatgatctggggattaacccaatggggtctggacggcgggcgctggtgcgtaaatatcccattggcgtggtgtcggccattgcaccctttaatttccccatcaatctggcggtgcataaaattgcgccggcgttggcggtgggctgtccggtggtgttaaaacccgcctccttaacccccttgacggcattgatgatggcagaggtggtagaggcttcgggctggcctaaacaggctttttcggtggtgccctgcaaccgctcggcggggcaaatgttggtggaggatgagcgcattaagctgctctcctttaccggctcgccagaggtgggttggaaaatgaagtctgaagcaggcaaaaaaaaggtagtcttggagttggggggcaatgcgggcctgattatcgaccataatgttaaagattgggaccatctgattcaacgggccatcctgggggccttttatcagtgcgggcaggtgtgcatttctgtgcagcgtatctttgtgcatcaagatgtgatgggcgagttccgcgctcgctttgccaaggcagcccaagcgctggtgattggggaccccttggatgccaaaaccacccttggccccgtgattgatcgggccaatgtggagcgcttgcagggttggatccaggaagccctggatcagggggccgcgctggtcaccggcaataccattgcggatgtgggggcgggtaactcaatgaccgccaccattttagaagaggtggatgccggttgccgcattaatgccgatgaagcctttggaccggtggtgacccttaccccagtgcagagtatggatgaagcctttcatctggtgaataactcccgctttggtttgcagtgcggtctgtttacccaggattttgcgacggtcatgcgcgccttagatcaactggaggtgggaggcgttatccacaatgatgtgcccagctttcgggtggacagcatgccctatgggggggtaaaggactctggcttgggtcgggaaggggtcaaatatgccatggaagatatgttggagccccgggtgctg

SEQ ID NO: 33646 - DNA, 951 bp, magnetite-containing magnetic coccus
cgcccacgtcgactgcgtacaacacccgcaatccgtgccatggtaagggaaaaccatctgcgcgctgtggatttgatctaccccatctttatcgtgccgggccagcagatccgcaaaccggtggtctccatgcccggtgttagccaactctccatcgaccaagccattgaggtgtgccaacacgcttatgatttgggcgttggtggtgttattttgtttggtattcccgaccataaagatgccgccggcagcgaaagctttgccgagcagggtatcttgcaacaggccattcacgccattaaagcggcggtgcctgatctctacctgattgccgatgtctgcatgtgtgaatataccgaccatgcccattgcggtatcctagtggatgggcaggtagacaatgaccgcaccctcagtgtgctgcaacgcattgcggtcagttatgccgatgcgggcattgatatggtggccccctcgggcatgatggacggtatggtacgtcacattcgcctggggctggacgccaagggctatacccaaattccgattatgtcctatgccatcaaatatgcctcggccttttacggacccttccgggatgccgccgaaaacacccccagctcgggggatcggcggggttaccagatggaccccgccaaccgccgtgaagccatcaaagaggccgaacaggatattttggaaggggcggatattcttatggtcaaacctggcctgccctacctggatattgtgcgggatctacgcaaccacaccaaccgccccaccgcggtgtataacgtgagcggcgaatacgccatgattaaagccgccgctatgaatggttggattgatgaacaaggcactgtgcttgagatgctgttaggctttaaacgggccggagcggatatgattttgacctaccatgcactggatgctgcacgctggttgcaa

SEQ ID NO: 33647 - DNA, 1554 bp, magnetite-containing magnetic coccus
cgccgttttgtcagcgattttctgattctaggcggtggttccactggtctggatctggctctcaggttggccgaacatggcaaggtgctggtgcttaccaaagcccccattggcgactgtaacagcatgatggcccaaggcggcatcgctgcggtgctggatgaggacgacagcaccatcctacactacgaagataccatgaccgccggtgcgggcctgtgcaacccccaatcggtgcgcttggtggtggaaaatggcgcccgtatgatccagcatcttattgatctgggcaccccctttgacaaaaccgataacaacagctaccacctaacccgcgagggtggccatagccggcgccgcgtgatccatgcggcagatgccaccggtcgtgcggtgatgcttagcctgattaaacaggcacaagcccaccccaacattgaagttttgcccaaccagatcgccattgatctcattaccgcccacaaactgggccattttctaccgggcaaaaaagatcgctgttatggctgttatgcgctggataccgaagccgatgtgatccgcacctaccaagcccgctttaccattttagccagtggcggggcgggcaaggtctatctttacacctccaaccccgacacagccactggggatggcattgccatggcctatcgtgctggctgccgggtctctaacatggagtttattcagttccaccccacctgcctttaccacccacaagccaaatctttcttggtttccgaagcggtacgtggcgaaggggggcatcttttgttggccgatggaacccgctttatggagcgccaccaccctctgctggagttggccccacgggatattgtggcccgcgccattgactacgaaatgaaacgcaccggcgagccctgcgtgcatctggatatcagccataagggtgctgattttattaaggcacacttccccaccatctatgaaaaatgccttgaatttggcatcgacatgacccaagagcccatccccgtggtaccggctgcccactatacctgcggcggggttgttaccggtttgcaaggtgcaacggatattgagtctctgtatgccattggtgaggtagccagcaccggcctgcacggagccaaccgcttagccagcaacagtttgctggagtgcttggtcttttcggaatctgcctataacgacattgtcagcaaaatgtttggggaagatcgccccgtgctctcccgccttcccttgtgggatagttatgaagcaggcagttgcgaagaagagatcttaatcgcccacgattggcaggagatccggcgttttatgtgggattatgtaggcattgtgcgcagcaaccagcgcctagcccgcgcccgccgacgcattgaaatggtgatgcaggagatcaatgagtattactggaactgcaaggtcagccaaaacctgattgaactgcgcaatctggccttggtggcccatttgattattcgtagctcccagcaccgcaaggagagccgtggcctccactacaccaccgactaccccgag

SEQ ID NO: 33648 - DNA, 2282 bp, magnetite-containing magnetic coccus
atgataagcaaacatctggaaacctccctaaacaaagcgttgcagttggcccacgcacggcgccatcaatttgctacgctggaacatcttctacttgctctgctggataatcctgaagtggtggatattttaatcccctgcggctgtgatatgcagcagttaaacatggaacttgcggaacatttggagcagcatattcccctgtcggctgacgcggcgccatccattgctgacattacgcccaccatcgcttttcagcgggttattcaacgggctgtgcagcaagtgcaatcctctggccgcgacatggtgacgggggcctatgtgctggtagccatgtttaatgaaaaagatgcccatgcggtctactttttagccaaacagaacatcaataagctggatgtacaatccatgatcgcccacggtggcgagagcgaggcgacaggcgcaggcgagcatggccacgcccacgagggtagtgcggccggggcaggcaacaaggagaaggatgaccccttggccgcttatacggtcaacctaaatatccgcgcgcaagagggtaaaattgaccccctgatcgggcgggaaaatgagatccgccgcaccctgcaaatcctctgtcggcgccgcaaaaacaatcccctgtatgtgggggatgcaggcgtgggtaaaacccacttggccgagggtttggcgctcaaaattgtcaatggtgaggtacctgaaatcctggccgatgccgaggtgttttcgctggatatgggcagtctactggcgggcaccaaataccggggtgattttgaatcccgccttaaaaatgtactacgcgccttaaaagagcgccccaagtcggtactgtttattgatgagatccatacggtgattggagccggtgccaccagtggcagcaccatggatgcctccaatctgctcaagcctatgctgcaaaatggcgagcttcgctgtattggctccaccacctttgaggagtaccgcaccatctttgaacaggatcgtgctttggcccgacgttttcaaaaggtggatgtgcttgagccttcacttgaagaaaccattaaaattctcaaaggtttaaagatacgttttgaggatcaccatggtgtgcgttttaccaatcaggccctgcaaaccgctgcggagttatcggcccgccatattaatgaccgcaaacaccctgattcggccattgatgtgattgatgaagcgggggcagctagtcagttattgcccctctccaaacgcaaaaaatccattggcgttaaggagattgaacaggtagtggccttgatggcccgcattcccacccgctcggtgagcaaggatgaccgtcaggtattgcgcaatttggacaaaaatttgcgcctctccctgtttggtcaagatggggctattgataaaacctgcgaggccattaagctcaatcgctctggcttgggaaatccagaaaaacccattggcagctttttgtttgcgggtcccacgggggttggtaaaacagagctggcccggctgcttgccgccgagatgggggttgagctgatccgctttgacatgtctgagtatatggagcgtcatgcggtatcgcgcctcattggagcccccccaggttatgtgggtttgagcagggtggactgctaaccgatgcggtgacgaaaaatccccattcggtgctgctgctggatgagattgagaaggcccatcccgatgtcttcaatattctgcttcaggtaatggaccacggcaagctgacggacaacaatggccgtcaggcagattttcgcaatgtggtgctgattatgaccaccaatgcgggggcttcggatctggagcgggcctcggtggggtttgttacccagacccatgttggggatgatatgaaggcgattaaccaaactttcgccccagagttccgcaaccgactggatgccattattccgtttgtgcaactcaatcgggagaccattttgcgggtggtggataagtttttggtccgtttggaaacccagttggaagagaagggggttgccctgtttgtggatgattcggcgcgtcatctgttggcgaaaaagggctacgataaaaaacatggtgcccgtcccatggagcgcgccattcagcaggagctcagaaagcccctctccgatgagctgctgtttggcaagttggtgcatggtggtgcggtgcatgtatcggcggttgaggcggccaatgagctggccattttggtggaggacagccacgaggtggaaaaagccgaaaaa

SEQ ID NO: 33649 - DNA, 2300 bp, magnetite-containing magnetic coccus
attgcgctgattgatcagcgggagcgggccttgcgctgggccaaagaggccgccgaacaggcagcccaggccaagagtgagtttctcgccaatatgagccacgaaattcgtaccccgatgaacgccattaccggtttgacggggctctgtctaaaaaccgatctcaacagcaaacagcgggactatttgaccaaggtggagggggcagcccgttcgctgctgcgcattgtcgatgatattctggatttctcaaaggtagaggccggttgtttggtgttggaagagaccgattttgagctagagagtgtttttgaccatctttcgaccatgatctcccaaaaggcccatgaaaaggggctagaggtggtctatggggtgccccgcagtgtgccgacctatctgaggggggatcccctgcgtctgtcgcagatattgatcaatcttgccagtaacgccgttaagtttacggaagagggggatatcgtggtgcaggtagcggtggatcgctatctggaggagcaagtggtactgcattttagcgttagggatagcggtatggggatgagtcaaccccaactggagcggctgttccactcgtttacccaagcagatagctcaaccacccgacggtttggggggacaggcttggggttaaccatctccaaacggctcgtggagatgatgcaaggtaaaatttgggtagaaagtagcctagggcagggcagcgcttttcactttaccgcatgttttcgttatgaccctgagcgggccttggccccttgtatgttgacctgggcgttgcaagataaacgggctttgttggtggataataatcccacctcccgtggatttttaagagaaatgatcgcctcgttctcactcaaagtgcagttggcctgtgggctggatgagggcatgcaaaagtgccatcaggcacgggatgaagggcatccctttgatgtggtggtgctgaatttcagcgccgagcaggacagcgccacggggttggcggtgttgcaagatctacagcgtttggggggtgatgaggccttgcggcgtaccttggtcattgtgcccgttactcaagaagccttgatccgggcggcggaccgcttagatgtaggggtgttgcagtttaagcccatctatcctgcggcgttgcagagtggcttgacagcgattctctgcccccaacaggatgacgatggggctgcccagaaactaacccgacgatgcatatggatttacacggcctgcatctgctattggtcgaggataatgaggttaatcaattggttgccagcgaaatcatcaaaggggctggggccgaggtgagcatcgccaagcatgggcaagaggcgctggatttggtccaggtaagccgttttgacgccgtgttgatggatctgcaaatgccggtaatggatggttatgaggctacacggctcatccgcgcacaaccgggtctgcacgatctgcccattattgcccttagtgccaatgttatgaaagaccaagtgcgccgctgttatgaagcaggtatgaacgatcacctgcccaagccggtggatcctaatgtgctgtttcgtctgttggcgacccatttggggttagagtccaaactggagctgcgggaagatccgccggatcaagagcaactcgtgcagcaaagcctgcaaggttttcctgctcatcccgctggggttgcgttatcccaagcgctgttttatgccgatggtcgggtggctttaatgtgcaagctgatgcagcggtttaagcaggaacaacatgatgtggtggcacgtatacggcagcagttagagctcggggccttggcagatgcccaacgtttggcccacaccctaaagggggctgcgggtacgcttggggcgaccctgttgcaagaaaaagccaaacagttggagttaagtataagacaaaaacaagaatcgagcccaagggacagcctcgccagcttcgctgttttggaagatatggaggcagccttggcgctggtgttacgctcccttactcagatattggcatcccctggggcgttggcgtacctagagagtgaaaccatgcctggggatggtgctgcctatgactggcaagaacaactggagcatttgcagaaacttattgaagattataatgcggaggcagaagatctggtggcgcgcatgttggtcgcttcgccccccgccccgttaatagagcccctgtcagaggtgatgcaagcggtgagcggttttgattttgccttggctgaagtgcgcatgcagcaagtcaggcagcgg

SEQ ID NO: 33650 - DNA, 1876 bp, magnetite-containing magnetic coccus
gtttgcggagtcaatttcatcaagaacatgcgcttccggtccatcaagagtggaatcgtgttgcgagagccacagtcgcagcttataatcgccccaagccaacgtctgctgaacgtctgtaaccaagccccgcgtgttggggcgttcggcgttgcagcgtagccgaccaacgctttatattacccccccgtatccacacaacaaaggctaaaacggaacttttcatggcccacaatcaagacgcctcctcacccagcggcatgacttaccgtgatgcaggggttgatatcgacgcaggtaaccgtctggtctctatgatcaagcgctcggtggcatccacccaccgccccgaagtgcgtagtgatctggggggctttggagccctgtttgatctggacacccgtaaatatcaagaccccgtcttggtctcggccaccgatggcgtaggcaccaaattaaaattggcttttctcaccggtaagcatgacaccgtgggcattgacttggtggcgatgtcggttaacgatctggtggttcagggggccgagccgcttttctttttagattattttgcctgtggcaagctctcccccgaaaccgccgccacggtggttgaaggcatcgcaacgggctgtcgcgcggcgggttgcgccttaattgggggcgaaaccgccgaaatgcccggtttttataccgagggtgaatatgatctggccggttttgcggtaggtgcggtggataaacataagattattgatggccgccatatcagcccgggggatgccattattggtttggcctcctcgggtccccactccaacggttactccctgattcgtaaattggtattggggcagagcggccctggtttggaggccgactttaatggcaaacccttgggtgaagtgctgttaacccctacccacatctatgtattgcccttgctggagttggcaaaaacccacgccattcatggcttggtgcatattaccggcggcggcttttgggagaatatcccccgcattttgcccgacgctaccggtgcgctgctcaaacgcagctgttggcagcagcccgaggtatttaaccttttgcaaaagcttggtaacattgctgaagatgagatgttgcgcacctttaactgtggtctcggcatgctggtcatcgtgcccgcaacccaggccgacagcgccctggcccagctacgcgccgccggggagcaagccgaactggtgggggaaatcacctcctgtaaagagggtgacgcacgggtggttatcctatgagcggggcaagctttcgtattggtgtactgatctcgggttctggcagcaatctgcaagctcttattgatggggttaagagcggttttattcccgcagagatcgccttggtgattagcaataaggccgatgcctatggcctgacccgtgcccgcgaggcggggattgagacgcgggtggtggatcataaaacctttgagggccgcagcccttttgagcatgaacttattcgcgcgctggatgatgccggtgtggagttggtctgtttggctggttttatgcgggtattgacccccctatttgtgcgccactatttgggccggttgatcaacattcacccctctttactgcccgcttttgcagggctgcatgtgcagcagcgggccattgatgcgggggtgcgttttagtggctgtaccgtccattttgtggaagaagaggtggatgcagggcctattatcgcccaagcggtggtacctgtactgcccagcgaccgtgctgaagatctggccaagcgcattttaacccaagagcaccggctctatccgtgggcggttaagctgtttgtggaggggcgcacccaggttaaggag

SEQ ID NO: 33651 - DNA, 1077 bp, magnetite-containing magnetic coccus
gaaaccctctccctggatctgggagaccgcagctatgagatcgtgattggtgaaaatgtgctggccagtttgggggcgcgtttaaaaccgatgctcaaaggtcggcagattggtttagtgaccaatgagaccgtagccccactctatgctgaaacggtcattcgcagcttggaagaggcgggttttcaggtcacactggtgattttgcccgatggcgagcgctataaaaattgggagaccctcaatctcatttttgatgcactgattggtgccaagtttgaacgccaaggggcgattgtggcgctggggggcggggtggttggggatatggcgggttatgcggcggcctcattactgcggggggtgccctatgtgcaggtacccaccacgctgctcgcgcaggtggatagttcggtgggggggaaaaccggcattaaccaccccttgggcaaaaacctgattggtgccttttatcaacccaagttggtgttgatggatttggcgaccctgcacacgctgcccaagcgggagttgttggcgggactggccgaggtgattaagtatggcattatctgggatgaggccctgtttcagcagttagaggagcaattagagcccctgctggcgctggattatggggtgttggctaaggtggtgcatcgttgctgtgtgatcaaggccgaggtggtggccaaggatgagcgggaaacgggggtacgggccttattaaatctgggtcatacctttggacatgcgattgaaaatttggcaggttatggtgaaaacctgcatggcgaagcggtcggtatgggcatgatgatggcggcgcacatggcctatctgcggggcatggtggatgccgctttggttgcaagggtgcgggctttgattgtgcgggcgggcctgccggagtttcccgcgcagcgccagccgttggcggcctatttggatgccatggggcgcgataaaaaggtggtcgcgggtaagatgcgttttgtattgcccacgggtatgggcgctgcggtagtggtggatgatgtgaccgatgccagtctggctcaggtgttagccccctat

SEQ ID NO: 33652 - DNA, 2089 bp, magnetite-containing magnetic coccus
agtctcatgagcgcccaaactctgtttgaaaaaatctggaatgcccatcttattcgtaccgatgaggatggaaccagtctcatctatattgatcgccatttggtgcacgaagtgaccagcccccaggcttttgaagggctacgcctagctggtcgcaaggtgcggcatcctgaggccacctttgcggtacccgatcataatgtgcccaccaaggatctggcgggggggattaaagatcccgtctccaagttgcaggtggatactttggcaagcaattgtcaggcgtttggcattaccgagtttggggtgggggatctgcgccaaggggtggtccatgtgatggcacctgaacagggtatctcactaccgggctttaccatggtgtgcggggattcccacaccgccactcacggcgcttttggtgctttggcgttcggcattggtacctctgaggttgagcatgtgttggcaacccaaaccctgatgcaaaaaaagcccaaaaccatgttgatccaggtagagggtgaactgcctgcgggcagtaccgccaaggatattatcctttacattatcggtaacattggtaccgcaggcggtaccggttacgtgctggagtttggcggtagcgccattcaagcgctctccatggaggggcgcatgacggtctgtaatatggccattgaggcaggggcccgggcgggcatggtagcggttgacgaaaaaaccatcgcttatgtgcagggtcgcccctacgcccccaagggggaagcctgggagaaggcggtcgcccagtggcaaacgctgaaatccgatgagggtgcgccgtttgatgcggtggtcacgctggatgcccgtaacatcgccccccaggtcacttggggcacttcgcccgagttggtagcccctgtggatggttgtgtgcccaatccgactgatgaacccaatggggtcaaacgcggggcgatggaaaaggcattggcctatatggggctgcaagcgggcacccccatgacagagattgcggtggataaggtctttattggctcttgcaccaacagccgtattgaagatttacgggcggcggcggtggctgtggcgggtaaaaaggtggctgcaagcatcaagctggcattggtggtacccggtacggggttggtcaagcagcaggccgagcaagaggggctggacaagatttttatggaggcaggttttgagtggcgcgaacccggctgttccatgtgtttggccatgaacaatgacgtgctggagcctggggagcgttgtgcttcgacctccaaccgtaattttgaagggcgccagggtaaggacagtcgtacccatctggtcagtcccgccatggcggcggcggcggccattgctgggcactttgtggatatccgtaacggctaaagcctctggcattgccgaggtcaaaccataagagaggacgaggttccctatggaagcctttaataccgtgaccgccattgtcgcccctttggaccgcgccaatgtggataccgacgccatcatccccaagcagtttttaaaatccatcaagcgctctggctttggccccaatctgtttgatgagtggcgctatctggatcaagggcagccgggcaaatccaatgaagggcgccccctgaataaggattttgtgctcaatctgccccgttatgccggtgcccgtattttactggcacgggataattttggctgcggctccagccgtgagcacgccccttgggcgttacaagattttggctttcgggtgattatcgcccccagttttgccgatatcttttttaacaactgttttaagaacggtatcttacctattgtgcaagaggcttcggtggtggatagcctgtttgccgaggtagccgcacagcctggctaccaattaaccgtggatctgcccgctcagcgcatcaccaccccatcggggcgcagcatcgcttttgaggtagatccctttcgtaaacactgcctgattcacggtttggatgatattggcctgaccttgcaacatgtggcagatattcaagcttatgaatccaagcacaaggggcaagccccctgggcc

SEQ ID NO: 33653 - DNA, 1005 bp, magnetite-containing magnetic coccus
tatgatgtggcagtggttggtgccagcggcaatgtgggccgcgaaatgctcaagattttagaagagcgcaactttcctgttggaaaagtctatgcgctggcttctgaacgctcggcggggagcaccattccctttaagggcggtgagttggtggtagaaaacttggaaaattttgatttttccaaggtagagattggccttttttcaccaggtgcgagtgtgtctaaagtccatgccccccgcgcagcggcggcgggttgtgtggtggtggataacacctcgtttttccgcatggatcccgatgtgcccctggtggtaccggaggtaaatcccgaggccattggcgggtataaaaagaagggcattattgccaaccccaactgttccaccattcagatgatggtggccctcaagcccattcatgatttggggaccattgagcgtgtggtggtaagtacctatcaagcggtttccggggcgggtaaagatgccatggatgagctgtttgaacagactcgcgccaaatatgtggagacgcttgaggttccgccgaaaaaatttcccaaagagatcgcctttaacttgatcccgcagattgatctcttcttggagaatggctacaccaaagaagagatgaaaatggtcaatgagaccaaaaaaattctggatcccagcattgctgtgaccgccacctgtgtgcgggttggggtgtttaatggccattcggaatcggtcaatgtgcagaccaagcataaggtgacggcagctcaagcccgcgaggcgctgcaaaagatggatggggtggtggtggtggatgatccttcccagggtcactatattaccccggcggaggcttctggtaaggatgccacctatgtctcgcgcattcgggaagatgagagccacgaaaactgcctgaacttttggtgtgtatcggataacctacgtaaaggcgcggcgctcaatgcggtgcagattgccgaagttttgatccgggattatctc

SEQ ID NO: 33654 - DNA, 633 bp, magnetite-containing magnetic coccus
tttagtggcaagcggccaggggttttggtggtgcatgagtggtggggtcttaatagctatgccaaaagccgcgcccgacaattggctcgtatgggctatatcgcctttgcagcggatatgtatggtgagggtcatgtgaccgagcacgccaaagaggcgaaggggtggatgcagcaagtgaccgccaatgtggaagggtggcgtcgacgggcggatttggccttggagcagctcaaggccgcgccacaggtagacacaacccgtttggcggcggtgggttactgttttggcggggggaccgtcatgcagatggcctatggtggctccgatctgctgggggtggcctcgttccacggtcctttaccccctgcggagaaaaaggattatgccaaaattaaggccaaaatctttgtggcccatggggatgccgatacctttgtgcccctagagcggctggaggcctttcggataggtttgaatgaggccggggcggattggcaactgttacgctacggtggagcggtacacagttttaccaatcccgctgccgatggtagctggatgcccacggtgaaatatgatgccaaggcggaccaccgctcgtgggcagcgttcacccattttttagatgag

SEQ ID NO: 33655 - DNA, 1329 bp, magnetite-containing magnetic coccus
cgtaaattttttggcacggatggtatacgggggatggccaacattcaccccatgacgccggatctggtgcttaaactgggtcgcgctgccgggcatgtgtttcgtgtgggggataagcgccacacggtgattattggcaaagatacccgtctatcgggctatatgtttgaatcggccctgctggcgggtttgacctctatgggcattcattgtcttcaggtggggccgttgccaactccggcgattgcctttttaacgcgggccttgcgggccgacgctggcattatgatctcggcttcgcacaatccctttcacgataatgggatcaagttttttggacccaatggcatgaaactacccgacgagttggagctggagattgagcgggtgctgctctctgacgaggatctgcccatgcccaccccccaccatttggggcgggcgcaccgtattgatgatgccttgggccgttatatagagtttgctaagaccagctttcctaaagatttacgcctggatgggctgcgggtggtggtggattgtgcccatggtgccgcctacaaggttgcgccggcggtgttgtgggagctgggggcggaggtggttacgttaggcaatcatcccaacggcaccaacattaacgatggggtgggctcgctctatccgcaagagatggtcaagcgggtgcaggaggtacgggccgatgtgggcattgcctttgatggggatgccgaccgtgtggtgatctgcgatgagcggggggagatcctggatggggatgtgatcctcgccatgtcggcgctggagatgaagcgcaagggggtgttgcgcggggatggggtggtggccacagtgatgtccaatttgggtttggagcgggctttggcggcggaggggctgacgttggcgcgcaccaaggtgggggatcgttatgtgctggagcatatgttggcgcatggctttaatttggggggtgagcaatcggggcaccttatctttttggaccacaacaccaccggtgatggtctgatctcggctttgagcgtgttggcgttgatgaccacccaggcccagccgctctccaagcttgccaatgtgatgcagcgggtcccccaggtgttgcagaacgtcaccatagcccgtggcagtgatcccatggatgacagccgggtggtggcggccattgccgaggctgaggcgcagttgggcacgcgggggcggattttggtgcgtaaatccggcaccgagcccaaggtgcgggtgatggtggagggggatgatacggcgcacattaccgcgctggccagtggggtgtgtgaggccattaag

SEQ ID NO: 33656 - DNA, 1062 bp, magnetite-containing magnetic coccus
atgcctctcgtttccatgcgccaactgttggaccacgctgctgaaaatagctatggcctgcccgcttttaacgtcaataatatggagcaggtgcgtgccatcatgcgcgcagccgatgagaccgatagcccggttatcctgcaagcctctgctggggcccgtaaatatgctggcgaagcctttttgcgccatcagattctggccgcactggagctctatccccatatccccatctgtatgcaccaggatcatgggcagtcccccgccatttgtcaggcggctattcgttccaactttagctcggtcatgatggatggctccctgcgtgaagatggcaaaaccccttccgattgggactacaacgtcgccaccaccgctaaagtggtcgagttctcccatgccatcggcgttagtgtcgagggtgagctgggtgtgcttggctccctggaaaccggcatggctggtgaagaggatggcgtcggtgccgagggcaaaatggaaaaagatgccctgctgaccgatcccgaagaggccgcccgctttgttaaagagacccatgtggatgctttggccatcgccattggtaccagccacggggcctataaatttacccgtaaacccaccggtgatattctggccattggccgtattgccgagattaatgcacgcatccccaatacccatttggtgatgcatggctcctcatcagtgccccaggagctgctggcgatcatcaatgagttcggcggtgagatccccgaaacctatggtgtgccggtggaagagattgtgcgtggcatccaacatggtgtacgcaaaattaacgtggataccgatctgcgtttggctatgactggtgccattcgtaaatatttccacaagaatcccagcgcgtttgacccgcgcgggtataaccgtcctgcggaagatgcggcctatgccgtatgtaaggcccgttatgaggccttcggtgccgctggcaatgcctctaagatcaaagtgatcaccatggaggatatggccaagcgttacgcttccggggagcttgaccccaaggtgaat

SEQ ID NO: 33657 - DNA, 1284 bp, magnetite-containing magnetic coccus
atgagcagtatcgtagagatccatggtcgtgaagttattgattcccgtggcaaccccactgttgaggtggatgtttataccgaagatggcggttttggccgtgcagcggtaccgtcaggggcctccacgggttcccgcgaagcggtagagctgcgcgatggggataaaagccgctttttgggcaagggtgtgcgcaaggcggtggatgctgttaataccgtcttagccgaggtggtgttgggtatggaagtggctgatcaaaagggtattgatgccgcgatgatcgccctggacggaacccacaataagagccgtttgggtgccaatgcgatcctgggtatctccatggcggtagccaaagcggccgccgatgagtgtgacctgccgctgtaccgctatttggggggtaccaacacctccttgttgcctgtgccgatgatgaacattatcaatggtggtgcgcatgcggataacaatgttgatattcaagagtttatgattatgcctgtggccgcgacaagctgcacagaggcaatccgtatgggggcggaggtctttcatagtctcaagaaggtgctcaaaagcaaggggctcaataccgccgtgggtgacgagggtggttttgcccccaacctgggttccaatgaagaggccttgaaggtgattgtggaggccattgaggctgcgggttacaagcctggtgaagatatcaagctggcattggattgtgcctcctctgagttttataacaaagagaccggtaactatgatttgacgggtgaaggtcgtgtgttgaccaaacaagagctggtcgccttctatgaggatctggtggcaaaatatcccattatctccattgaagatggctttgatgagagcgattgggatggctggaagctgatgacagaggctttaggcaataaaatccagttggtgggtgatgatctgtttgtgaccaacagcaaaattttggccgaggggattagcaagggtattgcaaactccattttggtgaaggtgaaccaaattggtactctgaccgaaacctttgaagcggtcgagatggcgcagcgggccggttacacggcggtgatttcgcaccgttccggtgaaaccgaagatgccaccatcgccgacatcgccgttgctttgaatgcgggtcaaatcaaaaccggttccatgagccgttcggaccgtattgccaaatataaccaactgatccgcattgaggaggagttgggcggcatggcccgttttgagggtatgaaggtgttttacaacctg

SEQ ID NO: 33658 - DNA, 1251 bp, magnetite-containing magnetic coccus
atggataaaattctcgttcgcggtggcaacaccctcaaaggcaccatccccatcagcggcgctaaaaacgcctgcctgccagagctggcggctaccctgctgacagaggataccgttaccctgcgtaatgtcccccatctgcgcgatgtcaccaccatgctcgaactactcgggcaacatggtgccgccatcaccattgatgaaaaacttggggtttccatcgactgcaaatccatccaaaacaccatggccccatatgacttggtgcgtaccatgcgcgcctccgtcctggtcatgggtcccttggtcgcccgctgcggtcatgccgaaatctccctgcccggcggctgcgccatcggctcgcgccccatcaatctacacctacgcggcctcgaaatgatgggtgcccatgtcaccctcgaagatggctatgtgcgcattaaagcaggccgcctaaaaggggcacacatcgtttttgatctggtcaccgtcaccggcaccgaaaacctgctcatggccgcgaccctggccgatggcatcaccattctcgacaacgccgccgccgaacccgaagtggtggacctggccaacctgctcatggcgatgggggccaaaatagacggtgccggtacccgtaccatcaccatcgaaggggtcaaaaacctacacggaacgtcccacgatatcctgcccgaccgtatcgaaaccggcacctttatggtcgccgcagcggtcaccggtggcgacatcaccatgaccggcacctaccccgccctgctggaagcccatatcgccaaaatgcgcgaagctggctgccaaattgacgagatggatcgagccatccgcgttcgtgccgaagccggaaccctgcgtgcggtggatattaccaccctgccccatcccggttttcccaccgatctgcaagcgcaaatgatggtgctgctcaccgttgctaaaggggccgcacagatcaaagagaccatctttgaaaatcgctttatgcatgtctccgaactgcaacgcatgggggccgatatcacggttcaaggcaataccgccatcgtgcgtggcgtgccccaactgcggggtgctccggttatggcaaccgatcttcgggcctctgcatcgctggttttggcgggcctctgtgccgagggcgaaacccttatctcacgggtctaccatattgatcgtggttatgaacgcatcgaagaaaagcttaaagctttgggggcagatattcagcgcctg

SEQ ID NO: 33659 - DNA, 1128 bp, magnetite-containing magnetic coccus
gccgagtccagcaaccgcaccaaaagtatgtttttggccgccatgagccatgaaattcgcacccctttgcatgccattaatgggttggcggagctgctggagcgggaagagctgaaccaagatcaaaagcactatgtgcatattatctaccgggcgggttcacgtttactggcgttgattaacgatattttggatttttcacgcctagaggctgggcggattgaattggagtccctcgttgttgaagtgcgccccttggtgcatgaaaccatggagatgctctctttcaaagccaaggataaagggctggctttgcagtggacgctggagccccaagtgccccagtggatgatgagcgacccgacccgtttggggcaggtattggttaatctggtggggaatgcgattaaatttacccagagcggcgaggtggctctcgaaataagcgtggctgaacagcagctgtgcgtgatggtgcgggataccggtttgggtattgcagaggataaacagcagattatctttgagccgttttcccagagtgatatcaccatcagccgacgctttggcggcacaggtttggggctctccattaccaaacagattgtggcattaatgggggggaccatttcggtacagagccgtttgggggagggtagccgtttttatgtcaggctgccattaaaggaggtcgctgccggggatctgctggcggctcagcaggcgactcaggaggtagaggttatcaccctgcctacgttaaacatcctgctggcggaagataccctggagaatcgggtactgtttcgagcctttttaaaacattgcccctgggcgattgatgaagccaaggatggtgccgaggccctcattaagtttaccactggccactatgatctggtgcttatggatgtggagatgcccatcatggatggttatgcggcaacccaggcgatccgtgcctgggaacgtgcccaacaacgtgtggcaacccccattttggcccttacggcgcatgccttgtcggagtatcggcagcagagtattaatgccggttgcaatggtcatgtggtgaaaccgttgggtaaacgggatttgatcgaggccattcgacaggccgtgacgcca

SEQ ID NO: 33660 - DNA, 2253 bp, magnetite-containing magnetic coccus
ctgcgcaccgcattggaggagagagagaaggccctacagtgtgcagagcaggccaacttggcaaagagtgattttctggcgaatatgagccatgaaattcgcacgccgctgaatgccattatcaacctgagctatcttatattacagacgccgctgacgtcaaaacagtcgaattatctggaaaaaattgaatcggcagggcgtactttgctcggggtaatcaacgatatcttggattattccaaaatcgaggcggggcatcttgtgctggatcacgtcgccttccaattagatgatgtgatcagcaatgttgccaacatcgccattgcccgcaaagaggataaggatctggacctgctctatcacgtgacgcccagcacacccacacagatgatgggcgaccccatgcggttgggtgccgtgctgatcaatttgaccaacaatgctattaaatttacagagcatggcgaggtggtcattcgggtggatgccaagcagcagcgtgagcagcattatcttctccatttttccgtgcaggatacgggtattggtatctctgctgagcaacaaaagcgcttgttccaaagcttcagccaggcggacagctccatttctcgccgatatggggggaccggtttagggttggcgatcagtaagaaattggttgaactgatgggtggcacactcagcttgcagagtgttgttggtcagggcaccacgtttgaattcaccattcccttgcaagccgttgagatcaagcctgatgaggtgccctctgccaccagcctcaatggtgtgcgcgtgctggtggtggacgataatgcaacagcacgggagattcttgaagagcaactaaacgcgtttcatatggaggtgtgcagcgtcgcttcgggcgaggcggcgttggatgttttacaccatgagccccgcccagagttgatcttgctggatgatcaaatgaccgggttgagcggggtagagacggtgcggcggctacgcggccaaatcaatctggcgcgtatacccgaggtgcttatgctgtcggaccatggccgagaaaaggtgcgtcaggaggccgaggcgcttggcataacccacttcatgtgtaagcccatttcgccctcggtgctgttggagacactgcttgaggtgcgtggtgagtgcttgccgcgcaagcagcgctcgcgtcgtccccttatccatccggagcttagggatggtctaagcgccatcgcgggggcgcgtgtcctgttggtggaggataatgcaataaaccaggaaatcgccatagagttgttaggctatgccggggtagcggtcacacctgctgccagtgggcagtcggcactggacctgctcaacagcgaggccccttttgatctggttttaatggacattcaaatgtccgatatggatggctatgcaaccacgcgtcagttgcgccaggacccccgttttaagacgctgccggtggtggcgatgacggcccacgccatggtaagtgaccgtgaaaaggctttgcagttgggcatgcaggaccatatacccaagcccatagaacccgagcaactttttgcagcactggtacaatggatcaaaccgcgacaggccaaccagcaaccgctcaatctctctccgcaagcccctaggccgctagaggagatggtcttgccagagctgaccggtgttgatgtacaagcaggtttggccagggtggggggcaatgcggagttgttgcgcaaactgctggttcggtttgcccaggagaacagtgctataacgcagaaaatttctaatctggcgacggagaacccagctcaagcgggagagttgatccattcatttaaaggggttgctggaaatttagggatgcctcaggtggccaagagtgcacgcgctgtagagttagctttaaagggttctgaatctcttgatgcggccttgcatgggctcacgcgggttttagatcccattttaaaagggttgtctaagctggataccacgcttgaagaggcctattcagaagcccagcctttggaacctgcgcgggtattgtcgcggattgaggagatgtctgccatgttggaacaagattttgctgtggcacaacatgttcaggggcaactgcaaacgctgttacaacagagccgatacgcccataaattccagcaggtagtggcggcgatggatgaatttgatacggaccgggtgcaagctctgcttacggaaatcgctgggcaattgagccagcct

SEQ ID NO: 33661 - DNA, 1233 bp, magnetite-containing magnetic coccus
ctctccggcaccatccgccccgccgccgataaatccatctcccaccgctccgtgatctttggcgccctggccgaaggcgaaacccacgttaaaggcatgctggaaggcgaagatgtgctgcgtaccatcaccgcctttcgtaccatgggtatctctatcgaacgctgcaacgaaggtgaataccgcatccaaggccaaggactcgacggcctaaaagaacccgatgacgtgctggatatgggtaactccggtaccgccatgcgcctgctgtgcggcctgctggccagccaaccctttcactctatcctcaccggcgatcactccctacgcagccgccccatgggccgcgtagtgcaacccctaaccaaaatgggcgctcgcatccgtggccgcgacggtggccgcctggcccccctcgccatcgaaggcactgaactggtacccattacctacaatagccccatcgcctcggcccaagtgaagtccgccattatcctggccggactcaataccgccggcgaaaccaccatcattgaacccgccgtcagccgcgaccacaccgaacgtatgctcatcgccttcggtgccgaagtgacccgcgatggcaaccaagtgaccatcgaaggctggcccaacctgcaaggccaagagatcgaagtgcccgccgatatctccgccgccgccttccccatggtggccgcccttatcaccccaggatctgatattatcctggaaaatgtgggtatgaacccaacccgtaccggtattctcgacctgctcctggctatgggcggcaatatccaacgcctcaacgaacgggaagttggcggcgaacccgtggccgacctacaggtgcgctactcccaactccaaggcatcgagatagaccccaccgtggtgccccgtgccattgatgagttccccgtgttttttgtagccgccgccctcgcccaaggccaaaccctggtgcaaggcgccgaagagctgcgcgttaaagagagcgaccgcatcaccgccatggccaacggtcttaaagccctaggtgccatcatagaagaacgccccgatggcgcacttattaccggaaatcccgacggtctggccggtggggccagcgtagactcctttaccgaccaccgtatcgccatgagcctgctggtggccggcctgcgctgtaaagagtccgtattggtgcaacgctgcgataatatcaatacctcctttcccagcttt

SEQ ID NO: 33662 - DNA, 1230 bp, magnetite-containing magnetic coccus
cttatcgtactaaaatttggcggcacatcggtgggatccattgaacggatccgcaatgtggcgcgtatggccatggccgaacagcaggcaggcaaccaggtggtggtggcggtgtcggccatgtctggtgagaccaaccggctggtggggctggtggaagatctgacccagttctataataaacgtgaatatgacgtggtggtctcggcgggcgagcagatctccatcggtctattggcgacggccattgaatccatggggcagaaggctaaatcctacctgggttggcaggtgcgctttattaccgatggttcacacagcaaggcacgcatcaaagaggtggaggcctttcgcattcaagcggatctggatgccggtgccatcgttattgtcgcgggctttcaaggggtggacagtcataacaacatcaccaccttggggcgtggtggctcggacacctcggcagtggcgctggcggcggctttgaaagccgaccgttgtgacatctataccgatgtggatggggtctataccaccgatccacgcattgtgacgaaagcccgtaagatggatcgtatctcttacgacgaaatgctggagttggcctcgttgggggccaaggtgctgcaaactcgctctgttgaactggctaagaaatacagcgtacctgtgcgtgtgctctcctcgctggagcccggtagcggtaccatgttgacgaaagaagaggataccatggaaagcgttgttgtctctgggctggcgtacgataaaaatgaggccaaaatcaccatccttggggtgccggataagcccggtgtggcggccaatctgttgggccgtttgggcgatgccaatatcaacattgacatgattgtgcaaaacgtctctccagcgggggatgccacggatatgacctttaccgtgcccaaggcggattttccccaggcgatgaaggttatggaagatgcggtcaaggatgtcggtgcccggcaactgcaaggtaatagcgatattgccaaaatttctgcggttggggtgggtatgcgcagtcactcgggcattgcgcaaaaaatgtttaaggcgctggccgacgaggggatcaatattttgatgatctccacctcagagattaaaatttcggtggtgattgaagagaaatataccgagttggcggtgcgtgccctgcacgatgcgtttgaattggaaaaagatccaagcgaccgcatcaac

SEQ ID NO: 33663 - DNA, 1623 bp, magnetite-containing magnetic coccus
attcagaccaagatcaccaccccttttgacgatcaaaagcccggcacctccggactgcgtaaaaaggttaaggtgtttcaacagcccaactatctggaaaattttgttcaatccatctttgacaccctggaggagtttcagggcaaaaccttggtcttgggcggggatggccgctaccacaaccgtgaagccattcacaccatcctgcacatggccgccgccaatggctttggtaaggtcttggtggggcgcggcggtgtgctctctaccccggcggtctcccatttaatccgcaaatacgacgcctttggtggcatcgtgctctcggccagccacaaccccgccgggcctgatggggattttggcatcaaatataatgtctccaacggcggccccgcccccgagagcatcaccaacgccatctttacccacagcaaagcgatcacccaataccgcatctggtcggataccgaggtggacctagactatctgggggattctgagatcggcaacatggtggtgcgggtcatcgacccagtttatgactatgctcaattgatggaagagctgtttgattttgaagccatccgtgctctcctaaagggcggctttcgcatcttgtttgatgccatgcacgccgtcaccggcccctacgcccgggagattctggaaaaccgcctcggtgccccagcaggcaccgtgctcaacggcgtggtcaaagacgattttggcggcggacatcccgaccccaacctgacctacgcagccgatttggtggcacgtatgtgggccgacgatgcccccgattttggcgccgcctccgatggcgacggcgaccgcaacatgattttgggacgtaaattttttgtcacccccagcgactccctcgccgtgttggccgaaaatggcacctgtgcccccggttacgcccggggcattgtgggggtagcccgctccatgcctaccagccagtcggtggaccgggttgctgagaagaaaaatttcgcctgctttgaaacccctaccggctggaaattttttggctcattgctggatgccggcaaagccaccctctgcggtgaagagagctttggcaccggctcggaccatgtacgcgaaaaggatggtctatgggcggtgctcttttggctcaacattttggcccatcgcaaaacctcggtcgaggccgtggtgaaggatctgtgggccatttatggccgcacctactacgcccgccacgactatgaggatgtggattccgctgcggccagcacactcatgagcgaactacgcgccaactttgccaccttaaccggccaagtgcatgagggcttaaccatcaaactggccgatgagtttggctacaccgatcccgtcaatggggagagtaccatcaagcagggggtacgcattctgtttgtcgatggcagccgcattgtctttcgtctctccggtaccggcacctcgggggctaccctgcgtatctatctggagcgctttgagcccaaccccagccttcagcacaaggatgcccaagaggcgctggccgacctcattcgcattgccgataccttggcgggcatcaaacagcacaccgggcgtcaggcccccaccgtcatcacc

SEQ ID NO: 33664 - DNA, 906 bp, magnetite-containing magnetic coccus
cagagccccatcgctgttgaagttgccggtattgccatgcgtacccccctggtgctgctctcgggctgcgttgcctttggcgaggagctgctcaccctggaagggtttgactttaaggccatcggtgccatctgcctaaagggcaccactttagagcccaaacggggcaaccccccgcaccgactggccgaaaccccttgtggcatgctcaacgcgatcggcctgcaaaaccccggcgcccgcgccgtggtggatgagattttaccccgcctctgcgcgcagatcgacaccccattgatcgccaacatctctggctccaccaccgagcagtatggcgaaatagcgcgtatctttgatcaaagcccggtggccgccatcgaaattaatatctcctgccccaatgtcaaagagggcggtattgcctttggttctgatcctgatatggccgccgccgtggtggaagaggtgcgccgagccaccaccaaacccatcatcaccaagctctcccccaacgtcaccgacattaccacagtggccaaacgggccattgaggccggtagtgatgcgctgtcggtcatcaacaccctgatgggtatggccatcgacctcaaaaagcgccgtcccgtgctaggcaacctacaagggggactctctggccctgcggttaagccggtggccctgctcaaggtgtggcagacctatcaactggcccgtcagcaccagatccccatcatcggccaagggggtatcgcctcggctgacgatgtgcttgaattttttctggtcggggcctccgccaccggcctctgcaccagcctgtttaaagatcccctgctccccatgcgcatcgcccaagccctgcaccagggtgttgccgaacagggggtcacaaacattgcccagctc

SEQ ID NO: 33665 - DNA, 1428 bp, magnetite-containing magnetic coccus
gaatttacggaactccccattcccgaaccggttttggccggcatacgcgactgtggttttacccagtgtacccccattcaagccttaactttgccactggctttggccggtaaagatgtcgctggacaagcccaaaccggtaccggcaaaaccgctgcttttctgattggcgccctctctcatctggtcacacacccccgcaaacatgggaaacccgctggtcaaagtctgccgcgcattctggctgttgcgcctacccgcgagttggtggcacagatcgagtcggacgccaaactgctcaacgcccacacccaatttaagttgcactgtgtctacggtggggtggattatgaaaagcaaaaacgcatccttatggaggaggatgtggaaattttggtgggcacgccgggacgtttgatcgactattttaagcaaaatgcctacggcctcaaaggggtcgaagtcctgatcgtggatgaagccgaccgtatgtttgatatgggctttattgatgatctgcgctacatgttgcgccgcttgccccactatagtgagcggctttctatgctcttttcggcgaccctctcctaccgtgcccaggagatgtcttacgaatatatgaacatgcccgaggtgctcagcaccacggtggatgtgaaaacggcggagcgggtggagcaaaagctctaccatgtgagcggtgatgagaagattgcgctcttggtggggttgctgcgggatattttgcagcatgagggcattgatttgagccagccagccatgcttgagttggatgacaacggtgatgaaatcgttgaacccaatggggccatgttgagtggcgatgagcccagcaccgagagtgaaccctttgtgccccacccggatgatctggataccgaggatgccgcccgtgcagccgaggcggccttggccaacgcacaaaaaaccccaccggggcgtagcatggtgtttgtcaataccaagcgggctggggagcgggtggagcgttggttgaaggccaatggcattcaagcgggttatctctctggggatgtaccgcaaatgaagcgcctaaaggtgctcaagcggtttcaggatggcgaatatccggtcctgattgccaccgatgtggcgggtcgtggtctgcacattgatggggtgacccatgtgatcaactatgacctgccggacaatgccgaagattatgtacaccgcattgggcgcaccgcccgggccggtaatcggggtgatgccattgctcttgtggatgaagagggtgcctactcgttagaagcggtacaggcctatattggcatgaccatcccgattgtctgggctgaggatgatctgtttgccgatctggtgcgtccgccaccacggccccgcagcgagcgggatatgcgtcgtaccggtggtggccgtagc

SEQ ID NO: 33666 - DNA, 1626 bp, magnetite-containing magnetic coccus
gagcagctgctgcaagaacagacccgcgtgctgatgcagcgggaagaggagcttaccgccagtcgcttgaaggccgatcaagcgaaccaggccaagagcgagtttttggcgaatatgagccatgagatccgcaccccgatgaatgccattatcggtatggcagatctgctgctggaaaccgagttgaataaggatcaacggcgttatgtgcaaattttcgcccgggcgggggcgtcgctgttagagcttattaatgatgtgttagatctctcaaaggtggaggccgataggctggagttggaacatcgaccttttgatctgtgggcattggtcgagggtgcggtagaaatttttaccctgcgtacccaagaaaaaggggtcaaactggattttgagctctcggcacgcgcaccacgctatgtgattagcgaccagaaacggcttcggcagatcttggtcaatttgctgggtaatgcggtaaaattcacccaatcgggtcaaattcaactctgggtggatgtgagagattgtgaagatgcaggcggttggctctattttcgcgtgcaagatagtggcattggtatgagcaaagcgcagcaaaagtcgatttttgagccctttgtgcaagcggatgcctctgttacccgtcagcatggggggacaggcttaggtttggcgatttgtaaaaagttggtggagctattatccggggatatctggttggagagcgaactcggccagggcagtcgttttcattttaccgcacgttttacccataccgctctggtggctgaaagtgagcgagcgttcacgtcagccaaactgcacgggcgccatgttttgctgttgggcagtcaaccgcaaaaccgagttttgctggaatctgtgttacgccgtgccggctgccagattaccacggtcacgcatcaggcgcagttggcgggccatttgttggagccgccagcgggattgcgcccttttcacgcggtgctggtggactgttacaatagcatggcgcgtgttcaccagcagattgcctcggtccgggccaatggcagcgttatgcccatggtgctgttggtgggtgaagcgcggcaagaggatatccaaatagcggcagatttaggggtattgctgctggaaaggcccgtttcgcacggtcgcctgcttgaggcgctgggggcgacgatggagcagggtgaagcagcgctattatcttcttctctgtcaccgacagccgccattgagatgcttaaacaggtgccgcttaaaattctgctcacggaagattcggtggacaacgccgtactgtttaaagcctatttaaaacagtatcccttagaaattacccatgccgccaatggggctgaagcactcacgctttttgagcagcatcactatgatctggtctttatggatttacaaatgccggttatggatggctacagtgcaacccgtgccatgcgtttttttgaaaagcagcagcggcgaccgcccacccctatcttggccttaaccgcctatgcattaagtggtgatgcagataaaagtcgggatgttgggtgtgatgcccatttggttaaacctattaaaaaattggaattattgtcttcaattgcccaatat

SEQ ID NO: 33667 - DNA, 891 bp, magnetite-containing magnetic coccus
gccctgttggtcgaagggttggttaaacggtataaagggggcattacggccctcgatggggtggatctgcgggtagagcctggagaggtgtttgccattttgggtcccaatggtgcgggaaaatccaccttaattaatattgtggcgcaaataaccactgccacggccggtgcggtggcggtctttggtaccgccttgcagcaagatccactggccaccaagcggttggttgggataaccccgcaagagatcgctttggaccccttttttacggtgcgtgaagtactggtcaaccatgctggttattatggctttcgcgatgcctcagcgcatgtggagcgtttgttggaacggctgggattggccgagcatgcgcataagcgtacacggcagctctctgggggaatgaagcggcgtttgacggtggcgaaatccctggtccaccaaccccccttgattattctggatgagccgaccgctggggtggatgtggctctaaggcgggatttgtgggcctttgtcagtgagctgcatcaagagggagttacggttattttaaccacccactacctggaagaggcgcaggcgttggcggggcgggttgccattattaaccatggccgggtggtgcgttgtgcgcccatgagccagttgttgaacagctttggcgggcgtcgtgcggccattcagtggcaggggggggtggctaagcctgctcagttgccggtggggatgcagtgggatgtggccggtgaagcgttgtccggcaccgtggatgagcaagccttgccacagttgttggcttgggcggcagagcatggccatggggtgcgggatttgcgtttggagcctccccggcttgaggatgtttatctgcaacttaccgcagag

SEQ ID NO: 33668 - DNA, 603 bp, magnetite-containing magnetic coccus
aaaaaaattacgatggttgccccccaagaggccctgcctgggcgtggaatacccatgccggtagaggatcaacattgggtgttgaaaacccctatgcgtgggccatggccggggatgcagcaactgctggtggggatgggctgtttttggggtgcggaacggcgcttttggcagcagccaggggtacacatgacggcggtgggttatgctgcgggttatacccccaatccgacctatgaggaggtgtgcgccaataagaccggccataatgaggtggtgttggtggtgtatgatccgcaacagaccgatttagagcggctactgcgcctcttttgggaggcgcataatccgacccaggggatgcagcagggcaacgatgtgggtacgcaataccgttcggggatctatctggcccatgaggcggagctggccctggccttggcaacccgggatgcctatcagcagcgtttgagtggtgcgggtctaggcaccatcaccacagagattttacccatgccccccttttattacgcagaagcgtatcatcaacaatatttggctaaaaacccaggcggctattgcgggctgggtggaactggggtg

SEQ ID NO: 33669 - DNA, 1236 bp, magnetite-containing magnetic coccus
tccagcagcatcctgcactgctcgttctgcggtaagagccagaacgaggcgcgcaagctgattgccggcccttccgtgtttatctgtgatgagtgtgttgatctctgtatggagatcattcgtgaagataagagcgatcagcttgagaaaaagcggggcggtgtacccaccccgatggagattaaaagcaccctggacgattatgttatcggccaggataacgccaagcgtaccttggcggtggcggtctataaccactacaagcggctggagagtaacgatacttcagcagatgtggagatctccaaaagcaacgtgttgatgatcggtcccacgggttcgggtaaaacgctgttggcgcaaaccctggcgcgcctactggatgtcccctttaccatcaccgatgccaccaccctgaccgaggccggttatgtgggggaggatgtggagaacattatcctgcgcctgttacaggcggccgataatgatgtggaaaaggcccagcggggtattgtttttattgatgagattgacaaaatctcgcgtaaatccgacaacccatccatcacccgtgatgtctctggtgaaggggtgcagcaagcgttgttgaaaattattgaaggtaccgtggccagcgtaccgccccagggtggtcgcaagcatccccagcaggagtatctacaggtcgataccaccaatatcttggtgatctgtgggggggctttcaatggtttagagaaggtgatcgagaagcgttcgagcaaacatcatggtattggttttggggccacggtacgcaagaacagcaaagaggagagtgtcaacgtcctgcttaaagagctggagcctgaggatctgctggcctttggtttgattcccgagtttgtggggcgtctgccggtggtggccaccctggaagagctgagcaaagaggcgttggtgcgtattcttacagagccgaaaaatgccttagtaaaacagtaccaaaaactgttggagatggagaacgtcaagctcacctttaccgatggtgctttagaagcgctggcgcaaagggccattgagcgtaaaaccggtgcccgtggtctgcgtgcactgctggagtcgacgttacttgacatcatgtttgagattccttccaagcaaggggtgcgcgaagtggtgatcaaccgcgaagtggttgagaagcagatcgagcccctgctgatctatgctgaagaagccttggaagccaat

SEQ ID NO: 33670 - DNA, 2328 bp, magnetite-containing magnetic coccus
gtgcgtatgccggtattaccgctacgggatatcgttgtttttccccatatgattgtgcccctgtttgtggggcgtgatcgttctattcgcgcgttggatgcggttaccgcgaccaatgaagaggatcgacgtatccttttggtgacccagaaggaggcctcaaccgacactccgtcggaagaggagctctacacgatgggggtcgagggttcgattctccagattctcaagctccctgacggcacggtaaaggtgctggtggaggggctacgacgtatgcgggtacggcgctatattcagagcgaaccccattttgaggccgaggctgtgcccctacagccagccagctacagcgatgcggaagcacgggccttaatgcgctcggtgatcacccagtttgagcagtatggtaagctcaacaaaaaggtgccgccagaggtattaatgacactgcaatccattgaggatccggtgcgtttggccaatacggcggcgtcgcatctgaccctcaaggtctctgacaagcagcagttgttggaggtggatggggtggtggaccaactggagcagctctatcttctgttagaacgggagatagaggtgattcaggtggaaaagcgcatccgtggccgggttaagaagcagatggagaaaagccaccgcgactactatctgaatgagcagatgaaggcgattcagaaagagttgggggatgagggttcggagaaggatgagatcaccgaactgaccgaaaagatcgaagcagcgggtatgcccgctgaggttaaaaagaaggccgatggtgagcttaaaaagcttaagcagatgtcccccatgtcggctgaggccacggtggtgcggacctacatcgactggttggtttcgctgccctggaacaaagagagcgagctcaagcatgaccttacagaggccgagaccatcttggaagaggatcatgatggtctgaagaaggtcaaagagcgcatattggagtatctggcggtacagaagaaagtgggcaagatgaagggtcccattctctgtctggtgggaccgccgggggtgggtaagacttcgctggcgaaatccattgcacgggccacggggcgcgagtatgtgcgtatttcactgggtggggtacgggatgaggcggagattcgcggtcatcgtcgcacctacattggttctatgccgggtaagattattcaatccatgaagcgggcaggcacgcgtaatccgctgtttttgcttgatgagattgataaggtaggctctgactaccggggtgatccgtcgtcggcgttgttagaggtgttggaccccgaacagaatgtggcctttagtgaccactatatggaggtggattacaacctcagcaatgtgatgtttattaccaccgccaacagcctgaacattgcgcgtcccctgttggaccgtatggaggtgatccgtctggcggggtataccgaggatgaaaagctgcgcattgccacccgctatctgattccccgacagatggaagagcatggcttgacggagcaggagttgagcatttcgtcgggtaccattaccgatattatccgctactacacccgggagtcgggggtgcgtaatctggagcgggaggttggggcgttgtgtcgtaaggcggcgcgtattttgttgacggaagagaatcgtaaaaaggtcaccattaccgcccagagtttagagaaatatttgggtacccggcgtttccgttttggtatcgcggaagaggcggacattgtcggggtgaccacgggtttggcgtggaccgaggtgggtggggagatcctcaccattgaagcgacccatctggagggcaagggctcctttaccatcaccggtaagttgggcgatgtgatgcaggagtcggtgcaagcggcgatgacctgtgcccgcagtatggcggaagggtggggcattaagggcgagtttttccagaaacgggatttccatatccacgtgccagagggtgctacccccaaggatggcccctcagcgggcattgctttatgtacgacgctggtcagttgtatgaccggtattgcggtgtgcaaagatgtggcgatgaccggtgagatcaccctgcgtggtcgggtgttgattatcggtggattgaaagaaaagctactggcggcccaccgtgcaggcattcgacgggtgttgatacccgaggataatgtgaaggatctaaaagagattcctcagagcatccttaaagatctggagatccatccggtgcggcatgtgagcgaagttttaaaactggctctggtccgcatgccggaacaggtggatgtggtg

SEQ ID NO: 33671 - DNA, 1152 bp, magnetite-containing magnetic coccus
aagcttcttaagtatgttggatttcccacctccaaagtgctagggccagaagcctcagccggcgaactacagtccatgattgacgaggctggtggtttgctggttaagccaatttttaaaggtggtgtaggcaagaaaggcaaggccggactacttggtattgccaaggatgtgcagaccgcactcaaagagaaggaacggctctattttgcagagcatcagcacggtaatgcctatgccaaggcagagggtgtgacctttgaaagctttgtggaagccaagtatgaggtctacttttccattaccgatagcaccaaatatcgggcacccacggttaccatcacccaccatggtggggtggatatcgaagagctccccccggagaagatcgccacggtgccctttgacccactgaccggttttaaaggttttgtggtctctaatgcgctaacccgtttgggtgcgcccaatgagattatcagtccactggtacaaaatctgcccaagctgtgggatctctaccacaactatggcatgaccacgctggagctgaaccccattcgtatgatgcccgatgccagtggccgtctggtcccggtggcgtgtgactttaagtgctcctttgatggggatgatcccaatgttgagcgtcttaatctgcccaccgatctggatatggcggactactccaattttgagatggaggtcaaccaactgcgcacctatcaggggcagtcggacgtgtacgtgatcaatgaccaaggctctatcaccgccatgacctttggtggtggtgccaacgcattggtaacggagcaactgggtgatcgggccaccatctcttcggattttggcggcaatcctccctatcaaaaaatgtatgacatcagccgtatcaccatgaaatattggattaaacagagcaacgttttcttcattatcggtggtaaggccaacaataccgatatctttgagacgttccggggtatggcggatgcgttgcgggaatatttcggcgaatatggcccaacgccactctatgtggtggtgggtcgtggtgggcctaacctgatccgcggtatgggttatttgaaagataccctggacgcactgggtctgccctatcgcttctttggctatgattccgccatg

SEQ ID NO: 33672 - DNA, 834 bp, magnetite-containing magnetic coccus
aaaggggtgtcggagtttccttattatgtgggcattcactctctggccgaaatggcgaccaaggaagatcgcgtctgcgttctgaacatccttggtggcgagagtaagagtgttacccccatcagccatgcctattcgggtggcaacatcgtctgcggtacccagccagggcgttccggcagcaccctcaaaacccctgctggggatatccctgtctacagcaacgtgctggaggcggtggaagcgggtcatgtgtttaatgcggcggtggtgtatgttcccccatcgggtgtaaaagatgccgtcattgaggcggttcgtgtaagccccaaccttaaaaaggtggtgatcctgaccgagaaggttgcggttaaggatgcccgcattattcgcgcttattgccaaatgcgtggtgtggatgttctgggtgccaactgcctgggtgtggccgatgcacacaacaaggtgcgtattggtggggctttgggtggggcgaatccagaagagtcgttgattcctggttccgtttccatcttttccaactcgggtaactttaccaccaccattgcggtctatctggccacggctggttggggcaccaccacctcggtgagttcaggtaaagatgtttatattcactatgcggcacctgaatatacctatgctatgcataatgatgaccgcaccaaagcggcggtcttttatgtagagcccggtggctattatgaacatgatctggtgtttaagaagccggttgtagcctgtgtggtaggccgttggaaagccaaactgacccgctcttgtgggcatgcgggtgccattgccggttccggc

SEQ ID NO: 33673 - DNA, 1269 bp, magnetite-containing magnetic coccus
aatgtagtgattgtcggcacccaatggggtgatgagggtaagggtaaaattgtggatctgctcacggagcaggccgatatggtggtgcgtttccaaggagggcacaatgcaggccatacactggtggtggatggcaaaaaatatattctgcatctcatcccatcgggtatcatccgtccaggtaagcagtgtgccatcggcaatggggtggtgttggaccctgcggcactgctggccgaaatggccaaattggccgaagtcggcgtagcgatctccccggagaacttaaagatcgctgatcgtaccaacctgattttgccctaccataatgcgctggatcaggcgcgggaaaagaaaaagggcgaagagaaaaaaattggcaccacaggccgaggtatcggcccctgttacgaagataaatcagcccgtcggggtattcgattggtggatctgtataacccggcactgtttgaagagaaactgcgggaaaatctcgatctggtgaactttctgctcaaaaattattatcacgaagagggctttcaactggccgatattcgtgatgactatctacgcatgggggatcaactggccccctattgtgaagatttggcaccttggctggagcaggcccaggccgagggtaaaaatattctgttcgagggcgctcaaggtgcgttgctggatgtggattttgggacctatccctttgtaacttcgtccaccaccaacgcatcaggggcctgtagcggcagtggtgtagcaccgggtaagttagactatgtgttaggtattgtgaaagcctatacgacccgcgtgggcagtggtccattccctacagaacttgagtgcgccgacggtcaatatttggccaaaaaagggcatgagtttggcgcaactaccggacgtcctcgccgctgtggctggtttgatgccgtggtggtgcgtcactcggcacgggtaagcggcctcaatggcatctgcattaccaaattggatgtgatggatggtatgtcagaggtgcggctctgcacgggctaccgtattgatggtaaagagacggcctatgtgccagccgatacggctaagttggatcgggttgaaccgatctatgaaaccatgcctggttggcgtgagtccactgtgggttgtaaaaattggcaagatctgcctgccgcagcccaggcttatctcaaccgtttggtgcaggtggttggggtgccgatcagcattctttctacaggtccagaccggagtgaaacgctgatc

SEQ ID NO: 33674 - DNA, 1224 bp, magnetite-containing magnetic coccus
cggcagagtttaatcttggtcttagcgggtggtcgtggcagtcgtttgaaaaatctaaccgacacagaagcaaaaccagcggttccctttgcgggcaaatttcgcattattgactttgcgctctccaactgcgtcaattcgggcatgcgccgggtgggggtgttgacccaatatcgtgcccataaccttatccaacatgtgcaacgtggctggggttcgttccgcgccgagtttgatgagtttgtcgaggtatggcccgcccagcagcagaccgccgccgaatcctggtactcaggcaccgccgatgccgtctatcaaaatattgatctaatcgaaagccatcaccccaaatatgtggttattttggggggagaccacatctataaacaagactacagcgttatgctggatcatcacattaccagtggtgcccaggtgacagtggcgtgcctggaggtcccggtggccgaggcccgtgagtttggtgttatggatgtggacgagcaagaccagattgtcaaatttttagagaaacctcagacccctccagagctacccaaccgtccgggttgggcgttggcaagcatggggatctatatcttcgatcatgaactgctggtggagcagttggagcgggatgccttgttggaggactcctctcacgattttggcaaagatcttattccctatctggtgcccaaagtgaaagttatggcgcaccgtttctcccacagttgtgtgggcttggatggtaaaaaagagccctattggcgggatgtgggtaccctggatgcctactgggaagccaatatggacctaacccatgttaccccagagttggatctgtacgatccaaaatggcccatttggacctaccaagtgcagcgcccagccgccaaatttgtgtttaatgatgactcacggcggggctatgcggtggatagtttggtctcggcggggtgcgttgtttcgggttctgccgtggagcgctccttactgtttaccgatgtgcgggtcaactcttacagctttgtgagcgattctgtcattctgtctcatgcggatattgggcgtaaatgtaccctgattaagtgcattgttggccccaatacggtgattcccgatggtatggtgattggtaaggaccctcaactggatgctcaacgcttttatcgtaccgagggtggagtgacgctggtcacgcaggaacatatcgacaagctt

SEQ ID NO: 33675 - DNA, 1419 bp, magnetite-containing magnetic coccus
atgcgtgtgctatttgtaacatcagagatctacccactcataaaaaccggtggtcttggcgatgtcgccgctgctctgcccgcagcgttgattgaacaaggcgttgatatacgcgttttggtgcccggctaccctagtgtgctagaaggcatgcagcgccaaggtgatgctattgtgctgggtgaggtttttggtcatggtgatgcccgactcatacccggccgcctgcccgatagcgatgtttttttgtgggcactggacattcctaccctctacaaccgtccgggcaacccctacttaagccacgatggccgggattggggggacaatgccattcgctttgccgccctctcgcgggtagcggcattgattgccgaagcgggtggttttttaggttggcgtcccgatgtgctgcacgccaacgattggcaagcgggcttggcctcggcttatctgcatttttctggcaaccgtcactgtaaaagcatcatcaccgtgcacaatatccaatttcagggcaattttcccgcccgtgtggtgcacgaggttggcttacctgccagcgccatgcatgtttatggtgccgaattttacggacagtttagctttttgaaagcgggccttttttacagcaactggctcacgaccgtcagccccacttatgccaatgagatctgcacccctgcctatagctttggtatggatggcctgttgcaagatcgcgtacaccagctacacggcattcttaatggcattgattaccatgcctggaaccccgagaccgatcctttaattccccacccttatagccgtgataccctagagaacaagcttctcaacaaacgggctttgcagcaggagatggggctgttggtggaggatgatcggcccctgtttggtctggtcagccgcttgaccgaacaaaagggcattgatcttattttggaggccattccagcggtgctcagtgccggggcccaattggttgtgttgggcagcggccaccgcgcttttgaggatcagctgcgccaactcgccgcgcaaaacccgctacaagtcgcggtacatattggttatgacgagattcactcccaccgcatccaagcaggggtcgatattctgttggtgccatcacgctttgaaccgtgcggcctgacccaactctatgccatgcgctatggcaccctacccttggtcagacgcaccggcggtttggccgatagtgttacgcccatccattccgaaaaccacggcaccggttttctgtttgatcgacccgacaccatcagcctacttaccgtcatgttgcaagccatgggttgcctgcgcaaccccaccctgtggcgcaatgcccagcaacgtgccatgtccatggattttggctggcgcaaatccgcacgtgcctacatgcatctatat

SEQ ID NO: 33676 - DNA, 2439 bp, magnetite-containing magnetic coccus
catgaccgccccgactggaacgccaccttcatcaaagagaagttggtcaactacatggtccatgatgtcggtaaagatcccgatattgccagcgaacgcgactggtactacgccgttgtctattttgtacgtggtgtattaagcgagcgacgcattcgccaaaaccgctacctgcgtgatgaaaaagggcgccgtgtttattatctttccatggaatatttgatcgggcgcaacctcatgcgcacggtattggatttagatttaaacatcttgttacgtgaagccctgtcagaatttgagcaggatctggacaccattgtcgcttgcgaggttgatgcagccttgggcaacggtggtctaggacgtctggctgcttgtattttagactccattgccaaccaaagcttccctggcatgggctacggcattcgctatgagtttggcatgtttagccagtccattgaagagggtatgcaggttgaacaccccgaacattggctgcgtcatggcaacccctgggagtttgagcagcccaacgtaaaatatcgggtccgctttaacggtaagattctctgttttaaagatgccgatggcaacgacacctgccagtgggtagacaccaaagatgtggtggccttggcctttgacgtgcccctctccggccataaaacccccagcattaccaacttgcgactttggtcggcgcgggctacccgtgactttgatctaagctacttcaacgaaggcaactatgttgaggcggttaaggataaagcggtttctgagaacctttccaaagtgctctaccccaatgactccaccttgcgcgggcaggagttacggctcaagcaggagtatttctttgtcagctcctccttacaagacattatggagcgctttaagctagagaatggcgatattcgccagttccctaagcgcgtggtcatccaccttaacgacacccacccctcgctggcggtacccgaactgctgcgtctgttctgcgatgagtacggtttggagtttgacgaagcctgggacctctgccgtcaaacctttacctataccaaccacaccctgctgcccgaggcgttggagacgtggcccatcgccattatggagcatgtactgccccgccatttacagattctctacaagatcaaccatcagcatcttaaagaggtcaaacaccgctacccagggaatagcaccatcctgagccgcatgtcactcattgatgatgtgagcaagcgggtacgcatggcccacgtctgtattgtgggtagctattcggtcaatggtgtggcggagctgcactcgcgtcttatgcaggcgggcatgttcaaagacttcaaagagatgcgtcctggtgtctttaccaacgtcaccaacggtattgatcagcatcgctggctcaacatgtccaaccccgggctctctgctttgatcaaggagagcattggcgacaaatgggtttcggatctacccgccttggttgaactggcccccttggccgatgatgcggggttccgtcgccagttccatgatattaagcgggccaacaaagtgcgtctggcccaattggtggcccgtaaaactggggtagagcttgacccttcctccatgtttgatgtccaggtcaaacgtattcacgagtataagcgccagttgcttaaccttatgcatgtggtaacccgctacattcgtatccgggatggggtcgagaatgatatggtgccccgttcggtcattattggtggcaaggcggcaccgggctaccacattgccaagcagattatccgcttaatcaatgatgtcgccagcaccatcaacaatgatccggcgatcaagggcctgcttaagctggtctttttgcccaactacaatgtctccaaagccgagatcatcatgcctggctcagaactttctgagcagatttccacaccgggcatggaagcctcgggcacgggcaatatgaagtttgccctaaacggtgcgctaaccattggcaccctggatggggcaaacattgagatcttggaagaggtgggggatgataacatcttcatctttggtatgacggcagatgaggcccacgatcttcgcgctggcggctatgatcccaccctctattttgagaaaaatgccgagctgcgccgggtgttagagatgatccgcgatggtttcttctgcccggacgatcccggtcgttatagcgatctgtacaacaacctgctgtttggtggtgaccactttttgctcttagccgactatgaagcctacattgcctgtcaaaaacaggtggaggccacctatagcaaccaggatcggtggaaccgcatggctgtgctcaataccgccaatatgggtaaattttccattgaccgtaccgtgcgcacctatgcggaaaatgtttggaaagtcaaacccatgcagctt

SEQ ID NO: 33677 - DNA, 1464 bp, magnetite-containing magnetic coccus
atgaagatcttgatggtggcatcggagtgtgccccggtcgctaaagtgggtgggctgggggatgtggtgcatgggctgagtcgtgagttgcaccagcgtggtcacgatgttgcggttattttacccaagtacgactgtatgcgttatgatcatatctgggatctggccattagctatgaaaatttgtgggtgccctggaacggtggggtgatcaactgcaccatctggtttggtcatgtggatggtttggcgagctactttattgaaccccatgcagaagagcagttttttaaccggggtacctactacgggttttgggacgacgcccaccgttttggctttttctctcgggcggcgctggagtttatgcttaaggctaatctgcgcccagacatcatccatacccatgattggcagacggcgttgatccccgttatgctttatgaaatctatgaatctctaggattggatcgacaacgggtgtgtcacaccatccataattttaaacaccagggcaccacaggacgggatctcctgtatgccacagggctgcaccgtgccgactattttggggatgttcactgtatgggggatgatttcacccctggggccatcaaccataccaaaggggcgataacctacgccaattttgtcaccacggtttcgcccaagcatgcctttgaagcccgccacagcgaccaaggctatggattgggacacaccctctaccgttttcaggataaatttggcggtatcctgaacggtttggattatgacacctggaaccccatgaccgacccctatcttagggtccactatgatcgcgatacgttggaacgcaagagcgacaataaacaggctctgcgtgaacggctgatgctacaacaggtgtataaacccatggtcgcctatgtggggcgcttggatacccaaaaaggggtgcatctcatccgtcatgcgctgttccgcaccttggagatgggcgggcagtttgtgctgcttggggcggcctcggaacggggtataaacgacgatttttggcatttaaaaaacgatcttaatgacaatcccgactgtcatttggaaattgggtttgatgaagctttggcccatcaaatctatgctggggtcgatctgtttgtggtgcccagcctgtttgaaccgtgcggtctcacccaaatgatcgcgctacgctacggtacggtaccggtggtgcgtcaagtcgggggattggccgataccgtttttgattggaaccatagtgatctgccactctccaagcgcaatggctttgtgtttgaagaggcctcctttgcggggttagaatccgcactggatcgagggattgcgttgtggaaacaggatccccatgggttccaaatgcttatgcaggcgggtatgcgctacgattattcgtggcggttgcccgtggaacactatctgaacatctaccgctacatccgc

SEQ ID NO: 33678 - DNA, 2103 bp, magnetite-containing magnetic coccus
gtgtggcccgggaatccgtttcctctaggtgcaacgtgggatggccgtggggtcaattttgccatcttttctgagcatgccgagcgggtggaactctgcctgtttggtcccgatggctttcgtgaaacggcacgcatctccctctcggagtataccaaccaagtgtggcacggctacctgccggatgtgcgtcctgggcagctctatgggtatcgggtttatggcccttatcagccggaacatggccaccgttttaaccataataaactgctgttggatccttacgccaaattgcttaacggacagttgcagtggcatgaagcgctgtttggttatcgttatgatgatcccttgggggatctaagctttagtgatctggatagcgccccctatgtgcccaaatgcgtggtggtggataccgcctttacctggggtggtgagcaaccccccaatgtgaattggctggattcgattatctacgagatgcacgtacgtggttttaccatgcaacaccccaaggtgccgcaaaaccagcgggggacctttgccggcctgtgtgcgccagaggtgattagctatctgcaagatttggggatctcttcggtggagttgctgccggtgcatgcctcggtggatgagtggcatctggcgcaaaaagggctttcaaactattggggttataatacgttggccttttttgtggccaatcctcggtttgccagcgggccagacgccatccgcgaatttaaaaccatggtgcaggtgttccatgaggcgggtatcgaggtgctgttggatgtggtctacaaccacaccgcagagggcaaccatgaagggccaactctgagctttaagggcattgataataaagcctattataaattagagccgggctataaccgttactatcgcgattttaccggttgcggcaactcgtttaatctgcgtcatcccaaggtattgcagttggtgatggactcgctgcgctactgggcaggcgagatgcatgtggacggtttccggtttgacttgaccaccaccttggcgcgggaggccgatggccactttgaccgccactccggttttctggatgccattgcccaggatccgctgttgtcacgcaaaaagatgattgccgaggcgtgggatattggtgatggggggtatcaggtagggaactttcccccaggctggggcgagtggaacgaccgctaccgcgatgccatacgccggtattggaaaggggataagggcatggcaggggagttggcttcacggttgacgggctccagcgatatctttaaccacaatggtcggcggccttggtccagcatcaattttgtcaccgcccacgacgggtttaccctgcgcgatttggtctcctataaccataagcacaacagcgataatctggaagataaccgggatggccgtgatgccaatgatagctggaattgtggtgtagagggggcctccgaggagcccgccatacggattttgcgcctgcgtcaaatgcgtaattttttgaccagtttgctgctctcgcaaggtttgcccatgttggtggcgggggatgagcgcgggcgcagtcagaacggcaataacaatccttactgccaggacaatgatattagctgggtcaattgggatgagcacgatgaagaggccaaagagctgctctcttttacccgttttctgattaaattgcgtcgtgagcatggggtttttcaccgtcatagcttttttaatggtcaaaaaatcaccggtcttgaggttaaagatgtggtgtggttgcgccccgatggccgggagatggagcggtgtgattgggataatgtgcacaccctctgtttgggcatgctgctgtcgggtgaggcgggggaaaaatttctctcccgctacggggatgcgcaggtggatgatacctttctgctgctgcttaatagccaccatgagccgctaccgttccatctaccagaggttgaggatggcagcggttggacccggctgttggataccatggagaggggtggcggttgtgatgagccacagccaggcattgtcaacagctatcaaatgggtgggcgcagtgcggtgctgttt

SEQ ID NO: 33679 - DNA, 2106 bp, magnetite-containing magnetic coccus
cagttgcaactggccagtgccgaggcgcgggtggccagtgagaccaaaaatctctttttggccaatatgagccacgaggtacgcacgccgttgaacgccattattggcatgtcccggctggcgcaagatcttagagaagagcatgttcgccaagattatttggtcaagatccatggggcatcccaatcgctgctggcgattattaatgatttgttggatttttccaaattggaggccggtaagctggcactggagcgtacccccttccagatcgatgaggtgattgccaatatcaacgccatcttggggcataaagcggtacaaaaggagctctcgattcgctactacgtggatgccgatgtgcccaatcatgtggtgggcgatccgttacgtttggggcaggtgttgattaatttgatgggcaatgccgtcaaatttaccgaccagggttatattgctttgcgggttgagcaggttgcccatagcgagcatcgtttacgcctgcgtttttcggtgaaggatagtggggtgggtatctcccccagtgcggttgcgggtctgttccaagcctttacccaggcggataactccataacccggcgctttggtggtaccggcctcggattggtgattagccgtgagttggtgaaggtcatggggggcgatatccatgtcgagagcgagcttggggtgggtagccgcttcttttttgaagccgagtttgtgcccattgatgagggcttgcatgccaaaaccgagcagccttggcaagggcgcggggcggttgtggttgacgcggatcgcgatgaacaaaattatctaaaacatatccttgaacggtgcggcttggggtgccactgctacagcgatccgacgctgttgttgagtgaggcttttgctcgtctggatcctgcaccgcattatctgtttattcgcgagtccagcctctccagcagcgccttggagcatctttcccaccatctgcggcaccatggggttgttaagcccatgaagcagattttgttgtgtcgccgccaaggtggtgacgagcggtcgggttggcatagccccctgatggataaaatgttggtagagcctctgcatgcgcaacagttgcgccgtctgcttgcgcagttagaggggattgagacgcaggaggggggtgggttaaacgatggggtttcggcagcgcgtctgcggcgcatccaaggggctcgggtgttgttagtggaggataacgcccttaaccaacaggttgcggtggcctttttagagcaggcgggcatggaggtggcggttgctgaaaatggtttgcgttgtattgagatggctgagcaatcgcattatgacttggtgttcatggacattcagatgccggtgatggatggtctggaggcgacccgccagttgcgccaacggtcagccttggccaagttgccaatcattgccatgacggcgcaggccatgcccagtgaacgggaatgttcgatggtggcgggcttggatgactatttgaccaaaccggtctctccagaagccattcaacagatgttggtgcgttggattagtccccgtcacccggccaaagtgcgcacccaaatggtcgagccggcggtcatgcctgtgaaggtcgttgagccgactttgccgtttaaggcctcccccggtttgggcgataccccgacgcagcgtttgcaggaggatgctcacgaagaggtcgctgcggggcgtgcagaggatttggcgcggtttgacacgattactcagatggatgtgtcggtggggttaagccgcacgggtaacagtgccaagctttatgagcagcttttgcggggctttttagagcgctacttggatgcccccttgcggttggatgccatgcagagcaagcaagcttgggcagagattggcgatttggcccatgccattaaaggggtggcgtcgtatatggcggcagaggcgttggtgcatgcggcgcaagcgatggatcaagcggttaagcaggagagtacgcaccgttttgaagagattgccgggatgctcaatcatgagcttaaattggtcttggcagatttacaggtatggcgctcgggccagccaccacag

SEQ ID NO: 33680 - DNA, 1266 bp, magnetite-containing magnetic coccus
tacgagaccgatgtgctggtgattggcgcgggtggggccggggttacggctgccattgaggcggctaagcgcggtcttgacgtgttgattgccaccaagctgcgggcgggggattccaacaccatcatggcggagggtggcatccagggggcggatcaagagtgtgactcgcctttacagcactatttggatgtgctggggggtggtcactttagcaatgatcctgagctggccgaagccctctgtcaggacggacccgaagcgttggcttggcttgaagagctgggtatgctgtttgataaatatcccacgggccgtatgcgggtgcgacacggggggggaacttcgcgtaagcgtctgcactccagcggggatatgactgggctggagatgatgcgggtgctatgggatgagtgccgcaatctagccaacgtgcaggtgatggagtttagccccattgtggagctgttgaccgatgacgatggacgggtggtaggggccattattgagcggctaacccacaataatgaggtgcgggtgatccaggctaaatcggttattttagccacgggtggcttgggccgcttgcatctacagagttttcccacctccaaccactatggtgccaccgccgatggtttggtactcacctatcgggcgggtctaccctttcgcgatttacagcacaatcaataccacccctcgggcatcgcttttcccgagcagaaggcgggtctgttgattaccgaaaaattccgagggttgggtgcgcagttggtgaaccgctttggggatgagtttgtctactccctggaacctcgagatgtcaccaccgcggccattattcgggagtgcagtgaatttagtcatggtgccaccaccccaagcggcaatgtgggggtgtggttggatattcccatgattgatgacctccacggcaagggtaccattgagcgggagttccctgggcgctttagcgagttttcccggcacggcattgacctaaccaaggtgccggtattggtctaccccacactgcactatcaaaatggcggtgtacgcatccggggcgatggggccacgggtctgcctggcctttatgcggcgggtgaagtgaccggcggggtgcatggaaaaaatcggttaatgggaaatgcgttgttggagttgattgtcttcggcctgcgcgcgggacgtgccgccgccgaatttgccctttcgaccaacccaggtggggcagcggggctctcccatatcgaatcctat

SEQ ID NO: 33681 - DNA, 1146 bp, magnetite-containing magnetic coccus
atgaatattcatgagtaccaagccaaagagatcatcgccaagtttggcgtcaatgtccctcgcgggcgggtagcctataccccccaagaggcagagatggcggccaaagagctggacagtgaggtctttgtggtgaaagcccagatccacgcgggtggacgtggtaaagcgggcggcgtgaaggtggtaaaaaccaccgatgccgtgcgtgaagaggctagccgcatgcttggcttgacgttggtgacccatcaaaccggtcctgagggtaaagaagttaaacgcctctacgtggaagaggggtgtgacattgcccgggaactctatttgggtattgtgattgatcgggcgaccagccgtgtcacctttatggcctccactgaggggggaatggagattgaagaggtcgctgagaagagcccagagaaaattctgcgtgaagtggtcgacccagcggttggcttggttgctttccaagcccgcaacctggcgtttgggttgggactggaaggtaagcagattaacaaggcggtgcagctgatgagcggcctctataatgcgtttatggagaccgacgcctccctgatggagatcaacccattggtgatcaccggtgctggggatgttattgcgctggattgcaaaatgaattttgacgccaatgcgctctatcgccaaaaagctattgaagagctgcgggattttgatgaagagaatcctaaggagatcgaagcttctaagcacgagctaaactacatcgctctggatggcaatattggttgcatggtcaacggggccggtttggccatggcgaccatggatattatcaagataaagggtggcgcaccggccaactttttggacgttgggggtggtgccaccacagagcgggtcacagaagcgtttaagctgattctctccgatgaaaatgtaaaagcagttctggttaacatctttggtggcatcatgcgctgtgatgtgattgccaatggtgtggtggaggcggcaaagcaggtgaatctgaatgttcccctgatcgtccgtttggaaggcaccaatgtggagaagggcaaagaaattttggccaactcgggtctgccgatcatctctgccgataacttggacgatgccgcgaccaaagcggta

SEQ ID NO: 33682 - DNA, 867 bp, magnetite-containing magnetic coccus
atgagcattttcatcgataaaaataccaaggtgatctgccagggctttaccggtgccaatggtacgtttcactctgagcaggccattgcctacggtacccagatggtgggtggtgtaaccccaggtaaagggggtagcacccatttgggtttgccggtgtttaatacggttgccgaggcggtcgcggctaccggtgccacagcgacggtgatctatgtaccaccaccgtttgcggcggatgccatcatggaagcggcggcggcggatctggatctggcgatctgcatcaccgaaggcattccggtgttggatatgatgaaagtcaagcgctaccttgagggacgcaagacccgtctggtggggcccaactgcccgggtgttattacgccggatgcctgtaagattggcatcatgcccggtcacattcacaagcgtggctcggtgggtgtggtctcccgttccgggaccttgacctacgaagcggtggctcaaaccaccgccattggcttaggtcagagcacctgcgtggggattggtggtgatcccattaacggcaccaacttcatcgactgcctagagcggttcaatgaggatgacgagaccgaagtggtggtgatgatcggtgaaattggcggtactgctgaagaagaggcagccgcttggattaaagcccatatgaaaaaaccggtggttggatttattgccggttcgacggcccccccgggcaagcgtatgggtcatgctggtgctattatctccggtggtaaaggtaccgccgctgagaagtttgccgcgctcgaagcagccggcgttttcatcgcccaatctccttctgcgatcggagagacggtgaaaaaagccttggga

SEQ ID NO: 33683 - DNA, 1944 bp, magnetite-containing magnetic coccus
atgttacacctggaaaaagttgaaaaaagatatggtgctaccatcattctcagcggcactgatctggttattcatccaggggaaaaggtgggcttgattggactaaatggtatgggcaaaaccaccctctttcgcattattgaggaggttgaacccttggatggtggacggctggatcgtcaccctccacacatgcgcattggtgttttgcgtcaggagcttaccccagcgcaccgttctattttacaagaaaccctgggcggtctgccccagttggtggcacttaataatgaacgcgaagcgctacatagcaagatggttgaacaccctgagcatgatgcgtatcaccagtgggtcatgcgtctgggtgaggtggatcatgccttggaagatctggatgcctacagtgccgaggcccgcgctggggctattttgttgggtttaggcttctcaaccgccgatttagaaaagccgctggatgccttttctgggggctggcgcatgcgggttgccctggcccagctgctcttttcggcccctgacctcatgttattggatgaaccaaccaaccacttggacctggagtcggtggcatggctggagcgctatctggcaggtttgagtggggcttacatgctcatttcccatgaccgtgattttctacagcgcaccacgcgggtaacggttgagttggaggatggcaagctcacccgctacaaaggcagttttgatgcctatatgaactggaagattgagcaagcggagttattgagcaaacaggccgccaaacaagctgataagttagaagccatgcagcgctttatcagccgttttcgcgccaaggccaccaaagccaagcaggtgcagagccgcgttaagcagatggaaaagctggaggcgcaaaaagtggagctcccaggccagggacgcagcgcccccgttatccgcttgcccgatcccccgccgtgtgccagtcaggtgatgaaaattgataaaatgagcatggcctatggctccacgcaggtgtttaaaaactgtcaattagagatcagcaaaggctcgcgcattgggctgcttggccccaatggtcgtggtaaatctaccctgctaaaattgttgtgtggtgcgttgcaaccaaccgcgggtgtggttatgccaggggatcgggtcaagccgggcttttttgcgcagcatgcgctggagtccctgcgtcttggggataccatcttagagtcagcccgcgaggttgccccgcccggaaccaccgagacccaactgcgtacggtgcttggggggctcctgttttcgggtcaacgggtcgaaaaattggtctctgtgctctccggtggtgaaaaggcacggctggccttggcgcggctatttttgagtggggccaattttttattgctggatgaacccaccaaccacttggatatgccctcacgggccgcactagaagaggctttggagtcctatcagggtacctttgtcttggtctcccatgaccgctctctgttagagagtgtttgtgaccgctatgttgccatcgcccaggatcagttgcaccccttaggagaggatctggatcattacctagagcactttgtgctgcaagagacagcctcccagccgaatggagtgcaagacaaaaccacagcccgcgccctttctaaggagagcaaacgcgaggcggcgcagatccgtaatgcgctgcatcaacgcaccaagcccctgcgcagccagcttaaccagtgcgaaaaaaacatccagcagcttgaagccgacaaaacccgcattgacgccaccctcaccgacagcagcctctatgaagagggtcaaaaagagcgcttaaaaaacctgttggagagcagcacccaaacggaacaagccctgagcaaagcctgggcactgtgggaaacgctcagcatggagatcgagaccctg

SEQ ID NO: 33684 - DNA, 603 bp, magnetite-containing magnetic coccus
gcggtaaagattaaaatatgcggcattacctccctcgcggatgcttgggcggcccatgatgctggggccgatgccatgggcttggtcttttatcccggttcacctagagcggttacgccgcaacaggtggcgcagtggcggggtgatctgccgccgtttatgacggtggtggggttgtttgtcaatgccacagcccagtggatcgcttctaccaccgcgctgtgtagcttggatcgtattcaactgcacggggatgagtcgccggcgcagtgtcgggcttggggggcgcgggctattcgtgctatccgggtggcggaggcggcggacctgcacgatttagcgcgttggccggtgggggcgctgttgttggatgccaagatcaagggcagctatggtggtacgggagcctgttttgattggcagttgttggggcaggccgaattgcccaagccatggattttggccggtggacttgatccggacaatgtggaggctgcggtgcggcaggtgcagccctatggggtggatgtctccagcggtgtggagtcagcccctggtaagaaagatcataataagatgcaccgttttgtggcagcggttcgc

SEQ ID NO: 33685 - DNA, 1200 bp, magnetite-containing magnetic coccus
ttggcgcgtatgcttgacctgttgcaggccatgggcaaccctcagcggcggctggggccggtggtgcatgtggcgggtaccaatggcaagggttcggtgatcgctttttttggggcgatactgcggcaagcgggtcgttcagtggccgcctatacttcgccgcatctggtgaccattcatgagcgtatccaatacaacggcgtaccggtagaggatgctttattacggtactacgcccagcaggtgctggcgctacctcaatcccaacaggctacattttttgagcgcttaaccgcgaccgcctttgcggtaatggcccattggcaggcaagcgacccatctttggtggtggtgttagagacggggctcgggggacggttggatgccaccaatgtggtgcaaccggtgctgacggccattactgccatggggttggatcatcaaagttatcttggtacgagcatggcgcagattgcccaggagaaggcgggcattctaaaagctggggtgcctgcggtattggccccggcccaggatgaggcgctggctgtgttggtgcagcaggcccagcaggtgggggcaccggtgcaggtagccgggcaggattaccgctgggggcagaataacgagggggccggttggtggtattccgatggcgtggggcaactgatgctgccagagccgggattattgggggcgcaccaataccacaatggggcgcaagcggtggccatggtgcgccagcttgtcgcgcaaggctggtcggtaccctcttcggcctatgcagcgggtcttaccgctgtgcgctggccagggcggttagagcgggtgggggatgcaccggaggtgtggctggatggggcgcacaatccggcgggtgcacaggtgtgtgctgatttttttcgccaatatgggcgggtggatgtcatgcttttcgccttgatggccgataaggatgtagcaggcatgctggaaccgtggttggagctggtaaaaacggtggtggtggttgagccggtgggtgggcgaagcatggccgctgaggggttggctcaggcttggcgagcggtgggggtgacagcggaaactgccccttcgaccgaacaaggttggcagcttgcccgaaaaaaagcgggtcatgcaggaaaaatcctcgtttcgggctcactttatctggtgggagaggtaaaaaaattgtta

SEQ ID NO: 33686 - DNA, 2508 bp, magnetite-containing magnetic coccus
gtgaagctcagcaggcgagagtatatcaaagcccatgccattgccgcggcagcagcagcggcgggcatgcccgtagcggccccaacagaggcccacgcaaccaccctcggtggtgacatccgttgggataaagcaccttgtcgtttctgcggaaccggctgtagcattttggtgggaaccaaagataaccgtattgtcgccacgcaaggcgaccctgacgccccagtcaaccgggggctaaactgcattaagggctattttctctccaaaatcccttatggcaaagatcgcttaaccaagccgctgctgcgtaaaacagcgggcaagtatgacaaaaatggcgatttccaagaggtctcctgggacgaagcctttgatgtcatggccgatcactttaaaaaggccatcaaaaaggggttggatgccggaaaaatgccacccgttggtatgtttggctccggccaatggaccgtgtgggaaggctatgccgcctctaaattgatgaaagcgggctttcgctccaaccatttggaccccaatgcccgccactgcatggcttccgctgtggctggttttatccgcacctttggcattgatgaacccatgggttgctatgatgatttggagcacgcggatacctttgtcctgtggggctccaacatggccgagatgcaccccatcctgtggtcacgtttgaccaacacacgcttgaccaaaccaaacgccaaggtggtggtgctctccacctatcaacatcgttgttttgacttggcagatttgggcattgttttcaatccccaaagcgatctggccatagccaactttattgctaactatgtgatcgaaaagggccgttacaataaagcgtttattgaaaagcacgtcaatttccgcctaggcaataccgatattggctacggtctacgccccacggacgagcgggaaaaaagcgcgaaaaacaacaaaaaccgcaaggacaccatcggctcacaacccatcagttttgaagagtatgccgcctttgtcaaaacctacgatgtagcaaaggccagccagatttctggggttcctgagcgtcagttaatcgagttagctgagctctatgccgacccagaccgcaagattatgtccctctggaccatgggcatgaaccagcacacccgtggcacttggcaaaacaacctcgtgtataacctacacctgctcaccggcaaaatctccgaaccgggcaatagccccttttcgttgacggggcagccttcagcctgcggcaccgcccgtgaagtgggtactttttctcaccgtctgcctgcggatatggtggtggccaacaaagcccatcgcgatatttgtgagaaacattggttactgccagagggcaccattcccgagaaggtgggcttccatgcggtgttgcaaaaccgcaagttgaaagatggtgagctcaacgcctattgggtgatgtgcaacaacaacatgcaagccgccgccaatatcaatgaggaggcgctgcccggctaccgtaatcccgataactttattgtggtctctgacccctaccccacggtaacggcgcaagcggcggatcttatcttacccaccgctatgtgggtggaaaaagagggggcttatggcaacgccgaacgtcgcacacaattttggcgtcagcagattccacccccaggggaggccaaatccgatgtgtggcagcttatggagttttccaaacgcttcaaagtagaggaggtctggcctgcggaattaatcgccaaacagcccgagctcaaaggcaaaaccctgtttgaggtgttgtacgccaatggtcaggtgaacaaatatcccctctcagaaaccgccgaagggtttgataacaacgaatctacggattttggtttctatgtccaaaaggggctgtttgaagagtatgcccactttggacggggccacgcccatgatctggcggattttgacagctaccaccaagctcggggtttgcgctggcccgtggtggatggcaaagagaccctgtggcgcttccgtgaaggctatgacccctatgtgcccaagggtgagggggtccgtttttacggaaaacccgatggcaaggcgtggatttttgccctaccctacgagcccccagccgaagagcccgatgccgaatatgatatgtggctttgcaccggtcgggttttggagcattggcactcgggctccatgacccgccgggtaccggagctctaccgcgccatgccggacgccatggtctatatgcaccccaatgatgccgccaaacgggggctcaagcggggcatgtccgcgcggctcataacccgccggggcgaggtgatcgcacgggtcgagacccgtgggcgcaaccgtgttccagaagggttgattttcatcccctggtttgatgcatcccggctggttaacaagcttacgctggatgccacatgccctatttctaaagagacggactataaaaaatgtgccgttaaggttttgaaa

SEQ ID NO: 33687 - DNA, 1425 bp, magnetite-containing magnetic coccus
gtgttgggctttgccgagattacgaccctaaaaaaagtgcaggctgatctgctgctcgctaaagagcaggcagaggaagcgacgcgggctaagagcgcctttttggccaatatgagccacgaaattcgcacccccatgaactcagtgatcggtttttcacacctcgctttaaaaaccaacctagataaacagcagagcgactatctcaataaaatccttttttcagcccgctctctgttggggttgattggggatatcctggatttttccaaaattgaggcgggtaagctcacggttgaatccctgccttttaccctggatgagatgctcgatagtgtggctgctcttaatgccaaccgcgccgaagagaagggcctagacctgatttttagccacagcagcaacctaccccaggcattgattggggatcccttgcggttgggacaggtcttaaccaacctagtgagtaatgccgtaaagtttaccacagaggggcatgtgcaggtgttggtcgaacccctgcaccagcaagagcaggagctgctgcttaaattttcggttattgacagtggcatgggaatgagttctgagcaggtttcactactgtttaccccctttactcaggtggatgtctctcatactcgccgttttggggggacggggttggggttggccatttgccgtaatttggtggagatgatggggggaagcatctctgtgcgcagccaagagcaggtcggtagtcattttgagttcacgatctgctgtggtgtgcagatggcgcaatcggaatcccacctcatccatggggccaaagaacggatggtctttgtgcaggaagcgggggtggtacgtcgtgccattgagcaaaacctgctcggctttggggtcaaggtcgagatggtcgatgatgcagagggcttattggccctgctcaagcaggcttatgcccaccctgtcgccctagtgatcatcggttggcaagcctatgaggcaggtgttgtcgaacggttgaaaagaaggcttcaacagcagccgcacaagccaaaagtgctggttttggcaccctccttcaaagtggcctccctcaatgcgggggctgcgcactatggtgtagatggggttattcctaaagcgtgtagcccgcttaaattggccaacagtgtggagcgtttattacagggcctgccactcttgattgaacagtccgagctggtgcaagaaggggccccgccccagtggttgcaaggggggcgggtcttgttggtggaagataatcccatcaatcaacaggtagcccaagagctgctggagcagtgtgggctccaggtgagcatcgcccaggacggggttaaggctgtggccgcagtggaacgagagcgatttgacctaatcttaatggatattcaaatgcctgagatggat

SEQ ID NO: 33688 - DNA, 2604 bp, magnetite-containing magnetic coccus
gcgtatcgccccccccattttttagtggaacaggtgacgttaacctttgagttggatccctcagcaacccgcgtggaggcgttgacccactttaagcgccatcccgatgcccccacggatgcccccttgcagctgcatggtgaagagctgcaaccggagctgttggagattgtcggtcagcaagagaggccccactatcatattgaaaatgatcgcctcacccttactccaccggctgagtcttttaccctgcgctgtgtaacccgtattgcgccagataaaaacagtgctttagatggcctatatatctctgggggcatgttttgcacccagtgcgaagccgaagggtttcgtaaaatcacctactaccctgaccgccccgatgtgatggccaaattccgtgttaccttgatcgcggaggcccaacaataccccattttattaagcaatggcgacaaagtagccaccgccgacttgggggatggccgccatagcgccacctatgaggacccctatcccaaacccagctatctgtttgctttggtggcgggggatctggcactgttggaggaccactacaccaccgccgaagggcgcaaggtgacgctacagctctactcggagcaccacagcattgaccaatgcgggcacgctatgcaggcgctgaaaaaggccatgcagtgggaggagtcccgctatggcctcagctatgatctcaatacctacatgatcgttgctgtgggtaattttaatatgggcgccatggagaataaggggctcaacattttcaataccaaatatgtgttggctgcgccccatgtggcgaccgatgccgaatatgaagcggttgaaggggtgattgcccacgaatattttcacaactggaccggcaaccgcatcacctgtcgtgactggttccagttaagcctgaaagagggcttaaccgtctaccgggatcaatctttctcggcagatatcgtctctggctcggtgcaacgtattcaggatgtacgcctgctacgcaaccatcagtttcccgaagatgccggtccaacggcccatccggtccagccagaatcctacattgagatcaacaacttctacaccagcaccatttacaacaagggtgccgaagtgatccgtatgctagagaccctgctcggttggccgatctttcgccaaggcatggatctgtatgtggcccggcacgatggtcaagcggccaccgttgagcagttcatctgctgtatggaagatgcctctgggcgtgatttgggccaatttcggctctggtatgtgcaggcgggcacccctgaactgaccttcaactccctttactatcccgaaagccaacgctacgtgctgaacgtcacgcaggtctgccccccaacaccggggcaattgagcaaagcccccatgcatatacccattcgcatggcattgctggatcccgacggccagcctcaatctcttaagctggtggatggggaacaggtgctgggggcagagaccgtgctggaactcaccaccggtgaggctacctacacctttgaaggggttagcaaggcccctaccccctccttaatgcggggtttttcagccccggttaagtgggatgccgcattggatcgtgaagcactggcgtttttatgggccaacgacaatgacccctttaatcggtgggagtcgggccaaattttagcggtcgagaccattttagacatggtggggctcacccaacagaatggcgaactgcctgaccttcccgaaagctttgcccacgcctttgagaccatcatcaaggatggcaaaagcgagcctgctctgctggctctctcgctaagcctgccgaccaccggctatattatggatcgcatggataaagccgatccccatcttgtttaccgggttagacagcatgttcgacaagcggtagccagtcgttttcggcccctttttctcagcctgtatggccgccattatagcgatgaaccttatcattatagcccagctaacgcgggggctcgtgcgcttaaaaatctggctttggattatctgttggaaaatcccgaacccacggtgctggcactggcccataagcagtttcaccaagcggacaatatcaccgactggctgggggcctatggacccttactacggtgcggcagcccctcctccagcgagcttacccatatcctttatacgcgctgtaaggattcggccaatgccctggataagtggttctccactcaggtgaccatggtcgctgggccagaggcactctctcttgccaaggccctcacccaacatcccgatttttcttggagcacccccaataaggtacgcgctgtggtgggtagttttagtggggccaaccccacagcctttcacgccatagatggctccgggtatggctttttgcaagaggtcatcgcccaactggatgagaaaaacccccaattggctgcccgtttatgcacctattttacccgttggcggcgcatggtgccggagctctcccaaccgatgcaaaacgccttgcaacggctgttggatacccccaatctctccaatgacacctatgagattgtgagcaagagtttg

SEQ ID NO: 33689 - DNA, 945 bp, magnetite-containing magnetic coccus
atgggtaaggttgcttttttatttccagggtcagggttcacaagcggtgggtatggggcaggcattacatggggcggatgcctcctgtgcggccctatttgaagaggccaacacggtgcttggcgaggatctgcgggggttgatgtttgacgggccagaggcggatttaacgcttacccgcaacactcagcccgcgctggtcgtgacggccatggcggcctatactttgctacgtcaacaaagtgatctgcaagcggattttgtggcagggcactccttaggggagtatgcggcgatctgtagcggagggggggctctcgtttgccgacgccatacgtcttacccgtatgcgtggggatgccatgcaaaaggcggtaccggtggaggtgggtgccatggctgccatgttgaatatggaggcggcgttggtggaggaggtgtgtcaggctgcatcgcaagcgttggggcaagtgtgcgtaccagccaactacaacaccccggcgcaaatagtgatctctggggacaaagcggcggtggagcatgcggtggccttagccaaagagccggggtgctaagcggtgtgtgatgttgagcgtctcggcccctttccattgccctctcatgcaaccggctgcggatgccatggctcaagctttggcgcagaccccgatgcaggatttgagcattcccttggtggccaatgtcaatgccggtatcaccaccgatgccgaaacggtacgccagcagttggtggctcaggtgtgtggttcggtacgttgggaggcctccattcgtgccatgattgcgcaaggggtggatcgttttgtggagattggtaccggcaaggtgctcaccggcatgctcaagcgcattgatggttcggtgcgtggggtggctgtgaatggtcctgaagatatggctgcattggcagagctgctgtaaggt

SEQ ID NO: 33690 - DNA, 735 bp, magnetite-containing magnetic coccus
agcatgcaaaatcgcgttgcaattgtaacaggctccaccgctggcattggtcaggaagcggctaagttgttggctaaacgcggctgtcgtgtggtgatcacgggaacccgtgaaacaaagattatggagacggttgaggccattcgcgccgagggtggggttgctgcgggggtggctgccaatattggtgtggatgctgatctggataagctggttgcctttgcccaagagcagtttggtgaggttgaaattttggtcaataatgccggtattacccgtgacaacctctttatgcgtatgaaagatgaagagtgggatgaggtgatggcgctgaatttaaccagcgtttttaagctctctaagcgggtcattcgcgccatgatgaagggccggtatgggcgcatcgtcaatgtgacctcagtggtgggctttagtggcaatgcgggtcaggctaactatacggcggccaaggcgggtttggtggggtttaccaaatctttggcgcaagaggtggcaacacggggtattacggtgaacggtgttgcccctgggtttattcaaacagccatgaccgataagctgaatgaaaagacccaagaggcgattttggcccaaatccccatggggaaaatgggaagtgtcgaagatatcgctgcggccattgcctttttagcatcggatgaagcacggtatattacgggtgagaccattcacgtcaatggtggtatgtatatg

SEQ ID NO: 33691 - DNA, 228 bp, magnetite-containing magnetic coccus
atgagtgatatcgcggaacgtgtcaaaaagatcgttgcagaacagatgggcgttgacctggacaaagttaccgacgacgccaagtttgtcgaagacctgggtgcagactccctggacaacgtggagttggtcatggctttcgaggaagagttcggctgcgagatcccagacgaaaccgccgagaagatcacctcggtgagtgacgccatcaagtacattggcgaaaac

SEQ ID NO: 33692 - DNA, 1227 bp, magnetite-containing magnetic coccus
agagtcgtcatcaccggtgtgggtttggtcacgcccttgggcgtgggtaatgatgtaacttggtcacgcttgatcgccggagagtctggcatcggcctgctcacctcttttgataccgaagagtacagctgtaaaatcggcggcgagattaaagattttaatcccgagcagtggatcgagaaaaaagaggtcaaaaaaatggaccgctttatccattatggattggcggcctcccaattggcatgggaagatagcggcttggaagcccccgatgaagaagccagctaccgctatggcgccattgtgggttcgggtattggcggtctgatcgcgatccaaaatcaagccattgcattaaaggaaaaggggccgcgccgcatctctcctttctttattcccatgtccttgatcaacttggtttccggtcaattggccatcaaatatggtttacgtggtcccaaccatgcggtggttacagcgtgtgccaccggcacccacgccattggcgatgcttaccgtattgtgcaacggggcgaggctgatgtcatggtggcagggggggccgaggcggccatttgtgagttgggcatcggtggttttgcagcggcacgggcgctctcgacccgcaacgacgatcccacccgcgcctcccgtccttgggacaaggggcgcgatggttttgtgcagtcggatggtgcgggcgtggtggtggtcgagagcatggaacacgccaaggcccgtggcgcgcgcatctatgccgaggtcgttggctacggcatgtctggcgatgcctaccatatcacggccccccatcccagtggcgatggcgcggcccgttgtatggctgcggctctaaaggatgcccagatggatcccagtggaatcggatatattaacgcccatggtacctccaccccccaaggggatgtgattgagaccaaggcggtgaaaaaaatctttggtgagagcggtgcaaaaaaggtgatggtctcttcgaccaaatctatgacgggccacctgttgggtgctgcgggggggatcgaggcgatctttaccgccaaggccctgcatgagggggttattcccccgaccatcaacttggatgatccggatcctgagtgcgatttggattttgtgccccacacggcccgccaagagcaggtagaggctgccctttccaactccttcggttttgggggaaccaacgcgacgttggtgttaaagagg

SEQ ID NO: 33693 - DNA, 435 bp, magnetite-containing magnetic coccus
tatggccgtgtatgtgcatcagaggtggattttataccggtacgggcccgtacggggctgctgtttcaggatgccgatgatcaacttttttcccccaccgtggccgaggatattgcctttggtccgctcaatttgggtaagagtccccagcaggccgctgccattgtggaagaggttttggcgcagttgcagatgagtgggtatgaaacgcgcatcacccaccatctttcggggggggagaagcgcatggtggccttggcgacggtgttggccatgcagccggatgtgctgttattggatgagccaaccaatgccctggatgaagcggcagaggcccgtttggtggcgctgctgcaagggttgcctcaggcgttggtggtgatctcccacgaccgccggtttttggcgcaagtgacccagcggcgggtggtgttg

SEQ ID NO: 33694 - DNA, 1125 bp, magnetite-containing magnetic coccus
tatgatgtggcggtggttggcggaggcatccacggtgccggggtggcacaaattgcggcccatgcgggttggtcctgcgtggtgttggagcaagcgcatgtggcagcgggcacctctagccgatccagcaaattgatccatggtggcttgcgctatctacaacagatgcagtttggtttggtgcgggagtgtttgcaagagcgcacccgtttgttacacgtggcccctcagttggtccggctaatccccttttacctaccggtctaccagcacgctagccgccccccctggatgatccgtgcagggctcaccctatacgccatgttggcgggccgcaacccgggcggccattatgaacgcctaccgcaatcccagtgggatacgctagggggtctgcggcagagcggactgaaacagcttttttgttattacgatgcccaaaccgatgatcgtgccctaactgtggcggtgatggcatccgcccaatcatacggggctcaattatggtgcgcgaccacgctgcaacagctccaccgtttaccccaaggctaccgtttaagtggtcaacgtggcgcggtaacctttacgatccaagcccgtgtggtggtcaacgtggccgggccatggatcggcaccgtggcagccaagtgtcagccacccctggagctacccccctttgcgcaggtgcagggtgcgcaccttagcctgcccaactggcatcctcctggggcttttaccctgcaatcgcccctggatgggcgggtgttttttgtcctgccgtggcagggcggcgctctgctaggcagcaccgagacgccctttgatggcgaccctgcccaggcggcatgcaccccccaagagcaggcttacttgcttgaatccgcacacccttttttcccccaggcggatatgaccgtcggtgccagctttgcgggcatccgggtattgcccaagggggatgccaaccgcgcatcccgcgaggcgcttttgccggtagacgaccccaccaagccgcgattggttacgctgatcggcggtaaactcaccagttaccaccccaccgcccgagccattatcaagcggttgcaaggggcgctccccccggccaacacggcgggcgatccc

SEQ ID NO: 33695 - DNA, 1730 bp, magnetite-containing magnetic coccus
ttagaggcagcgaaacgttccgccgaaaccgccagtaaagccaaaagccgctttctctccaccatgagtcatgaaattcgtaccccgatgaccgccattttgggggttgccgaattgatgtcgggaacccatttagaccgggttcaacgggagcatgtgagcattatccggcgctctggggatgccctgttggagctgattgacgatattttggtgatcagccaaaacgaaggcgcccaagagggggaaaaacaggtggtgtttgatgtggaccacctgttggaatcggtgatggatatggccagttatcgcgccaccgaaaagggaattaaactgctctcacatgtcgccgctttggtcccggtgcgggtgatgggcgatccagtacggctgcggcaagtacttataaaccttgtgggtaatgccataaaatttagtgaaaagggggaggtggttatccaagtgcggcctgggccgcgcaacggccctgaacgctcggattaccggtttagtgtgtcggataatggtattggcatccccatggaaaagcgtgaggcgatctttgatgcctttagccaagtggacgaaacagaaagccgtcgctttgggggtaccgggctggggctgaccatctgtcgccgcttggtcaaccttatgggtggacagctcgagttgctctttagtgaacctggggtgggttcaacctttgcttttgatatccctttacaacccgccatggaacaggccaatcccgccaacttggagtatgatcataccactctgaaagagcgccgcgtggtggtgttcagccgaggcaaaaacctgcgcaccatggtgcaggagatgctcacgcctgaaggggttcactgtaccgccgtcagtaaccatgatgagctggtgcaattgatggaggtggttcacgatgtggagcgggatgggcagggacccctgtgcgatatgctgctgttggatgccgaaaaacccttcgccaatatggatgtggtaagctacgcaagcgagctgaaaaagcgcaagatatttcgaaacttacattttgtaatcctagggttggaccccggacaaaaagagcgttttgcgctgtgtcaggcgggcatcaactatgtgtcgcccccgctgaagcgccgtgttatcttaaaaaccttggccgaactgtttgtcgaacctggctatcggcacttggatgacgcctgtcgcaatttaatgcacgctacccacaagcgtgaacttaaagaggggggggctctgcgtattctactggctgaggatgaccccgatagcagctatgttatccaaaattttcttaaagataccctctgccacctggaggtggtgaccgatggacagcaggctctgcaacggtttcaagaggggatgaccgatcctttgggtgccgctatggagtttgacctcgttattatggatacccaaatgccggtgatggatggttatacggcggtgcatcgcatccgtagttgggaacgcatacagcagcgcgcccctgtaaaaattttagccatctcagcccatagcgggcaggaggggcgtttgaccagtctgcgcaatggctgcgacgaccatttgaataagcccctgacccagcgggatctgctcgcccacattgacgcactgtgtcaccgtctgccaaaaacaggctaatcaagaggtcatccccaccaagcttagccagtcttgggtttgtatatcctcgc

SEQ ID NO: 33696 - DNA, 756 bp, magnetite-containing magnetic coccus
attccacttgaggtaacgcccctacccgcctgggaagataactatatctggtgttttccaaccgaacccggtgccgtggcggtggttgacccaggccaggctgaaccggtcacagactatcttcaacagcacggattacgtttaagccatattttactcacccaccaccacggggatcatattgatggcgttgcgccattgcaacgcaagcatcatgcccgggtgctgggcagcgctctggatgcccaccgtcttcccccgttggatgaagccctacggggggggcaaaccttttgtctaggcccccatcaagtcgacacctaccacacccctggccatacctcaggccacctctgctaccacattgccgattgtttgtttgcaggggatacgctattcagctatggttgcggtcgactgtttgagggcaccccccaacagatgtggcaaagcctgctcatcttaagggccttaccagagaccacccggctctgttgtgcccatgaatatacactgaccaacctgcggtttgcgcgtagcttacccggtcagcaggagcccttggccgccccgtggcaacgggcccaacaaacccgtcagttgggcaaaccaacgctgcccagccgcttggcggaagagaaacaatacaacccttttttacgctgtgatgacacccagtttcgtaccgccgtgggtcagcaggcggcctcggctgaggcatgttttgcctatatacgccaattacgaaatcacttt

SEQ ID NO: 33697 - DNA, 702 bp, magnetite-containing magnetic coccus
gagcgggtggcgctggtcaccggtggcagcagtcaactggggcaggccattgtgcaggcgctgatggaacaaaattaccgcgtcgcgctggtctgttttgagtcagacgcgacggcgatgatccagcgttaccccatgcaagaggctaaaatacaaagttttacgtgtgatttgcgtaatcccgaagccattgaaacgctggtggggcaggtggtgcgccactttgggcagttggatgtggtggtgcataatgccgcacgttttgagcccgaccatgaagaaaacccaagctggcagagcctggagaatctttttaaagttaatgtcatgggacccttatggttatcccttaaggcagccccctggatgcgcagtggccctgcgggggggggacatattattcaaattggggatatttggggggaacggcccttgctgggttatagtggttatagcagcagtaaagcggcgctgcatatggcgggtcgctctttggcgcgggagttggcccccgaaattcgggtcaataccatcgccccaggtgcggtgtttccccaaggggaggatgatcgggcttaccaagtgctgctgtcgaacacccccttggccgcagaggcaggaccgctgggggtgattaccgcccttaactatctgttggccaccccgtttgtgaccggacaggtgctgcatgtggatggtggt

SEQ ID NO: 33698 - DNA, 588 bp, magnetite-containing magnetic coccus
gttctggttaccaagcaggcccccgattttaatgcgactgccgtgatggccgacaattcgtttcaagaaatctccatgtcggactataaaggtcagtatgtggtgttgttcttctatcccctggactttacctttgtttgcccttccgagctgatcgccttcgaccaccgcttgggtgagtttgaaaagcgtaatgtacaggtgttgggttgctccatcgactcccattttagccacttggcttggaaaaataccgaaatcaataacggcggcatcggtcaggttaaatatcccctgattgcggacctgaacaagcaaatcgcccgtgattatgacgtgctctttaacgacgccattgcattgcgcggctctttcttgatcgacaaagagggtaaagtgcgtcaccaagtggtgaacgatctgcccttaggtcgtaatattgatgaaatgttgcgcatgatcgacgccctgcaattcactgaagcccatggcgaagtgtgtcccgctggctggaaatctggcgatgctggtatgcaaggctccaccgaaggggtggctaagtatcttgccgccaacgctgataagctg

SEQ ID NO: 33699 - DNA, 1272 bp, magnetite-containing magnetic coccus
gccaaccgtgccaagagcacctttttggccaccatgtcacacgaaattcgcacccctttgaataccattttgggcatgggtcaactgctcgaagagaccgacctaactgaaatgcaacactggtgcgttaatattcttggcaattcgggtcgggccttgctcaccctgatcaatgatattcttgatctttctaaaattgaagaggggcatctttcactggaacacaccccttttgaccttcatcaacttttacaggaagtcgaggagctgtttaccttctcggccttagctaagggcattacactgcgcggccatttttcagaaagcctgccccagtgggttatgggagaccctacccgcctacgccaagtgctgctcaatctgctgggcaatgccattaagttcaccaaacagggctttgttgaactctccgcacaaaccatggcagaggatgaaatctgtttttctgtttttgacagcggccctggtattgccaaggaacgccagcaagagatttttttaccctttacccaagcggactccagcaccacccgcaaatatggcggcagtggcctcggtttaaccatctctcggcggctggttaagttgatgcatggacagatccaattggaaagcaggttggggaaagggtctcgtttctatttttctttaaatttaccccaagcgcccacagaacggatcccgccaccctcactccccgccacaaccgttgtgcacagttccccgcaacgggctttaaccattttggtggccgatgattccgacgataaccgtattctcattgaagcctttttaaaaaaatccccctacaaattggtcatggccagcaacggattggaagcactggaagaatttaaaaaacaaccctttgatctggtcttgacagacattcaaatgcccattatggatgggtatgaagcgatccgtcagatccggcaatgggaaagcagccaaaagatgaccacccgcacacccattatcgccttaaccgcccatgtgatgaaggaagaagccgaacagatcgaacaggcggggggagatctccacctgagcaaacccattcagaaaaaacgcttgttggaagtcattcaaacccttacccatgacaaccgacttagcgtacgctaaagcatatcccatctggcacgccatctagcaggctaggccagctgctctgagattgattcatgacccgtaaagaaggaggcaaacctgtgccccaacaaaccccgacgctgagtcaacgtattg

SEQ ID NO: 33700 - DNA, 2166 bp, magnetite-containing magnetic coccus
caactcggccagggcaaagtaacggtcacaccgattcattacccgcatgctgatgaaatggggcgcatgatcgactcgactcaacgcttgatgcagagcatgcaggccctcaccgatcaagccaatgccattgccttgggtaactatgcccaacgcgtaaaaatactctcccaatatgatgtgttgggcaatgccatcaataacatgagtttcgccctacagctcaatgaacaacagcaacgccagcgtgaatggcataacgaaaatttgaatcgacttacccacgacctttccggtgatttaacccccgagaccttggcccaacaagccatcaccttgattggggaggctattcaggcaggtcgcggtggcctttatatctatgacgatcagacgcaaccccataagccactgctgttggtcggccgctatatgtttacccaacacgatgaagggcaacagcggttttccatgaatgagggcacggttggacaagccgcagcacaaaaaaagcccattttgttggaatgcctcacgcctcctgcggaccaattaagcagtggcgttgcaaactttagtgcccgcaacagttataccctacccctgctctacgaggaccgtctacaaggggtgttggaagtggcgacccttaacccacttaacacacagcatcgccaatttttagatgccgcttgccaaataatcgcggccactctgtttaccagtctccagcgtgagcgtattgccaacctactggtactttcgaaggctgcgactcaacgtgccgaggcccaaagccaccagctccaacttgccaacgcccaacttgaagagcaacagcagcagctacaacagcaaaccgaagagctccaacagagcaatacgcagatggagcatcagcaacaactattgcaacaacaagccgaagagctgcgtatcaataacgaagcgttgcaacactctcagcatgagctcaatcagcgggctatacagcttgaggaagccagtcaatttaaatctgactttttggccaacatgtcccatgaactgcgcacccctctcaatgccattattttaatctcaaatttaatgtcacgtgatgaaaccggcaggttggatcaagagagtatcgagcggacgcgggtgatctataatgcgggtaacgatctattgcgtttgatcaacgacatcttagacctctccaaagtggaagctggccgcatggaggtgcacttagaaaccgtgcatagccaagaattggtcgaagagttagagcccttgttccgggatagcgcccaggagaaaaagattgagttgcgctttgatgatcagcttcaaggctgctttaccagtgaccaccaaaaggtggtgcaaattctgcgcaatctgctctctaatgccatcaagttcaccgcccagggttcggttattttaaggttggccaaaagcgatcatccacaataccccattcgcctaagtgtgacggataccggcattggcatttctaaagataaaatgccctatatctttgaggcattccgtcaaatggatggttccatctcgcgtcagtatgggggtacggggttggggctcgccattacccatcgctttgccaccctcttaaagggagaggtcgagttgcatagtgaagagggcaaaggcagccaatttaccctactgctgcccttagcccaccctcatgagaacaccgagcacgggcaaacggagcctaacgcaccgctctctgagaccaacggaccaaccgccgagcccaccttgatgccgccgcttccctccagatttttgctcaaggggcggcctaagatcctagtgattgatgacgatctgctgtttgtggaaaacatctcttacatcaatcaggcgcaaggcttggataccctctcagcacatgatggtcgcgagggattaagagtcgccaagagccatcatccggtgggcattatccttgatcttggtctacccgatatgcggggagaggaggtgctggagcaactcaagcgctcaccggagctacgtcatattccggtttatatcatttcggccaaggataaacagcgtgccttggtggaccaaggagccatcggctttttacaaaaaccggtcaatgatgcccaaattgccacagctcaacggacattgttgcaa

SEQ ID NO: 33701 - DNA, 1641 bp, magnetite-containing magnetic coccus
atggctgccaaagaagtaaagttcggcgaagctgcacgcgccaaaatgctgaatggtgttaatatcctggctaacgctgttaaagtcaccctgggccccaaaggccgcaatgtggtgctggacaaatcctggggcgccccccgcatgaccaaggatggcgtctccgttgccaaagagatcgaactggaagataagtttgaaaatatgggcgcacaaatggtgcgtgaggtctcctccaaaaccgccgatgtggccggtgatggtaccaccaccgccaccgtgctggcccaagcgatcatccgcgaaggcatgaaagcggttgccgctggcatgaaccccatggatctgaagcgcggtattgatctggctgtcgaagccgtggttgtgggtctgaaagggatctcccgcgaagtggctaactcccaagagatcgcccaagtgggcgcgatctccgccaactccgataaagtggtaggcgacatgatcgctgaggccatggataaagttggtaaagagggtgttatcaccgtggaagaggccaaaggcctggaaaccaccctggatgtggtggaaggtatgcagtttgaccgtggctacctctccccctattttgtcaccaacgccgacaaaatgttggtgcaaatggagaatcccctgatcctgttggtggagaaaaaaatctccaacctgcaacagattctgcaaatcctggaaggcgctgtgcaatcctcccgccccctgatgattatcgccgaggatgttgagggcgaagccctcgctaccctagtggtcaacaagctgcgtggcggcctgaaagtgtgcgccgtcaaagcccccggctttggcgaccgtcgtaaggcgatgatggaagatatcgcaaccctaaccggtggcgtgctggtttctgaggatgtgggcgttaagctggaaaatgtcaccatggatatgctgggtatggctaaatccatcgtcgtgaccaaagaagacaccaccatcatcgacggtgctggcgaccacgaagccatcaaggcccgtgtcaaccagatccgtgcacaaattgaagagacctcctccgattatgaccgtgagaagctgcaagagcgtctggccaagttggctggcggtgtcgcggtaatcaaggttggtggtgcgactgaagttgaagtgaaagagcgcaaagaccgtgttgatgacgccctgcacgccacccgcgccgctgtggaagagggcattgttcctggtggtggtgtggccctgctgcgcgcccgtgaagcctccctgaccaacctgcaaggtgccaaccatgaccaacaggtgggcatcaacatcgtgacccgcgccctggaagagcccctgcgcatcatcgcttccaatgccggtgctgagggttccgtggtggttaaccgtgtggttgagaccaaagagaccaactttggcttcaacgccgccaccggcgtgtatgaagatctggtcgccagcggtgttatcgaccctgccaaggttgtgcgtcatgccctgcaagctgcggcttccgttgctggcttgatgatcaccaccgaagccatggttgctgaactgcctaaagatgagcctgccatgcccggcggtgacatgggcggtatgggcggcatgggcggtatg

SEQ ID NO: 33702 - DNA, 288 bp, magnetite-containing magnetic coccus
tcgatcaattttcgtccgctgcatgaccgtgttgttgtaaagcgtaccgagtctgacgccaaaacggctggtggtattattattcccgataccgctaaagagaagcccgttcaaggcgaagtactggccgtgggtagcggtgtggtgaacgatgcaggaaatgtccgtcccctggaagtcaaagtgggcgacaaagtgctcttttctaaatatggtggcactgaagttcgtatcgatggcgaagagctgctgattatgcgcgaatccgacatcgtgggtatcctgggc

SEQ ID NO: 33703 - DNA, 867 bp, magnetite-containing magnetic coccus
aaggggattgtccttgctggtggatccggcacccggctgcacccggtgaccataccgatctctaagcagctcttaccgatctatgataaaccgatgatctattaccccctgaccacgctgatgttggcaggtatccgggatattttaatcatctccaccccacaagatacaccccgttttgagcagttgttgggggatggctcaaattggggggtttccctctcctatgcggtgcagccttctcccgatggtttggcgcaagcatttattattgcagaagattttttggatagacagccttgcaccatgatattgggggataatatcttttttggacacgacttgtcgcaggtgttgcagcgggttgccttgcggcagcaaggggccaccgtatttgcctatgcggtcagtgatccagagcgctatggcgtggtgcattttgatagccaaggtagggcgttgggtattgaagagaaaccggcgaagccaaaatcgcgttatgctgtcacggggctttattgctacgaccagcatgtggtggagtatgcccgcgcgctacgtccatcccctaggggggagttggaaattaccgatctgaacaaccgctaccttgccgagggctctttgtcggtagaacggttggggcggggttacgcttggctggataccggtacccatgactccctgctgcgcgcggccacctttgtggagacgctggataaacgacaaggggttaagattgcctgtccagaagaggtctctttccgtatgggctggatcgaccaagcacaattgcgggcgctggcccaaccctatctaaaaaatggctacggccaatatctgctgcgggtgtgtgaagagcccgat

SEQ ID NO: 33704 - DNA, 1020 bp, magnetite-containing magnetic coccus
aaggtattggttacgggtggtgccggttttattggctcggagttggttaggcagctggtgacacaggcagagtgctcggtggttatggtggatctcttaacctattcgggcaatctggcttcattggcaccggtcgccgcgcggccaaactatcgttttgtgcaggctgatatctgtgaccgaggggccatgagccaactgtttgtgcaagagcagcctgatgcggtggtacatttggccgcagaaagccatgtggaccgctccattgatggtcctcttacttttgtacagaccaatgtgatgggtacggctgtactgctggagtcggctcgggcctattgggtgcaaaccgcgcccgccaaacaacaaacctttcgttttttacatgtctccaccgatgaggtgtatggcgctttaggggagcaagggctctttacggaacagaccccctatgcccccagctcaccctattcggccagcaaagcggcttcggaccatctggtgcgggcgtggtataccacctatggcctgccgaccctgattaccaattgttccaataattatggaccctaccaatttccggaaaaattaattccattgatgattttaaatgccctagcgggaaagcctttgcccgtctatggtcaaggtagcaatgtgcgcgactggctctatgtggcagaccatgctcgggcgctgcgacaggtgttagcccaggggcaggtggggcaaacctataatattggcggtggggctgagcgtagtaacctgacggtggttcaaaccctctgcacccttttggatgaattgcagcctagggaaaagccctatgcttcgctcatcgcatttgtgcaagaccgtcccggccacgattttcgctatgccattgacgccagtaagataagcgagcaactgggatggcagccaacggtcagttttgaacagggtcttagagagacggtaaagtggtatttgcagcacccccagtgggtagagcagatccgcggggtggcagagcaa

SEQ ID NO: 33705 - DNA, 1188 bp, magnetite-containing magnetic coccus
gaactgcctgccattgcgggttttcgtgccgctgcgacggcgtgtggcattaaaaaaaatgagaccctagaccttaccctggtcgccatgcaggcgggcaccagcgtggctggtgtctatactaaaaatcgcatcgtttcccccactgtcaccctttgtcgggaccggcttaaggagcgcgaagcccgtgctttgctggttaactccggcaatgccaatgtgagcaatggtccacaagggatgctggacgccctctccaacggcaaaacggtagccgaccaactgggcgtagaagatcgccaagtcttcatctcttcgaccggggttattggcgccgcactgcccgtgcataagattaatgcggccattccgggtttggtggaaaatttacaaccgggcaattggttacaggccgcacggggcattatgaccaccgacacctttgccaaggttgccgtgcgtcacagccagattgatggcacccctatcactatggtgggcatggccaaaggatcgggtatgatccaccccaacatggcgaccatgctggcctatctgtttaccgatgccgccgttagtagcgagctgttgcaaaccctgcttaaccgggccgtgcagttaagctttaatagcattacggtggatggggactgctccaccaacgacaccctcatgctgtttgcctctggggccgcgccacatacccccttggcagatgaagatgacccacgtcttgccccctttgccgaaatgctcaatgatctggctatggaactggcccagtggattgtgcgagatggtgaaggtgccagcaagtttgttaccgtacaggtgcgtggcgcccaagatgagaccgctgcccggcaagtggccatgaaggtggccaccagctccttggttaaaaccgcctttgcgggttctgaccccaactgggggcgcatctgtatggcggtaggttcggctggaattgctattgaagaggatctgattgatatttttctaggggatgtgcaaatcgttaaccgaggccagcgtgacgccgcttataccgaagagcagggacaggcggtcatgaacgaggcagagattggtattaccattgatctcaaccaaggagaggcccaagccaccatctggacctgtgaccttacccatgattatgtgtcgattaatgccgactatcgcagt

SEQ ID NO: 33706 - DNA, 2157 bp, magnetite-containing magnetic coccus
ttggaccctcaacagatccaggaactgcaatctggtttctccgctgatccctttgccgtgctcggtcgccacgaccagcccgatggacaggtggccgtcactgtgctcagcccccgcacagagcggctatttttaaccaatatcggtcaggaaatgacgcgcataccggacagcgatctgttccattggtgtggtgatggacgcgcactgccctaccattatcgtttgcgccgagtggatgcccacggcagccaaaccgaatttcatgacccctacagcatgccaccgatgattggtgatctggaccgccatctctttaatgagggcacccaccaccatgccggccagtttttaggcgctcaccgtatggaggtggagggcattcgtggggtctgttttgccgtttgggcccccaatgcccaacgggtaagtgtggtgggggatttcaaccaatgggatggccgtatccaccccatgcgcctgcaccaagatagcggcatttgggagatctttatccccgcgctgaaacggggcgaacattataaatatgaaattcgtaccaccaacggtgccttgctgctcaaaagcgacccctacggccatgctcatcaactacgcccagaaaatgcctcgatcatcacagaaccgagcaactacccctggcatgatgaggtgtggatgcgtgctcgcagccgctttaattggcaaaaaaaacccattagcatttacgaggtacacttaggttcctggctcgatgctgccacggacccctttcccaactatcgggagctcggcaaacgcttggcccgctactgtagcgaaatgggctttacccatgtggaactgatgcccatcaatgaacacccctttgatggctcctggggctaccaaagtaccggttattttgccgtcacctcccgctttggcgatggggatgattttcgcgctatggtggaccaactgcacggcgccaatattggggttatcctagactgggtgccggcgcattttcctaaagatgcccacggtttggggcagtttgatggcacagccctgtatgaacatcaagacccccgccttggggagcatcaggattgggatacgctgatttttaattttggccgtcttgaggtcaaatctttccttatatccagcgccctacacatgctcacccgctaccatctggatggtctacgggtcgatgccgtagcctccatgctctacctggactactcccgcgaggattggttgcccaacaaatatggtggccgggaaaatctggaagcgatcacctttttacgcgaacttaaccaggcggttcaccatgactgccccggcgtgttgatgatcgctgaagagtccacagcttggccacaagttacccgtccccctgagttgggcggattgggttttaacatgaagtggaatatgggctggatgaacgataccttgagctatttcagcaaggatcccatccaccgaaaatatcaccatgataatctgaccttcagcctttattatgcgttttcagaaaacttcaccctgcctttttcccatgatgaggtggtacacggcaaagcctctatgctgggcaaaatgccgggggatgagtggcagcggtttgctaacctgcgccttctttacacctacatgtttacccatccggggaaaaagctgctgtttatgggatgcgaatttggtcaaagccaggagtggaactttagccaagccctaccgtgggaactgctggagcacacttttcacaagggtttacaacaactggtcaaggatcttaacctgctctattgcaaggaaaccgccctgcacgagcgggacttcacccccgatggctttcagtggatcgactgtcacgacagtgaccaatccattattagctttcagcgtaaatccagcgagggtgaggtggtggtactgctcaactttacccccatcccccgagacaattatcgcatcggcgtaccccgcccaggtctttataaagagatcttcaatgccgactcaggccactatgggggcagcaactatggcaatggtatgagccagttactaaccgaaccctacccttggatgaaccagcttcaatcgttggtgcttaatgttccccctatggcgggaattatcctacgctgtgagcaa

SEQ ID NO: 33707 - DNA, 1233 bp, magnetite-containing magnetic coccus
agcatgaaactcggtattaatggcatgggccgcattggcaaattgaccctctggcaacatatcgccaagcagagctttgacgaaattgtggtcaatgtgggccgggatgttggccgtggtttggaggatctggcccaagttatccgcaaagacagcacctatggcagtttagccagctacctctatggctttcgtggcggcgagcccattaccgccatcgacaatgatgcaggcactatgctcatccatggcgttccggtaacctttttgcgccgcgcccgcaatcccaaggatataccctggggggagcacggggtggggttggtggtggattgcaccggtgcctttgttgaccccacagtaccggcggatgatccccgtggcgccctgcgtggccacctggaggctggtgcggaaaaggtcctgctctcggccccctttaagattaaaaacaaagagctgagcatgccagaggatgccatcacctgcgtgatgggcatcaacaatgaacagtatgatcccagccagcaccgtttaatttcagccgcctcctgcaccaccacctgcctgtcgtatatgatgaaacccatgttggagcattttggggtacaacgtattttatcggcctccatggttaccattcatgccgccacctcaagccagatggtgctggatgcggtgcccaaggcgggggccaccgatctgcgtaaaaaccgtgcggtgatgaacaacattatcctcaccaccaccggtgcggctaaagccttggccgaggtcatcccccaggttgccgagattggctttatggccgaatcggtgcgtattcccaccaacagcggctcgctggtgatcctcacccttaatttacaatccgaagccgaaggggaacccatcaatcggcaggcggtgaacgccatttatcgcgaggccagccaagggctctaccgggaccatttggtctttagcgaggcgcaaaatgtctcttcggacattatcggctttcccaaagcggccacggtgattgaatcccgcgagacccatacccgtaccgcctactcccatgtggatcttagccgtctaccgggtctatcctccgagattaaggcccagttgcaggtaacccggctggatgtgcccgtcacccaagcggttgtttatggttggtatgacaatgagtttggcagctacactaatatgttgggcaatctgaccgaacatgttggccagcaactg

SEQ ID NO: 33708 - DNA, 1488 bp, magnetite-containing magnetic coccus
ctgggcaacaaaggctataatctggcccgcttggtggtcaacggtgccccagtaccagcgggcaccatcctgacgaccgagtttttccgctgccaccgcctaatccacgaccacccccccgcctggcaagattttatggcgcggctacgcgctgaaatggccgcattagagcagcagaccgggctggggttcgccgatcctcaacgccccttgttggtttcggtacgctctggggcattgatctccatgccgggcatgatgcaaaccatccacaatgtgggcattaacgagaccattgttgccgggctcagtcagcaatcgggcaatgccttttttgcctgggacacctaccgccgttttattcaatcctggtgcatggcccacgatgtggagcggggtgtttttagcgacatcatgcgcagctttaaacagcagtatggggtgaaaaaaaaggggcaattcagcgccgagcagatgcgccagctcgcctttgcctaccgggacgctgcccgtggattggccatcaccctgcccgaagagccctggcaacaattactggctgccattgaattggtcctggcctcctggcatggggagaaggcccaccactaccgggccatcatggatctttccgacgcctggggcaccgctgtggtgattcaaaaaatgatctatggcaacctgctacagagcatgatcaccgaagagaccgatggtgcggcctgtccccgagtgctgtcaggcaccggcgtgctgtttaccgcccacccctaccgcaaactcacccaagtgatgctgtggggggactatacccccggcaaccaaggggaggatattgtggggggattggtctccacctggcccattagcatggagcagtgttacagcgaccatcgcgacccccagcaggcccttgaacaccgtttcccccttatctatcagggtttattggagctggccaaaaccttgatctacacccgcgactggaaccatcaggagattgagttcacctttgatgggccaaccgtggaacatctgcacattctgcaaacccgcaacatgatcacccgtgagagcctccattcggtggtgagcggctttaagcttcatggcagcctgaaagaacatctcatcggccaaggcattggcgtgcatggcggagccttatgcgggcgggcagcgtttaacttggagcagatcgagaccctgcgccaaacctatcccagcgatcccttgatccttatccgctacgatacggtcagcgatgacattaaggagattagccaaagccagggcttgctcaccgcccgtggcgggcagacctcccatgcggccattgtggcggcctccctccaaaaaacctgcgtggttgggtgcgaatccatgcgggtatgggagctccaaggttactgcaaactggatggggtgacggtcaaattgggggacgccatcgccattgatgggcataacggtcatgtgctgcggggg

SEQ ID NO: 33709 - DNA, 1398 bp, magnetite-containing magnetic coccus
tctgatacgtttgatctggtggtaattggtggtggtcctggtggctatgtggcggccattcgtgccgcgcaactgggcttaaagaccgcctgtattgataagcgcccaacgctggggggcacctgcctgaatgtgggctgcattccttctaaagcgctgttgcaatcctctcaccaactagagaccgcccagcatgccatggcggcccatggggtagagatcaaaggggttaaggccaacttaaccaccatgatgcagcgcaagcaagaggtggtgcaggggttgacccagggcattgcctttctctttaaaaagaacaaagtcacccaccttatgggcagcggtaccattgtggacagtagccatgtgcaagtgaccgcagcggatggcagcgtacagaccctaaccacagagaacattctcattgccagcggctccgaggttgccaccctgcccggtttggagatagatgaaaaacacattatctcgtccacgggtgcccttgcattggacaaggtgccaaaaaaaatggtggtgattggtgcgggggtgattggcttagaactgggctcggtctggcgccgcttaggggccgaagtgacggtggtggagtttttggatggcatcctgcccggcatggatggggagattcgcaaaaccgcccagcgcaccctgagcaaacagggcatgcactttaaactgggcaccaaagtgaccgcagccagcgtgcttaaaaatggcgtcaagctcaccatggagccggttaagggtggcgaggccgaagaacgacaggccgacgtggtgttggtggcggttggccgcagaccctacacccaggggctgggactggaaaacattggggtcacgctggatgagcggggctttattcccgtggatcatgatcgacagaccacctgcgcgggggtgtttgccattggcgatgtgatcggcggggccatgctggcccacaaggccgaagaggagggcagcgccgttgccgaagcgttggctggtcaggtggcccatgtcaactatgacgccattcccgctgtggtctacactcacccggagatcgccagcgtggggcaaagtgaggagtcccttacagcggcgggtatcccctataaagtgggtaaattcccctttatggccaactcgcgcgcccgtgccattggcgatgccgagggctttgtaaaaattcttgcccatgccaccagcgatgccattttgggggcccatatcatcggccccgcagcgggggatctcattgctgagattgtgctcgccatggagtgtgacattagtgccgaggatattgcccgcacctgccacgcccacccagggttgggcgaagcggttaaagaggccgctttagccgtggataaacgtgccatccac

SEQ ID NO: 33710 - DNA, 1329 bp, magnetite-containing magnetic coccus
acggaaatcaaggtgcccacacttggtgaatcggtaaccgaggccactgtcgtacagtggctcaaacaggtcggcgatgccgttgctgttgacgagcccttggtggagttggaaaccgataaagttacggtcgagatgccctcgccggtggccggagttattaccgaaatttacgcgggtgtggatgccgatgtcgaggtcggggccgtgctctgcgtggtggatgcccagggcagcgcccgcgtagccgtccccgccaaaccggcggctgagcctgccccggctccagcggtggcgacagccgcgacacccgcgccagcggtggctacaccggccccaaccgtgccggttgccccccccagcggcggagccgccctctccccagcggtgcgtaaactgctggctgaacatggcctagatgccacgcaaataccggcaacgggtagcggtggacgactcacaaaaggggatgtattggcctatcttgagcagccaaaacctgctccaacggcggcaccaacccctgctccaacggcggcaccaacccctgctccaacgccaacaccggcccccgctccaatggccaccccggcactcgccccggcagcgcagctgccccccgccgtcgaaggcccccgcgaagagcgggtcaagatgtcgcgcctgcgtcaacgcattgcccagcgtttgaaggaggcgcaaaacaccgccgccatgctcaccacctttaatgaggtagacatgacggcggttatggcgctgcgcagccaatacaaagaggtgtttgaaaagcgcaaccatgcccgtttgggttttatgtccttcttcgttaaagcggccatctcggcactccaggagtttcctgcggtcaatgctgagatccagggtaacgagattgtctttaaaaactactatgacattggtgtcgcggtgggctcaccccagggcttggtggtcccggtcctacggggggcggacgccatgtcgttggcgggcattgaatccaccatcgcgggcatgggcaaacgggcccgtgatggccaactctccatggaggagatgagtggcggcacctttaccatcaccaatggcgggatctttggctccctgctctccacgcccattcttaatacgccccagtcggcgattttgggcatgcacaaaattcaacaacgcgccatggtcatgccggatggctccatccaggcccgtcccatgatgtatctggcactctcttacgaccaccgcattgtggatggtaaagaggcggtgagttttctggtgcgcatcaaagattgcatcgaggatcccgcgcggattctgctcaac

SEQ ID NO: 33711 - DNA, 2868 bp, magnetite-containing magnetic coccus
ctggacgcactcctaaacgggaccaacgccctctatatctctgagctctacgcccggtatttggataatcctcatgcggtggatgccacctgggcgaccacttttggcgaactgaccgaggatgaaaccccggaaatttttaaagagattcgtggcgccagctggtcaaaattggagtctggcattctgggcaaaccccttgaacgcgaccccgacagccaaacccgtcacgctcactttgtgcaaggggtcacacaggtggccgggaccgagccagaacagatccggcgggccaccttggatgccattcgggctttaatgatgatccgcacctaccgagtgcggggccacctgatcgccaactttgaccccctcggactggaggcacgggaacaccatccagagttagacccggccaactatggttttgctgaagaggatatggaccgccccatctttattgattatgtgttgggcttagagaccgccaccctcagacagattgtacgcctgcttaaagagacctactgcggcaccattggcgttgagtttatgcatattcaagagcccgaagagaaagcctgggtgcagcgccgtattgaatccattcgcaaccgtacccacttcaccctcaagggcaagcgcaccattttgcaacgcctctccgagtcggaagggtttgaaacctttctacagctcaaatataccggcaccaaacggttcggtctggatggcggtgaatcgctgattccggccattgagcaaattctaaaacgcggcacccaactgggccttaaagaggtggtcattggcatggcccaccggggacgtttaaacgtgctggcgaatattatgcgcaagccctacgccgccattatgcatgagttccaggggggctccaacaaaccggacgacgtgcagggttccggggatgtgcgttatcacttgggggcctcggctgaccgggtctttgatgacaaaaaggtccacctctccctcaccgccaacccctcccatctggagttggtcaaccccgtggtattgggcaaagtacgcgccaaacagctccaacgtggggataccagccaacaacaggtcatggggcttatcatgcatggcgacgccgcctttgccggccagggtttggtgcctgaatccctggcgctatcgggcttaaagggctatcaaaccgggggcaccatccacctgattgtcaacaaccagatcggctttaccaccaacccccgcaactcccgttcgtcgccctatccgtcggatgtagccaagatgattcaagccccgatctttcatgtgaatggggatgaccctgaggcggtggtgcatgcggcccgcattgccatcgagtatcggcaggcgttcagtaaggatgtggtgattgacatgtggtgttaccgtcgtcacggccacaatgaaggggatgaacccagcttcacccagcccattatgtaccgtgccattgccaaccaccccaccactcggcaggtctacgcccaaaaattggagcgcgagggggtacttaaagagggcgaaggggagcagatttacaaagagttccacaatgagctggagacctcgtttcaagaggcccaatattttctgcccacctcggccgactggctggatggtatgtggaaaggggtctctaacctgcggggcgaggaggagatgcaccagcacaaaacctgcgtgccagaacgcaccctgcgcgaggtaggcaaggcgctctacacgccaccccaggattttgcggtgcaccgtaaaataatccggcagctacgcagcaaagagcagatgtttgaaagcggcgagggttttgattgggccacaggtgaggcgctggcctttggcaccctattggtcgagggcattcccgtgcgtctctcggggcaggattgtggccggggcaccttttctcagcgtcattcggtgttgatcgaccaaaatgatgagtctcgttatgaacccctgaaccatatccgttcgctccaagccgattatgaggtgatcgacagccccttagctgaggcatcggtgttgggctttgaatatggttacgcctcggctgacccccatgcgctggtgctgtgggaggcgcagtttggtgattttgtaaatggcgcccagatgattatcgaccagtttatcagctcgggggagtctaaatggctgcgcctaaacggcatggtcatgctgctgccccatggttttgaggggcagggccctgagcactcttcggcccggcctgagcgatttttacagctctgtgccgaggataatctacaggtctgcaatctcaccaccccggccaactattttcacgcgctacggcggcaaaatcaccgcaatttccgcaaaccgctggtgatttttaccccaaaatcgctgctgcgccataagctttgtgtctccaaactcgaagcgtttatcagcggttcatcctttcaacgggtgtatgacgaggtggacaccctggttgccgacgaagcggttaagcgggtggtgctgtgtagtggcaaagtctactacgaactgctacagacccgccgtgagcaagggagcaacgatgtggccattgtgcgcattgagcagctctacccctggccccgcaacgccctgtttaaggtgctccagcgttatgccaatgccgagattgtgtggtgccaggaagagcccgccaacatgggttattggagcttcctctttcagcgcctgatccatctgctcgaggatttgcagagcaaacagcgtctgcccatctatgcaggacgcggggcttcggcctcacccgcttctgggttggccagcaaacatcttcaagaacagacgcatttggtccatgaagcactc

SEQ ID NO: 33712 - DNA, 1635 bp, magnetite-containing magnetic coccus
attaaagaagatattagccagatgaaggaggatcaagagcggctggcgcatgccaaagagagtgccgatttagccaaccgtgccaaaagcagctttttagccaatatgagccatgaaatccgtacccccataaacgccattgtcggcatgtgtcatttggcgcaacggatgacggtcgagccgaaattacgggactatttgggccatattcaggtggcagccgataccttgttgggcattattaatgatattttggatgtctctaaaattgaggcgggtaaacttcattttgaggatatcccctttaaactagatgagcttataagtcgtgtaatgcgactacaaggcttgaaagcgcaggataaaaatgtagagctggttatcgacttagagcctcaggtgccgcaaactgtggtgggtgatccgctgcgtattagccagatattgaccaatttggtcaacaatgccgttaaatttaccgaacagggcgaggtggtgctctcggtcaaactgcaaggggtgtttgacgggcgtgtcaccctgtacttcgaggtacgtgatagcggtattggcatggaggatgcccaacttcagcgactttttaccccatttcaacaaggggatgactccatgacccgtcgctatgggggcacggggctgggtttgagtatctgccaaaacttggtcaagatgatggggggccacttacaggtcgagagcaggttgtctgaagggagccgtttttactttacggtctctctgccaatccaccaggcgccggcgcttgaaagggttgatcaaacctctttgaacctgcgggtattggtggtggacgataaccagaccgtgcgcgaggttttgcagcgtatgttgaaatcctttggctattgggtggatctggctgcggaggggccgacgggtgtggcgctggtggagagtgctctgcaacaggggcagccctacgatttgatcttgatggattggcatatgccacagatggatggccttcaggctagcgagcagatacggcacttgcaaggggttcgcgcgcaaagaacgccagtcatgattatggccgccgcatatggtcaagaagatagccacacagcggtctccgagccgggctttgcgggctttttggagaaacccacaacccctgcaaatttattcggtgccatcatgatcggtttgcatggcgccccgcaagaagccccttctggggatgctgggtgggggtatacggtcccagacctgtcaggttatcgggtgctgttggtggaggaccaccccatcaatcaagcgttggcgcgtgagatgctctcgttggccaaactacaggttattacggcggatcatgggcagcatgccttggatctgttgcaagaagcgtctgtggatctcatctttatggatatccagatgccggtgatggatggcttttctgccactcaagcgatccgcgccgatccccgttggcaacatatcccaattattgcgatgacggcccacgccatggccgatgatcggcaaaaatgtttggatggggggatgaacgaccatctgggtaagccgattgatccaccgttgctgtttgccaaaatcacccagtggttagggccgcagcaaagggggagg

SEQ ID NO: 33713 - DNA, 777 bp, magnetite-containing magnetic coccus
caataccctccactttggtcagctcgtcctattgaagagcaggttgagccccctttggtaaagctacctattgagtcttacgaagcggagattttctcaccacccacacctctcccccaaagcgcggtggccttagacaaaggtgaaccatttaatacgaacggtccgatttctttaaaacctttggtcacaaaggttgatccctcctttcacgaccaagttatgccccccgtggttaacccggttgagcgcccccatccaaccccagcaccggtgaacgctctgcccagcagcgcgagcctcccagcaccggtgaacgctctgcccagcagcgcgagcctcccagcaccggtgaatgatctgcccagcagcgcgagcctcccagcaccggtgaacgctctgcccagcagcgcgagcctcccagcaccggtgaatgctctgcccagtggtggtcaacctgcggcaccgattcgcatcatggttcagccgaaccaaggtttgcctcacccgctcaccatgcgacagcaacccatcgagcgtgtggcttctgttaagcctgttgtgcggccaaccgccatagaacaagcctcaaaaaaaagcgttgagatgcccgagctaccacccataaagcgggtggaaatggaacaggagcctatttggcccgcatctttggtcgagcataaaagggtcccagagcctaaacatcgctcgacctatcgggccataaccgccaaggccgtgcctcgtccccatgggataacccccccttatggaaaa

SEQ ID NO: 33714 - DNA, 1263 bp, magnetite-containing magnetic coccus
ctagagaccttggccatccacggaggtttttccccagatccaaccaccaaggcggtggcggtgcccatctatcagaccacctcctatgcctttgacaatacgcagcatggagccgatctttttgatctcaaggtacccggcaatatctacacccgtattatgaaccctaccaccgatgtgttggaaaagcgcgtggccgccatggagggaggtatcgcagcgttagcttttgcctctggcatggccgccattaccgctgcgattcaaaccatctgccgttgtggggataatatcgtctcggtcagtgagctctacggtggtagctacaacctgtttgcccacaccctaccccagcaaggtattgaagtacgcatggctaagtccgatgattttgccgcaattgctgcccatgttgacgataaaacacgggcgattttctgcgaatccattggtaaccctgcgggtaatgtggccgatatctcccgtctggcagaaatagcccacagcgctggggttccgctgattgtggataataccgtgccaaccccgtgtctctgccgtcccattgagttcggtgcggatattgtgatccatgctctaaccaaattcatgggcgggcacggcaccagtattggtggtattgtggtggattctggtaaatttccttgggcggagcatggggagcgctttcccatgatggtgacccctgatgcttcctatcatggcgttgtctataccgaagcctttggagctgctgcctacattggtcgctgtcgcgtggtgcccttgcgcaacatgggggctgccatctccccctttaatgcgttccaaattttgcaagggattgaaaccctgccgctacgcatggagcgccactgtgaaaataccgaacgggtggcaagctacctaagcagccacccccaagtcagctgggttcgctacgcagccctgcccgacagtcctgctcgcagcttggccgatcaatatatgggcggtaaagcctcgagtattctctgctttgggattaagggtggccgtgaagctggggctaaatttattgatgccctgcaattgattgtgcgactcgtcaacatcggggatgccaaatccttggcctgccatccagccaccacgacccaccgtcagctaaatgatgccgaattggtcaatgccggggtttctgccgatctcatccggttagccattggcattgaacatattgatgatattcttgccgatgtgagccaagctctggaggccgcc

SEQ ID NO: 33715 - DNA, 1221 bp, magnetite-containing magnetic coccus
gctgtagaggggcttgcacatgatgtgacggagcgtcatcgagccgagtttgagttgcttactgcgaaggaacaggccgaggccgcaaaccgtaccaaaagtgaatttttggccatgatgagccatgagatacggacccccatgaactccattcttggcatggcagagctgctcagtgaaagccctttaacccccgaacaacaaggctacttaaaaatccaacggcgtgcaggacatggattgctggagctgatcaacgatattttggacctttccaaactcgaagcaggtcggattgagctatatattcagccttttaatctacctgagttattgcaatccgtcgttgatctgctggaaaatctcgcccgtgagcgagggcttgctttacgcttggaaaggatggaggagatccccactttatgccagggcgaccgggctagactgcgacagattatggttaatctggtgggaaatgccatcaaatttacccatgatggatccgtaaaaataagcgtagaaaaaagcagtgatgatgcaacaaatctgctgtttcatgtgattgatagtggtattgggattgctgaaaaagatcaatcctctgtatttcaacgctttacccagattgactcctccaacagccgcttctatggcggttcggggctgggcttggccattacccaccacttggtagaattgatgggggggaaaatctggctaaaaagtgctttgggagaggggagctgctttacttttactctgccattgccccccgtacagatcgatgaaccggctttagccgcaacccacgacgaagaagcccccatggtggccacggaatcatgctgtgccacgaaaccattgcgtatcttgctggctgaagactccccagataatgaactgttaatccgcatttttctcagagatagcccgcacagtttgtgctgtgtaaaaaatggtcttgaggcataccagcaggttcaaaaagagaactttgatttgattttgatggatatacagatgcccgtcatggggggggatgaagcgattattaaaattcgcgcatgggagcaatctcagcaatgtgaccccaccatcatcattgccttgaccgcccatgcgatgagtgaacatcaaaaacattacctcaccttgggttttgatgcctttctgagcaaaccgattaataaaaaaacattgttaaatgccctcgcccaatat

SEQ ID NO: 33716 - DNA, 576 bp, magnetite-containing magnetic coccus
gccacggagtcccgcaccaccggcgaaaccaagatccaagtcacccttaacctggatggcagcggcaaggcccaggttgatactggggttggttttttggaccatatgttggaccaaatcgcccgtcatggcggcatggatctggaaatcgaggcatgcggcgaccagcacattgatgaccaccataccgtagaggatgtgggcataaccatgggtcaagcctttcggcaagccatcggcgaccgtcgcggcatcacccgctttggtcacgcttatgtgcctctggacgaagcgcttagccgggtggtggttgatctttccaaccgcccctccctctcctggcgggtcaagttccccacccaaaaggtgggcaacttcgatacagaactgtttaaagagtggtttgccgccttcgctcaacaagggggcattaccatgcatgttgaatcgctctacggagagaacagccaccatattgccgagagctgttttaaagccttggcccgcgccctgcgtagcgcgtgtgccgtggatgcgacattgggcggggtagcgcccagcaccaaaggcactctt

SEQ ID NO: 33717 - DNA, 2673 bp, magnetite-containing magnetic coccus
gtcagcattgctgatgccaccggaaacattacctacgtcaatgaaaagttctgtctggtcagcggctacgcagagtccgagctgttgggcaacaatcatcgtgtgctgagttcgggccatcatggggctacgttttttcaggaaatgtggcacaccattgaacagggtaacgtgtggcatggtgagctgaaaaaccgcgccaaggagggtggttttttctgggttgcatccaccattgtcccctttctggacagtcagggtaagccctaccaatatatctccatacgtaccgatataacccaacgtaaacgggttgaagagcagcatgaaaaacagaagatttttcttcagggaatcaccgatgccatgggcgaggggctctttgcggtagaccgcgaaggggcttgtatttttattaataaacaggccgaaaggatgctcgggtggagtgccgaagagatccacttaaaaaaaatgcaaggattgattcacgcatcgacgcggattgcggatgcctaccaatggcccgccttgcgtagcatggatgaagcggcgccggcccgttcggaggatgaacattttatcaaccgtagtgggcagatgttccccgtttctatggtggctgtgccgctagaggaaggggagcgcatcgtcggttcggtggtggtgtttcaagatatctcggttcgcaaacagcaagagcaggtattacagggtgcggtgcgtgcggcagaccaagccaaccgtgctaaaagcgattttctggccaatatgagccatgaaattcgcaccccgatgaacgccattctgggtatgagccatttggcgatacgcaccagcaatgatccaagacagcgtgcgtatttgcaaaaaatccatggggcggctcaatcgctgttgcacatcatcaacgacattctcgattttgccaaggttgaggccggtaaaatggagatggagatggttcccttcaacctagatgaggtgctcgataccctcgcgacgctaacctcagttaaagccgatgagaagggcctagccttaatttttaggcgtcaccttgatctgccccaacgggtggtgggggatgccctgcgtcttaaccagattttgctcaacctgaccggcaatgcggttaagtttaccgagcagggtagcgtggtggtcaatgtagaaaaagtgcagcagcagggtgatcaaatcgtgctgcgtttctctgtgcaagataccggtatcggtatggatgagtcccaaatccaacagctctttgtcgcctttgagcaggcggatagctccattacccggcgctatggtgggcgtggtttgggtttggccatctgtaaacagttggtcaacctgatggcgggtgaattgagtgtacagagcacgcccgaggttggctcttgttttacctttacggtaccctttacggtggtgcaggagcaggtggtggacgccatcgttccccaagggatacggggccgtgtggtgttgctggcagatggttcggcgctggcgcggcgggtggttgccgagatgttaaaacatatgggttgtgacgtgctagaagccgagcaggtggagcagctgctaaccgcgttgcaagccaagataggtccggatatggtgttgcttgacagtagcatggtggatgcccagggcgcacacgcttatgccgccattcgtcaggcagatgcagggggggcttgtcccgtgttggtaatgcatacccatggggaccgagaacaggttttggcatggatggccaaggataaacagttgggccatgtacaaaagcctttaaccccgtcgcggttgctggaagggatggtgcaactgttggtggatgagggccgcgtaacgggattgagcggcgagaccgatgtcatcgctcgttataagcccttgttgacaggtgccaatatcttgctggtggaggataatggggttaatcaagaggttgcctttgagctgctgagtatggttggtgtcgaggtgacggtggccgataatggcagccaagcgttaagctttttagagcaagccagctttgatctggtgttaatggatattcaaatgcctgtcatggatggttatgcggcgacccaggcgatccgtcaaaacatgtcattaaccctgcccattattgccatgaccgccactgttatggaggccgatcaagcgcgtgcgttagccgtgggcatgaacggtcatgtgagcaaacccatagaaccccataagctctatgaaatgctgttacgttggctgccctctaaaggagagccgtctagggccgttgcgcgtttgcgtttgcctggggatgaaacggagcctgacgttacgctgcctgagcagctacctgggataaacattccgctgggggtgcagcggctggtggggaataagagcctctatcttacccttctacagcggttttatcaggaccaaaaagagatcatggtgcagatccgtgaaggattggcacgcaaagattttaacacctgcatgatgcaggcacacaccttaaagggggtcgctgtgagcctcggtgccctgcctttggccgcgtgtgcgggcgtgcttgaaacagcgtgtaaacagcgcgatgagcgggcgaccacccaggcacttatccccttggcgcagagcttgagtgaggtaatggcagggcta

SEQ ID NO: 33718 - DNA, 804 bp, magnetite-containing magnetic coccus
agtcagcccccaatcgcctttctcggtggtggtaatatggccagtgccatcatcgctggtctgcacaaggtcggctatcccgccgcaaagctgcgtgtaggagagcccaacgccacccagcgagaggccttaatccgccaatttgccatccagggccatgcccataatccggatgccgtggcagaggcggcttttgtggtggtggcggtaaaacccaatctggtcgctcaagtgttgcgtgatgtggccccgcagctggcccccactgcggtggtgctctctatcgcggcgggggtggatctaaccaccatggcggcggccttgccagcgggtcaacccatcattcgggccatgcccaataccccggcgctggtgggccaaggcatgaccgtactatgccccaatggacatgttgatgcagagcaactcgcccaggcacaacgcttgctggaaagtgtgggccaggtcgcggtggtcaaacaagagagtctcatggatggggtaaccgccctctctggctcagggccagcctatctgtttttaatcgccgaggcgctctcggatgggggggtggcctgtggtctacccagagctctggccgatcaactggcggtgcagacactgttgggctccgccaccctgctacgggagagtggtgagcaccccggtgtgttaaaaaatcgagtgacttctcccggcggtaccaccattgcgggtctgggcgtgctggagcggcaaggagtgcgaggtgccctaatggctgcggtagaggccgcttggaaccgatccaaggcattgggtcaa

SEQ ID NO: 33719 - DNA, 906 bp, magnetite-containing magnetic coccus
gtgattacccgctttgcccccagtcctaccggctatctgcacctggggcacgcctattcggcgtggtgtgcctttgattttgcccaacgtcatggcgggcgctttctgttgcgtattgaggatattgatacggtgcgttgccgcccagagtataccgaggcgatctttgccgatctggcttggctcggtttttactggccagagccggtgcgccagcagtcccagcatatggtgacttatggggatgccctagtgcagttgcaggatttggggctactctacccctgtttttgtacccgcaagagcattcaacaagagatcgccaacgccaaccgtgctccccatggtcccgatggtcccctctacccggggcgctgtcgagctctctccatggcagaacgtatggagcggctgcacgagggacagagccatgccttgcggttggatgtggggcgggcgctggagctgctggggggcgtcccgctgcactgggttgatggtgagcagggtgtagagatcacggcgacgccagagatctttggggatgtggtattggcccgtaaggagtcccccaccagttaccatctggcggtcaccctggatgaccatgtgcagggcattagccatgtggttcggggcgaggatctgcgtcaagcgacccatctgcaccgtctcttacaagcgctgttggggttacgcacacccatctatcaccaccatcccctactcaccgatgagcagggtaagcgctatgccaagcgggataaaagcctaaccttacgcgccttgcgggcagagggtgtaagcgccgaggccatcatgcaaagggtgcgcagcggtgcaacgctgttagcctaacccatgtttaacagcctattgtagaagatcttaaaatacagaatctta

SEQ ID NO: 33720 - DNA, 1162 bp, magnetite-containing magnetic coccus
cttacccgcctagatgcggtgcatgagggtaccattctgtcgacctgtaaccgggtggagatctatatggccagccgcgaccccgacgcggctgcgggcccaaaccagtcagtggatcgcccgcgatcacgcccttgaccccgccgatgtcaccccccatctctataccaaggccgagtccgaggcggtgcgtcacggtttttgtgtagcctctagtctggactccatggttttgggcgaggctcaaattctcggccaaatgaaacaagcctatcaagatgctctctccgctggttccaccggggtggtgctcaaccgttttttccaacacgcctttttaaccgccaaacgggtccgtaccgaaacctccattgcggaaaattccgtctcggtggcctctgccgctgtggatctggccaaacgcatctttggtgatctgagcggtcatagctgcctgctgatcggggccggtgaaatgtgtgaattggcggcccgccatctggtaacccatggggtcaaagaggtgctggtgaccaaccgcacctttagccgcgcagtggatcttgcgcagcagtttgatggtcatgcttttcccatcgaagcattggccgaaaatctacatcgcgccgatattgtcatctcctccaccggctccaccgtctatatggtcgggccggatatggtgaaacaggctctcaaaagccgtcgccaacgccccatatttcttattgatattgccgtacctcgggatttagatcccgagatcggtcaagtggatagcgcttttctttacgatatggacgaccttaataaaatcgtcaacgacaaccgccaagaccgtgccgaggccgctcaggctgccatgcagattatcgagggggaaacccccctgtttatccaatggttggataccctggatgtggtgcccaccatcaaacagatgcgccgcaaggccgaagcggccaaagaccagctcttgcaaaaacatttggcaggctgggatctaagtgataccgaccggcaaagggtcgaaaatctggcccgccaactggtcaataagttgatgcatgatcccaccgaacggttacgtagcctaaccaatgagcatgacggcgaccgttatatcgatgcggcccgcaaactctataagttggatgacgac

SEQ ID NO: 33721 - DNA, 969 bp, magnetite-containing magnetic coccus
gcagatcccattcgcgtcgcggtcacgggtgccgctggtcaaatcgcctactctttgctggttcgtttggcttcgggtcaactgtttggtaaagaccgcaaggttgagcttaaattgttggagatcccacaagctatgggccccctagagggggttatgatggagctacaagattgtgcgttccccaccttggccaaggtggaggcctttgataaccctgagcaggcgtttgacggcatcaactggtgtttaatggtgggttcgcgcccgcgtgggccgggcatggagcgcagtgatcttatcaaaatcaacggccctatttttgttaatcagggtaaagcgctgaaccgggctgctcaggatgtgcgggcggtggtggtgggtaacccctgcaacaccaactgtatgattgcagcccataacagcgatgtgccccatgagcgcttttctgccatgatgcggttggaccaaaaccgcgccaaatatttgctggccagcaaggcgggtgcccaagttatagatgtgaccaacgtggtgatctggggtaaccactccaataatcaggtgcctgattttgagtttgccaagattggcggtaagccggtacccgaggtgattgccgatgccgcttggcttgagaatgcgtttatgcccaccgtacagaaccgtggtgcggcggttatcaaggcccgtggtgcctccagcgcggcctctgcggccaatgcggcgttggatcatgtccgctccttgattaccccaacccccgcaggggataccttttgtgccgcagttatggccaatggtgcgtatggggtggatgccggtttgatcgcgggtatgccgttgacctccaccggccatggggattggtccattgtggagggggtccctatgagtccttttatcaaaggcaaatttgacgcggtgttggacgagttgcgccgtgagcgtgagatggtaaaagatctg

SEQ ID NO: 33722 - DNA, 738 bp, magnetite-containing magnetic coccus
atggataccacaggctgccgagcgctggtgacgggggcagggcgtcgcataggggctgccatcgccttggccttgggtgaggcgggcatggatgtggcggtacactacagcggttcagcgcaaggggctgagcagagctgtgcggcgctggccaagatggggcggcgggcctgcgcttttcaagccgacctaagcgattgggcgcaagccgaggcgctgctgcctcgggtggtggcgcagatggggccggtgcgggtgttggtcaatagcgccgccatttttgaacgcagtgaccttgtggatcaaagccaagcccagtggcgccgtcatatggccatcaatctggaggcacctatgctgctgatgcagcactttgcgcgtcagtggcaaagcgaccagccccccgatggggcgggccgcatcgtcaatattttagatcgccgggtgttggcaccgccccctgggcatctggcctataatgccgccaaaggggcgctatggagccttacccgcgtcgccgcgcgggaactggcaccgcatattacggtcaatggtgtggggccgggacccattttaccggcggccggtgagccgttggagcagtttgctaaggtgattgccgccactcctatgcagcggagtggaacaccgcaagaggtagcggatgcggtactctatttcattcaaaatggttttgtcaccgggcagatgatctgtattgatggaggtgagcatctc

SEQ ID NO: 33723 - DNA, 1119 bp, magnetite-containing magnetic coccus
caggccaagcagagtgcagagcgtgccaatcgggcgaaaagcgaatttttagcgacgttaagccatgagatacgcacccctttaaatggcatgatcgggttattaacagccttacaagcgagtcggctcgatgccaagcagcaggagcaagtgggcttgattagtcgttcatccaatttattattagatttattaaatgatattttagatttttccaagattgaggccggtgaattggtcttggagcagataccctttagcccgttacagttggtggaggatgtgtgtgcctgcttgtcagagcgtgcgcaaggcaaaggggttggtttgcgcttggagacgcatgggtggatacccccgggcttaaaaggggatgcggtacgtattcgccagatcatgcttaatttgaccaacaatgccataaagtttacgcagcagggtgaggtggtactccatctatgggggttggagcagcagccggtacccttaccgagctgggtctccatgcggtttggtgtggtggatagtggagtgggcatagcggcaaaggatatgggtcggatttttgatcccttttgccaagcagacagggtgctggatcgtcgctataaaggcacgggcttagggctatccatatgcaagcggctggtggaggcgatgggcggggagatctgggcggagagtcaggagggacagggtagcagctttaggtttacccttaccttagcgttggtcgaacatctgccagggcaggcaatggggcgtgaattggtccatgaggttttacccatgcgtattttgttggtagaggatgatccggtcaaccagatggttgcggtagagttgttagagagtgcggggcacaaagtggaggttgcggataatggtgcgtcgggtttggttaaggcgcaggagtgctcctatgatttggtcttgatggacatacgtatgccgggcatggatggcattacggcgacccgcatgttacgggcgttcgagcaggccgagggcagggagcgggtgccggtgttgggtttgaccgccgacacgctgaaggagaccctgctggcttgtcgtgaggcaggcatggatgatgtgctgaccaagccggtgcgggtg

SEQ ID NO: 33724 - DNA, 1380 bp, magnetite-containing magnetic coccus
cccagtcacatgtttcgtgagtatgatgttcgtggtattgcccacagtgagctatcggaagaggtggttaaacattggggtgcgctgtttgccgaacgcatacgtgatgcatacaagggcaaaaaatttatgccccatgtggtggtgggacgggatggtcggctctcctcacccgccttggccaacgccctgatggcaggcttggccgaggcaggtgcgcgggtctcggatgtggggttattgcccaccccggggctctattacgcctcccacgcgctgcatgccgatggggcgattatggtgaccggtagccataatccagctgagtataatggcatgaagatgatgttggggggattatccttttttggacaggatatccaagatctggcccaacgcttaatgctgggggagcggcccatgccacggatggggggctccgttagccgggtcgagctgcgacgcgactatattaatcggctggtggccgattaccgtccgggtcgccccctcaaggtggtgctggattgcggcaatggcgcggcgggggccgtcgccaaggagctgctacaggcccttcctggaatcgagggcgaagtgctgtttgctgaggtggacggcacctttcccaatcatcatcccgatccaacggtgccggccaatctggaggatttaaaaaatcgggtgctggcctggggggccgatctgggcatcgcctttgatggcgatggcgaccgcatcggggccattgatggggatggtcgggtaatctggggagatcgcctgatgatactcttcgcccgggagattttggccgagcatcctggggcctccattctgggggatgtcaaatgctctcagcagctctttgatgcggtggccgaggcaggtggcaagccgatcatgtggaaaaccggccattcgctggtcaagagcaagatgcgtcagagtggtgcccttttagcgggtgagatgagtgggcatctcttttttgcggatcgctattatggctacgatgatgccctgtatgctgcggtgcgactgattagcctactggctgctgaacccacctctttggcggcacgcttgagctcattgcccaaggtctatgccacaccagagttgcgcattgagtgtgccgacagccgcaaatttcgcgtcatggaccgcatcaaacggcaggttttggatgggggtttgggtgaggtttcggacctggatggggtgcgtgtcaagcagcctggggggtggtggttggtgcgcgtctccaacacccaaccggcgttggtggcccgggttgaggccgactccttagagcgcctgcaagagatggcaaccgccctagccaagatgttagagggggaaaatgtggttttcccc

SEQ ID NO: 33725 - DNA, 1314 bp, magnetite-containing magnetic coccus
atgcgcatcaccatgataggtaccggttacgttggcctggtttccggggcctgcttctccgagtttggggtggatgtcacctgtgtagataaggatgtctccaagattgaacgcctcaataagggagaaattcccatttttgagccaggtttagatcaactggtggtgcgtaataaggatgccggtcgcctgcactttaccaccgacaccaacaccgccgtggccaacagtgatgtggtctttattgcggtgggcacaccagagcggcgtggcgatggtgccgccgacctgcgctatgtgttcgatgccgcgcgggatgttgcccgcgcgatgcagggctttacggtggtggtgaccaaatccactgtcccggtgggaaccggggcacgggtggcggaaattattcgtgaaaccaagcccgatgccgattttgccatggcctccaaccccgaatttttgcgtgaggggtctgccattgaagattttatgcggcctgatcgcgttgtggtgggggtggattctgaccgcccggtggccctgctcaaagagctttaccgcccactctatctgattgagacccccattctgtttaccaacatcgccaccgcagagttgaccaaatatgcgggcaacgcttttttagccaccaagattatgtttattaatcagattgctaacctgtgtgaaaaggtgggcgctgatgtgcatgatgtggccaagggcatgggcttggatcgccgtattggccgtaaatttttacaccctggcccaggctatggtggctcctgttttcccaaggataccgccgcgctggccaataccgcgcgggatcacaacacccccatgaccattgtggagaatgtgattgaggccaacaaatggcaaaagcagcgcatgatcaccaagattcgcgatgccatgcagggcaaattacgggggaaaaccatcggagtgctgggcctgacctttaaacccaataccgatgatatgcgtgactcttcatccctaaccattttgccggcgttggccggggatggtgcccgcatccaagccttcgatcccgagggtatgcatgaagcgaaacgcatgatgcccgaactgcactattgtgatgacgcctatagcgcctgccaaggggcggatgcggtggtgattttgaccgagtggaaccagttccgcaatttggatctggaccgtattaaagcgggtatgcagaccgacagcgaagggttgtatcccttttttgatctacgcaacatctatgttccggctgatatgcgggcccagggatttgcctacgttggggtgggacga

SEQ ID NO: 33726 - DNA, 828 bp, magnetite-containing magnetic coccus
atgatgaaggttcgtaaggccgttttccccgtagcaggcttaggtactcggtttctacccgccaccaaggtggtcccaaaagagatgctctcggtggtggatacgcccctgattcaatatgccgtggaagaggcctgggatgcaggtattgaagaggtcattctcattacaggacgtggcaaaagcctgttaatggaccagtttgaccacatgtatgagctggaagataccctgcgccgccaaggcaaagaggtgttgctcagcgtttctcacgaacccattccgtttcccggtacggtggtcgccacccgccagcaagatcccttgggattgggccatgccgtatggtgcgcccgctatctggtgggggatgaaccctttgccgttatcctgcccgacgatctggtacatgcccaaaaaccggtgctcaagcagatggtagaacgctttgaggagctgcaatccagtatcgtagcggtcatggaggtcgccccagaccagaccaacaaatatggtattctggacagcgaaccagaacaaaatggggtgtggcgcattaaggggttggtggagaaaccggatccgtccgtgtcaccctccaatttagccatcattgggcgctatattctcaccccagaaatcttctgtctgctggaatccattcctcgtggtgcaggtggtgagattcagttgaccgatgccatggcagccttactcaaacatcaatccatctacggcatgcgctttgagggcacccgtttcgattgtggtgataaagcaggttttcaaatggcttcattggcactcagcatggaacgcccagagttg

SEQ ID NO: 33727 - DNA, 1779 bp, magnetite-containing magnetic coccus
atacgccatttactgccccactatcagcgctaccgacgcgcctttgtatggggctttctgctgcttattgccaccaatgccagtgccgcgctgatcccctatttaatgaagcttgccatcgacacccttcagcgcggcgaggggatgacggatgtcaaaacctatgccctgttgctggctctgctggcggtgctcacggcgctgttgcggatacgcgcccgcacccatgtgtttcgcattggccgtgaagtcgagcgggatatgcgcaacctctaccatgctcagttgcaagatctagaggcccccctcttcgaccatgcccgtaccggtgatctggtctcccggggcatcggcgatattacggccctgcgcatgtttatgggtccgggttttctacagcttaccaacgcctcgctggtctatattttggtgctgcctgccatgctttggctcaacccctggttgacccttatggcgctactccccctgccctttgtggtcatagccgcccgtcaattgaccaagcgactctaccgttatagccgtatggttgcagaccgctttggtgggttaaccgcctttgtgcaagagtcggtggcgggcatgggggttattcgcacctatgcccgtgaggatgcttggaaccaacgcttttacgaagagaccgataaactttatgccacccaacaggatcacgccagactgcaaggcatgtttcaaccgctcatgctctttagcggcggtttgggtgcctggataatcttagccgtgggtggtcctggcgtggtacagggcaacttgacggtgggggattttgtggcctttaccggctatctgaccctgatgattcaacccaccgtagcgctggggtggatccttaccgtcatgcagcggggcttggccgccatcgaccgcctgagcgaggtgctggatatcacccccagcaacgccgatcacccccagcaggcactgcacccagagcccaccaccccctatgccattgagatccgccatctcaattttttctaccagcaggatcgacgcattgccccccgcagtaaagaggccgcaccctcccacgcggtgaccaccgctgcgggggatggcacagaacccgccgccgtacagaccctgcatgatattaccctaacggtcccccatggtcactttgtgggcttggccgggcgcattggcagtggtaaatccaccctactgcgctgcttgagccgcacctatcccattccacaaggcagcctgtttttggatggtgtggatctggcccatgtacccgaagcccaactgcgccaacaccttaccatgaccccgcaggagagcctgctgttctcccggccactgctggaaaacctgctctatggtcagcccgacgaagatgaagcgtgcgcctgggaagctgcccgcaatgctgcttttgatgaagaggtcgagggcatgccccaaggtatggagaccttaatcggtgaacggggcatcaccctttcgggcggccagcgccagcgggccgcactggcccgcgccttggtggttaacccgcgcattttactgctggatgatatttttagttcggtggatgcccgtactgaagcacacattcttaatgccctgctggaccgccccgaccgtcccaccatggtcatggtgtgtcagcgggtagccgccctgcaccgggccgacaccatctacctgatggatcaagggcgcatctgcgaaacaggcaaccaccagtcgcttatgcagagcagcagcctctatcaagcgttg

SEQ ID NO: 33728 - DNA, 1737 bp, magnetite-containing magnetic coccus
acccgttatggtgcctttttggatctgcatctgttacggcgttttttccgttacgccaaaccccatacacgctgggtcttgttggccctcgccattttgcccttgaacacccttattcagttagggcaacccctactgttaaggcaagcggtggatgaacacctcatccccggcacgctggatggctttgctggattgctggttgcattgggcgttttgttgttgctacaagccttggcgggctatggcatgtcggtggttaatgccaccctggggcagcgggtggtgcgagatctgcggcgcgacctgtttggccatttattacgcttggatgccagctattttaataaacacgcctcgggtcgtaccaccaatcgcgttaccaatgatgtggaggcggttagccagatggtctccgcgggtttaatccaccttattggcgatgtggtgctgctgacgggcattctcatcagcatggcgctgttagccccaaccctttctctcacgctggttgtggcactgcccctgattgtggggggaaccctgctggccgccaaaaaaagccgcctcgcgcaacgggaaaaccgcttgatgctggcccgcatggccagccgcctgacagaagagattgaaggacagcaagaggtacgactgtttcatcggcagcagcgcaaccatgcggaatttgagcagcaaaatcaggtttattttacctcatcactggtgagcaacacttgggaagccttccaatttagctttattgatgcactctctaccgtggttatcgcagcgctattttggattggcgccagcatgagcagcgccgacggcgtgaccattggcaccctggtggcttttattgattatgtgcgccgggtttttcaaccggtacgggatctatcggggaaatttaccaccatgcaggcagccatgaccgcgttggaacgtatttttggccttttggacagcaaaccacagatcacggacgcccaagttaaccatgccttcaccctgcccgcccgcccccgcttggtgatgcaggaggtcggctttgcctatggcgagcagcccatattaaaaaatctctcgctgaccgtggaacccggtgaacaggtcgcagtggttggccccaccggggccggtaaaagcaccctcattaaactgctcaaccgtacctacgaaccccaacaggggatcattcaactgggcggtcaagatctgcaaaatattcccatggctactctgcgtcgtacggtgggggtggtccctcaagagacctttttatttagcggtaccattgctgagaacattcacttgcgcgacccttctatcccacaagcggcggtggaggaggccgcccacaaaaccggcgccatggcttttatcgccgacctgcctgaaggcctgaatacccgattgaccgaacgggggggcaatctttctagtgggcagcggcagttgttgggcattacccgtgcgtttgtgtttaaccctgccttgctgatcttggatgaagccaccagctcggtggataccatcagcgaacgcttgatccaaaacgccttacaggagctgatggtcgggcgtaccgccattgtgattgcacaccggctgaacaccattattggagcagatcgtgtcattgtgatgcatgggggagagatcatccaggggggctcacaccaaacactggtcactcagcctgggctctatcgtaagttgtgtgaactgcaattt

SEQ ID NO: 33729 - DNA, 1374 bp, magnetite-containing magnetic coccus
gatctcattgtcattggtgccggtccgggggggtatcctgcggccattcgagcagcccagctaggcttatcggtattgtgtatagaaaaaagcccccatcccggtggtacctgtcttaatgccggttgcatccccaccaaagcgctgttggcttcgacccatctctacacccaaatacgtgaccaagcggatctgcacggtattgagataaccaccatgcaggttaacctagcccgcatgcagggccgtaaagagcgggtcgtcagccagttgcgcagcggtattttggggctgtttaaaaaatatggtgtcaccttgttgcatgacgaggccatcgtgagcggccctgggcagattaccctcgccgccagtggtgaaaccctacaggcgaaagccattctcttagcgaccgggggtcagccgcgccgccctgccagcatgccggtggatggtcaggtggtgatcacctcggaacaagccatcgctttgacccgggtgcccgaacatcttattgtgattggttccggggcggtggggttggagttggcctcgatctgggtgcgcttaggcgcccaggtatcggtgatcgaggcccagccagaaattttgcccggttgggatgccaccgtggcccgtaccgccaagcgcagtttgcgccaacaggggatcacctttttaaccgatcatcgggttgagaccgtggtacgcagtggtagccgcgctgcggtgacctgccttaacagtaagggggagaccctgatgctggacggtgatcaggtgttggtggcagtggggcggcaggcccaactttgtgtggcaggcattcaaaatttggagttacaacaggacgagcaaggacggctgtgggtcgatgcgcattatgccacctcactggcggggctctatgcggtgggggacctgattgccggaccgcaactggcccaccgcgccaccgccgaaggattaagggtggccgattatttggcgggtcggcctctatcgcctatgggacccataccctcggtggtctacaccgatcctgagttggccatggtgggcttgacggaacagcaggccaaggttgccgggtatgcggtcaaatgtggtcaatttccttttatggccagtggccgcgcccgtgcccaagagcagaccgaaggcttgattaaattggtgatggatcaaacaaccggtcagttacttggggcacatgtggtgggcggcgcgggtgcggaacacctacagctcgccatggccgccatgctcactcaggatcgtggccagttgctggagcggttggtcatgccccacccctcatttggtgaagccctgcatgaagcgtggctggtggcgacccaaaagcccattcacatc

SEQ ID NO: 33730 - DNA, 2601 bp, magnetite-containing magnetic coccus
agcagccccaaacagacccccatgatcgcccagtatctgagcatcaaggccgcccatccggagaccttgctgttttttcgtatgggggatttttacgagctgttttttgacgatgccaaacaagcagctgaggcattgaacattgcgcttacctctcgcggcaagtcagagggagagcctatccccatggcaggaatccctgtccatgcgcgccaaacctatttaaacaagctgattgaagccggttttaaagttgccatttgtgagcagatggagccaccgggcgcctctaaagggccggtacgccgcgaggtggtgcgcactgtcacccctggcaccctaaccgaagagagcctgcttagcccccgcgaaaacaactatctggtcagttatctccccgcagccaagcgtcacccccacgctttggctgccctggatctttccaccggtgagttttttgctctgaccttggaaagagaagatcaagtcgccgctgagctgtcccgcctagagcccgccgaactgctgatccccgacaactgggagccagagccatggctcaaggggtggaaacgctgtctgtcgcgtcgaggttcctggtcttttgatggcaaagagggggcccgggtccttttagaacattttcaggtcaccagtttagaaagttttggcgtggcagatagtcccccctgtttaggggtgtgtggtgccctcctccactattgccgcgaaacccaaaaagaggcgctttcccatatcactggcttgtcccgcctgcatcagcaagagggcatggtgctggatgaaacctgccgtcgtaacctagagcttaactataaccttaaggatggcagccgcaaaagcagcctgcttggggtgatggatcgctgtattacccccatgggtagccgtctgctggcgcagtggatcaaccgtccattgcaatctctggacgccattgccacccgtcaagagagcgtctcctggttgcgggaaaatttggttgcttaccaggatctgcgtgaacggctgcgcatggtccacgatctggaacgctttttaagccgtattgcgctacgccgggccagccctcgggatctgggaggactccgccaaacgctgcaatgtctgccccagctctacgccatccttaccccagctgacgggcacagcctcgcggtacccagcctactacgcatcttggccgaccattttaatggccacgaggcgcttaccaagcagcttgagcagcagttggccgatgagctaccgttaaaccttaaagagggagagaccattcgtctggggtttgatcaaaccttagacaccctgcgcagcctcagccgcgatggcaaaagctatcttaccaagctggaggtagaagagcgggagaaaaccggcatcccctcgcttaaaatcaaataccatcgcagcttcggttacagcatggaggtgacaaaaacccatttggacaaggttcccccgcgctatatccagcgtcagaccatgaccaatggtgttcgttatgtcaccgaagagcttaaagagtatgaagagcagctgcttaccgccgaagagcgcatgttagagcgagagcagcttctgtttgaagcactggccgaacaggttgctcgccaagccgaaacactgcaagccagcgcccgtgccattgccaccctggatgtcttagccaattttgcgcacattgccgaggagcgcaactattgtcgcccgctgttgcatgagggggcggtgattgaaattaaccagggccggcatccggtggttgaacagttttccgacaccccttttgttgccaacgatatacgcttggataaccgccagcgtaccggcttgattaccggtcccaatatggcgggtaaatccaccctcatgcgtcaggttgcgctcattgtcctgctggcccacaccggggcgtgtgtaccggcgggttcggctaaaattgggcgggtggatcgcatcttcacccgtgttggggcgtcggacgatctggcgggggggcgctccacctttatggtggagatgaccgaaaccgcccacattttacaccatgccagcgagcgatctttggtgatattggatgaaattggccgaggcacatccacctacgatgggctctccatcgcctgggcggttgcggaacacatccacacccagtgccaagccagaaccctatttgccacccactatcatgagcttactcagttggagtcgcaattggatggggtgtttaatctcacggtggaggttaaggagtggaaagatcaaattctctttttgcacaccattgtgcggggagcggcggatcgtagttatggtattcatgtcgcccagttggcgggactaccccgtgccgtcacccgccgtgcgcgggaggtcttggcggatttagaggaacatgccgtgcaccatccagattccatggggcaaggccacgcccctgcctcccagccctatcagctcacgctttttgaggatgccccaccctcgccagccttattggaactcaagcgtgtcgatcccgacgaattgacgcccaaagaggcgttggaagccctttataggctcaaggagttattg

SEQ ID NO: 33731 - DNA, 426 bp, magnetite-containing magnetic coccus
cgcatattggtgctcaacggccccaacctaaatatgttgggtaaacgtgaggcatccctctacggccacgaaacgctggccgatgtcgaggtgctgtgcgccgcaaaagccgcacaactgggggcacaactggccttttaccaatccaattatgaaggggcgttggtggagcgcatccaacaggcccgggaagatgccgatctgatcgtcattaatcccgccgcctatacccacacctcggtagccatccgtgatgccctgttggccgcagaaaaaccggtggtggagatccacattagcaacatccacaaacgggaacccttcagacaccactcttacgttagcgacatcgccctgggacaggtggttgggctgggcatacgtggttatgcatacgccatggaagccggcatcacccaccttgag

SEQ ID NO: 33732 - DNA, 1332 bp, magnetite-containing magnetic coccus
atgtttaagaaagtattaatcgccaaccggggcgaaatcgccctgcgggtgcatcgcgcctgtaaagagttgggcattcaaacggtggccattcactccaccgccgatgccgactcgatgcatgttaaggtggccgacgagtccgtctgtgtaggtcccccctcctccatggactcctacctcaacatctcttccatcatggcggcggctgaggtgtcggatgccgaagcgatccatcctggatatggttttctttcagaaaatccagagtttgccgagattgtcaaagcctctggcctgacctttattggccccgaaccggaagtaatccggctgatgggcaacaaggtgcaggcgcgtaaaaccatgattgccgccggggtaccggtggtgcagggcagcgaaggtgccgtcaatagcgaagaggatgccctgcgtattgcccgtgaaattggttttccggtcatcatcaaggccgttggcggcggcggtggacggggtatgaaggtggtgcatgccgaggcgggcttgatccgcgcctacacggtagcccgcaacgaagcccggcagtttttccgcaacgacgccatctatattgaaaaatatctggaagctccccgccatgtggagatccagattatgtgcgaccgtcacggcaatgctgtacacttgggcgagcgggactgctcgttgcagcggcgtcaccagaaaattttggaagaggctccctctccagcggtctcaccagaagagcgccatagattgggcaccctcgcggccaaggcggcccatgctgtgggttatgaaggggcgggcacctttgagttcctctacgacaagggcaacttttacttcttggagatgaacacccgtattcaggtggaacacccggttacggagatggtcacgggcatggatctggttaaagagcagatccgtattgccgccaatctgcccatgagctttacccaggaagatattgtcatgcgcggccactccatcgagtgccgcatcaatgccgaggattcagagacctttctcccctcgcccgggctgattacagagtatcatgcgccgggtggtggtggggtgcgggtggattccaactgctacaccgggtatcgcattcccccgcattatgactcgatgatcggcaagttgattgtgcatgggcgcaatcgtgaagaggccgtaacccgcatgcggcgggcgttggatgagtatatcatctgcggcatttccaccaccattcccctgcaccagcgcattatgcaggatgccacctttattagtggcacctatgacctgcactttctggagcgttttttagga

SEQ ID NO: 33733 - DNA, 453 bp, magnetite-containing magnetic coccus
attgaccgcgcccatattgcactgcgggttgcggaactgggggtgcagatacgtggcgatatggtgggcaaagaccccgtttttctggtggtcttaaaggggggctttgtatttgccgccgacttaatgcgggcgctggatcatacggtgccggtggcttttaccaatgcccgtccctgtgcccacctgcccatttttagccgcgaagatgaagatttgttgcggggtaaagatatatgggtggtggacgccctgttggaccaaggccacagcgccatgcgccttatgcagggcttacagccgttgcagccgacctccatacagtttgcggtattactgcacaaaaccgttgagcgtgcggaaaaaatacctgtccgctatgtgggttttgaggtgcccgatacccggctggtgggctatgggctggatgaaaatcagcaatttcgcggcatg

SEQ ID NO: 33734 - DNA, 969 bp, magnetite-containing magnetic coccus
aagattgatgtttttggtatcggcaacgccctggtcgatcaagtttatgctgtagaagagtcctttctaacccagatcggcgaagaaaaggggcgcatgtccctggtagatccgcagcgccaagccgaacttagccgtgctttggcatcaaccccagccctgcgggcgtgtggtggttcagccgccaatagcttgattgctcttacccaattgggggggagcgcctttcatgcctgccgtgttgcagaagatgaaaccggccacttttttgcccaggatctaaccgctaacggtgtacagcaccaactgcacacgctgcccgctggcagcagcggcagttgtatggtttttatcacccccgatgcggaacgcaccatgtgtacctttttaggggcctcggctgacctacagcccgaggatgttcccgacgctattctgacaaccgcccagtggtgttatgttgaagggtatctggttacagcacccaacaccttggccgcagccctaaaagggctgcaacaggcacgggcaaacggggttaaaaccgccctgagtttttccgatgtcaatatggtaaaatttttccgcgacggctttagccaaatgttgggggagagcggtgtagacctgattttttgtaatgccgaagaggccctggcttttgccgaaaccgacgacatggcacaggctaccgccgcactaaaaaaacagagccgtacttttgtgatcacccttggcgcggaaggggcactgctgtgggacggccagcaggagatccaggtcgccggtcaacccgccaaagccatcgacacgaatggcgcgggggatatgtttgcgggtgcctttttttacggcatcacccaaggctgggattttaccaaagccgcccaactggcctgtcgctgttgcgccgtgctggtgacccatgcgggggcgcgtttgcctaagtcgcgcacccaagagattctg

SEQ ID NO: 33735 - DNA, 1239 bp, magnetite-containing magnetic coccus
catagccagttagagctcaaacggcatcgggagcggttggaaaagcaggtacgtatgcgcaccgccgagttggagttggccacccgtgaagcggagctccgtaaggatgaggccgaggctggtaaccgcgccaagagcgaatttttagccattatgagccatgagatccgcaccccgttaaatgccattttgggcacccatgagttgctgagtgaaagtgcgcttagctctgagcagcaacggcttatggagatctcccggaatgcgggtgaactgttgcttaatttggtcaatgagaccttggatctcgcgaagattgaagcgggcaagttggatctggagtataccatctttgacctgccgaggttggtggaggagattacccaaattaaacgggtggcggcggagcacaagggggtgcggttggagagcgagatggccctggaggtcccccgttttgtgatgggggacccggaccgtttgcgccagatcctggttaatttgctctccaacgccattaaatttaccaacagcggcaccgtgagtttgcagatgagccggggggtggcggatcgtaccttttttaaagtgagtgataccggtgtgggcatagcggctcatagtatggagaaaattttccatccctttacccaggcggatacctccaccacccgcaaatttggtggtaccggtctggggctgaccatctgtaaacatctgtgcgaagccatggggggagatattcaggtagagagtcaggtgggggtggggtcgacctttagcgtcaatttgcccttgccacgggccgagagctccatggatgaaccctcagccccagaagaggtgatcgtcgagcaggtacaagcgcccttacgtattttagcggtggatgatgccgaggataaccgtaagctggtacaagcctttttagccaaaagtgggcaccatctggatctgtgcgaggatggtgcgcaagccttggatcgctttaagcgcgaacactatgatctggtgttaatggatctgcttatgcccgtgctggatggttatggcgccacccgtaagatacgccaatgggagcagcagcagcatcgactacctacccctatcattgcgttaacggcgctgtcggtgcggcgggatctggacaaggcgctggcgtgcggctgtgatttttatttgaccaaaccctttcgcaaacaccaattgctggacgccatttaccgtattcacggtatg

SEQ ID NO: 33736 - DNA, 2148 bp, magnetite-containing magnetic coccus
ctaataattgacggtaaggaaatcagtgtccagcctggcaccaccattatggaggcggccaagaagctgggtgtgtatattccccatttttgttatcaccccaagctgtcggtggcgggcaactgccgcatgtgcttggttgaagtggttaagatgccccgcccggtggtggcctgtgccatgcccgtgggggatggtatggaggttaagacccatagcgatatggtgatggccgcccgccaaggggtgatggagtttttgctcatcaaccatccgctggattgcccggtgtgcgaccagggtggggcgtgtgatctgcaagatttggccatgaaatatggtccagaccgctcccgttatattgagattaaacgccagccgaacaatttggatctgggacccattattgaaacagagatggaccgctgcattcactgcacgcgctgcatccgcttttccaccgagattgccggtgtggaagagatgggggccacggggcgtggggaccatatgttggtgggtacctacgtgagcaaggcgctctcatcggagttggtgggcaacttggcgcaggtctgcccggtgggtgccctcaatgataaacccttccatttcaaagcccgtagctgggagatgtccagcggcgatggtatctgcacccactgttcggtggggtgtcaggtgcgggtggaccatctggatggcgaggttaagcgggtggttgcccgtgagtgcgacgagatcaatgagacatggttgtgcgaccgtggtcgtttctcttatgacggtttgagtgtgggtcgcctaacccaaccgaccattcgtggtgaagagggtgtgcaagaggtgagctgggccgaggcgatgacacgcgcggcggagttaatcaaggcgggtgagggtgacgccgtagcgggtattgcgtcggaagagcaaacggtggctgaggagctctatgccttccaagattttatgcgcaatgtagtgggcagcccgcatttggaccatcgcattcggcagcgtgattttagtggggatgccgtggcgctgacccgggccgatctgatgatgaatacttcgctggaggcgctcgaagaggcggacgggatcctgctggtgggttccaacagtcgttatgatgtgcctttgctcaacctgcgtctgcgtaaagcagcccgtaagggtgccaaggtgatggccattaatccctgtgaaaaggatttggcactgcctgggctgcacacgctggtgaccttaccgggtgaagagcctggcgtattgagccagattttagccgccttaaagggtaagggggcaggagaggccgctcaggtggccgccatgctcaaagcggcggagaaaccggttatcctgctgggtgactttgccatcaaccatcctgcggctgaaacgttacgtcgtacggtggtagcgattttggaaaagctgggcaaattggacgatagttggaacggctataaccgggtaagtgcgcgggctgcggcggtgacggcgcaggatatgggtgtggtgccccatcgtggtgcgggttacgccattgtgggtaaacggggtaagaatgcccatgagatcttgcagggcgcggcggagggttccattaaggtgctgtttgtgttgggtgccgatctagagcgtgaagcggccgatcccaaactcgcacgggcagcgctggaaaaggccgatgtgatctatctaggtgcttttagcaactcgaccagtgaggcggctaccgtggtattgccgggcctaaccccatgggagaagagcagcacagtcaccaatgccgagggccgcgcccaacgtatggaggccatggtgccggctccaggtgaggcgaaagaggattggcgggtgttgcgtaagctgtcggattggttctcgactccgctctcctataccaccaccgaatcgttgcggcaggcgttggagaacaccgacctacgctataaagaagagcgcttggtgtgtgaggatttgaccccagcctgtgaccataagccggtaaccaccggtttggcggtcacggagtggttggcaccacccagtgctaagggtttgcggctctcattggaactgcccttctaccatagtgatgccatggtgcggggtgccaaggtgatgcaggcc

SEQ ID NO: 33737 - DNA, 780 bp, magnetite-containing magnetic coccus
atgggcttgatgaaggggaaacggggcatcatatttggggttgccaacgaccgtagtatcgcctggtccattgcagaggtgtgtaagcgtgagggtgcggagataggcataacctatttgggtgaggccatggctaagcgggtggtgccattgggtgaaaaactgggtgcggcctttacactttcttgcgatgccacggacgatgcggagatccaggccgttattgatgcttcggcggagatatgggatggtattgattttatcgttcactctgtagcctatgcaaaaaaagaggagttaaagggcaagttttatgacacctctaaggagggttttcagcttgccatgacggcatcggtttacacattaatttccatttgtcgcattgctgagccacgtttgaccgatggagcgggtattttaaccatgtcctatttgggtgcggaacgggttatgccgcactacaatgtgatgggggtggccaaggcagcgttagaggcgagtgtgcgttatttggcggtggatatgggccagcggggtatacgtgtgaatggtatctctgcggggccgattcgcactttagcggcggcgggtatctcagattttaaagagattctcaactggaaccgggataatgcgcccatgcgtcgcaacattagtcagcaggaggttggtgagtcatccttgttgtttttgtcggacatgggttcgggtgtgacgggtgagattatgcatgtggatgcggggtatcatgtggtgggcatgcgtgcagtggatgag

SEQ ID NO: 33738 - DNA, 700 bp, magnetite-containing magnetic coccus
gaaacggccatggcgggcagtcagattgggacactatttcaggtagccacatttggtgagagccatggtttggcattgggtggggtggtggatgggtgtccggcgggattggagctgagtgaggcggatttgcagggggatttaaaccggcgtcgtcctgggcagagtcgttttaccacgcagcggcaggagcgggatgaggtaaagattttatcgggggtttttgagggtcgtaccacgggcacgcccattggatttattattgagaatgaggatcagcgttctaaggattacagtgagattaaggataaatttcggcctgggcatgcggattttacctattggagcaagtatggcaatcgggattatcgcgggggtggtcgcagtagtgcgcgggagacggcgatacgggttgcggcgggtgccattgccaagaagttattaaggcaggcggagggggtgacggttcggggggcattgacgggtatgggtccggtggtgattgagccgtcgcggtgggattgggcggaggttgagcgcaaccatttttttagtccggatgcgggttcggttggggaatttgaggcttatttagagggcattcgtaaggcgggcaattcggtaggggcttttttggaggtgcatgcggagggtgtaccgattggattgggtgagcctgttttgatcgtttggatgcgga

SEQ ID NO: 33739 - DNA, 1521 bp, magnetite-containing magnetic coccus
gtcaacctggatctccccacccccaaactctatgagcagattatcgcccgcggtgaagggcagattgcccacggtggttcggtcgtggtggagacaggcatctataccggtcgttctgccaaagataaatttattgtggaggagcctaccagtcaggcggatgtggattggggcacggttaaccgtcctgtttcccaagaaaattatgaaaaggtgcgcggtcgcttgatggcgtttttacaaggtcgggagctgtttgtacaagatgtgcgggttggtgccgatcctcaatttcagcgccgggtgcgggtggttaacattaaagcgtggcaaaatctgtttgcacgtaacctgtttatcacccctgagaccatggaaaatgaggttgttccccccgattttaccgtcattgcctgccccgattttaaggccgatcctgaactggatggcacccgttccgaagcctttatctacatgaacattgcccagcgcgagatcattattggtggtacggcctatgcgggagagatgaaaaagtcgatcttctccatcatgaactatctgctgcctaagcaggccgtgttccccatgcactgtagcgccaatatcggcacacaagatgatgtggccatcttctttggcctctctggtaccggcaaaaccactctctccaccgatcccaaacgccgtatgattggcgatgatgagcatggctggtccgataaaggggtgtttaactttgagggtggctgctacgccaagaccattcgtttgaacgccgtggccgagccggttatccataactgtacccaaacctttggtaccgtcttggaaaatgtggtgatggatgaggagagccgtaccctggacttggatgacgaccgcaagaccgaaaatacccgtgccgcttatcctttaagctcggtgggtaacattaaggctgacggtatggggggtcatcccagccatgtgattctgctaacggcggatgcctttggggtactccccccggtctcgcgtcttacctctgagcaggccatgtaccactttatctccggctataccgccaagctggccggtactgagcggggcgtcaaagagccccaagccaccttctcatcctgttttggtggcccgttcatggttcaccaccccacagtctatgctgaaatgctgggtaaacggctgagcgagaccggtgccaagtgctggttggtgaataccggctggaccgcaggcccttatggtgaagggcatcgcatgcccatccgcgaaacccgcgccatcattgacagcattttggccaatgagctcaacgatgtggctacccatgaagaccctgtctttgggctggccgtgcccaccgccattgatggggtggaaaccgtacgtctgacccctcgtgatacctggaaagatggtgcggcctttgatgccaaggccaaagatctggcccgtcagtttaatgaaaattttgccaactttgctgatcgcgtctccgatgccatcaagggtgctggt

SEQ ID NO: 33740 - DNA, 1551 bp, magnetite-containing magnetic coccus
ctaggcgtcggtaaaggcgaccgcgtgctggtctacctgcccatgatcgccgaagttatccccgtcatgcttagctgcgtacgcatcggtgccatacactccgtggtgttcggcggcttcgccagtaccgccctcgcctcacgcattgatgacgccgcacccaaattgatcatcaccgtggatgccggtattcgtggcggaaaagtggtaccctataaacccctgctgcaagagtccctaaaccaaatcagcgtcacacgccccaaagtgctgctgatcaaccgtaacctagaccccaacctgaaaatggaaaaaggagatctggatttcaccaccgaattggccaaacataaagatgccgtggtggaacccgaatggctgccatcctcccaccccagctatatcttgtacacctctggcaccaccggcaaagccaaaggagtacaacgggataccggcggacacgccgtcgccatgcgcgcctccatgaaacacatctatggggtcgaaccaggccaagtgatgttcgccggctccgacgtgggctgggtggtaggccactcctacatcgtctatgcacccctgctcaccggtgccacaaccgtggtctacgaagggctgcccatccgccccgatcccggtgtttggtggtcgctggtcgaaaaatataaggtgaactgcctctttacctcccccaccgccatccgcctgctgaaaaaatctggcgaagagtggatctggaaatatgacctctccagcctagaatccatgttcctggccggtgaacccctggatcgcgaaacccatcgctgggtcacgagcgccctaaaacatgccccggtggtggataactattggcaaaccgaaaccggctggcccatcctcaccaactttaaagggatgggactcatggagaccaaatttggctccccctgtcgccccgcctatggttttgatgtggtgctcattgatgacctaacccaacaacccgccgaacccaataccaagggctcgttgatgatccgtccccccctaccacccggttgcctaagcaccgtatggggcgacgatgaacggtttgtgcaaacctacttcagccgcatgcgcgaacccatttacgccacgtttgactccgctgtttacgacgatgacggctactactacatcatgggccgggatgatgatgtcatcaacgtggcaggccatcgcttgggtactcgcgagatcgaagaggccctctgctcccaccccgccgtggccgaggccgcctcgatcggcattaaagacgagctacgcggccaagccattagctgctttgtggtactcaccaccggtgccgagccccccagcgaagccgacctgaaaaaccatgtggccagccaactggggccggttgcccgtcctcactttgtgcgggtggtcacggcgctgcccaaaacccgctcgggcaaagtgctgcgccgcgccattgttgctattaatgaagggcgcgatcctggcgatctacccacgattgaagacgcctccgccctggataagatcaaggaagcc

SEQ ID NO: 33741 - DNA, 1065 bp, magnetite-containing magnetic coccus
atctatgatctcaaacatctgggtgaggatgtgacggtgctctcccttggggagtccttttttgaaatggagatggatgatttttctcagttggatctggagaagattaaccactactcggactcgcaaggcattccagcgctgcgtaaaaagttggcccactactaccagagccgctaccgggtgacggtgaaccctgaccaggagttaatcatctccgttggtgccaaatcgcttatctatatggcgatgctggccacccttgagcccggtgatgatgtgctcatctgggaacccgcttggctgagctatcctgaacaggccaagctggtacatgccaagccccggtttattccctatgatctgccggttgagcaattggacacgctgtttaccgacaaaacccgcatggtggtactgtgcaaccccaacaatccctcggggcgggtttacaaccgcgctgagctgcaacggatccacaccacctgcgcccaagcgggtgcgtggctgttggtggatgaggtctatagtgattttgtgctggacgaaccctttgtctcattgggtgagctggtaccggactttaaccacttgatcatcattaattcgctctccaaaaatctgggcatttctggctggcgcattggttatgccattggtccagagcccctgattgccgcgctgctgcgcattaaccaacatgtgatcacctgtacgggcaccccgctgttgcactactgcaaccattattttgataaattggtcaatcgcgccctgccccaggtcgaggcggtgatgcaccggcgcaagcgcattaagggcatgttacaagagttgggcttggatgagatggcgggcagcgccaccttttaccattttgttcaccttggcgactatccaggcaacgcctttgcgtttgccgcccaactgctgttggatcaccacatctcggtggtcccgggctacgcctatggtgagaatgtggatcgctttatccgcatctctattggttgggagtcagaagagcggatttggctggcgctgcaatccatcaaaaatgtcata

SEQ ID NO: 33742 - DNA, 1467 bp, magnetite-containing magnetic coccus
cttaatcaactggtggcacactacccccagcggcatgccctgattgacgcggtacacgaacagcgccacagctaccagggtttggccatactgatccagcgcctacaggccaccttagagagctggcagatcggcgcgggcgaggtggtggtgagcctactacccaacagtgtggagcagttgagcctgtttttagccgccctctacagtggccgtcattttgcccctctctccccccaatgcaccgccattgagctggcccactggttaaaggtgacgcaagccaaggtgtgcttattaaccacactctccagcccggctcagcaacaggcggtgcgcgaggctggggtaacgctgcaacttgtggcgctggatggtcagtttgagtgggcacaaaccgagcagcgctctgttaaggcggagccacaaggggggagccgtctctatttgcacaccagtggcaccaaaggggagcccaaagcgctggtgattgatgccaacaccctatggcaggcgggccaagcgtttgttgccctacatccggccctacatggggggatgcgcttttttaatattatgcccatgtcctacctaggggggctttttaatctgggcttaatccccttggtccatggcggttctattgtggtggcgcccccctttagtggccgcaccttaatgaccttttggcacgatgtaaaacgctttggggtcgaagctttgtggctggtccccaccgtggcccgtggtctgctggccctctaccgacccggtaaggatgagcgcaccaccccccgccaaacgggcatccaatatgcctttgtgggcaccgccgccattacgccagaggaaaaacagcgttttgaggcctgttttggcatcccactattagaaaattatggtctctcagagaccaccttcttaacctcggagcagccgggccaagcgcaactccgttcgctgggcagcgtgggcagcgtgctgccctatgtgaccctaaaattggaccatggccccgccgagcagccccgacctatccgggtgcgcaccccttacgcctttgtgggatacctgggccaagatggcgaaattcgctcccccctcgatgatgaaggttatctgcacaccgacgacctgggcctgttggatgccaacggccaattggttttaagggggcgcaccggtgatttcatcaaaaaagggggttactttgtcagcttggtggagatagaagccttggctaccacctgcccaggggtgcttgaagcggtggcggttgccaccgtgtctgaactctatggcgatgactataacctgtttatccgctgcgatggcagcatgacagaagcacccgaggcccactttaggcagtggatggccgagcgtctggttcgctacaagtggccctgtcgcattcaagtggtggaagcgtttccccgcaccgaaagcggcaaaattcagaagcgc

SEQ ID NO: 33743 - DNA, 1668 bp, magnetite-containing magnetic coccus
gtaggtgccgacattacccatctgaagatgatccagcaggagctgaccctcgcgagggatgccgccaatgccgccaaccgtgccaaaagtgcgtttttagcggtgatgagccatgaaatacgtaccccaatgaattccattttgggcatgaccgatctgctcatggagcacgctctggatgccgaacagcgccacgccctacaggctattgcacgggctggcgacgcgctgatgattatcattaatgacatcctggatctcagtaagattgaagccgaccgcctggagctggagttggtggagaccgatctagacaatcttatggcaaatttgggggatatgctcaccctgcgtgcccaggagaagggtgtgaaactgagtttgttaagagaagagcaactatccccctatcgctggtgcgatcaggtgcggctgcggcaaattttggttaatctcatagggaatgccatcaagtttacccaccagggtagcatcgaggttaagctcagcaaggggccgggcaatcgcattcgttttagtgtctccgacagcggcattgggattgacctacagcaacaggaggccatttttgaatcctttaaccaaggggattccagtgtcacccgacgctatggtggtactgggctagggctctccatcagtcagcgtctggttaagctgatggggggtgttctcaaggtgtacagtcggcccggtaagggtagcaccttcttttttaccattcccatggcgcccgtaccccatctcggtcgacatctgacgcatatacagaattgggaacaatttcacctgctgctggtagaacctgttggcacaacaagcacaattggacaactgttaaccccgttgggtatgcaggtcagccatcttcacgaacttacccatatcagccaagtcgtggctcaattggatcccattgatctgctattgattaatctggatagcgtagaggatgaaaccctaaatcagagtctgcaacaggtgcatgatcacccggctagcgcccggctgccgttactgttactgctgccagaaccggatcatacccgttttgagatggttaaagggatagggggacactgtttggctaaaccagtacgcagacaagggttgattgatgccatggagctggttatcggggccaaacatgctacgcaagaagcgaagattgcaggtgaaattaagggcttaaaaattcttatcgctgaagattctgacgataatattttattgctgcaatcctacctaaaggggtctgatcatcaattgaccattgtgcgcaacggcctagaggcgctgcaacaggtggaacaacaccattttgacttggtgttgatggatgtacagatgccggtgatggacgggcttgaagccacccgcaagattcgcctcatggaacagcaacagggggcacggcagccgctacctattgttaccttaaccgcccatgctatgctggaagataaacggcgcagtgtggaggccggctgcaccgaccacctgacaaaacccatcaaaaaacaggttctactcaaggcgattgcaaaattgatgcaatcggttgcagcataaaaaaggggcaatctttaaggggtgacaaccctgtccgtgcgacttgaactgggataaggcatggctatgggcaaa

SEQ ID NO: 33744 - DNA, 1620 bp, magnetite-containing magnetic coccus
attggctggaaccgcatccgcatattgaaagcccaacaggcacaaaagcaggttgagcatgagttggatctcagccgggtcgcagcccaggccaaaaacaccttttttgcccaggtcagccatgagattcgtggccctttgaacgccatccttggttatgtcgtcatgctccgccaaacggagttaaaggctcaacagctccatttattggaacatttaggcagcgcctcccacgccctgctcaccctgctcaatgacattctggattacagcagaatggaggctcaaaagctgactctggccccccagcctacccatctaccaaccttactcaagcgcatggaagagagctttgcgcccaggatagcgaagaagggactgcacttttctttaagcatggcgaaagatcttcccgcctgggccaatctggacccggtgcgcatggaacaggtcatcaccaacctgctggacaacgcttacaaatttaccctccaggggcatatcacgctggaagctcggctggagagcgatgcatccacgccgcccaggctgaccatcatcgtcagcgacagcggcattggcatggacaccagccaagagcagagtctgtttgaagcctttaatcaagcggatccaagcatcgcccgcagctatgggggcagcggcctgggcttggcaatctgccgccatattttgtccttgatggaaggggatatcgccatggaaagcacccccaaccaaggcagccgttttaccctgcgcatcccctattgcccggtctctgaaacagagattgacacccttcacacctcgccagccgttgcacaagcgccgaaggagccacgtcacccccttgctacccatcatagtggttgtcacatcttgctggtggaggataatccactcaacacccatgttctccaactgttctttgaggaggctggtttggtggtctggcatgccgaaaacggacagagcgccctggatcagttggctcagcacccggtggatctggttatgatggatgtggagatgcctgttatggatggcctctcctgcacccgtcgcttgcgccgcaactatccaacgctacctgtgatcggcatgaccgcacattctgacgctgggatacgccaagcctgcctggagattggtatgaatgaactgatcttcaaacctatggattgggctcaactgtttgagctgttgcatcactggctgcccaccaccacttcgcctcgccctactataccattacaaccacccacccctgatgccgcttccaccaaaaagcttccggctttggagggcattgatgtgaccatcggtctacaacgggtggttggtcgcgaaacgctctatcttcacctgctggaaacctttgcaaaagatcatcagcaaacccaatcccttttgcgatccgccctgctaaacagcgatcatgttgggttcagaagccaactgcatggcctcaaaacatctgctgactacattggggccatacccttggcccatcaagcagaaacgctttatcaactgttgggaaaaacctggaatggatcctctaaaattgaggccaacaccttgattgggaatttggaaaaactcctggaaggcctg

SEQ ID NO: 33745 - DNA, 2565 bp, magnetite-containing magnetic coccus
atgaaacaggaacaactcaccagcaaatctgctgaagccctgaatagcgccgtcggcctcgccgccgagcgcaaccaccaatttgtcgaacctgaacatctgctgctggccatgcttgagcaaaaagatggggttatccctgctctcttgattaaaatgaatacccccctgcccgctttgcaacaggccaccagcgtggcggtggagaatctacctcgggtacacggtgggggggctgcgcagacactgccctcccggcggctacaaagtttgtggcaagatgccgagcgcgaagcggcaaccctgcgcgatgactacacctccaccgaacattttctgctggctatgaccgaacacaaagagggggcactaccctcccttttacgcccctttaccattacccgcacaagggtgttggaggccttaaaaaccgtgcgcagtgggcaacgcgtcaccagtaaagagcctgaaggaacctttcaggcccttgaaaaatatgcccgtgacctcaccgcgttggcaaaaagcggtaaattggatcccgtcattggccgcgatgaggagattcgccgcaccatacaggtgctcagccgtcgcaccaaaaacaatccggtgttgatcggtgagcccggtgtgggtaaaaccgccattgtggaggggttggcgctgcgtatggagcggggggatgtgcccgaatccctcaagggggtgcgggtggtggccctggatatgggggcgttggtggcgggtgccaaatatcggggtgagtttgaagagcgcctcaaagcggtcatcaaggaggtgcaagaggctcagggcaagatcattctgttcattgatgagatgcacaccatcgttggcgctggccaaagcgaaggagccatggatgcaggcaacctgctcaagccagccctggcgcggggtgatctgcactgtgtgggggccaccaccctggatgagtaccgtaaacatgtggagaaagatcccgccttggagcgccgctttcaaccggtgcaggttcgcgagccttcggtggaagccaccatctccattttacgaggcattaaggataagtatgaactgcaccatggggtgcgcattaccgatgccgccattgtggcggcggccacccttgcgcatcgctacatcagcgaccgttttctcccggataaagccattgatctggtggatgaagcagcggcccgcatccgcatggagatcacctccaaaccccaggtgttagactcccttgatcgccagatcttacagctacagattgagcagtctgccctgagtaaggagaaggatagcgcctctcgcgagcgcttgaccaagctggaggcggagttggcggatcttaaagagaatgcccacgccatgaccatacgctgggagcaagagcgccttaacatcaaacaagtgggcatccttaaagagacgttggagtcaacccgtctccagttggagcaggccgaacgcagcggcaatctggaaaaagcgggggagctgcgctatggcaccctacccaagctggagcaggaactgcaaaaggcccaagagcttgccgcccagagtcgtgaaaatccactcttaaaagagctggtggatgaagaggagatcgccaccgtggtggcccgctggaccggcattcccgtggcccgcatgttggaaggagagaaagacaaactgctcaagatggaggaacggttgggccatcaggtggtagggcaggagcgggcgctccaggccattgcacgggcggtccggcgggcacgggccgggttgcaggataataaccgtcccattggttccttcttttttctgggtcccacaggggtgggtaaaaccgagctgagcaaagcgttggcgcagtttctgtttaatgatgagagcgccatggttcgcttggatatgtccgagtatatggaaaaacatacggtggcgcggctgattggtgccccgccgggttatgtgggctatgaggagggaggccagctcaccgagcaggtacgccgccgcccctacagtgtggtgttgctggatgaggttgaaaaggcccatcccgatctgtttaacaccctgctccaggtgttggatgaggggcgcttaaccgatggtcacgggcgtaccgtggattttcgcaatacggtcctcatcatgacctctaacatcggttcccatttaatggcagagggcggccccacggctcaggtagagcatagggttatggagctacttaaacagacctttcgcccggagtttctcaaccgattggatgagatcattccctttcacgccctgcaacgtgagcacatgggcgccattgttgacatacagcttaaacgtctgcacaaactgctggataaattaaatatccgtttagaactggagcctgccgcccgcgccgccctggctgaagaggggtatgatcccatctatggggcacgccccttaaaacgggttatgcagcgcctggtccaagaccccctggcagaggcgatgctcagcggtcatctgcacgagggggatcgggtggtcatccacttcgatggggaacaatttgtg

SEQ ID NO: 33746 - DNA, 1272 bp, magnetite-containing magnetic coccus
atgcaaccggtctatgtgattgatgggatgcgtaccccttttctcaaaaccacaggggggccaaatcctttcagtgcggcggatttaggggtgcaggcggggcgtgcgttgttgatgcggcaaccctttcatgcggatgccttggatgaggtgattttgggctgtgtctccccggcggccgatgaggtgaatattgcgcgggtggtagccttacggctggggtgtgcggtgcgcaccccagcgtggacggtgcagcgcaactgtggttcgggcatgcaggcgttggatacggcggtgcggcgcattggccggggtgaggcggcgttgattttggccggtggggtggaggcaatgtcccgtgcgccgttgcagtttaacagccgttatagccgttggatggggcaactggtgcgcagtcgtacaccgttggccaagttgcgtaccctgctggggtggcgtcccggttttatggcaccggttatcacgctattgaaggggttgaccgatcccaccaccggcctctccatggggcagacggcggagaatctggcctaccgctttggtattgagcgggagagcatggatgcctatgcggtgcgcagtcatcaacgggcggcggcggcgtgggaggaggggcgcatggccgccgaggtgacgccgctctacgatgcgcaagggcagatctacgcccaggatgatggcatacggcccgatagccaggaggagaagctggccaagcttaaaccggcttttgaaccgccccatggccgcatcacagcgggcaacagtgcccagattaccgatggcgctgcgctgctgctgttggccagtgaggccatggttgaacactaccagcttaccccgttgggcaagctctatccggcccagtgggtggggttggcaccggagcagatggggttgggaccagcccacgccatcgcgccattattgcaagagctggaatgggatatgagtgccattgatctgtgggagatcaacgaagcctttgctgcccaggtgatggcctgtagtgaagcactggccgatggggactattgtgcccagatgttgggggtggatcatgctctggggcatatgaatcctgcccgtcttaatgtggacggtggcgcggtgagtttgggccatccggtgggggccagtggtgcccgcattgtattgcatctgctgcacgccttggggcagcgccatctgaaacgtggtattgccgccctctgtatcggtggggggcagggtggcgcgatgctggtggaa

SEQ ID NO: 33747 - DNA, 1682 bp, magnetite-containing magnetic coccus
gtgagcggacgccccagggtatcgcctattggcagtttgccgaggatcgcgccccccgttgggagccgcatacttggcagcaagcggcccggcaggcggcgcagtggcaagcggcgctcagaaatgagcggctaaagcagggcagtcgggtggccatctgcatgcccaaccgtatggagtgggtgctgttcgatgtggcggccatgagtttgggcttggtggtggtgccactctatccccacgaccggcccgaagcgatggtctatatcctcaaggatgccggggttaaactgttactggtggaggatgagcgccaattgcagagcttaaagccccacttggctcagttaaggcagcttaagcgcgtggttgtattacagggccactgtagtgaaagctgtggggattgtgtggcggctggagattggctaccccagggtaagcaaacttggttgcgagtggcgggggccaccgatccccacggtttggcgaccttggtctacacctcgggcaccaccggtccacccaagggggtgatgttgagccaccgtaatctcctctccaatgcctcagcggcgctggcgcggatacgggcctataccgatgatcggtttctctcttttctacccctctcccatgcgttggagcgcacggcggggtgttatctgcccatgatggccggttgtgaggtggccttttcacggggtattccctacctttctgaagatctggcggtgatgcagccaaccgtactgatttcggtgccccgcatttttgagcgcattcacggcgaggtacaggccaagttgcagcatgccccagagtggaaggtgcgactgtttcagcacactgtggagagtggttgggaccattttgaacaccagcaagggcgtagggggttgcaccttaaaggtttattatggcccctcgttaagcccttggtcgcccataaattgctcaaaaaattggggggtcgtctgcgcctagcggtgtcggggggggctgcattagatccccacatctcgcgatttttcctgggtctgggcttgccattggtgcagggctatggtttgacggaaacagccccggtggtgagtgtcaacacccctggggataatgagcccagcagcgttggacaacccctgccgggtgtacaggtgcgcatcgacgcgcaaggggagctctgtgtaaaaggggccagtgtcatgagcggttattggcacaatcccagggcaacccgccgagtgattgatcaagaggggtggtaccacactggggataaaggggagctggatgcggcgggccacattaaggtggtggggcggttaaaggagattttggtgacagccacgggccgcaaaatcccccctggggatgtagaaggggcaattcttgcggatccgctgtttgcgcaagtgctggtggtgggggagggttatccctatttggcggcgttggtggtgcttaatagcgaaatcgcccagggtgtgaccttggatgagatggcattggtggcgcgtatgaacgaccggttgcatcgttttccccgctatgcggagattatgcgggccgccacggtggcgccatggacggttgaaaatggactgttaacaccgacattaaaggtaaaacgtacggctgtcatacagcagtatcaggatgtcattgcccagctctacgtt

SEQ ID NO: 33748 - DNA, 1260 bp, magnetite-containing magnetic coccus
aatcccaaaattgccatcatcggcctcggttatgtgggtttgcccctagctgttgcctttgggaaaaaatatcccacagtgggctttgatatccgcagccaacgcattacccaactgcaacagggtcaagacaccaccctagagtgtagcagcgtcgagctagcgcaagccagccagcttagttttaccgctgatttacaagaaattgcccactgcaacacctacattgtcaccgtacccacccccattgacaactaccgccgcccggatctgagcccgctgataagtgcctcagaaaccgtcggcaaggttcttaaagcgggggacgtggtgatttatgaatccacggtctaccccggtgccaccgaagaggtgtgcgtacctattttggccaagcactccggtttggtctttaacgagacctttttcgcaggctatagccctgagcgcatcaacccaggggataaggtgcatcgcctggagaccatcaccaaagtcacctctggctcaacagccgaggctgctcagtgggttgatcaactctatcaatccatcattcaggcgggcacccacctaacctcttgcatccgggtggccgaggccgccaaggtgattgaaaacacccaacgggatgtcaacattggcttgattaacgagttggccctgctctttaaccgcttggagatcgacaccttagaggtgttgcaggcggcaggtaccaagtggaattttctgccctttaggcccggcttggtgggggggcactgtattggggttgatccctactatctgacccataaagcccaagagattggctaccacccggatatgattcttgctggccgccgcgtcaatgacagcatgggcacctatgtcgccagtgaagtgattaagctgatgacccgcaaacatttgtgtgtcgccagttcgaccattttaatcttgggcctaacctttaaggagaactgccccgatctgcgcaacactcgggtggtggatattgctcaagagcttctggaatatggggccgaagtggccatttacgacccctgggtggatgcccaagaggcgcaccatgagtatggcctaaatttgctgaccgaggttccccatgcccactatgacgcggtaattttggcggtaccccatcgccaatttatcgaggcgggcattgagtgggtccaagccctgcgcaaagagatttcggttttctacgacctaaaatcgctgtttgccaaagagcagagcgaccaacgcctg

SEQ ID NO: 33749 - DNA, 1623 bp, magnetite-containing magnetic coccus
cttcaaacggttgccaacgaagtcggaaaatttgtacagcgtcggcgttcagaaattgccttgagaattgccagtgatgaagccttaaaagccaatcgagcgaaaagtgactttttagcggtcatgagtcatgaaattcgcacccccatgaatgccattatgggtatgaccgagctattggaagagacggaactgaccaccatccagcgtaactatctctccatctgccgttcttcaggtcaaaatttgctgcaactgatcaacgatatcctagatatttccaaggtggaggccgggcgtatggaggtcgcggttgcgccttttcatttgcaccgtattatccatgacgccaaccaagtcattctgtttcgcgcccaagagaagggccttaaccagattgtctacatagatcctgctgtgccaaccattcttcttggagatcaggcacgcatccgccagattttaatcaattttttaggaaattcggttaaatttacccaatctggcaccattgcgacattggtcaccacgcgcgcccatgccaataaggaagatcaactggtgattcacgtggtcgacacgggcataggtattgaacaatcggagcaagaagcgatttttaaggcgtttcatcaagttgattcctccaaccagcgccaacaaggtggtactggcttaggtttggcgatctgtttaaagctggttgccttgatgcaaggttcggtcagtttaagtagtagagcgggcaagggcagcacctttaccttaacgttgccgctaacggttgcaccggccgagcagatccaatcgcttaaagtggagcggggattgacgggctaccatatggtgatctggcatacccaccccatcagcacgctctacattgaggagatgttcaaggagcggggggcaaaggtacgtagctgtaaccagtccatgacgttggccaactgtgccattcagggggatgcggttttagcaacgaccgatatgatgattatccattaccatgaagaggataaaaccaacccgctggagctcataaacacgattcgatccgaacaaagtctgcatgaaatccccgttctggtttatgggcgctgttatgatcccgccctgctaaaacagcttaaccagttgggggtgcgctttttgccagagagtctgatgcaggatgttctgtgcgaacaaatcgtgacagagctcagtaaaagaccccggtcagcggtaacatcgggccaggggggtactctgcccatgcatattttactggtggacgatagtccagataatatctttttaattcaagcttttttaaaaaagacatcctatcaaattagtacggtgtacaacgggaaagaggctgttgagtacgttatgcaggctgacacgcccccggatcttattcttatggatattcagatgcccattatggatggctatgcggccacccggcagatccgtttgcttgaacagcaacaagggcagtcgcgaatccccatcattgctctaacggcccacgccatggccgaagaggccgaaaagttaaaagcggcgggttgtgatctgcatatggcaaagcccgtatctaaacggatccttttagaggtgttgggccggtat

SEQ ID NO: 33750 - DNA, 1251 bp, magnetite-containing magnetic coccus
tttcaccgcttgggttgggtaaaaaaggtggtgggattgcttattgaaggcaatggtccagcggtctccattggtcagatgtgcgatgtcgttcgtgagaatggcgaggtggttaaggccgaggtggtgggttttcgggacaagtcggtattgttgatgccgctgggttctattaaggggatctttccgggttcgcggattatctcccagggtcgagcggagcaggtaccggtggggccgcagttgctgggtcgggtgattggacccatgggcgaggcattggatggtcacgccttaccccatttggatgatcatgtacccctgcatgccgcgccgatcaatcccatgttgcggcgcaagattgaggagcctttggatcttggggtgcgggcggttaacagtctgcttaccgtgggtcggggccagcgtttgggtatttttgccggaaccggtgtgggcaagagcaccctgttgggtatgatggcccgctatacggcggcggatattaatgtgattgccctgatcggtgaacgtgggcgcgaggtggtggagtttattgaggatgagttgggccctgagggcatggcgcgttccattgtgattgtcgccacctcggatcaacctccgttattgcgtttgcgggcggcgtatatggcaacggccattgccgagttttttcgtgcccagcaaaaggatgtgctgttgttgatggactccattacccgttttgccatggcgcagcgggaggtgggtttggccaccggcgagccccctaccagtcgtggttatccaccctcaacctttatgctgttgccccgcctgttggagcgggggggacgggatcaagggcgtggttcgattacttccatctatacggtgttgatggaaggggatgatattcaggatcccattgttgacgcggtacggggtattttggatggtcacattgtgttgtcgcgggatctggcggcggccaaccactaccccgccattgatgtcaacggttcgttgtcgcgtttgatggaggggctgtcggagaaggcgcataaacgggctgccggtcaactacgggaaattttggccacctatgttaaggccgaggatatgattaatattggtgcctatgtggcgggcagtaacccgcgcattgaccgggccattcggtttattgagcccatacgtacctttttgaagcagtcggtggaggagccctcgactttggaagagagcatcgctcagttagagagtctg

SEQ ID NO: 33751 - DNA, 702 bp, magnetite-containing magnetic coccus
ttgcttgaaaaccgtattgcgctggtcaccggcgcgggttccggtattggtaaggcgatcgccgagggctacgccgctgcgggggccactgtgctgctgctgggccgcacccagaagaagctggaaaatgtctatgatgccattactcaagccggcggcaaagccaccattgtacccatggatctagaaactggccttggcgctattcccgaactggtcaaaaatacctacgaacgctatggacgcttagatattctcgtcaataatgccgccctgctgggcaccctctcccccttggccaactaccggccccaagagtgggaacaggtgatgcgggtcaatgtcaccgcacccttttttcttatgcgtgaatttatacccctgctaacacaaagcgatgatgcctccatcatcaacctaagctccggtgtgggccaccagggccgtgccttttggggcgcctatgccgcctccaaagccgccctgattaacctaagcgaaaccttggcgcaagagttggaaaaaagtccgatccgtgtcaacaccgttaaccccggcgccaccgccaccaccatgcgcgccaaagccttccccggtgaggatcccaccaccctgccctctgcccaagccattttaccggtttttctctacctggccagccaacaaagcaaagatgtacgcggagaacacctcaatgcccgc

SEQ ID NO: 33752 - DNA, 1911 bp, magnetite-containing magnetic coccus
attcaccacaccacctgccccttggattgccccagtgcctgcgccttggaagttaccttgcagcaggggcagctcaaggggatcaaaggggatgcccaacaccccttcacccaaggggttatctgcggcaaagtggcccgctatggggcggtgcaaaatggcccacgtatcacccaacccatgaaacgggtcggccccaaagggttgggccactttgagcccataagctgggatgaggccatgcaaaccgtggtggcgcagctacagagccgcatcagccgttatggggccgaaaccgtttggccctactggtatggtggcagcatggggctgttgcaacgcaaagcgctggagcgcttgacccatcgggccgggtttagccgtatgaagggcaccatctgctcctttgtcggagtttctggctggcaggcaggggtgggcaccttttatggcccttcggcggaggatatggccgcttccagtgatctggtgattttgtggggcatcaatgcggtttcgacccacatcaatctcatgaattttgtgaaaaaggcccgcgcccgtggggcacgcctagtggtggtggatccctaccgcaaccgtaccgcgaaactggccgatgagcatcttaatccccgccccggcaccgatggcgcactggccgccgccatgatgcatgtcttgctggcagaggggctggccaaccgcgactatctggcccgcatgagtgattttgatggcgaggtggaggcccacctgagccacaaaacccccgagtgggcggcgcacattaccggcttgtcggcggaaaccatccgcgcttttgcccgccagtatgggcaggccgccgccccctatattcgtatggggctgggaatgagccgtcagaacaacggcgcggtcaatattcacgccgtaagctgtttgcccgccatggttggcgcgtgggagaagcccggtggtggtgccatgatgatgtctcacggggcctttggggtgaatattcaggcgattaccgccccgcatttggtggatggcacacccagccgcgagctggatatgagccgtcttggcgccgtgctgggggatgcccagttagccccgccggtaacagccatgctcatcatgagcgtgaacccggcggtgacagcaccggatctgggagcggtctatcgcggcctaacccgcgatgatctgtttaccgtcgtgcatgagcaggtgatgagcgataccgccaaatttgccgatattctgctgcccgccaccacctttttggagcatgaagatctctatagctcgtatggtcaatacaccttgcaacatgccgaggcgctgttgccgccaccgggtgcctgccgctgtaaccatgattgggtcaatgatctggctcagcgtttgggctttacggaagaggtgtttcaacgcaacctaagcgagacggtggcgcaggtgctggcggattccaagctgcccccccgtgagcagtggtcgcagcgttggcacaatgttaccccccatgaggcagatcgctaccaccgcaacggctttggtcacgccgatggcaaatttcactttcggcccgcatgggggaataccgccatgcccgcgctgcccgaccattgggcggtgaatcgtcgggatttgccctcggatcgagcctatccgctggattttatgaccccacccgcccacgcggtgttaaattcaacctttaccctaagtgcggaccatgagcaaaaattaggggagccaaccttaatgatcaaccctgtggatgccgctgaacggggcattgttgagggggattgggtggtggcctataatgccttggcgtttttgcgctttaaggcccatgtgagcgaagatgtacgcccgggcttaaccctgtgtgagagtaattttgccgcacat

SEQ ID NO: 33753 - DNA, 279 bp, magnetite-containing magnetic coccus
cagatcacgccacatcaactggccgagatgctggctcataaaccaccgcctttgcttattgatgtacgcacagcagcggaatttaataccgatggccgcattgaacatgcgatcttagtccccttgagcgacttaagccgccgggcaccagagatgtttaagcaatatccgggccgagaagtggcggtgatctgccgcagtggtaatcgctccatcatgggttctgtggggctaaaaaaggcgggttttgccaaagtctataatgttacggggggcatg

SEQ ID NO: 33754 - DNA, 531 bp, magnetite-containing magnetic coccus
ctcgccagcgaacgacgccatttggatgaagccaagttgatggttttgggcgataggggtaccggtaaatcttcactggtggcgcggctgttagatggccgctttgtagcggacatgcaccccaccgaaggggtctccctgcgcacgtggcgtttttccgacggtcagcgccgcctgcgcttaaacctatgggattttagcggtgcggatcactattttgccgcccatccttactttatcaccccccagggcttaatcctgctggtcatggatggcgctgaacctgaacccgaacgccgcttggcccgctggatgcgcatcatacgctcactggcgggtcgtcaagccagtgtggcactcatttgccaccgtgccgaccgttttcccctcgaattggactggaatgaaatacgccaacgctaccccagcattaaggtggccgtgcggcgggcctcttccatgactggagaggggattgagtcggtgcaacaggccattaccaagctgctggatacctttgaaccggcccaa

SEQ ID NO: 33755 - DNA, 2271 bp, magnetite-containing magnetic coccus
gtggggacctttaccgatattaccgcgcgtaaagatatggaagccgccttgcacgatgccaaggtcgaggcggagtccgccagccgtgccaaaagtcgctttttggccaacatgagccacgaaatccgcacccctatgaatgccattttggggctttcgtcgctggctttggagcaggctaaagaagcgcgtcagcgggatttcttagagaaaatcaaccattctggtcactttttaatgggtctgctcaacgatattttggatctctccaaaatcgaagctgagcgtatggatctggagtctcaaccctttcggttggatgagttgctcaaacagttggcggccaatgtactacccgccatgcgtaataaagcggtagaggtgcattttttcatcgcatcgggtacccccttggcgctggttggggatgccttacgcttggggcaggtgttgcacaatctgttgagcaacgccatgaaatttacccatgagggggaggtgcgtatcaccctcaccgcagagccctatgtccaattgaccgatcactacctctttacctttgaggttaaggatagtggcattggtattccggcggaggtgcagcccaaactctttgaatcctttattcaagccgacagttccaccacccgccaatatgggggttcagggctgggtctggcgatctgccgccgcttgatggagatgatgcacggcaagatcactttgcagagcagcttggggcagggttccacctttacctgccgtttgcccttacagatccaatcttgcacagtcacatgctgcccaatgccagaggatgcctttaaagggcagcgtttgctggtggtgagtaacagcggctcgttaccagaatccattcagttttccatgggctcgctggatcttcagctacgccataccgttgatcccgaggccatggccgcgctggttgcccaggggttttaccccgatgtggtattgctggatgacaattgtggcgatagcactcagctggtcaatgcgatttcacagtttaccctcatgatgacggagcaaaaaaaacccaccatactcatgacaaccgtacaccaggatagtacgctgctggagcgtctgagtgcggcggggatggatggcgtgctggataaacccttactgcccatggcgctctatgatgtgttgatgcgccttttacataccggttccctgaatatgggggggttggagagcgtcagcagccgggaccatgccgcccatttggcggggttgcatgttcttttagtggaggaccacgaccttaatatggaggtggcaaaagccattttggagcgggttggcatacgggtgatcaccgcgcagcatgggggcgaggcgttggcgctgttagagcagaccgagggagccgcctttgatgccatccttatggatctacaaatgccggtgatggatggttttgaaacaacacgggtaatacgcagtaaaacggcttgggctcagccacccattattgccctgacggccaatgcctttagccaagaccgggagcgggctttacaggtgggtatgaacgaccatatcaccaaacccatcgctccagggttgctctatgcggccttggaacgttggatcgaccgtaaagatcgtgccatcggccatctggatctattaagtcaggccgaggaggtggtggtgtttccccctttgcaagggtggcaacagcagcaggtgttgatccgctttgaaggtgatgaggcgttggtgcggcgtctgttggatcggttggtggaggagtgtcataggctgctctcccatgtggagcccctgttgacacaacaggcgtggcctgagctgttggccagcgtacatggctttaagggtattaccggcaatttggggttagaaatcttgcaaaagaatgcctcaatcatggaacaagggctgtgcaaagagcgggtggtggcctcccaggttgcccagcattggcatattttagcaggctcaatccgcgattttgtagggacctatgggcagtggcagcagcagtgtatggagggggataaagggcacgggaagcgtgatgagcagggtaaaggggacgatatcctgcaagaacttttagagctattggccggacgccaaatgggcgcgcgggaccactataagcgacatcgtagggtattgatggcgtggttgggcgaaagcaaggccgcagccttagaaaaggccatggcagaacttgattttgtaaccgcagagaaggtgctcttgagc

SEQ ID NO: 33756 - DNA, 2397 bp, magnetite-containing magnetic coccus
atgcaactccccatcgaaggcatgagttgtgcggcctgttccagccgcttgcagcgccgtttagagagcatgccgggtgtgacccaggccagtgttaatttggcgacagcctcagcccggattgagggcgtggtcaccctggaagggttggaaaagctggttaaacagaccggattttccgtgccgcgcatcacccaaacgtttcagttagaggggctctcctgtgcctcctgtgtaaccaaagtggagcaggcggtggccaaactgtccggggtggaacgggtggcggcaaaccttgccacgggggcgttgttggtcacgttgattcccgactatgtgagccagacaaccattcagcaggcggtgcagggggtgggttattcgctgctggccagccaagagggcgaggtcgaatcgcgtgcccaaaccatgcaacagcgggagatccgccagttgcagcaccgcttggtggtgggggcgctattggttttggtgaatatggcgatgatgcacggttggttgccaggggtagccacgctggatgaagggtggcgcaacctgttgcaaggggtctgcatgacaccggtggtgttatggtcgggctgggggtttcaccggggggcatggcaggtgctcaaacatggtagcgccaacatgaataccctggtgagtgtgggctcattgagcgcttatgtggcctctgtgggcatcgctctggttccccagtggtggagccaagccgggcagggtgggcacctctattttgataccgcaggcatgattattgtgctgattttgattggtcgatggttggaggcccgagccaaggggaaaaccgcaggggccattcaagccttgctggccctgaccccacaaaccgccctacgcgtgcaagaggatggtggtaccgaaaccatagccgcagcgcaggtgcgtgtgggagatcggttgctggtacatccaggtgcggcggtgcccagtgatggggtggtggaggtgggcgaaccctatctgcacgaggccatgctcaccggcgagccgctacccgtgcaaaaggggctgggggatgaggtgagtgggggcaccctaaatggggcggttccctttaccatgcgtgccagccgggtggggggagataccgcactggcacggattattgccatggtgcgtcaagcccagggggctaaaccgcccattgcccggttggccgaccgcattgccggggtgtttgtgcccattattttggcgttggcaaccctggtattgctggtgtggtggctgctgttgggggccccttttacccatagtctcacccattttattgcggtaatgattgtggcgtgcccctgtgcgttggggttggccacgccgacctcggtgatggttggcacgggccgggccgcgcggttgggtatgttgatgcgcggtggggatgtgctggagcgggcccagcaggtgaatgcggtgatctttgataaaaccggcacgctgacctgtggcacaccggtattggttaaccatcagggcgcggccgctttactcgccggggttatggcggtggaggcccagtcggagcaccccattgctcaggcgttggtgaaggggctgggcgaggcaggggtggtgccagccgcagccagcaaggttaaatcgttgaccggttatggtatgcagggccaagtgggagaagagacgcttttattggggcggagcatccttctggaacagcgtggggtggggctggatcccaccttgatggcgcaggctgccatgtgggccgagcagggacagagtgtgattcacgtggcttggcaggggcagcatgcgggtttgctgtcggtggcagatgccgttaaagcagagagtgcggcaggggtggcggcgctccaggcgcggggctgtgcggtctatatggtgacgggggataatgccaaggccgctcaggtggtggcggcccagttgggtattgcggcaagccatgtacgggccgataccctgccggatggtaaagcgcaggtggtggcagagttgcaggggcaggggttggtggtggcgatggtgggggatggtattaatgatgcccctgccttggccagggccgatgtgggtattgctctaggcagtggcaccgatgtggcgatggagagcgccgatattattctcatggggggggatgtgcaaggggtggcgcgcgccatcgctttgtcggcggcggtgctggttaatattcggcaaaatctgttttgggcctttggttataatgcgttgctcatccccatcgccgctggggtgttggtaccgtggggggtgatgttggagcccgcatgggcggcggcggccatggggctgtccagtgtgacggtggtgagcaacgctctgcgtttggggcgtttgcgg

SEQ ID NO: 33757 - DNA, 780 bp, magnetite-containing magnetic coccus
ttgatccgcttgcagggcgtgtgcaagcagtatggtgcgttatccgctttgcaaggggttaacctaaccgtcgcgcggggcgaagtggtggggtttttgggccccaatggggcaggtaaaaccaccaccatgtccatcttggctggcctcttggcccccacagagggcgtggtgcaggtggccggggtggatatgctgcgccacccgcaacaggccaaaccgcatataggctttctacccgaacagcccccgctttataaagagatgacggtacaggcgtatctgagccatttggcccggttgcgcggggtggcggcccgtcagtgccgtgaggcggttagccaggttatggcgcaatgcggtcttaaccccgtggccgggcgcgtgttggggcatctttctaaagggtatcaacaacgcgcgggtattgcgcaggctttggtgcatcgcccagaggtggtgattttagatgaacccaccagcggattagaccccctgcaaatccaggaaatttgtctgttgatccgtagtctcggccaacagcacgcggtgttgttatccacccatattctctctgaggtgcgcatgacctgtgatcgggtggtgttgattcatcaaggcaaaatccaactggataccagtatggccgacctggagcaacatctgcaagctccccaagtggtgcaggtaagtttagccaacgatccaggtcaggcggtgttagccgccctaccgggggtggcgcatgttgaagcctgtgcgggagggtggcgcattacc

SEQ ID NO: 33758 - DNA, 1609 bp, magnetite-containing magnetic coccus
ttacgcatgggtacggggcagtttcgtcgtgaggttttggagcgcacggtagcattacataagaacaaccggcagttagcattggccaagcgtgaggcagaggaggccaatgcggcgaagagtcggtttttggcgaccatgagtcatgagatccgcacgccgatgaatgcgattgtgggcatggcagatttgctcaaggatacaccgttggatcgggagcaggcacgttttgttgcgacttttcagcgggctggtgatcaattgatggatcttttgaatgatattttggatttatccaaggtgcaatcggggcagattcatattgaggtcgttgagacggacatacgtacattattggatgatttgtcggcgatgatggtggccaaggcgcgggttaagcaggttgatttattatttaatccgcatcctaatttaccggctcgggttggggttgatccgttacgtttgcgtcaggtgatgatcaatttactgggcaatgccattaagtttacggccaatggtgaggttgagttacgggcgtattttaccagcagttctgaggtcccgtatgggttaggttttgagatttctgacacgggaattgggattgatgaaacccggttaaaggcgatttttgaagcgtttacgcaggcggatttatcggtaacgcggcaatttggtggcacgggattggggttgacgattagtcgtcatttggtggcgttgatgggtggggatattcaggttgagagcaccatcggtcagggcagtcggttttggtttgagatacccattgacgagccggtgcagaggcagccactttcgattttggagccgcgtcctgttctttatttaaatggcatgtcgccgaatcatgcagaggttttgcggcatcaattactgcatcactgtgaggagatccgctattcgcatggtgagggggagttaggggcgcagcttatggaggctgctcctggttcggttgtttggttggagagtgggcatgatcctacgggggcttttcgtttgttagagtcgttacgcgggcagtatggtaagaggggttttcattggattgttgcgggttgggagtctgttgagaagtgtttggagcaggctaatttcttgggtagtcattatatacagaagccgcacagcatggggcaggtattacagttattgatggatgtgttgggtatgcagcgcggtggtattggcgccgagggttgatatggatttacagacgccgattacgattttgttagcggaggatagtccggacaatgtgttattggttgagcgttttttaaagaagacggcgtatcgattggatgttgtgggtaatggtcgtgaggcgttggagtcggtgaagaagcatcattatgatttaattttgatggacattcagatgccggagatggatgggttgagtgcgacgcgcacgttacgttcgtgggagcgtgagcaggggacgccgcgcacgcctgtattggcattgacggcgcatgcgtttcgtgaggatcgggaggcgagtattgaggcgggttgtgatgggcatttgactaagccatttaagaaggatgagttattgaagacgattcagcggcat

SEQ ID NO: 33759 - DNA, 336 bp, magnetite-containing magnetic coccus
gatgcggcattgtgtcgtcgtattacccattggttggatgaccatttccgccgggcaccccgtggggtggattttccggtacgcccagcgggtacggtatttcagcaaaaagtatggcgtgagattagccgggttggccctggtcagaccattacctatggtgagttagccaagcgattaaacagctcggcgcgggcggtgggtgtggcggcggggcagaaccctatcccggtggtgattccttgtcaccgggtggtgggtgccaaggagttggggggttacagtggtcatggtggtttgcacaccaagcgcaccctgctgagcctggagggggcc

SEQ ID NO: 33760 - DNA, 3645 bp, magnetite-containing magnetic coccus
gtgggatcggatgccaacgtttctattaccggcgcgggcgatatcgccctaggtgttatcaccgccaaaggggatgatgtcaccctggtatccgctggcaaaattaccgataataatggtgccgccaacaacgttactgccgatattctaaacgttaccggccccaatggtgtagaagggctggagacctccattacccaactctcatcaacgggcagcacagatattgttaatgctggggcgatggccattaccaaggcatcgctagagggaggtagtagctcctttattgccgagtcactgaccattctagatatggcaggcgataccgcaaccatcgccaataacacatccctaaccttgcaaaccaccacgggtaatattgtctttttagacaccaatgacaccatcgtcgcccagggcagtggtacggttaccatcaacgcgggtaccaccgataagagtggtgcggtagccatcatcggcaatattaccaccgccaaccaaaacatcagtatcacggcggatagccatatcaccatcggtttgctcaatgcggggatcggtgatgtcagtgtcagctccgattatggggtggttttggatggcaacagcaccgcggtgaacgtcattgcgcggaatttttccctgagcggtaccacgccaacggtgcggcaggcagaactgcacaccaccaactccattgccaatgcccacgcccatgattccgaggtcgcggcgaagttgacgttgctggaggcaaacaccgcagccatggacattatgtcaacggccgagagcacggcgaactactcgttgacgctcgcctccagtgcttatgacacggcacaagccgaagttgaccgtttggcccccatcgaaaacggtttaaaaataactacttatgtgttggatggggtttcgattgcgctatcgactgcggcctctgccattgaggtggctgcgggtgcggctcaggctattccattctccggtgatgctggctccgaggcggccgctgcggtgaccggtttggcggcaaacgttgcaggtattgcggcttatgcgatcggcattgcccactccgaaattgcgggtcagttggatgatgctgaggatttggcctttaataaagatgcagaaatgtatgcggctaaaagcacattgaccgatgctattgccaaccaccaagcctacaaagaggcaacctccatcagtcaggccgcttatgatgcggcggtcatcgagcgtaaccataattggcaggtggctaggcaggccgtgctggctgaagatgcctcatccacagctggtacgttggcactaccctttggtattcagatctcggggcagttggatgtgaatgcggtcaacagtgatgtggtgctagccattaccggccctgccgtgctcaattccatgtctgcaaccaaaacagcaggtacggggatcatgtccatcactgccaccgataatatctccgtggtgggagccttggttgccgatgactacatccgcctagagaccaccgggcagattatcaatggtaatgccgggcatagcttgaccgcctctaaatttgtgggtgtggctggaaccggtattggggccagcggtggtttgaacacctcggttaccaccatggcggccagcaccaccaccggtgatgtcaccgtgaccaacaataaggctttgacgcttggtacggtagacggggtgagcggtatcaccactgcgggtaatatcgtgattgcggcaaccagcccccttaccgtctccaacaacgtcaccacttctggcggcacggtcgccctgacggcgggtaatagcgccaacagtggcgatgattttaccctctccgccaataccaccatctcagcggccagtaccgttaccctgacagccggtgataatgtggcggttgaatccggtgcacagattaccggtaccacggtgaccattaccgccaacaataccggcgatggcgaggccgatggggttaacggtggtgcaaccattgccggtaacattaacgccagcagcttggtgctcagcgggggtggggttaaccactctggcaccataaccagtgcgggcagtgtcaacattagcgccacctccaccgccgcttcgtcggttaatggcatcaccctgggtagtgtgacggccggtggtcaaattgatgtggtctccagcaataaattggtgatgaaccaaaatgtcaccaccaccagtggtgccgtggtgttgaccgccggtgatagcagcgccagtggcgatgatctgaccctggcggcaggtaaaaccatcagcagtggtgataacaccattaccctgacctctggggataatatgagcattggtgcggcggctcagatcaccggtacgacccttgtattggccgccaatcatgagggggctggggtggccgacggggtttctggtagcatggtgctggctggcaatctgagtggtcaaaccgtaaccatcagcggagccgggttgacccataccggtagcatcaccagtaatagcacggtgagtgtcaacgtcaactctgcggcgacctcggccattagtggcatttcgttggcggcagtgacagccggcggtcagattgatgtgacctccagtcacgctttaaccctgacccaaaatgtgcaatccactggggggccaatcaccattacggcaggtttacaaacaacctccgtggataacctgaccgtcgatgctggggtaacggtgcagagtagcgccggtgtggcctttagtgcaggggacagcatgaccttcggcttgggttcacaggttacaggtacgggtatcaccctcattgccgataaggccggtgatggggatggcgatggggtaagtggtagtatcaatctctatggtaacgtaaacggttcgtcggtggatgtcagcgcggcaggctttagacagaccggtaccattaccagcagtggcgatgtggatatcgccgtggtttcgaccctctcatcaccgtataacggcatcgctttaggcaccatttcggcggcgggtcactcggttaagatctccgccaccggtactgcaacggcagggattgccgacaataacggtgccgcaacgaatgttaccgcagccgacctagccatggtcgccaatgggggggtaggggcatccgcagatgcgttggagacccaggttagtaatctggccgctaccggtggttcgggcggtgtgaccatctccaacagtggtgatttaagcctaaccacggttgagggtgtaaccagcttctcagcagccgatggtgcgctttcgttggtaacgacgggtaacttgttgattagcgacggtttcgtgcagggtgccgggttgaccgtcacattgcaggccacaggcggtaacatcaatgagaccaacagtggtgccgcagccgatgtggtggggaatatcattaccttgaccaccacgggcttaggtaatggtgtgggtgatgtggccaaccgtctggagctgaatgcccaagtgttgaatgtgaccaccgataagggagatgtctatttgcacgatacagcaggtggcgttgccgtcggcttaataaccacaggtacgaccgagggtacccgggtggatatgatggttagtaatggc

SEQ ID NO: 33761 - DNA, 2946 bp, magnetite-containing magnetic coccus
gtcagcattaccgaccgtgacggctttatcacctatatcaacgaaccctttagcctcatcaccggctattccgagctggaaattgttggcggcaaacaccgcttgctgcactctggcgtgcatgaccacgccttttatcgtgatctctggggcaccatctccagcggcaaagcgtggaaaggggaactgtgcaatcgggccaaaaacggcaaactgttttgggtaagcaccgccattgtgccctttatgaatgaagcggggcaggtagaacgctacatctcgatccaaaccgatattacccagcgacgagagatcgagagagagcttgaaaacaacaactatctctcggacatggctctgcgcctgtccaattcaggctattggcacctactgcttgaggatgaaggctattatatttcgtcagaacgcaaagcactgatcatgggggacccccctcatcctggcttccgctaccatatccaggacgactggctggccaacattcgcaaaaccgacccagccatggctgaacaggttttcgccaattttacccaatccatcgccaccggccaggatatccattttagttatccctacgtccgccccgtcgatggccgcaccatctggttggaaacagcgggctatgttgaacgcgacgagacaggcaaaccctacagagtttatggcgtcacccaggatattaccacccgccgggccgcagaacgtgagatcttgcgggccaaagagatcgccgaagaggccacccaagccaagagcgattttttagccaatatgagccacgaaattcgtacccccatgaatgccattattggcatgagttatctggctctacagacagaattgagccgcaaacagcaagattatattaacaaaatccacaatgctgccaatgcattacttggcattatcaatgacattttagatttttctaagatcgaagcgggcaagctagacatggaaaacctgccctttttattgagcgacaccttagagagtttaaccaaccttatcgcggttaaggcgcgtgaaaaggggcttgagctgctcatcgccatggatcccgctgtgcccgatggtttgataggcgatgatctacgccttggacaaattttggtcaatttggtcaataacgcggttaagtttaccgatactggggagattgtggtccgggtcaaacaggtggaggccaatgatcgcgaggtcatgctacaattctccatttccgacagtggcatcggcatgaccgaggcccaagttgccaagctgttcaactcttttagccaagccgatgcctccaccacgcgcaaatatggtggcacgggcctgggtctcaccatcagcaaaaagctgacggagatgatgcacggtaaaatctgggtagagagcactccaggggtaggcagtacttttctatttaccgcccgctttggcctatcaacgcacccggctaagtcaaagcttaaactgacaggggatctacagggtctgcgggttttaatcgtcgatgacagcgcaacatcccgtgaaatttttgaacaactggccatcagcctcggctttgacgcccacttagcggccagtgcaagcgaagctttgcttgccatctaccgagcagaagccgcagacacaccctaccaactggtctataccgattggaaaatgcctggcatggatggtgtcgagcttacccaccgtctcaaaaccgccacagacctgcaacacccccccaagataatcatggtaacggcctatgatcgggatgagatgttgcgccgtctaggctccaacaccgtggatggctttttaaccaaacccgcgacatgctcatccttgatggaagcagccatgttggtttttggcttagaagcgcgcaccgacttggagaatggcggcgaactactgggcctagaggagctccaaagcagggctggggcacgcattttgttggtagaggacaatgagattaaccaacaagttgcaaccgaattattggagatggcccacttagaagtcgcggttgccagcaatggtcagattggggttgagatggtgcgagccgaaccgtttgacttggttcttatggatatgcagatgccggtcatggacggttataccgcagcccgcaccattcgccaggaggcgcgttttcaaaccctgcccattctcgccatgaccgccaatgccatggcgggggatcgggaaaaatgtctcgctgcgggcatgaatgaccatgtcgccaaacccattgatcccaaggagctgtttaccgcattagccaaatggatcgagccgcgccagcaaccgttgcccaccaccaccaagcttgccgtggtggacgacgcccaagagcagctgcccgaactgccggggatcgatacccgcaatggcattttacgcatggggggacgggttgccagctataaaaagctgttatccaagtttatccttaatcaagccaacagtatcgtcgagattgaacaggcacttgaggctgctgatattaagctggctacccgcttggcacacaccgtaaaggggattgccggcaccataggggccgatttgctgcaaacacgggcagcagagattgaaaccaccctcaataaaggcgacacagcgcaggctttggctcaatgccctgccgcacaagccgcgctacaagagaccattgcggtaatccaacaggctctgcccagcacagcagcaaccccgcagccccaagcgtacgaggcgctgccactgcccccagattttatcctgcaactggaaacggttatcgcacaggccgaacagtttagcggagaggccattgaacggttggaaaccctcttacccaccgcgcagggaaacccctgtgcgcattctctaaaaaatgcctaccaagccatggccgagtatgattttgaaaaagccatcgcagagata

SEQ ID NO: 33762 - DNA, 648 bp, magnetite-containing magnetic coccus
ttgctcaccgcccgcaacctgtgtgctgaccgtggtgggcggcgggtgttggagggaattgatctctccatcggggctggcgaggtggtgaccatcatcggccccaatggtgcgggtaaaagcacgttgctcaaggtgctgctgggggtggagccctacagcgaagggcaagtcatccgaaaagccaatctatgcgtcggttatgtgccgcaacggatgccggttgacgccattttgcccatgaccgtgcagcgcatgttgcggctggctaaggaggtggatgagacggccatgctggcggtgctggaggagaccggggttgcccatgtgttacacgcaccgctgcaaggcttatctgggggggagttccagcgggtgttgttggcacgtgccatgttgcgcaatccccaactattggtgctggatgagccggtgcagggggtggactatagcggcgaggtggccctttatcagttgattggtgccttgcgcaagcgtcatggctgtggggtattgttggtctcccacgatctgcacatggtgatgcgggataccgatcgggtggtctgtcttaaccggcatatctgttgtaccggtacccctgaccatgtgagtgggcatcctgaatttgcccgtctgtttggggat

SEQ ID NO: 33763 - DNA, 1194 bp, magnetite-containing magnetic coccus
caggatatcacggcacgtaagcgcatggagttggccctacaggaacagaaggagcaggccgaagcggccaaccgggccaagagcacctttttggcggtgatgagccatgaaattcgtacccccatgaatgccattttgggtatggcagagctgctacgggagagtgacctgaccagccgacagcattggtgtgtggagaccttaaaccgttctggtgagagtttgctgtcgttgatcaacgatattttggatctttccaagattgaggccgagcgcttaaccctagagcatgtggtgtttgatctggtgcagctggtaggggatgtctgtagcctgtttgggtatgaggcgcaaagtaagggtttagcgttaaagcatcacatcgcccctacactgccccgctatgtggtgggtgaccccatccgcttgcggcagatcatgatgaacctggtgggcaacgcggttaagtttaccaaacaggggcatgtgtcggttgaactaaatcccctcgcggatgggcggctatcctttgtgatccgtgataccggtattggggtgtccgtggaacagcagcgcaatatctttaagccctttactcaggcagactcctccataacccgtgagcatgggggtacggggttgggcttgaccatctgcatgcggttagtggcattgatggggggtgaaatgcagttagaaagcaccctgggggaagggagctgttttcattttgagttggagctgcctgcggccccgccgggtgccgagtcggttgtgggtacgccgcgcaccttggccgatgtagccagtgcattacgcttagagagtgccgcacaccataatgatcccattttggtggtggatgatgccgaagataatcgtatgctggtcaacgtttttttaaagaaaacccgttatacgctggtgatggcagaaaatgggcttgaggccgtcaatgcctttaaacagcagcccttcgcgttggtgttaatggatattcaaatgccccttatggatggctacgaggcaacccgccagattcgccaatgggagcagcaaaagggtagtggacgcacgcccattatcgcattaaccgcccacgctttgagtgaagagtcgcagcagattttagaagcaggctgtgatatccacctgaccaaacccatccgcaagagcaagttattagaggttttg

SEQ ID NO: 33764 - DNA, 498 bp, magnetite-containing magnetic coccus
ttgattaccgaagcgaagattcaacgccgcgtgcaagcactggctaaggagattatcgcccgcatggggcaagagccggtgatggtggcgttgctcaagggctcatttttgtttgcggccgatctgctgcgggagatgggccgccaaggggccaaacccaagctggattttttggcggtttcatcctatggtagcggcacccaatccacaggtcaggtacaggttcagcttgccattaaggagcccttgcagggccgcgatgtgctgttggttgatgatattttagataccggcaatacctttgcccacgtcattgagttgctcaaggcgcagggtgcgcaacaggtattaacctgcacgctgcttaacaagcaggcccgccgccagcaacctgtcgtggccgattttattggctttgaggtacccgatgcctttgtggtggggtatggtattgattgggacaaccattttcgtgagctcccctatgtaggggttatc

SEQ ID NO: 33765 - DNA, 849 bp, magnetite-containing magnetic coccus
aagggcagcctacaggactccaccattgagctgtttaaacaggcgggttggaccatcgtcaaccgctcccgcaactattttccctccattgatgacccggagatcaaacctgcgctcatcaaaccccaagagatggccccctactgcgccgacggtacgctggatgtgggacttaccggatatgattggattctcgaacaggattgtgaagataaggtccatgagttaggggtgcttgattattcaaaatcctccagccacggttgtcgctgggtggtggcggtatccaatgattcgccggtgcaaaagattgaagatctgcacggcaaggtggtttcaaccgagttgattaaaaccaccaaacgcctgtttgccgagcgcggtgtgcaggcggacatccgttactcttggggggctaccgaggccaaggtggtggaaggattggtggatgcggtggtggagatcaccgaaaccggcagcaccatccgtgcccacggtctgcgaattattgaggatctgctgcacaccaacacccgcatgatcgccaacccagccgccatgcaggacccctggaaaagggccaaaattgagcagctctatttgatgcttaatgcctctttaaaggcccaccataaatccatgctcaagctcaatgtcgcagacatcaacctagatgccgtctgtgcgctactacccagtctgcacgccccaaccgtcaatccccttaaagcccttggctggagtgcggtagaaacggtggtggatcgggatcaaatccgggacttggtgcccaagctggtgggggccggtgcggaaggaattgtggaatacgaccttaaaaaagtggta

SEQ ID NO: 33766 - DNA, 1767 bp, magnetite-containing magnetic coccus
ctcggtatcaccgaacttgccctgcgtgacgcccatcagtctctgtttgccacccgcatgcgtttggaggatatgctccccatcgcccctaaaatggacgaggtgggcttttggtccattgaggcttggggcggcgcgacctttgatagctgcattcggtttttgggtgaagacccctgggaacgtctgcgtgcactgaaaaaggcgatgcccaagacccctttacagatgctcttccgtggtcaaaatatccttggttatcgtcactatgccgatgatgtggtggaaaaatttgtggagcgctgtgcggttaacggtattgatgttttccgtatttttgacgccatgaacgacacccgtaatctggaaaccgccatcaaggcgaccaaaaaggtgggcaagcacgcccaaggcacccttagctataccatcagcgatgtgcacacggtggatatgtgggtggatatggcgaaaaagcttgaagatatgggtagtgactccatctgcattaaagatatggccggtctgctcaagccctatgtcgccacggagctggttacaaagttaaaggccgccgttaaggtgcccattgccatgcagtgccacgccaccacgggtctctccacggcgaccattgttaaggcggctgaagctggaatcgatatggtggacagcgccaccgcctccatgtccatgacctatggtcactcagccaccgaatcggtggtggcgatcatggaggggtctgagcgggatacggggctggatctggttaagttagaagagatttctgcctatttccgtgaagtgcgtaaaaaatacgccaaatttgaaggctctttgaagggtgtggattcgcgcatcctgctggcccaggttcctggcggcatgttgaccaacatggaaaaccagcttaaagagcaagggtgcgccgacaagttggacgccgtgctcgaagagattccccgcgtgcgtaaggatctgggcaccatcgccctggtgacccccacctcgcaaattgtgggttcgcaggcggtctttaatgtgctgatgggggaacgttacaaaaccatcaccaaagaggcccgtggtattttgcgtggtgaatatggtgccacccctgccccggtgaataaggagttgcaagcgcgctgcttggaagcgggcgaagagcccatcacctgccgcccggctgacctgctgcaaccagaaatggatagcctaaccgccgagctgaaacaaaaggccgctgagtcgggcatcaccctggctaaagatgtgatcgacgatgtgctcacctacgccctgttcccggcggtgggtttaaaatttttggaaaaccgcaacaaccccgccgcctttgagcccaagccctgggaagaggccgcccctgttgctgccccagcagcggcacccgccaccgccccaaccgcgactgaagcctacaccgtggtggttaatggtaccgcttataatgtgcaggttggccctcaaggtcaggttgccagtgtcgcccccagcgcagccgccgcaccagtggctgccgcacctgctgcgggtggagaacccattaaagccccattggcaggctctatttccaaaattcatgtctcaacgggtcagcacgtaaactcgggtgacgtggttttgatcatggaagcgatgaagatggaaaccgaggttcgctcacccctgtcgggcaccgtaagcagcatcaactgcaaagaggggaatgtggtcaacgttggggacattttgattactctc

SEQ ID NO: 33767 - DNA, 1032 bp, magnetite-containing magnetic coccus
caagcgttggagttggcggctcagcggatttaccaattccatagctggcagctcccccaaatgggtatccaagagttcatggatgcctcgggcaccctgctggggcagcgggtacaggcggttaaaaaggcggggctctatgtgccaggtggtttggccagctacccctcctcggttttaatgaatgccatacctgccaaggtggcgggcgtcgaaacgttaattatggtggtccccaccccggacaaccaagtaaacccggcgatcttggctgcggcccgcttggcgggtgtggataaaatctttcgcattggtggtgcccaagccgtagctgccatggcctatggcacccagcaggtacccgccgtggatatgattgtagggcctgggaacatctacgttgccaccgccaagcgacaggtatatggacaggtgggcattgatatgatcgccggtccttctgaaattttggtcattgcggataaccaaaacgaccccaaatggatcgcggcagacctgctctcgcaagccgaacatgatcgcgatgcccagtcgattttggtcacggatgacgccacttttgctgagcaggtgcggctggccattgcagagcagcttagccatctttctcgcagccaaatcgcccgtcaatccatcatggaacgcggtggaattattgtggtcaaagatcttgatgagggtgccaaaatcgcctctcgcgtggcaccagagcacctggagctggcggtggcagatccccgtactttgatgcacaaaattgatcatgcgggggcaatttttatggggcggcacaccccagagcctattggggattatgtagcaggtcccaaccatgtgctgcccaccaatggtacggcccgtttttcgagccccttgggggtgcataattttatcaagcgcagcagcctcattggctgtacggcaaggtcgttcgccagcatcggtccggccgcctcggcgctggcgggttccgagggcttaaccgcccataagttgagcgttgatctacgc

SEQ ID NO: 33768 - DNA, 1326 bp, magnetite-containing magnetic coccus
tttcgcatgcgcaccaagcagggcggttggtgctggattctggcacggggcaaagtggtggcgcgcaccgccgatggtcaaccccaccgcatggtgggcgcccatcaagatattagccagcgcaaacagttagaggctgacctattggccgctaaaacggaagccgaacaggccaaccaagccaaaagccgttttttggccaatatgagccatgagatccgcacccccatgaataccattttaggtatgggtgagatattgctcaacgcacccaatttaacccctaagcagcaccgttatttgagtatctctcagcgagctggggatactttattggggttgatcaatgatattttggatttatccaaaattgaagcgggggaacttcaccttgaacataccctttttgcgctacatgatgaacttaagagcctcattaccatgctccgccccatggcacgggataaagggttatccatgcagtgtgtcattgatccgcaactccccacccatgtgcatggagacccgcaacgatttcgccagattgtgctcaacctattgagcaatgcccttaagtttacggatcaaggcagtattaccctgcacgccaaacccatagagaccgggcgcctacagtttacggtaagcgacaccggcatcggcatgccggaacaggtcatcaccaaaattttccgcccctttgtacaagccgaggccaacaccacccgccgctttggtggcacaggcttggggctaagtatctgccgtcaactggtcacaatgatgcacggtgagatctatgccaacagccaagttggcgagggcagccaatttatttttgaaattgagctccctgcggccaattccgagacggttaaacaagagcggctctctccaccaacaaaacaaaatatccctatgcggttgcttttggtggatgatatggaggacaaccggctattggttaaagcctttttagaaggcaccccccaccaaattgttgaggcggaggatggtctggacgcattggaaaaatctcaacaaagccaatttgaccttatcctcatggatggcatgatgcccaaaatggatggtttggaagccacccgccgcattcgcgccagggagagcgaacataaccttactcctgttaccattgtcgctttaaccgctaatgccatgcctcaggatgtcgccgacagcctcgcagcgggtagcgactaccatatggccaaacccatacgtcgcgccaaactgttgcagttactggcgagcattgccaacgaacggcgtctcttctcccatgaggaagtaaaacagaccacc

SEQ ID NO: 33769 - DNA, 1305 bp, magnetite-containing magnetic coccus
ttggcccgtggcaagcaagatattgagatccctggacgtggccgcagtgatgagatcggtgccatggccatggcggcggacgtctttaaggtcaaagcccatgaacttgccaatgccagccgctataagtcggaatttttggccaacatgtcccacgagttacgcaccccgctgaacagtttgctgatcctcgctaaaatgctcagtaacaatgaagagggcaatttatcggaagaccaagtggaatcggcccaggttatctatgaaagtgggcgcgatttattgcacttaattaatgatattctggatctatccaaggtggaagccgggcgcatggatctctatgtcgagagccgtcctttacaggcattgccacagatgcttgagcgcacctttaaacccgttgcccagcaaaaatccctggcgtttcattggagcatcgccgacgacctgcccaaagagttggccaccgactggcccaaagcggaacaggtggtgcgcaactttctgtctaacgcctttaaatttaccgagagtggtcatgtgacggtcgccatccacaagccccaagcccatcgtatctttatgaacagtgatttaacccataaaaacgcgcttatgatctctgtaaccgatagcggcatcggtatcgcagaagataaacgcgagcttatttttgaagcctttcgccaagcggacggcaccaccagccgcgcctatggtggcacggggctagggttgaccatctcccgtaaatttgcggcgcttctggggggcgaaatccaggtagagagcgctcctggcaaaggctcttgttttacgcttatccttcctctggagagcccaaacctggaacaccaagcagggaggggggagcagatggaaccagaaaaccccctaagccccagtgaacaggtggaggccatcactcactttagatcccacaccaccaccctgttggtagtggatgatgaccggcgcaatgtgtttgcgcttaaaaaaatgttggaagatcgggtggggttggtgctcagcgcttataatggcaaacaggcgttggatgtactgagccaacaccccgaagtcgacctagtgtttatggatattatgatgccggagatggacggatatgcggccattgaggccattcgccggcagccccaccttcaacacctgcccatactggcgcttaccgcacgcgcgatgcctggggaccgggagctctgccttagccacggtgccaatggttatctctccaaaccggtagagagcgatgctctgttccaagcgcttatcacttggctt

SEQ ID NO: 33770 - DNA, 1566 bp, magnetite-containing magnetic coccus
aacaatagcgtcgacgatatcaagccctgctttccgctcttcggtgaaccggaataccgggaaaacatgaagaacaagcaggataaatatgaagagcgtgagagcatggagaaactggaagagaccttccagtggaccaccagcgctgagtacaaagagctgaacttccaacgtgaagcggtcaccattaaccccgccaaagcgtgtcagcccctgggcgctgtgctttgctcgctgggttttaagggcaccctgccctacgtgcacggttcccaaggctgcgtggcttacttccgcacctatttcaaccgtcacttcaaagagccagtcgcctgtgtctccgactccatgacggaagatgctgcggtgtttggtggtcacaagaatatggatgccggcctgaagaacgccctggccctctacaagcctgagatgattgcggtctccaccacctgtatggccgaagtcatcggtgatgacctgcactcttttatcaccaacgccaaggtaaaagggcatgttcctcaggatctgcctgttccttccgcccacacccccagctttgtcggctcccacaccaccggttgggatggcatgttggaaggcattatccgctacttcacgctggataagcatgagagcgctgtggtcggttccaacggcaagattaatctggtgcctggttttgaaacctacttgggtaactaccgcattctcaagcgctacatggaagagatggatgtaccctacactctgctctccgatccttctgaagtgttggatacccctgcggatggtgagtaccgcatgtatgttggtggtaccgagcttgaggatgtcaaagacacccccaacgccattgataccctgttgctgcaaccctggagcttgaccaagaccaagaagtatctaaaagatacctggcagcagcccatcagtgagatcaacccgcccatggggcttaagtggaccgatgagtacctgatgaaggtcagtcagctcagcggcaagccaatcccagcctccatcgagcttgagcgtggacgtttggttgacatgatgaccgactcgcactcctggttgcatggtaagcgcttcagcctctacggcgatcctgactttgttatgggtctgaccaacttcttgttggagctgggtgctgaacctgtgcacgtcatgagcaacaacgccaacaagcgttggggcaaagccatgagcaagattctcaagagctccccttacggtcaagagaccgaagtacacgtgggcaccgacctgtggcacttccgctcgttagtatttgatcgtaagcctgactttatgattggtaacagctacggtaagtttatccagcgcgataccaagcacaaagggctggagcatgaggtgaagctgatccgtttgggcttccccatcttcgaccgtcaccacctgcaccgcatgaccactttgggttatgaaggggcgatgtacatcctcactaccctggtgaacgcagtactggaggatctggattccaagaccaccggttatggcgaaaccgactacaactatgacttggtgcgc

SEQ ID NO: 33771 - DNA, 759 bp, magnetite-containing magnetic coccus
ataaagaccatgcgcgatgccatgatcgcccggattcttgatttgatggcaaccgatgagcgcctctttttcctctcggcggatatgggggcccccctgctggacaccctgcgggagagctaccccaagcgttttatcaatgtgggcattgctgagcaaaaccttatcaatgtcgccgctggtctggcgatggaggggtgctgcgtctacaccttggccattgcccccttctatttgcgtgcttttgagcagatccgtaacaatctttccatagccgcgcgctttaatccgctcaatgtcaatatgatggggattggtggcggtgtgagttatgatatttccggcccctcccaccacgccctggaggatctggcgaccctgcgctctttgcccgatgtggcggtgatctcacccgccgactggttggctgcgtcccagttgcccgattttgcccaaaccgcgccttaccctaaatatattcgcctcgacggcaagggtcatgaaccggtaaccacccaaccgatggtgtggcgtcaaggttttcaaaccctgcaacagggggcgcgggccgctctactgaccaccggcttcatgacccaaaaggggcaaaaactggtggctgagttgggcgaggcggacatcgggcatattgatctgtttcaattcacccgcgatttggatgaacaggcgctggcccaaaccctgcgcggttatggacgcctcgttaccctgcacgaaggctatctgggccggggtggg

SEQ ID NO: 33772 - DNA, 2294 bp, magnetite-containing magnetic coccus
catacgccacaccaccctgttggtggcagcactgctcacagcggcctttatcttgctggtctatggtttgctgcggcacttggtgctgcaaccggttgccctgttgcgacaagcttctaagtgcattgcccaccacgaaccactgcctaagttacccttgaccgaaggggatgagatcagccatttggccattgccattgcggctatgtctcgctccattggcgaatatcatcgccatctacagacccagcggaaccggtttgaaacgttactggctgccaaccccgatttgattagcctgaaaaaccgggtcggtatctatcaagtggtcaaccctgccttttgccattttttggggcttcctaaagaggcgatcctcggccaagatgatgcccgcctgtttaccccccaccaagccgcacgcatacggcaagccgaccaatgggtcttatccagtggcgcaccctcggcacaggaagaggaggccgtaggccctgacaacctcccgctttggctgcacgttatccgcaccccaatcacccaggctacgggggaggtttcgggcattttaaccacggtgcgcaacatctcggcgcgacgcatggccgaggaggccctgcgcaccgcccatgaggggttggagcaagaggttgcccagcgtacccaggcactccgtgagagtgaaacccgcctgcgtattgtgaccgaaaacctgcctgctgtggtgtggatgagtgatcccttactgaccagcatgcactttgttagcccggcctatgaacagatctgggggaaatcacgggagagcctgttgcaagatccacaatccctatggaccagcatccacccgagtgaccgcagttttgtactcaagcgcattctaaacagcaacggtcaaccgtgggaggcggagtatcgtattctgcatcccgatggcaccacccgttggattcgtgaacagggtgccgcctttcgcgatacccataagcagatcctgtttttaattggctgcgcttttgatgtgaccccgctaaaagagaccgaacgggcgctctccaccgcgaaacaggaggcggaatcagccaaccatgctaagagtgcctttttagccaccatgagccatgagatacgcaccccgttaaatggcataaccggcatgatagagcttttacaacggagcgctcttagcgtggaacaacgtcaacaggtggagactatctccaaatgtagcgtggttttgatggatattttaaacgatatcttggatctttccaaaattgaggctggccagttggtattggagcgcgcacctttcagcccaacccaactactgcttaatttgttggaagtgatgcaaccacaggcccgcaataaggagttggatctacagcttaatatggatgaaaaactccccagtaccatgctgggggatgccacccgtctacgccaagtggcgctcaacttaattggcaatgccattaagttcaccccacggggatgggttaaaataagcttgctggtgcatgaacggatcgacgatattgtttgggttgagttagcggtacaagatcaaggtatcggaattgctgatgaaaaacttgtccatctgtttaatccttttacccaagccgatagcagcatcacccgcaactatgggggtactgggctaggactggccatcagcaaacgcttggtcgaggcgatggccggtgccattagtgtcaccagcatcgagggcaaaggcacccattttcgcgtgaccttacccatgcaggttgcgcatacccctctacctgccgatgcgttcgccccgcaagagacgcttgctctacgaccactacagatgttgttggtggaagatgagacggttaatcaacaggttgtctgtgccttattagaggatgaaggacatcacgttgatgtggccaaccatggggaagaggccgtgcttatgtgccagcagcgtgcctatcaggtaattttgatggatctacgcatgcctaagatggatgggttaagcgccacggagcagattcgccaacaaggcatgaaccaacagacccccattatcgctttaacagcggatgtattaaaaagcactctggatcgctgcctagaggtcggcatgcagcaggttttgacgaaacccatacggctggtgcaacttaaccatgccttggcgcacattggtctacccatggctccgccgcgcccccctgcccaggcgttatcggaaccagcgccagaagcgaccgagagcgctctccccacagagtctgaggaagatacctgtc

SEQ ID NO: 33773 - DNA, 486 bp, magnetite-containing magnetic coccus
aaccgcagccgctttcgtcatgaagctgaactgctcgctcggttacaccaccctggtattatccctctggaggagagctttgatgccctcggcaccagctatctggtcatgccctatgttgcgggcgaaaatctgcaccaacgcatccgccgtcgcccgctgcatgaaggcgagctccacgccctgctggtcgcccttgcccaagggttgatcgctgttcatgaggctggctattgccatctggatatcaagccaaataatgttttattgcagcaggatgggtctccggtactcattgattttggagcagcttggcaccaaaaagagctggaacggggacgcgccgaccccctttttacccgcgactatagcccctatgaactgtttaccaaacagcatgtgggctgccacagcgacctttatagtcttggtgcccttgcctaccggctgctcactggccatgcaccggtttgcagtcagatccgg

SEQ ID NO: 33774 - DNA, 1128 bp, magnetite-containing magnetic coccus
caggccttgcaggatgcccaggcggctgatcgggtaaagagtgaattttacgcgaccatgagccatgagattcgcaccccaatgaacgtggtgctgggcatgagtgatattctgctggagacggtgcaagagcctgaacagcgccagcagttggcccgcttgcaacaggccggtagtgccctgttggagttgatcaataatattttagacatatcccgcattgaggagaagcgcttaaccctccatatggcgcctatggatttacggtctttggtagaggatctgctgggtttctttcaactcccttaccatgagaaagggatcgcgctggtgagtgagtgggagcagggcttggccacccatattttgggggacagtggacggctaaggcaggtattgaccaatctattggggaacgctcttaaatttacggagcgggggcaggtggtggtggtggtgcgtcgggatcccgaggatgccacctacttacgtattgaggttagggatagcgggattggtctacatgccgatcagcttttgcatatttttgataaatttacgcaggctgaatcgggtctgacgcggcgttatggtggcagcggtttgggtttggctatctgcaagcagctggtggtgttgatgggggggcgtatctgggtagagagcgaggatggggtgggtagttgttttatctttaccttgccctaccaggaggttacagaacttgaacggcggcagatgcaggatgaagcggcggagtggtcggttgatgtgccgcgcaaagtgttgctggttgaggactctgtggacaaccagcagcttattgtcgcttatttaaaagctagcccttatcaagtgagcattgcccaaaatggtgccgaaggggtggcgatggccaaacaggatgcctacgatcttattttgatggatatgcagatgccggtgctggatggctatgcggcgacgcgctccatccgccagtgggagcggcagcaggggcgcgagccggtgcccattgtggcgctgacggcccatgccttggagggggatttagagaagagcatagaggcgggctgtagtctccatttgaccaagcccatacgcaaggctcaactccttaaccagctg

SEQ ID NO: 33775 - DNA, 993 bp, magnetite-containing magnetic coccus
atggcccaacagaccaacgaagctttggctcgtctgcgtagcctggttgaacaggatttgcagcgcaccaatgaagtcattttggaacagctcaactcccctgttgagttgatcacccaggtgggggatcatcttcttaacagcggcggtaagcggttgcgccccattttgaccttggtaacagccaagctgtttgggtatcaaaaagccgatgtccatgcgctgctggcggctgtggtggagtttattcacaccgcaaccttgctgcatgatgatgtggtggataagtccaacacccgccggggacaggcaaccgccaactcggtatggggcaacaaggcgcccattttggttggcgactttctcttttcccgctcgtttcagatcatggttgaacatggcgatttacgggttttgcgcattgtttccgactgctgcgccattatctctgagggcgaggtgatgcagttggtggccagcaatgatctggccaccgatgaagagcgttatctggatgtgattcgccacaaaacggcctcgctgtttgcctcggcttcgcagttgggggcggtggtggcggatcaatccgacgagattgcccagcgcatgtatgattatggcatgatgttgggcaccgcttatcaggtggtggatgatctgctggactactcggccgagacggaaaaactgggcaaaaatgtaggggatgatttccaggagggtaagataaccctaccggtgatccacgctttccgctcaggcgatgcggaagagcaagctttttggcggcgctgtttggaggatgaagagcaggatgagagcagctttgatcatgcccgtgctttgattgccaagcatggttcgctggactacaccatgtcccaggcccgcgcgttgattgttaaagccaaagctgcattggctcccttgccggagagtgccgagcgccaagcactgatggatttggccgacctttcggtggatcgggaatat

SEQ ID NO: 33776 - DNA, 1170 bp, magnetite-containing magnetic coccus
aaaaaagcacgcaaagctgcccgtcaactggcttggttagactccggtagcaaaaacgcaaccctacacgccatggccgatgccctgatcgcctgtaaaaagatcctccaagtagaaaatgaaaaagacctggaagccggtgaaaaaaatggcctgaccgacgccatgctcgaccgcctgcgcctcaccgatcaagtcatcgccagcatggccgaaggcatccgccaagtggccgctctgcccgaccccatcggcgaaatcaaccatatgcgtcgcctggccaaccagctgcaagtgggtaaaatgcgcgtgcccctcggtgtgatcgggatcatctacgaatcccgccccaacgtcaccgccgatgccgccgcactctgcgtcaaatcaggcaatgccgttatcctgcgcggtggctctgaagcgtttcactccaaccgcgccatcgccgccgccctcgcccaaggtatggaaaagggacgtgtgcccagcgatgccgtgcaagtggtaagcaccaccgaccgagccgccgtcagtgccctgctaaaagccgatcaatatgtggatattatcattccacgtggtggtaaaggattgatccaacgggtcatggatgaagcaaccatccctgtcatcaaacacctggatggtatctgtcatacctatattgatgccgacgctgaccccgctaaagccattgacatcacctttaatggcaaaatgcagcgtaccggcgtgtgtaatgccaccgaaaccctgctcatccacgaaaaggtcgccaaaaccatactgcccgccctggctaaacggctcaaccaagccgactgcgtgcttagaggctgccccgaaaccatccgcttggtgggcgaagtggcccccgtcatccccgcgacagaggaggattgggataccgaatacctcgccgcaattctcgctatccgggtggtgaaaaatcttgaagaagccatggaccatatcgacgcccatagctcacgccataccgaagttattgtgacagaaaaccacgcaaccgccatgcgttttgtgcgcgaagtggacgcctccgccgtcatggtcaacgcctccagccgctttaatgacggctttcaattcggcttgggcgcagaaatgggcatctccaccgataaactgcatgtgcgcggccccgtc

SEQ ID NO: 33777 - DNA, 1557 bp, magnetite-containing magnetic coccus
ttggagttggctacccgcattgaagaaaacgccgatggggtggcactcacggttatggggggggctcggcaggcgtccaagcggttggcgatgccggtggggacgcgggtaacggtacgcaatctcttttttaatactccggcgcggttaaaattcctcaaggcagatcgtacggaagccaatcaaattatggagttgatgcaacgctttgccattgcctacccccatgttgggtttaagctgagcctcaatggtaaggaggtgcaacactatcgcgcggtggccgacgagagcgcctatgtggagcgtttgggggcggtgctgggggccgagtttattcccaactgtatggagattaacagcggcgatgcgcagatgcgggtgcgtggttgggtggggctgccgacccttaatcggggctcggcctcggcgatgcatctgtttgtgaatggccgttgggtgcgggataaggtggtgacggcggcggtgcgcgaggcctatcgggatctgatgcccagggagcgttttccgttgaccgcgctgtttgtgcaggtggacccagaagaggtggatgtcaatgtgcatcccgccaaggccgaggtacgttttcgccatgggcagagtgtctatggcctgcttagacgcaccttagccgaggtgctgcacggtatgggggcgcggtgttatcaagccagcgaagccccattgcagagtgccgaggagccaccggagtatggcgcggatttgggcaagcagcggctggcggagcctgtgcagttgccggcggcggtgagccaaccggagcgttggcggcccagctatccgcctgcgggtgaaggggtgccccgtgccgcagcggtggccaactggtcccctcagcggcagggggccttgcctttgcagagccgggatagctacagccccgccccgggtcaaccccgcccgacagcacctcaccatgaggctgctatggatcatggccccttggggcaggcggtggcccagttgcacaatctgtacattgtggcgcagagtgagcagggcatggtgttaattgaccagcatgcagcccatgagcggattgtctatgagcgcatgaaaggggcctgggcccgtaaggagaaggtcgagacccagatgttgttgatgcccgaggtgctgcaactaagcgaggtggaggccgaacgtatgagccattggcgctcgactttgcagcagttggggattgctgtggagccctttgggcagaacgcctttgtcattcgtgaggtacccgccctattggcgcggggccagatcgcaccgttggtgcgggatgtggtggagcagttggagcaggtgggtcaggagagcgctttgagcgaagcccaggatgcggtattggccagcatggcctgtcatggttcggtgcgatcggggcgggcgcttacccgtgaagagatgaacgccctgttgcgggagatggagcgcaccccccacacggggcagtgtaaccatggtcggcctacccatgttcggttgagtttggcggatctggagcgcctgtttgagcgccgt

SEQ ID NO: 33778 - DNA, 741 bp, magnetite-containing magnetic coccus
tgctctcgaccctctatcctgcgtggcgggcttcccgcgtggacccggtggaggcgctgcgttatgaatgataccgcaacgcccctgctggaggctcataacctaacccggggttttcaaaccgaggggggcaccgtcgaggtgctcaagggggtggatctctctctggcacggggggatatggtggcactgctgggccagtcaggcgcgggcaagagcacgcttattcagattcttggcaccctggatcgtcccaccaccggcagcgtgcggatgacgggggtcgacctgtttaagctctcccgcagccaattggcccgttggcgcaatgaaaatatcgcctttgtctaccagcagcaccggctgttgcccgagttctcagcattggaaaatgtgatgctgcccttgctgatccgccgcatggggcaggctcccgccagcaaacaggcccagcaggtgttggagcgggtggggctggcccatcggcagagccatcgccctggtcaactctccggcggggaacagcagcgggtcgccattgcgcgggccttggtgggggggcctaagctgctgttggccgatgagcccaccggtaatctggatacccatacggcggatggtatttttgatctgctgctggcgctcaatgccgagcagcaacttacccagttgattgtgacccacaatcccgatttagccgcccgcatggggcgccgtgtgcgcatgcaggatggccagatt

SEQ ID NO: 33779 - DNA, 1449 bp, magnetite-containing magnetic coccus
gtacagtcctacctctacgcctatttgcaaggccatagcccacgttatttccaagaaaattttgcgggaaaactggggcaaaagattaaacaagccgggcagagtgccctgccgttgctcaatatcctgctgcatgatggggtgcggattattaccattctggccatgggtacggtgatgctctgggagatgtggcccgccatgagtttaaccctgttgggctggtcggtgggttttttaggggttgctctgttctatgcccgtcgctgtcaggccctctcctacgccttttctgatgaggtttccacctcggctggacgcttgatcgacaccatcaccaacattgagctggtgcgggcttttagtcgtcagctctttgaacggcgtcaactggccggttttttggcgcgggaacagcaggcgtcggaacgggtgcgctggttcttgattattatgaacagtgtgctctataccatcaccctgttttttcaagtgctgttgctggcgatggtggttcaccgggtggtcaaaggggagctgggggtgggggattttgtgctggtcttttccctgatcaccatcgttgttaataacgtgtggaacctttcccaacgcatgttggagttttatgagcagctgggcattcttgccgaggcgttggccatggtggggcagccccatgaaattcaagatgccccccaagcgcaaccgttgcaagtgacccaaggggaggtggtgtttgagcggctacatttcaaccatggcgatggacatggggtgttccacggtctggacctcaccattaaggcaggggaaaaggtggggttggtggggccatcgggtgcgggcaaaagtaccttggtcaagctgctgcgccgtcagtatgaccctcagcaggggcgtatctgcattgatggacaagatattgcccaagtgactttgtgctcccttaacgatgccatcgccgaggtgccccaactgcccggcatgttgcaccgcagcattggggacaacctactttatgcccgactggatgcccagccccaagagctggtggatgcggcggctcaggcccactgtatggcctttatcggacgccgcgcgggagggatggcaaccctagtgggggagctgggggtgcagctctctgggggtgaaaagcagcggattgccatcgcccgtgcctttcttaaaaatgctccgattcttattttggatgaagcaacctcctcgttagactctcaaaccgagcatcttatccagacatctttatggcagttaatggagggtcgaacggtgattgccattgcccatcggctctctaccctaactgcgttagatcgcattatctatctggagcaaggtgagattgtggagatgggtacccatagagagctgctggccaaacagggtgcctattggcgactgtgggagcggcaatctggaggt

SEQ ID NO: 33780 - DNA, 1908 bp, magnetite-containing magnetic coccus
gccaaggagattgcggatgcggcaaaccaggccaagagcgattttttagccaacatgtcccatgagattcgtacccctatgaatgccattatcggcatgagccatctggcgttacagaccgatctaaatgggcgccagcgtaactatattaccaaggttaagcgctcggccgaggcgttgttggggatcattaacgatattctggatttctctaagatcgaagccggtaaactcaccatggagttcattgattttcgactggaggatgtgttggataacctctccaatctggtggggttaaaggctgaagagaaagggttggagctgcactttagtttaccgccagggctgcatacggcgctcaagggtgatcccttgcggctggggcaggtgctcatcaacctaggcaacaatgcggttaagtttaccgcccatggggatgtggtggtaaaggtgcagcagctggagcgtaccacggagcgcattaaactctattttagcgtcaaggatagtggcatcggcatgaccccggagcagaaggggttgttgtttaaatcctttagccaagcggatgcctccaccacccgtaagtttggcggtactggcctgggattggccatctccaagcggttggtggagatgatggagggtgaaattgatgtggatagtgtgcctgagcagggcagcgattttcactttagtgcatggtttgggttgggcgaagtgcggggcgaagagacgctgcgggtagagcgggatttggcgaatctgcatctgttggtggtggatgacaacagcaccgcgcgggagattctcgcggagatggcgcaaagttttggttttcgggtagacacggcagagagtggcgcagcggctttggctaaagttgaagccgcggcggcgttaaacgatccggtacaggttgtgctaatggattggaaaatgcctgatatggatgggcttcagactgcccgcgccatgcagcataatgacgatttgcaagagctgcctatggtcattatggtgaccgcctatggccgggaagaggccgtgcaggctgcgacaggggtggaactcaagggctttctgaccaagcctgtttcaccctcgacactgttggatgcggtgatgggcgccttgggccgggaaggggtatcaggccgtcgtgcccatgagcggcaggttgaagagtcagaagccatcatcctgctgcgtggtgccaaggtgttgttggtggaggataacgagattaaccaagagctggctctggagttattggccaatgccggcattttggccaagctggcggaaaatggtgtcgaggctttgcaggcccttcagcgagagccctttgatggggtgttgatggatgtacaaatgcccattatggatggctacacggccacccgtgaaatccgcaaacaggcggcttttaaggatctaccggtgatcgccatgacagccaatgtgatggcggctgatctggagaaagccaaggccgcaggcatgcaagcccacgtgagtaaacccattgatgtacgcgagatgtttaccaccatggcccagtggattaaaccgtcaggattggtggtagagccggtgcttgcggtgacaacagcagagccggtggatgtgggtgagggggatgcgttccccacaagcctgccggggatccatttgcaggagggattagcccgttcagggggggatgtttccctatatcggcggttattgggtaaattccgcgagaatcaagccgcagcattggtgcgcatgcaggggcatttgcaacaaggtgagcgtgaggatgcggtgcgtcaaatacatacccttaaaggggtgagtggtacccttggtgcacgagacctatttgaggcggcaaaggcgctagaggccaacctgaaagcc

SEQ ID NO: 33781 - DNA, 1128 bp, magnetite-containing magnetic coccus
ctacagcaggcgatgcgacaggcgcagcaggccagtcaagccaagagtgagtttttagcggccatgtcccatgagatccgtaccccaatgaacacggttattggtatgaccgagctgctgctggagacccctttgagtgaagagcagcagcgttatgtgcggagtttgcgcagctcgggtacagcgttgttggacgtgattaacgccattttggatcttacccgtattgagtcgggccgtctggaactgaccgaagagcgttatgatctccatgaattaatgcgtgaaacctgtgaagttatgggctatgccgcggccaaaaagaagctggagatggtcttggagatgaatcccaatacccccaactatttggtgggggatgcgccgcgtttgcgtcagatcctgatcaatttggtgggaaatgccataaaatttaccgaagtgggacaggtttgtgtgcgtgtttggttagatgaagcggtagagcgcttacgcattgaggtcgaggatagtggaattggtattcccaaggagcacataaacaccatttttgatatgtttgcccaagcagattccagtatggcccgtcgttttggtggcagtgggctgggtttgaccatctctcagcgtttggctcagcttatgggggggcgtctcgcggtgcagagtcaggtacaaaagggcagttgctttaccttgtccatgccttgccaaattggtgaagaacctgcacaagaggtggtaacagaaacgcagagtttaacccgtcagactttacgcattttgctggcggaggactctgtggataaccaaaatttaattcaggcctatctctcccgtacatcccacgaactgatctatgccatcaatggagaagaggctgagcgctacgttaaatccgggcagccagtggacctgatcttgatggatatacagatgcccttggtggatggctataccgccacccgtcgcattcgagcatgggaacagcagcaggggcggcctgcggtaccgattgtggctttaaccgcccatgctttgaaagaggatgaaatgcgcagtttagaagcgggttgtgacgcacacttgaccaagcccatcggtaaaaagcagctattgcaggtattg

SEQ ID NO: 33782 - DNA, 1866 bp, magnetite-containing magnetic coccus
gagttggataaaacctatcagcgtttaaaaaaatcactctataccagcaaccgcatggccaaattagaggccaccattatgcacacggtgatggatggtttgatcaccatggacagcagcggcaaagttttgagtttcaaccacgcggcggaggggatttttggttatgcggcggcggaggtggtgggggagcagatcaccatgctcatgcccgaaccctaccgtagccaacatgatgattatgtgcagcgctatctgcaaggggcggcgccccgggtgatcggttcagcgggacggcatgtcaccgcgcagcgcaaagatggtgccctattacccatccgcttgtcggtcaatgagatggtattcgagggggagcggctgtttgtgggattggtggcagatgtcagtgagcggttgcaagaggagcgcgctttgattgaggccaaggagcaggccgaggcggccaatatggccaagtcgcgttttttggcggtgatgagtcatgaggtgcgcaccccgatgaatggtattttgggtatgcttggtttgctcaatgatcgccgcttggatggtcagcagcaggagtggcttgccaccgcgcaggagtctgccgaatccatgcttaccctgttaaacgatattttggattttagcaaaattgaggcggggcatctggaactggagcagagcgcttttagtccagaacagatcttaaagggggtgcatgatctgtttttaccccgtgctacggccaagggcatcacgctggaactggagcagggggctaaccttccggcgtgggtgcagggggatcctgggcgtctgcgccaggtgttgatgaatttggtgagtaatggcattaaatttacccaccaggggggggtcacgatgcgggtggcgcaacaggcgaagagagaggattctctactgttgcagtttgaggtgcaagatagtggtattggcattcctccgcaacagttgacccaactgtttcagccctttaatcagttagacccgtcttattcccgcaaatatgggggcagtggtttggggttggcgatctgtcgtcatttggtggatctgatggggggggagattcgcttggagagtccaccaagtgggggtagtcgttttacctttaccgcccgttttggctatgcgcatgcgccccaagatgaggtgttggacaattccgagcaggaggtacaactgcatggggtgcgggtactcctggccgaggacagccccaccaatcagatggtggcggtggcgatgttggcccgggtggggtgccacgtggatgtggcggtcaatggtttggaggtgctggaagcgttgacccgtgcgccttatgatctgattcttatggatttagccatgccagagatggatggctggcaggccattgcacgtatccgtggcatgaatgccccgctgcgggatattcccatcattgcgcttaccgccaatgcctatccagaggtacgcgcgcaatgtctggcggcgggggcgcaggactttattaccaagccgatccagcgcaacattttgctcaatggtatcttggcattggtgacgcaggctcagcagacaggccagcaaggggtgggggctaagcggtgtcattccaacgccccgatccgcgatgagaaggtgctggagcgtttggccgaagatacccactgttcgttgttaccccgtattctggaggtatttattgatgaggccgatgcccgtttgcaggcgatctctacggcgttggataatgaggcttggcagaccgtagcgctggaggtccaccccttaaagagcagtgcagccacctttggagcagcccgattggctgcctgtgccatgcagttggat

SEQ ID NO: 33783 - DNA, 3050 bp, magnetite-containing magnetic coccus
acccaaaaaacacccccaacgagtttgtatcagaatgagccttatagagcctaaaatattgattgtcgatgatcgacccgctaactctatggcgctaagggtatctctttccaaattggatgtgcagatcattgaggcccccagtggcaatgatgctttggggctaatggtcgagcacgactttgcactcatgctgttggatgtcaacatgccgggcatggatggttacgaggtcgctaaaattgcccgctcgtgggaacagaccaaagatattcccatcatttttatgaccgccatccaccatgatgatgcccaccgcgcaacgggttatcaacttggggctgcggactatattgacaaaccggttgataccaccatcctccttagcaaagtgaaggtttttgtcgacctttaccgttctcgtcaaaaactgctagaggccaaccgacagttgagggagtctatctcgttacgccggggtgtagaagagcagttacgcatgacacaatttgccattgatcgcctgggggatatggtttttctcatctcaccccaaggcaaaattgtgtatgttaatgaaaaagcctgccaaaaattgcaatatgaaaaagaacaactgcttcagttgagtattgagcagatcggctgtggccatattgagacctcttggaaagagcattggcttaaattaaaatcctaccagaccctgacctttcagtcccatttacgcaccaaaaatagcattcaatttcccgttgagattcaatccaactatgtaaaaacttcatctcatgagtataactatgcctttattcgggatattaccgacagggtccatcaagaagagcggctcaggttgctctctcgggctgttgagtatggccctgcaagtattgttattaccgatgccgaggggcacatccagtatgttaaccccaagtttgaaaaaataaccggctacggggcagaagaggtgattggcaataaacccagcttactaaaatccgggcagactgaaccggccatctatgatgccctttgggacagcattagtcggggccatgagtggagaggtgagcttatcaacaagcgcaaagatggttcgctttattgggaaatggctcacattagcccggttctctctaagaccagtggcaagattacccattttgtcggcattaaagaggacattacctcgttaaaagagacggaggcccacctggagttgacccagaaaaaggccgaggcggcttccctggcgaaaagcgaatttttggccaccatgagccatgaaatacggacccccatgaacgccattttaggcatgacggagttattgggcgagactcagttgagcattgaacagcggggctttttgtctgtctgtcgctctgccggtgaaaatctattacagattatcaacgatattctggatatttccaaagttgaatcgggtgggctggagctccaacatgtcccctttaatctgcgccgtattgtgtatgatgcgggcgaggtgattcgttttagatctcatgaaaaggggttgcaccagctgatttttattgatgaaagtgtgccggagtggttattgggtgatccggcccgtatacgtcagattttgatcaattttctaggcaacgccattaaatttaccgaagcgggcaccattgccacggtggtcagcaccaccgccggcaaaggcagtcaggtagagattgtttttcgggtcattgataccggtattggtatacctgaaagcaagcagagcgtggtgtttgatgcctttaagcagttggattcctccacccagcggcgctacgggggtaccggtctgggtttgaccatctccaaaaaactggccgatctgatggggggccaacttggcttaaaaagccaggaaggccacggcagcaccttcactttatcccttcggttaagccgctcaacagggccgagtaagagcagtgcccagcctgcgcccatatttgcggggatgcatattttaatatggcacacacatcctattaaacgcatgaatattgaagagaccttaatccgttatggtgcaaccctgcaccattgcagcgaggttgacccttttctacgttgtgcgcaggccaaccatgcagctacgcccattgatctgttatttattcactttgatcacgccgatgtcgatgtattgagtgagatcaagcgtcttagggcggtatccccctgggagaagattccggtattaatctatggacgctgccacgatcgctcattaccagctaagatgttgcaacagggggttaattttttgcctgaaccggtttttccagatgtcttactggatgaactttgccgcattacgcaaaagtcccagcaaccagaagtggacagcaaaccaagcagagcctcgctgcgtgtcttgttggttgatgacagcgaagataatttattgcttgcctcgacctttttaaagagcacgccccatattgtccaaaccgccaccaatggcaagcaggctgtggagcgctttacccaaacatcgccccgctttgatttgattttgatggatatacagatgcctgaaatggatggttttcaagccacagcggccattcgggcatgggaaaaagcgcataaaaagccgccctgcccgattattgccctaaccgcctttgccatgtcggatgacgagtcaaaatgtctttctgcgggatttacgggttatgtgagcaagcccatcagcaaagcccgtttactggaggccatggaggcctgtaccgctgcaaaagccccaacccaagctgaaggacaagtggattaaaacgcgctttggcccacggcaatccccaacacatgagggaatgagcaccgccatagccgggcttgtttttttgcactccgtcagatatggaacagataccaatgcttatccaattgagtacagtcataggcgggcatgccctccgtgatgtcatagagtttttgcgcacaatcagccattggctcttcagaatataaataacttaccgatccaccaacaaaataatagtcta

SEQ ID NO: 33784 - DNA, 1326 bp, magnetite-containing magnetic coccus
tggcaacccgactcctggcgcaaatttaacgctctgcaacagcctgagtggcccaatcaggacgaactccaacaggtgtgcaaaaacctgagcagctatccgccgctggtgttcgccggtgaggttcgctcactttctggccatctcaagcgggtggccaatggcaaagcgtttttactgcaagggggcgattgtgccgaatcctttggggagtttaatgccaacgccattcgcgacaagctcaaaatcctgctgcaaatggcggttattttgacctatggcggcgggcgtcccatcgtcaaggttgggcgcattgccggccagtttgccaaaccccgctccagcccaaccgaaacccaaggggatcaaaccctacccagtttccgtggggagatggtcaacgatcccgatttttccgaatcctcccgcaacccagagcccaaccgtctggaacgggtctattttcagtcggccagtactcttaacctgctacgcgcctttaccagtggtggttttgccgatctgcatagtctaaacaactggacccgcgattttgtaagcaacagcccccaaggcaagcgctacgccgaaatcgccgacaaactgacggacgcccttaaattcatggataccgtggggattaactccaccaacaccccggtgttgcatgaggtggagtattttaccagccacgaggcgctcattctcgattatgagcaggccctcacccgtgaggattccctgaccaatgagtactattgctgctcggcccacatgttgtggattggcgagcgcacccgccagttggatggtgcccatgtggagtttttgcgcggggtgaaaaatcccattggtgtcaaactgggtcccagcgccaccgccgaagatgccttgcgcctgtgcgatgcgctgaatcctcagaatatacccggacgcctcacctttattacccgctttgggcacaataaagtggaagagaatctgccaaaactgatccgcagcatcaaacaggccggtcgctccgtgatttggagttgtgaccccatgcatggcaatacctttaccgccagcagcggttacaaaacccgcaatgtggaccatgttatgtcggaaattcgctccttttttgcggtgcataaagccgaaggcacctgcccaggcggcgtacactttgagctcaccggtgacgcggtgacggagtgtgtgggcggctcgcaccaagtgaccgaggcccatctgcctgagcgttacgagaccacctgtgacccccgtctcaacgccacccagagcctggatattgcctttttgatcacagagacgctgcaa

SEQ ID NO: 33785 - DNA, 1098 bp, magnetite-containing magnetic coccus
ttgaaggagccaagcatgtcccgagtctataatttcagcgctggtcctgccgtattaccactgtcggttctggaacaggcccaagcggaaatgctggattatcagggtaccggcatgtcggtgatggagatgagtcaccgctcagccgcttatatggcgattatcgccgaggccgaagccttggtgcgtgagttgatgggggtgccgacaaactataaggtactgtttcagcaagggggggctacggggcaatttaccatggtgcccatgaacctgctgacagaccgttcgcaaaaagcggcctatgtgcataccggtagctggtccaaaaaggccatgagcgaggcgaaaaagcagtgtgacaatgtggtgatggtcgccagcagtgaagccagtaattttaactatattcccgatcaaggggattggcagccatttgctgacgccgcctatctgcacgtgaccaataataacaccatttttggtaccgaataccattggaccccagagagtggcgatgtacccttggtgggggatatgtcttccaacattctgtcgcggcctgtggatgtctctaaatatggcattatttacgcgggtgcgcagaaaaacctggggccatcgggggtgactctggtgattgtgcgggaggatctgttggggcgtcgcagcaacctgccggtgatgttggattataaggtgcaggctgagtctgaatccatgcacaatacgccgcccacctatgccatctatattttgggtctggtgctcaagtgggttaaagcccagggcggggtggctggtatggaagcgcagaatatcgccaaggctgcgctgctctataaggctattgatgagatggcgttctatagctgtcccactcaggttgagagccgttctcgcatgaatgtgccctttattctgtcggatgaccgcctgaatgagagctttttgagtgaggccaaaaaggccgatttggtgacactcaaggggcaccgttcggtgggtggaatgcgcgcatcgctctacaatgccatgcctcttgcgggggtcgaggcgctggtggcctttatgggcgattttgccaagcgtcatggt

SEQ ID NO: 33786 - DNA, 1071 bp, magnetite-containing magnetic coccus
ttgaaaaaacgtgcattaatcaccggtgttaccggacaggatggggcctatctcgccgaatttctgctgcaaaaggggtatgaggtgcatggcattaaacggcgcgcctccctctacaataccgagcgggtggatcacctttaccaagatccacaagtggcctcgcgggattttgtgctgcactatggggatctctccgactcaaccaatctcatccgtatcatccaaaccacccaacccgacgaaatttacaatctggccgcccagagccatgtggcggtctcgtttgagacccccgaatataccgccaatgtggatgccctgggcaccctgcgtatcctggaggctatccgtatcttggggttggagaaaaagagccgtttttaccaagcctcgacctcagagctgtttggtaaggtgcaggagatcccccaaaaggagaccacccccttctatccgcgctcgccctatgccgtggctaaactatatgcctattggatcaccgttaactatcgtgaagcctacggtatttttggttgtaacggcattttgtttaaccatgaatcccccaagcgtgggggcacctttgtgacccgtaaaattacccgtgccatgtgccgtattaagctgggtatgcaagattgcctctaccttggcaacatgaacgccaaacgggattggggccacgctaaagattatgtggagatgcagtggttgatgctgcaacaggatgagccggtggattatgtcattgccaccggggagcaatattcggtgcgggcctttgtcgaagcggtgggcaaagagttggagatgtccatacgctggcagggtgagggcattgacgaagtgggcattgacgaaaccagtggcaaaaccgtggtacgggttaatccccgttatttccgccccaccgaggttgaaaccctgttgggagaccccagcaaagcccgccgtgaattgggctggcagccccgcatcacctttcaagagttggtggaagagatggtggccgaggatcttaaattggcccagcgggaccaactggtgcagcagggtggttatgaggtc

SEQ ID NO: 33787 - DNA, 1398 bp, magnetite-containing magnetic coccus
cgtcgtgcaaagattgtagcaaccttgggacccgcctgttccagtgtggaacagattacccgtttgatcgaagccgggctggatgtggcccgtttgaatatgagccatggggatcataaagcccatttggagctgattcataatgtgcgggaggcctcgcggattgccaagcgcgaggtggcgctgctgtgtgatctgcaagggccaaaaattcgtgtgggccatctggatgaaccccttagattggaaaaggggcagcagtgggcgattattcccgagggcagtcatccccccaagctcaagtgtgatgggattatcccttgtacctatgcaggtttggcaaaggatgcggtgccgggctgccgcattctgtttgatgatggctatttgcaagcccgcgctattggtaccgaagagggggccttgctggtcaatattgaacatggggggctgcttaaatcccacaagggcatcaacatgcccgatgccagcatctcggccccgagtttgaccaccaaagatcagcaggatctcttttttggggttaaacatgatgtggattatgtggcactctcctttgtgcgcagtgctaagtgtgtgcaaaacgtcaagtttatgctgcatcggcgtaaaatttacaaacccattatcgccaaaattgagcggccagaggctatccgcaatattgatgagatcatcaaggtggtggatggcattatgatcgcccgtggcgatatggcggtggagattggcaaccatcgggtgccctcggtgcagcgtcagatcattcaaaagtgccgggccaagggtaagccggtgattaccgcaacccaaatgctggagtcgatgattcaaaatccatcccccacccgggccgaggcttctgacgtggccaacgccatttgggatggtaccgatgcggttatgttatccgccgagacttcggtgggggtagacccgatcaatacggtgctcaccatggggcgcattgtggaggaggcggagcgcaatccccgtggcccccgcttggatgcggaatcccacagcattagcagcgcctccatgatggcggcggcgcgggtggcggagcaggtgtcggcccgctggattattgccctgacggtgaccggtagttcggccttatcattggcccgttttcgaccggaggtgccggtgttgggggcggcccgtacccagggtggggtgcggcgtatgaatctctattggggcattaccccccggctgttcaactactccattgaagagcgggaggatattgagcccgaggtgatccagtggatgcgtgaacagagcatgttgcaggtgggcgagaaaattgtggtggtcaaaggaggtgggctgctgagcaatcacagcacatccagctcgatccgtgta

SEQ ID NO: 33788 - DNA, 1191 bp, magnetite-containing magnetic coccus
gctgagcaggcccttagccaagctgtggagcaggcgcagcgggccgaccgcgccaaaggtatttttttagccaccatgagccatgaaatccgtacccctttgcacggtattatcggcaccagtcggcagcttaatcgtatgccgctggatcggcaggtggcccacaaagcgcaggtgatcgagcaggccagccaagcgctattgggcattttaaacgatgtgttggatttttccaaaattgataccgaacagcttgtactcgaagaggtggtgttcgatctgccgcgcatgctgcaagagctctatgccgttgtccactcccaggccgaagagaagggtttgcagctgcacctccagcttcaagagcctctaccgagagcctgccggggggatcaaacccgcctgcgtcagattcttaataatctgctgagcaacgccattaaatttacccaacagggtgaagtaacactacaggttgctctaaccggagaaaccgaccctgccccatgggtagcctttgccgtggcagatacgggcattggcattgacgaggcccacctagagcgattgtttgaaccctttaagcagatggatgagagtatcaaccggcgttttggcggtacagggttaggtttggccatcagtgccaaattggcagaggccatggggggtagcataagggccaaacgtcgtacagaagggggatctctgttcaccttaatgatacccctgcgacaagtgcccatcgagcagctacccaagcccgcccagtcgcacatggaagccgccgatgccatgcctgggttaaagattttattagccgaggatgatccaatcaatcaagaggttgccataggtattttgcaggaggatgggcaccaggtgcattgtgccaacaatggtcaacaagcctatgagatggcccagcagcaggcctatgatctgattttgatggatctacgcatgccgattatggacggcctacaggccaccactaaaatccgcgcggcgcataccggccttaaccatgcaacgccgatctttgccttaaccgccgatgtgttaaaagatagcttgcaagcctgtcgcacagcgggtatggacgaggtgttgaccaagcccatccatttacaacatttgcgctatatgttggagcgtgtgcagccccagcatttatccccgccccaagag

SEQ ID NO: 33789 - DNA, 942 bp, magnetite-containing magnetic coccus
atgaaaaccgcccttatttgtggcgtgactggccaagatggcgcatggttggccctgctgttattatccaagggctatcgggtggtggggacctcgcgggatgcccagattgcgaccctgaccaaattggatctgctgggggtgcgggagcgtattgagctgcgctccatgacacccacggattttcgcagtgtggtgcagacgttgattcaggtggaaccggatgagatctataacctctctgggcagagctcggtggggctctcttttcagcagcctgtggagaccctggagagtatctcccagggtaccctgaatttgctggaatcaatgcgtatgatcaataaatcaatccgcttttataatgcgggttccagtgaatgttttggcgataccggtgatctggccgccgatgagctcaccccctttcgcccgcgcagcccctatgcggtggctaaatccgcctcggtatggagtgtctctaattatcgggagggctacgccatgtatgcctgttccggcattttgtttaatcatgaatcttggttgcgaccggcccgctttgtgaccagcaaggtgattaaaaccgtcaaccgtattgcccaaggcagcggtgagcagctgcaactgggcaatatggatattagccgtgactggggttgggcccctgaatatgtcgaggcgatgtggcgaattttacagcaagagaagcccgaggattttattattgcaacgggttataccgcttctctacaagagtttgtggcgctggcctttgccgcccataatctggattggcgggaccacaccaggagtgatgccagcctgttacgggagaccgatatacggattagtcgggccaatccgcaaaaggcacgggagcggttaggttggcaagcaaccctaaccatgccggacgtggtggcgcgtatggtggaggcc

SEQ ID NO: 33790 - DNA, 1737 bp, magnetite-containing magnetic coccus
atccgccgtctgctgcgcttgatctggccgttccgttggtatgtcattaccgcactgctctgtatgggggtgatggcggctaccaatggggccatcgcctttatggtcaaaccgctggtggatgacgtctttatgcagaaagacgcctccctcgttacccttattcccattgtggttatgggtatttttatcgtgcgggcggtggtcttttttctgcaatcctatctgatgcagagcttgggctttaagattgtgcggctgttgcaggtgcggctctacaaaaagattctgcatttggatatggagcgttttaataccgaatccaccggtagttttatctctcgcatgatctttgatattgatcagctcaagcgggtggtctccaccgccttggccgatattacccgggagctgttgacggtcacttttctgtttggggtggtggtctatcgcgccgcagagctggcctgggtctcggtggttggggtgcctttagcggtctatctgatctacctgttcgggcgaaaaatgcgcaccatcagccgccgccaacaagagctgatggaggatgtcaccagccatctggaggagaccatcgccggggttaaggtggtcaaagcctactgtatggagggctatgaacatggggtgtttcggcgtattagccagcgggtattaaaaaacaacctgcgctcagcctttatcaacgccatctccaagccctccattgatctggtggcgggtattgccatctcgctggtggtgttgacctcggcccatgccattttggatggtaaaaccacccctggtacgctcttttcgttccttaccgcgctcatgatggcttacagtccattgaagcgtattacgatgctctataatgggttacaagcgggattggcggcggcgcaacgggtgtttgagcggctggatcaatatcctgccattcaaaatgtgccggaggccggtaagctgcaaccccttaccaaagcgctgcgttttgaaaatattggctttcgttatcagagcagcgaggggccggtgctgcgaggcatcaacctacacattggggtgggcgaaaaggttgcgctggttggtcaaagcgggtgtggtaaaagcaccctggccaatctggtgccgcgcttttatgagccgcagcagggggcgattctgtttgatggggtcgatattcgcagtgtgaccatgcgctctttacgccagcagattgccatggtgacccaggagaatgtgctgtttaacgataccatccgcaacaatgtggcctatggcaagctcagagccagcgatgaggagatctgggcagccctggaggcggccaatgccaagagctttgtggagcagttacccgaggggctggatgccatgatcggcaataagggggccaagctttcgggtgggcagcggcaacgcattgccattgcccgcgccctgctcaaatcggcctctgtgttgattttggacgaagcaaccagcgccttggatagcgagagtgaacagttggtgcaagaggcgctggatcgtctgatggaccgctacaccacgctggtgattgcccatcgtctatccaccattcgcaatgccgaccgcattgtggtgatgcatgaaggggcggtggcggagatgggcacccatgatagcttgctggcgcaggggggcctctatgccaaactctgtgagattcaatttgatacccaaacggcgaaagagtaagcggtg

SEQ ID NO: 33791 - DNA, 552 bp, magnetite-containing magnetic coccus
gcgctctgcttggacttggatggtacactggccgacagtctgccagttatgcgtgctatctatggggcttttttggcccactttggggtgcagggttgtgagacggagtttcaacgcctcaatggtccacccttgcgggaaatctgcgccatactgcaacagacctatggactgcccggatcggtagaagcgctgcaacagcgctatagcgacctgttaaaagaggctccacaacagattttagccgccgacggtgcggagcaggtgttgcagcgggccaaccaagcgggctggcaggtgtgggtggtgacttccagcagtcggtcgcacgctttggcgtggttgcaacaggtcggcctgagcggttggattgcgggggtggtggggggggatgatgtccagcatggcaaaccccatgcggaaccctatctgcgggcgttggccctgagcggggcggtgccccaacactgtttggcggtggaagatagtgtgcagggggcaacggcggccctggctgcgggggtgaaaaccttattgttggccaagcaaatc

SEQ ID NO: 33792 - DNA, 1167 bp, magnetite-containing magnetic coccus
agcgacaaagtgagttcgatcatgtccacctatggacgctatcctgtggcctttgaacggggtgaaggggtgcgcttgtgggacaccaatggacgggtctatctggattttttgtccggtatcggtgtaaataatctgggtcacagtcatccaactgtggtcaaggcggtgcaggagcaggtggcgaaattaacccacacctgtaacctttaccgtattcccaaccaagaggcgctggcggcgcgactggtggccacctgttttgccgatcaggtgttttttagcaacagcggtgccgatgccaacgaagcggccatcaagttggtgcgtaaatatatgaaggatcgcggccagccgggccgctatgagatcattaccgccaccaactcctttcatggccgcaccatggccaccctgacagcgacgggacaagagaaggtgcagtcgggttttgagcccttggtacctggtttccgctatgtgccctacaatgatatggaggccatggagaaggcggtcggtccctatacagctgccattatggtggagccgattcagggtgaatcgggggtgcgggtaccggacgctgactatttaaaccagctacgggcgctgtgcgaccgcaaggatattctgttggtgttggatgaggttcaatcgggcatggggcgcacaggcaaaatgtgggcttaccagtggagcgatattgagccggatattatgaccagtgccaaggcgttggcctctggggtgcccatgggggcctgtttggcccggcgtggggtagcggcggcgtttgcgccgggttcccacggttccacctttgggggcaatcctttgagtgcggcggcggcgttggctacactggacgtgatgttggccccggattttctgcccacggtgcaggcccggggtgactatttcatgaacgctctacgccaattggcacaagggcggcgcatggttaagcagatccgtggtcggggcttgatggtggccatggagcttaatgcaccgggtgaagaggtggcttccatcgcgctttcccgtggtctgttgatcaactgctgcatgggcacggtattacggtttttgccaccactggtggtctcggaacaagagattgaccagggtttggccattctgggggaagtactctccgaccta

SEQ ID NO: 33793 - DNA, 915 bp, magnetite-containing magnetic coccus
cgggatctcttatccttgtttgatctgcgggatgaggagtttaccgttctttttcaacgggcgaccacgctcaagcgtaagctagagcggcacgaacctgtgcactcgctggatggccgtaccttggccatgctgtttgaaaaatcctctacccgcacgcgggtctcgtttgaggcaggcatgtttcagttgggtggtaaggcgctctttttgtcatcgcgagacatccaattggggcgcggtgaaggggtgaaggatagtgcgcgggtgctgtcacgctatgtggatggcataatggtgcgcacttttgatcatgccaatgtggagatcatggcagagtatgccagcgtgccggtaatcaatgggttgaccgatacactgcacccttgtcaggttttggcggatatttttacttttgaggagaagcgtggttcgctcaagggtaagcgggtcgcttgggtgggggatggcaacaatatggccaacacctggatacaggcggcggtgcgttatggttttcatttaacgctggcctgcccgttgggctatgagcccgacggggatatactctctgcggcgcgcaaagagcttgccgagcgcgaggtggatgccagccttaccctggtacgggacccccggcagggggtggatcgggctcatctggtgaccaccgatgtttggacctctatggggcaggagggggagagcgatacccgcaaggcggtttttgcggcctatcaggtggatagtggtttgatggcggcggcggatgccgaggcgctctttatgcactgtctgcccgcccatcgtggagaagaggtgacggcagcggtgttggagggttctcagtcggtggtgtgggatgaagcggagaatcgtctgcatgtacagaaggcgattttggaatttttgatg

SEQ ID NO: 33794 - DNA, 1203 bp, magnetite-containing magnetic coccus
gataaggttgtgctggcttactcggggggtttggatacctccatcattttgaagtggcttcaggatgagtatcagtgtgaggtggtcgctttctgtgcagacctgggtcaggcggaggagttggagcctgcgcgtgccaaggcggaaaagtttggggttaaagagatctacattgatgacctcaaagaggagtttgtgcgggattttgtctttcccatgtaccgcgccaacacattgtatgagggggtttaccacctgggtacctccattgcgcggcccttgattgccaaacgtcagattgaaattgccaatgccacaggtgcccaagcggtctctcacggggcgacgggtaagggtaatgatcaggtccgttttgagctgggttattatgcgttgcgtcccgatattcgcgtcattgcaccttggcgggagtgggacttgaccagccgtgacaagctgtttgcgtatgccgaaaagcatggtattccggtccccaccgacaagcgtggtgaggtcccttactcgatggaccgcaacctgctgcacatctcctttgagggcaaggcgctggaggatccatgggttgagcccgatgaagagatgtttgtcttatcggtttcaccggaaaaggcccccgatcaggccacctatgtggagctgaccttccgccagggcgatttggtcgccattgatgaccaggagatgagccccgccacgctgctggccaagctcaaccagttgggtgggcgcaacggcattggtcgcttggatctggtagaaaaccgctatgtgggcatgaaatcacggggagtttacgagaccccgggtggcaccattttgggggtggcacaccgtgcgatggagtcgctgacgttggatcgtgaagtggcccatatgaaagatgagttgatgccgcgctatgccaagttgatttacaacggctactggttttcgcccgagcgggccatgttgcagacgatgattgatgcctcgcagacctttgttaacggcaaggtgcgggtcaagctctacaagggcaatgtggttgtggtggggcgccaatcggaaaactcactgtttgatccggcaatcgctacctttgaagatgataaaggtgcctataatcaagcggatgcagatgggtttatcaaacttaatgcgctgcgcatgcgcattgcggcgatgctgcgcaacggccccaag

SEQ ID NO: 33795 - DNA, 1383 bp, magnetite-containing magnetic coccus
atgggtaaattgtggggggggcgctttagcgaacccaccaacgcctttgtggaggcctttagtgcctccatcgactatgacgcccgtctttaccggcacgatattcgtggctccattgcccactgcgccatgctgggccgccaagggattattccccaggcggatgccgagcgcattattcaggggttgcagcaggtacgcggtgaaattgaccggggcgagatgcactacagcaacgccttggaagatatccatatgcatgtggagagccgccttaccgagatcattgggccggtggcgggtaaattgcacaccgcccgttcccgcaatgatcaggtggcgacggactttcgcctttatctacgggatgagttggatgccattgtgcaagccattcgcaccttgcaaggggggttggtgatgctggccgagcagcacgcccatgtgatcatgccgggatttacccacatgcagagcgcccagcccgtcacctttggccaccatatgatggcctattatgagatgctcaagcgggactatgggcggtttagcgatatgcgcccccggcttaaccgtatgccgttgggttctgcggcgctggcgggtaccacctttccgttggatcgggagagtgtggcgcgggagctggaatttgatggtctgtgtgaaaactctttggatgcggtttcggatcgggattttgccattgagatgatggccgcctgcgcaaccctgatgatgcacctatcccgtttttctgaagagctgattttgtggagtgcgccggcctaccgttttatacgtctgcccgatgccttttgcaccggttccagcattatgccgcagaaaaaaaaccccgatgtgccggagctggtgcggggcaaagtggggcgggtctatggggcgctaaccagtgtgttgacgctgatgaaagggctacccctggcctataaccgggatatgcaggaggataaagaggcggtttttgatgccgtggatacggtgcgcgcctgcctgcgggtgtttggggatatggtgccgggcatacagccccaggtggcaaccctgcgtggggcggcgggggcgggttttgccaccgcgaccgatctggcggattatctggtgcgtaagcagattccctttcgggaggcccatgaaattgtgggcaccattgtgcgcatggccgagcagcagggggtggatctggatgggttgactctggctgaccttcagtcggtggatggccggattgagtccgatgtaacggccattttatcggtggaatcctccgtcaatgcccgccaagccattggcggcactgccgttgcaacggtacgcaccgccattgccatggccaaacaggagcttgctctgtaatcctgc

SEQ ID NO: 33796 - DNA, 1242 bp, magnetite-containing magnetic coccus
atggactattttcactatcaagatgaccaacttttctgtgaagaggtggctttagagcagatcgcgcaagcggtgggaacccccttttattgctattcagagcgaaccttgttgcaccatttacaggtgtttcagcaggctttcgccagccaagatagcctgatctgttattcggttaaggctaacagcaatctggctgtgttggatgctttggccaaacagggtgcgggttttgatattgtctcggggggcgagttggagcgggtacggcgggttggctgtcctggcgagcgggtggttttttctggtgtgggcaaaagccgggcggagattcaggccgctttggcctatggcgtgcgcatgtttaatgtggagtcgatccccgaactacagcgcattcaagaggtggcgctggccatggatgtggcggccccggtgacgctgcgcattaatcccgatgtggaccccaaaacccacccctatatctccaccggcttgaaacgcaataagtttggtattccctttggggaggcggtggcggtctatcagcaggcggcgcagatgagccatgtgcaggtggtggggctggattgtcacatcggttcgcagctgacccagctctctccctttgtggatgccctcaagcgggtgatggtattgattcaggcgctcaagggccacggtattgagattaaaaatctggatcttggtggtggtttgggcatcccctatgaggatggcgataccccgcccagcccggcggagctggccgcagccctgctggagcagttggatggcatgccggtgacggtgatattagagcctgggcgtgccattgtggggaatgccggggtgttggtgacgcgggtggagtatgtgaaaaagggcgagcagcgccactttgtgattaccgatgccggtatgaacgatctgctgcggcctgccatctacaacgcctaccatggggtgattcccttgcagcgcaagtttgaccgtgaggagcaggtggtggatgtggtggggccaatctgtgagaccggtgatttttttgcgcgggatcgctatttgagtgaggtgtatcagggcgaactgctggcggtgcgctcggcgggggcctacggttttgtgatgagcagcaactacaacacccgcccacgggtggcggaagtgttggtgcgtggggatcgctacgcggtggtgcgcaagcgggagagcgtggcgcagctgttggagaatgagtcc

SEQ ID NO: 33797 - DNA, 798 bp, magnetite-containing magnetic coccus
tttattaaaatgcacggcctgggcaatgattttgtggtgttggatcacctggagagccctcgtgaattaagcccccaggaggcccgcttttgggccgaccggcggcgcggcgtggggtgtgatcaggtggtgcagctcctgcccggcgtcgaggggggagatgcccagatgcgcatctataacccggatggctcccgggcggagatgtgcggtaatgccatgcgctgtgtgggtctctatctgcatgagcagcgggggatggcggcggccttggcggtggagacgctggcggggatcatgcgcccacaggtgacgtcggccttggccattacggtggatatgggtcggccccaatgggcagggcgggcgattccgctggaccaggatggggagatgattgacgcaccgctggaggttggcgggcagagctaccgcatgacggcgctctccatgggcaacccccatggggtggtgcgggtcgcggatgccgaagggtttgagctggccaaggtggggcctttggtggagcaccatgcgctgtttcccaatcggattaattttgaggtggtgcaggtgctcagccggtcgcgtatccgcatgcgggtatgggagcggggggcgggtatcaccccggcgtgtggcactggggcctgtgcggcggcggtggcctgcatgcggcagggttgggtggagcgcgactgtacggtggtgctggatgggggtgagctacagattgtttggttggagagtgatcgggtaatgatgagcgggcccgcgacagaggtctttcggggtgag

SEQ ID NO: 33798 - DNA, 2550 bp, magnetite-containing magnetic coccus
gagattgaggccaagcagaaagagctggaggccaaacgtcaggctgaagaagaggcggcccgtcagaaggccgagcaagaggccgctcgccaaaagcaagaggccgaagccgcccgtcgaaaagccgagcaagaggccgctcgccaaaagcaagaggccgaagccgcccgtcgaaaagccgaagaagaggccgctcgtgctgcggctgctgcgcctgccgctcctgtggcagcgccggcagaggctgctccagcggtacctgttgcggttgcagagcccgtcgttgttgcgcagcctgccccagaggcgcctgccccagttgtggaagaagagatggtggaagccaagcccctcccagccgcagcgccagcggcacccagtgcaccggttaggcttttgcaccagcctgttgaggaggagcccaagcgcaagctctccaaggcccagcgtgaggagatggcgcgccgcaagaccgaagatttggtcagcaagcgtctgaaccagttggaagagctgcgggagcagaaacgtaaagaggatgcccgtaaagaggccgaggttgcgctggctaaaaaagagaagcccgttgtggcggccacagcggcggccgcagcagaggtggttgccggtcgtaccccgcgtgaagattcggccggagagcccttttcggctggccgtcgcaagaataaaaaatatcaggacaatgaggatcgtttgcagcagccacggggcaaaagccgtcgccgcaagccctttaagtccgagatgcaagcccccgcgcctgtatatcgtgaggtcaccattccggagaccattacggtgggcgaattggccaatcgtatggcggtcaaatcttccgaggtgatcaaactgctgtttgcacagggtatgttggtgaccattaaccagaccctggatcaagacacggcggttttggtggtggaagagatgggtcacaagcccaagtcggtatcggaatctgcggccattgaggcggagttggatgccggtgaggatgccgcagaggatatggagacacgtccgcctgtgattaccgtgatgggtcacgtggatcatggtaaaacatcgctgctggacgctattcgttccaccgatgttacctctcgcgagcatggtgggattacccagcatattggtgcttatcaggtgacgttggccagtggtgataaaatcaccttcctggatacccctggacactcggcctttacggccatgcgtgcccgtggtgcgcaggtgacggacattgtggtactggtggtggcggcggatgatggggtcatgccccagacggttgaggcgatcaaccacgccaaatcggccaaggtgcccattgtggtggcggtgaacaagattgataaacccggttccaatccagatcgggtgatgcagcagctttctgaccatggtttggtgccagaggcctggggtggtgataccatctttgtgcatgtgtcggccaagagtggcgagggtatcagcaccctagaagagatgttactgttgcaggcagagatgcttaatttgcagagcaaccccaccaaaaagcgggcgcgtggtaccattattgaggccaatttggatcgtggtcggggtgcggtggcgacctgtttggtgcagaacggtaccctgcgggtgggtgacatctgcgtggttggtaatgagtggtgccgtgtacgggctctgaacgatgaccggggcaatcaggtaagcgaggcatcaccctcgatgccggttgagatcattggtctgtcgggtgtgccccaagcgggtgatgatctggtggcggtcaatgatgagcgccgggctcgtgagattgcccagttccgtcagcagaaagataaagaggccattcaggccaagcaacagcctgcgacccgtctggaagatatgtttgagcatatcgaacagggcgaggtagaagagctgaatgtggtattgaaggcggatgtgcagggttctgtggaagcggtggccgaagcgctacgcaagatcaagcatgagcagattgaggtgcgggtgattcacaccggtgtgggtggtattaacgaatcggacgtgatgctggcggtagcctctggggcgattacggtgggctttaatgtgcgggccgatgccaaggcacgggatttggccaaacgtgagcagattgatctacgtttctacaacgtgatttatgatctggtggacgatatcagtctggcattggagggccgtttggcacctaccgtgcgggagaaggtattgggtcatgcccaggtgcgcgaggtcttccggattaccaagattggtaacgtatgtggctgtttggtcaccgatggtattattcagcgtaatggcaagttgcgtattttgcgccagaacgttgtggtttatgagggaccggtctccgccctgaagcgctttaaggatgatgttaaagaggtgcgtgaagggtttgagtgcggcatcagcatcgagaagtttaacgatgttaaggtggatgacgtgctggagtgctatgtggaagagcaggttaagcagaccctctct

SEQ ID NO: 33799 - DNA, 528 bp, magnetite-containing magnetic coccus
attgctaaacgatatgcaactgccctggctgagctggccagtgagcttaacattctggattctatccgggatgagctcgcccattttcaagcactcttggcggaaagccccgagatgcacgagatgatggtcagccccaccgtatccaaagagagtcagcataagctgatttccacttacctggagtatgccaagccaaacgatctgacggcgaattttcttcgcttgcttatcgataagcaccgcatggccctgctcaacgacgtggcaaccgccattgttcgggtggtggacgaacgtgcaggtcggatacaggtcaaggttgagacccccaaggcgctcacgccgtccctggtggccaagctagagaaatctctggctgatgtgacagggaaagaggtctccctggaaattagtgaaaaacccgagctgctgggcggcttggtcattcgtatgggcagcgtcatgttggatgactcactgcgcacccagttacaccgtctcaaagagatcatgaaaggatagggg

SEQ ID NO: 33800 - DNA, 1506 bp, magnetite-containing magnetic coccus
gcggaaatcagcggtatcctgaagaaacagatcgccgagtacggtaaagaggcggaagtctctgaagtcggcgaagttatcgcggtgggtgatggtatcgcccgtgcctacggtcttgacaatgtcatggccggtgaaatggtggagttcgaagatggtacccagggcatggccctgaaccttgaagaagataacgtgggtatcgttatctttggtgaaggtcttgccatcaaagaaggtaccaccgttaagcgtactggccgcattgtggatgtacctgtgggtaaagggctgctcggtcgtgtaaccgacggtctaggcaaccccatcgacgacaaaggtccccttgagaccaccgagcgtcgtttggcggaggtcaaagccccaggcattatcccccgtaaatcggtgcatgagcctctgcacaccggtattaaagcactggacggtttggtgcccatcggtcgtggtcagcgtgaattgatcattggtgaccgccaaaccggtaaaacagcggtggccatcgacaccattatcaaccaaaagcgtacccatgagaccgactctccggtttactgcatctacgtggccatcggtcaaaagcgttcgaccgtcgcccaggttgtgcagaccctggaagagaatggtgccatggcttacaccacggtggtagccgctaccgcatccgatccggcccccatgcagttcttgtcggcctacaccggttgcgccatgggtgagtactatcgtgataatggcatgcacgccctgatcgtctatgatgatctctccaagcaggccaccgcataccgtcagatgtctctgattctgcgccgtccgcctggtcgtgaagcctatcctggtgacgtgttctacattcactcccgcttgcttgagcgtgcggctaagatgaatgatgaacatggtggtggttctttgaccgcactgcccatcattgaaacccaagatggtgacgtgtcggcctacatccccaccaacgtgatctccatcaccgatggtcagatcttcttggaaaccgacctcttctactccggtattcgccctgcgatctccgtgggtctgtcggtctctcgggtgggtggttcggctcaggttaaagcgaccaaacaggttgccggtaccctgcgtctggacttggcgcagtaccgtgaaatggcggcctttgcccagtttggttctgacctagatgccaccacccagaaattgctacaccgtggtaagcgccttatggaactgctgaagcaggcccagtatgcgcccctctccatggaagagcaggtggtttctatctttgctggtacccgtggttttctggacgtggtggatgccgatgccgtggtgaaagctgagttagagttgctcaagcagatgcatgcaaagcatagcgatcttctggacaccattcgtaccagtggtaagctggatgcggacacagaaaccaaacttggtgtggcgattaccgccatcatcaaagagtttttggcc

SEQ ID NO: 33801 - DNA, 870 bp, magnetite-containing magnetic coccus
atggcgaacttaaaagccctgaaagtacggatcggttccgtcaaaaatacccggcagatcaccaaggctatgaaaatggttgcggccgctaagctgcgtaaagcaaccgaacaggccgagtcggcccgtccttacagcaaacgtatgagccgtatgatgcactcattggcccctgctgctgctggacgggacaacgctcctgagctgctggtggggcgtggtgatgttaaaaaagtaaacttggttgtctacaccgcagaccgcggtctgtgtggtagttttaatagcgtggtaatccgcgccacccgtgcccgtatcgcagagctagaaaagcaaggttttcaagtcatgcttaccttcattggtcgcaaggcttatgatgtgcttaaacgctctcacggtcatctggtgcgtaaggtctataccgagatgtcacgccatatgagctttgcttatgtggaaaaaaacatcgtaaaagagcttatcaaagatttccacgaaggccagtttgacgcctgttatctggtgtttaaccagtttaaatcagccatgagccaagagctgacctgggcacagagcattcctcaacccattgataccgagggtgcttctacccaaaccggatatcagtttgagccggttgaagaagagctgctcgaagagttgttgccccgtaacttggctgtgcaggtgtttcaagctttggccgaatccgaggcttctgagcatggttcccgtatgaccgcaatggataacgcggtgcgtaacgcgggggatatggtcaagaagctacagaccaaatacaaccgttcccgacaggcggccattaccaccgagttgatcgagatcatcagtggtgctgaatccctg

SEQ ID NO: 33802 - DNA, 1395 bp, magnetite-containing magnetic coccus
actggaaaagtggtacaggtagtcggaccggttgtggacgtccgcttcgagggcgaattgcccaacatcctcaatgcgttacacatggtgcgcaatggtgagcgtctggttttggaagtcgccacgcacatgggtgagggcaccgtgcgtgccatcgccatggacagcaccgacggtgtcgtccgcggcatggaagtaaccgacactggggacactatccgcgtgcctgtgggtcgtcaaaccctgggccgtattcttaacgtggtgggtgagcctcaagatgaaaaaggcccagtcgaaaccaccgagaccctgccgattcaccgtcctgctccggcctttgcccagcaagccaccagcgcagagatattggaaaccggcatcaaggtgatcgacttgctggccccctatgctaagggtggtaaagtgggtctgttcggcggtgcgggtgtgggtaagacggtgttgatcatggagctgatcaacaacgtagcccaggaacatggtggttattcggtgtttgccggtgtgggtgagcgtacccgcgaaggtaacgacctttaccacgagatggccgagtctggtgttattgatcccaatagctgggagaactctaaggccgctctgatctatggtcagatgaacgaaccccctggggcccgtgctcgggtggcgttgaccggtctgacggtggctgaatatttccgtgatttggggggccaggatgtgctcttcttcgtggataacatcttccgcttcacccaggctggtgctgaagtgtcggcgctgttgggtcgtatcccttctgcggtgggttatcagcctaccctaggtaccgacatgggtgctttgcaagagcgtatcaccaccaccaaaaccggttccatcacctctgtgcaagccgtctatgtgccggccgatgacttgaccgaccctgctccagccaccaccttctcccacttggatgccaccacggtgctaaaccgtgccatctctgagatgggtatctatcctgctgtggatcctctggactccacctcgcgggtgttggatcctaaggttgtgggtgaagagcattaccatacagcccgtgaagttcagcgcattctgcaaacctataaatccttgcaggatatcatcgccattctcggtatggatgagctttccgaagaagataagctggtggtgaaccgcgcgcgtaaaattcagcgtttcctctcccagcctttccatgtggctgaagtgtttaccggtaccaagggtgtctatgtacccgttaaaaagacggtacagggctttaaagagctgtgtgaaggcaagtatgacaatgtgccagaagcagccttctacatggtaagcgacattgatgctgctttggcaaaagctgagaagctg

SEQ ID NO: 33803 - DNA, 1830 bp, magnetite-containing magnetic coccus
atgtgcggtatcatcggtgttattggcgagcgtaatgcgaccccgattttaattgaggggttacgtcgcttagagtatcgcggctatgattcggctggtatagccgttgcttaccagggtaaattgctgttagcccgcgcagaaggtaagttggtcaacttggaaaatgagttggcgcacaccccccgcaccggatttttgggcattggccatacccgctgggccacccatggaccccccaccatccataatgcacacccccatcgtagtgagtcggttgcggtggtgcataatggaattatagaaaattatcaggagctgcgcgaagaactcatggcgcatggcgtaacctttgtctcagagaccgataccgaggtgatcccccatctcatcgagatggcgatgcgagccgacccccatgctcccgctgaggaggcggtacgaagggcgatctgtaaattacagggggcctttgcgctggggattttaattcaaggcaaagaggatatgctcatcgccgcccgtcggggcagccctctgatcattggcttaggggatggtgaaaactttattggctccgatgcaacccctttggtgccctacacccgccgcatgatctatttgcatgatgacgatatggcggtgctgaccaaagatgcggtgcgtttgatggacatggagggtgccgcagtaagccgccccattaaggtgacacaggtacgcgatgatgtgacggagaagtggccctatcggcactatatgcaaaaagagatctatgagcagcccaccgccattggtgaaacgctcaaagagttgattcaccctgcctaccgcaccatctccatccgtcaaaactcggctgggttggatcttgccaccattgaggatattaccatcgtcgcgtgcggcacctcatggcatgcagggttggtggcaaaatattggattgagcagttggcccatgtgccggtacaggtggatattgcttcggagtatcgctatcgggcctcccccatgcgcaaaaatgggttgatgattgtcatctcgcagagcggtgagacggcggataccctggcggctatgcgctatgccaagcagggcgggttgcaggtgttgggggtggtgaatgtgccggaatcctccattgaccgtgaggccgatgccaccctgcacacctatgcaggtccagagatcggcgtcgcctcgaccaaagcttttaccacccaactcacggcgctggcctgttttgccttggcgatggccaaagccaagggcgtgttggatgccaaacaggaacagggttatgtggatgagttgttgcaactccctgcaaaagttgagcaggtgctcatccatgatgcctcgttagaggccattgcgcgggagctgatgcatgccaatgggtttctgtttttggggcgtggtacctgctttcccatcgctttagaaggggcactaaagctcaaggagatctcctatatccatgctgaaggctatgccgctggggagatgaagcatggccccatcgctttgattgatgaagatctgccggtggtggtggtggccccacagaacagcttgttcgataaggtggtcagcaatgtggaggaggtcaaggcgcgtggagggcgggtattgatgattaccacccaaggccaagctgccggacgtattccagccgattacaccattcccgtggtgccgtgtggtgagtttgtggcgcccattttgtatgtcattcccttgcaaatgctggcctaccacatcgcggttctcaagggtacggatgtggatcaaccccgtaatctcgcaaaaagtgtgacggtggag

SEQ ID NO: 33804 - DNA, 1197 bp, magnetite-containing magnetic coccus
atgaatcctgaaatggcgcgtctcaacccctatccgtttgagaagctggcggttttgtttgagggaattacccccaatggggcgttatcccctctgaacatctccattggtgagcccaagcatcccacgccggcgtttgtaacccagcgtatgatggaggcgttgcaggatggggatatggccaaatatcccaccacccgaggggagcgagccctgcgtgaaagcatggcggcttggttgacccgccgttttgaactgcaagcgggcagtgtggatcccgaccggcatgtgctgtcggccaatggcacccgtgaggcgattttttcggtggcgttggcggtggtggatcgggccaaggggggggtggtattgacccccaaccccttctaccagatctatgagggggcctgttttatggcgggggtggagcctgtccatattgacgccacggaagagacccatttgcgccccccctttacccagttggatgccgagttgttggcgcgtacgcagatggtctatctctgctccccatccaaccccaccggggcggtgcatccgttggaggagttgcaggagctcattcggctggcggatacctacgattttgtgatctgtgccgatgagtgctactcggagatctggtatgatgccccgccgccgggattgttgcaggcgtgtgcggccatgggtcggcacgattttgcccgctgtttggtgtttcactccctctccaagcgttccaacatgccgggggcccgcaccggttttatcgccggggatgcccaactgttggaccactactttaagctgcgcacttacaccggttgtgccacaccgccgtttattcaaaaagcggccatcgccgcctgggatgatgagcagcatgtggaggagaatcggcgggcctaccgggccaagctggaggagtccatggcgattctctcaccggttttgcccgtgacccgccccgaggccagtttttatctatggctcaaggtacccggtggcggtgcgttgtttgcccgcactctctacgaaaaatataatgtggtggtgctgcccggcggctatttggggcgtcaaggggcccatggtaacccggcggatgggtatatccgtattgccctagtggcgacgttagagcaaaatcgggaggcgatgcatcgcattgcccagtgcgctcaagagatgata

SEQ ID NO: 33805 - DNA, 1254 bp, magnetite-containing magnetic coccus
tggcacccctttactcaggcgcaaaccgctccagatcccattcccatggcctcggctcgtggtgccaccctgaccagtgtggatggccgtacctttattgatttaaatgcctcttggtgggtaacgacccacggtcatgcccatcccgccattgccgccgccattgcccaacaggcacagacccttgagcaggtgatttttgctgggtttacccatgccccggcggtgaatttggcaacgcggctgagtgaaacattggggggtgatttagaccgcgtctttttttccgatgatggctctacggcggtggaggtggcgcttaaaatggcggcccaataccatattaaccagggtactccacggcatcgctttgtggcgtttcgtgggggctatcatggggatacggtgggggccatgtcgatggggcagggctcgggcttttttgacgcctttcaagccatgctgtttcatgtggatctgctggactatccggccacctggctgggtgatcccacccccgagctgcgggaggcgctggtattaagccagttggatgactacctcgccacccatggcccgcagtgtggggcgctgcttatggagcccttggtgcagggagctgcgggtatgcgtatggcccgtgcgggttttgtgcagcaggtgatggagcgctgccgggccgccggggtgttggtgattttggatgaagtgatgaccggctttggccgtaccggaacgctgtttgcctttcagcaatgtggggattacccggatattatttgtctctccaaaggcttgaccgcaggatttatgcccatgtcggtgacggtggtgcgagagcccatctatcaggcatttatgggggaggggtttgaacgggcgttggcccatggccactcctttaccgccaatccgctggggtgtgtggcggcgctggcctcgttggagctgtttgagcaagagggcagcttggcccggattggccagatcgccgcactacaccagcagcgcttagagcctttgcagaagcatgccaaggcggtgcggccccgggtctgtgggagcattggggccattgacctgcgggtggccgatggcggctatggggcagagattggccccaagttgaaggccttttttattgaaaagggattgttgatgcgccccttggggaataccgtctatctactgccaccctattgtgtgagcgatgcacaactgcaccagggctgggacgctattgaagaggccctg

SEQ ID NO: 33806 - DNA, 1158 bp, magnetite-containing magnetic coccus
taccgtgccttttgtcaaagcagagaggcggcgggtcaatggcgtcagctgcacgcggtgcagccgctgccccgtggccgggtgttgcgggatggggtggagctgatcaacttttcatccaacaactacatgggtttggcagatcaccccctgttgaagcagcgggccatggcgtggaccgagcagtgggggacaggggcccaggcttcgcggctggtgtgtggcgatctggagccctttgcacgcattgaagcccgcttggtggcaggtaaggggtgtgaggctgcattggtgctcaatgcgggctatcaggccaacagttcggtgattccggcgctgttggataaacgggtgttggggggggagccactggttttttccgaccggttaaaccatgcctccatgcatcacggtgtccaattggcgggggtgcggcagctacgctatcggcatggcgatctggaccatctggagaggttgttaaagaggcacgcaggggaaaaggtcgctaaatttatcctctccgaaacggtgttcagtatggatggagaccggattgatgtgggggggttgatcgcgctcaaacagcgttatggggcctttttatatctggatgaagcccatgccaccggggtattgggacccgatggctttggtttggcggcggcctatccggggcaggtggatttggtgatggggacctttagcaaggggttggggggatttggcgcgtatgtgacctgtagccacgcgctgcgggcctacctgatcaatcgggcaggggggtttatctacagcacggctctcccccctggggtgttgggggcgatggatgccgcgttggagttgctgccccagatgggcgaggtacgggcgcgggtgttggcgggtgcccagcgggtacgagctgctttgcgcgcagcgggtttggatacaggtaacagttcgacgccgattattccggtgatggtgggggatgagcagcgtactttggcgttgagtgaggggttgcgggcagagggtctgttggggatcgccatccgtccaccgaccgtgccggagggaaccagtcgcttaaggctctctttgagtgccgcccacagcgatgaggattggagcctgctggccgctgcggtgccccgctgtttgcgagagatc

SEQ ID NO: 33807 - DNA, 1368 bp, magnetite-containing magnetic coccus
attcttatcatcggcggcggtatctccggtctctccacagcctggtttctgcataaaaagggagaaaaagtcatattgctggagtcccgtgaccgcgtgggcggtaatatacgcaccagccgtaacccggaaggctacctgatcgaacacggacccaactccaccctgcaaaaacccggcgacgaagaagatgccttgggccgtatcatcacagatatggcgttggaatccgaacttcaagaagccaaccccctagccgcccgccgctttgttatgaaagggggtcaactgcatgtgctgccaacctccccaccaggatttataaaaacacccctgttttccctctctgccaaactacgcttatgcctggagccctttatcggtaagagcgaacaagaagagagtattgcccaatttgtcatccgacgtttgggtcaagagttcctcgattacgccattgaaccctttgtctctggcgtctacgcaggcgaccctaaacagctctctgtacgggccgctgtggctaaaatctatgcgctcgaagccaaatatggctccctgattaaaggggccatcgccctgggaaaaatccgtaaagccgccggcatgccccgtggacgcatgatctcttttgagacaggtatggaaactctgcccgccaccatcgcgaacaggttgccccaccagagcatccacaccaacgcccaagtaaccgccctctgccaacatggcgctgcgtggcaggttagctggcaacaaggggggcaacacgggggtgaaccccacagcatcatcgcctcccaagtggtgctggccactcccgcttcagtctccgcccaactgctgcgccccctaagccctcaagccgcagacctgctggagagcatccgctacgcccctgtggattcggtggccctgggctatgccaaacaagatataaaccattctctcgatggatttggttttttaataccacgaaaagagcaggttacaacccttggtggactcttttccaccaccctgttcccaggtcgagctccccaagataaagcgctgctcacctgctttatcgggggtatgaccaacccctccatcacccaatggtcagaggagaaggtggtgactcaggtggatcaggatatgatggccgccctaggcatccaacacggggccgaatatgtccacctaacccgctatactcatgccatcgcccaatatgaacagggccatttgcaacgggtaggggatattgatagggcattggcaggctacaaagggctgcatttgcgtgctaactggcgggatggggtgagcgtatccgactgtgtattaaacggcgagaagagcgcacagaagatcctagcgggg

SEQ ID NO: 33808 - DNA, 1041 bp, magnetite-containing magnetic coccus
cgctttatccaagcctgttttcgtcagcctgtagaccgcacgcctatttggttaatgcgtcaagcggggcgttatctgccggagtatcggaaaacacgggcacaggctggggattttatggcgttgtgcaaaaatacagagttggcaactgaggtgacgatgcagcccattcgccggtatgggttggatgcggcgattctgttttcggatattttggtcattcctgaagcgatgggtatggatgttcggtttgccacgggggagggtcctcttttggatccgccggtgcgtgtgcatggagatattgaaaagcttatacataccgatccagaggatagtttggattatgtgatgcgggcggtggcctcgattcgtaaggcgttgaacgaggagatccctttgattggtttttcgggttctccttggacgttggcgacctatatggtggagggggggtcgagtaagacctttggtttggttaagggcatgctctatgacgcgccagagtcgatgcatctgctgctggacaagttagcagatatggtggcggcctatttaaatgcgcagattagacatggcgcacaggcggtgcagatttttgatacctggggtggggtattgagtcagccgacttttagggaattttcgttgcgcagcatgaaggcggtggtggatcgtttggatcggaccaatagcgcgggtgagcggataccggtgattctgtttgccaagggttgcaacgccatggtggaagatattgcgcagagtggttgtgatgtagtgggtctggattggacctcggagattggtccattaagggaacggattggtcataaggttgccttacagggcaatatggaccctgcgctgttgtatgcatcgccagagcgtatcgctcaaggtgcgcgggaggttttgcaggcgtttgggccgcatccgggacatatctttaatttggggcatggcatggcaccggatatgagcccggatcatgttgaagcgttggtaagggcggtaaaggaagagggcttgaaaattcat

SEQ ID NO: 33809 - DNA, 838 bp, magnetite-containing magnetic coccus
aatattaatggtgaaacaggcctacttgcggtcattgggggaccctgtaagtcactccctttcacccaagatgcacaatctggccctgcgtcattgtcaactcaattattgttatgtggcgctaccggtcaaaccacacaatttagtgcgagcggtgcagggttttgcggctatgggcatgcgcggttttaatgccaccattccccacaaagagaacctgctcccgctgatgcacacccttagtgaagaggccagccatattggtgccgttaacaccgtggtgattgatgacgatggcaaaatgaccggtcataataccgatgcctatgggtttattaccggacttaaagaggcttggcgtagtgacctgtcggggttaaccgccattatgttgggttctggtggcgcggcacgggccattttatatggacttattcaagccaaagccgcacgggttatcatcgccaaccgtaccattgagcgtgcgcaggctctgattgaggccatgcaaccctatgcacccaacacacagcttatggttgcaccgacccaagccgatcaactgccgctggagtcgtgtgacctgcttattaacaccaccagtatggggttaaagggagagaccattccctatattgacttggcacgacttccacaccacgccttcgttagtgatattgtctatggtgcccatcctaccccactgctacgggccaccgcacaacatcaattaggcgggcaggatggtctgcccatgttgatccatcaaggggccaaagcctttgaattatggacagggcacagcatgcccgttgagctggttgagcatacactacgt

SEQ ID NO: 33810 - DNA, 2292 bp, magnetite-containing magnetic coccus
gagctgcatagtgccaaggatgaggcgcagcaagccaatcgtgccaagagtgattttttagccaatatgagtcatgagattcgtactcccatgaacgccattattggtatgtctcatttggcgttaaaaacggacctcaacgctaaacagcgcgattatgtgggtaaaattcatgactcggcgctactgttattgggtattattaatgatattcttgatttttctaaaatagaggcgggtaaactgagtatggagtcggtcgccttttacttggatgatgtgctgagcaatgttgccaatttggtctcaatgaaggttgaagagaaggggttggagatcagttttcaggtagaccgtggggttccgcttcatttggtgggggaccctttacggctcgggcagatattaatcaacttggtcaacaatgcggtaaagtttaccgagcaaggtaacattgtggtggccatcactgcggagctggattgcgagagtcatgtggttgtgcagtttcaggtaagggattcgggaattggcatgacgaagcagcagatagacaggctgtttcaggcgttttcacaagcagatagttcgaccacccggcgctatggtggtagtggtttgggtttaagtatttgcaagcggttggttggcatgatggatggggatatttgggttgaaagtcagcctgggagagggagccagtttacttttaccgcgcaattagtgtctcagcggcaggatcggcgtcggtttcgtttgcccagtatgcatttggtaggtttacgggttttggtggtggatgataaccctgtggtgcggcagattttggtggaatctttagccatattttccttttgtgtagaggcgttggctaccgttgaggaagtgattgaggcactgggtcaggccattgcgaggggcgagccatatggcttggtggtcttggcggggcggttcgggggtaagggtggggtagcgttagcgggtgagataaaccgctgttatccccagctcacgttgccgaagatggtgttggttggtgccagtgaacgggatgatgtggtggcgatggcgggtgcgcagttggtcgagctgtttgtgaccaagccgattacacagacgatattatttgagggtgtgttagaagtgctaggttatgtcgtacaagcccagcaacatgcggggggaagggatcggacgcgggaaaagcgggtgttgtctggctgtcaaatattgctggtggaagataatgagatcaatcagcaggtggcctgtgagttgttgcaaggggagggggttacggtggtggttgccaatagcggccagcaggcggtggatcgggtgttatctggggaacggtttgacgcggtgttgatggatattcagatgccgggtatggatggctatgaggcaacccaagtgatccgtaaacagccgcagtttagcgatctaccgattattgccatgactgccaacgccatggcgggtgatcgggaacgttgcttggctgcgggaatgaacgatcacattggaaaaccgatacaaccaaaactattatttgaaactttaggtcgttatgtgattaagggggatggggttgtagaggcagggaacaaggggattttgctgccgccgattgagttgacaccattggatggtagcgtgacgaccccgctgccaccgcccgtattgccggcagctgtggggcgtgctgccatgatttcgccgcgagcgggggcagtgccggaacggcttgatggtgtggatatggagaagggattggtgcatgttgggggtaatgaggcgctctatgtaaaaattttgaaggagatcggtgagcgctataaggatgtggtggtggagattcaggggttatttgccgcgcgtcattttgcgcaggcaattcagttggtgcacacctataaaggtcttacaggtaccattggggccatggcgcttagtcaaagtgcagcccagttagaagaggccttaaaagcaggcgcgtatgagcggttaccgcagttattgggagatttttcacagctggccgagcggctcaacgtggctctgctaccgatggttggggtggccaatgtgcaggcgttgcccagtggggctgagcaagcggggctggaggagggtttattggcgcttggtgcattaattagggatggagatgcagaagctttagaccgggttaagcagcttaggggcatggcggcggggcaagtgtatcaacccttgatggcgcagttggaaagtgagctggatgagtatgagtttgagcgagcc

SEQ ID NO: 33811 - DNA, 1155 bp, magnetite-containing magnetic coccus
ctgaaacaggctcaggaggcgagccgtcaagccatggaacaagccgaacgggccaaccgagccaagagtgaatttttagccaccatgagccatgagattcgtacccctatgaacgtggtggtcgggatgagtgatattttgctggaaagtttgcccaatcctcaagcgcaaaaacatattcaacttattcaaaaggcgggcaccaccctgctggatctgatcaatgatattttggatctatcgaagattgaagcggggcaattggagttggaacatgcggtctttaatccaatattattgattgaggataccatcgcgattttccaaatgcaggccaaactaaaagggttaacccttaccagcagcatgactggtcacattccccacgctctgatgggggatcgcgctcgtttgcgtcaaattttggtcaatctcctgggtaacgccattaagtttaccgaaaaaggatcggttgaagtccaggcgggttatgcaaaccagcagttttggtatgcggtggttgatagtggtgtgggtattggctcggattctctattgagaatctttgataagtttacccaggccgatagcggtgtagcgcggcgctttggcggaagtggcttagggttggccatttgcaaaaatttgatggagcttatggggggtaccatcgaaacccagagtacgttgggtcaaggcagccgtttttactgtgctatcccagcccccatagccgatcaccttttacccagcgacgtcgtgaccaaagaacccatcacggcggctttgcctgcattgaccattctattggtcgacgattcagaagataaccgcatcctcgttcgcacctatttaaaacaaagccagcataagctcgatgaagccgtggatggtgctcaagcggtcaaaatggccatagaaaaacgctatcatctcatttttatggatattcaaatgccgattatggatggctatcgtgccacagcagagatccgcgcccacgagcaacagcagggtttgtctcccacgcccattttggctttgacggcccatgcgctgagtgcagacgttgaaaaaagcctcgctgccggctgtaacgaacacctgaccaaacccattcgtaaaaaggatctgctaagggtggttaatcatttc

SEQ ID NO: 33812 - DNA, 1872 bp, magnetite-containing magnetic coccus
caatcagcacctgctaccgcttggaccattgaagagagcatggagctctaccgcacccaagggtggggtttgggatatgtgcatgtggatgccgagggggatctaaccattaccccgggcagccaaccccatattgagtccatcagcctgccaaagttggtggatgatgtggaggcgatggggtttcaaggcccgatgttgatccgttttggcgggattttgcaagatcgaatcacccgtttgaaccgtgcttttacagaatcccgcagtcgattgaattatgccgggcactatcagggtgtttacccggtcaaagttaatcaagatcgccatgtggtctctgaggtggtggccagcggtaccccgatggggttggaggtgggctctaaaccagagctggtgctggcgatggcctatatggaccgtaccccgctgattatctgtaatggctataaagaccgagactatattgagctggcgctgcgggctacagggttgggttttcccatctttgtggtggtggatcggctggaagagttggctcccatcattgatctggcgaagagtttaaatgtctcacccaacctggggttgcgggcacgattgctcaccgagggggtgggcaaatggtcagagtcggcagggggcttttccaaatttgggttgaccgcgggtgagatcttgttggcggttaatcagttggagcgggaggggctgaaagagagtctaaaactgttgcacatgcaccagggttcacagatctcgctgctggatgtggtgcgccagagcgcccaagagattgtacgcttctatttggagctgcgcaaaatgggctgccccattgagtatgtggatgtgggcggtggtttgggtgtggattatgaggggttaagcagcagtgccccgtgtagcgtcaactactccttgggtcaatatgccgatgccctgttgggggtgtttgccgagcgctgccgcgaggctggtgcaccagagcccaatgtggtcacggagagtggacgagcattgaccgccccccatgcggtgctggtggtggaagttatgggctggagtgagccggttgggcgagatccggccccagagaccatccccgaacaggctcccgaggtgcagacgctgcacaccttggccatggagtttgataaagagcgcgccgacctgatctgggaacaggcgctgatgttgttcgagtcaattaagcaaggctttgtactgggccgtctggatttgaccgcgcgcagtattgccgagcgggtgatggtgcatttggggcggttggtgcatgaggcaaaagggcaggaccctaagcctgagtcccgtttgcaggggtatgtgtcggagcgctatttgaccaatttttccatgtttcaatcgctgccggatgcgtgggccattggtcagttgtttcccattatgccgttgcagcgtttgcatgaagagcccgccgctgaggctattttgcaggatttaacctgtgattcggatggccaagttaaacggtttattggggtgcaaggggagaatgccacactgccggtacatcaccctgggccaacggaacgctaccgcttgggcttttttctggtgggggcctaccaggagatattgggggattaccataacctgtttggggatacccatgtggtggaagtaggcttaaaagccgatggtagtatggcaaagccggtggtgcgccgggggcaacgcagcgtggacgtgctgaaagcggtctcgtatgaaccctcggaactgtatgatgctgtaggccgtttggcgcggggtgcttgcaaagatgaccgcgcggcccagtttattgaggcctatgcccgcttggtgaagggatgcccctatttg

SEQ ID NO: 33813 - DNA, 762 bp, magnetite-containing magnetic coccus
atgcgtattgccacctggaacgtaaactccatgaatgtgcgtcaggagcacgtggcccaatggctggccgaggatccctgtgatctgctctgcctgcaagagcttaaaatggtcagcgaaaaatttcccgctgaacggtttaagtcgctgggctggcacctgctcgccaatggccaaaaaacctataatggtgtggcggtgctgagtcgttttcccttagaagagcgtgatgtggtgctggatttgccgggtgttgatcccgcgcaaaaacggttgatggccgtcaccgtcaatggcgtgcgggtggttaactgttacgtgcctaatggctcagaagttggcagcgacaagtaccactataagctggattggctggctaagctccagtcgtttgtgcaggcgcagctggcgagctatccccaattggtggtgttgggggattataatattgccccagacgaccgggatgttcacgatgtgtcgttttgggcaggtaaaattttggtctctccccctgaacggtctgcctatcaggcactatgcgggttgggtttgaccgatgcctttcgccatctacagccggagggtggctattttagctggtgggactatcggctgggctcttttcagcgcaatatgggggtgcgtattgaccacctgctgagcagcccggcgttgacggccaagctcacccattgccacattgatcgtgagccccgtggctgggaacgtccctcggaccatgcgcctgttattgctacc

SEQ ID NO: 33814 - DNA, 1617 bp, magnetite-containing magnetic coccus
atttttgacataaccgaccgtaagcagatggagcataccctgcaccaaaaccgtacgcgcctacaagctgcggttgtagccagtcgggcaggcaccttttattacaccattgaaaacgaccaaaacagttgggatgcccgcatgctagagatctatgggcttgaggcttctcaatttgataataactatgccgcctgggtacgctgcatccacccagaggatcaacacagcacagagcaggctttcttccgtgccttaagcgcttcttaccacacccaaacctatgacattgaacaccgcatcgtgcgacccgatggatcgatccaccatctgcgcacccaggcttggatccagcgagacagccagggaaaagctgaacaggtaagtggtctggtctttgatattaccgaacaaaaagaggttgaaaccaccctgcgcttggcccgcgaacaggccgaatcggccaaccgtgccaaaagcgattttctagccgccatgagtcatgaaatccgcacccccatgaatgccgtcatcggcatgggtgaagttttgttagagaccaaattggatcaagagcagcgccactatatcgaaacgttgcagcatgctggcgaagcgttgttagacctgattaacgccatcctcgacctttcgaagatcgaatctgggcgtatggagttggtcgaacaagattttgatctgcacaagatggttgtcgaaacctgtcaacttttccaggttcaatgccgcaaacagggcattgaactcaatttaaactgggaggagagcaatcctacctatattcatggcgatcaagcccgcattcggcaaatattgtttaacttaattggcaatgcggtcaagttcaccgatgaaggctcggtcacggtagagatccgctccattgaacaagaaaaaactttactctttaaaattaccgatagcggcattggcattcccgcagataagcaagagaccatttttcaaaagttttcgcaggctgactccagcctttcccggcgccatggcggatcggggctagggctaaccatctgtcggcacttagtggagcatatgaagggtcgcatctgggttgacagcgaagagggccaaggcagttgtttctcctttaccctaccctgccgcccaacggcccccaaggccgaaataatttccaacccccatgatgcgcagcaaaaacaatcaaaaaaagcacggattttgttggttgaggactctaaggacaatcaaattttaatccgcacctacctcaagcgcgaaccccacagcttggtggtcgcctgggatggcgaagaggccttaacccgctttaatgaagatggcccttttgatttgattttcatggacatgcagatgcctattatggatggttatgccgccaccgcccatatccgcgccttggaacaagcgcgccaccttacggcaaccccgattgtcgccttaacggcccacgccctacagggcgatgagcagcgcagcttacaggctggttgcaacgcccacttaaccaagcccatccgcaaggcccacctgttggcagccatccgcgaccatgccaacccatcatgagtcactccagaaccccgctccaatcca

SEQ ID NO: 33815 - DNA, 1242 bp, magnetite-containing magnetic coccus
aaagcagccattgcccaagaaaagttaaacagagaaatactgatcgaaaaagaatctcagataatagcagcagaaattttaaacaaagaaaaaagtctgttcattgcaaatataagccatgagattcgtactcccttgaatgcgataattggactaggtgaacttcttcaagaagagataacagattttgaacataaacgacaattaaacatactgacaagcgctggagataatcttctattattaataaatgatattcttcacctatctaaaattgaatcaggcagcatgttaattgaagaaaatatattttcattacaaaatttgttaaacaatacagtgggaatgttcgagcagggagcttctaaaaagggcttatatctaaaagtcgaggtgaaaaacgccttgccatcatttgtgaaaggcgacattcacaggcttagacaggttttattcaatttgctaggcaatgcggttaagtttacttcctgtggtggagtgactttaacggtatcggcgcttgaaaatgatcggctaagcttttctgtaagtgatacaggtattggcataccatcatctttgcaagaaaagatctttcttccatttcaacaagcagactcttctatcactagaaaattcggcggcacaggtttaggactagctatcactcagagcttgatcgttcaaatgcaaggaaatctttctgttgaaagccatgaaggaaccggtagcacctttacttttgatttgccattaccggaaacagatcctccgcagaatcacttattaaatagttcctcagataattcaatagctagccctgcagtagatagacggcaatgggaacgacaaaaaatctgtgctgattcgacagcaaacaagccagctaaacgaattcttctcgtagatgattctgaggataatcgatcattgattcaagcatacttacgcagatatccccatgcactaacaacggcagaaaacggtaaagaagccctaacactggtcaaagaaaaacattttgatatcatttttatggatattcaaatgccggttatggatggactatctgccacaagggctattagagcctgggagttaactcaacaatcgaatagaaatgttccgataattgctctgacggcacatgttatgctcgaggatgaaaaaaaatctattgatgctggctgtaattttcatcttaccaaaccaatcaaaaaagcgcgcttaatcgacatcatt

SEQ ID NO: 33816 - DNA, 1140 bp, magnetite-containing magnetic coccus
gaggagactgaactggcgctacgtgtcgccaaagagcgtgctgaagcagccagtcaagccaagagcgaatttttggcgatgatgagccatgaaatccgtaccccgatgaatgccattttgggcataaccgagttgctacaagagcaaccttccaaaaaggaacagcttgaatttctcactgtgcaagccaaggctggacaagcactcttaaccttgatcaacgacattctggaactttcgcggttagaagcgggccgtgaacagctacaaacggctccctttgatctctacgaattgctgcgttctgtgagcacgctgttggagccgagcgccaagcataagggtttgtccgtgcatttggaaattgctgagggcctttcaccaaactggattggtgacgaacggcggctacgtcaagtattgattaacttggttgggaacggcattaagtttaccaatcgaggctcgatctggatctctgcccaaccgatggccaatggtcttgaaattagggtaaaagatagtggtgcgggcattaatccccgtcatcatgataaaatttttgaaagattccatcaggttgattctactgcgacacgtaaacatggtggtacgggcttagggctggcgatcaccaaaaagcttatggatcttatggggggagagatccgcatggaaagtcaacctgaccagggaagctgctttacgctggccttgccccttagtgaggcgccttgcgctctccctgcggcggaggaggccgccttgccaccccttgatgtgacagcaccgttgcgtgcccttaagatcctgctggtggaggactcagcagataatgccttactcattcgctccttccttaaaagcacaccctaccatttagagattgtagaggatgggcagcaagccctagatcggctgcaagattcgaattttgatctggttttaatggatatgcagatgcccgttatggatggttatacggctaccagccagatccgtctgcgtgaagcgttagatgagcttccgccgtccatcatcattgccctcaccgctcacgctttgaagggggaccgggaaaagtgtttgaaggcaggctgcgatgattttttaaccaagcccatacgtaaaaagcagttg

SEQ ID NO: 33817 - DNA, 3222 bp, magnetite-containing magnetic coccus
atgcccaaacgtaccgatctaaaaaaaatcatgctcattggctcgggacccatcgtcatcgggcaggcttgtgagttcgactattcaggtgcacaagcttgtaaagctctaaaagaagagggttatgaagtggtgttggtgaactccaaccccgccaccatcatgaccgatcccgagctggccgaccgtacctatgtggagccgatcaccttggcgtcggtgacgcgcattatcgccaaagagcgccccgatgcgattctccccaccatgggggggcagaccgccctgaacatggcccttaacttggccgatgcgggggtgctggagcagtacaatgtggagctcattggtgcctcgcgggatgccatcagcaaagcggaggatcgcgaacgtttcaaacaggccatggatgatattggcctagagatgcccaaatctggctttgcccactccatggaagaggcgtgggagatccagacagaggtcggttaccccaccattatccgccccagctttaccctgggggggaccggcggcggcatcgcttataactcggaagagttcgaggagattatccgccgtggtttggccgcctcgcccaccacagaggtgttggtggaagagtcggtgctgggctggaaagagtttgagatggaggtggtgcgggatcgtctggataacgccatcatcgtctgttccatcgaaaactttgaccccatgggggtgcataccggggactccattaccgtggctccggcccagaccttgaccgataaagagtatcagattctgcgggatgtctccatcgcggtgctgcgtgagatcggtgtggataccggcggttctaatgtgcagtttgccatccatccagaaaatgggcggctggtggtcattgagatgaacccacgggtctcccgctcgtcggcattggcttctaaggcaaccggttttcccatcgccaaagtagccgccaagctggccattggttataccctgccggagattatgaacgacattaccggcgtaaccccggcgtcgtttgagcccaccatcgactatgtggtgaccaagatcccccgctttacctttgaaaaattcccccaagccagcgccctgctgaccacccaaatgaagtcggtgggcgaggcgatggccatcgggcgtacctttaaggagtccttgcaaaaggcattgcgctccatggagatcggcctggatggctttggcgaaattttggatgtggcggatgagagctgggaagcggtgctggaagagcggctacataatcctggcccagatcgcatcctttatgtggccgaggcgtttcgccaaggtaaggatctggagtggttaaatcgcgtgactgccattgacccttggttcctggatcaaattcagcagattgtggaggcggaagcctctattcgtggggtgagctttgagaatatctccatcccccgcctgcgtgagcttaaagagatgggcttctccgatgcccgcttggctcgccttacccaaaccagtgacacagcggtacggaccagccgcttgacccatggtgtggtgccggtgtttaaacgggtggatacctgtggggccgagtttgcctcgcagaccgcctacctctacgccacctatgagcaagtatgtgaggctgcaccaagtagccgtaaaaaaatcatgatcttaggcggcggccctaaccgcattggtcagggtattgagtttgattattgctgtgtgcatgcggcctttgccctgcgggatgtggattatgagaccattatggtcaactgtaatcctgagaccgtctccaccgattatgacacctcggaccgtctctactttgagccgcttacctttgaagatgtgatgaccattgtggatatcgagaagcccgacggggtgatcgtgcaatttggtggtcaaacccccctcaagctggcgaaacggttggaggctgccggggtgcccattatcggcaccacgcccgaggccattgatgtggccgaggatcgggaacgttttcaggtcttgctgcaaaagttgggcttgcgtcagccccctaatggtattgcccgctctgagcaagaggcgattcgcgaggcggaggccattggtttcccggtggtggtacggccatcctatgtgttgggtgggcgagccatggaaattgtacacgatgtgaaggatctggagcgctatatgcgcacggcggtgcaggcttcgccggaccaccctgtgctgattgaccactttctcagggatgccattgagattgatgtggactgtattgctgacggcaaaacggcggtggtggcaggcattatggagcacattgaggaggctggtgtgcattccggcgactcggcgtgctcgttgccgccctattcggtggggctggatctgatcaatgagatcgagcggcaaaccaaaatgttggccgccgcgctggaagtcaaagggttgatgaatattcagtttgcgatccaaaagggggcggtctacattctggaggtcaaccctcgtgcgtcccgcacggtgccctttgtctccaaggcgacaggggtgccctttgccaagctggccgcgcgggtcatggcgggagaaagcttgcaagagttggggttaacccactcacccaagctggggcatgtggcggttaaagaggcggtcttcccttttgagaagtttatgaatgtggaccccgtgttggggccggagatgaaatccaccggcgaggtgatggggctggcggatacctttggggcggcttttgccaaggcccaagagggggctggggtctatttgcccatggcgggcaagtgtgccaaccagcgcatctttatctccgttaaggatgaggacaaacacgccattgtgatgccagccaaacgtctggtggagatgggctataaactaagcgccaccagcggcaccgcccgcttcctggaaggggagggggtgcctgtggagaccgtgaataaggtgactgaaggtcgcccccacattgtggatcaaatgaagagcaatgaggtggcgctggtctttaataccacacaggacaaacgggcgttggaagactccttccccattcgtcgtacggcgctgatgagtaaaatcccctattttacgacggttgcgggtatgcgggcggcggtttcggccatggaagcgatgcgggccggggactttagttgcaaggctttgcaagattactat

SEQ ID NO: 33818 - DNA, 1122 bp, magnetite-containing magnetic coccus
cgcgcggttttggttctagaagacggcacccgttttgatgggcgctcccttggtgcccaaactgaacaggtaggggaggtctgttttaacacctccatgaccgggtatcaggagattatgagcgatccctcctatgcgggacagatcgtcaccatgacctatacccaaattggtaatgtgggcatcaacccagaggatatggagtcccgacgcccctggattcgcggctttattgtcaaggaatccgcccgccgcttcagtagctggcgggctcaggagagtctgtcggtctttttaacccgccataatattcccgcgattgaaggcattgatacccgcgccttggtttcgcacctgcgggataaaggggccatgcgcggggtgctctctaccctggattttaataccgaaaacttgattgccaaagccaagagctttcccggattggcggggatggatcttaccggggaggtcagttgccaaacaccctacccttggcaacaggggctgtgggacttggaacagggctaccggcagatcgaaagcgggagcaaccgcaagcgggtaacggtgatggactttggggtcaagcacaacatcctgcgcggtttggtgcaggcgggttgtgaccttaccgtggtgcccaccgataccccagccgaaaaaatcctggcgggcaaccccgacggtattttcctctccaatggccccggcgaccctgatgctgtcaaacacggcgtgcgtaccatccgcgccttgttagagaccaaaatccccatctttggtatctgtctgggccaccaaatgctctgcttggccctgggtgcgcagaccttaaagatgaaatttggtcatcgtggtggtaaccatccggtgcaaaacctctccaccggtgtggtggaagtcaccagtcagaaccatggttttgtggtttcagatagcgcactgcccgacacgctggaggtaacccatcgctccctgtttgatggcagtgtggaaggggtgcgcatgaaggataagccggtcttctcggtgcagtatcaccccgaggccagccccggcccccacgatgcccactacctgttcaaacagttcgccgatctgatgcgctaatcgaagggt

SEQ ID NO: 33819 - DNA, 966 bp, magnetite-containing magnetic coccus
atgaataccatcgcggttatgaccagtggcggcgatgctccaggcatgaacagcgccattcgtgcggtggtgcgtaccgccatcggtgcagagatggaggtactgggcatccgccgcggctacagtggcctgctggaaggggatcttatccccatggatgccgcctcggtgggtaatattctacaaaagggtggtactgtgctgggcacctcccgctgcgcggagtttcttaaaccggagattcgccaagaagctgccaatattttacgccgtaaacatgtggatggcttggtcgtcatcggtggcaatggctcctttaatggcgcctaccaactgcaccaagagcatgacataccggtggttggcgtaccgggtaccattgataatgatatccaaggtacccactacaccatcggttttgacacggcggtggagaccggggtctatgcggtggataaaatccgcgacaccgccaatgcccacgaccgtatttttttggtggaggtcatggggcgacatagccccgccatcgccatccataccggtgtctgcaccggggctgaacatgtgattcacacccccgaaaataccgactatgacaccttggtctcagggatccggcggggccgtaagcggggcaaaaactcctttattatcatcgtcgctgaggggcaagttcctggttcagcctatcaggtgcaaaagcatctggcggacaattatcaaatcgcctcgcatgtggccattttgggccacctgcaacgcggcggatcgcccaccgcccatgatcgctttattgccgccagcatgggttttcacgctgtccaagccctcaaaaccggcgaagtggccacggttaccgcttgccgtgacggacgtattcagctggtccccttacaagagtgtttggaaaaaaatgatgccatcgacgctttctccttaaacctgacccagcagttggcaatc

SEQ ID NO: 33820 - DNA, 1389 bp, magnetite-containing magnetic coccus
aacaccaagggtgccccacatagcgggtcaatggccgtgttaacggctctgcaagcgcggctgggggcacacaaggtgctgcgggatggtgcccatttggagtcctacgcctgggacaatactggcctgtatgcccgccccgacggggtggtattggcgagcacgttgcacgatgtccagaccaccttggcgctctgtcatgcacatcgtgtggcggtaacaccgcgcacagccggtactggcaatgtggggggggctttggcggtggagggggggattgtgctctccttgcagcgtatgaaccgtattcttgagatcaacccggctgaccgtttggtggtggtggagcctggggtggttaatgccgatttacaagatcagttatcggcccatggcctgttctggccgcccaatccttcctcttcaaaaagttgtgctattggtggcaatctggccatgtgtgcggcgggtcccaatgcggtgcgctatggggtggtgcgtgattgggtgctggggttggagctggtcacggcggagggtaaggtgatgcgtaccggctcgcgctgctcgaagagcgtgacaggttacgatatgacccggctgttgttgggttcggagggcacgctgggcgtgattacacaggcgattctgaaacttaccccaaagcctgcggtccaacttacaatgcgcgttgtttatgcaagcgtgacggcagcggcccaagcggtgagtgccattatggctgcgggtgtgccgccgtcggcgctggagtttatggatagctcctgtttggggttgctgcgccaagcgggcatggccataccggcccagggtgccgctttgctgctgttggaggtggccgacgaggtgacgcgggttgagggtgaagtggcgcggttgcaggaaattttacaacgttacgcgccgttagagctggtggtggcgcggcaggctgctcaggctaaggcggtgtgggcggctcgctatgcgctctcacccttattgaaaaacttggcccctaagcgcgttaatgaagatgtggcggttccggtttcgcgtctaccggagctcattgaggggttacaacgcatcgccgagcgggtggatttgcccatcgttaattttggccatgcgggtaatggcaatattcatgttaatctgttggtggacccggaagattctgtggtgatggcccgtctgcccgatgcgttggatcgggtgtttgatctggtggttaagctggatggtaccctctctggtgagcacggtattggttatcaaaaaagggactatctgggttgggagttggatgcggagaatctggcgatgcagcggcgtttaaaagcgctgtttgaccctaatggaattctaaatcctggcaagctcttt

SEQ ID NO: 33821 - DNA, 903 bp, magnetite-containing magnetic coccus
atgatggcctgtgttgtccaagcgacggacctaaccaaacagtatcagaatacgccagttgtgcacggaatcaactttgagattcatgggggcgagtgttttggcattctcggccccaacggtgcgggtaaaagcaccaccatgcgcatggtgacagggctctccccggtggatggcggcgagctgttggtgtttgaccagcccatgacccccgaagccacccaggtacgccgccgtttaggggtggtggctcaagaggataatctggacgatgacctgttggtttgggaaaatattctggtttatggtcgttattttcagttgtccgatcgccagatcaagccgcgtattcagcagcttttggcctttgccaagttagaagatcgtgccaacgccccggtgcgcaccctctctggggggatgaaacgccgcttagtgattgcgcgggcgctggtcgccgaaccggagctgatggtgttggatgagcccaccactgggttggatccccaggcgcggcacctaatctggcagcgcttgcgtcaattacgggagcagggcattaccctgctgctgaccacccactatatggaggaggccgcgcaactgtgcgaccgtctgctgattttagacagtggtcacattttggatcagggcaccccgctggagctgattaaccgccatgtggagcccgaggtggtggaggtgcgttccagcatccccttgctgttggcggagttgcccaagttgcctgcccgtttggagcaggtgggggataccctcttttgttacacccatgaagcgcgggctgtgttagaaaagttgggcaaccgccatgatctaaccctgctggcccgcccggccaatctggaggatgtgtttttaaaactgacgggccgggagctg

SEQ ID NO: 33822 - DNA, 1278 bp, magnetite-containing magnetic coccus
tttaaggttgctgacattggtttggcggcatggggtcgtaaggagattgagattgcagagaccgagatgccaggattggtatcgttgcgcagcgagtatggtgcagagcagccgttgaagggtgcgcgggttgcgggttgtctgcacatgaccattcagacggcggtattgattgagacgttgacggcgctgggggcggaggttcgttggtcatcgtgcaacattttttcgacacaagatcatgcggcggcggccattgcggcggcaggggtgccggtttttgcctggaagggtgagaccgaggaggagtatgtctggtgtgtggagcagaccatcaagggaccagatggttgggttcccaacatgatcttggatgatgggggtgatttgacggagattttgcatcgccccgagtatgtggagatcatgaagggtgtgcgtggtatctctgaagagaccaccaccggggtgttgcgtctgtatgagatggcgcagaagggcaagttggagtgccccgcatttaatgtgaacgattcggtaaccaagtcgaagtttgataacttgtatggttgccgtgagtcgttgatggatgggattaagcgtgccacggatgtgatgatcgcgggcaagattggcgtggtgtgtgggtatggggatgtgggcaagggttgtgcccaggcgttccgtggtttgggtgcggtggtgtgggtgacggagattgaccccatttgtgccttgcaagcggcgatggagggttaccgggtggtgaccatggaagaggccgcttcccaggcggatatttttgtgacggccacgggcaaccgggatattatcacccgggcgcacatggagcagatgaaggatcaggcgattgtctgcaacattggccactttgattctgagattgacattgcgtcgattcgtgaattgaagtgggacaacattaagccccaggttgatcatgtaaccatgcccagtggtaaccgcattattgttttggcggagggtcgtttggtgaatttgggctgtgcgacggggcatcccagttttgtcatgtccaacagttttaccaatcaggtgatggcgcagattgagctgtttaaccggggtgagatgtatgagaaccgggtttatgtgctgcccaagcatctggatgagaaggtggcgcgtctgcatttggcgaaggtgggggccaagctgaccaccctgacccaggtgcaggcagactatttgggtatttcggtggatggtccttacaagtcggatcactaccgttac

SEQ ID NO: 33823 - DNA, 1137 bp, magnetite-containing magnetic coccus
ctattctcttctgaatcggtctctgaggggcatcccgacaaaatggcggatcagatttccgacgcgattttggatgctttgttggcccaagatcctttgtcacgggtcgcttgtgaaaccatggtcagcacaggtttttgcaccattgctggtgagattaccaccaaggcggtcattgattatcaaaaaattgcccgtgagaccatcaacgccattggctatacctcggcggataccatgggctattcgggggatacggcggcgatttttgtggcgctggacaaacagtcggtggacattgcccagggtgtaaacgagggtgagggtattgacctggaccaaggcgcgggcgaccaaggcattatgtttggttatgcctgtacagagaccgatgtcttaatgcccatgcccatctactatgcccaccgcttgatggaaaaacatgcggagttacgtaagagtggtgagctggcctgggcgcggcccgatgccaagtcgcaggtgacggtgcgttatgtggatgataagccggtatcggtggaggcggtggtgatctccagccagcatagcccggatgttgaccatgacaccattgagaaagagatcattgaaaaggtgatccgtgcggtgattccggctgagttgctgcatgaggggacccaatattttatcaaccccacgggtcgttttgtgattggtggtccggtcggggatgccggtgtgacgggtcgtaagatcattgtggacacctacggcggcatgggttcccatggtggcggggccttttcgggcaaggatccctctaaggtcgaccgttcgtcggcctatatgggccgttatgtggcgaaaaacattgtggcggcgggtttggcggagaagtgcgagattcaggtggcgtatgccattggggtatcgcagccgatgtcggtaatggtggacacctttggcaccggcaagctggatgatgaggcgattacggagttggtgaagaagcattttgatctgcggcccaaggcgattgtgcagcagttggatctattgcgtcccatctacaaaaagagtgcggcgtatggtcactttggtcgcgagttgccagagtttacctgggagcgcacggacaaggcagcggccctgcgg

SEQ ID NO: 33824 - DNA, 1595 bp, magnetite-containing magnetic coccus
tggatcgcacccaccacagtttgcagcaactgattgtggatctcacccacgctaaagagctggccgaatctgccaaccgtgccaaaaccgcctttttggccatgatcagccatgagatccgcacccccctgcatggcatacgcggcatgacccaactgttgttggggaccgaaaccaaccctcaacaacaaaaacatctgcatgctattgagcagaacaaccgcgccctacagcagattattgatgacctcttggatctggctagtctggatgctcaaaccttggagattaaagcacaaccctttgatctcttggcgttagttgaacaggttatgacggtcatcatgcagcaatccgacaccaaaaatctggcccttggctatcatctaccccaacccttgcatggcagctacctgggggatggtcctcgcattggtcaggttttgcttaaactgctgggcaacgcccttaagttcaccgcccgtggtagcatcaccctggatctggcgctcattagccgccatgagacacagcatctcatccgctttagtgtgcaagacacgggcataggcattgcccccgaactccaagaggcgctgtttgaacgctttgcccaggctgacgattcggcctcgcgccgctatgaaggggcgggcttggggctctccatcatcaaggccctggtggcacgcatggggggagcgattcacttaacaagccaaccctcccaaggctccctgttttggtttgaactgcccttgcaaccgctgccatccaacggcccagcacccttgccaaaccttacccacagccatctgctctactggcatggcaacagtatcgtgggtgagctgcaacgcaatctattaaccccctattttgcgcgggttacgctggttatggatgaggaacagaccctgcgcagcctgtggcgattacacgcacaaggcagacccgtggacctgctgctgttggaccaccccaacgcagttatggcccaggagctccggcgcaagttgcgtaaagagagcccctttgagcatctgcccatgctgctgttacacccccactccccatgggccacagcccctagtatggaggggttgcacaccctggagcggcccttgcggctacgccctgtattgcacaagctcgatcaactgttgcatggggtcgagagcaccccagaaccgcccgtggatgagccccaggcgctccccagcttacaaattttggtggcggaggataacctcgtcaatcagcagattgccgccggttacctcacccgtttggggcaccgctaccaatttgccaaggatggcattcaggcgctcaatttggtgcaaaaaggggggtttgatctgatcctcatggatgttcgtatgccagatatggatggtttggaggccacccgtcatatacgtgccttaccaaaaccctggtgcgacatccccattgttgccctgaccgccaatgtctttgaacaggatcgtcaaaattgtcgggaggccggtatggatggctttttacctaagcccttggatctgtcccaactggagcaagcactgcgcacccatttgcactcaacgccagga

SEQ ID NO: 33825 - DNA, 2142 bp, magnetite-containing magnetic coccus
caggtactgggcgtgatggtgctttatctcgcccacggccacgagcagaaggagcgggagaccgcctttctggcgcgagctgggcatattatcagcatgggattaatgcgccgccgtgccgccaaggagttaagctgcgccaagcaacgcgccgagcgggccaaccatgccaagtctgattttttggcgaccatgagccacgaaattcgcaatcctatgaatgccattatcgcccttagccaccttgccctggaacagagccacgaccagcgccagagggactatctgagcaaaatccacacagcgggccaatcgttgttacgtatcatcaatgacatcttggatttttccaaaattgaggcgggcaagctggagattgaacagaccgatttccaattggatgatgtgttgagcaaccttgccaccctgaccgcggttaaggcccaagagaaacagattgagcttattttcgacaaagccccggcgctaccccacgccttgcgtggggaccctttacgcctgagtcaaattttgctcaatgtggtgggcaacgccattaagtttaccgagcagggcgaggtggagatgagcattacccgccacacccaacggggggagctgctggagctctgctttaccgtgcgcgataccggtattgggatgaatgaagcgcagatagcggaactgtttcgcccttatcagcaggccgaatcttcgacctctcgccgttttgggggcagtggtttagggctctccatcagccaccagttggtcacgctcatgaacgggaccattcaggtgagctcaacacccggggttggcagccaatttgttattaccttgccctttgccgttttgccggatcggccagaaagtctcgtcatacccaagctgttgacggggcaggtggtggtggccagcgccaaccagcgcatgtgtgacgtggtggcagaaaaccttggccgctttggtctgacctgtgccagtgtcggtgccatgagcactctgcatcagtggttagagaataacccgctgccccgctttatggtgttggatgcggatatgctgccggtctccatggcacaagatctggagctgctgctcaaccccatgcttcaccgttttgtcgaggggggggtgctgatgttacatggctaccagactcagcaagcggttatggatctggccgctaaggatgcacgggtgggggcggtacagaagccggtcacctcttccagcctctatgatggtgcagtacagctcctgggggtaggctcccttagcgatgcccaacacgccccggtacaatccaatgcctcgcccaccacgtggccccaactgactggccgtcatatgctggtggcagaagataatgccatcaaccagcaaattatccaggagctcttgagtaaagtcggggtaaacgtgacgctggtcaacaacgggttcgaggcggtggaaaaggccaaccccctgcatcatgacgccattctcatggatctgcacatgccccttatggatggctttgaggccaccacgcaaatccgccaacggtttggcaacacactgcccatctttgccatgaccgccagctcaaccccagaggatcaaaaacaggtgcagcagagtggtatgaatggtcacctgaccaagcccattgatccagttcttttgtacaccaatctaagccaatggcttggcgagcaaccacctaagccgccatcggtttcatcccctcaacccgctcaaccacaaccggcggacagcctgcaaagcgtgccggggcaaccgggccagcgctctcctgctggtccccccaatataccgggcatcaattatacgctagggctgcaacaactgggtggggatgcagagctctatcaccaaatacttctcgcctttgagcaagatcagcgggagacctctgctaaactgattcagctactggaagcgggtgacttggccgccttggaacccttggtgcatacgctcaagggattgttgggcagtgttggggcggagcgcttacgcgccagggtcatcgccctggagacctcgctgaagatggctcaacccaaagagaatatcgctgcacttattcaaacgatgcaggcggagttggcccccatgctggcggccatt

SEQ ID NO: 33826 - DNA, 1044 bp, magnetite-containing magnetic coccus
gtgcgtcctgaaattttggctatggcgggctatacaccgggtgaacaacccaaacccggtgagcaggtcattaagctcaataccaatgaaaacccctatggcccccccgaagccgtcaagcaggccatgcatgccgccattcatgataacctgcgtcgctaccccagtcccgatggctatggggtgcgtgaagccgccgcgcgggtgttggggcatggactcacccccgagcagattattttgggcaatggttcggacgatctgttaaccatgctgctacgtacctttatcgacccaggtcaggtggttgccagcatggagcccacttacaccctctatgaggcgttagtgaccatacagggtggctgctatcggagtgtgccctggcaaccggatggggggctacccctagaggggctggtggccctgcaacccaagcttatttttgttacccggcccaatgcccccactggccatgtggtacccctggagcaggtagcggccctttgccaagcggttgcacagagcgcggtggtggtgctggatgaagcctatggggattttgccgaggatcatggtttgccgctgttggccgcccaccccaatttaatcatcacccgcagtgcctccaaatctctgtcattggcgggcatgcggattggcatcggttttatgcatgccgatgtggcgttgcagatgcacaaggtgcgcgactcctacaacgtggaccgggtggcccaggcggcgctgttggcggcctatgaaaactggtcggattatgccccgctgatagcgcgtatcaagcagcaacgccaatggaccaccacccagttacgcaagcgtgggtttgaagttaaggatagctacggcaactttgtcttggcccgcgttccccagggggggctggatggcttgcagtggctggagtccttaaaaaaacgcgggatcttaattcgctactttggcagcattccgcaactgtcagaatttttgcgcatcaccatcggcaccgaagaggagatggctctgttgatgaccgccatt

SEQ ID NO: 33827 - DNA, 360 bp, magnetite-containing magnetic coccus
atgtccattccgcaggaactatactataccaaagaccatgagtggctacgtaaagaaggggatgaggtggtgatcggcattacccgctttgccgccgatcaattgggcgatgtggtgtttgtggagctcccccaggtagaagataccctgcaaatggggggtaccttcggtgtggttgaatcggttaaagccgcatcggacctcttttcacccatcaccgggcaggtgatcgcaaccaatccagacctcgcagaagccccagagttggttaacgaagatccctatggtaaagggtggatgttacgcttgaaacccgaagatcctgcacaaatggatgcattgcttaccgcccaagcgtat

SEQ ID NO: 33828 - DNA, 2640 bp, magnetite-containing magnetic coccus
gtctatgtttttggtaacggccaagccgagggcgacgctggaatgagtcacttactgggcggaaagggcgccaacttggcagagatgacccgtttggggattcctgttcctgctgggttcaccctatgcaccgaggtttgcggactctatttacagaaacgtcgctatcccgaacttctcaaagaacaggtgaacgaggcgctgctcaaggtgcaaagtgccatgggggccggttttggcagtggggatgatccactgttggtttcggttcgctctggggcgcgggtctctatgccgggtatgatggataccgtgctcaacctagggcttaacgatcataccgtgcaaggattgattaagcgtaccggtgatgctcgctttgcttatgactcctaccggcggtttgtgcagatgtacgccgatgtggtgttgggggtggatcatcaccattttgaggccatgctcaacgccttaaaacagcagaccggtaaagtgcaggataccgatattacggcagatgagtggaaaagtctggttgcccaatataaaaacaaagtgctggaagtgacccaaaaaccctttccagaagagcctcaagaccaactatggggtgccattggcgctgtgtttgactcttggaccatcccccgcgccattacctatcggcgcttgaatgagattcctgaatcctggggaaccgctgttaccgtgcaggccatggtgtttggcaacatggggacagattgcgccaccggtgtggcttttacccgtgatcccagcaccggccataaccgctttttcggtgagtatctgattaatgcgcagggcgaggatgtggtggcaggcattcgcaccccgcaacagatcacgctggagggtaaacgcctcaatggctccacgctacccgccatggaagaggcaatgccggaactctataaagagttgtatgcggtgcaaaatcgcctggagatgcactatcgcgagatgcaggatattgagtttaccatccagcgcaacaaactttggctgctgcaaacccgtaccggaaaacggaccgccaaagccgcgctgaaaatcgccgtgaacatggtacacgaaggcttaatcaatacccgtgaagcggtctcgcgggtctcgccagaatccctcaaccaactgttgcacccgactctggatccaaaggccgacaagcggattatcgccaagggcttggccgcttctcctggggctgccaccgggcgtgtggtctttgaggccgacgaagccgagcagtgggccgccaccggtcaaatggtgatcttggtgcgcgatgataccagtccggaggatattcacggtatgcactccgccaaaggcatcatcaccgcgcggggaggcatgacctcccacgcggcggtggtggcgaggggtatggggcgtccgtgtgtctctggctgtgcggggctctctattaatatggaaaatgagcagtttagcgtgggtggtgtgacggtcgccaaaggggattgggtcacgattgatggttctaccggtgaggtgatgttggggcaggtgcccaccgtaccgccagaactttctggtgattttaccgcctttatggagtgggtggatggctttacccgcatgaaggtgcgtgccaatgccgacacccccgacgatgcccgcatggcgcgctcctttggtgctcaagggattggtctgtgtcgtacggagcatatgttttttggggcagaacgcatcatccatgtgcgggggttgattttggcacaaaccgaatctgaccgcatgcgcgccattgataaaattctgccgcttcagcgtagtgattttgctggactgtttcgcgagatgaagggttacccagtcatgatccgactgctggatccaccgttgcatgagttcattccccatgatgaagaggggcaaaatgaggtcgccttggtttttggcatgcccattgacaaggtgcgtgagcgggtggcgagtcttaaagagttcaaccccatgctgggccatcggggatgccgattgggcattagctttccagagatctatgagatgcaggtacgggccattatggaggccgcctgtcaattggttaaagaggaaggctttatcattacccctgagattatgattccgctggtgggcttagagagtgagctatcctatctacgggaacgtgtggtggctgtgtgtgaaacggtgatgggggagaacagtgtacgtattccttacatgattggtaccatgattgagctaccacgggcagctttgattgccgatcagttggctaagagtggtgaatttttctcttttggtaccaatgatctgacccagaccaccatgggtatctcacgggatgatgccggccccttcttgcaggagtatgtgcagaaaaacttgttacccaaagatccctttatcagcattgaccaagatggtgttgggcagctggtacggttggcggcagaaaaggggcgttccacccgcccagagattaagctaggtgtctgtggtgagcacggcggtgacccagagtcgatccacttcttcgaaaaggtaaaattggattatgtctcctgttcgccgtttcgggtacccattgcgcggttggctgcggcccaggctgtgttggca

SEQ ID NO: 33829 - DNA, 2100 bp, magnetite-containing magnetic coccus
tacctcattttaatcagtcctcatggccttatccgaggtgaaaatcttgagttaggacgtgacgccgataccggcgggcaaaccaaatatgtggtggaattggcccgcgctttggcccagcggccagaagtcgggcgggtagatctgctcacccgccgggtggtggatgcccaactgagcagcgattatgccgagcccgtggagaggctttcagataaagcccgcattgtgcgcatcgagtgcggcggcttggcttatctgcccaaggagcagttgtgggatagcttggataactatgccgataatgcgctggcctatatccatgaacagccccatatgccccatcttatccatacacactatgccgatgccggttatgtgggggcgcatctgtgcagcatgttagagattccactgatccacacggggcactctttggggcgcagcaagcgcaagcgactgttggccggtgggctggcccgtcaggagatcgaggccatctataacatcagccgccgtattgatgccgaagagcgtaccctggcggcggcctctagcgtggtggtgagtacccatcaggagattcaaggccagtatgttttatatgactattaccagcccgatcaaatgcaggtgataccgccgggcaccgatcttaataaattttatgcgccccagggtgacgaagcccaaagtgacatcgccaaacagttggcccgctttttaacccatcctgacaaacccattatcctcgccctctcccgaccggacccacgcaaaaacatcaccaccctggtggaggcgtatggccagtcaccccaactgcaagagatggcaaatctggtgattatcgcaggcaatcgcgacgatattcgggatatggacgccggtgcgcaagaggtgctcaccagcctgctcatgaccatggatctctacgatctctacggtaaaatggccatgcccaagcaccatcaggctgacgatgttccccagctctaccgcttggcggcgctttctaagggtgtatttgttaaccctgccttgatcgagccttttgggctaacgctaatcgaagcggcggcttgcggattgccccttgtggccaccgaggatggcgggccgattgatattgtttccaattgcaaaaatggcctgctcatagacccgttggatggggaggccattgcgcaggcattgatggatatactcagcgatcaagggcagtggcagcgttttgctcaagcggggcagcagggggtgcgtgcccattattcatggcaggcccatgtggaaaaatatctggccatgatccagcccttggttgagggtagtaggccgctccagcgtatgtgcttgagccgcagaccggcccactatcgagaggcggccattattacggatctggatcaaaacctgttgggagatgatacctcgctgagtgcatttgtggccttaatgcggcagtatcgtaagcaggtgagttttggcatcgccaccgggcgcaatctggagagcgccttgagtgtcatgcgcaaacacaaaataccccagcccgatgtaattatggccaatttaggaaccgaggtctattacgcccctgatctgctgctggatagtgcctggaaaaaacatatcaatcacctgtggttccgtcatgaaattgtggaaatactcagccaggtacccggtttgagtatgcagcctaagggtagccagtcaccctttaaaatcagctactatatggatcccaatgtggcccccgatcttcaggagatcaaccgtattttgcaccaacaggagcagacggtgaatgtcattttttcacgggggcagtttttggacattctgccgcaccgtgcttcaaaggggtatgcgctgcgttgggtttcggcgcagttggacatccccttggagaatatgttggtggccggtggttcaggggccgatgaagatatgatgcggggtaatacccaagcggtggtggtgggcaaccgtcatgatgaggagctctcgaccctggctgaggttgataaaatctattttgcgcagcagagttatgcggcgggtattatcgaggccattgaccactatgactttttt

SEQ ID NO: 33830 - DNA, 1815 bp, magnetite-containing magnetic coccus
aaggtgctgtatggcaaccggaatgattttaatgagcagatgaagcggttggtggagaccatggcgcggcagtatattgcgcgtccggcccagtatagggagtctgatctggagcgtgaaaaggaccacacttggtttttgcatcagcagtgggtgggtatggcgctctacagtgatggttttgccaacgatctacagggtttaaataccaagcttagctatttgcaagagctgggtattaacatgatccatattatgcccctgctggattgcccgccgaataagagtgatgggggttatgccatacgggattttcgtaagattgatagccgtgctggcacattggaggatataaccacgcttgcggattccatgcatacgcgggggatgttattgacgttagatgtggtgctcaaccacacctcggacgaacacgagtgggctaggcgggcccgtgagggggattctgactatcagaactatttttatgtatttaaagataggagcatgccggatctgtttgaagagtccatggtggagatttttccccagaccgcgccgggtaattttacctggagcgaagagatgggccggtgggtgatgacctcttttaacagttatcagtgggatttaaactacagcaacccatcggtactgattgaaattttggatattattctctactgggccaatctaggggcggatattatgcgcttggatgcggtggcctttttatggaaaaaaataggcagcacctgtcaaaaccaacgggaggcgcacctgatactgcaactgctcaaggattgctgtcaggtgacggcaccgggggtattgtttattgctgaggcgattgtctcccccttggagattaccaagtattttggtgaggatgccatcaacgccaaggagtgtgagattgcctataatgccactctcatggcgctattgtgggatgccatcgcgacgaaaaaggcggagcttttgtatcggggtattaagagtttgccggataagttggagcgggccacatggttgaactatatccgctgtcatgacgacattggtttgggttttgatgacacggatattcgtcaggcaggttatgagccgtttgctcaccgtcgttttttggtggattattttacggggggttacacggactctccagcgcggggcaggccgtttgggcagaatgataagacgggggatgcccgtatttcaggcacattagcctcgttagcgggtttggagagtgccctttacgaaggcaatgaggaggcggtgcatacctctatccaaatgattctgttgttgcacagtgtgattctttcctttggggggattccgctgctctattatggtgatgagttgggcaccttgaacgactatagctatgagcagcaagagagtaagcgggaagatagccggtggattcatcggccaaccattgattgggataaggcggagctgcgcaatcagccgggtagtgtggagtatcgtctttttaatgcgttaaaaaagatgattgcggtgcgcaaggagatcccggcgtttgcggattttaacaaccgtgagatgttagatttgggcaatccgcatctgttggcctatgcacggtttgattttatgcatgcttcggccaaggtattggtgatctgtaattttgatttaaagccgcagtatgtggagttggagcagcttaggcagttgggctttttaaagagccataatttgcgggacgcctcgacgggggagagtccgcaacggtttaacgatcaattggcaattccggcctatgggttttattggctgatg

SEQ ID NO: 33831 - DNA, 1509 bp, magnetite-containing magnetic coccus
aaacctatgacgctggtcatcctggatggctggggtctgcgcgatacccaagaaaataatgccattgccaatgcctccaccccccatatggatgactggttggccaaccgcccccatgctcaagtgcgtacctcgggcagggatgtgggcctgcccgacgggcagatgggcaactcggaggtgggacatcttaatttgggtgctgggcgggtggtctaccaggagtttacccgggtaagctgtgccattgaggatggctcctttatgcacaatcaggtattgctggatgccatccgcgccgctaatgaggcagggggggcggtgcatctgtatggtttgctttcacccggtggtgtccactcccaccaagatcaaatcttggcggcggtgcagtgtgccaaacaaaatggggccagtgagatctatatccatgcgctgttggatggtcgagataccccgcctcaatccgccatggaatatatgacccgttttgaagaggggttgcaaaagttgggtgccgggcgcgtggcgaccgtgtgcgggcgctactttaccatggaccgggataagcgctgggagcgggtggagcgaggttatcggctgatggcactgggtgaaggcaccccctttgacagcgcttgtgaggccattcaggccgcttacgatgcccagcagaccgacgagtttgtggagcctgcggtaatggtggagcaaggccagcccatcggcatgatcaacgatggtgatacgcttatctgtatgaactttcgcgccgaccgggtgcgggagatcagtcatgtgtttaccgataccacctttgaaccctttgtgcgggatggcttgcccaagttgtcggcctatgtctgcctgacccaatatgatgtgtcgctgcaaaacgtacagattgcctatcccccggtggcgttgaccaatattttggggcaggtgatggcccaacacgggttgacccaactgcgggcggcggagacggagaagtatgcccatgtcacctactttttcaacggcgggcaagagcagccgggggagggtgaggatcgtctgttggtggcatcgcccaaggtggcgacctatgatatgcaaccggcgatgtcggcggcagaactgacggatcgggtgattgaaaagatccaatcaaccccctatgacttggtggtggtcaactatgccaaccccgacatggtgggccatacgggggtctatgaggccgctgtgcaggctattgaaacggtggacacccagttgggtcgtctaaccgatgccattgtgcagatgggtggtgaggtgcttattaccgccgatcatggtaatgcggatcaaatggtggatgagcagggcacggcccataccgcccatacccttaatccggcaccgctgatctatttggggcgggatgctcaactgcacgatggccggttgagtgatgtggcaccaactttgttggcgctcatggggttgcctcagccgctggagatggatggtgtctccctg

SEQ ID NO: 33832 - DNA, 630 bp, magnetite-containing magnetic coccus
atggctcgactggaagttgaaaatattcactacgggtttggtcgtcataaagtcctaaaaggcattgacctaaccgcagaggatggtgagtgtctggtgctgtttggtgtcaatggcgcaggcaaatccaccttgttaaacattcttgcgctgcgctatcgacccaagcggggcagctatcgcctcaatggacaagaggtgtgggataaccccgactatagccgcagtcagatcgttaccatcgctcaccacagccatctttatggtcatcttacccccgtagaaaatctacaatttttttccgcgatgcgcgaccttgaacgcaccgatgaacagattaaacagtgtgtgcgggatgtgggtttaagccgttttttgcaccgtccggttaaagggttttcggcgggcatgcgcaagcgcgtggccctggcgcgggtactattggccaacccgcccttgctgctgctggatgaaccctattcagccctggatcaccagggtgtgcagtggctgaacaaaatccttaatgcttacattaaagagggcggtaccttgatcatcgtcacccacgatccagatcgggtggcggcactgccctatcgtgccttgcgggtgagtaaagggttgctg

SEQ ID NO: 33833 - DNA, 1286 bp, magnetite-containing magnetic coccus
cgtttgcggttggccttggaggagctgggacccacctttattaagtttggtcaaaccctttcgacccgtctggatattctacccgatgagattgggcaggagctcaagcgcttacaggatgatgtgcccccctttgatctggcgacggtacgccaaagcatcgaagaagatcttaaacgccccctgcatgagctgtttcgtagctttgatgaaaagccggtggcttcggcctccattgctcaggttcaccacgcttttacccacgatggggatgaggtggcggttaaggtgttacgcccggatgtagcggcgcgggtcgagacagatattgccatgctcatgaccatggccagcttggtggaggagttgatgcccgagtggcgtcgccttaaaccccggggcgtggttaaggagtttgcccaaaccatccgtaatgagatggattttttggtggaggcttcgcgggcgcaaaaattaggggagaattttaaggatgatgtggggatgatgatcccccaggtttattggcccttgacctccagccgggtctttaccatggcgtggattgagggtgtctccattgatgaattaccccgtgagcgggtggcggggcgtcctgacccccgggtggtggcggagcgcctgttaagctccttttttaagcaggtgtttcacgatggttattttcatgcggaccaacacccaggcaatattttggtgcgcgaggatggggtggttgccctgattgattttggcattgtctcccatgtctctgagcagacacgccaatttttggcggagatggtgcagggttttattacccgcgactataaaaaggtggcccaggtgcatctggatgccgggtatatcccccatgataccgatatggatgcctttgaggaggcgtgtcggcagattggcgaaccggtgtttggtcaaccgttgaaggatatttccgtggcgcggctgctggccaagctgttcaagaccacggagcagtataatatggaggtgcaacctcagctgttgctgctgcaaaagaccctctttaccctggaaggggtgggccgagagctgcatccggacctcaatgcgtgggagattgccgagccgttggtcatggcttggatgaaagcccgcattggcccaaagggtcagttattaaagttgcgccgccagttggaggagatgggctatgccatgggggcggctccagagatggcttttcaggttttggagcgggtcgccaacgaccgttttcacattcgcctccatgccagctctat

SEQ ID NO: 33834 - DNA, 1932 bp, magnetite-containing magnetic coccus
ctggaactccagtctgcctcccaagatatttgggaccgcaaataccgtctcaaatccaagggcggcgaccctgtggataagaccattgaagacaccttcaaacgggttgcccgtgcgctcgctttggttgagcaagaaccgctccaggagcagtggtatcagcgctttttgtgggcactgatgcagggtgccataccggcgggacgcattgtctccaatgccggtgcccgggaccataaacccgccaccagtaccatcaactgtaccgtttcgcaaaccgttaaagactccatggatgatatcctggcggcggtgcatgaggcgggtttgacccttaaggcaggctgcggcatcggctatgagttctccaccttgcgtccccgtggggcgtttgtggcgggggctggctccagcacctcggggccgctctcctttatggacatctatgacgccatgtgccgtaccgtctcatcggcgggggggcggcgtggtgcgcaaatggccacgtttgatattacccacccggatgtggtggattttatccgtgccaagcgtgaggatggccgtctgcgtcaatttaacctctcctgtttggtgactgagcagtttatggaggcggttaagtccgatatggattgggaactggtgttccctgccaaccactatgagttggatgacccaacggtggagattgtctaccgccactggcccgtaaccgaaggctataaaaccaatgagcagggcgaggtggcctgccgggtatggaagagcattcctgcccgtcggttgtgggatgtggtgatgtcctccacctacgattatgccgagccgggttttattttgattgataaggtcaatgagcagaacaacaattggttctgcgaagatatacgggccaccaatccctgtggtgagcagccgttgcccccctatggggcctgtctgctgggttcggtcaatctggcacgctttgttaaaaacccctttacggccaaggcggaatttgattgggcacgctttaaagaggtggtagctgtctttacccgtatgttggataatgtggtggaaatccatggtctacccctgccgggtcaggccgatgagattgcacataaacgtcgtcatggtatgggctttttaggtttaggctcaaccttgaccatgctcaatatggtgtatggggaccgtcaatccgtagagtttaccagccaagtggcccgcgaaatggcgctaaccggttgggaagtcggtctggagctggccaatgaaaagggtccagccccggtgatgaaccagatgtataccattaccgaagcgatgatggccaagcgtcctgagatggccaatgacggcatctgtgtcggggatcaactgcccggcaaggtgctcatggcccgctatagccgctatatggctaagtttcctgagcgcctgcgcaagcgtattgaaaccgaaggctcgcgttttagtcaccatagctccattgcgccaacggggaccatttcgctgtcgttgggtaacaatgtatccaatggtattgaacccagttttgcccataaatacagccgcaatattattcgcgaggggcgtaagaccaaagagaaggtggatgtcttctcttacgaactgctggcctatcgggcgttggttaatcctgatgccgatccctatgccgaagaagagaaaaacctactgcccgcaacctttttggacagcaatgccattaatccacgggctcatgtggatattcaggccgccgcgcaggagtgggtggactcttccatttccaagaccattaacgtgcccaccgattttccttacgatgagtttaaggacatctatctctatgcctatgaaaaggggctgaaggggtgtaccaccttccgctttaatcccgaggcatttcagggtgtgttggttaaagaggaggat

SEQ ID NO: 33835 - DNA, 2040 bp, magnetite-containing magnetic coccus
ctgcatcatctcaacgccccccagcggcaagccgttaccaccctggacggccccctcatggtcttggccggggcaggatcgggcaaaacacgggtattgacccgacgtctggcctggattatccaacagcaacaggcctcccctgaagaggtgctggcggtgacctttaccaataaggccgccaaagagatgcggaaccgggttcaggcgttactgggtttggatgcccccgcccaggcccaccgcttctggattggtaccttccacggcatgagcgcccgcatgctgcgccaatacgccgaccgccttggctttgagcgggactttaccattcttgacagcagcgaccaggagcgcctatttaaacggctctgtgaagagttgggctttgccgatgcctactggacccccaagcgcctaacccacaccattggacgctggaaagatgatggcattcgcccccaggatttaaccgatcgggagatccgtaaagcgtgggaacgggcgcgtattcaacagatgtacgaacgctaccagcaagcactgctgcaaagcaatgccatggattttggcgatctgctgctgcactgtctgcaattgtggcaacaggaaccggccatcttggcggcctttcagcagcgctttcgctatctgttggtggatgagtatcaagataccaaccatgttcaataccgctggatctgcgctctatcagggttgcaccaaaacctctgtgtggtgggggatgatgaccaatccatctacagttggcggggggcacgtattgaaaacattctcaagtttgaagaggatttccctcaaaccaagattattcgtttggaacaaaactatcgctccagtggcaatatccttaaagccgccagcggcctgatcaaccacaacaagggccgcatggaaaaacagctctggaccgaagatgcccaaggcgatgccattcacttctaccaagcggagaatgatgaggatgaggcacgctttgtggcctcggaaattctcaccctctgccccgctggggattatcaacaggcggctattctggtgcgaaccgctcgccagacccgctccctggaagagggtttgatgcgggcgggtattccttatcaggtggtgggggggctgcgctttttggatcgcgccgaggtgcgcgatgccttggcctatctgcgggtggtggcctctaaccgggatgatgtggcctttgagcgggttatcaatctccccaagcgtggcattggcccaggtgccctgcaatccctgcgggagattgccagccaggagcgctgctctttgctgcatgcggcccgctttgcggtcgagagcaacaccatgaagggggctgcggccaagggtttggcagcttttattcagctcattgagcacgctcgcagcatgctcgccgacgatataacccccgctgagatgctcaccaaactgttggccctaagtggctaccgggattatgtacgggatctggaaaagggcaacgaccgtatcgacaacctggacgaactgcgtaatgccctggcccgcactgagagtttgcaactatttttggaagaggttgcccttgccaccgacctccaggatggcggaccagttgccaatcgggtggtgatctccaccctgcatgccgccaaggggttggagtttccctgggtgtttctggtgggggtcgaagaggatgttatgccccataaactggccctcaccgaacagccggagatcggcttagaggaggagcggcgcttggcctacgttggcatgacccgcgccaaacagcggctttatctcaccatggcgcgtcgtcgatggctctttaataaaccggttatgccaattaagtcccgttttttaaaggagcttcctcaagaaattttagaggatcgtggttttcgtgtgagcagccgacgcggtgccacaggcagcttggcgggcctgcccggtggatcattgcaccaccagaaggtgcgctttccgttacgttaagccggtacgaatagcaggctctggggggcgggt

SEQ ID NO: 33836 - DNA, 798 bp, magnetite-containing magnetic coccus
cagcgatcggttttaattacaggttgttccagcggtatcggtgcctgtgtggcccatggcctgcgtgagcgtggctaccgggtgtttgccaccgctcgccaagaggccgatgtgcaacggctgatgagtgagggatttgagtcctatctcctggatctcaccgattctgacaccattgcgaacgccctagaggccgtgctttaccgcaccgaaggtaagctctatgcgctttttaataacggggcttatgcccagcccggcgcggtggaggatctcagtcgagcctgtttaaccgcatcctttgagaccaatctctttggttggcacgatctgaccgtgcgggtcttgcccattatgcgtgcgcaagggtatgggcgtatcattcaaaacagctcggtacttggttttaccgcgctgaaatatcgcggggcctacaatgcgaccaagtttgcgttagaggggttgagtgataccctgcgcttggagctgcatgggagtggcatttacctgagcttaattgaaccaggacccattcacagccgcattaatgccaatgcgttgcaggcgtttgaacgttggattgatccccaacacagcacccatcgtgaacactatgtccagcagcttccccgtttgctcgatcagcagcatgcagcctataagctaccacccgaggcggtgctcaagcgggtgattcatgcactggagagtgaccggccccgtcggcgttaccccgttaccatgccaacctatctgtttagcgtcctcaaacgggtggcccccaccgcctttttggat

SEQ ID NO: 33837 - DNA, 867 bp, magnetite-containing magnetic coccus
atgttcaaaggtgtctatactgcactgatcacaccatttaagaaccgtgctgtcgattatacggcattggctaagctggttgagcagcagattaatggtggaatacatggtctggtgccttgtggtaccaccggcgaatcggccacgctctcccatgaagagcataaagcggtcatccgtaccgttgtcgaactggtccagggccgggttaaagtgttggcgggcaccggttccaattgtaccgaggagtccactgagctcacctgttacgccgaagaggtgggggccgatggtgctctgcttattaccccctattataataagccgacccaagcgggtctgatcgcccattataccacggtcgctaaccacaccaagctgccggtggtactctacaatgtgcctggccgtaccgcagtggatatgcatgccgatacggtgattgccctctccaaggtcagcaacattgtggccatcaaggaagcgacaggtaacatggaacgcgcttcgcaaatccataagggtgcaggatcgagtatgaccttgatctctggggatgatgccacctttttaccctttctcagcgtaggcggtcagggggttatctcggtaactaccaacctagccccccgtcttgtgcgagatctatgggacctgtggcacaatgggcaaataaacgaagcccgtgaggttcatgagcagcttttggagatcaatggcttacttttttgtgaaaccagccccattccggttaaagcaggcgctgctatgttgggtctgtgtcacaatgaactgcgcctgcctatgacagccatgagtgaagccaatcaggccaaactgcatcgtgccatggtaaaactgaatctg

SEQ ID NO: 33838 - DNA, 837 bp, magnetite-containing magnetic coccus
gcacacgtgatcgatggtaaagcaattgcacaatccgtgcgggaagagctgcgcatggaggtcgaaagactcaaattaaaccatcagcttaccccaggtttggcggtggtgctggtgggtgcagatcctgcctcccaggtctatgtgcgtaataaaaagagggcgtgtgaaacggcgggtatcgcctctttttcccacgagttggccgctaccaccagccaagcagagctattggcgctgatcgagcaactcaaccaggatgacgctgtccacggtattcttgtgcaactgcccctacccaaacatattgatgagcaaaaagtgttggaggccatctcccccagcaaagatgccgatggctttcacccctataatgtaggccgcttggtgaccggcgatcccacttttcaaccctgcacgccctggggtgtcatggagatgttaaaggtgagcggggtggatcccaaaggcaaacatgcggtggtgattggccgctccaacattgttggtaaacccgtcgcccttatgctgctggctgcccacgccacggtgaccatctgccactcccgcacgccagatctggccgagacggttaagcgggcggatattgtggtggctgcggtgggtcgggccaacatggtgcctggtagctggatcaaaaagggggcggtggtgattgatgtgggcatcaaccgtggggaggatggcaaactgtgtggggatgtggattatgccagctgttttgaacacgcctcggccattaccccagtgcccggtggcgttggcccgatgaccatcgccatgctactaaaaaatacggtcgagggggccaaacgc

SEQ ID NO: 33839 - DNA, 1587 bp, magnetite-containing magnetic coccus
atcaaccgcaaaaaggttgagcgaaccaatatcatcctccaaagcgaggtcctcagacgccaagcgaccgaaacggcctaccgggaatgtgaatccaggcatgaggcaaagagggtttttatcgccaaaatgagtcatgaattccgcacgccgatgaacagcatgatcggcatgttagatatgctagagggcacaccattgtctgaagagcagtttgaatacatcgactcaatgcgccaagcaacggaccacctaaccagtatggttggtaatcttcttgatattacccagttggaagcaggaattatcaaaatcaaagaaaaaccctttagcctcatagccttggtcaagaatgtcatcaatattattcgaccattggcctttaagaaaaagattctttttattccctatatctcgcctgacattgcgccttggtttattggtgatgccaatcgtcttcagcaaatcctggtcaatctactgggcaatgccatcaaatatacccactggggcagtgtggcgctgctgatctctgcaaagcctgtaaactctcgttataacgttgaatttaaagtggttgatacaggagatggcatcgatttagagaatcaggagaagatttttcaggcttttgtccgtggtgcctacaataacgctgaaaccaccgaggggacgggacttggcttgtcgatttgtaaaaatctcgtcgatctgatgcaaggaaccatcgaactcaaaagcaccccccaacatggcagcacattttcggtctccattcccttgacccgctacaccgcccctgttcaaacgggtaaagagaaaaagctgcaaggggtgaacctatccatactcacagatcaccttgtccaaggcatgctctttgaagagcaattaacccgccacggtgcccattcgcatctatgctttaatggtcaatccatcgcggcgtgttttgctgaagaaaaggataccgacctgcttatcgtgcatcatgataacacaagtaaaaagaagctattacaagggtttgagaagtttaaacaggaggtcaccgactgcaaggcgaaaattctcatctgtggccgttgttaccaaagagatgacatggaagcacttgccgacaggggtgtctctatcttcccggattttcacgatgaagatgaattgattgataaaatccaatcggtgctgggtctgcacaaaaatagaaaaaagccagacccgctcgatgcgaaaaaacgggtgttgatcgtcgatgacagtgaagataaccgagtcctattgtcccactacctgcgtgattatgcgtgtgaaatcattcaagctgtagatggtcacgaggcgattgacacatacatcgcctccagacactcactggatctggttctaatggatctacagatgcccggtctggatggtctgagtgcgacccaaaagatacgggcttgggaaaaagcacatcgtgttgcaaaagtacctatcgttatcatatccgcacatgcgactgaatcccatagagacgcctcgcttaatgcagggagtgatgcgtttttgaacaaacccatccgcaaaaaaaccctcaaacgg

SEQ ID NO: 33840 - DNA, 876 bp, magnetite-containing magnetic coccus
caagtggaaaaggtcaaggttctcatagaagcgctaccttacatgcgtcgatttgagggtaagaccttcgtgatcaaatatggcggtaatgccatggtggatgaagatctcaagagcgcgtttgcccaggatgtcattttaatgcgtcaggtgggcatcaaccccatcattgtgcacggtggtggtccgcagattggtttgataatgaagcgcatgggtttggagcccaagtttattgacggcctgcgtgtgaccgatgaagacaccatgagtgtggttgaaatggtgttggcgggcaaggttaataaggatattgtcaatttgatcaatctgaatgggggccgtgcggcgggtttgtcgggtaaggatggttataccattcaggcgcgtaagcgcacccatgtgcgcaagggtccggatgtgcaggttccggagattattgatctgggttgggtgggggatgtggagcgaattgagaccaatcttttggatcggtttcgggcttcggacattatcccggtggtggctccggtgggggtgggtgccaatggtgagacgtacaacattaacgccgattcggtggcgggtcacatcgccatcgcgatgcaggcggagaagttgattttgcttactgatgttcctggggtgcaggataaaaacggcacgctgatcaatcagattgatgaaacggatgtggataagctgattcgcaatggcacggtgacggggggcatgattcccaagttagagacctgccgcacggcccatacggggggtgttaatgccagccatattattgatggccgcgtggaacacgccctgctgttggagatcttcaccgacagcggcatcggtaccgtgctgcgttaggtccag

SEQ ID NO: 33841 - DNA, 1893 bp, magnetite-containing magnetic coccus
cccaatgttgcggccaacgcgctgatcaacgaggaacagtaccaagaaatgtataaacgttccatcgacgacccggcggccttttgggctgaacaggccgaggcgcgcattgattggtttaaaaaatgggacaacgttctggattttgatctgcgtaaaggtcatatcaaatggtttgagggggccaaactcaacgtctcctacaactgtattgaccgccacctggaaaaacgcggggataaagtggccatcctctgggaaggggataatcccgctgccgaccgtaaaatcacctaccgtgaactctctgcgttggtcaataagtttgccaacgctttaaaagcacggggcgttaaaaaaggggatcgggtttgcatctacatgcccatgattcccgaagccgctgtggccatgctcgcttgtacccgcattggcgcggtgcactccatcgtctttgggggtttctctcccgatgcactgcgggaccgcattattgatgccgagtgtcgcgtggtgatcaccgccgatggcggcatgcgtggttctaaaaagatccccctgcgtaaaaatgtcgagaccgcgctggcccagtgccccaacgtacacacctgttttgtggtgcaagatacccaattagagattgagtggaccgaagggcgcgatgtttggtatcacgaagccattgcagccgccagtgccgactgcccccccgaggagatggatgccgaagatccgctgtttgtgctctacacctcgggctccaccggcaagcccaagggggttctgcacaccaccggtggttatctgctgtatgcctctatcacccaccaatatatcttcgattatcatgaggatgacatctactggtgtaccgcagacgtaggctgggtaacgggccacacctacattgtttatggacccttagccaatggggccaccaccttgatgttcgaaggggtgcccacctacccggacgcttcccgcttttggcaggtggtggataaacatcaggtgagcattttctacaccgctcccaccgccattcgctccatcatgagccagggggacgcactggttaaggccacctcgcgtcaatcgctgcgcatccttggcagcgtgggtgagcccatcaaccccgaggcgtgggagtggtactaccatgtagtgggtgaagggcgctgccccattgtggacacttggtggcagaccgaaaccgggggaattttgattaccccactgcctggggcaacccccttaaaacccggttcagcaacccgtcccttctttggggtcaaccccaaagtgctctccaacgagggcaaagagatggagggcccctgtgaaggcatcctggttttggatcatccctggccgggcatgatgcgtaccgtgtatggcgaccatgatcgttttatcaacacctattttgccaactatcccggctactatttctgtggggatggctgccgccgtgatgaagatggctactattggatcacggggcgggtggatgatgtgatcaacgtctccggccaccgtttgggtaccgctgaagtagagagcgccttggtgctgcacgatcaagttgccgaagcggcggtggtgggcatgccccatgagatcaagggtcagggcatctacgcctatgtgacccttatgagcggggttgagccctctgacgcactcaaaaccgagttggtcaagctggtccgcaaggagattggccccattgcctcattggatgtgatccagtttgcccccggcctgcccaagacccgttccggcaagatcatgcgccgcattctccgcaagattgctgcccatgaagtggacaccctaggggatacctcaaccctggccgatccatcggtggtgcaaaacctcatcgacaac

SEQ ID NO: 33842 - DNA, 1266 bp, magnetite-containing magnetic coccus
atgagtcgttccgcaagcctatttcaacaggcagcagggttgatacccggaggggtgaacagccctgtacgggcgtttaaatcggtgggaggcatccccccatttatccgtgaggccgccggtgccatgatgaccgacgaggatggcaagagctacattgattatgtgggttcttggggtcctatgattttggggcatgcgcccaaagaggtggtggcggccatccagcaggcggctgtgcgtgggtgctcttttggtgcgcccaccagcaatgagattttgttggcgcaaaagctgatcgaattggtgccatcccttgagatggtgcgtttggtcaactcggggaccgaggcgaccatgagtgccttacgtctggcccgtgctgcaacgggtcgggatgccattttaaagtttgatggatgttaccacggtcatgcggacagtttgctggttgcggcgggctcggggctagcaacctttggggtgccttcctccccaggtgtgacccgtggcacggctaaggataccctaacggttcccttcaacgatctggcggcggtggaggcatgttttgcgcagcaccctgaggggatcgcggcggtgattgtggagccggtggcgggtaacatgggctgtgtactgcccaggccgggctatcttaaagggttacgggacatctgcaccaaatatggtacgatcttgatttttgatgaggtgatgaccggtttccgggtggatctgcgctgtgcccagggtttttacgatgttacgccagatttgacctgtttgggcaaggtgattggtggtggtctgccggtgggtgcttatggtggtaagatggagttgatgaatcaggtttcgccagcaggtccggtctatcaagcgggcacgttatcgggcaatcctttggccacggcggcgggtttggccacgttggaggcgatctctcagcctggtttttatgagaccttaaccagccgcacccagcgtttgacggtgggcattggcaaggcgctggatgaggcgggcattccccatgtgagctaccatattggttcgatgtttggtctgttttttaccgatgcccgcgaggtttacaactttgctgatgcggccaagaacgatcataaccgattcaaggattggttccattgcatgttggaagagggggtatactttgcacccagcccctacgaagccggttttgtctccattgcccatgatgaggccattattgacctgaccattgaaaaggcccgtaaggtt

SEQ ID NO: 33843 - DNA, 921 bp, magnetite-containing magnetic coccus
cgccatatgcttggcatggatggtttggcccgtcacgaaatcggtgccattttggattctgcccaggcttttcgcgatgtcaattatcgtgagatcaaaaaggtccccaccctgcgtggcaagaccgtgatcaatctcttttacgaaaactccacccgcacccgtacctcttttgaactggccggtaaacgcatgagcgccgatgtgatcaacatctccgcttccagtagctccgccgccaaaggggagaccctgctcgataccgtggccaccctacaggccatgcgtcccgatgtggtggtgctgcgtcatggggattctggtgccccccactttttggcccgccatctggatgccggtatcatcaacgccggtgatggtcagcacgagcaccccacccaatcactgctggatctgctcaccattcaagaccacctggaagagatgggcaaaagcagctttgaagggatgaacgttgccatctgtggcgatgtcctacatagccgggtggcccgctccaacgcctttgccttgcgcaccctgggtgccaatgtgcgttttgttggccccccaacccttatgccctctgaagcgaccaaggtgtttggcgttacggtccaccataatatggaagaggggctgcggggggtggatgtgatcattatgctgcgtctgcaactggaacgcatgacctcggcctatctgcccagtgtacgcgaatatttcgcttattggggcctgacccgtggtcgcttggagctcacccagccccacgccctggtgatgcatcctggccccatcaaccggggtgtggagattgcctcggatgtggcggacaatcccaaccgttcggttattttggagcaggttgccaacggtttggcggtgcgtatggcggtgctttaccatctttgcaccggt

SEQ ID NO: 33844 - DNA, 668 bp, magnetite-containing magnetic coccus
gccgtcgctggtttgaaaaagagagcgtggcactggaatactatgatgccatcgtggtggccttgggctttgccctgctgatccgcacctttgtgatcgagccctttaaaattccgtcgggctcgatgatccctacgctattggtgggggactatctgtttgtcaacaaatttgcctatggttaccgcattccctatacccaaaaccggattttaatgggggatggcccgcagcatggcgatattgtggtatttaagttcccgatggatccttccaaggattacattaagcgcattgtgggcttgccgggggatcgtattgcctatgaaaataagcgcctgtatgtcaatggcaaaccgttggattataaaatagcgggcgaatacagctatcttaatgagtacgagcgccgcattgataccctcggtttgcaggaaaataatggggagcgcagctatcgggtgttgattcaacccaatgtgccctcggcctttcccatggagcaggtggtgccagaaggccactattttgccatgggcgataaccgcgacaacagtaacgatagccgctactggggtatggtgcccgccttccgtctcgtcggtcgagccacccgtctgttttggtcttgggatcatgtggaggggcgggttcgctttgaccgagta

SEQ ID NO: 33845 - DNA, 1422 bp, magnetite-containing magnetic coccus
atgaaatcaatacgtcgtacaaaaattatcgccacacttggccctaacgcttcaagtcgcgattttatcaaacatttagcgctgaccggcgtggacaccttccgcctaaacttcagccatggttcccatgaagatcatcgtcgtcggcatggttggatccgctctgtcgaagaagagttaggccgccccttgggcattatgatggatctacaaggtcctaaattgcgcatcggtacctttgaaaattctgaagtggagcttgttcggggccaaaagtttgccctctataaagaggagcgcacgggggatatcaacggtgttaccctgccccataatgagctgtttcaggtgatgcgtcccggtttggagttgctgctcaacgatgggcgcatcaatctaagggtcatggaggttgaggattttggggtctgctgtgaggttcgtgtggggggtattctctcagatcgcaagggcttgaatgtacctgccgccatgctgccggtaaaagccctaaccgacaaggatctagaagatctggaatttgggttggaattgggcattgactggtgcgcactaagctttgtacagcgtcctgaggatttacgggaagcccgtaagctgatccatggtcgtgccgccctattggccaagattgaaaagccccaggctgttgataatttggaggagattgttaaagtcgccgatggggtgatggtggcccgtggggatctgggtgttgagtacactcccgagcgtgttccagcggtacaaaagcggcttattcgcatgtgccgagagcagtgcaaaccggttattgtagcgacgcagatgttggagtcgatgattgacgcccccatccccacccgtgccgaggcctcggacgtggccaacgccatctatgacggggccgacgcggtgatgctctctgcggagacagcggtggggtcttatgcgtgtaatgcggtttctgtgatggaccgtattgcccgggtcacagaggcggatcctgactgtctacagcgtaatttgcacacccccttaacatttgacaatagcgacaatgacgccataagcaaggccgcgcgggatgttgccatgagccgtggttgccaagccattgtggcgtttaccaagacgggctcaacggccttacgggtctcgcgtacccgcgcttcggtgcccattttgggtttgacaccggatatacgggtagcccgccgtttaaccatggtgtggggcgtgcacagtgttaataccagtgatgtgagcaactttgctgagatggtgggcaaggctacacgtatctgtcgccgtgaggagttagccaacaccgatgaccgtattgtggtgattgcgggtgtgccgtttggtcaggagggcaccaccaacattctccgcattgcccgcattggtgaggctgag

SEQ ID NO: 33846 - DNA, 1227 bp, magnetite-containing magnetic coccus
tccagcaccgtatcactggttacaccgttgctgtcggtggtttcgaccgtaatgcccaaggagaagtccacattggagtcgctgggtgccttgatctccaaaccatcaatggtaaaggttccctcggtggcggtttcagtcacagcccccatggggataacggcggtgccatcggcattaaccgtgatctccgtgccatcagccaagcggatctctgtaccatcgggaatacccgtaagggtaacgcccgttaccgattcagacccatccgtgtcttgcagagcaaaggtgggctcgttgaccgagatccactgatcttcacgaccggaggcgctgcctgcggtaatctccaccccatccgcttcggggttgaccgtcagggtaaactgcgaagagaccgaagtggtgtccgtaccgccactgttggcaccatcatccaacacatgtacggtaacgcccatattaaagacgccagagacatcgccatccaccgtggcagaaagaccgtccagatcccccacagagagggtccaggtaccatccccattgtcggtgcccgccgacagggtcacggtgtcgggcacatcggagatcaccaccgaggtgatggattccgaaccatcggtatcggtgaccgctgcggcgatatccagaggaatgctggtggcatcctcttgacccaccacatcccccacattcaggtcaggtgcatcggcgtcggggttaaccgtcactgtaaagctggacgaaccgtttaaggaatcatccaccgtgacgccatcgtcaccaacatcattaaggttccaagagacatccagatcaaacttaccgctataatcctcgggcagatcggtcaactgaatggcgctaaagtcaactggggcatcccctgtgctggtaatggtccaagtgccatcgccattgtcggtacccgcagagagctgcgccccagcgggcacaccaccaatggtgaccaccagggtctcagaaccatccacatctgccaaaccaccgctgatatccagggtaatggcctgatcttccgtaccggtggtatcgttaacggtcaagctcggatcatcggccacgccggttacttcaacggagatggtgccattggtgatctcggtatcggtggtcgcaccattgtcgtcgatggtggtgacgcggatacccagttcaaagtccacgttggaatccgccggggccatcacctgcaagccagct

SEQ ID NO: 33847 - DNA, 1656 bp, magnetite-containing magnetic coccus
tggtttcgtatggtcatggagcggtttcgcacctttttttactatattctaggtattacctttgtgatcaccctattgcaggtggtcacccctctttatgtgatgcaggtctatgaccgggtggtcggttcgggctctatgagcacattggcctttctggtcggtggcgccctcgctgcgctgggctttgactggggctttcggcgcatgcgcgcggttatgttaggctacgtgggggcgcgccttgataacatcattgacaacgccgtctttcagcgtattctctatctactccccgcctataccgagcgggctaccattggctctcaggtcgcgcggattcgagattttgaatccatccgtgaattttttactggcgccctggtcgtggtctttcttgagctaccctttacggtggtctttctgctggtgattgcctcactggctggtcctttggcctttgtacccatggttaccatgattttgtttgtcatcctgtgggtgacgatgaccccactggtgagcaattcgggcgcgacggcacgtcgctttagctctcaaaagcagtctttcattgttgaagccctcaactccatgcgggccattaaatattgccgcgcagaagatatttggctggatcgctttcgcgagatgtcggccaaggccgcccaagcaaattttaagacctcgtttatcaacgcgattgtgcaatcgttggggtcggcatttatcgtgctttccggcctgggcaccatcggttggggggtgttgcgcgtcctttcgggggacatgaccgttgggggactggtggcgtgcatggtgctggtgtggcgggtattaacccctatgcaggccctgtttaccgcgatgacccggttagaggcgattcgtgcctccgttgctcaggttaacaacctcatgaatgttaaacccgagcgcgagccccacgcccccattaaaaagattgcccagttccgtggggatgtcaccttttcacgggtctctatccgctacagtcaagaggctgaccctgcgctggttggcgtcacctttgaagccaaggctggagaatgtattgtcgtgataggcggcaatggttcaggtaaatcaaccctggttaaattgattgccggcatttacagcccacaagctgggggtatttttattgatggccgcgatacccggcagttggaccccattgaattgcggcaggcgattgcctatgttccacaaacggtcaacctgttccacggcaccattgcacaaaatctacgactggcccaccccaccgcctcccaagaagaattagaggacgcgtgcagcaaagctaccgtattggaagagattttggctttgcccaaggggtggtggacccgcattggcgactctcgctcttctcagctttcgtcgggatttatccaaaagctatccttggcgcgggcctatcttaaaaaagcgccggttatcctgtttgatgagcctgccaacgctttggattgggatgcggacgatgcttttcaaaatgtggtgaaagagttaaagggaaaatccaccattttcatagtgacccacagtcccagacaccgcaaattagccgatcaactgctctatctggaacggggctatttgcagcttgcaggccctgccgaagaggta

SEQ ID NO: 33848 - DNA, 1593 bp, magnetite-containing magnetic coccus
cggggggtgattcgttatgtgctgctactgagtgtcgtcatcaacttgttgggccttgccctaccgttgacgctgctccaggtttatgatcgcatcctacccaaccaagcctatagcacccttcaagtgctcatgttaatggtgcttgctgcggttacattggagagcacccttaaaaccatccgcacctatattggtggttgggtaggggcgcgttttgaacaccgctccagttatctggcgctggagcgcatgctctataccaacctgtccacctttgaaaaatcgggctctggggaacaccttgagcgcatggaaagccttggtacaattaaggatttttatgcaggccaagcgatgcaggtctatttggaccttatttttgtacccatttttctttttttcatttggcacatcggcggctatatggtttttgtgaccattgccacttttggcttctttgtgtttgccgcgctgctggtgggtgatcgcctaaaaaaagcggtcaaagagcgttccgtggccgacgaacgacgcctgaactttatcatcgaagttctcaccggcatgcactccgttaagggcatggcgatggaagctcaaatgctacgccgctatgaacgcctgcaagaagggtgtgccaacaacgccaaacaggtggttctagagagcaacagcgctcagggtttagggagcttttatgcccaaatcaacaccattttgatcgcggctgtaggctcgaccttggtgattgatcaccagctaaccatcggtggcttggcagcatgtaccatgctctctggccgtgccatggggccccttcagcaggcggtgggcatctgggcccgttggcagaccatccgtctggccaaagagcgcatgcaagagatctttcgcatgcagccggatattcatgacaacatggaagattgcccggagatcgagggtaagctggagctgaaaaatgtcagctaccaatttgacgatgaccaccccccccttctgcacgatcttaatttggtggttgaacccggtgaaatcatagcggtacgtggtgacaacggtagcggcaagacctccctcttatggttaatgatgggagctttgcccgccaccgagggcgaggtctatctggatgatgtgcccatccgcatctacgaccccaaatcgatgcgggataaagtctcttatctaccccaggctggggtattattccaaggcaccttgctcgataacatcaccatgtttcgtgaagagttgtatgatgccgccatggacgtcatcgccttgatgaaactggaagaggtgatctccagcatgcccaaaggcatcgacacgcacattgatgatggctccaaagagtctctgcccaaagggattcgccaacgcatttgcattgctcgggcactgctggaaaaacccaagcttattctctttgacgaggccaatgccgccatcgacggggccggtgatgagcaacttaaacagaccttagagggaatgcgcggcaaagtgacgatgatactggtgacagtgcgcccctctctctacaagattgctgatcgcgtctatgacctgaaaaaaggcacttta

SEQ ID NO: 33849 - DNA, 942 bp, magnetite-containing magnetic coccus
  unsure (1)..(942): unsure at all n locations
ctggttcgtatcggtacccgtggtagcgccttggcggtgtggcaggctgaatgggtaaagtcccaacttcaagcgcaccatcccggtattatcgtggagctggagcttatcaaaaccaaaggggataaaattttagatgtcccccttgccaaagtgggtggcaaaggtctgtttgttaaagaactggaagaggcgatgcttgatggccgcgtcgatctggccgtccactctatgaaagatgtgcccgccgaatttcccgatggccttatgctaggtcccatcctcaagcgcgaggacccccgcgatgcgctactctccatccactaccagagtttggctgaactgccccagggcgctctgattggttcctcttcgctgcggcgccaaagccagatcaaggccaaacgtccggatctgcgtctggattggttacggggcaatgtgggcacccgcatacaaaaattggtagaggggcaatttgatgccattatcttggcggcggccggggtaaaacgtctggggctgaccgaacacgtggtgcaatatttggaacctgaagagatgctgcctgcggtgggccaaggtgcggtaggcatcgaacatcgggtggacgatgcccgcatcgccacgctgcttgccccgctctaccataaagagacccatagctgtgttaccgcagaacgggcctttttggctaagctagaggggggctgtcaagtacccatcgccggttatgccaacccctgtgcacngaannangcaatttancccntntttaaacccctttacggggattggtcgcctgaggttgaggggggccgcgtggtgcaagcccagtgtcagggtccccgcgccgatgcttatcgcatgggacagcaattggccacccaactgctggaggccggtggcggtgccatcctacaagccgtatacaaccaggac

SEQ ID NO: 33850 - DNA, 984 bp, magnetite-containing magnetic coccus
gccgttattggcgcgggatcttggggcacggcgctggcggccctgctggcgggtaagctgccccaagtaaccctgtgggcacgggaacccgaggtggtggagggcattaaccagggtcaccacaacccggtttatctggcagacctggatctgccgcctaacctggttgcccatcaagatctagcctgggtagcggccaaccatgatgtgttggtcatggtggtgcctacccaattttgccgtcaagtgctggctcagctcaaaccccatgtgcggccccatgtcacctttgtgtcggccaccaaaggggtggagactgccaatctggccctgatctcggagatctttacccaaacctttgcggcccccatcgcccagcgtacctgttatctctccggcccctccttcgcccgggaggtgatcgccgggcagccggtggcggtggccatggccggtgccgatgaagcggccttggcggctatgcaggcgctctttttcttcccccattttcgtacttacagcaccagcgatgtggtgggggttgaactgggtggggcgttgaaaaacattattgccattgctgcgggtattagtgatggattggggtatggggctggtgcgcgggcggcgttgatcacccgtggtttggccgaaattgcccgtttgggtcacatctatggggccaacccccagacttttgccggattgtcgggtatgggggatctgctcatgaccgcctcatccaccctgtcgcgcaactataccaccggctttcgcttgggccagggggagagcctaagccacattagcggcagctcaagagaggtggccgaaggggtgcaaaccgccgccagtacttggctgttggcccagcgccatggggtggagatgcccattacccaggcggtacatgccatcttatttgaacaggtacccccacaacaggcggtgacgcaactgctaaaccgggatatgaaacgggag

SEQ ID NO: 33851 - DNA, 1527 bp, magnetite-containing magnetic coccus
gagatcctgaacgatccctacatgaacaaaggcgtggcttttacggaagaagagcgggatctgtttcatctccgcggtctactgccccccagggtccagaccatggaggctcagttagggcgggctttagataattttcgctgcaaacctaacgatttagagaaatatattttcctaaccggcctgcaagagcgtaatgaaaccctcttctaccggttggtcatgaccaacattgaagagatgttacccatcatctacacacccacggtgggtaaggcgtgccaaacctatggtcacatctttcgccgcccccaaggcatgtttatctccattaacgacaagggccgcatcgctgaactgctgggcaactgggtccataaggatgtacgggttattgtggtaaccgatggtagccgtattctgggcctgggggatctgggcgcacacggtatgggtattccagtgggtaagttggcactctataccgccttggcgggcatcccccccatccactgtttacctgtcaccctggacatgggcaccaacaacgaagccctgcggaatgatcccctctatgtgggcctgccccaaccccgtgtcaccggtgagatctatgatgaaatgatcgaagagtttgtgctggcggtacaggagcagttcccccgtgccatgattcaatttgaggatttttctaacgacaacgccttccggttattggaaaaatatcaggaccgcatctgcaccttcaatgacgatattcaaggcaccgccgccgtggcactcgctggcattttgggcgctttgcgcattacagaggcggatttatgcacccagcgttatctctttatgggcgctggcagtgcaggctttggcattgccgacctcattttacgcgccatggaacaaaagggcatcccccgtgagcaggggctcaagcagttccgctttatggactcacgggggctggtcactcgcagccgcaccgatctgcggggacgtaaatcagaatttgtctgtgatgacccgccactcaccgacttgcaacaggtggtggaacgctttatgcccacggtattgattggggtttcggggcagcccggcgttttccaccagggtgtggtcgaggccatggcccgcatcaatcctcgccccattatctttgctctctccaaccccaccagcaaggccgaatgtagcgcccaacaatgctaccagtggagtgatgggcgcgccatctttgccagcggcagcccctttgagcccgtcaccattgccggtcaaacctttgtgtcgggtcaggggaataatgcctactgtttccccggtattggtttaggggtgattatgtgtgaagccagccgcgtgaccgaggagatgttcctagtcgccgcccagaccctggcccaaatgaccgcccagagtgacctggatcaagggcgtgtctatccctccatgcaggacatccgcgcaatctctctaaacattgctttagcggtggtcgatctggccagcaagcgcggactggcc

SEQ ID NO: 33852 - DNA, 963 bp, magnetite-containing magnetic coccus
aaggcgattttggtgacgggtggtgcagggtatataggcagtcatgtgtgtaaggtgttatcacaaagtggttttttaccgataacttacgataatttaagcgaggggcacccctgggccgtccgttgggggccgctggtggtcggggggcttgacgatggggctaaattggcaggtctctttgcacagtaccagccgcaagcggtgatccacttggcgggtcgtgcctatgtgggtgaatccatgacggacccggccctatactaccgcaataatgtgcaggccgcgttggtgctgttggaatgtatgcgtcaatatggttgtaaaaatatcatattttccagtagttgtgcgacctatggcgaacatcggcagatgcccataaccgaggcgatgtcccaacatcccatcaatccctatgggcgttctaagttgatgtttgagtggatgttgcaggactatcaggtgtatggcttgcagagtgtggccttacgctattttaatgccagtggtgccgatctggagggcgagattggtgagcagcaccaaccagaaccccacattataccccgcttgttagaagccgcccgtaagggtagcccctttaccatctatggtaccgattatgagagtgaggatggcacctgcgtgcgggattatatccatgtgagcgatctggcccaggcgcacctgttggcgttgcaatggttgtggcgggggggtgagagccgcgcttttaacctaggtaatggtcagggtttttccattcgacagttaattaaagtggccgagacagtgaccggcaaaagcatcgcggtgcagttgggtgcccgccgccctggcgatcccgccgtgttggtgggcagcgcagaaaaggcgcgggaagagctggggtggcagcctcaatatggtaccttggaaattattttaacgagtgcttggcgctggatgcagcggcgccaa

SEQ ID NO: 33853 - DNA, 1301 bp, magnetite-containing magnetic coccus
gaggccctggcccgagcagagtcagccaaccaagccaagagtgagtttttagcgatcatgagtcatgagatacgcaccccccttaacgtgctgctgggcatgggcgacctgctgcatgagagcctgttaacggaggagcagaccggccaattggaactgcttattaaagctggcaaacatcttgttgttttaattgatgatattttagatctctctaaaattgagtttggcggtctaacattaacccgagagcccctccaaccccaccgactgtttttgttaatctgcgatattgtgcgtctacaggcccaagagaagggtttgaccttcaactgtgacatccccaccgaattgcccccgtgggtactgggggatgaaggacgcttgcgccagattatgatcaatctgttgcacaacgccattaaattcacccagcaagggcatgtcaccctgaaaatcgcctatcagcccgcaggcagtctgtttagcataaccattagcgacagtggcatcggcattgccgcgaagcatctcaaccacatttttgacaaattttcccaggccgattccagcatatcccggcgttatgggggcaccggtttggggctggcaattgcccgcaatttggttacgttgatgggggggcatcttaccgtggagagctgcgtcaaccagggcagccattttcaactgaccttagagctgccgcccacccagccccccatacggccatccaccgtggcactcaccgaccttgccaccttaaaaccactcaatattttattggctgaggactctttggataatcaaaccctgtttttaacctacttaaaacccaccccttggcaggttgaaatcgccatggatggccagcaagccgtggaacgggttaaacagggtgggctagatctggttttgatggatttacaaatgcctatcatggatggctatcgggccacccaagcgattcgccactgggagcaaacctcaggcacaacccccctgcccattttggccctaagtgcccatgcgcttagagcagaacagcaaaaaagtctcgaagccggctgtaatgcccacttggtgaaaccgatcaagaaaaaggccctcattgaggccattcatcaaaacatggcacgcaccaccgccaaagtctcccacgagactccctagccccacgttaagccccaaacccgcgtttgccgatccaccgcaccagctcagaccaagagagcttaaacccctttttccaggctctaaatcttgtccatcttctttttaacaacagatacaccagcacc

SEQ ID NO: 33854 - DNA, 1164 bp, magnetite-containing magnetic coccus
ggtttcaccacccgcgccatccaccacggctacgacccctacgctgggcacggttcactaaccccacccatctacatgagttccacctacacgtttgcgaccacagaatcggggcaaaaacgctttgccggtgaagaagagggctacatctacgcccgtgtaggcaaccccaccacggcgcttttggagcaacgtcttgctgaattagagggagccgaggccggattggtgaccgcctcaggcatgggggccaccagcgccctactttggacgctgcttaaacccggtgacgaaattattaccgataaaaccctctacggctgcacctatgccttttttaaccatggtctgcacaaatttggcgtcaccattacccacctggatctcaccgaccccacgcagctggcgcaagccatcagcgccaaaacccgcgtggtcttttttgaatcccctgccaatcccaacatgcgcttggtagatattgccgccatcgccgaaatcgcccaccagcaccatgcactggtggtggtggacaacacctattgcaccccttatttacaaagacctatcgagtttggtgcggattttgtggtacactctgcgacgaaatatctgggggggcatggggatctgctggccggtgcgattcttggccccaaagcggccttaaccgaggtgcgtttttatggcctcaaggatatgaccggggcggtgctctcggcccaagatgcctttttgattctgcgcggtctaaaaactctggcccttcgcatggatcgccactgtgccaatgccctcactttagcgcaattgctcgaagcccatccccaagtgacagcctgttactaccctggtctaccaagctttgcacagtacaccttggcccagcggcagatggcccaaccagggggcatcatagcctttgagctcaaagggggcatggaggcaggccgacgttttctggatgccctacagctgatcacgcgggcggtcagcttgggcgataccgagagtttggcccagcaccccgccagcatgacccactcggtctatcgcccagaagaacgggccgctcatctcattagcgagggcttggtgcgcctctcggctggtttggaagatcctgaggacctcatagccgatgtcacccaggctcttgccgca

SEQ ID NO: 33855 - DNA, 708 bp, magnetite-containing magnetic coccus
gtgttggagttggagggggtagcggcgggttatggtccggttagggtgttgcatggggtttcgttacatgtgcatgcgggggagattgtcaccttaattggggccaatggggcgggtaagagtacgttattgatgtcaatttttggcaatccgcgaccgttagcgggggttatacggttgcatggggtggatattgtgggggagtctacgtatgggattgcgcggcggggcattgcgcaggtaccggaggggcggcgtatttttggtgagatgacggtatgggaaaatttattaatgggggtgacgccgttgggggcgcgggatggtgaacgagaggggcgggatttggggtgggtgatgtcgttatttccccgtttgggggagcggcgtgagcagcgtgcgggcaccttgtcggggggcgagcagcagatgttggccattgggcgggcgttgatgagtcggcctaggttattattattggacgagccttcattgggtttggcaccgttgatgattaagcagattttcgccattttgcgacagattgcggatgagggtgtgacgatttttttggttgagcagaatgccaatcaggcgttgcagttggcggatcggggttatgtattggtgaatggtcgtataacgttatcgggttcggggcaggcgctattgggggatgctgaggtgcggggggcttatttggggggg

SEQ ID NO: 33856 - DNA, 774 bp, magnetite-containing magnetic coccus
ctatttattcaaaccgattggttgcagagcaacttggagcgggagaatttgcggattattcaggtcgggggtgagaacttttacagccgcatgcatatccctggggcggtcatggttggctatcaagatataaccgggtatcgagatggaataccgggttttcgtgccgagacagcgttattacgcaaactgtttgggcgtttgggcatcacacctgagagccatgtggtggtttatgacgccagtggtggtatggatgcagcacgtatggtgtggacgctgcactgtatggggcatacgcagtgttatattttagatggcggcatgggtgcgtggtataccgagaagcgggtttgtacggatcatatgccacagattgcaccggttgagtatcgtgtggatgaagatttgcgttgggatgcggacattgagttgatgcagcgggtggttgcgggtgagcttgagatgaaggtgttggacacccgtagcgaggcagagtatgaggggcagaccatccgtggaccacggggccatatcccaggggcgcgccattttgagtggatggatgccctgcgcactccacaggatccccaattgaaggatgatgaggcgttgcgtgaaatgttggcaggtcgtggggtagagaatccgcacaccgatgaggtggtggtctattgtcagacggcacatcgggcggcccacacttgggcggtcttgcgtcatttgggctatgccaaggtgcgcttgtacgatggctctatggcggagtggggt

SEQ ID NO: 33857 - DNA, 1958 bp, magnetite-containing magnetic coccus
atgggcaaagtggttggcattgatctgggtaccaccaactcctgtgtctcaatcatggagggcggcgagcctaaagtcattgagaatagtgaaggggtgcgtaccaccccctcgatggtggcgtttaccaatcaaggggagcgtctggtggggcaagctgccaaacgtcaggcggtaaccaacccgaccaataccctctatgcgatcaaacgtctcatcgggcgtcgctttagcgatccgttgaccgctaaagatcaaggcttggttccctataaaatcgtcaaagcagataatggcgatgcttgggtggaagccgatggtaaaaaaatgagcccctccgagtgctccgcgatgattctgcaaaagatgaagcagaccgccgaagattacctcggagagagcgtgagcgaggcggttatcaccgttcccgcgtactttaatgatgcccaacgtcaagccactaaagatgccgggcgtatcgccggccttgaggtgttgcgcattattaacgagcccaccgccgccgccttggcctatgggttggacaaaaaggatggtcaaaccatcgccgtgttcgacttgggggggggtacctttgacatctccattctggagatcggtgacggcgtgtttgaagtaaaatccaccaatggggataccttcctgggtggtgaagatttcgatatggccattatcgactatctggccgatcaattcaaaaaagagaacagcattgatctgcgcaaggattccatggcgctgcaacgcctcaaggaggccgctgagaaggctaagattgagctttccagcagcaaccagaccgacattaacctgccctttatcactgccgatgccagtggccccaagcacttaaacctgagcttgacccgggctaagctggaatcgctggtggatgagttggtgcagcgcaccctcgccccctgccgcaccgccctgaaggatgctggcatgaccgcggctgacattgatgaggtgatcttggtggggggtatgacccgcatgcccaaagtgcaggcagtggtgggtcagttttttggtaaagagccccacaagggtgtgaaccccgacgaagtcgtggccattggtgcggccatccaggggggggtgctcaagggtgaagtgcaggatgtgttgttgctggatgtgaccccgctctccttgggtattgagaccctgggcggtgtgttcaccaaattgattgagaaaaataccaccgtgcctacccggaagtcgcaagtcttttcgacggcagccgacaatcagtcggccgtgaccattcgggtagcccagggcgagcgcgaaatgttctccgacaataaaaccttggggcagtttgatctggttggtatcgcccccgcgccccgtggcatgccccagattgaggtgacctttgacattgacgccaatggcatggtgcatgtgtccgccaaggataaaggtaccggtaaagagcagtccattcatattgaagcctcgggcggtttgacctcggaagagattgatcgcatggtgcatgaggccgagtcccatgcggaagaggatgccaagaagcgtgcctgatcgaagcccgcaacaatgcggactctctggtctattccagtgagaaatcgttgaaagagcacagcgataagctggacgatgcgttgaaaaaccagattaccgccgccattgaagatcttaaagcggtgatgcccaaggaggatcctgaggccatcagcagcaagacccaagcgctcatggagctttccatgaagatgggtgagcagatctataaggaaaatcctgaagccgctggcatggatcctgaagccgcagcccatgcagcagggatgcatgggggtgcagccacgggtggtggcgatggggcaaacaaacatggcaagggcgccgaagatgtggtagaagccgagtttgaagaggtcaacgacgacaaaaaa

SEQ ID NO: 33858 - DNA, 792 bp, magnetite-containing magnetic coccus
aaggtaggggtgacaggtgtttgtggtcgtatggggcgtatgttggtggaggccactcataaggcgcaaggctgcatgttgggcgcagcgagtgaatacccagggcacacattgattggcgccgatgccggtgaactggcaggcgtgggcaagttgggggtgctggtggggggggatgccgagacaacctttcgcgatgccgatgtggtgattgatttttcggtggtggaggccaccctggcgcatctgcgtttggcgctggcccaaggcacacccattgtgattggcaccaccggttttagcgcggcagaacgtcaacagattgccctggcggcggagcgtattcccgttgtgtttgcgcccaactatgcggtgggggttaacctactgtttaagatcgctgccgaggtagccgccgtgcttggtggcgagtatgatattgagattgtcgaggcccaccaccggcacaaggtggatgccccctccggcaccgctttgggtttggggcaggccattgccgaggcggtggagcgcaacttagatgaggtggccatttacggtcgtcaaggtcagaccggggcgcgggatccacaaaccatcggtttttccaccattcgcggtggggatgtggtgggggaccataccgccatgtttatgaccgatggggagcgcttggagctaacccaccgggcctccagccgcatgaccttcgccaagggtgccgtgcgggctgctaagtgggtggtggagcagaagccgggtctctatgatatgcgggacattttagggttt

SEQ ID NO: 33859 - DNA, 2421 bp, magnetite-containing magnetic coccus
tctgaacagcgcagcgacgaaccggaagttgtggatgccattattgaggatcagcagggggctcaagccaccactgacgcgaccccaccggtacgcatagaaaacagcttgcccaccgagctggtaatctaccccttgggcggacgccccttctttcccggcatgttaacccccattcaggtagagggctccccctactatgagaccatcaaaaaagcgatggactcccacgggcggctgttcggcattctcgccagtcacgccgaggatggacaagaggtgtttgacgccaatcaactgtttggcatcggtacggtggtgcgcattttagaagcctccgtcaatgaggaggctaaacagatcaagctgctggccgagggtctctggcgctttgaggtgcgggatgtggtgagcgtgggcccccccattgtggcccaagttacccaccataataacccggtctcggtggtggataccgacgcccttaaaccctacaccatggcggtgatcaacacccttaaagagattcttaaatatgactcgctctatcaggagcaggtcaaaatgtttctttcacggcacaactttagcgaaccggatcggttggcggattttgtcgcttccatgacctcctccagccgtgaagagctgcaagaggtgttggagaccctgcccattatggcgcggttggaaaaggtcttgaccctgctcaaaaaagagctggaagtggtcaaactacaaaacaagatccagcgccaggtggaagagggtatcgcggaacatcagcgtcaatttttcctgcgggagcagctcaaagagatccaaaaggagctgggcatcaccaaagatgaccgcaccgccgagatcgaccgttttcgcgaacgcttggaaaaactcaccctctccgaagaggctgagcaaaaaattgaagaggagctggataaactggccatcctggaaaccggctcttcggaatatggcgtgacccgtaactatgtggattggctcaccagcctaccctggggggtacactccaccgacaagctgaatattgcccgagcgcggcgcattctggaccgcgaccatgatggtctggaggatgttaaagagcgcattttagagttcctggcggtgggcaaactcaagggtgagatcggcggctctatcattctactggtgggtccgcccggggtgggcaaaacctccattggtcgctcagtagccacggcggtggggcgtgaattttatcgtttctccgtaggaggcatgcgcgatgaggctgaaatcaaggggcaccgccgcacctatgttggggcgatgccgggtaaatttgtgcaggcgatcaaacacactaaggttgccaacccactgattatgcttgatgaggtggataagattggggcaagctatcaaggtgatcccgcttcggcactgctggaggtgctggacccggagcaaaattccgagtttcttgaccactatatggatgtgcggtttgatctttccaaggtactgtttatctgcaccgccaaccagcttgacaccattccccgccccttgctcgaccgcatggaggtcattcgtctatccggctatattacttctgagaaggtgcgcattgcgcgtaatcatctgctgccaaagcagttggaaaaaaatggcctggataaaagccagttacgggtcagcaatggtgccctgcgggagatcattgaaggctatgcccgtgaagcgggggtgcgccgtcttgagcaaaagattggggccattgcccgcaaagtggcggtgaaggtgctggaggaggctgaactccccatcagcgtgggacagaatgatctggatagctacctgggcaagcccgatttccgtgaagagaaacctttgaccggggtgggtattgtcaccggtctggcctggaccgcccttggcggggcgaccttggatattgagtccgcccagaccagcaccgagggtaataccctgttgctcaccggccagcttggcgatgtgatgaaggagtcggcccgtatcgcctttagctttttacaatccaatgtggaaaagttgggcggcaaaagtgagcggctcaagggcaatattcatctgcacgtacccgaaggggccaccccgaaagatggtccttccgccggcattaccatcgccaccgcgctgctgagtctggcacgcacccagcccctgccccgccgtttggccatgaccggcgagatcaccctaaccggcagtgtactggcggtagggggggttcgtgaaaaggtgattgccgcgcgccgggtgggcatccgcgagctgattatccccgaggcctgccgtaaagattatgatgaggtgccggaacatattcgtgaaggttttacggtacactttgtaaaaaaatatgccgaagtggctaagctggttttt

SEQ ID NO: 33860 - DNA, 2073 bp, magnetite-containing magnetic coccus
cgcagtgaagacccccttttgggcaccctgttgtttctggcccaccattggcacttgcccgccacggtgcagagcctaacagcaaacctacccctgaccgaagcgggcctaacccccgaactttttttgcgtgctgctgaacaggctggcctgaaggcccatattcgcaaacagcccttacacgcactgcacacggaacacctgcccgccgtgctgctcttgcatggccgtatggctgtggtactgctgggctgggatgaggatgaagcccacctgctgctgcccgaaagtggccgcgaaacccgtctggatcgccaagcactcgacgagcgctacgaaggccacgccattctggtaagccccatgtttaaacatgatgcccgcaccagctttattggcaacccaaccacgggtcactggttttggagtgcgctgttccgttactggcctatctacagcgaagttgccgtggcctccttacttattaacctctttaccgtggcctcctcactgtttgtcatgaacgtctatgaccgcgtggtgcccaacaaagccatggagaccctctgggttttggcccttggggtagccattgtctactgctttgattttttactacgcaccctacgcgcccattttttggataccgctggaaaacgggtggatattgtactggcctcaaacatctaccgccatgttagcggcatgcagttaagctaccagccccaaagcaccggagccatggcgcgtaatcttcaagagtttgaacccctgcgtgactttttcacctcggccacccttaccgccattatcgacctccctttcaccctgatttttgtggtgttggtcgcgcaactgggtggccttaatgtcgccatggtccccctggtctgcatgccagtggtgattctggttgggcttctgctgcaagccccccttaaccgggtcatgaatcgtgccctcaaagagtctgcccagaaaaacgccatgctggtggaaaccctgggccgcctagagaccatcaaacttaataatgccgaaggacaccttgccggcaagtgggaaaattgcatcatcgaaaccgctaaaaccgcccagcagtcgcgttttctctccaccctgggggtgaatttcgccatgcttgtgcagcagtttagctcggtggcggtggtggtggtgggggtttatgccatcaatgccggtgagatcaccatgggggcgctcatcgcctgtaccattctgaccgggcgggccttggcccccctctcccaggtggcaggtttgatggtgcgcattcaacaaaccatgatctccctacgcaccctcaatcaaatcatgaacaccccccaagagcgccccgagggacgcacctttcttagccgccctcgcctctcgggtaagattcaactcaaagatctttcgttccagtaccccaatgccaaaaccgccgctttgcaaaagcttaatctactcattgaacccggtgaaaaagtcggctttatcggacgggttggatcaggcaaaagcactttgcttaaattgctgcaaggactctacccccccaccgaaggcctggttttggtggatgatatggatgcccgtcaaatcgaccccgccgacctgcgccgcaatatgggttgtgtgacccaagatgccggcctactctatggtaccattcgtgaaaacattaccttgggcgccccctttgccgatgattccaccctacgccgcgcggtggaacaggggggtgttgcggcgtttaccgatcgccatcccgatggcttggatctggttatcggtgagcagggccagggcctttcgggtgggcagcggcagtgcgtttccatcgcccgtgcgttgatccataaccctcccattttgctgctggacgaacctaccagcgccatggatagcggctcggaggagcgttttaaaaaggtgattgaagatacgttacctggcaaaaccttgctgttggtaacccatcgggcctccttactctccttggtggatcgtgttgtaatcattgaagatggccaaattcttgccgatggccctaaagaggccatttta

SEQ ID NO: 33861 - DNA, 420 bp, magnetite-containing magnetic coccus
atgaccattgaacgcactttttccatcatcaaacctgacgcagttgctaaaaatgtcgtaggggagatccaaagccgtttcgagaaagcgggcctgcgtattattgcttctaaaatgattcgcctaacgcctgaaattgcaggaaaattctatgaagtgcataaagcacgccccttctacaatgatctgtgcagctacatgagctcaggccctgtggttgtgcaagttttagaaggtgatggcgctgtcctgaaaaaccgtgacattatgggtgccaccaatcctaaggacgccgctccaggtaccatccgtgctgattttgccgagagcattgatgccaatgcggtccatggttcagacgcccctgaaacggctgcccaagaaatcgccttcttctttagtggcacagaactgtgcgat

SEQ ID NO: 33862 - DNA, 999 bp, magnetite-containing magnetic coccus
atgagcgtcaccataggtatcaatggctttggccgcatgggccgtctggtcttacgggcaggctggaacagcccaggcattatctgggggccgattaacgagaccagtaccgatgcccacggctccgcccacctgctccagtttgattcggtacacggcaggtggcaacacccttgcacggcccaacagggggagatctgcattgaggatagccgcatcccttaccacagcgtggccgatattgatgcccaccactggtcaacctgcgatctggtgattgaagccaccggcaaacaccacaaacagccccacaccctacagcgctattttgagcaaggggttaaaaaggtgttggtggccgctccaaccgagggggccctcaacctggtctacggcgtcaatgatcacctctaccagccccagcagcaccatcttgtcaccgcagcctcctgtaccaccaactgtttggcccctgtcatcaaggtactgcatgaaaagattggtattgtacacggtaccatgaccaccattcatgatatcaccaacacccaaaccattgtggacaaagggcacaaagatctgcgccgtgcccgtgcctgtggcaactccctcatacccaccagcaccggatcggccaaagcgatcaccaaaatttttccggagttgaccggtaaactcaacggtgtcgcggtgcgtgtgcccctgctcaatgcctccctcaccgattgtgtctttgaaatggccaagcccgttaccgaaagcgccatcaacaccctgttcaaggaggcctctgaaagttatctgcacggcattcttggttatgaagagcggccattggtctcggtggattttctgaatgatccgcgttcagccattatcgatgccccctccaccatggtgattgacggcacccagcttaaagtgttggcttggtacgataatgagtggggctatgtcaatcgcttgatggacctcgcgcttaaaatcgccaacacctta

SEQ ID NO: 33863 - DNA, 2139 bp, magnetite-containing magnetic coccus
attatcggtttaaaaaagatttttgcccaagccctccgtagccaaccacagctattggaacttacgatactcaacgacgatggcaagccgctgttctcctctacccgtgagcaggcccccaacaccacccttacccattttcgcacccccattatggtacagggctcttttcaagggatcttggtcggggcgtgggatttggccccggatcttcgcgccattgatacccatgtcaaccatatcctgctactcaccagcttactgtttggtctcatcaccctcatggtcatttttatggtgcatcgcctcgccatacagccggtcgatgccatttataaccgtttgattaaacagatttcacccccacaaagcaaacctgaaacctttcatgcagccagagagttgcgccgcctgcaccaaaccgtagagagttttagccgcaccgccgccagccatttggaaaatgcccgcaccctgcaagagagcgaggccctgctcaaacaacgggttgagcgacgcacacgggagttacggctggccaaagaggccgccgagcaggccaacctagccaaaaccgaatttttagccactatgagccatgagatccgcacccccctaaatggtgttttgggcatgtctgatctgcttttggagagcgatctaaacagctatcaacgccaccatgtcgaaaccattcaccgtagtggtcgcaccctgctacgggtcatcaatgacatcctggatctctcgcgcattcaagccggtcgcatgcccctggaggtgaccgcatttaagctacgggcctgcctggaagatgtgcaagccctcttcaaagaccaagcccgccgcaaagggttatcctttagcatcaactgtcaggaggagctaccccaacggctgttgggggatgccacccgtctgaatcagattctctttaatctggtggggaatgccttaaaatttaccgagcgtggatttgtacgggtttcggtacaggccgagcaggtacgagaagccgacctgctgctccgcattcaggtcgaagattccggcatcggcatctccgatgagtataaaaatcgcctgtttgagatttttagccagcaagatagctccatctcgcgccgctatggcggtagtggcctaggtttggtcataacccgcaaactggcccagatcatggggggcaaactgggctttagcagccgcagcggtgcgggttccaccttttgggtaaccgcccgttttgggcgtgtaccagacaccctccccgatcatccgctgctcccccgagaggagcagcagtctaacctgctcaatcaacgttttagagcccacatcctgctggcggaagacaatcccgtcaatcaagatgtagcccgccttaacctagaacgattgggttgccgtgtcacgctggtggaaaatggccaacaggcggtgacggtctttcaagaaaaccgctttgacttggtgctcatggattgtgaaatgccgatcatggatggctataccgctacccgcactatacgggatcttgaacgacaacaaggacgccgcgcgacccctatcattgccgttaccgcacacgccctagccagccatcggaataaagccatcgccacgggtatgaatgattttctaagtaaaccctttagcaccaccaagctgattaaattactggccacctatctccccccccacacggtcattgcccaacctgacccagccccccccgtggtaacacaagaaacagccccgtccgctgaccccgcgcacaaaacgctggatcaccgcgcactggatcaaattcgcgctctagacccggcggacccgcaaggcatgctcaaccgcatgatcgacctttattttgaacaaagcgctaaagatttcaaagcgatcgaaaatggtcttgcaacacagaatgccgaattgattcgctttcacgcccacaagctcaaatcttcgagcgcgcaaatgggggggcaacagctttccttactctgccgcaccatagaggaacagtgccacaccttcacacgggtggaggagagcatgagccaggcaagcaaggcccaacatgagctctgtgcggcgctgcacgcactgcggcaaacagccccacctacccccccctct

SEQ ID NO: 33864 - DNA, 1650 bp, magnetite-containing magnetic coccus
cgggcggatggtagcttttttagtaccgaattttggtcgcatcccattcagcaaaacggggagctggtgggtgcggtggtaacctttatcgacatcagccagcgggtactcaaccagacggcgttaaaggcgtctgagcttaaataccgcaccatttttgagtcggtaccgaccccgctgcttattttggataccagcggcgtggtgagggatgtcaactccgcgcatcaaagcacgtttggccgttttgccgggggctcgttgatgggggtttctatccgagagcatccgggggtggcgggttcgctgttggcagagagctttttggcgctggctaagggtgagccgatgcccttgcaacaggccagctataccatggaagcagagggtgaggcgattcactttaatgtgagaggcgtgccctttgtaacacgcgatggtgaggggcgtgaggatctgcaaggggcgttggtgattcatgaaaacatcacagacctcaaacagaccgagctgaagttgcgcaaggcggtggaggaggccgattgcgccacccatgctaagggggattttttggcggtcatgagtcatgagatccgcacccctatgaacttggtggtgggcatggccgagctgttgttagaaaccgatgtcaatgccgagcaaaaacactatctggaaaagttacagaaggcgggggatacgctgcttagtttgatcaataatattcttgatttaaccaaattagacgagggccagctcaagttgctggacgagccttttgcgccacaggcgttgttggatgaggtgtctggcatcatctccctagcggctgaggctaagggactgaccctgagttgcgagattcaggagggggtgcctgagcgggtcttgggggattcggtgcgcatcaagcaggtattgcttaatctgctctccaacgccttaaaatttacccagcaagggtttattcgtttgtcgctgacggttgagggcgcggagggggcgcagcagctctgttatgcggtcagtgatagtggcatgggcatacccgattaccacttggacgaggtgtttgagcggttttcccagggggatagcagcatgacccgccggtttgggggcagcggtctgggcttggcgatctgtaaaaagttggttattttgatgcaagggcagatccaggttagcagtcaggtggacgttggggccatctttcagattcgtttaccgttacgtgcggcggcgttggcccctgcgtcgtcccagcagcaggtgaagcgccgtttgaaccaaggggttagggtactgcttgctgaagatgccgttgataatcgcatgctcatacaggcctatttgcgcaattccccccatgatttagtgatggtggaggatggtcaacaggctctacagcttatagaagaggggactgattttaacctgattctcatggatgtgcagatgccggtgatggatggctatagtgccacccgcgccattttggcagagttgggggcccaacagcggcccccttgccccattgtggctttaacggcccatgcgttggagggggaccaagcgcgtagtttgcaggcgggttgtgtggcgcatttgaccaagccaatcaaaaagaaaattttgttagaggccatc

SEQ ID NO: 33865 - DNA, 12981 bp, magnetite-containing magnetic coccus
atgcggccaccatggcgcagttgtcggccattgatcaggatcactggagcgctgacctacggtgcgggtttgaaagatgccgctgcggcgctggaagccaataccaacagctatgtgacgggcagctatgtggtttcgatcaccgatgcggccaccatggcgcagctgtcggccattgatcaggacaccactggagcactgacctacggtgcaggtttgaaagataccgctgcggcgctggaagccaataccaacagctatgtgacgggcaactatgtggtttcgatcaccgatgcggccaccatggcgcagttgtcggccattgatcaggataccaccggagcgctgacctacggtgcgggtctgaaggatggtgtagcagcgctggaagccaataccaacagctatgtgacgggcagctatgcggtctccatcaccgatgtggtgaccatggcgcagttgtcggccattgatcaggataccaccggtaccctgagctatggtgcaggcttgaaggatggtgcagcggccctagccgccaacaccaacagctacattacgggcagctatgttgtctccgttaccgatgcggccaccatggcgcaactttcggtcatggataccgccaccagcggcaccctgacctacggtgcgggcttgaaggacggtgttgcggcactggatgccaataccaacagctacgtgaccggttcttacctcgtttccatcaccgatgcggccaccatggcgcagttgtcggccattgatcaggataccactggagcgctgacctacggtgcgggtttgaaagatgccgctgcggcgctggaagccaataccaacagctatgtgacgggcagctatgtggtctccatcaccgatgcggccaccatggcgcagctgtcggccattgatcaggacaccactggagcactgacctacggtgcaggtttgaaagatgccgctgcggcgctggaagccaataccaacagctatgtgacgggcagctatgcggcctcgatcaccgatgcggctaccatggcgcagttgtcggccattgatcaggataccaccggagcgctgacctacggtgcgggtttgaaagatgccgctgcggcgctggaagccaataccaacagctatgtgacgggcagctatgcggtctccatcaccgatgtggtgaccatggcgcagttgtcggccattgatcaggataccaccggtaccctgagctatggtgcaggcttgaaggatggtgcagcggccctagccgccaacaccaacagctacattacgggcagctatgttgtctccgttaccgatgcggccaccatggcgcaactttcggtcatggataccgccaccagcggcaccctgacctacggtgcgggcttgaaggacggtgttgcggcactggatgccaataccaacagctacgtgaccggttcttacctcgtttcgatcaccgatgcggccaccatggcgcagttgtcggccattgatcaggataccactggagcgctgacctacggtgcgggtttgaaagatgccgctgcggcgctggaagccaataccaacagctatgtgacgggcagctatgtggtctccatcaccgatgcggccaccatggcgcagctgtcggccattgatcaggacaccactggagcactgacctacggtgcaggtttgaaagatgccgctgcggcgctggaagccaataccaacagctatgtgacgggcagttatgtggtttcgatcaccgatgcggccaccatggcgcagttgtcggccattgatcaggataccaccggagcgctgacctacggtgcgggtctgaaggatggggtagcagcgctggatgccaataccaacagctatgtgacgggcagctatgcggtctccatcaccgatgtggtgaccatggcgcagttgtcggccattgatcaggataccaccggtaccctgagctatggtgcaggcttgaaggatggtgcagcggccctagccgccaacaccaacagctacattacgggcagctatgttgtctccgttaccgatgcggccaccatggcgcaactttcggtcatggataccgccaccagcggcaccctgacctacggtgcgggcttgaaggacggtgttgcggcactggatgccaataccaacagctacgtgaccggttcttacctcgtttcgatcaccgatgcggccaccatggcgcagttgtcggccattgatcaggacaccaccggagcgctgacctacggtgcgggcttgaaagatgccgctgcggcgctggtagccaataccaacagctacgtgacgggcagctatgtggtttcgatcaccgatgcggccaccatggcgcagctgtcggccattgatcaggataccaccggtgcgttgacctacggtgcgggtttgaaagatgccgttgcggcgctggaagccaataccaacagctatgtgacgggtagctatgtggtttcgatcaccgatgcggctaccatggcgcagttgtcggccattgatcaggataccaccggagcgctgacctacggtgcgggtctgaaggatggtgtagcagcgctggatgccaataccaacagctatgtgacgggcagctatgcggtctccatcaccgatgtggtgacgatggcgcagttgtcggccattgatcaggataccagcggtaccctgagctatggtgcaggcttgaaggatggtgcagcggccctagccgccaacaccaacagctacattacgggcagctatgtggtctccgttaccgatgcggccaccatggcgcaactttcggtcatggataccgccaccagcggcaccctgacctacggtgcgggcttgaaggacggtgttgcggcactggatgccaataccaacagctacgtgaccggttcttacctcgtttcgatcaccgatgcggccaccatggcgcagttgtcggccattgatcaggataccactggagcgctgacctacggtgcgggcttgaaggatagcgttgcggccctggaagccaacaccaacagctacgtgacaggttcttacctcgtttccatcaccgatgcggccaccatggcgcagctgtcggccattgatcaggataccaccggagcgctgacctacggtgcaggtttgaaagataccgctgcggcgctggaagccaataccaatagctatgtgacgggcagctatgttgtctccatcaccgatgcggctaccatggcgcagttgtcggccattgatcaggatacctctggagcgctgacctacggtgcgggtctgaaggatggggtagcagcgctggatgccaataccaacagctatgtgacgggcagctatgcggtctccatcaccgatgtggtgacgatggcacagctgtcggccattgatcaggataccaccggtaccctgagctatggtgcaggcttgaaggatggtgcagcggccctagccgccaacaccaacagctacattacgggcagctatgtggtctccgttaccgatgcggccaccatggcgcaactttcggtcatggataccgccaccagcggcaccctgacctacggtgcgggcttgaaggacggtgttgcggcactggatgccaataccaacagctacgtgaccggttcttacctcgtttccatcaccgatgcggccaccatggcgcagttgtcggccattgatcaggacaccaccggagcgctgacctacggtgcgggcttgaaagatgccgctgcggcgctggtagccaataccaacagctacgtgacgggcagctatgtggtttcgatcaccgatgcggccaccatggcgcagctgtcggccattgatcaggataccaccggtgcgttgacctacggtgcgggtttgaaagatgccgctgcggcgctggaagccaataccaacagctatgtgacgggcagctatgtggtttcgatcaccgatgcggccaccatggcgcagttgtcggccattgatcaggataccaccggagcgctgacctacggtgcgggtctgaaggatggggtagcagcgctggatgccaataccaacagctatgtgacgggcagctatgcggtctccatcaccgatgtggtgaccatggcgcagttgtcggccattgatcaggataccaccggtaccctgagctatggtgcaggcttgaaggatggtgcagcggccctcgccgccaacaccaatagctacattacgggcagctatgtggtctccgttaccgatgcggccaccatggcgcaactttcggtcatggataccgccaccagcggcaccctaagctacggtgcgggcttgaaggacggtgttgcggcactggatgccaataccaacagctacgtgaccggttcttacctcgtttccatcaccgatgcggccaccatggcgcagttgtcggccattgatcaggataccactggagcgctgacctacggtgcgggcttgaaggatagcgttgcggccctggaagccaacaccaacagctacgtgacaggttcttacctcgtttccatcaccgatgcggccaccatggcgcagttgtcggccattgatcaggataccaccggagcgctgacctacggtgcgggcttgaaggatagcgttgcagcgctggatgccaataccaacagctatgtgacgggcagctatgcggtctccatcaccgatgtggtgaccatggcgcagctgtcggccattgatcaggataccaccggtaccctgagctacggtgcgggtctgaaggatggtgcagcggccctcgccgccaacaccaacagctacatcacgggcagctatgtggtctccgttaccgatgcggccaccatggcgcaactttcggtcatggataccgccaccagcggcaccctaagctacggtgcgggcttgaaggacggtgttgcggcactggatgccaataccaacagctacgtgaccggttcttacctcgtttccatcaccgatgcggccaccatggcgcagttgtcggccattgatcaggataccaccggagcgctgacttacggtgcgggcttgaaggatagcgttgcggcgctggaagccaataccaacagctatgtgacgggcagctatgtggtttcgatcaccgatgcggccaccatggcgcagctgtcggccattgatcaggataccaccggtgcgttgacctacggtgcgggtctgaaagatgccgctgcggccctggaagccaataccaacagctacgtgacgggtagttatgtggtctccatcaccgatgcggccaccatggcgcagttgtcggccattgatcaggataccaccggagcgctgacctacggtgcgggtttgaaagatgccgctgcggcgctggaagccaataccaacagctatgtgacgggtagctatgcggtctcgataaccgatgcggccaccatggcgcagctgtcggccattgatcaggataccacgggtgcgctgacctacggtgcgggcttgaaggatggggtagcggcgcttgatgccaacaccaacagctacgtgacgggcagctatgtggtttcgatcaccgatgcggccaccatggcgcagctgtcggccattgatcaggataccaccggtgcgttgacctacggtgcaggtctgaaagatggcgtcgcggcgctggaagccaataccaacagctatgtgaccggttcttacctcgtttccatcaccgatgtggtgaccatggcgcagttgtcggccattgatcaggacaccaccggtaccctgacctacggtgcgggcttgaaggatagcgttgcggccctggaagccaataccaacagctatgtgacgggcagctatgtggtttcgatcaccgatgcggccaccatggcgcagctgtcggccattgatcaggacaccaccggagcgctgacctacggtgcaggtttgaaagataccgctgcggcgctggaagccaataccaacagctatgtgacgggcagctatgcggtctccatcaccgatgcggccaccatggcgcagttgtcggccattgatcaggataccaccggagcgctgacctacggtgcgggtctgaaggatagcgttgcagcgctggaagccaataccaacagctatgtgacgggcagctatgcggtctccatcaccgatgtggtgacgatggcacagctgtcggccattgatcaggataccaccggtaccctgagctatggtgcaggcttgaaggatggtgcagcggccctagccgccaacaccaatagctacattacgggcagctatgtggtctccgttaccgatgcagccaccatggcgcaactttcggtcatggataccgccaccagcggcaccctgagctacggtgcgggcttgaaggacggtgttgcggcactggatgccaataccaacagctacgtgaccggttcttacctcgtttccatcaccgatgcggccaccatggcgcagttgtcggccattgatcaggataccactggagcgctgacctacggtgcgggcttgaaagatgccgctgcggcgctggtagccaataccaacagctatgtgacgggtagctatgtggtttcgatcaccgatgcggccaccatggcgcagttgtcggccattgatcaggataccaccggtgcgttgacttacggtgcgggtttgaaagatgccgctgcggcgctggaagccaataccaacagctatgtgacgggcagttatgtggtttcgatcaccgatgcggccaccatggcgcagttgtcggccattgatcaggatacctccggagcgctgacctacggtgcgggtctgaaggatagcgttgcagcgctggaagccaataccaacagctatgtaacgggcagctatgcggtctccatcaccgatgtggtgaccatggcgcagttgtcggccattgatcaggataccaccggtaccctgagctatggtgcaggcttgaaggatggtgcagcggccctcgccgccaacaccaacagctacattacgggcagctatgtggtctccgttaccgatgcggccaccatggcgcaactttcggtcatggatatcgccaccagcggcaccctaagctacggtgcgggcttgaaggacggtgttgcggcactggatgccaataccaacagctacgtgaccggttcttacctcgtttcgatcaccgatgcggccaccatggcgcagttgtcggccattgatcaggacaccactggagcgctgacctacggtgcgggtttgaaagatgccgctgcggcgctggtagccaataccaacagctatgtgacgggtagctatgtggtttcgatcaccgatgcggccaccatggcgcagttgtcggccattgatcaggacaccactggagcactgacctacggtgcaggtttgaaagatgccgttgcggccctggaagccaataccaacagctatgtgacgggcagctatgtggtttcgatcaccgatgcggccaccatggcgcagttgtcggccattgatcaggataccaccggagcgctgacctacggtgccggtctgaaggatagcgttgcagcgctggatgccaataccaacagctatgtgacaggcagctatgcggtctccatcaccgatgtggtgaccatggcgcagttgtcggccattgatcaggataccaccggtaccctgagctacggtgcgggcttgaaggatggtgcagcggccctcgccgccaacaccaacagctacattacgggcagctatgtggtctccgttaccgatgcggccaccatggcgcaactttcggtcatggataccgccaccagcggcaccctgacctacggtgcgggcttgaaagacagcgttgcggcactggatgccaataccaacagctacgtgacgggcagctatctggtatccatcaccgatgcggccaccatggcgcagttgtcggccattgatcaggatacctccggagcgctgacctacggtgcgggcttgaaagatgccgctgcggcgctggtagccaataccaacagctatgtgacgggtagctatgtggtttcgatcaccgatgcggccaccatggcgcagttgtcggccattgatcaggataccaccggagcactgacctacggtgcaggtttgaaagatgccgttgcggccctggaagccaataccaacagctatgtgacgggcagctatgtggtttcgatcaccgatgcggccaccatggcgcagttgtcggccattgatcaggataccaccggagcgctgacctacggtgccggtctgaaggatagcgttgcagcgctggatgccaataccaacagctatgtgacaggcagctatgcggtctccatcaccgatgtggtgaccatggcgcagttgtcggccattgatcaggaaaccaccggtaccctgagctacggtgcgggcttgaaggatggtgcagcggccctcgccgccaacaccaacagctacattacgggcagctatgtggtctccgttaccgatgcggccaccatggcgcaacttttggtcatggattccgccaccagcggcaccctgacctacggtgcgggcttgaaagacagcgttgcggcactggatgccaataccaacagctacgtgacgggcagctatgtggtatccatcaccgatgcggccaccatggcgcagttgtcggccattgatcaggataccaccggagcgctgacctacggtgcgggcttgaaagatgccgctgcggcgctggtagccaacaccaacagctatgtgacgggtagctatgtggtatccatcaccgatgcggccaccatggcgcagttgtcggccattgatcaggataccaccggagcgctgacttacggtgcgggtttgaaagatgccgctgcggcgctggaagccaataccaacagctatgtgacgggcagctatgcggtctccatcaccgatgcggccaccatggcgcagctgtcggccattgatcaggataccaccggtgcgttgacctacggtgcgggtttgaaagatgccgctgcggcgctggaagccaataccaacagctatgtgacgggcagctatgcggtctccatcaccgatgcggccaccatggcgcagttgtcggccattgatcaggataccaccggtaccctgagctatggtgcgggtttgaaggatggtgcagcggccctagccgccaacaccaacagctacattacgggcagctatgtggtctccgttaccgacgtggccaccatggcgcagctctctgccatggatacggccactaccggcaccctgacctacggggcaggcttgaaggatagtgccgctgccttggtcgccaataccaacagctatgtgactggggctgtaacggttacagttacggatgcagcgaccacggctcagctgggtgcaattgaccaagataccacgggtactgtgaactacagcttggcaggtattaaggatacggtttccaatatcaccatcgactctggtaactatgttgccaatgcgggtggggccacgatcacggtaaatgatggtatcgctaacctgattacggacgccggtacagtcgttaccggaacccgcaatgttacggtaacggatgcagcctccatggcgcagctgtcgcaaattgacaactacaccacaggtgctctgaaatatgtcacgattaaggatgcggtggcggccctggttgctaataccaatagctatgtgacaggttcctatgctgtatcggtgacggatgccgccagcatggcgcaattgtcggctattgatcaggataccaccggtaccctgacctatacaaaactgaccgatgcggtagcgaatttggtaaccaacaccaacagctatgtaaccgggtctgtcaatgtcacggtgtcggatattgcgaccatcagccaactctcaagcattgatgcgaacactacaggttctgtgacctacacccaaattggtgatgccgcagcaaccttggcaaccaatgctggcaactatgtcaaagcaacaatccatgtcacggtgacggatgctgcgacgattgcgcaattgacaaccattgatggggataataccacagggtcgttggtctacacggcgggtggggtgaaagatagcgcggctaatttggtggttaataccaacagctacgtgacaggggccgtcaatgtttcggtaacggatacggtctccatcgctcagttgtccgctgtcgatgagtacaccaccggtacattgacctacggggccggtgtgaaggattcggtggccaacctgttggtcaataccaacagctatgtcacgggttcttatgcggtctcgatcaccgatgtcgccagcatggcgaatttgtcggcgatcgaccagtttaccacgggcacgcttaactatacgaagctgagcgacacggtgtcggctttggttgccaataccaacagctatgtgactggctcggttaatgtgaccattactgacaatgccagcatggccaacatgtcggcgattgatcaaaacaccacgggcacattgacctataccaaactcagcgataccgccgctgctttggcggccaataccaacagctatgtaaccggttcggtcaatgtaaccgtgacggataatgccacggtcgctcagttgaccaccgtggatgcggctacgacggggaccattaaggtcgccagcgtggtggatagtggctcaaatatctccagcaacttcgcctacgtggatggcttgggtgtgagctatgtaaacgccaacgataacgtcatggccgtgactgtggctcaggcgacggatgccacggtaaccatagccgatgatgacgtgctcaccatcaccgacacctccagtaacatccagggttcgacctttagcgctttggtgactgcgggtgctgacgcgacctacctggatgcgacggatgacatattgacggtaacagccgcacaagcggccaccaccaatatcaactttaccgccgcagatgtggttacggtgagcgacaccgggtccaacattcagaccaacatcaccacgattttggccaaagatgtggataagttgagtgcctcttcggcgctggatcttaccgatagtgatgtaaccggcaaaacggtggacttctctggtgttggggatacaaccattaccatggcctacgatagttccaacgtagccttcggtagcctgacttcaacgggtggtggtgagctgattctgtcggttacaggtacgggtaccttggcaacggtgacgggcctatcaaacttcaatcaactgtctgcggccagtgacttgaccatcgactctgctcaggtggcgggccaaacgttggatatgagtggtgctggtaatgtcaccgtctcgttggcttcggcgaccacggccagctacagtagtttgacatccacgggggcgggcaccttgggtctgcaaattggttcaaccggaacctatacttcggttacgggttgggaggtgtttgatagcattaccagcgattatgcgatcacggttgcggcctcggccgttaccggaaaaacggtggcctttagtggtactggcgcggtcaccattgatggtgcgagcagcagcaatgcaaccttcctaaacgtgacccatgattcaggcacctcgggtgatttgatcttggcggttagcagcagcacgggttcggctgtgtttagctcgggtgcggctaactttgataaggtttcggtggatggtaccctctacaccggtatcaccagtgccaatggtcagattattgtcaacggttccacaagtgtggctgcggggatttcgggtacggcgtacaccgactttatcgtgaactatgataccgacagcttgggaacaacctatgcttcaacccaaggtttgttgggtggtgccggtgacgaccgcttgattgataccaccagcagcggtgtgttgctggcaggtgaggctggagacgacacgctaaccggtggtgctggaaatgacatcttctaccatgatggttccagccatggtttggataccattaccgacttcgcatcaggggatctgttgcaaattgcttcgggcaatgcaggtcagtggacgctggattctaccggtcaagcgctgaccaaggcgaccaacagcagcctgggctttaactttaacagtggtaatgacctgaatgatgcgacctatgatcttcagttcaacggtgccagtgatgcagcgggtcatatcatgacctttgacttggatacggatgctgatcatacggtggccggttcttcgtatgcagatctgatggttaactttagcagtggtaccaccgatggttacaccatgagtggtggtagcggtaacgaccgtttgatcgactacaacgatagtgcctctacctacatgacgggtggtagtggtcaggataactttgtcttcaacgagaacaccaccggtttgacagcgggtgactacacgctggcgacaggcaatgcagatatcattaccgattggtcggtggatgacttcttcatctgggcttcgagcaacctgattgcgggtggtgtaacagcaaacggagctgcggcaaccaagacctacttggatgcttcggttgcgggtggtagcgatgggtatgatgagagcgcctctgcacacatctacatcctgcgcgatgccaacaacgtcgcaaccagcggggatggaacagtggcagatgcccaagccacgattgacgccatcaacggggctacctcggatggtacctttaatgcggcgagtgccagtgatgtgctgctgtttgcggtctatgacagcacgaccaccgacacccatgtttggttggcgagtgttggtgctaaccagacgttggatgtggcagacatgaccatggtggccactttgcaagatacgaacatcacagcgactggtgttatgtacacagccaactttgcgtaa

SEQ ID NO: 33866 - DNA, 1950 bp, magnetite-containing magnetic coccus
aagattcttatcgccaaccggggcgaaattgcctgccgcgtgatcaaaaccgcacgccgcatgggtattcaaaccgttgctgtttactcggatgccgatcgtgaggcgctccatgtgcgcatggcggacgaggcttattatattggcccatcaccaagtaaccagtcctatctggttatggataaattgttggaggttattaagcagtgcggggcggatggtgtacacccagggtatggatttttatctgaaaattcgactttttgccgccgattacaggagatgggggttatttttattggtcctaatcccacggcgattgatgccatgggggataaaatcagctcgaaaaagctggcgcaagcggccaacgtcaacaccattccgggccatatgggcattattgagaatgccgacgaggcggtgcgtattgccgctgagattggttatccggtgatgcttaaggccagtgcgggtgggggtggcaagggcatgcgcattgcccacaatgacgccgaggcagccgagggttggcagagtgccaccaatgaggggctctcctattttggtgatgggcgggtttttattgagaagtttattgagaacccccgtcacattgagattcaggttttgtgtgatggtcatggtaatggggtttatttaaacgagcgcgagtgttcgatccagcgtcgcaaccagaaggtgattgaggaggctccatcaccctttgtggatgcggatatgcgtagggcgatgggtgagcaagcgttggcattggcgcaggcggtggattatgtctctgcgggtaccattgagtttgtggtgggtgcggacaagggtttttattttctggagatgaacacccgtttgcaggtggagcatccggtgacggagtttataaccgggttggatttggtggagcagatgatacgggttgcccgtggcgagcggctgtcgatcacccaggatcaggtgttgttgaagggttggtcgatggagagccgggtttatgcggagaatccttatcgtaattttctgccgtcggtggggcgtttggtgcgctatgagccccccctcgaaagtgcccatgtacgggtggacacgggggtatttgctgggggtgaggtgacacttttttatgatccgatgattgccaagttgatcacttggggccaggatcgtggggaagcgattgagcatatgcgtgaggcgttggatagctatttgattgagggtccggggcataacattgactttttgaatgcggttttacggcatcctcgctttgtaagtggcaacatttccacggcgtttatcgcggaggagtatcctgagggttttgagggtgcgcctttgagcgggatggataggcagttgtttgcggttgcggcggcctatattgagcagcaggcgcaggcgttattgatggacctgggggtcgagaagtcttgggtagtgagtgttgatgaggaggttttacccctgatttttagggaggttgaggggggggatgaggttgagtttggggatggttcgcggtttggggtgagtggtgttgtacggcctggggcgaagaaggttacgttaaccatagctgggcaggtatgcacgtttggtgttgtgcggggtgaggaggggtaccatttaacgcggggtgggcgtcaggtaggggtttatgtgcgcacaccgcgtcagcatcaattggcgcagaggatgccggttaaggttgctccagacacctctaagatgttgataacgcccatgccgggcttggttttaaagattatcgttgaggttggggattgcgtttcggcgggggatccagtgtgtgtgttggaggcgatgaagatggagaacatcatgcgggttgagcgtgatggtgtggtaggggcgatttttgccaagccggggcaggcggtggagtcggacagcattatcatgacctttgag

SEQ ID NO: 33867 - DNA, 1572 bp, magnetite-containing magnetic coccus
aaggatttagagcggcgcctgcgtaccaccacagagcgggcggaatctgccagccgtgccaagagtgattttttggcggtcattagccatgagattcgcaccccgctcaatgccatcatcggcatgggcgaggtattgctggatgaccctttaaccaccgagcaaaaacactatgccatggtctctcagcaggcggcgcatacgcttttggatttgatcaacgatgtgctggatctctctaagattgaagccggtgaatttcaactggaacacgcaccgtatgacctagtgggtcttattcacagcgtcgtggaagtcaacaccattaccgccaaccagcagggcttgcccattgagtgcaacctacccgacactttgcccacccttatgcatggcgacctcaggcgcgttcggcaagtgctgtttaacctgctgggcaacgccattaaatttaccgaacaggggcttattcgtgttgaaaccgagcggttagaaacgccggtggccagttggatccgtatctcggtgaaggatactggtattggcatcgcccaagagaagcaatccctaatttttgatgcgttcacccaatccgatggctccatcacccgccgttatgggggcagtggtttggggcttaccatctctaagcgcttggtggagatgatggggggtaaaattggggttgatagtcagttgggtaaaggtagccacttctttttcaccctgcctgtcaccgccagatgggatgtactggaacccctatacccgccccccgccaccctcttacagcagcagcgaattttactgatacacagcgatgtagaaaaccgcgaccgcatgcaaacgctgcttgagcaggcgggtgcaaccgttattctagggggagattgtcgccaacccacggcctgtttggcccagttggacgcatcgctggatggtatcgtcatgaactgcggtaccctcaatagcgccggcttaaaccatttggaacaacacctggcccactatcccaagctggccaaacgcacggttattctaaccaacaaagtcaggggttccctgctggaccgcaccacaccattgggcatacactaccttaacactccggttcaagctgagcagatctatccgttattaaagggcatttctgacacatcatccctctaccagaccccattcgtggggcataccgagggagcaacacccctacttacccaggcaaacgtgttggtggtggaggatagcgaagacaatcggctgctgattcgcacctatcttaaaaaatctccgtatattctagatttcgccagtaacggtctagaagccatcgaaaagtggcaacaaaaccactatgatctggtattaatggatatccagatgccgctcatggacggtttaaccgccacacgccacattcgcaagcaggagcggcgtgagcagcggccacacacccctattgtggctttaaccgcccacgccatggccagtgaccatcaaaatgccatggcggcgggttgcgatgattttttgaccaaaccgattaagcgagacacccttttcaaagcgcta

SEQ ID NO: 33868 - DNA, 666 bp, magnetite-containing magnetic coccus
cgcattcaacgcaacgtgcgccgcgatgacggcacactggaaaccaaatgggacgagttccaggtcaaggccacccctttgacccccgttctcaacctgctagaagatgttaaaggcaatcaggacggctcactcactttccgtcagtcctgtcgttcggccatctgcggctcttgcgccatgcgcattggtggcaaaacccgtctggcctgtaaaacccagattggtgaagtggtggacgaaaataacaccgtgcaaattgccccccagcaaaactcgccggtgctcaaggatttggtggtggacatcaccaaatttttcaacaaagtgcatcagatcaaaccctacctacaagagggggctgagagcgcaaccgaggtcaatgataccgcctttgatcaggttaaccatgtgacccagtgcatcatgtgcgcctgctgcttctccgactgcaccatggccgaggtctccgatgcgtttatcggtccagcggcgctggcgaaggcgttccggtttgtctccgacccccgcgaggggaacaaacgggagcggctgcgggtgctctcgcaagatcacggcatctggtcctgttcgcgctgcaccatgtgcgtgatggtctgccccaaggatgttaaacccatggaggccatcgtcaagctacgtacc

SEQ ID NO: 33869 - DNA, 1686 bp, magnetite-containing magnetic coccus
atgtacaagcacgacctgattattgtcggtgcgggattggcaggcatgcgggccgctgttgaagcggtcaaagcgggggttgacgttgccgtcatctccaaagtgcaccccttacgcagccactcctgcgcagcccaagggggcattaacgcagccattaaccccaaagactcctgggaatcccacgcctacgataccgtaaaagggtccgattttatcggtgatgaggatgccattgaactgatgtgccaagaggcccccaattcggtgctggaaatggaccgtatgggcacccccttctcccgtctggaagatggcttgattgcgcaacgcccctttggggccgccagcttcgaccgcacctgctacgccgccgaccgcaccgggcaagtgctgctgcataccctgtgggagcagttggtcaaggctggggtgcgggtctacgaagagtgccagatcctgaaaatctccaatgtggatggccgcatcgccggtgtcgtggcctacgatattaaaaagggtgaggtgtttggtgtgcaagccaaagtcaccctgctctgcaccggtggttatgggcgggtgttcctcaccagcaccaatgccaccgccagcactggcgatggtatggccctggcctaccgggccggtgccagcctgtgcgatatggagtttgtgcagtttcaccccaccggcctacgctactccggcattctggtcacggaaggggcccgtggtgaagggggctatctcatcaataaagatggcgaccgcttcatgaccaaatacgcccccaataagctggagctggcctcccgcgatgtggtttcccgggcggaacagaccgaaattcttgaagggcgcggggtggatggtgccatcttcttggatctgcgccacttgggtgcgcaaaaaattaatgagcgcctgccacaggttcgccaactggcccgtgacctagagggggtcgatccagtctatacccccattccagtacgccccaccgcccactattccatgggtggcattcgtaccaataagtatggtgaaaccatcctgcccggcctgtgggccgcaggtgagtcggcctgtgtctccgtacacggtgccaaccgcttggggggcaactcgctgttggataccattgtgtttggctacatcgccggtcgtgaactgggtgccaagcttggctccatggagatgccgaccctgcccgcaagcgaagttcaggcggttaaggataacattgcccagctggtcgaccgtcctaacaagggggtgcgcccggcctcgatccgtgaacgcttgggtgagtccatgaacgcctatgtcagcgtcttccgtcacccagataacattcaaaaggcggcggatcttatccccaccctgcgccaagatctcaccaccatgcacttggatgacaaatccaaagtgtttaatgtcgatctgctgcgggctatggagatgcaaaacttggtggatctggccgagaccatcatcgctggtgccatcaaccgcaccgagtcccggggtgcccactctcgtgttgacttccccgaacgggatgacgagaactggcgtaagcacaccataaccaagtgggataacgatgcccagaccaccgccttctcttatgaagcggtacgtaccgtgggcaaagatgcctataaactcgcggtgcggtcttac

SEQ ID NO: 33870 - DNA, 1812 bp, magnetite-containing magnetic coccus
ttgaacgggttttttaaaaacctctccctgtggctggttatcggccttcttatggtcatgctgtttaatctgtttaacagcccccaaggaccagggcagagcatcacattttccgatttttctgaaatggtcgcccaaggcaaggtaacagcagttacccttgaagggcgtacggtacgcgggctttcgaccgatggtagccctttttcatcgcgcgtgccggataactacgatcttaccaaggatctgctggcccatggggtggatattgacgtgcgggagcccgaaggcacccccatgttgatgcaaattttaattagctggttccccatgctgctgctcattgcggtgtggatctacttcatgcggcaaatgcagtccggcggtggacgtggggcgatgtcctttggcaaatccaaagccaagctcatgtccgataaggcggcgaaagtaacctttcaggacgtggcgggcattgaagaggccaaagaggagctgcaagaagtggtgcagtttcttaaagatcctcataaattccaacggcttggtggtaaaattccaaagggtgtgctgctggtgggtcctccgggtaccggtaaaacactgctggcgcgtgccatcgctggcgaggccaacgtgcccttctttaacctctctggttccgattttgtggagatgtttgtgggggtgggtgcggcccgtgtgcgggatatgtttgagcaaggcaaaaaaaatgcgccgtgcatcatctttattgatgaaattgatgccgttggtcgccaccggggtgccgggttgggcggggggcacgatgagcgggagcagaccctcaaccagctattggtggagatggatggttttgaatcgactgagggtgtgatcatggtcgcggccaccaaccgccccgacgtgttggatcctgcactgctcaggcccggtcgttttgaccgtcaggtgacggtgcctaaccccgatattttgggccgcacccagatccttaaagtgcacatgaacaaagtacccctgtcggactcggtggatgccgaggtgatcgcccgcgcgacccccggtttctctggggccgatctggccaacttggtcaatgaagccgccctgattgccgcccagttggataaacgggtggtggagatggaggattttgagaacgccaaggataaggtcatgatgggtaaaccgcgtcgaagcgcggttatttcagaaaaagagcgcaagacaacagcctatcacgaagccgggcatgcggtggtggccatggcactggacggggcagaccccgtgcataaagtgaccatcatcccccgtggtcgcgctttgggcctgaccatgcaactaccgttggaagatcgctacacctactccaaggtgcagctagaacaaaatatcgccatcttaatgggggggcgtctggcagaagagttggtgctcaatcagctcaccaccggggcgggcaatgatatccaacgggctaccgatctggcccgtaagatgatctgctcctatggtatgagtgacaccttgggtccccttacttatggtgaaaatgaacaagagattttcctcggtcgggagatcacgcagcacaaaagcgtatcggaagagacagctcggcgcattgatgcagaggtatttgacatcgttgatcgcaattacaaaagagccaaacagatcttgaccgataaaatggaggtgctgcacaccatggcccaggcactgttggagcgcgaaaccattgatgcggatgaggtgattaagctcatggcaggcgagcctgccgagaccgctttaaagcct

SEQ ID NO: 33871 - DNA, 2469 bp, magnetite-containing magnetic coccus
ctgcccattgtggccactttgcaaccgctgcaagcggccttgctgcgccatcccaatgttatccttagcgccccgccgggctccggcaaaaccacggtggtgcccttggctctgttggatgccccctggttggccggagagcgcatccttatgttggaacctcgacgactggcggcgcgggccgctgccagccgcatggccgagctgttgcaggagccggtgggggagcgggtgggctatcagattcgctttgagcgcaaggtggggccaaacacccgcgtcgaggtggtgacagagggcatgctcacccgccgcctacagtccgaccccgccttgcagggggtgggggcgattctgtttgatgagtttcacgaacgctccttgcagggtgatctggggttggcgctggcgttggagctgcaacagctgcgtgacgacctgcgcctcttggtgatgtcggccaccctggagagccagcgcttggccaagctgttgggggatgcccccattatagaagggcatggacgtagttacccggtgcaggtgcgctatgccagccaaccctatgcccatgtggtggagggggtggtgcagaccattcgtcaggcgttggcccaggagcggggggatctgctcgcctttttgccgggggcgggggagatccgccgggtggaggccgctttgcggtcaggcttgcccgatgatgtgaccctattgccgctttatggcgagttgggtatgcaggcccaagatcgtgccgtgcgcccctggttggagggaggacggcgggtgatcttggcaacggatattgccgagaccagtctgaccattccgggcattcgggtggtggtggatggggggttgtgtaaacgtccgcgttttcatgccagcagtggtttgacccggttagagcggctgcgcatctccgatgcctcggcacaacagcgggccggacgggcagggcggctggagccgggggtctgttaccgtatttggccagaatcgcaacagcgcatgctgcaaccggcgacccctgcggagatacgtgaggccgatctggctccgctgctgctggagttggccctatggggggtggcagatccgacgcaaatgagctggctggaccccccgccggaaggggcggtagcgcagggttgggcgctgttggtggcgctgggcgcggtggatgaagcacggcatatcacccccttagggcgacagatggcccaactgccgttgcatccgcgtttggcccatatggtgtgtatggccccagagcccgcagcccaggccatggcctgtgatgtggcggcgctgctcagtgaacgagatcctctgaaaggaggggcgcgccaggtggatctgcacctgcgttggcaaagtgtggcgcagtttcggcgtcaggggagcgctgggccgggggtggatgcggccagcctacagcggattgtgcggggggcggaccagctacgccatctattgggggtgagccgtcagcaggtggcccatggtgatctggggctgctgttggcggcggcctaccccgaccgggtggcgcagttgcggccagggcagcgggggcgctatctgctggcgagcgggcgtggggtgcggttggatgagatggaccccttgagtggtgagccgctgctggtggtggccgcgctggatgccggtgaagcggagggacgggcctatttggcggtctctttggcgcaagaggccttcatggcgcttcagccgccggcgtggcaggcgcaggtggtgtggtctgaccagcagcagcgggtggtggcagagcgccagcgctgttttggcgcgttggtactggagcggcaacccctgcatggcgaggcccccgaggctgcggtgttggcggccatgttggtgggggtgcggcgcatggggctggcggtgttgccctggacgccagcggccatgcagtatcaagccagggtgcagttgatggcgcgtcttgagtcgggctggccgttgttggaagaggctgtgctgctggaacagttggagcagtggttggccccttttctacgtggggtgaatcggcgggcacagttggagcgcctgaatatgttggagattttgcaaagtcaattaacgtggtcccagcagcagagcttggaacaggcgctaccgacgcactatgaggtgcccagcggttcccgcattaaattggattatacggcaggggcgcagccggtattggcggtgcgcattcaagagctgtttggtttggccgagagcccgtgtcttggccaggggcgggtgccggttacgttgcatctgctcaatcctgcccagcgtccggtgcaagtgaccagcgatctgcgcggattttggcagaccacctggccccaggtgcgcaaggagctacgtggacgctatcccaaacatcactggccagaaaacccctggcaggcccaagccaccgcccgcgccaaaccccggagt

SEQ ID NO: 33872 - DNA, 876 bp, magnetite-containing magnetic coccus
gctctggtaacaggtggtgctggttttatcggtagccatctctgcgaaatgctccttgagcagggccacaccgtgcgcgccttggataatttttccaccggacgccgggccaatgtggcgcacctcatcaaccaccccaagtttaccctctacgaaggggatattcgcgatcctgaaacgctggtaacgccgtttcagggggtggagtgggtttttcatctggcggggctggcggatattgtgccctcggtagagaaccccacgacctattttgaggtcaatgtgcacggcaccctcaatgtgctggagtttgcccgccgcaaccaagccaagcggctggtttatgcggcttcttcctcctcctatggcattcccgagctctatcccaccccggaagagagccccattcagccccaatacccctacgccctaaccaaatatatgggtgaagagctggtgctacactgggccaatgtctataaaatgcccaacctctccttgcgtatgtttaatgtttatggtccgcgctcccgtaccaccggggcctatggtgcggtctttggggtcttcttggcgcaacgtttaaacaacaaaccctatacggtggtcggggatggccaacagagccgcgactttacctatgtaaccgatgtgtgtgcggccttttatgcggcggcccagtcgacgtgggtaggcgaagcctttaatgtgggcagtggcggccaccagaccatcaaccgcttggtggagctactggggggcgagatcacctatattcccaaacgcccaggcgagcccgattgcacctttgccgatacccgtaaaatccacgccaagctcaactggcaagcccaggttagctttgagcagggggtg

SEQ ID NO: 33873 - DNA, 1730 bp, magnetite-containing magnetic coccus
ctggatgaccgcgcccgtcatctacggcggctggtactgcgtgccttggacaagggaggtcgtggccaccctggttctgccatgtcgctgatggagctgctgcgggtgctttacgacgatgtgctcaatatcgacccccacaatcccctgtggcaagatcgggaccgttgcatcctctccaaggggcatggctgtttggccctctatgccctgctggccgacaaagggttttttcccgttgcagagctggatcgcttttgccagctggagagtcgcttggggggacatccagaacggcatgttctgcctggggtggaagcctccacgggggccttggggcatggtctctccctggcggcgggcatggccctagccgccaagttaaagggggcaagctggcgggtctttgccttaatgggggatggtgagatcaatgagggctcggtatgggaggccgccctgtttgccgccaaacaccagctcaacaatctggtggcggtgatcgactataacaagttgcaatcctacggccccatctctgcggtgcaggggttggagccgctggcggataagtggcgcgccttcggttttggcgtgcaggaggtggatgggcacgatgtgggcgcactgcgacactgctttacccagctcacgccggaccagcccaatctggtgattgcccatacggtaaagggcaagggtattcccgaggccgaggataaccccagttggcaccataaatcctccctcaaacccgctgaaatggaaagcctctaccaagcgctggcctaacctgcgaacaggaaaccataaccatgcgacgccgctgtttagatgaagtttttgccctggcgcaacaggatgcgcgggtgctgttcatgggttcggacttaggcgcaggcacgctggagaccatgcgccaagcctgcccccggcagttttttatggagggcattgccgaacagaatctgattggtgttgccgcaggtttggcgctggagggttatctgccctacgtcaacaccattgccacctttttaacccgccgtgcattggaacagattgccatagatgtggccctgcacaagctgccggtgcggctgattggcaatggcggcggcatggtctatgcaccgctaggccccacccacaccaccttggaggatgtcgccctcatgcgggcgctgcccaacatgacggtgctggccccttgtgatgccgacgagatgcagcggctcatggggcagaccttggcatggcccggccccatctatattcgcttggccaaagggggggatgcggtggtctcccgcgaggagctgccctgtaccataggcaaggcgattcccctgctctatgggcgggatgtgcttattatcagttatggtatcatggtgcagcgggcgcttacggcggcccacgcgctggcccaggagggcattgagtgcagcgtgctcaacatgcacaccctaaaaccgctggatgaagcagccattgtgcgcgaagcccaaggtaaacggctggtggtcacggtggaagagcacagccagatcggcggtttgggcagtgcggtagcccaactgctggcgacccgtgatctgctggatggcggcccacgcctacgtattctggcctttgccgatgccttttgcagcggctatggcagccaaaatcaacagattgcccaagcgggggtggatgtgttggatattcagcgcaccattaaagaa

SEQ ID NO: 33874 - DNA, 918 bp, magnetite-containing magnetic coccus
tcgccacccccagcggtgatgaggaggcttgaacgcatggagttaaaaccctaccttgcggatcgtaaatacttggtcgagagcgcccttgaccggctactacccgccgccgaccgagagcccagagccttgaccggggctatgcgctatagcctgctcatcggcggtaagcggctgcgacccatcctaaccctagcctgctgcgaagccgttgggggagccctagagcgcgcaatgaactttgcctgcgccatggagtgtgtgcatacctactcccttattcatgatgacctaccggccatggataatgacgatctacgccgaggtcaccccacctgtcaccggcaatatggtgaagccaccgccattttggctggcgatgccctgcttacccatgcctttgagctggccgccaagccggtcacaggggtattgcccgaggcacgcctagagctgattggcgaactggcgatggcagcgggaacctatggtatggtgggggggcaaatgctggacatccagggggagaaacgccccttggaactggtgcagttgcaaaacatccatatccataaaactggcgccctcatccgggttgcctgtctggccggtgcccgcttgggtgggggaacccccgatcaagttaaacaccttaaacgctatggcgaggcgttggggctggcgtttcaaatcaccgatgatattctcgatgaggttggagacaccaaaaccctgggtaaagccaccggcgtggatcgcgctttggataaagccacctaccccaaactcatggggctggcccaggcccgcgaggcggctgaaaatcttatgcaagaggcgacccgctgcctaaccgagttcggcccgcaagccgatcctctgcgcgcactggcgcagtatgtcatcgcccgcacccat

SEQ ID NO: 33875 - DNA, 1872 bp, magnetite-containing magnetic coccus
attctgcccatgaccacgctgctttctaccatcgactcccccaaggcgttgcgccagctgaacgaagctaagctgccgcaagtggcccaagagatgcgcgaccatatcattgagtgtgtctcacaatcagggggccatctgggggccagcctcggggtggtagagctaaccattgccctgcactacgtctttaatacccccgatgatcgcctggtctgggatgtagggcaccaatcctatggccataaggtattgaccggacgccgcgatcaattggctagcattcgccaacgccacggcttgagcggctttaccaaacgttccgagagcccctatgacccctttggcaccggtcactcatccacctccatctctgcggccatgggcatggcccgcgcggccaaggccaatggcattcagcgtaaggcggtagcggttattggcgatggtgccatgggcgcgggcatggcctttgaggcgcttaaccatgccggtcatgataaccatgatctggatctggtggtggtgctcaatgacaatgagatgtccatctcccccaatgtaggggcgctctcttcctaccttaaccgcatgctcagcggcggggcctataatgcttttcgtgatggcaccggcaaggttttaaagaccatctcccgctccatgtgggacgccgctaaaaaggccgaggagcatgtcaaaggcttggtcatgcccggcaccctctttgaggagttgggctttacctattttggccccatcaatggtcacgattttgatgccctgctgcctaccctgcgcaatgtgcaaaaattgggtggccccattttgttgcatgtaatcaccaaaaaggggaagggctttccccccgccgaagagcatccctgcacctaccacggggtggccccttttgataaagataccgggattattcagtccagcagcgggggcacctcctataccaaagtgtttgctcaagaactctgcgccttggcggagcagaacccccacattcacgccataaccgccgccatgcgtgaaggcacgggtcttaacctgtttgaaaaacggttcccggagcgttttcacgatgtcggcatcgccgaacagcacgccgtaacctttgctgcgggtctggcgaccgagggcattttgccggtggtggccatttactccacctttatgcagcgggcttatgaccaactgatccatgatgtggctctacaagatctaccggtgatctttgccctggaccgcgccggtctggtgggggccgatggggccacccatgcgggggcctacgacctctcctatctgcgcactgtgccgggcatgaccattatggccccagcggatgaaaatgagctacgccatatgctgcacacggcagtggcccttaacaaacctgtcgccctgcgttatccccgtggcaccgccctagggctccccccagaaccgccccacgtactcgaaattggccggggccgcaccctacgcaagggggagcatgccgccattcttgcggtggggcaaccggtacaccctgctttggaggctgccgccatcctagagcagcaaggtatttcggtttccgtctacgatgcccgcttcgttaaacccctggatcaacggctgctgcaagaggtggccatgcacggggtggtgctggtggtggaagagaatgctgtacagggtggttttggcagcgccgtgttggagtccctgagtaaccagggtgcgctggatcgcggtttaaaaatccgctgcatgggcattcccgaccgctacattccccacggcacccaaaaggagctgcgtggcgaaatcggcttagatgccgtgggtatcgccaccacgctcaaagagttgctg

SEQ ID NO: 33876 - DNA, 558 bp, Cytophaga hutchinsonii
ttatctgaatccttctatctacgggaaaacgtacagctgatcagtaaggagctgctaggaaaagtactcgtaacgtatattgatggaaaatatactgcaggtataattactgaaacagaagcctatcaggccccggaagataaagcatcgcatgcattcaacaacagacgtacaacacgtacagaagtattttataacaaaggcggaatcggatatgtgtacctttgttacggcatacatcatttattcaatgttgttacaaataacgaaaatataccccatgcaattttaatccgctcggtagaaccgctggaaggtgttgatataatgatgcagcgtaggaataaaaagaaactggacaaaacacttactgccggccccggtgcattatcacaggcattaggtattaccaggctacacaataaaattccgttatccgcaaatacggtctggatagaagaccggaacatcccggttgaatcaattgtatcaacaacacgcgtaggaattgattatgcacaggaatataaagacaaaccatggcgttattatattgca

SEQ ID NO: 33877 - DNA, 438 bp, Cytophaga hutchinsonii
gatactgcaacatttggcaatggttgcttttggtgtacagaagccgtttttcaagacattaaaggagtcgttaaggttacgtcaggatatagcggcggcacagtaacaaatccaagctacaagcagatatgtaccggcacaacagggcatgcggaagtattgcagattgtttataatccctcaatcgtcagttacagcgaattgctgcagatgttctggtattcacatgacccgacaacattaaatcgtcagggaaacgatgttggcacccaatacagatctgtggttttttatcacaatgaaacacagcgcaaggaagccgaattttataaaaagaaactggacgaggaaaaaatatttgagaaaccgattgtgactgaaattgtatcgttcacaaaattttatccggcggaagactatcatcagaattattataaa

SEQ ID NO: 33878 - DNA, 906 bp, Cytophaga hutchinsonii
atgtctgtaattgtaaaagaccttgttaagatatatgggaaacaatatgctgttgatggtatatcctttacagcagaaaaaggccgcattacaggattcttaggtccgaacggagccggcaagtctaccacgatgaaagttgctacgtgttttattccgccttcttcaggaaccattgaagtgtgtggttacagtgtacttgaatcgcccattgaagtaagacgtaatatcgggtacttacccgaacacaatcccttgtatctggatatgtatgtacaggaatatcttcagtttatcggagggatgtacggcatgaaagatacagccctcaaaaagcgtgttgctcaaatgatcgagctatgcgggttgggagtggagcaatataaaaagcttggtgccttatcaaaaggatatcgccagcgtgcaggcctggcacaggcactgattcatgatccgcaggtattgatattggatgaacctacaaccggtttagatccaaatcagatcctggagattcgtaaagtaattaaaagtattgccaaagataagacggtaattttttcaacccatatcatgcaggaagtacaggccttatgcgatcaggtcattattatcaatcgaggaaaaatcgtagcagataaaacaattacggagatccgtaatttcaatacatctattaaaatcatccgcctggagtttaccgagcaagtggatatacaggcgtttaaaatatttgattttgtttctgatgccagacacatgcagggcaatgcatatgaactggttgttgctacccatgcagatacacgtccgcttatctttaaagcctgtgcagacaaaggctggacgcttattgaaatgaaagtggaagaacaatcgttggagagtgtgttcagagaattaact

SEQ ID NO: 33879 - DNA, 1266 bp, Cytophaga hutchinsonii
gtggattacaatcaggcaatacaatttttatatacacaatatcctgcttttgaaaagcaaggcggcctggcatacaaaccgggtctgggtaatgttctgaacatttccgctgcattcaataatccgcatacagcatttaaatccattcacgtagcaggtacaaacggcaaaggcagtagttcaagcatactcgcggctgtgctccaatccgcaggttatacggttggcttatatacttccccgcacattcatgattttacggagcgtatccgcatcaatggtgttcccattccgaaagacattgttgttgatttcgttcagaataatacagcagtatttgatcgcttcaaaccctcttttttcgagataacaaccattctggcattcgtctggtttgccaaacaacaggttgatatagccattattgaaactggtatgggcgggcggctggacgctacaaatattgtacagcctgaagtttcattgattacaaatgtgagcctggatcatacacagtttttaggcaataccatacaagcaattgcttctgaaaaggccggcatcattaaagcaggaatacctgttgtgatttcagaacttcagcaagagctgatttctgtttatgaggaacaggcaaacgcgctaaattcaccgttaattaaggcctttgaagcatataccgttgatacaattataacagcatctgaacatactgaaatcagtattacagatcatgtcttaaagaaaataattgcacttcgattagatctgcaagggttgtatcaatcaaaaaatgttgttggtgtattgactgtaatagatcagttgaagaaggacggttgggcaatacccgaagactctatcaaagaagggttggcgcatgtccagcagttggctggctttaaaggtcgttggcagatcatatcacaaaaaccgttaacaatcctggatgctgcacacaacgaagcgggcataacgctttccatgcagcagttgcagctatatcataagtccattcatattgtgatcggtatggttaaagataaggacatcgaaaaagtattgtccttgctgcctgtgcaggctacctattatttttgtcaggcagactcgccaagagccatgcctgccgctgagctgcagacagcagcagcagtcaacggtttgcagggacaggcaataacgaatgtaaacgacgctgttcgggcagcgcgcaaaaatgctgcaccggacgatgtgatctggatcggaggcagtttatatgtt

SEQ ID NO: 33880 - DNA, 1065 bp, Cytophaga hutchinsonii
ggtgtatacatgtatggtaagcaaggagaaaaatacatcgatcttatttctggtatcggagtcagtaatatcggacattgccatccgaaggttgttcaggcaattcaggaacagagtcaaaaatacatgcacctgatggtgtatggggaatttgttcaggcaccacaggtaagactggccaccaaactgattgaaacacttcctccctcgttagattccgtttatctggttaactctggaagtgaagcaacagaaggtgcgctgaaacttgcaaaaagatatacaaaccgcagagaaatcatttcatgcaaaaatgcctatcatggttcttcacatggagcattgagtgtaatgggaaatgagttttttaagcagtcttacagacctttgcttcctgggataaaacatatccggtataatcatacagaagatctggatgtaattacagaacagaccgcagctgtgatcattgaaacgatccagggcgaggcaggtgtgcgcattgctgataaaccgtatatgcaggctttgaggaagcgttgtgattacacagggactttattgatattggatgagattcaatgcggcttcgggcgtacaggtactttctgggcatttgaaacgtatggtattgttccggatattttacttgctgcaaaaggtatgggcggaggtatgccgatcggagcatttatctcttctaaaaaaataatgcagacattgagttcagatccggtattaggtcatattaccacatttggcggacatcctgtaagctgtgctgcgtcgattgcctgtatggaagttattcaggaagaaaagctgatggacaccgttttgaagaaagaatcgctgatcagaaaacagctaaatcatccaggtattaaagaaatcagaagtgcaggtttgatgatggcggttgaatttgaatcgtattcggtattgaaacggattatcgatcaggctattgaaaaaggtgtgttaacagactggtttttattctgtgacaactccatgcgtattgcaccaccgcttattatctcagatgaccagatcgaacaggcg

SEQ ID NO: 33881 - DNA, 1194 bp, Cytophaga hutchinsonii
gatcacagctggtacgcgcaggcagatacccgaattgagcaaatacgtaaaggcgattttgtattaacggttaaagatcagaatggaaatatcctgaaaaattgtgacgttaccgttaatctgaaacagcacgattttaaatggggaaccgccttggcctttcagcagaatagtacggaagatgaagtctggtaccgcaatacggcgagtaactatttcaataatgcggtttttgaaaatgattttaaatggccatccatggaatatgttaatggtgatgtaacttattcaaaccttgagcgatacctggattggggcaatgatcagcatattgacttcagagggcatacactggtatggggcgggaagcaggcttcgccacccaattcatattggttaacaccttcctggttgtgggatgtctcttccgattctgcttataaattaatcgaaagacgtatcaaacgtgatcttacttattttaagggacgcatacatgaatatgatgttgtaaacgagcccgtgcatgaaaaagcactggcaggctggcttggagacagcgtgcatgtaatggccttcaaatgggccaaacaggcagacccgactgcaacgttatatatcaacgattatgcaaacattgacggtgctacaacatctaaatacagatcctatatttcatacctgctaagtaaaggcgctccggttgaaggcattggtgtacaaggccatttcggatcgcggattgattgggccagtgtaaaactacggctggattatctggctgaaatgggcttgccgattaaaattacagaatttgatatgaatcagaatactttaaacctgaccgaagcagaacaggcaagtgaatattctaaaatgatgcgtattgcgttttcacatccgggagtagaaggatttttattctggggattctgggataaccgccattggatcccgggtgcagggcttttcaaggcagataaaacacctaaaccagcagcagattcggtatataaactgatccatacaacctggtcgacaacggctcatgtaacaacagatcaaaatggtcaggtaggtttcagagggtattacggcagctatgaagtgttaagtacctgtggcaacgctcttgcgggacaaacagtatttactaaaaatacactttccaatactgttacattagattatgca

SEQ ID NO: 33882 - DNA, 957 bp, Cytophaga hutchinsonii
atgattaaaaaaatatccgtagtgcttgtccttcttacaggcatgttactttccgcttcggtttttgcacaaaagacaatcgttgaaaaatacggtaagttgtctgtaaaaggaaattatatggttggccagtacggtgataccgttcagctgagaggcatgtctttattctggagtcagtggatggggcaatactacaattcagatgtggtaaagtggctgcgcgacgattggaaatgtaccgtagtacgtgctgcaatgggcgtggaaatggacggataccttgaaaatccggatacagaaaaaatgaaggtgatggaagtggtgaatgctgctattgccaaaggcatttatgtgatcattgattaccacagccacgaagcgcagaagaatcctgcagcggcgcaacggttcttttctgagatggcaaaaaaatacgggaacattcccaatattatttatgaagtttataatgaaccactgcaggcaacttcctggaataaggacataaagccgtatgcagaaggtgtcattacaaaaatacgtgtgtatgatacaacaaacattattgtggtaggaacaagacaatggtcgcagctggtaacagaggcggcagcgaatccgatcacccgtcagaacatcatgtatacccttcatttttatccgggtacgcacaagcaggaattgcgtaatgaagcacaaaaagcattggatatgggtattgccttatttgttactgaatatggtacctgcgatgcatcgggtaacggaaatttcagtccggaagaaactgctttgtggtatgaatttctggatgcccacaagatcagttattgcaactggtccattgcggataagcccgaaaccgcttcagctattgtaccggcagcaagtccgtatggtggctgggctgattatgatcttacaccgtcgggcaaattagtacgcgatgatctg

SEQ ID NO: 33883 - DNA, 1494 bp, Cytophaga hutchinsonii
ataaatttaattcattcgctattgaaaacaattggaattataggatccggaatcagtggattaagtgctgctgcagtactggcactgaacggacaaaaagttgtagtgtttgaaaaaaacgatcagcttggcgggcgcatgcggcagtttgaagccaatggtttcacctttgacatgggcccgagctggtactggatgccggatgtgttcgaacgcttttataaacagttcggctattccggcagcgacttttatgaattaaaaaaactcgatccgggttttcagatgatcaccgctgatggagaaacagtaaagattccggccggatgggacgaactgctggcacttttcgaacagatagaaaccggcgccgcagacaagctgaaagcatttatgcgggaagcggaatataaatacgaggtaggtgtaaaaaaactgatctatcaacccggactgtctgtactggaactcatcaatgcagatacaataagcggcgtgttccggctgcagattttttcttctttcagcaaacatgtgcgcaggtattttaaaaatgacacacttattgctttaatggaattcccggtgttgtttttaggtgccatgcccaaaaacacacctgctctgtatagtctcatgaactatgcaggtttgaagcagggcaccttttatccgatgggaggtttcaaaaaagtaattgatgctatggtacagatttcgcgagagcacggcgtagaatttaataccgctgaaggagttgatgcaataaaaaaagaaagcaattcgaaaatttcattaaccacacatgcccgcagcatacagctggatggattgatcgcatcggcagattaccagcatgtagaaagcaagttgctgcagcaaaaagatcgtaactacacagagtaatactgggataaaaaaacattcgcgccttcttccctcatcttttatatgggagtgaataccaaactcgacaaactcgaacaccacaatcttttcttcgatggggattttccgaagcatgcaagagaaatttatgaagacccgcaatggcccgaaaatccgctgttctatgtgtgctgtccttcccgcacagatccttctgtagcaccagccggcaaagaaaacatctttgtattgatgccgatagcccctggcattgcggatgaagaagccatccgtgaaacctattacaaccttttgatgaaacgactcgaagcatataccggcgttccggttcgggaaaacattgagtacgtaaaaagttattgtgtgaaggattttgtagcagattataattcgtataaagggaatgcatacggacttgcaaataccttgatgcaaacggctaatcttaagccaaagattaaaaataacagcataccaaacttttactactgcggacaattaaccgttcccggtccgggcgtgcccccgtcaattgtatccggacaagtagcggccaatgaattattaaaaaccttatctgttaat

SEQ ID NO: 33884 - DNA, 1317 bp, Cytophaga hutchinsonii
tttaagaaaatattaattgctaacaggggagaaattgcattacgtgtaatccgtgcttgtaaagagcttggaataaaaacggttgctgtatactctgttgcagataaagaaagtttacatgtacgttttgctgatgaagcggtttgtataggacctgctccttcgaatcaatcgtacctgagcataccaaatattattgcagctgctgaaattacaaatgcagatgctattcaccctggttatgggttcttgtctgaaaatgcaaaattctctcaggtgtgtgaagactatggaattaaatttattggtgcaagtgcagcaatgattaattctatgggcgataaagcttctgcaaaagataccatgaaaaaagccggtgtgccatgtattcccggttcggatggtttgttgggttcaatcgaagaaggtatcaaattagcgaataaagtaaagtaccctgtgatcctgaaagctacggctggcggtggtggcagaggtatgcgtattatccgcagcgaccgtgaatttgaaaaagcatgggttgatgcgaaacaggaagctggcgcttcttttggtaacgatggtttgtatttagaaaaattcatcgaagaaccacgccatatagaagttcagttattaggcgataaattcggaacggttgttcacttatctgaaagagattgttctattcagagacgtcaccagaaactgattgaagaaactccttctccgatcattacagaacgcttgcgtactaaaatgggtgaagctgctgtaaaaggtgcaaaatctattaagtatgaaggtgccggtaccattgaattcctggtagacaaacacggtgatttctatttcatggaaatgaatacccgtattcaggttgaacataccattaccgaagaagtaactggtgtggatcttgttaaaatgcagatccgagtggcagcaggcgaaaagcttgaaaagaaaaactacttaccgttacgtcattctattgaatgcagaataaatgcggaagacgctgcaaacggtttccgtccttctccgggcaagatcacgaacttccatatgccgagcggttttggtgtacgtgtagacagccactgttatacaggttatacaatacctcctaattacgattctatgattgctaagctgatcgttaacgcggctacgcgtgatgaagcgtgtgaccgcatgaaacgtgccttacaggagtttgttattgaaggtgtaaaaacaactattccattccatattacgatgatggacgaccctcagttcaggtccgggaagtttacgacagcattccttgag

SEQ ID NO: 33885 - DNA, 972 bp, Cytophaga hutchinsonii
aatgtaaaggcatgtattaccggtattgcaggttatgtaccggattatatattaacaaaccaggaattagaacaacttgttgaaacatctgatgagtggattctttccagaaccgggattaaagaacgtcgcattttaaagggcgaaggattaggtacttctcacatggctgagaaagcagttaacgatctccttgcgaaaacaaatacagacccttctgaaatcgatttattaatttgctgtacaaccactccggactatgtatttcctgctacaggaaatttagtatcggatatgtgcggactgaaaaatgcattcagctatgatatgaatgcagcctgctcgggttttttattcggattggtaacaggttctcaatatattgagagcggcaaatttaaaaaagttattgtagtaggtgcagataaaatgtctgccattgttaactacaaagatcgcaatacatgtattttatttggtgatggtgctggtgccgttttgctggaacctaacaacgacggatttggtgttgttgatagtgttttaaaaacagatggttccggagcgcaatatctgattatgaaaggcggcggcagtcgccatcctgcatctctagaaacagttatgaacagcgagcactttgcacatcaggaaggtgcaacagtattcaaatttgctgttaaaaatatgtcagatgtggcagctgaaatcatggagcgtaatcaattaaccggcgataatgtacaatggttagtacctcaccaggcaaacaaacgaatcattaatgcaactgcagagcgcatgaatgttggacctgaaaaggttatgatcaatattgagcgttatggcaatacaacaagtgctactatcccgcttgtgctttgggattacgaaaaacaacttaaaaaaggagataatttggtattggcagcgtttggcggtggctttacctggggatctgtttatttgaaa

SEQ ID NO: 33886 - DNA, 681 bp, Cytophaga hutchinsonii
tttaaaattaacatgaataaactagtcattataacaggtggtacgaaaggaatcggcagagcattggtctataaatttgcttccgaagggtttgatgtttttacctgtgcccgaaatagagaagatctggactctttaaaaaatactattttgtctaactatgccggtatacaggtttttacccaagtggcagatgtttccaacaaaaaaggaagagaagaagtggtacgggcgtttacccaactgaaccgggcggcagatgttctgattaacaatgcaggtgtttttgttcaggggcaaatccataacgaacccgaaggtgttctggaaacgcagatccaaaccaacttatatagtacctatgatattacccgtggagtgattggccggatgatcgaaaacaagagggggagcatttttaatatctgttccattgcgagtatcatgccgtatgcaaacggagggtcatatagtgtctccaagtttgccatgctgggcatgacaaaagttctgagagaagagatgaagccatacaatatccgggtgacggcggtactgcccggagcaacgctgactgcttcctgggatggggtagacctgccggaagaacgattcattaagccagaagatgtggctgattcaatctttggtatctataaactatccgatcataccgtagtg

SEQ ID NO: 33887 - DNA, 714 bp, Cytophaga hutchinsonii
aaaacagcgcttgttaccggagcgtcaaaaggcataggagcagaaatcgcgaaagcgcttgcccgaaacggatcaaccgttattgtaaactattccacagatagaatcaacgctgaagcggttgttaaacacattcgtgaaaacggaggggcggcaactgctattcaggcagacgttacaaaagcggcagaagtaaaacggttgtttgaagaagcctgtcaacagttcggtaaaatagatacattgattaacaatgcaggtgtctataaatttgaacccatagaagcagttacagaagaggaatttcaccggcagttcaacagcaacgtattgagtgtactgttgtctgttcaggaagcattaaattattttaacgaagctggtggaagtatcattaatatcggttctgttgccagtgtaaaagctactccgtcatcgctggtatattcggcaagtaaaagtgccgtagatggaataacccggattttatcaaaagaacttggtcctaaaaaaatccgcgtgaacgcaatcttacccggccccactcatacagaaggcaaccggattgcaggtacacctgtggaagaatatattgcagcacaaacaccgctgggaagaatcggacagcccgcagatatttccatgctggcggtgttcctggcttcagacgatgcttcctggatcaccggacaaaaaatatgtgtgtcaggtgga

SEQ ID NO: 33888 - DNA, 954 bp, Cytophaga hutchinsonii
aagcctacatccaatacatcgtttgatgtaatcattttaggtgcaggccctgccggatctacggctgcacttgctcttcagaaaagcaaccttactgttgccttactggaaaaagagctttttccccgggataaaatatgcggagacgcattatcctgcgttgcagaacgtgtgcttaaacagattgatccctccttagaacaggaactgctgctctattcagaaaaaacggtagtgaataaagcgcgtgtatatagtcctgaatttcgttctatcgtattgaatttttcaaaacgcggacattgtatcaaacgcctggattttgataactggctctttgaaaaagcgaatgcaaaaaacattgaagtttttcaacaggcaaaggtaacggatgtacgtattgataattcaggcgctgaagtagttttgcaggatgggacaatactgcatgctgctatagtgatctgctgtgacggtgcacactctgttgcggccaggcagcttacacatttaaaactggaccgcaagcattatgttggcgcggtgcgtcagtattaccgtaatatcagtgatactgccggtaatgaacttgagattttttttctcaaggattttcttcccggttatttctggatctttcctttgaagaacggggaagcaaatgtagggtttggcgccttatcagctatcatttcaaaaaataaaattgatctgaaaaaaagtctgcaggagatcatacaatctgttccgcaattaaaagaacggtttaaagatgcggaagcaatggagactgtaaaaggttttggactgccgctgggttcaaggaaactgcctatctcaggagcgcattttatgttgtgcggcgatgcggcttcgctgattgacccggttacgggagaaggcattgaaacagccatggagagtggcaagtatgcggcggaacaggccatcagg

SEQ ID NO: 33889 - DNA, 873 bp, Cytophaga hutchinsonii
atgcatcaaagtccacttcaacctatcattttaccacaaacagaaaaggctggtgtacaattgtatctgaagcgcgacgatctcattcatcccttatatggcggtaataagatccggaagttaaagtacaatgtgcagcaatgtttgcgtgaaggtaaaataggtttgctcacctgcggcggcgcctactccaaccacattattgcaacggcagcgtatggaaaagagcatggtttgaaaaccaaggcaatcattcgcggagaagagctgctgattgataaccctacgcttaaagatgcggcagcacttgggatggaatttgtttttgtttcaagagaaacataccgaagcattcgtgaacaaaatgcgttggcttttgatttaagtaaatcgaattataacgaatggtattttattcccgaaggcggcaccaatgcttttgctgttgaaggtattgcagaactggtagctgaaattgaaatcccgtttgattatatcgctacaccctgcggtacgggtggtacttttgccggtttgatgaaaggcattaaagtttattcgccgtggcgaacgaaactgcttgttttttcggcgttgaaaaacggtaattatattattgatgaagtggctgaattgctgaaagcagattttgacagaacaacgttagagttgtttacttcagagtacgtgtttggcggctatggaaaggtgaaacctgaactgattgcttttgtaaaatcgtttgagcatcagacaggaattttattagatcctatttataacgggaaaatgatgtttggtctgttgggtaaaattgaaagtggctattttaaaaagggttcagtgattgttgctattcacactggaggaatc

SEQ ID NO: 33890 - DNA, 1299 bp, Cytophaga hutchinsonii
ggaacaatcggtggaaaaccaggagattcattaacgcccatcgacgtagcaaaatttgcagcagcatatggcacctgggcaaaaacgaactctgaaagcaatacaatagtaattggccgtgatgcgcgtttatccggaccatggatttcttccatcgtttctgaaacgctgcgttgcttaggttttaatattgtcgatttaggcttgtcaacaacaccaaccgttgaaatggctgttgtttgggaaaaagcggcaggtggtatcatcatcactgccagtcacaatcccggtcaatggaacgcattgaaactattaaacgcaaacggtgaatttgtttccgagcgcgacggtaaaaaaattcttgtactggctaaaaaagaaaacattgaatttgttgatgtaaaacattttggttcttacagacaagacaatacatatattcaaaaacacatcgatgcaattttaaaattgccgttagttgatattgaagctataaaagcaaaagactttaacgttgccatcgactgtgtgaactctacaggtggtattgcacttccgttattgttaaaagcgctgggtgttaaaaaggttgcagaattctactgcgaacccgatggacatttcccgcacaacccggaaccactggcggaaaacctttctttcatatccaatgaaattgcaaaagggcattatgacttaggtattgttgtggatccggatgttgaccgtttatgctttgtgaacgaagacggtgaaatgtttggtgaagaatatacgctggtagctattgcggattatgtcttaaaacatacgccaggcaatacggtttccaatttatcttctacaaaagcattaaaagatgttaccgaaaaacatggcaaacaatacattgcttctgctgtcggcgaagtgaatgtagttacggccatgaaaaaaaataaagccgtgatcggcggcgaaggcaatggcggcgtgatctatccggaactgcactacggccgcgatgcgttagtgggtattgctttgttcctttctcatttggcaaaatatggaaaatcgatttccatgatgcgcgccagttatcccaactatgttatttcaaaaaataaaattgaactgaccccggaaattgatgtagactgcgtgattgaaaagattaaggaacactacgctaaaacacctatgattacggttgatggtgtacgttttgattttgatgccggctgggtgcacttacgcaaatcaaataccgaaccgatcatccgtatttatgcagaagcagatacacatgcaactgcc

SEQ ID NO: 33891 - DNA, 1770 bp, Cytophaga hutchinsonii
ttattaaccgaagtagcctgggaagtatgtaatcaggtaggtggtatctataccgttatccgttcaaaagtacctaccatgactgaagtatggggcgatcgctactgtttggttggaccgtattttcacaacaaagccattgctgaatttgaagcgattgatacctacgaagctgatgatgtttttgcacaggctgtattgagaatgcgcaacttaggttatgaggttcattacggacactggctggtatcaggccgtccgaaagttgtattgataaatcatttctctgcattctaccggttaggtgaaattaaatacagcctttgggaaaaccacggaatctcaagtccggaaggggatgacctgttaaatcaggtaattgcttttggtttccttgcaaaggtgttccatcagcaattggatgaaacaaaaggagaacttccatgtgtatctcatttccacgaatggatgacaggtacagcgattcctgaaatgcgccgcgaacatgtaaaaacatctattgtatttacaacccacgccaccttattgggccgctacctggccatgaatgatccgaatttctatgacaacttaccttattacgattggaataaagaagcggtcaattttaatatcgaacctgcagtaaaaatagaacgcgctgccgcacacggcgcgaacgtatttacaaccgtaagtgaagtaacagcccgtgaatgccagtcgttactgggcagaaacccggacatggttttgcccaacggtttgaacattgaacgtttcactgccttacacgaattccagaatttacacaaagaacataaagatcagatccatgaatttgtgatcggtcacttttttcaaagctatacgtttgacctggataagaccttatacttctttacttccggaagatatgagtacaagaataaaggcttcgacattacgcttgaagcgcttgcccgtttaaactggagattaaaagaagagaacaccgatacaacggttgtgatgttctttattaccaagcagccataccataccattaacccgcaggtattacaatcacgcgcggtaatggaagaggtgagaagcaactgcgatgcaattgtacagcagctgggcgataaattgtttgaagcggctgcatccagcggcgacttaaaattaccggatttaaataaatttgtagacgaatactggaagctgcgtttaagaagaaccttgctatcctggaagtcgcatgaattgccaaaggttgttacacacaatttagtgtacgacaatcaggatgaaattctgaacttcctgagacattccaatatggtaaacaatgaacacgataaagtaaaagttgtttatcacccggacttcattgcaagcaccaatcccttgtttggcatggaatacggacagtttgtacgcggttgccatttaggtgtgttcccaagttactacgaaccatggggctatacgccgcttgaatgtatggcatccggtgtgcctgcaatcacatccgatttatccggattcggtgactacgtattgaaaaacattccgaataatgagaacaaaggtatctacgtaacaaaccgcttccataagagttaccacgatgctgcacagcagctggcagaccagatgtatcactttgttcacctctcccgcagagaccgtataacgcaacgtaacagagtggagagtgcatccgaacattttgactggcagaacttaggaagctattatgataaagcgcatcgtttggctttc

SEQ ID NO: 33892 - DNA, 1230 bp, Cytophaga hutchinsonii
agaagagtagttgttacaggtataggagctcttacacctatcgggaatacatcgaatgaattttggaataacctgctggctggaaaaagcggcgctgcacccatcacctattttaatacagaaaaattcaaaacaaaatttgcctgtgaaattaaaggatataatccgcttaattatttcgaaaaaggcgaagcccgcaagtatgatctgtttacacaatatgcacttataacggttaaagaagctatagaacaggcgaagatagatttcgactcattaaacaaagaccgcatcggtgttatctggggttccggcaacggaggtattcttaccacacaggaacagatcatggagtatgcaaaaggtgacggcactccccgatttaacccatactttgtacctaaaatattagtagatattgcctctggtgttatctccattaaatatggtctgcgtggtataaactatacaacagtttctgcatgcgcatcctctactacatcggttattgatgctttcaattacatccgctggaacaaggcagatatgattattactggcggttcagacgctccgatcaatgaaagtttaatcggagggtttggtgcactaaaagccttatcaacacaaaatgaaaatccggaatcggcttcccgtccgtttgataatagccgtgatggctttgttatgggtgaaggtgccggtgcaatcattttagaagaatacgaacatgctgttaagcgtggtgcaacgatattatgtgaagtaatcggtggtggtatgtgcgcggacgcctatcacttaacgggctcacatccggaaggtgacggcgcctacatgggtatgaaattaacgctggaagatgcgggtatttctgcagcggatgttgattacattaacccgcatgcaacatctacaccaattggtgaccaaagcgaattaaaagcaattcaacgtttgttcggcgatgcatcaaatgcttcaatcagtgcttctaagtctatgaccggacacctgctgggtgctgcgggtgccattgaagcaatcatttgcattcaggcggtacaacacaacatgattcctccaacgattaatacaactgccgtagaagccggatacgaaaatctgaatctggtattaaacaaagctgttgctaaagaagtgaatgtagccatcagcaatacatttggatttggcgggcatatagcagccctgatggttaaaaaaatc

SEQ ID NO: 33893 - DNA, 3540 bp, Cytophaga hutchinsonii
atgcaattaagtaagttagagattaaaggatttaagagttttggtgataaagtagtcataaattttgacgaaggtattactggtattgtaggtccaaatggctgcggaaaatcaaacgttgtagatgcgatacgttgggtattgggtgaacagaaaacacgtgccctacgttcggacaaaatggagaacgttatttttaacggcacaaaaaaccgtaagccacagcaaatggcagaagtttcgttatcttttaacaatacaaaaaatttattaccgactgaatattctcaggttacaatcacacgccgttactaccgtacaggcgacagtgaatatttattgaacggtgttacctgtcggttgaaagatatcaatgacttgtttctggatacaggtatcggttctgattcgtatgcaatcattgaattgaaaatggttgatgatattttgaacgataaagacggatcgcgccgtgaattgtttgaagaagcagcggggatctctaaattcaaaatgcgtaaaaaacaaacgcttaagaaattagaagaaacagataaagatcttgaacgcgttgaagatttactttttgagattaacaaaaatcttaaatcgcttgagaagcaagccaaacagactgaaaaatatcatgagataaaagaagattataaaaatgcgagtattgatctggctaaagtaagtgtacattctcaacatgaggaaatacaagctttaaacaagacgttagatgaaaaaacagacttgcgcacgcaatacaattcacagatcaatgaaaaagaaagtgatgttgagcgtgtaaaactggagatggttaataaagaaaaattattagctgacaggcaaaaaacgttgaacgaacatgtgaatttgatccgtacgtttgaaagtgataaaaaaattaaaaacgaacgtctgcgtttcttaaatgacaaaagcaaatcattaaccgatcagattgaattagataagcaaagcaatgaccgtgcggcattcagcctggatagcttaacaaaagaaaaagaatcagcagagaaaatatttgaagaaatttcgttaaaagttgaaaaattaaagcaggaatacgaagagcaaaaagaaaaaaacaagcttttacaggaagaagtaggaacagcttccagtgcatttaaattaaagcaggaacaggtttatcagatcaacaaacagctcgaaatttatgccattcagctttcatctttaaaacaggaattagaaaaaacaacaagtgatacatctgcgcattctgctaacctttcagaatttgaaagcaaagcaaatgaagtaaagcgtacactagatacaaaaaatgcggagcttgaaaccctccaagctgaagatgagcgtattcagcagcaggtgatcaatcttgaaaaagagattgaacagatccgtgaacaattgacgcaggcaaacagaaagcttgattcaaagcaaaacgaattcaacttaaccaaatcaatggttgagaacctggaaggtttcccggaagcaatcaaattcttaaagaagaatgcgtcgtggggtaaggacactccgctcctttcggatattcttacctgtgacgaaaaattcagactgtgtatagagaactacctggagtcgttcatgaattactatgtggtagagaacgaagcacaggcaattcaggcagtaaacctattaagtgattcagcaaaaggcaaagcaaacttctttgttttaacccgtttcaataactatacatcatcacaaaaaaatacgtttggcgactgcgtatctgccctggatattgttgaatacgataacaaatacaaaggtttgattcaatatattctggatggtgtatacattattacaggtaatcaggatattattccggaagatccgcaatcggtctttattacacagaatggtaagttagcaaaacgcaaatacagtatttccggtggttcagtaggattgtttgaagggaaacgtatcggccgtgccaagaacatggaaaagcttgaagcagatatcaagcagatcaccagtgatattgaaaacattcgtgttgtacttgatacgaaattaaaagagttttatttattaaaagagaatacgaaaaaattagaagttgaagaacttcgccgtgagatcaatttagtaaacaacgagtacattacgctgaaaacaaaacaggaacagctggcttccatgctttctgataatagtttgcgcagagaagatgtattggaaaagatcgctaaaattgaagaagacattaatatcaatacgcctcttgccaaagaaggtaaagatgaacttgaaagtctggaagaaagactgaatcagttgaatgatgatttcagcttacagacaacgcagttaagcaacaaatctgctgtatacaatcaggagaatattggtttccatcagcagcaaaaccgtgtaaacagtttagagcaggaaattggttacaaacaaacaacgtttgatcaaagcaaagaacgtattgctaaaaacttagaagaactggaaatagcaaatggtgagatccgccagatggttgacagtgctgatgtgagcgaagatgaactcatctctttctacaaagaaaaagaatcgatcgaacaaggtgtgcatgaagctgaaaaagattattacagcacacgggtacgtattgatgaagtagaaaaagaagttaaggaaatcagacgtaaccgtgaagaatgtgatgaaatacttgttacgcttcagaaccgtgttacggaaacaaaaattggtttaagttccatcaaagagcgtttgaatgtagagtttaatttaaacttagacgacattttagcgaatcagaatccggatgatgtattaccatccgaagaagaactgaaagaaaaagttattaaaattaaaaacagcttagaccgccttgggccaatcaaccccatggcaatggaagcataccaggagatcaaagaacgccacgtgtttattacaacacaaaaagaagatctggcaaaatcaaaagaatcattaatggaaaccattaatgagattgataccgttgctaaggcgaccttcctggatgcgtttgaaaaaatccgcgataactttatccgggtgttccgttcgctgtttacagatgaagatagttgtgatctgaaattggttgatccggaaaatccattagattcagcgattgatattatggcaaaaccaaaaggtaagcgtccgttaacaatcaatcaattatccggaggagaaaaaacgcttactgcaatctctcttctgtttgcgatctacttaatcaagccggcaccattctgtatcttcgatgaggttgatgcaccgttagatgatgccaacattgataaattcaataatatcatccgtcagtttgcgggtgaatcacaattcattattgtaacgcacaacaaacgtacgatggctagtactgatattatctacggtatcacgatggtagagcaaggtgtatccagattggtacctgtagacttacgttcgttaaatgaagcctaacaa

SEQ ID NO: 33894 - DNA, 705 bp, Cytophaga hutchinsonii
acagcctggcccattattatattctttgttgcgcattggtatttatctttgttcagccaaacattctttctgcacagatattctgcgcacgcaatgtttaaaatgaataaattctgggagaaattcttctttatattcttatacctgactcaaggttcttcttacttagttccaagagcctatggcgcacttcacagaatgcaccatgcctatagtgatacagaaaaagatccacactctcctctttattcaagaaatgcatttgttatgatgtggaaaacaaaagacatctacaacgctgtattaagaagagaagcacaagttgaggataagttcaataagaaccttcctgaatgggcattcatcgataacattggtgatatgtggatctccagaattatttggggaacattatatgtattattctacatttattttgttcctgctgatatgtggtatttatatttattattaccaatccatttcttaatgggacctgtacacggtgctatcgttaactggtttgggcataaattaggttatcagaactttgataacaaagatgcttccagaaacacacttgctctggatgtactgttaggtggtgaattatttcagaacaatcaccatatgtatggcagcagaccaaactttgcaatgaagtggtttgaatttgatcctacctatccggtaataaaagtattg

SEQ ID NO: 33895 - DNA, 1734 bp, Cytophaga hutchinsonii
tttaaagaccttggattgtctcctgaagttgtggaggctatcgaatctattggctattctgaagccacgcctattcaggaaaaaacaattccaattttaatgacaggaaaagaccttacaggtcaggcacaaacgggtactggtaaaacagctgcctttggtattcctgctattgaacatgttgatatttctatcaaccaaacacaatccttaattctttgtcctacacgtgaacttgctttacaggtatgtacggaattaaaaaaactttctaaattcaaaaaaggtcttcgtgtacttgcagtatacggtggcgaatcgattgaaagacaaatccgcgatctgaaagcgggtgcgcatatcgttgtaggtacacctggccgtatcattgatcacctggacagacgtacattgaatgcttctcacctttctcagatcatcttagatgaagcggatgaaatgctgaacatgggtttcagagaagacatcgaattaatcttaacccgtttaccagaagaacgtcagactgtattattttctgcaacgcttgctcctcctatcctggcgcttgctaaacgtttccagaataatccggagatcattaaaattgaaagaaaagaattaacgatcagcacggttgaacaattctattacttagttaaaaactctcaaaaaacagaaattgttacacaaatcattgacctgaacaatcttcagttgatgttgatcttctgtaatacaaaaagaaaagttgaagaagttaccgatgaattaaaagcatacggacacaatccgatcagcttacacggtgataaaacacaacgcgacagaacagaagtaatgagcaaattccgtaagggattagccaatatccttgttgctacagatgttgcggcacgtggtattgacgttacaggtgttgatgcggttatcaactacgatgttccattggatattgaaaactacgttcaccgtatcggcagaacaggtagagcaggtcagttaggtaaatcattcacattggtaacaagtgatgagaaatataaattgagagacatcgaacgttatacaaaggcaacaattgaaaaagctgaaacgcctacacgtcaggaattagttgcttataaaaaagataaattagctacacgtattactactgaattagaaaaaccaaacattaaaatctggtctgatttattagaagaatataaagaaaaaggtattactgctgatcagattgcaattgcgttgctttctaaagaaatgaaagatcttgcagaacctgaacgcagagtatttgaagaccgtggcgatcgtcgtgatcgcggcgacagaggtgaccgtggcggtcgtttcgatcgtggtgacagaagagatggacctcgcagagatggccgttcttcagaccgtttcggagacagaccagctgcttcaagagaccgtgatggtggtgaaagacgtgaaagaacgccgagaccaagaacaagtgatgcaagtatggcacgtttattcgtaaacgttggacgtattgaccgcatctctcctggtgatatcgttggtgcatttgccggtgaggcaaacatcaaaggttctcagatcggacagatcgatatcttcgataaatattcattcgtggaacttccacatgacttagttgatcaggttatggacggaatgagaaacaataaaattaaaggaaaatcaatcaacatcgaaatttcgaacggtaagcaa

SEQ ID NO: 33896 - DNA, 924 bp, Cytophaga hutchinsonii
atgaagagttcgatttttacactaacacttagtcccgcttttgataaaagtacgtcagtggaaagtgtacaacctgagcataaattacgttgcgacagcccgatttatcaacctggtggtggcggtattaatgtttcccgtgcaattaaaaaattaaacggaagttctgtagccctttatcctattggcggagatacgggcaatcattttaaagcattattaactgaagaaggaattgaacagattacttttcagataaaaaactggacacgcgaaaatttcattgttgtggaacgttctacaaataatcaattccgtttcggcatgccgggttcagaaatatataaagaagaatgggaacaaatgcttgctgtgattcaggatccttcaaacgattttgaatattttgttgtgagcggcagtacgcctaaaggtgttcccgatgaattctatacccgtttatctcagatcattcttcagaaaaatgcgcgtcttattttagatacttccggagcagccttaaaacactgcctgaaagaaggaatatttttgtgtaagccaaacattaatgaattaagtgaaattgtaggcaaagaacttattacaaaagaacagcaggaagctgccgcgatggaaattatcaatagcggtaaagttgaaatcctggttgtatccttaggtggtgccggagcattcctggcgtctaaacaaggtatctatcatgtaactgctccgcccgttgaaaaaagaagtacagtaggtgccggagacagtatggttgcgggcatggtattaagtttatcccgaggcaatcattatgaagatgtgatcaaattcggcgtagcatgcggtacagcagcaacaatgaatttcggtacagagctttgtaaattagaagatgtagaaaggttgtataagcaactt

SEQ ID NO: 33897 - DNA, 726 bp, Cytophaga hutchinsonii
gtcatttttttacatggtttccctttcaacagaacaatgtggaaagaacagcttgaggcacttcaatcagaaacacgcgttattgcttgtgacctgaggggttttggcaaatctgaagatgaaacttcttttttaagcatcgaccagtttgcagatgacctgatcggttttatggatgccttgcgcattgagaaagccatcatctgtgggttatccatgggcggttacattgcgttgaatgctgtaaacagatttaaaaaccgtttcgaagcattgattttatgcgatacgcaatgttattcggatactgccgaagcaaaacaaaaaagatatgcctctatggatgaaatttctacaaacggtataagtgctttcaatgaacctttcctgaaaagtgtatgcgctgcaaaaacgctggaaacaaaacccgaagttatagaagctttgcgcgagatggtttattcaacctctgaacatagccttaccatgggtttaacagcgctggctgaaagacatgaaacctgttcaatcttaagtaccattgatatgcctgcgcttattatctgtggaagtgaggatgcagtaacgcctcctgaaaaatcggaatatctgcacgaacagatttacggatcggtgctgcgtataattgacgaagccggacacgtatctaatcttgaacaaccggaactattcaatacacacatcctgcattttattcatgcctta

SEQ ID NO: 33898 - DNA, 1116 bp, Cytophaga hutchinsonii
gtgcctttagaaattttaaaattgaataagcagttaaatactgcaatgtctgatatgggttttgttgaacctaaagaagttcaggaaaaaacattatcacgtattattggcggacaggatctggttgttattgggcctgagggatgcggcaaaactactgcaatgattttaggcgtattggcaaaattaaaatatgcctttgaaattgctccccgcgcaatgattatggttcctaataaagataagggccttgaattagaagaacagttcagatttctgggtaagaatttggatatacgtgtattgggtgtttatcccggtgcaggcatggaaggccagcgggagttactggaagatggtattgatgtagtgattggtacacccgaccgtattgaggcattgtatattaaatctgctgtcaaccttacacagcttaaaacatttattctggatgatgcagatcttatcgttaaacaaggtctgcaaacagttgtaaaaaatatatctgaaagtttacctaaatgccagcacattgtatttacagaagtgatgcacgaaaaactggaaaaactcatccatttcttcttagtctatcctacaacgattgaagtaaatctggattcagaacatgtgttaagtacggttgatttacagttgtttaaagttccgaattataaaacaaaattgaatctgctgaacctgatgatgcgtgattatgacatctataagaaggttgtcgttttttcaaattcaaaagtgacttctgataaattattgaaaagtttagaaaaacgcattgaaggagcagtagctatttttaatccatcgtatagtcagaaaggatttacatcttttgaacagtttaaacaagacgaaaatgttcgtgtattgttactgtcaaatgaagaagaggtattgctgaatctggatgatatcggtcacattcttcactttgatcttcctgcagaccgtactatttttatcaatagagtagaacgtaaacaggtggatgaacttcccaatacggttgctattacgtatgcaactgacattgaattgaatatggttcgtaagattgaattaggtgtagggcatagtatggaaattatggagctg

SEQ ID NO: 33899 - DNA, 1392 bp, Cytophaga hutchinsonii
atagccattattggaggaggaatatcaggatttgctactgctttaagactacaaaataaaggttttaaaacaattgtttttgaatcacatgggcaattaggtggatgtgctggcttttttagtgaaaaaggtttttcatttgatgtaggggcaactactttagttgattttagtaaagggggaattggaggtgatttttttgaagagcttaatttttctttacctgagggggaatatattgattatgtgttatggcttccggatcgaaaagtaacattatatagagatgctattaaatggaataaagaacggttagaaaaaatcggaaccactaaaaatcacatagaattttggaatcttattgataaaacaactgaagtcttttggagggctgcaagaaagaatattcgtctaccaataaaaaacctgaatgatattatttatgcttttagagtaattggtgcaaaaaatatttatttattgaaatatcaaaattacacgatgcttgatattttaaaaaaatttaaacttgaaaatgataaagccttaaagggattactttcagttcttattgaggatacagttaatagtacaatagataaagcacctttcattaatgcttctttaggttgttcaataagaggtgctggattaatgagagcaacaggaggaatgaaagggttttggaattatctttcaaaaatttacttaagcaaagatggtgtaattaaaaaagcgcataaagttttaagtctatcaaaagatcgttctgtctggacaattaatacatctaaaggttccttctatgcaaaaaaaatagttagctccttaccaattgatttaacatacaacatcgctcctatccatataaaaaaaatattaaataaatatatgtttcacaataaagaagctacaggaggggcaatcgtcatttttttaggagtgccggaatctaatttagaaaatgaaatattaacgcatcatcaaattttactcaattacgattcaccattaggaaatggaaataatatgtttatttccatttcctcaaaggatgatactttgtctgcccctcttggatatcgttctgtaatgatttctacccattgtgatattaatgaatggaaaaatttatctgaacatcagtatcagcttaaaaaagaagaaattggcaaaagattattaggttatgctaaacgggtctatccaaatttagtagataatggaatcatctataaaataggtagtccactaacttatcagaagtttacaaatagagtgaacggaagtgttggtggttttaaacaaacattagaaaattcgaatttcaactctattcctcaaaatataggagaaaaagatttatggattgttggcgataatacctggccc

SEQ ID NO: 33900 - DNA, 1008 bp, Cytophaga hutchinsonii
caataccaaaatgatttaatattaagagctgcccgcggagaagctgttgaacgtactcccgtttggctgatgcgccaggcaggaagaatacttccggaataccgtgccgttcgtgaaaaattaagcggatttattgaattatgcaccacacctgccttagcggcggaggttactattcagcccgtggacatattaggcgtagacgccgccattatcttctctgatattcttgtcattcccgaagcaatgggtttaccttatgaaatgcaggaaagcaaaggaccgtttttcccaaaggtaattacttcggctgctgatattgatgccttgctggcaacagatgcagccgatcatttaacgtatgtctatgatgcgattgagcttgctgtaaaagaattgaacggacgtgtgccgttaattggttttgccggagctccgtttaccattcttgcgtacatgatcgaagggcagggttctaagacattctctaaggcccgccgtttcttatatacagaacctgtgcttgcacaccgcttattagaaaaaattacactggctacaattgcgtatttaaaacgtcaagttcaggctggagctgccatgtatcagatctttgattcctgggcaggcgttttacctccggatcaataccgcgaattctctttgcgctacatcaaacagatatgtgaagctgtacctcaggtgccccgaacagtattttcgaaaggtgctttttttgtgcgtgaagatttcaacaacttcccctgcgaaacggttggcctggactggaatatggatattggggaatcaaaaaaaattattggtccgcataaaacattacaaggcaatatggatccttgtgcattgtatttatccgaagaacagatccgtgtgaaggcaaaagaaatgctggatgcatttggcacgcaaagccacattgcaaacctgggtcatggcttgtatccggacacagataaaacaaaagtgaaatgttttgtggatgccgta

SEQ ID NO: 33901 - DNA, 945 bp, Cytophaga hutchinsonii
gaagacctttttaaggtcttccgtacttttaatgtattgatcatcggtgatgtgatgatcgattcctatttatggggaaaagtagaacgtatttctccggaagcaccggtgcccatccttcaggttgaaaaaagagagatcagacccggcggtgcagcaaatgttgcgctgaacattaaatcattgggcgctactccccttctatgcggcttagtgggcgatgataaagatggcgctgattttttaaaaatacttgaagacaatcaattaccaacagaaggcattgtttccagcaaagaccgtgtaacaacaatcaagcaccggatcatttcaaatgcacaccacatgctgcgtgtagatcaggaagatgaccgcgtaacaaacacggctgaattagctttattaaaaacacgtatcgattcactgattgacaaagcacaggtgatcatttttgaagattatgataaaggtgtcttaagcgaagaactgatcgcatacgtaacagataaagcaaatgcgcaaggcataccaacggtggtagatccgaagaagcgtaattttttacagtataaaaactgcagcttatttaagccaaacagaaaagaattaaaagaaggcattaaaaccgatgcgaatttaaacgacagcaaacagcttgaacaaaccgttgaagagttaattcgtttgttaacgtgcgacagtgttttaattacgctatctgaaaaaggtgtttactggacagacagctcagagcatttacacataccggcacaccatagagaaattgctgacgtatcaggcgctggcgatacggttatcagtgtagctgcgctatgcgcggcagcacgcacgaaaccagccatcctggcggcattatctaatctctccggaggattggtatgcgaacaggttggtgtagtacctattgacaaaaaattattgcaa

SEQ ID NO: 33902 - DNA, 921 bp, Cytophaga hutchinsonii
atgtcatcccttaaattattttctggaactaactcccactacctggcagagaaaattgctgcagcgtatggagagccactaggccatagaacaataaaacgtttcagcgacggtgagatctatgttagttttgatgaatctgttcgtggaaaagatgtgtatattatccagtctactttcccgaatgcagataatttaatggaattgatgttaatggttgatgcggcacgcagagcatctgcagcagaagtagcagccattattccgtatttcggttatgcgcgccaggatcgcaaagacaagccaagagtaccgattgcagctaaattagttgcgaatctgctttcagctgctggtgttgaccgtttaatgacatgcgatttacacgcaggccagatccagggctttttcgattttccggtagatcacctggacggcgcggcaatctttattccttacttaagaagcattcaatccgataaattaatcatcgcttcaccggatgttggtggtgtgaaacgtgcgcgtgaatttgcaaagcatttaaaagctgaattcgtagtgtgtgacaaacaccgtgaacgtgccaatgaaattgcttcgatgcaattgattggtaatgttgaaggtgccgatgtgattttagttgatgatttgattgatacaggcggtaccattacacgtgctgctgaagtaatcatgaataaaggtgcgaagagtgtacgtgcaatctgtacgcacccgatcttatctggttcagcatacgaaaacattgaaaattccgtgttaacagaaatgttggttacagatacaatcccgcttcgcaaagaaacatcaaaaattaaagttcttaccgttgctgatttatttgctaaagcaatttatcagatccagcagaacgaatccgttagttcattattt

SEQ ID NO: 33903 - DNA, 855 bp, Cytophaga hutchinsonii
ttattcaaacctatgcttcaggcagaagcatttaaaaataaagttgtcgttgttacgggcggcggaacaggcctgggaaaaagcatggcacaaatgctgttgcagctgggtgcaaatgttgttattacgagcagaaaattagaggtattggaagcagcagcgaaagaactcgaaaccttaaccggcggcagtgtattggcagttgcctgtgatgtacgggactacaggcaggtagaagaattgctgcaaaagtctgttgcccgttttggccgtgtagatgccttgctgaacaacgctgcgggaaattttgtaagcccgacagaaaatctttcaccaaaagcatttgatgttgttgttgatattgttttaaaaggaacatacaattgtgtgcttacgtttggaaaatactggatagataatcagattccggcaacggtattaagcattgttactacgtatgccactacgggctctggatatgtggtaccttcagcatgcgcaaaagctggggtaattgcattaaccaggtcactggcggtggaatgggcgaaatacagcatccgctttaatgccattgcacccggaccgtttcctacagaaggagcctggagccgtttgttccccggacagattgcagaattatttgagcctggcaaccgtattcccttaaaacgttttggtaaacacgaagaactcgccaatctatcgtcctatttactttctgaatattcggcttatatgactggagaagttgtaacgattgatgggggagaatggctgaaaggtgcaggggagtttaacggcctggatgtggtgagtaaggaagaatgggccgaaattgaacgcagtatccgt

SEQ ID NO: 33904 - DNA, 2160 bp, Cytophaga hutchinsonii
ggaatgtcttgtgcatcctgtgcaagcagttcacagagtattcttgaaacacaacctggtgtgataagtgttgctgtaaattatgcaaacacaacagcgcagatagaatatattccaacgattacaaatccaaaaaaacttaaagcttcattacaatctatcggttacgacttgatggttgatgaaagcgaagaagcaaaagacacgctagaggaaattcataaaaaaaattatacgattcttaggaataaaacaattgcagcaatcgtactctcattacctatcgttgtaatagggatgttttttatggacataccatatgcaaattatattatgtgggcattgtctacacctgtgattggctatatagggagttctttttttatcaatgcctggaaacaagccaaacataggtctgctaatatggatacactggttgcattaagcacaggtgtagcatatttctttagtgtatttaacactttgtttcctgaatactggcatcagaaaggccttcatgcacatgtatattttgaagcggcttcggtagttattgcttttattttactcggaaaattattagaagaaaaggctaaaggaaatacatcttctgcaattaaaaaattaattggtttgcagcctaaaacggttacggtcgttcatcaaggtggtcatcaggttgaaacgccgatagctaatgtaaagattggtgatgtactattagtgaagccgggagaaaagattgctgtagacggcaaacttgtttatggcaactcttttgtggatgaaagtatgataagtggcgaacctatccctattgaaaaaaatataaatgattctgtgcttgcaggcacgataaatcaaaagggaagttttcaattcgttgcagaaaaagtcggtggagatacgatgctggcacacataattaaaatggtgcaagatgcacaaggtagtaaagctccggttcaaaaacttgttgataaaatcgcaggtgtatttgtaccgatagttattgtaatagcaatcttaagtttaatagtgtgggtgttgtttggaggcgaaaacggtttcacgcaaggtatgctggcaatggttactgttcttgtaatagcgtgcccttgtgcgttaggattggccactcctacggcaataatggttggtgtcgggaaaggtgctgaagctggcatcttgataaaagatgctgaaagtcttgagactgcaaggaagataaatgcaattatcctcgataaaacaggaacgattacagaaggcaagcctgctgtgacggatgttatttggttgaatgaaaacgcagacaaaattaacgttttcgcatccattgaaaaacaatccgaacatccccttgcggaagctgttgttaactattttggagaaatgagttacctaaaagttgataattttgaaagcattaccggttctggagcaaaagcggttgtagataatacatcgtatttcataggtaatatgaaattgattgatgcacaaaaaatcaacatacatacaaatcttagaaataaatctaatctatggcttaaagaagctaagactgtcatttactttgctaataccacagaagttttagcagtattagctatttcggataaaatcaaaactacttccatagatgcaattaaacaactcaaaacgttgggcatagaagtatatatgcttacaggcgacaatacctttactgctgaagctatagccaagcaagtcggtataagtcaatttaaagcagaagtgttaccatctgataaagcgaattttgttaaggagctgcaggcacaaggtaaagttgttgcaatggtaggtgacggaatcaacgacagtaatgcattggcacaggctaatgttagtatagccatgggcaaaggaagtgatattgcaatggatgttgcaaaaatgactatcatttcatctgacctttctaaaatacctcaagcaataaaactatctacctatacggttaatgccatccgacaaaatttattctgggcatttatctataacataatcggtatccctttggcagctggtatcctctacccttttacaggttttttattaaacccaatgattgccggagcagctatggcactgagctctgtaagtgttgttagtaacagtttgagattaaaa

SEQ ID NO: 33905 - DNA, 1035 bp, Cytophaga hutchinsonii
caagcaaaaggatacgccgcgcaaaatgaaaaaacggatcttgctccctggaattttgaacgcagagacgttggaccgcacgatgtacagtttgatattcactactgtggtgtatgtcattctgatctgcatcagatccgcaacgattggttcaagggaattttcccgatggtgcccgggcatgaaattgttggaaagatcgtaaaggtcggggcacatgtaacgaaatttaaaatcggcgaccttgcaggtacaggctgtctggttgattcctgcagaacctgtgataactgcaaagacggcctggaacagtattgtgtaaacggaaacagcggtacgtataacagcctggaacaggataaaaagacacctacttatggcggctattccaataccattgttgtacacgaagatttcgtattgcacatcagtgataagctggatcttgcagcagcagcaccgttgctgtgtgcaggcattaccacctattctccgctgcgtcactggaaagtaggcaaggggcataaactggcagtattaggtttaggcggtcttggccacatggccgtgaaatttggtgttgcctttggtgcggaagttacggtgttgagcacatcaccgaacaaagaagccgatgccaaaaaattaggtgcgcataaatttgtggttacgtctgatgccgcacaggtaaatagtgtgaaaggatattttgattttattctggatactgtatctgcaccgcatgatgtaaatatgtacatgtctttattgaaaacaaacggcgtacacatctgtgttggtgttccgcccacaccgtatgaagtacatgcgttcagcatcatcggcggcagaaagagcctggcgggttccaatatcggtggtttgccggaaacacaggaaatgcttgatttctgcgcgcagcataatattacgtcagatattgaacggattgatattaaaaatattcatgcttcgtatgaacgcatgttaaaaggggatgtgcgttatcgttttgttattgacatgtcaacctta

SEQ ID NO: 33906 - DNA, 1845 bp, Cytophaga hutchinsonii
cagcattttgaagcctgcaataccaaccagaatggggaaatcttctggcgcgaaacatacctgaacccgatcttccttcccgatggccggattgatgaggtatcgggtatttcccacgacattacggagaagaaacaatgggaaataacgattcaggaaagcgaagaaaaattccggaacatcttcgaatcgttccaggatatttattaccgtaccgacctgagcggttacatcaccatgatctctccttccggctgcgaactgagcggctatacacaggaagaaatcatcggcaaacacatcagtgaattctttaccacgccgaaacagcaggtgaacctgatccgtgaagtattaaaaacaggccgggttaaaaattatgaaacgaatgtaaacatcaaaggcggggaatcgatacaaagtatttcaaacatccgtttgatctacaacaacgaaggaaagccaattggtgtggatggtgtagccagagacattacatttttaaagaaagcatcgcaggaattatatcatgccaaagagattgcagagaagtcgcttaaggtaaaggaaaacttccttgcgaacatgagtcatgagatccgtacgccaatgaatggtgtgatcggtatgattgacttattgaatgaaacaccgctgatggaagaacagcgtaagtatgtgcagacgataaaaaaatcatctgaaacattactgaatattttaaatgacattctggatctttctaaaatagaggcaggcaaaatgcagctgcgtctcgctcctatttccattgagcaaactgttgaaaaactgcatgcattattttatcagcaggcaacgttaaaaaatattgatctgttatacagcattgattcaaatgtgcctaaagttgtgcttgcagatgaaacccgtttgctgcagatcctttccaatcttacatccaacgcaataaaattcaccgatcagggttctgtccgcatccagatttctttacagtctaaaaaagatctggtaaataaaatccgggtcaacatcagcgataccgggatcggtattgcgcaagacaagctgaatgtattgttcggttattttaaccaggtggataactcttcctctaagtcatacggcggtaccggtctgggtttagcgatttccaaagaattaagtaagctgatgaatggcgagattggcgtgcagacagaggccaacaaaggcagtgttttctggttcacctttgaagccaatgaaagcaaacgtttggttgaagcgaaagttgaaacaccaaatgcattctccagtgaaaaaacattcaaggattatccgaaaattttattggtggatgataacgccatcaatctgtttgttgcttctgaaatcttacggaaagcgggctgtgaaattgacaccgccggcaatggccttgaagccatccaaaaggtgaaggaaaacccgtaccggatggtgctcatggatatacaaatgccgcagatggatggtattgaagcaactgctgagatccgtaaattaaatttagcctatacacctccgatcattgccatgaccgcttattccatgaaagaggataaagacaggtttatggtcaatggcatggacgattatattgcgaaacccatcaaggcagaaagtctgatttcaaaggttaaagcgtggctcgattcaaatgcggctaaaaacggacatacggcaacacaaacaagcgatgaaacggcggtcgagatcccgattctggatctggaagtgtttgaaaaactaaaaagcctttccggtgcggaaataatcgatcagatttataaagagtttgaaaatgaatcacttgagcaaatt

SEQ ID NO: 33907 - DNA, 846 bp, Cytophaga hutchinsonii
ttacgtctggcaatccagaagtcgggaagattgagtgaagaatcaatcaaattaattaaagaatgtggtatcgaattcagcagtggtggtggcaccttgaaatcagttgcatataattttcctttagaggttttatttttaagagacgatgatattccgggttatgtggccgacggcgtagcagatattggtattgtaggcgagaatgtggcggttgagacacggaagaagatggatacggttcgtcagttaggtttttctaaatgccgtttatctattggtgttcctaaagcaatggaatttacaggtaaagaaagcctgaacggtatgcgcattgccacgtcgtacccgaatattttatcggattatttatttgaaaataacataaaggcaagcattcatgaaatcagcggttcggtagaaattgcaccgggtattggtcttgccgatgccatctgtgatatcgtaagctcaggaagtacattaataagcaatgggttaaaagaaactgaagtagtgttccgttctgaagcgatcttagcggcttgtccgcagttgagcgcagaaaagaaagctattctggatgaattgatgttccgtatttctgcagttaagaatgcagagaaaacaaaatatattatgcttaacgttccggatcatgcgattcaaacagttacggcattgttaccaggtgtaaaaagcccaaccgtaatgccgttagctgaaaaaggctggagctcgttacattcagtagtaaaggaaagtgatttctgggaaatattaagcaagctgaaagaagcaggtgcagaaggcattctggtgctgccgattgagaagatcgtgaag

SEQ ID NO: 33908 - DNA, 1260 bp, Cytophaga hutchinsonii
gcatctgattggtcaagccttctcaagcgccctgtaatggaagcggcggagctggaggggcgtgttcttgcgattttgaaagaagttcaggaacgtggtgatgcagcactgattgattttgcgttgaagtttgatggtgctgcaccgaagtctttgttagcaaccgatgcagagattgcagaagcaaaggtattggtttcagaagaattaaaagcagccattcaggttgctaaaacaaatattgagaaattccacaccgcgcaaaaagaagtacagataagtgtagagacaatgcctggtgtgaactgctggagaaagagtttaccgatcgaaaaagtagggttgtacattccgggtggtacagcgcctttgttctcaaccatcttaatgctgggtgttcccgcaaccatcgcaggttgttcgcagctggtgttgtgtacgccgccgaataaagaaggaaaaattcatccggcaattttatatacagcaaatttactgggtattaaaaccattgttaaagcaggcggcgcacaaggcattgcagcgatggcctttggtaccgcatctgttccaaaggtgtacaagatttttggtccgggaaaccaatacgtaacaacagccaaacaactggttacaaaatatggtgttgcaatcgatatgccggccggtccgtcggaggttgccgttatagcagacaaacaggcgaatgctgcatttgttgcagccgatttattgtcgcaggcagaacacggtgccgacagtcaggtagtgctgataagtgatagtgaagacatgattaatcgggtgcaaactgaagttgatgcgcagctggaaaaactatcacggaaagatttagctgccaaagcgttggataacagcaaagcttttttagtaaaagatatgaatgaggctatggcgatgagtaatctctatgcaccggaacacttgattttacaagtagaagatttggataatctggtggctaaggttgtaaatgccggttctgtgtttatcggtccatacacgcctgaatctgcaggtgattatgcatcgggtaccaatcacaccttaccgactaacggatacgccacagcatatgcaggcgtatcgctagattccttcatccgtaaagtaacgtttcagaagatcactaaggaaggtttgcagaagattggtccggtgattgaaaccatggctgccgccgaaatgttggatgcgcataagaatgcggtgacgcttcgtctgaaagaaataaacaag

SEQ ID NO: 33909 - DNA, 2082 bp, Cytophaga hutchinsonii
acatatacctcaacctgctcgtattgcggtgttggttgtggtgttaaaattcacaaagcggttaatggcagtcttcagatagaaggcgataaatcgtatcctgcaaaccagggcatgctgtgttcaaaaggcatgaacttacattatgccgccatggatcagacagaccgtttgttatatcctgaaatgcgtggaaacagaaacatgccgttgcagcgtgtttcctgggataccgcgctggatagagctgctgcagtattcaaagcattgatcgaaaaatatggtccggattcagtgggatactatgtgtccggacaatgtttaacagaagaatattatatcgcaaataaaatcaccaaaggttttattggtaccaataacatagacactaattccaggttgtgcatgagctcggcggtggtagggtataagcttgccttgggcgaagactctgtaccgctgagttatgacgatattgaactggcagactgcttttttataacaggagcaaacccggcctggtgtcacccgattttattccgccgtctggaaaatcataaagcggccaacccgcatgtgaagatcatcgttgctgatccgcgcaaaacgcaatcctgttccttggcagatgtgcatttgcaattacagccgggcacagacattgtattgtgtcatgcgattgcacgccggttaattgaaacaggaaagatcgatcaggcttttattgatgcccataccagcggatatgaagcattcaaagaaaaagtttttacgttaagccttcaggaagcggctgatatctgtgtattggaaaaagaactgatcattcaggcagcagatatgatcggcgattcccaggcctttatcagcatgtgggcgatgggcctgaatcaaagtgttattggtgtaaataaaaatgtttcacttctgaatttatcgttaataacagggcagattggcaagccgggcgcaggaccgttgtctttaaccggacaaccgaatgcgatgggtggaagagaagttggcggcttgtccaatatgttacctgcacataaaaacttattaaatccagcacacagaaaggaagtagcagatttctggggtgtacctgctatcaatgaaaagcctggatttactgctacagaaatgtttgatcagctgctttccggaaaaatgaaagctgtatggatcatttgtacaaacccattggtgagtctgcccgatgcacgaaatgcagaagctgcgttgcgtaacgcacgttttgttgttgtgcaggatatttcaaataaatccgacacgttgaaatatgcagacctggtgctgcctgctgctgcgtatatggagaaggaaggcgtgatgacaaattccgaccggcggataagttatctttccaaagtaatggagccgccgggtgaagccttgcccgatgttgacattctgtgccggtttgcacacaagatgggctggaaagaatcatttaattatgcatccaatgcagaaatatttgaagaatatacgcgtatcaccaaaggtacgaatattgatataagcggtttgtcgtatgcagacctgattcagcggagaagcgtacaatggcccgttccggaaaaaggtcatccgggtacaccgcgtttatttaccgatcatacattttatacacctaccggtttagccaatattatttcagtggattctatgaatcactctgaaaaactggatgatgattttccgctgatccttacaacgggacgcatccgtgatcaatggcataccatgacacgtacgggtaaagtacgtaaattgaacaagcacatttcaaaaccctttctggaaatccatccggaagatgccggaataagaggaattaaacaggatgatgttgttacgatagaaagcagaagaggggatgtacgggtaacagctattcttaccgaagatataaaaaaaggcgtagtgtttttacccatgcattggggaaggatgttaagcacagacctgacgcgtacaaacaatgtaaccaataatttaattgatccggtttctaaagagccggactataaattcacagcggtgcaggttaca

SEQ ID NO: 33910 - DNA, 594 bp, Cytophaga hutchinsonii
gaaacaccattgcgggttgatgcatttgaattagaggatgatatcaaagtggaattaatcagcaggaaatttaaggatatcatggaaattcttggtttggatctttctgatgatagtttgaaggatacgccgaaccgtgtagcaaaaatgtatgtaaaggaaatattcagcggcttgaatccattgaacaaaccagctgtggctttgtttgaaaataaatacaaatacgatgaaatgattctggaaaagaacattacattttattccaactgtgagcatcattttgttcctattattggaaaggctcatgttgcttacatttccaatggaaaggtaattggtttgtcaaaactcaacagaatcgttgattattttgcaagacgcccgcaagtgcaggaacgattaacggtacagattgcaaatgaattgaagtctattctgggaacagaagatgttgcaattgtactggatgcaaaacatttatgcgtttccatgcgcggtgtgaaagatgaagccagctcaacggttacggcgcattactccggaaagtttaaagaagaaggggttaaaaatgaattccttgcatatataaag

SEQ ID NO: 33911 - DNA, 792 bp, Cytophaga hutchinsonii
atggatttaaaactgtcagataaagtagcttttgtaagtggctctaccgcaggtattggctttgcaattgctaaaagacttcttatggaaggagctcaggttattattaatggaagaacacagcacaatattgatgaggccatccgcgaactaaaatcagctgtgccaaaggcaaaaatatccggtattgctgctgacttttcaaacgtggatgaggtaaacaaactcatacaagcactccccgacatagatatacttattaataatgccggcatctttgaacccaaagcattcgtagaaattccggatgaagactggtttcgcttctttgaagtaaatgtaatgagtggtatccgcctgtccagacatttctttccaaacatgctgaaaaagaattggggcagaatcatttttatatccagcgaatctgctgtatttattccggatgaaatgatacattacggcatgacaaaaacagcacaacttgctgtaagcagagggttagcagaactcaccaagggctcaaatgttactgtaaattcaattttacctggccctaccaaatctaaaggtgtaggtacgtttattgaagatctgtcaaaagcaaacaatatcagtattgaagaagttgaaaaagatttctttaaaaatatgcgtcctacgtcccttcttcagcgttttgcatctgttgaagaagtcgcagatacagttgcctattacgtaagtccgcttgcttcagccacaaatggtgcttccatacgtgtagaagggggcttagtccgttccattcta

SEQ ID NO: 33912 - DNA, 1197 bp, Cytophaga hutchinsonii
ttgatgtcttcacgtgttttaatttccggcattggttctgtttcttcaattggtctcaatgtaacggagttaacggattctattcttgaatcaaaaacaggtgtttccagaaaaaccagattggattctattctggcgcgtgccttaccaacagcacagatacagctaagtgatgccgcattaaaaagcagggtgccgggtttaccggctaagcaggtatattccagaacagctttattaggtatgatcgccgcttcggaagccgtagcaatggcaggcttaacaaaggaagactgtatacgtgcaggcctggttaattcaaccagtgccggtggtatggataaaggcgaatttttttacgcagattttattcaatctccttccaaaggaaatcttaaattagcattaacccacgactgtggtgacgccgccgaacaaatggcagccttgctggggattgaacaatacattacaaccatcagtacagcgtgttcatctgcagccaatgcaatgattcatgcagcacgcctgattaaagcaggcgtatgcgatatagttgtggcaggcggttcagatgccatctgtaaatttaccataaacggttttaattcgctgatgatcttatccgaagagccttgcaaaccctttgataaaaaccgtacgggtttgaatttaggtgaagccgccggatatttcgtacttgaatcagaagcttcggtaacccgcagaggtgtaaaaccattagccgtattatccggttatggcaatgcctgtgatgcgtatcatcagacggcatcttcgcccaatggagaaggcgcttacctggccatgatgcaggccatcaacgtgagcggttatgcaccatccgtgatcgattacatcaatgcacacggaacaggtacacagaataatgacatgtcggagagtgttgccttgcagcggatcttcccggcagatcttccgccggtgagttcaaccaaagccatgaccggccataccttagcagctgcaggtgggatagaagcagtcatgtctgtgctggcgatacagaacggatggatgttcccgaataaaaatttcaaagaccccattgaagagacaggtattataccggttacagaacttcagacaaataaaacgattaaacatattctctctaattcctttggttttgggggcaacaactcatctttactg

SEQ ID NO: 33913 - DNA, 1104 bp, Cytophaga hutchinsonii
aacgtttacatacttgctgattctgttgtgacgccattggggcagagcacggaagagaatatggaaaagttatatagcttgcaatctgctatcagaacatatacgcatccgcagatcggtactttttacgcgtcaaaatttgaagacggaaaatcgtttcaaatcaaaaaagatgcagccggtaaaactaaaatagaacgtctgtttatttcctgtattgaaaaagccttagaacgtacggaaattgatgtagaaaatgctaacgtcttgtttgtatttgcttcaacaaaaggaaacgtagaatacctgacagacgaaacatttgataaaaaccgtttacgcatcgggataacggcacaagacgttaccgcctattttaataatcccaatacacctattgttgtatccaacgcctgtatctcaggcttacaggccattcaatacgggtatgaagttttgcaggacaaccgttacacacatgtagtggttacaggagcagattgtttttcagaatttattctgtccggctttcattccttccaggcacttagcccgtttccatgcaaaccatttgataaagcacgtgcaggtttatccttaggagaaggctgcggcacattgatattaagcaataaaaaaactgatgcagcagctattgaaattctatcggttgtatcttccaatgatgccaatcacttgtctggtccttcaagaacaggagaagggttgtcgtctgctatccttggcgcgataaacgaagccggtattaccgcagagcagatcgacgttatttcagcacacggaacagcaacgctctataacgatgaaatggaatcgatggcatttaaaacagcaaacctggaagcaaaagctgtttatagtgtaaaaggcaatattggtcatacgctgggcgcggcaggtattattgaaaccatttacctggcgcagagtttacaaaataacatgcttgttccatccattggttttactgaaaccggtacaagcgtagaattaaatgttacacgccagtccactcttaaaaccatgcagatcggcttgaaaacagcgtctggttttggcggaggtaacaccgctttactttta

SEQ ID NO: 33914 - DNA, 723 bp, Cytophaga hutchinsonii
aatttaaaatacgcattggttacaggtgctgccagaggtattggaaaagcaattgctgtaaagctggcttcagacggttatcatgtgctgattaattataaatcaaacgatgctgaagctgaaaagacaaaatcggctattgaagaacagggcggagctgcaacattgatgaagtttgatgtatcggatcgcacggaagtaaataacgtattagcaggctggctggaacagcatcccgattctgttatcgaagtgcttattaataatgccggtatccgcaacgataatttattgatgtggatggaaccgaaggattgggatggcgtgatcgatatcaacttaacgggtttttataatgtaaccaaaacattgatcaaccagatgctgttgaatagatatggccgcattataaatatcgtttcgctatcaggcctaaaaggtgtacctgggcaaatgaattactctgccgcaaaggctggcgtaataggtgctacaaaagctttggcacaggaagttggaaagcgtggaatcactgtaaatgccgttgctcccggttatataaagacagatatgacgcaggatataaatgaaaaagaagcaaaagcacagataccggcaaaccgttttggcgaaccggaagaagtagcagagcttgtttcatttctggcttctaaaaaagcttcgtacataagtgccgaagtaatttctattaatggcggattg

SEQ ID NO: 33915 - DNA, 1380 bp, Cytophaga hutchinsonii
atgataacgattggagaccagatagtaacactagatcaattaaaggggtttttatattcaaacgaacaacttgagatcagtgcagcagcgattgaacgagtaaaaagaaatcatcagtttttgatacatttttctaccgataaaatcatttatggtattaatactggatttggtccgatggctcaataccgcgttagtgatgaagatcgtaaaaccttacagtataatttaatccgcagccattgttcaggtacaggtaatgcacttgatccgatctatgttaaagcagccatgattgttcgcttaaacagcttcctgatcggaaaatccggcgtacacgaaagtctgatatttctattgcgcgatctgatcaacaacaatattacgcctgttgtatttgaacacggtggtgttggggcaagcggtgatttagtgcagctggcacatttgggacaatgtctgatcggcgaaggttctgtgcactacaagggagagatccgtgaggctgcagaagtatttgcagaagcaggtatttcaccgataaccattcagatcagagaaggcttagccgtaatgaacggaacttcttttatgacaggtattggtgtggtgaatttaattcaggcacaaaatcttgtaaactggtcggtgaacgcagcatcattgatcaatgaactgatcgcttcatacgatgattatttttcttctgaactgaacgatgtgaaattacatgccggccagcgtaaagtagccgcacagataagagaacgtttagaaggtagtacgctgatcaaatcacgtgctacgcatttatacaaaaaagtggatgaaatgtattttgaagataaagttcaggaatactattcgatccgttgtgtaccacagatcgttggccctatcagcgataccattgaatatgcaacaacagttattgaaaatgaagtaaactctgttaacgacaatccggttgttgacgaagctgccaataatatttatcacggcggtaatttccatggcgattacatttcgctggaaatggataaagtgaaaattgctattacaaaacttgccatgctggcagaacgtcaggtgaattatttaatgaacagcaaattaaataatatgcttccgccgtttttgaataaaggtgtgttagggttgaattttggtttacaaggggttcagtttacagctacatcaaccgttgcagagtgccagacattagcaaacccaatgtatgtacacagcataccaaacaataacgacaatcaggatattgtaagtatgggtacaaactctgccttgatatgcagcaaagtaattgagaacgcatatcaggtaattgccattgaattgatgtctattacacaagctattgat

SEQ ID NO: 33916 - DNA, 2070 bp, Cytophaga hutchinsonii
attccttctattcattgcagttcctgcctgtggttactggaaaaactttatacgattgaaccgggcattatccgctcggatgtaagctttaccaaaaaagagatttcaattacctataacagttctgtcgtaaacctgcgtcgtatcgtagagttgatggattcgcttggttacgcaccacacatacaactgaataaaacaacagagaaagaaacgcctgaaaccaaccgcagtgttttttataaactggtagtagcaggtttttgtgcttcgaatagtatgttgatgagtttcccggaatacctggggcttgacagggaaatagaagggatgtatgcagaggtattcggatacatttctattgcgcttggtttacctgtattattttattccgcatctgatttttatatcgctgcctggaaaggaataaaaaacaaaatgatcaacctggatatgcccattacgattggtatgacagcgttattttcccgaagtgtatatgaaatactgacccataccagcgcagggtatattgattcgtttacaggtctggtcttttttctgctcatcggtaaatggtatcaaagcaaagtatatcaatcgatgtcgtttgaccgcgattatcaatcgtattttccggtagcggtaaacagagttgaggccgatgggctgaaaccagctgctatttctacgcttcgtgcaggagaggagatcgtaatccgttcacaggagattattccggcagatgcaacattaataagcgaaagcgcatacatcgattatagttttgttacaggtgaatcactgcctgttaaaaaacataaaggtgaattgatctatgccggtggcagacaaacaaaggaaagtattcacctgcgcatagaaaaagaggtgtcacagagtcatttactgcagctgtggaataatcaggtgtttgataaatcgaaaggcggcaattctgtttcgcagcttgcagatcgcttcggccgtaattttaccattgctttattgatattgagtgctataacattcggatattggtataccattaatattgctgcagcatttaatgcattaacagctgtcttgattgtagcgtgtccgtgtgcgctggcgttatccattccgtttgcttatggtaatgcgattcgtattctggcaaaaaaaggattgtttttacggagtacagaggtagttgaaaaacttgcacacatagatacaattgtatttgataaaacgggtacgattacccaatccgaccagtctgcggttaccttttatggaaataaactcaccatggaacagcttggctgtatttatgcagtcgtgcagcattcgacgcacccgctaagcatgaagcttgctgcctatttaaaaccgcacgcattacattatgttgtttctgattttgaagaaatttcaggaaaaggcctgcaggcaagcattgcaggtaataattataaaatcggatcggcagcttttacacagcgaagagaggcgggtacattagccggagcatatgttggtatttctgtaaatgatgtattttacggttactatatcttccggaataaatatcggatgcacatggacacattgatacagcagctgaaaggtacataccggttgtatgtattgtccggagataatgatacggaaaaaaaacagctggaagctatttttccggaagcagaaaatattatttttaatcaaagccccgaagataagctcgccttcatatccgggctgcaacagcagggaaaacaggttttaatgttgggcgatgggttgaatgatgccggtgcattaaagcagagtaatgtaggtatttctgtttcagaagaagtgtataatttttccccatcctgcgatggtattatggatgcattatatatttcttcattgagtcgtatgttaaactttagtagaggaacggtaaaagcggtaaaagcaacattattattttccattttatataacattgttgtcattacactggcagttcaaggcctgttcagtccgcttgttgcagcggtgattatgccggtaagttctgttacggttgtatta

SEQ ID NO: 33917 - DNA, 1277 bp, Cytophaga hutchinsonii
ttaataaccctggcaatggtcttttgcagcatgcttgctgtaaatgcacaaacgacacccgttcagaaatacgggcagttaaaaattttcaacggaaaagtttccgatcagaacaacaacccggttgttttacgcgggatgtccttattctggagcgggtatccggaaggagcaccgtactacaatgcaactactgttaaatggctgcgggatgactggtgtgtggatgtagtccgtgctgccatgtctgttgaaacaggatcttccaactacgtaaataatccggcggcagaaatggctaaggtgaaagccgttatagatgcctgtattgccaatggcgtatacgtaattgtcgattttcatacccataatgccgaaaactataaaaaccaggcaaaaacgttttttacggagatcgcaacaacgtatggcaatgtgccaaacgttttatacgaaacgttcaacgaacctatttatcaatcttggtcaggtacgattaagccttaccacaatgagttgatacagaccatccgtgcaaaagatccggataacatcattatctgcggtacaagaacatattctcaggaagtggatgaagcggcaaacgatccggttacaggaacgaacattgcgtacactgtacactactatgcaaattcacaccagggttcattaagacaaaaagttacaaatgccttaaacaaaggtgttgcaattttcgctaccgaatacggtacaaccgatgcttccggtaacggcggctataacccgggcgaatcgcagacctggtggaatttccttgaagcaaataaaataagttcagccaactggtctgttacaaataaaaatgaaacttctgcggcattaaagccgggtacaggcatcagcaactggacaaccaacgatcttacagcttcaggtgcgcttgtacgggcatatctgaagggtaaatgtaatgttacggttactacaggatctgttaccgttgcatttgcaggaaataagattgtatatgatgcgggcgaaacagttactatgacagctactgctacagtagcaaacggtacaatctcaaaagtggaattctatagcggtacaacgttattgaattcagacgcttcgagcccgtatacattttcaacatcaacgcttgcatcgggtggtcacagcatcactgcaaaatcatatgatgcagcaggcgctgtaattgcaatatctccggtatatgtaataagtattattggtgcgtcaaatgttgctacaacaggtatcaccga

SEQ ID NO: 33918 - DNA, 843 bp, Cytophaga hutchinsonii
gcatacgttttccctggtcaggggtctcaattttcaggaatgggtaaagacctttttgaaaactctgcgaaagcaaaagaattatttcttcaggcaaatgatattctgggattcgatattacgaaagtaatgtttacaggtacagacgaagaattaaagcaaacgaatgtaactcaaccggctatatttattcattctgttatacttgctaagatcagcgaaacatttgcacctgaaatggtggcaggtcactcgttgggcgagttttctgccttagttgcaaatggtacattatcttttgaagatggattaaaattagtatccaagcgtgctgctgccatgcagaaagcatgtgaacttgtaccgggtacaatggcagctgtattggccttagcggatgaaaaggttgaagagatatgtgcatctattgcagatgaagttgttgtcgcagcgaattataactgtccgggacaattagttatttccggcagtgtaaaaggaatagaaaaagcatgtgagctgatgaaagcagccggtgcaaaacgtgcgttggtattacctgttggtggcgcattccattcgcctttaatggaacctgcccgtattgagttagaagacgcaattaaaaatacattgttcagcaagcctgcatgtgccgtttaccaaaacgtaaatgccaagccttcaacagatgttgaagcaatcaaattaaacctgattgctcagttaacggctccggtccgctggacacagtctgtacagaatatggtaaaagatggcgcaacaacgtttgttgaatgtggtccgggtaaagtattacaaggtcttgtaaagaaaattgaa

SEQ ID NO: 33919 - DNA, 1773 bp, Cytophaga hutchinsonii
aagtacaacattattgttgtaggtactggtcttgcaggtgcttctgccgctgcctcattagcagaactaggttacaacgtacaggcattctgctttcaggatagtccgcgccgtgcgcactccatcgcagcacaaggcggtattaatgcagcaaaaaattatccgaacgatggtgactctgtttaccgtctgttctacgatacagtaaaaggtggtgactaccgtgcgcgtgaaggaaacgttcaccgtttagcggaagtctctgtaaatattattgaccagtgcgttgcacagggtgttccgttcgcacgtgaatacggtggcttattagataaccgttcatttggtggttctcaggtatcccgtacgttctatgcccgcggccagacaggacagcaattattattaggtgcttacagcgcacttagccgtcagattcacacaggcaaagtaaaaatgcacacgcgtgaagaaatgctggatctggtaatgattgatggggaagcaaaaggtattgtaacacgtaaccttgaaacaggtaaaattgatacacacgctgcacacgccgtacttctttgtacaggtggttacggtaacgtattcttcttatctacaaacgcgcagggttcaaacgtaactgcagcatggagagcacacaaacatggtgcattgtttgcaaacccatgcttcacacaaattcaccctacatgtattccggtttcaggtgatcatcagtctaaattaacattgatgtctgaatcacttcgtaacgatggccgtgtatgggttccgaaagcaaaaggcgataaacgtaaagcaagcgaaattcccgaagacgaaagagattacttcttagaaagaaaatacccgtcattcggtaaccttgttccgcgtgacgtggcatcacgtaacgcaaaagaacaatgcgatgcaggcaaaggtgttggtacaagcggcttagctgtttatcttgactttgctgaatccatcagccgtttgggcgaagacaccgtacgtgccagatacggcaacttatttgacatgtatgcgcagatcaccggtgagaatccgtataaagaaccaatgcgtatctaccctgccgttcactatacaatgggtggtctttgggttgattacaacctgatgactacgattccaggtttgtatgcattaggtgaagcgaacttctctgatcacggtgcaaaccgtttgggagcatcagcattaatgcaaggtttggctgatggttactttgtagtgccatatacagttggtgattacttagctaagatcggaccgaaagcggtagatacgaaacaccctgcatttgctgaagcaaaagcgaaggttgaagaacagacgaaaaaactattagcaataaaaggaacgaaaacggttgccgaataccaccgtgaattgggccacatcatgtgggaatactgcggtatggcccgtaatgaagcaggtctgaaaaaagcacaggtattgattcaggaattacgtgccgatttctggaagaatgtaaacgtaaccggaacaaacgaagaactgaaccagcagcttgagcgtgcaggccgtgtagctgacttcctggaacttggagagttgatggtggtagatgccttgaaccgctctgaatcctgtggtggtcacttccgtgaagaatcacagacagaagaaggcgaagcattgcgtaacgatgacgatttctgctacgtagctgcatgggaatacaaaggcgataatcaaccggaagtattacacaaagaagta

SEQ ID NO: 33920 - DNA, 729 bp, Cytophaga hutchinsonii
atgtcaggtcacatgaatttaacgttaaaggtttggcgtcagaaagatgctaaatcttcaggtaaacttgaaacatacgaagcgaaggatatctctccggatatgtctttccttgaaatgattgatgttgttaacgaaggtctgattaaaaaaggtgttgaacccatcgcttttgatcacgattgccgcgaaggtatctgtggtgcgtgcagtatgtacatcaacggacatgcacacgggcctaaaaaaggcattacaacgtgtcagctgcacatgcgcagcttcaaggatggcgaaaccattaccattgaaccatggagagcgaaggccttccctattataaaagatttagttgttgaccgttctgcgtttgaccgtatcatacaggcaggtggttatgtgtctgtaaacacgggcgtaaccattgatgcaaatgcgatcgcaatccctaaagagcatgcagacaatgccatggatgcagcaacctgtatcggctgcggtgcctgtgtagcagcatgtaaaaatgcttctgctacgttgttcttatctgcaaaggtttctcagctggcattgttaccgcaaggtcatccggaaagagcttcgcgtgttgaagcaatgatcgaccagatggaagcagaaggtttcggtaactgtacaaacacagaagcatgttctgctgaatgtccgaaagaaatcggccaggaacacatcgcccgtatgaacagagag

SEQ ID NO: 33921 - DNA, 1626 bp, Cytophaga hutchinsonii
ggggagattgttttcaatacccgtaaaggccaggccagcgaacacttctatggcttaggcgataaatctgccgataacgatatccgcgaaaaacgttttgagaactgggggaaagatacgtatgcctacggcaaggatacagatccgctctacaaaaacattccgttctttatcggcctgcatcataaagtagcttacggtattttctttgataatacattccgtacttattttgattttggattcgaacgcaagaatgcaacgtcattctgggcagacgggggtgaaatgaattattatttcatttatggtccggagctgctcaatgtagtggaaacgtataccaacatgaccggtaagcctgaattgccgccgctttgggcgttgggctttcatcaatgtaaatggagttactatccggaaaaacaggtgcgtgaaattacaagtgaattccgcacacgcagaatcccctgtgatgccttttatctggatattgattatatggatggcttcagatgctttacgtggcatcccgaacatttctctaatcccaaaggcatgatttccgatcttgaaaaacaaggcttcaaaaccgttgtgatcattgatccgggtattaaaatagatcccaattaccgcatttataaagaaggtctggaaaaaggatatttctgcaaacgtatggatggcccgttaatgaagggcgccgtgtggccgggagaatgtaactttcccgatttcacccgcgcggaagtgcgtgaatggtgggctggtttatttgatgaactgatggataccggcgtgcgcggcgtgtggaacgacatgaacgagccggcggtatttgaaatagaaacattccccgatgatgtgcgccacgattacgatggtgatccatgcagccatagaaaagcgcataatgtttacgggatgcagatggcgcgtgcaacctatgaaggcgtaaagaaattcggacataacagacgtccgtttgtaattacacgttccggttattccggcctgcagaaatattcttctgcgtggacaggcgacaacgttgcttcatgggaacacttgtctatagcaaacagtcagtgtcagcggttaaacgtatcgggcgtttcttactgcggctccgacatcggcggctttatcggttcaccatccggcgaattatttgtgcgctggattcagcttgggatcttccatatgttctgccgcgtgcactcatccggtgaccacggcgatcaggaaccatggtcgtttggcctggaagtagagttgcttacaaagaaatttattgagctgcgttatcagctgcttccctatatttatacaacattttatcagcatgtaaaaacgggtgtaccaacgctgcgtcccttgccatttgtagcacaggaagattctgaaacatacaacaggcaggatgaattctgcatgggcgacaacctgctggtttgcccgatcctggcagaaaaagttgatggccgctgggtgtatctgcccgaaggcaagtggtattattactgggatgataaagtgcatgaaggcaaccaggaagtatgggccgaagcggcactggatcggattccgttgtttgtaaaagcaggcgcagtaattccgatg

SEQ ID NO: 33922 - DNA, 1194 bp, Cytophaga hutchinsonii
aaaaccaccatgaaaacagtagacagttttaacttttcaggtaaaaaagccctgatacgcgttgattttaacgtccctcttaataagagttttgaaattacagatgatacaagattaaaagcagtattacctactgtttcgaaagtattaaaagatggtggttcagcaattttgatgtcacacttaggtagaccaaaaggtggaccggaagaaaaatattctttaaaacacatccttccttatctgaacaaaatgttcggacaggaagtattgtttgcggcggattgtatcggtgaagatgcaaaagcaaaagcagcagcattaaaaccaggtcaggtattattacttgagaacttacgtttctatccggaagaagaaaaaggcgatgttgaattcgcaaaaaaactttctgtattaggtgatgtatgggtgaatgatgcatttggtaccgcacacagagcacatgcttcaacagcggtaatcggacaattcttcaaagataaagtttgcgggtatgtaatgcaggctgaacttgacaatgcaaataaattattaaagcaaggtgaaaaaccaatcacagctgttatgggaggttctaaaatctctgataaaatcatggtgattgaaaacttattagatacggttgacaacctgataatcggtggcggtatgtcttataccttcacaaaagcattaggcggaaagattggcaaatcaatcaacgaaccagataaattagagcttgcgctttcgttaattgaaaaagctaaagcgaaaaatgttaaattatatttaccgttagataacgttgttgcagatgatttcagcaacgatgcaaacaagcagacagtaaaaacgggtgaaattccggatggctgggaagggctggatatcggacctgaaactgttaagttattcagcgaagtagttgcaaactctaaaactgttttatggaacggaccaatgggcgtgtttgaatttgcaaactttgctactggtacgattgctattgctaaagcagttaaagaagcaacacaaaaaggagctttctcattaatcggtggtggcgactcagctgctgcaatcaacaatttaggtttcggtaacgatgtatcttacgtttctacaggcggcggtgcattacttgaatacttcgaaggcaaaacacttccgggtgtggcggcgttggagaaa

SEQ ID NO: 33923 - DNA, 1654 bp, Cytophaga hutchinsonii
tacagataaaaatggctgttctgtttcaatcggtccgttaaccatttcacagaatccaccaatcaacctgacggcttcaccaacaatcacaaatgttttatgtaatggaaacagcaccggaagtattgttattaatccttcgggtggtaatgctccctatacgttctcctggaccaatggtacaacagcacagaatttaaccaatgctccggcaggtacttattctgtaacgattaccgataacacaacctgctccagaacatttggaccttacacaattactgaacctattgcaatttctgcaactgcaacaccagtgagtgtttcgtgtaatggcaaaccagatggttcaattacacttacccctgcaggcggaactgctccttacacgtattcatggagcaatggtgctacaacaaaagatgtttcgggattagctgccggcacctatacagtaaccataaccgataataacacctgttcaaaagcttttggcccatttacgatcacacaacctgtagcaatttctgctactggtacagtgagcaatattacgtgtaatggttcatcaacggggtctataactattacagcaccaactggcggagcagccccttattcttactcctggaacaccggtgctgctataaaagatcttacaggactagctgccgggtcgtatacgttaaccattacagatcaaaatggttgctcccgtatattaccaacatttacaattacacagcctacagcattatcaagcattggtgctgtaacacaggttgtgtgcaatggaacagctacaggggctataaacatttctacaccaacgggcggtgtagccccttacacattcctgtggtcaaatggacttacaactcaaaataatccttcccttattgcaggcagttattctgtaacgattacagatgcttcgggctgtaaacttgttttaccatttacggttacagaacctgctgcaattgcaacaacggaaacccaaatgaatgcttcctgcaatggaacttcaaccgggtctatttctatttcaacacctaccggaggaacagctccttttacctatttatggtctaatggtgtaactactcaaagcaatatgtctatccttgccggaaattattctgtaacaattacagacagtaaaggctgttcaaaattattcggcccgtatacaataacagagcctgcttcaatagcagtgacaggaacttctacacctccatcctgcaatggttcagcttccggttccatttcacttgatcttcctacaggcggcgtagcaccctattcctatagctggtcgaatggtgcaaccacgcagaatttaacaaatgttgtagcagggacgtatactgtaaccattacagatagtaaaggctgttcaaaccctactcctgtttcatttactattgctaatggtgtacctattactggtacagcatctgctacccctgcaactgtttgttccggccagggcactatggttactgcaacgattgatgcggcttatacacctgcaaccaacgcttattcatttaatgctgggtcaacattccagtcttcttcttcttttgctattgccaaaatcacaggagatacagtaatatctgtagttataaaagatataaacgga

SEQ ID NO: 33924 - DNA, 2241 bp, Cytophaga hutchinsonii
ataaaaaaggtctattctcttatgcctcaaagaattgaggcagcaaaaaagttgataggcaaacctttaacgcttactgaaaaaattctttattctcatttggatgaaggtacagcgacaaaggtgtatgaaagaggtgtatcttatgttgattttaatccggatcgtgttgctatgcaggatgcaacggcccaaatggcgttgttacaatttatgcaggcaggaagaccgaaagttgctgtaccatctaccgtacactgtgatcacttgattactgcaaaagaaggagcaacaaaggatttaccttttgcaaataaagaaagtaaagaagtatttgattttttaggttctgtttctaataaatatggtattggattctggaaaccaggtgcaggtattatccaccaggtagttttagaaaattatgcattcccgggtggtatgatgatcggtacagattcacatactgtaaacgcaggtggtttaggtatgctggcaatcggtgttggtggtgctgatgcatgcgacgtaatggctggtcttccatgggaacttaaattccctaaattaattggtgttaaattaaccggtaaattgaatggctggacagcacctaaagacgtgatcttaaaagtagctggtatcttaactgtaaaaggtggtacaggtgctattgtagaatactttggcgaaggcgctacttctatgtcttgtacgggtaaaggtacaatctgtaacatgggtgctgaaatcggtgctaccacgtcaacatttggttacgatgaatctatggagcgttacctgcgtgctacaggccgtgcagatgttgcagatttagctaacggtatcaaacagcatttaaatgcagatcctgaagtatacgcttctcctgaaaaatatttcgatcaggtaattgaaattaatctttctgaacttgagccgcacttgaacggtccgtttactccggatcttgctactcctgtttctaaaatgaaagaagaagcagagaaaaacggatggccgttaaaagtagagtggggcttgatcggttcttgtacaaactcttcttacgaagatttatcaagagctgcttctatcgcaaaacaagctattgctaaaggtttagtgacaaaagctgaattcggtatcaacccgggttctgaacaggttcgttatacggcagacagagatggtttgttgggtacgttcacagacctgaatgcaaaaatatttacaaatgcctgcggcccatgtatcggtatgtgggaccgtgtaggtgcggagaaaaaagagaaaaacacaatcgttcactcgtttaaccgaaacttcgcaaaacgtgcagatggtaacccgaatacatttgcatttgtagcgtcccctgaaatggttgctgctattgctattgcaggtgatctttctttcaatccaatcacagattcattgatcaacgataaaggagagaaagtaaaattagaccctccattcggtgatgaacttcctacaaaaggttttgctgttgaagatgcaggcttccaggctccggctgctgatggctctgccgttcaggttgctgtttctccaacatctgatcgtttacagttattagatccgtttagtgcctgggaaggtacagaccttaaaggccttaaattattgatcaaagcaaaaggtaagtgtacaaccgatcatatttctatggctggtccatggttgaaatacagaggtcacttagataatatttctaataacatgttgatcggtgccgttaacttcttcaacgataaaacggatgatgttaaaaaccagttaacaggtacttatggtcctgtacctgctacgcagcgtgcttacaaagctcagggaatcggctctatcgttgtaggtgatgaaaactacggtgaaggttcttcaagagagcatgctgccatggaacctcgtcacttaggtgttcgtgcggtattggttaaatcatttgcacgtatccatgaaacaaaccttaaaaaacaaggtatgcttggtttaacgtttgcaaacaaagatgattacaataagattcaggaagacgattccatcgatatcttaggcttaacaacttttgcgccaaacgttccattaacactggtgttaaatcacaaagacggaagtaaagaagagattaaagtaaatcacagctacaacgaacaacagattgagtggttcaaatccggtggcgctttaaatatcatcagagctaatgttgga

SEQ ID NO: 33925 - DNA, 765 bp, Cytophaga hutchinsonii
ataccattttacaaatatcagggaactggaaatgatttcattatcatagataaccgcagcaatatctttgatagagaacgccgtgatattgtggcgcaactgtgcgacagaagatttggaatcggtgcagacggctttattctattgcaaaataaagaagggtatgattttgaaatggtttattacaatgcagatggaaacgaaagtaccatgtgcggaaatggtggcagatgcattgttcagtttgctcaggacatcggagtaatgaatcttacaacacattttttagcagtagatggagtgcattatgcatttataaaagaaaagcttgtaaacctgcagatgatgaatgttgccggaattgatacattggcagacgatacattctttttaaatacaggctctccgcattacgttaaaaaagtagaaaaaatagaacagtttcctgtttttgaaacaggaaaatcaatacgttacagcgatacatttgcacccggcgggacaaatgtaaacttcatggaaatgcaggataactggctttttgtacgtacatacgagcgtggtgttgaaaacgaaacatattcctgcggaaccggtgtaacagccgctgcaattgctgcagagaagcttggcatagcacctcagtatgttttaattaaaacactggggggtgaattagaggtaacttttattaaaaaaagcgacgggagctataaagatgtattcttgatcgggcctgctaaaagagtatttacaggggaaata

SEQ ID NO: 33926 - DNA, 1251 bp, Cytophaga hutchinsonii
tttattcaaaataggagcaaattagcagaaaagttagtcccgaacgcgttagcaatttttcattcaaacgatatttatccgaccaatgcagatggcacgatgccattcagacaaaacaacgatcttttttatttttccggtattgatcaggaagacacgattctattagtctttccggatgcatctgataagcgatataaagaagtattgttcattcttgaaaccaatgaacatctggcgatctgggaaggagcgaagttttcaaaagaagaagcaaagaaattatcgggcatagaaaccatattctggtttcatgaatttgatgcaatattaaagcagctggtgtatgatgccacaacgatttattgcaatcaaaatgaacatggccgcgctgaaaagcttatagatacaaggaatgaccggtttgtacaaacatgcaaaacacgttatcccctgcacgaatacaagcgtttggccccgctcagcaacgcattgagaagtatcaaatcaaaatcagagattgataccattcaaaaagcatgtaacataactaaagatgcgtttgagcgcatattaaaatccattaaacccggaataaaagaatacgaaatagaagccgatatcattcatgagtttataaaacaaggttcaagaggacacgcctatcagcccattattgcagccggtgcaaatgcatgtgtattgcattacatccaaaacgatcaggtatgtaaggaaggcgacttgatcctgatggattttggcgctgaatacggaaactatgcctcggatttaacacgtactgttcccgtaagcggaaaatttacggcaagacaaaaagaagtgtatacttctgttttaaccgtgttcaagcaaatcaaaaaatgtattaagccaggtgttacgttacaagaacttaatacccaaacaggtaagtttgttaccgaagaattactgcgtttacatctgctttctaaaaaagaggttgatgcaccagatggaagcctcgcatataaaaaatacttcatgcacggaattggtcatcacttaggtttggatgtgcatgatgtgcatgtaaaaaatgaaccattaaaagaaggtatggtgataacgcttgaacccggaatttacattccggaagaaggtataggaattcgtttagagaatgatattctgttagttacaaatgggaatatcgatttaatggaacatattccgcttgagattgaagctatcgaatcactaatgagt

SEQ ID NO: 33927 - DNA, 1200 bp, Cytophaga hutchinsonii
tatcaatatcccaacgggataacgttgctgcataaacaggttttatcaacccgtattgctcattgtggttatatttttgatgtgggcagccgggatgaagatttgaaaacgcaagggttggcacatttttgggagcatatggctttcaaaggaactgacaaacgtaaaacatttcagatactaagcagcctggagcaggtgggaggcgatttaaatgcatatacaaccaaagaaaaaatatggtttcatgcatcactgccttttacgtatctggagcgtgcagcagacgtgctgacggatatttctttcaattcaatttttcccgaaaaagaaattgaaaaagaaaaaaaagttgtgcttgaagaaatgcatatgtatgcagataacccggaagacgctattcaggatgaatttgaaacattaatatttccggaacattcattagggtataatattttaggtaccgaaaagacactgcaatcattcacgcagcagaatttaaaatcatttcttaaaaagaatattgatacaagcagagttgcatttgtggtgctttcgccgcaatcttttacagaggtaaaatacattacagataaatacatccctcatgtgaaagcgcagcattcagccaaggtacgcgaaaaaaacagaggttttaaaccagctaccctcatcaaaaagattgatgcttctcaaacacattgtgtaatcggcagtcttgggctgaatataaaagaagagcggagattgggtttgttcttattgtcaaacctgctggcaggcccgggtatgacatctacgctgaacatggctatgcgagagaagaaaggctatgtatataccatagaatcaaactttacttcttatatcgatacgggtgtgtatagtttttattttgctacggaatcaaaacaatttgaaaaagcactggatgtttttcataaagaaatagcaaaagtaagggaaaagaaattaagtacagttcagctgcatcgcttaaaagaacagattaaaggccagttgataatggctgaagagaataacagtaactttatgcaaatgatgggcaagagctatctggattttggtaagatagattcgtttgatcatatcataaaaaagatagacggcatatcggcagaagttattaacgacttggccaaccagttgatgaatcctgcgcgcatgagtaagttgatt

SEQ ID NO: 33928 - DNA, 1194 bp, Cytophaga hutchinsonii
cttattgtgtttttgattgcctgtctgtacagcgcgatgctgtcggcgcagatcaatacaccatccggagctgtggtaccatttaactcgaatccgaattatggtggtaacggtattatgccaaccaacctgccaaccaccggaacatatggtaaatcgcaggatgcggcagatgcctataatgagtggaaagctgcctatacagaaacatgtacaggtgatatgatccgtatcaaatttgatgagccgaatcgtaccgtgtctgaaggtattgcgtatggtatgcaattagctgcctatgctgcggataaagcgttatttgatggtttgtataaatactggaaaaacttccagtctccgaattcatccggtaaagccggtaagttaatgaactggagaatcaatggctgttcaggcgtgagtggtacaggcagtgctgccgatgctgacgttgatgctgcatgggcattaatgatcgcagaaactcaatggccgaatctgaatacaccttatgattatatcactgaagcaaacaatatgcttaatgccattaaggaattggaaatgctgaatggtcagcttatcaatggtgatggctggggatttgctgatcagtgccgcaacccttcgtatcagtctcctgcatattatgaatacttcaaagttgtaaatgcaggtaactcaggtacatggaacggtggaattacaggagcctataatctgattaatgcaaacgctgacgttactaccggtttaatttcggattggtcaaatccaagcggtgttagaaatacctgtaacccgggtggacttggacaggcagcaacagatggttatggctatgatgcctgtcgtaacccatggagaatggcacaggatgtaatctggaacaacaatgccaacgcaaaaacgatttgcggcaaaattaccgataagtatatcaatgtaaaaggtcccggtggcgtaggtggtccgttatatcagaatggtaataactatgccggtttctcacacaatgcaacattcgtttccacatttgcaatggctgttatgggttcaaccaaccaggcgttgatgaactccatgtatacagagacaaaaaatacaaaagatgtaattaaaaactctacactttccggttatttcggtaatacattgcgctgcgtgtctttatttatgatgacaggtaacttc

SEQ ID NO: 33929 - DNA, 1719 bp, Cytophaga hutchinsonii
ttacctacaacggtattcgctattagtggtattcctgcaacaccaatcgcggcaggcggcagtgcaacgtttaaagtaacgggcaaaccggcagcagctggcgtaaatacaggatctattaccattgttacaaatgatccggttacaggctcatacaaagtaaatgtttctgtaacaggtactgtgcctgcattacaggtattaaacagtgcaacagctgtaacatctgacaatgcaccggctatttctgttggttcatctacggttggtacttctgcagcagcttatacggcgttctctgttaaaaatgctggtttagctccgcttacatttacatcgattacaagttcttctgcagactttgtaatttcagctgtaacacctgcaacacctgcatctattgcagcgggcaattcagcaacattcaccgttacagccaagccggcagttgtaggagctaatactgctgttataactattgtaacaaatgacccaacaaaccctaccttcaaattaaatgtatcggttacaggtattgctgcatcaacaccttctgtacaggtattgaatggcgcatctatcgtaacagataactctacggcaatactggtaggtactgctcctgtaaatacaacggcagcacctttcacaacgttctcaattaaaaataacggaacagctgctttagacttcacatcgattacaagttcttctgctgatttcgtaatttcagcggtaacacctgcagcaccaacatctcttgcaataggtgcatctgcaacatttacagtaacagccaaacctatggtacttggaactggaaatacagcggtaatcactattgttacaaacgatccgacaacagcatcgtttaagttaaatgtaacggctacaggtacagcacccgctattcaggtatttgatggtgccggtacaacgactcagatcacatcagataacgtaactgccatttcattaggcacagctacggtgactgaagcggcaacgccttcgcacacatttacaattaaaaataacggtacagctcctttaacaggacttgcattaacagcaacggcaggttttgaagtttctgctttaacaccggcaggtacttcgcttgcaccaaatgcaacggctacgtttaccgtaacaggtacacctgctttagttggagcaaacacgggttcgattacaattgcttcaaatgacggaacaactccggcattcaagatcaatgtaagcgttacaggtactgctgctcctgcaaaactacaagtagtagatggaacaagtattttaacatctaacggtactgcaatttcacttggaacagcagtggtaggttcagctgtaccggattacactaccatatctattaaaaatactggcggatcaccgcttacgtttacatccattacaagttcttctgctgtatttgttttagcagatgtaacgccagcagctcccggaacaatagcagcaggtgcttctgcaacgtttacaataaaagcgacaccggtattaggtgctaatacaggaaagattacgattgtaacaaatgacgcaactacaccttcattcgttattaatgtatctgcaacgggtacatctaatccggtacctgccgttcaggtacttgatggttctactcaattggtgacaaacggaacagccgtatcacttggtacagctcctgtaggtacagatgctccggca

SEQ ID NO: 33930 - DNA, 1272 bp, Cytophaga hutchinsonii
acaacgttatctataaaaaataacggtacggctccgcttagctttacatcaataacaagttcatctgcccaatttgtaataacggatgtcagtccggctgcacctactacattagctgtgggcgcttcggcaacatttacagtaacggctaaaccattagtggttggtactgcaaatacagctaagcttacaattgtaacagacgatcctgcaacagcatcatttgttgtaaatgttagcgtaacaggtacacctgctccattgccatcattacaggtattaaatggttctgcgattgttacaaataataatgcgacacctatttcattaggcacggctgcggtaggttcacctgctccggcatacacgtcgctgtcaattaagaataacggatccgctccgcttacctttacgtcaataacaagttcatctgcacaatttgtagtatctggtgtaacgccggaggcacctacaacattggctgtcggagcttctgcaacgttcacggtaacagctactccacttgctgttggtacaggaaatacagcgaagcttaccattgtaacaaatgatcctgcaacaccatcttttgatgttaacgtagcggttacaggtacgccagctccgaaaccgataattacagtaaccggtgtcacaaataacggatctacggtttctatcggaaatgtgacagaaaatactgcaacggctccttatacatttacgatatccaatacaggctcattaccgctggaagttggatcaattacatcttcgaatccggtgtttgttgttacgcaggtaaatcctactacaatcgctccgaattctacaggtacgttcaccgtaattggtacaccaacaagtgttggtacagtaaccggaaaaattacgattccaagtaatgatatcagtacaccttcatttgtaatcaatgtaagtgtaacgggtaaaacagccccttcaggagcaatacttgaaatattgaataaatctgcaatcgtaatggttaacgacggtactccaatgatgattggtgctaattcaatcaatacggttacagcgccttaccagtttacacttacaaaccctggtacagtggcagtaaacattggaggcataacggctactacaggatttattgcaactcaaatgaatcctaccggtacaacacttgctcctggtgcaattgcaacattcaccgtaagaggtacaccaaacagtgtgggtacaccaagacagggtagtgttattataaaatcgaataatgca

SEQ ID NO: 33931 - DNA, 2478 bp, Cytophaga hutchinsonii
atggaagcaaaattttcaaatcgggtaaaagaggtgatttccttaagccgggaagaagcattgcgcttgggtcatgattacattggtgccgaacacctgttgttaggaatgattcgcgaaggagaaggtgtggcaattagtttattaaaaaaactaggcatcacgttagattctttaaaaaagtcgctagaagaagccgttcgtggaacagctactggtaacgttaaaaaccttaccaatattcctctgacaagacaggcagaaaaagtattaaagattacatatctggaagcaaagatcttcaaaagtgatcttattggtacagaacatttattgttatctgtattgagagatgaagataatgttgctacacaaatattaaacaaatttgatattacgtatgatgttatcaaggaattgcttgaataccatacgcacacaccaaaagctacagatgctgaagatgcagatgacgattcatctcgtttgttcggtaacagcggttctggtgcgggtaaagaagcagctcgtccgggtgctgaaaaatcaagaacacctgtacttgataacttcggcagagatttaacaaaatacgcggaagatggaaaacttgatccgatcattggtcgtgaaaaagaaatcgaacgtgttgcgcaaatcttgtcccgtcgcaaaaagaataacccgatcctgatcggtgaaccgggtgtgggtaaaacagctatcgctgaaggtcttgcattacgtattgttcagaagaaagtatcacgtgttttattcggtaaacgtgtagtaacattggatctggcttcattggtggcaggtacaaaataccgcggtcagtttgaagagcgtatgaaagcagttatgaatgaactggaaaaatctcctgaggttattctgtttattgatgagattcataccattgttggtgcaggcggtgcttccggttcattggatgcatcgaacatgtttaaaccggcattggcgaggggagacatacaatgtattggtgctactaccttagatgagtaccgtcagtacatcgaaaaagatggtgctttggctcgtcgtttccagattgtaatggtagatgcaacaacaccggaagagactgttcagattttgaacaacatcaaagagaaatacgaagatcaccataatgtaatttattctccggaagcattggaagcttgcgttaagttatcggatcgttatatcagcgaccgtttcttaccggataaagcaattgatgtgttggatgaagcaggtgcccgtgtacacattaacaatattcacgttcctgcagatatcctgaaactggaagagcagattgagaatatcaaaaaagaaaaaaacaaagttgttaaaagtcagaaatacgaagaagctgctcaattgagagactctgagaaaaaactgatcgaacagttggataacgccaaacttcgttgggaagaagaaaccaagaagaaacgttaccatgtaaaagaagagaacgttgcagaagtaattgccatgatgacgggtattccttctgcacgtgttgcgcagaaagaatcattgaaactgttaagcatggggtctgatctgaaggctgccgttgttggacaggatcaggcaattgaaaaattagtaaaagccattcaacgtacacgtgtagggttaaaagatccgaagaaaccgattggttcattcatcttcttaggtccgacaggtgttggtaaaactgaattagcgaagtctcttgctaaatatttattcgataaagaagattcgctggtacgtattgatatgtctgagtatatggagaaattctctgtatcgagattggttggtgcgcctccgggatatgtcggatacgaagaaggtggtcagttgactgagaaaatccgtcgtaagccatacagtgttgtattgcttgatgagattgagaaagcgcacccggatgtatttaacttaatgcttcaggtattggatgacggtatcttaacagatggtttagggagaagagtagatttcagaaatacaatcatcatcatgacatcaaacattggtgttcgtgacttgaaagatttcggatcaggtatcggtttcaatacacaatcccgtaaagagaatgtagatgaaatgatgaaaggtacgatccagaatgccttacgtaaagcattctctcctgaattcttaaaccgtttggatgatgtaattgtattcaactctttaacaagagaagatattcatgtaatcatcgatatcacgttggcaaaagtattctcaagaatcacaacattgggttatacaattgaattaacggataaagcgaaggatttcttagcggaaagaggttatgaccagcaatatggtgcgcgtccgttgaaccgagcgatacagaaatatcttgaagatccgattgcagaagaaattctgaaaggagatgttcaggaaggtgatacaatcttagctgactacaaagaaggt

SEQ ID NO: 33932 - DNA, 735 bp, Cytophaga hutchinsonii
ttacttagtggaaaaactgctctggtaacaggagcatcaaaaggcataggaaaatcgatcgcgatgcgttacgcacaggaaggtgctaatgtggcgttcacctatctttcaagcgttgaaaaaggtcaggcattagaaaaagaattacaggcattgggtatcaaagcaaaaggataccgctcagatgcatctaaatatacagaagcagaagaattagtaacttccgtattagcagactttggacagcttgatattgttgtaaacaatgcaggtattacaaaagatggcttattaatgcgtatgacagaagaacaatgggattctgttatggaagtaaatttaaaatcggtatttaacctgacaaaagcggcattaaaaccaatgatgaaagcgaaagcaggttctattataaatatgacttctgttgtgggcatcagcggtaacgccggccagacaaactacgctgcctctaaagcaggtatcattggtttcacaaaatcagtagcgcaggaattgggttcacgcaacatccgctcaaacgcaattgccccgggttttattgaaacagaaatgacggaagtactggacccgaaagtgaaagctgaatgggaaaacggaattccgttgaaacgtgccggaaaaagtgaagatgtagcgaatgcctgtgtattccttgcatcagatctttcaacatacattaccggacaggtattacaggttgatggcggaatgctg

SEQ ID NO: 33933 - DNA, 1326 bp, Cytophaga hutchinsonii
atgtcaacaaagttcgatgttatagtgatcggtagcggtcctggtggatatgtagctgcaattagagcctctcaattaggtaaaaaagtagctgtagttgagaaagcagaattaggtggtatttgcttgaactggggatgtatccctacaaaagctcttttgaaaagtgcacaggtgtatgaatacatcaaacatgcaaaagagtatggtatcaatgttggaaacgcggaagcagattttacagctgttgtaaaacgcagccgtgacgttgctgccggcatgagcaaaggtgttcagtttttaatgaaaaaaaataaaatcgaaatcattgcaggtttcggtaaactggtaaaaggtaaacaagttgaagtaacagacgataaaggcaacaaaagtctgtacggagctgatcacatcattttagcaacaggtggccgcgcgcgggaattgccgaatgttaagatcgataacaataagatcatcggttaccgtaaagccatggtgcttgaatctaagcctgagagcatggtgattatgggttccggagcgattggtgttgagtttgcttatttctatgcaacaatgggcactaaagttacgattgttgaatacctgccaaacattgttccggttgaagacgaagaaatttctaagcaattagaaaaagaatataagaagatgggcattaacattatgaccggtgccgctgttgaatccgtagatacagcaggtaaaggttgtaaagtaaccgttaaaaaaggtgatgctacagaagttattgaatgcgatattgtactttcagcggtaggtgttgctacaaaccttgaaggtattggtctggaagatgtaggcgttgctacagacaaaggccgtgtattggttgatgattattacaaaacaaatatcccgggagtgtatgcaatcggagatattgttaaaggtcctgcgctggcacacgttgcttcgcatgaaggtattatatgcgtagagaagatcgcaggtttgaatcctgaaccgatggattacggcaatatcccgggttgcacgtactgtacaccagagattgcttctgtaggtttaacggagaaagcagcaaaagaaaaaggatacgaattgaaagtaggtaagtttccattctcagcatccggtaaagcaagtgctgccggtgcaaaagaaggttttgttaaagttatctacgatgcaaaatacggtgagttgttaggtgttcacatgattggcgcaaacgttacggagatgattgcagaagcagttgtagcacgtaagcttgaagcaacaggtcatgagatcattaatgcagtgcacccg

SEQ ID NO: 33934 - DNA, 2274 bp, Cytophaga hutchinsonii
gacaatatcaaaattatcattgggaatggaataaacataactgaaataaaacaagtgcaagaaaaacttgctaagagcgaagagttgtatagactcgttattcatgcagcaaacgatggaatctgggattgggatatcgcttccggaagtttatacctcagtgagcgttggaaatctatgctaggctatacggatgaaacattagcaaatcatatatcttcctgggaaaaaacaatgcatccggatgatctatcaatagcaaaagaaattttacagaaccatttcgaaaaacgaaaaccatataactatacattaagatatttacatgttgatggttctattcgttggatcatgtgcagaggttttgcaattcgaaacagaaaaggagaaccatatagaatggttggtagctgcacagatgtgacagatacacaaatagcagaagaaaaattaaaagaaaatgaagaaaaactacaagcaattttcaatcactctcatgatgcaaaatttttagttgatccctgcacaaataaaattattgagtttaataaacgaactcttgaactatttgaaacggacaaacctgatacattatatactattcctcttacatctcttagaaaatatccactaactgacgctgaattggcagacactcagaaccagtttaaacaacttggatattggaatcaggaagtcctttatataacacaaaagaaaaatgaattttggggaaacattgttgctaaaacaatatttattaataagaaagaagtaattcttgtccgaattacagatatatctgaaaacaaaaaaattgagcaggaactgatcaaagccaagcaaattgctgaagaatcaacaaaagcgaaagaaatgttcttagctaatatgagtcatgaaattcgtactccaatgaatggtatacttggtatggctgaactgatttcgcgaacatccttagatgttacacaaaagaaacatgttcagctgattaaaaatagtgcggataatttattgattattattaatgacattttagatatagcaaaaattgaatccggaaaactaaccattgaacaaattccatttgatatttgtgaagtaataaaaagtgctattcagaccttaacctacaaagcagaagaaaaaggtattgatttgattatacatccaattaaactcgaccatagagttgttattggcgatccattcagacttacacaagcacttttgaatttaattaacaatgcgattaaatttaccgaaaacggttccgtagaaatcagtggacgcattccgcattccagttcaacggacatcacatttgaatttaccgttaaagatacggggataggtatacctcaggaaaaattagacagcatttttgaaggatttactcaagcatcccctgatacatccagaaaatatggaggaacgggacttggacttactatcagtaagaacttaattcagatgcaaggtggtaacatttgggttgaaagcgttgttggcaaaggaagtaaatttattttttcaatcacatataaaaaaggtgatctgttagatgtctctccaaacaataaaaataaaattaacctatatcaacttcatgatttaaaagtattattagctgaagacaatgaagtcaatcaatattttgcaaaaacattgatggatgaaattggtgtaaaggtagatgttgctaataatggcattgaagcctttcagttctttgaacaaaatgaatatgacattattttaatggacatacaaatgccgtatatggggggtattgagacaacatcaaaaatcagatcgcacgcaaataaaacgaaagcaaaaattccaattattgctttaactgcaaatgcacttgttggtgattctgaaaaatatattgaagccggaatgagtgattatatttctaaaccatttgatcgggaaacactatttagaaaattacaactacatgcaggttcaaacaaaaatatctttcaagatgcaaagaacatccatttatttcaatccgataccaatgacgcatatctaccaaactatagtcatttagaaaaaaactttcaaaataacaccgtttttctcaaaaaaatatttacgttattcattgaatcaacaccagaaattgtaaacgaattaaaattattttctgaaggtaaggattatgaaaaactacaagcaacagcacacaagttaaaagccagcgttgatgcattcaaaattgtagcattacatcaaacaataagaaatatcgaa

SEQ ID NO: 33935 - DNA, 984 bp, Cytophaga hutchinsonii
gtaaaaaccttagttcaatttattactgaaagtcaaaagcatgtatttggtgcatcaggtgatttgtccaaaatactaaatgacattgctgttgcagctaaaatcatcaatcgtgaagttaataaagctggactgcttgatattttaggaatggaagggggaatgaatgtgcagaatgaagaagtgaaaaaattggatgtgtatgcaaatgatcaatttatctcagctcttcgatctggggggcaatgttgtgctattgcttcggaagaaaatacagatataattccgatcgaaaataatggccattcaaaatcaaattatgttgtacttatagatcctttagatggatcttcaaatattgatgtgaatgtagcaataggtagtattttttcaatttatcgtagagtttctgaatctggtccaggagagactgttgattgtatgcaagtaggtaataagcaagttgctgcaggatacattatttatggctcatctacgatgatggtgtatactacgggtgatggagtgaatggatttacattggatccttcaatcggagagttttgtttatcacaccccaacttgaaaatcccggaagatggttttatttattctgttaatgaaggtaactacgcagattttcctcgcgaaatacaagaatatatttactattgtaaaacacctgattttgaaacaagccgtccatattcatcaagatacataggatctatggttgcagattttcatagaaatttaattaaagggggaatttttatgtatccggcaacggctaaatatccattaggtaaattacgtttgatgtatgaatgcaatccgttggcatttattgtagaacaggctggcgggaaggctatcgatggtgaaggtagaattttagatattgaacctacaaacattcatcaacgcacaggcatcatcatcggttcaaaaaatatggttgaaaaagtagaagcctttatacaa

SEQ ID NO: 33936 - DNA, 1422 bp, Cytophaga hutchinsonii
ggaaataatacaacaggttgtgtcccggcaatagctgtaccttcaactgctttctgtgccggtgggtctgtgcttatgacagcaaccacaggaacttcctataaatggttcaatggaacttctcaggtaggaacagctgcaacctatacagctactacagccggaaattatacggtagaagtgacgaatgcttcaggctgtaaagcaacaagtattccggtaacaatcacggttaatacattacccgttattactccatatgtaaaaatagatgcaaatgcatggaccagtagttcaacagctgcagtctgtgaagctgacacagtcaatttcggaccgcatcctaatgttgcttctggctggagttggacagggccaaataatttcaattcatccttaaggaatccggttcttactgctattaccgctacacaggcaggaacgtataaagctacttatacggatgccaacggctgcaaaacaaccagcgactttattcttcaggtatcgaaaccaacggcagcaatcacggtttctgctgcttcattctgcccgggtggttcagcagtgctgacagcaagtacagggacaacatacaaatggttcaaaggaacaacagcccttggaacagcgtcaacacaaaccgttacagaagctggcgcctataccgtggaagtaacaaatgcggcaggctgtaaggcaacatcggcaccatcaactgtaaccctcagtactccacaggcaacgccaacaattacagcaacggtaacatcattctgcccgggtggttcagcagtgctgacagcaagtacagggacaacatacaaatggttcaaaggaacaacagcccttggaacagcgtcaacacaaaccgttacagaagctggcgcctataccgtggaagtaacaaatgcggcaggctgtaaggcaacatcggcaccatcaactgtaaccctcagtactccacaggcaacgccaacaattacagcaacggcaacatcgttctgcgcaggtggttcagcagtgctgacagcaagtacaggaacaacatataaatggttcaaaggaactacagcgcttggcacagcgtcaacacaaaccgttacggaagcgggcgcctataccgtagaagtaaccaatgcctccgggtgtaaagcaacgtcggctgtaacacaaataacactgaatgctgcaccgccggcaatcattacagcatcagcaacatcgttctgcgcaggtggttcagcagtgctgacagcaagtacaggaacaacatataaatggttcaaaggaactacagcgcttggcacagcgtcaacacaaaccgttacggaagcgggcgcctataccgtagaagtaaccaatgcttccggatgtaaagcaacgtcggctgtaactcaaattcttactacgcaaccatct

SEQ ID NO: 33937 - DNA, 1236 bp, Cytophaga hutchinsonii
aaacgagttgttgtaacaggaataggcgcattgacacctatcggtaataatacagaaagtttctggaattccttaatcagcggaacaagcggagctgcaccgatcacaaaatttgatgcttctaaatttaaaacacggtttgcctgtgagctgaaaaactttgatccggtaaattttatggaaaaaagtgaagcaagaaaatacgatttgttcacgcagtatgcattgattgcagttgaagaagctgtacaacatgctcagatcaattttgaaacattaaacagaaaccgtattggtgtaatctggggaagcggcaatggagggattggtacgtttcaggaacaggtaacggaatttgtaaaaggagatggtacgccacgtttcaatccattcttcattcctaaaatgatcctggatattgctgccggtgttatctccattaaatatggtttacgcggggcaaactttgctacggtatcagcctgcgccacatccaacacggctattattgaagcattcaatcacatacgctggggtaaagcagatatgattattacaggtggttctgaagcgccgatcaatgaagtttcggtaggcggctttaatgcgtcgcgtgctttatctacattaaatgaaaatccgtctatcgcatcccgtccgtttgatacaaaccgcgatggatttgtaatgggcgaaggagctggtgcgcttattcttgaaagttatgaaagtgccgtgaaacgtaatgctcctatattagctgaagttgtaggtggcggtatggcagccgatgcgtatcacttaacgggtacacatccggaaggggaaggggcatatcttgggatgctggaagctctggcggaagcaaacattagcgcggctgacattgattatgtaaacgcacacgcaacgtctaccccgcaaggagatatcagtgaaatgaaagcgattgaacgtgtattcggtgcttcaacaaaattacatgtaagtgctaccaaatctatgacaggccatttgctgggcgcagccggtgcggtagaagctattgcatgtatcaaagctgttcagcacaatattattccgcctactatcaacaccatggagattgatgcggctattaatccgtcgtttcagtttacgttaggggaagcgcatcataaaacggttcattatgccatgagtaatacgtttggcttcggcggacatattgctactgcgatctttaaaaaatatgaa

SEQ ID NO: 33938 - DNA, 2604 bp, Cytophaga hutchinsonii
gttttgagtaagacaaaagaagccacagaaacaccattgatgaaacaatacaatgctatcaaagggaaatatcccggggccttgttattatttcgtgtaggggatttttatgaaacattttctgaagatgcgataaaggcatcaaaggtattaggaattacattaaccaaaagaggcaatggtaccgcatcagagactgcattggcaggctttccgcatcattcacttgacacatatttaccccgcctggtgcgttccggattgcgtgtagcaatttgtgatcagctggaggatcctaaatctgtaaaaggcattgttaaacgtggtgtaacagaactggtaacgcccggcgtttcatttaatgaccatgtactcgacgtaagtaagaacaattatctggctgcgattcattttcaaaaagactcactcggaatttcttttctggatatttcaacgggtgagtttttaacagcgcaaggcgatagacattatatcgataaacttctgcagagtttttcaccgtctgaagtattgttctgtaaacaaaagaaagaagtatttattgaatactttggtgacagatacaatacctatgcacttgaagactggatttttgcgtatgatttcacctatgatttattaattcgtcattttcaaacaacttcactaaaaggctttggtattgaagaaatgctggaaggcataacatctgccggtgctattcttcattatttgaatgaaacagaacacaaagaagttgctcatattacgcgtgtaaacagaattgaagaagaacgttatgtatggctggatcgttttaccatccgcaacctggaacttgtaaatgcgcagcagctggaaggtgttccactgatcgaaattctggatcatacaaagacaccgatgggcgcgcgcttattgaaaaagtggctgattcttccattaaaagaattaacacccatacaggaacgtttggatacggtagagcttctggttaaaaataaagagctgacgacaacattggttgacgagctcaaaccaataggagaccttgaacgactgatctctaaagtggctgcacgcagggtgaatccaagggaaatggttcagttaaagcgttcgctggaacgtttggttccgatacagcagctacttaaacagcaagatcagcatgttctgttaaaattagcagagcagataaacccgtgtgaatacttggccggcagaattctgaacatgcttaaagaagatgcaccgatgcttaccaatcaggggagaatcattcgtgatggctgtaatgcagaactggacgagcttcgtgcaattgcatatacaggtaaagactatctgctgcagatacagcaaagagagatcgaacgtacaggaatcagttcattaaaaatatcatacaataaagttttcggatattatcttgaagtaacaaatacacataaagaaaaagtgcctgcagattggattcgtaaacaaacgttgacaggtgcagagcgttacattacagaagaactaaagatctacgaagagaaaattttaggtgctgaagacaagatcaatgtaatcgaacaaaaaatgtttcaggaccttgtacttgaagcagaaagttatataaatccaatcttacagaatgcccgcatagttgctcagatagattgtttgtgttcgtttgctcatgctgctgttgctaataactattgcaaaccaattgttgaagacagcgcattgattaatattaaagccggtcgccatccggtgattgaaaaacaattgccgttgggggagagctatattcccaatgatatttatctggatgatgagacgcagcaggtgatgatcattactggtcccaacatggccggtaaatctgccttgctccggcaaacagcattgattgtgctgatggcacaggcaggcagttttgttccggcaacacatgctaccatcggtacggttgataaagtatttacacgtgtaggtgcttcagataacctttcaaaaggcgaatcaacattcatggttgaaatgaatgaaacagcaagcatcttaaataatctaagtggtagaagtctggtattgatggatgaaatcggccgtggtaccagcacgtatgatggaatctccattgcctgggccattgttgaacatttgcataaccatccgaacttcaggccaaagacattgtttgcaacgcactatcacgaattgaatcaattaacagaagatttaaaacgggttaaaaatttcaatgtgtctgtaaaagaagccggcaacaaggttatatttatgcgtacactgaagccgggcggcagtgaacatagctttggtattcatgttgcacagatggccggcatgccaacaagcctggtactgagagcaaatgagatcatgggacatttagaaaaagagcatgtacgtgaagggcatgaagataaattaaaagaagtgccgaagtcgaccctgcaaatgagtttgtttgaagcagcagatccggcgtgggattccataaaaaaaatattaacgcaaacagatgtgaatataatgtcccctgtagaagctcttttaaaattgaatgaactaaaacagctaatt

SEQ ID NO: 33939 - DNA, 987 bp, Cytophaga hutchinsonii
aaagtagctgtagttggcgctaccggtttggtaggaacccaaatgcttaacgttcttaaagaacgtaatttccctataacagaactaattcctgtagcttctgaaaagtcagttggtaaagaagtagaatacaatggtaataagtataaagtagttacagccgaaacagcaatcgctatgaagcctgaaatcgctgtattttcagcgggtggaggaacatctttagagcttgcaccgttgtttgctgccgctggcaccacagtaattgacaactcttctgcatggagaatggatccgactaagaaattagttgttccggaagtaaacgcaaatgttttaacaaaagaagataagattattgcaaacccgaactgctctacaattcagatggtagtagtattggagccattacataaaaaatataaaatcaaacgtgttgttgtttcaacgtatcagtctgtaacgggtactggtaaaaaagcagttgatcagttatttgacgaacgtaaaggcattatgaatggtgtaaaagcatatccatatcagattgatttaaatttattgccacacattgatgtattccaggaaaacggatatacaaaagaagaaatgaaaatgattttggaaacaaacaagatcatgggcgacgattcaatcaaagttactgcaacaacagttcgtgttccggttattggcggacactctgagtctgtaaatattgagtttgaaaatgactttgatgttaatgaagtaaaagaattactttctaaagctccgggtatcattgttaaagacaatccgtctaaattagagtatcctacgccaatggacgcgcataacagagatgaagtctttgttggccgcatacgcagagatgaatctcagccgaaaacattgaatttatggatcgttgcagataacctgcgtaaaggtgctgctacaaatgcagttcaaattgctgaatatttagttgcgaataaattagtt

SEQ ID NO: 33940 - DNA, 1215 bp, Cytophaga hutchinsonii
aaaattaaagtagctaacccggttgttgaactggatggcgatgaaatgacacgaattatctggaaatttattaaagataaattgatccttccttacctggatttagatatcaagtattatgacttgggtatggaaaaccgcgatgctacaaacgatcaggttacaattgattctgcagaagcaattaaaaaatacagcgttggtatcaagtgtgctactattacaccggatgaacaacgtgttgaagaatttaaacttaaacaaatgtggaagtctccaaacggtaccatccgtaacatcttagatggtactgttttccgtgagccgatcgtttgtacaaacgtaccacgcttagttcctaactggactgctcctattgttgttggccgtcacgcatttggtgatcagtacaaagcaacggatttcgttgtaccgggcaaaggtaaattaaccatcaaatttgaaggtgaagacggaaaagtaattgagcacgaagtgtatcagttcaaaggtccgggtgttgcaatgggcatgtacaatacagaagagtcaatcagaggttttgcgtattcttgtttcaacatggccttaagcaaaaaatggcccttatacttatctactaaaaacaccattttaaagaaatacgatggtcgcttcaaagatatttttgaagagatctaccagaaagattacaaatccaagtttgaagctgcgggtattgtttacgaacaccgtttgattgatgacatggttgcttctgcattaaagtggaacggtaactttgtctgggcttgtaaaaactatgacggagacgttcaatcagatacggttgctcaaggtttcggttcattaggtttaatgacatcagtattggttacgccagacggttctacaatggaagcagaagcggcacacggtacagtaacgcgtcactacagagatcaccaggcaggtaaaccaacgtctacaaacccgatcgcgtctatcttcgcatggacaagaggtttggaattccgcggtaaaaaagatggtaaccaggaattggttaacttctgccagacacttgaaaaagtttgcgttgcaaccgttgaaagtggtaaaatgacaaaagatttagctgtttgtatccatggcaacaaagtgaaacatggcgaacactatttatatacagaagaatttttagctgcaattgatgacaatttgaaaattgcatta

SEQ ID NO: 33941 - DNA, 1155 bp, Cytophaga hutchinsonii
atgaaagcagccgtatttcataaaccgggtcatatctccgtagatacagtagaagatcctaaaatagaaaagagtgatgatatcattcttaaagtaacgtcaacggctatctgtggctctgatcttcatatttacgatggcttttttccgcaagcacgtccgctgattatgggccatgaatttatgggcattgtagaagaagtaggtaatgcggttacacatttaaaagcaggtgaccgtattgttgttccttttccgattgcctgcggacattgctatttctgtaaccatgacatgcagcctaattgtgaacacagcaatcccgaacattacggccccgaaggagatgtattaagcgggaaaggcggtggtttgtttggttatacagatctttacggcggatatgccggagggcaggctcaatacgtacgtgttccgtatgcggattattcgccacgattggtgccggaatcgctcagcgatgaacaggttctttttcttacggatatctttcctacaggttggtcagcaattgattgggcacagttaaaaggaggtgaaacagtagcaatctttggttcagggccggtaggactgatggctcaaaaggcagcctggttaaagggggcaggccgggttattgcgattgatccgttgaattaccgtttagctaaagctaaaatggttaataatgtagaaacgctgaatccacatgaagttgatgtaattgaggcaatccgcgcaatgacaaatggacgaggtgcagatgtatgcgtagacgcagttggagttgaggctgaacggacgttttttgataaagtaaaagcggttgtccgttttgaaaaaggaacagataaagtgcttgaaaattgttttaaagctgtacgcagaggtggtactgttacagtagttggcgtatatggaacaccctatgataatttccctctgcataccatgtttgataaaggacttacagtaagactgggacaagctccggtacaaaaatatattgatcatttatttacccttgtgcaaaatgagaaagtggtattaaatgatattgttacacacgtactccctttgtcacatgcatcccatgcttatgacatctttaaaaataaacaggaagattgcgttaaggtaattttaaagcct

SEQ ID NO: 33942 - DNA, 2604 bp, Cytophaga hutchinsonii
cttattaatgactttcaaacaaatacccagtctggtttaacaaccagtgaagcagaaaacagaataaaagaattcggacagaatatttatcaggttcagaaacaaaaaagtatctggctgatgctgttattacagtttaaaagtccgatcgtttatctgcttcttgctgcggcagctgtttctttatactttaaagatgttattgaaactgctgcaatccttgtcgtaattgtggttaatgccatcatcggttttttaatggagcttcaggcacgcagttcaatgaatgcgttgaaagaaatggacgtgatcaaaacaaatgtgatccgcgatggaaagaaacaagagatcccttctgaaaatattacacccggagatattgtattgctggaagccggtgatgttgttccgggcgacggacgtatcattgaagcgaaccagctcaaatgtgatgaatcttctctgaccggtgaatcgttacctgcggaaaaaaagaccgaggaattacaagccaatactgcgttgggagatcaacacaatatggttttcaaaggtacatcggttgtgaatggaaacggcaaagcacttattactggtatagccgaacatacacagctcggtactattacgtctctggtagaaaagtcggaagataaacaaacacccttagatcaaaaaataaatgtactaagtaaaaaactgatctggatcacactgacaatgactgctatatttgctgcaacaggtgtgatacagggcaaagaatgggtgttgattttcgaaagctctatagcccttgcggtggcagctttcccggaaggacttccgattgttgccaccattgcgctttcgcatggcatgctccttatggctaagaggaatgcaatcgtaaaaaaactttctgccgtggaaacgcttggcggtacacgcgtgattctgacagataaaacaggcacacttactgaaaataaaatttatgtagaaaccttttctttcccggaagaaaaaatagcggtaaagattaacaataacaccgtaaactacccggataaacagatagaaaagagcaaagagaattttgaaaaaatgcgcctggtgggtgcgttgtgtaacaatgctccccttgagcagcaggaacagaaagacgatcagaaacctgctgcgggcgacccgattgacattgcactgattttgctggcaaatgtttcaggaacatctgcaaaagacttacaagggcaatttgaacgtattggcgaagtgccttttaattctgatatcaagattatgggaacgctgcataattctccaaacgggaaatttgtagctgctaaaggttcggtagaacatctgttaaacaactgcagcaaaattcaatatggcagcgaaattaaagatctgaatgatgaacagaaaaaaggcattctggatgaatctgaaaaaatggcggcagacggactgcgtgttatagcgtttgcttatcgggaaggtcaggatatcaatacagacaattatttatcggaactcatccacgtaggtatgatcgggtttctggacccgccgcgtatggacattaaagatgctattttgcgttgcagaaatgcgggcatacgcattgttatgatcactggtgaccacccgatgacagccttaaatattgcaaaaaaaatcggactggtagatgaaaatgaacagcatgtaattatcggccaggatctgccggaggcagaagcggtaacagatgaatggagagagaaaattcttgcgacttctgtttttgcacgtactacaccaaaacaaaagctggagattgttgaagcctttcaaaaagccggaaatattgttgccatgaccggtgatggcataaacgatgcgccggcgctgaaaaaagcagacattggtattgctatgggactgcgcggcacacaggttgcaaaagaaacagcaggcattgtattgaaggatgattcctttacatcgatagctgaagcagtagcacatggcagagaaatttttgacaacattaaaaaatttattgtgtatttattctcctgcaatttaagcgagatctttattgtaaccatacttggttttattacaccgctctctaccttgttaccgctacagattttattcctgaacatggtaaccgatgtgtttcctgcccttgcattaggcgtaggcaaaggcgatgagaaagtaatggaaaaacaaccgcgggatgcaaaagaaaatatacttaccaataaagactggataagaattgcattgtactccttacttatttctgtatcggttatcatttctgtgttatattgcaatcacattattgaatcagaccataaaattgctaacaatgctgcattccttacattagccttttcacaacttttccatgtattaaacatgtcgtccttcagttcaaaaatgttcctgaacgatataacaaaaaatatatttgtgtggctggcaattttattatgtgcaggtattatgatcacggtatatgcaatcccgtatacacgccttatactgggtcttgaactgttaccagcagaagctgtagtcgtttcaatcgcatgtagtttcattccggtggtagtagtt

SEQ ID NO: 33943 - DNA, 1149 bp, Cytophaga hutchinsonii
gattattacaatatggacgacctgctgacggaagagcataagttgatccgccaatccgtgcaggcctttatgaataaagaagttaagccaattatagaaaattatgcacagcgtagtatctttccggatcatctggttaaaccgttcggagccttaggtttatatggccctacaacacctgttgagtatggcggcggcggactggattatatttcttatggaattatgatgcaggaaattgaacgggtagattccggtatgcgttccatggcatcggtgcagggctcattggttatgttccctatttttaaatatggaagcgaagaacaaaaaaagaaatacttacccaagctggctagtggtgaattacttggctgtttcggattaaccgaaccagaccatggatcaaaccctgcaggaatggttacatctattaaagatgccggagatcattacattctgaatggcgccaagatgtggatcaccaattctcccaaagcagacattgctgtggtttgggcaaaggatgatgcaggcagaataaaagggatcattgttgaacggggtatggaaggttttacaactccggagattcataacaaatggtcgctgcgtgcgagtatcacaggtgaactggttttcgacaatgtaaaagttcctaagacgcatgtattgcctaaagcagatggattgagtggcccgttgaagtgcctggattcggctcgctatggcattgcctggggtgcgttgggtgcggcaatggaatgttatgacattgcaaaaaactatgccatggaacgggttcagtttgggaaacccattgcaggttttcaattaacacaaaagaaattagcggagatgctgactgaaattaccaaggcacaactgcttgtatggcgcttaggtatgttaaaaaacgaaggcaaagcaagcaccggacaagtatctatggcaaaacgcaataacgttgacatggcattaaaggttgcgcgcgaagcacggcagatattgggtggcatgggtattacaggcgaatacccgatcatgcgccacatgatgaatttagaatctgtggttacctacgaaggaacacatgatatccatctgcttattacagggcatgatattacagggctgaatgcatttaaa

SEQ ID NO: 33944 - DNA, 1395 bp, Cytophaga hutchinsonii
cttacaaaatcagcattcgggttggtaggcctgggtgtgatgggcaaaagcctcgcccgaaattttgcagcgaacggtgtagccctatctttatacaatcgatttgtaaagggttcagaagagcaggtggcagaaaaatgtattgctgaataccctgaacttcaatcggcgaaaggctttgaagatttgaaaacatttgctgcttcccttgaacagccgcgtaaaatttttctgatgattaaggccggagaagaaacagacacgtttattgaagaacttgttccgtatttgaacgcaggagatgtattgattgatggcggaaattcgtattacggtgacacaaaaagacgtattgagtttttagcccggaaaggaatatattttatcggaacaggtgtttcaggcggagagcagggagcgctcaaaggaccgtctattatgccatccggagatcctgatgcgtatgcactggttgaaaaataccttacactaattgctgcgaaagataagcaaggggagtcatgctgtacctatatcggaaaagatggatcaggccattttgttaaaatgattcataacggaattgaatatgctgaaatgcaattgatcgcggaagtatatgcgtatttaagatatgccataaaaatcgagccgactgaaatagctgcattatttacagaatggaacagcggtgagttaaacagttatctgcttggaattacagcagcgcttttaataaaaaaagaaggagatgcttggctgattgatctgatcttagacaaagcgggcaataaaggaaccgggaactgggccaccattgcggcatctgagctcggacaacctgccacacttattacatccgcgctgtttgcccgttacgtttccacgataaaagaacacattcttgtaaatacacaaccagcttcggtatatcattttaatacagctgcattatcggagataaaagatgcgtatatgcttgcgcgcattgttaatcatcagcagggatttatgctgatccatgaggcttcacagaaatatgggtgggatctgaattttgctgagattgcacgcatctggacgaacggctgtattatccgaagtgcttttatggaagagcttattccggcattaaaaaaagattcaaacatctttacccatcctgccattttaaaacaattgaaagatctcaagcctgcattgaaagcttttgccgtgaatgcactgcaatatgatctttctgtaccgtcgcatctggcagcacttgattacctgaatgtgctttcaggtaattacgcaacagcaaatatcatacaggcacaacgcgattttttcggagcacatacgtatcagaagattggagatagttccggcaagtattatcacacggaatgg

SEQ ID NO: 33945 - DNA, 486 bp, Cytophaga hutchinsonii
atggaaaatagaatatatattgttatgggcgtttccggttgtggtaaaacaacgattggtacgctgctggcagaaacattaggaattaacttttacgatggcgatgcttttcatcccatatcaaatattgagaaaatggctgcgggtattccacttacagatgaagatagatacaactggctgctggatattaataagcaggcgaaagaatccctgagtgaaggccattctgttgtgtttgcctgttctgcattaaaagagtcttatcgcaaattattagcacagcagattgaagataccatcgtttggatctatttaaaaggagaccttgataccattcatctcagagtaaaaaatagaacgggacattttatgtctccggcactgttacaatcccaattcaatatactggaagaaccatcttccgcgatgcatattgatacagcattagatacagatacgattattcatacaattgtgaaaaaa

SEQ ID NO: 33946 - DNA, 1404 bp, Cytophaga hutchinsonii
gtaaacaagaaaacaaagattattgcaactgtaggtccggcatgtaacacgaaggagaagttatgggagttggttcaagctggcgcgaacattttcagattgaatttttctcacggcactcacgatgtacatcaaggcgtaattaacgcgatccgcgaacttagaaaagaacacaatgttaacatagcaatccttcaggatttgcaaggtcctaagatccgtactgacgaagttgagaacaacggtgttgaacttgttgcaggtgcgcagattgttattactaaagaaaaaatgttaggtactaaagataaaattagtacttcttataaaatgcttacatcggatgttaaaaaaggcgatgctattttaattgatgatggtaatattgaattaaaagttttagaaacaggtaatggtgaagttacgtgtgtggttatttatggcggtatcttaaaatcacgtaaaggtatcaacctgccaaacacaattgtttccgaaccttcattaacagacaaggataaagaagatttattattcggtttgaaaaatgaagttgactggattgcgctttcttttgttagaagcgcagttgatctgaatgaattaaaagcaattattgctgaacatggtaaatcatgtaaagtaattgccaaggttgaaaaacctgaagcagttaaagatattgatgcgattattgaagcatctgatgcaatcatggttgcacgtggtgacctgggggttgaacttcagatggaagatgttccgatgatccagaaaatgatcattaaaaaatgtaatcagttagctaaacctgttattgtggcaacacaaatgatggaaagtatgattacaaacgcgcgtcctacacgtgccgaagcaagtgacgtagcgaacgcaatcattgatggtacagatacaatcatgttgtctgctgaaacagcttcaggaaactatccggtgatcacggttaaagcaatgacacgtatttgccaggcggtagaaaaagaagctgatatctataataaatcaacattagatgatattacaaataccagcgacagtgttatcgcttctgcatgtgaattagcggataaagtaaatgctaaagcaattatcggattgtctcaatccggttattctgctttcagaattgcaagccacaggccaaaagcaagcatttatatcgctacacatgatgagcaattaatgaatcagatgaaccttgtttggggtgtacaggctttcaggtttgaaaaatttacaacaacagacgaatcaatcgaagcggttaagaaaagccttgttgaaaaaggacttttaaagaaaggtgatatctacgttactacggcttctatgccaatggcagatattcagcttgcaaacagcctgaagttaggaattgtt

SEQ ID NO: 33947 - DNA, 219 bp, Cytophaga hutchinsonii
atgtcagaaatcgcacaaaaagtaaaaagcatcatcgttgagaaattaggtgttgaagaatcagaagttactactgaagcaagtttcactaatgatctaggtgctgattcactagatactgttgaacttatcatggaatttgaaaaggaattcaacatttctatcccagacgaacaagctgaaaacatcacaactgttggtcaggctattgcttaccta

SEQ ID NO: 33948 - DNA, 1239 bp, Cytophaga hutchinsonii
atgaatttaaaaagagttgttgtaacgggattgggctccttaacgccaattggtaatactgttcctgaatattgggattcactaataaaaggagtaagtggagctgcgctcattacaaaattcaatccggaaaaacacaagaccaagtttgcgtgtgaagttaaaaactttaatgttgaagacttcattgaaaagaaagaagcccgtaagatggatcctttcacgcagtatgcggtagttgtggccgatgaagcgatcaaagatgctggcattacagcagatttggatcatgacagaatcggcgtgatttggggagccggcatcggtggccttaaaacatttgaagatgaagtatcggcattctccaaaggagatggaacacctcgtttcaacccgttctttattccgaaaatgattattgatatcagtgccggctacatttctatcagaaatggttttcgtggccctaatttttcaactgtatctgcctgtgcatcttcttcaaatgcaatcctggatgcgttcaattatatccgtttaaacaaagctaatattattattgccggtgggtctgaagctgctgttgtagaatcaggaatcggtggttttaatgcctgcagagctttatctgaaagaaacgatgatccggcaacggcttcacgtccattcgataaagaccgggatggttttgttatgggtgaaggcgctggtgctcttgtgcttgaagaatatgaacatgcgaaagcccgtggtgcaaaaatttattgtgaagttattggcggcggtatgtctgctgatgcttaccatttaactgctccccacccggaaggcttaggtgcaaaaaatgtaatgctcaacgcgatcagcgatgccgaaatagctaaagaagacgttgattatattaacgttcacggtacatctactcctttaggtgatatcgctgaagtaactgctattcaagctgtttttggtgaacaagcgtacaaactgaatatcagttcaacgaaatcaatgaccggacacttattaggtgctgccggtgctattgaatccattgcaaccatacttgcaattaaaaaccagatcatccctcctactattaacaaccacaacagagacgaagcatttgatgcaagattaaagcttacattgaataaagctgaaaagcgtgaagttaacgttgcgatgtgtaatacatttggttttggtggacataactgctctatcgtcttccgcaaa

SEQ ID NO: 33949 - DNA, 411 bp, Cytophaga hutchinsonii
gtatccagacaagaacattttaacgcagcacacaaactatataatccggcctggtcggaggaaaaaaatgctgaaatgtttgggccatgtgcaaattcaaactggcatggccataattttgatttgattgttacagtaaaaggtgagccgagccctgacacagggtttgtcattgaccttaaaaaattaagcaccctgatccgtgaaaaagtaacggataaagtagatcataaaaatctgaatctggatgtagattttatgatcggaaaaatggccagtacagaaatactggcgtatgaattctggaagatacttgaaccgcatatcacaacactttctgatggcagaggtaagctgcattcaatcaaattgtatgaaacaccacgcaactacgtggaatatttcggcgag

SEQ ID NO: 33950 - DNA, 2625 bp, Cytophaga hutchinsonii
ggtaaggctagtccggacactataacagaaaaacacattcaggtgtattcgattgcctttcagctgttaaatatggctgaagaaaatggtgctgttaagctgcgccgcaagcatgaaagcgaaaaatccttatcaagcgtaaacggtttgtggggcaaaagtcttttgatgctgaagcaaaagaaaattacaccggaacagatagcagaagaattatgtaatgtacgcattgaacctgtattgacggcacacccaacggaagccaaacgtactattgtcttagaacaccacagacaattgtatctgctttttttacgctgggaagattcaacgtatacagaacttgaaaaaagtgagatcagaagagaaataaaattaacgcttgaccgtctttggagaacaggggagatttatctggagaaaccggacctgagttctgaacgttcaaatgtactgcattatttaactacggtattcccggaagtagtatccatactggatcgcagattgggtatggcctgggaacaaatgggctttgatccggagcttattattacctatacaaaacttcctaaaatatcttttggtaactgggtaggcggcgaccgcgacgggcacccgctggtaacaagtgaagtaaccagagaaacgcttgaactgtttcgtctgaatgcatttatcttaatgcacagacatcttgaaaaactggaaaagaatttaagctttacctgtttatttaaagaaacaattaaaccgcttcagaaacgaattaatgaattagtggaagaaaccggtacacaggagttactggaaaaagaatccaacaacagagaaattttccgtttctatattgagcttcttatcatgaagcttccgctggaagagaataaaggtgatggcttacgcctgaatgaaaagacgtacagctacaatgaatctcagaaactgattgaagatctggtaattttacgtgatgccttactggcattcggggcaagagccattgcatacaatgatgtacgcgacatggtgcgtctggttcagacattcggtttccacttggcgcatctggatattcgccagaacagtaagttccacgacaatgcgatttctcaattgatgaatgccgcatcgatggatggtgaccgtttccttacactgaacgaagaagagcgttgtaaatttattaataaagaattgctttctctccgtccgttctcatacccgaatacaacacttgggcctgaagcggaagcggtaacttcatgcctgcgcgttgttgctgaacacgtagagaaatacggaacaaaagcacttggttcgctgattgtaagtatgacgcgttccacgtccgatttattactggtgtacttattggcaagagaggctggtttattaattaaaacggaaaaaggtattgtttgtaaacttccggtagttccgttatttgagaccattgaagatttacagggaagcccgcatatattaagcaaatttttagaacacccgattacaaaaaacagtctggagtatcaccgtacgtgtacgggtgaaaaagaaaaagtacaacaggtaatgatcgggtatagtgacagtaataaagacggcggtattcttgccagccagtcgaatctgtcgaatacacaattgaaactggttgatgtaggtaaaaaatacggtgcacgtatccgtttcttccatgggaaaggcggctctatcagccgtggtgcaggtcctacgcaatggtttatcaaaacgttgccgcacaataccattcagggtgatatgcgtttgaccgaacagggtgaaacgatttctcagaagtatgcaaataaaattaatgcagctttcaaccttgaattgctggaagcaggtacggcaggatataccattctgcacaagtacaccaaacacaaaaagaaccgtttcgataagcatctggattatttagcagagaaaagtaaagagttctacacgaatttaattacggataaaaactttattaccttctttggtcaggccacaccgattgatgtgatcgaacaaagtaagatcggttcaagacccgcccgtcgttcaggcaaacgtacgctggcagatcttcgcgccattccatgggtattcagctgggcacaatcgcgtttcaatataaccagctggtatggcgtagggaacgcattagaaacgttctacaaagaacagcctgaagagtttgaatacctgaaaaaaatggcttcaagtgataccatcatccggtatatttttacaaacgttgataccagtttggcagcaaccgatgaaaagattttcagaagttatgcaacccttgttgaagacgaggaggttcgtgcagagattctggatatgattgtgaaggaatacaacaaaacaaaaaagatgcttgcgttgttgtttgataatccgtttgaagtgagaagatcgttccatcattattcaaacgtattgcgtgcagaagcattgaacgacctgcactacgatcagattgaactgctgaggaaatggagaaagatgaatacccagcctcaatctgaaaaggcgaataaaatattaaccgaattgcttcttaccgtgaatgcaattgcaggtgcgttgcgtaataccggt

SEQ ID NO: 33951 - DNA, 1290 bp, Cytophaga hutchinsonii
aaaagattactctccgcttttatttttgtttcgctggtgtttacaactgtctgtcatcaaacagttgctcagacacaaccattcccggcaaacaaaacctactcgtatggtaccatgcctggcaataaaaatagccaggatgctatcaataactacaatacctggaaaacgaattatgttgaagcctgttccaacggaaggttcagagtaaaatttgacaacagaagccagacggtatcagaaggtatcgcttacgggatgttattagctgcttattcaggcgacagaacattatttgacggtctttggaattattataaagataaccgtaacggaaacggtgtaatgaactggaaaatcaatggctgttcgggtactgcaggtgctaacggtgctactgactctgaagtggatgcggctatggcccttatcgttgcagactatcagtggagtacttcaggctccatcaattataaaaatgatgcaaaggcattgatcactgccatcaaaaattttgaggtagaaagcggatcgtatgtgttaaagccaggcgaccagtttggcggcagtagcctcacaaacccttcgtactttgcgccgggttatttcagaacgtttgcaacgtatatgaatgataccttctggaacaatgtagccgataaatgttatgtcgttattaataataacctgtctgtaaataatgccgcaggcggtttagtgtctgactggtgtacagcatccggcagttattcaagtgcagcaggcggttatgcaaacggcggaagaaattactcatacgatgcagcccgcacaccatggagaattgcagtagattatgtttggtatggcaatgcaagtgcaaaaacgtattctaaaaaatcttccgatttcgttcgcgtaaacctgggcggttctcaaaatgtaaaagatggttacagccagaacggttctgctgtaagtaactaccacaactcaacatttgttggcgcttttgctgcagcagcgatggcaggcgaaaatcaatcgcaccttgacaattcctattccgatctgaaaggcatcaacgatgcgaattcttattttaaccagacattaaaaacactttacctgtttttattaacaggtaacttttatttaccgggctcaggcactgtagtgcctcctgtaaacgctgcacctacggtttcgctaacggctccttcaaacaacgctgccttcaatgctccggcttcggtaacgcttacagcaaatgcagccgatgcagacggtactattgcgaaggttgaattt

SEQ ID NO: 33952 - DNA, 2118 bp, Cytophaga hutchinsonii
acttcaaagacagaaggtacagatcctaaatttcaggatctccaaaaaaacacatcggatgccaccgatcaatttatgacaacggatcagggattgaaaattaatgatgataataattcattaaaagccggagagcgtgggccttctttactggaagattttattttaagagaaaaaattacacattttgatcacgaacgtattcctgaacgcatcgtacatgcgcgtggatctgcggcacatggctatttccaggtgcacgaatcgatggcgcaatataccaaagccggctttttgcaggatccatcaatcaaaacacctgtcttcgtaagattctctacagttgctggttccagaggctctacagatctcgcgcgcgatgtacgtggattttctgttaaattttatacagcggaaggaaattatgatcttgtaggaaataacatgcccgtcttttttattcaggatgcagcaaaatttcccgacctgatccatgctgtaaaaccggaaccgcatcatgaaatgccgcaggcagcttctgcgcacgatactttctgggattttatttcactgatgcccgaatccatgcacatgatcatgtgggtcatgtctgaccgtgcaattccacgcagtttaaggatgatggaaggttttggggtacatacgttccgatttataaataagaataatgaatctcattttgtaaaattccactggaaaccgaaacaaggtacgcatagtgtagtatgggatgaagcacaaaaaatttccggtaagaattgtgattttcaccgtcaggatttgtgggaagcaatcgaaagcggcaattttccggaatgggaattgggtgtgcaattgattccggaagcggatgaacacaaatttgcatttgacctgctggatcctaccaagcttgtgcctgaagaggaagtgccggttaccattataggaacaatggtactgaaccggaatccggataatttctttgctgaaacagaacaggtggctttccatcccggacatttggtaccgggcattgattttacaaacgatccattactgcagggaagattgttctcttatacggacacacaattatcccgcctcggcagtcccaattttcatgagattccgattaaccgcagtgttgctcctactcataacaatcaacgcgatggccacatgcgccaggaaattaataccggacgtgtaagttatcacccgaattcattgggcggcggctgccccttccaggcaaagatggctgaaggtggtttcaccagcttcaacgaacgtattgatgcaaagaaagttcgggaacgcagtgaaagtttctcggaccatttcagccaggctaccctattctttaacagccagacagaagtagagaaagggcatattattaaagcacttcgctttgaactgggcaaagttgaaacagaagcaatccgcgtacgcatggttggtttgctttctcagattgacaaaacactggcaacgaaagtagctgccggacttggtatcgcagttcctgctcctgcatttcctatgaatcatggtgtgggcgcagatgatgattttgaaaagcatgagcctaaaaaagcagagcaggtaacaaaatcttctgatgcacttaccatattgagaaatccaacggttaccccttctattgcaacaaaacagattgcctttttatgtgcagatgaggtaagtggtgcgtctgtggtgagttataaaaatgcgttggaaagaaaaggtgctgtagtgaagatcattgcgcctcaccttggatttatcaaaacagaagaaggtaaaaaaataaaagtggatcaaagtttattgattgctgcttcggtattatttgatgctgtttttattcctgcagggaaaggaattaaacaattaaaaggtataaaagaagtagctgaatttatcaccgatacatacaaacattgtaaagtaattggtggcgaagacgaaggtgctttagtaattcaatctgtacaagcgattatggaggccggaaaaaatgcagatgaaggaattgttctgaataaagacacaacggcatttgttaaagcacttggcaaacatcgtttctgggaacgcgaagaagcg

SEQ ID NO: 33953 - DNA, 1062 bp, Cytophaga hutchinsonii
ttcacccccggtccatctgaattatacccaaccgttcgtcagcatatgatcacggcattggatgaaaagattggtgtaatttctcatcgcagcaagaagtttgaagaagtctacaaaacggcttcagataatcttaaaacattactggaacttccttccaactatgaagttctttttcttgcttccgcaacggaaatttgggaacgtatcattcagaactgtgtagagaaaaaaagcttccattgcgttaacggttctttttctaaacgtttttacgagtttgccggcgaacttggccgtgaagcatacaaggaagaagctgcgttcggcaaaggcttctaccctgctgatattactgtccctgcagatgctgaaatcatctgtttaacacacaatgaaacaagttccggtgtatcgatgcctgtagaagacatcaatacatttagagataaaaataaagacgctttgatttttgttgatgcggtatcttctcttccatatccaaaattcgactggacaaaaattgattctgtatttttctctgtacagaaatgctttggcttgccggcaggcttaggtgtatggatattaaatgaccgcgtaattgaaaaatcaaaagcgttgttggcgaaacgtaaatctatcggcacgtaccataccatcccttctatgttagagaaagcacgcgtcaatcaaacgcctgaaacaccgaacgccatgaatattttcctgttaggaaaagttaccggcgacatgctgcagatcagcgcagatggtattcgtaagcagacagaagaaaaagcagcattaatcaacacatacattgaatcaagcaaggtattcagcttcggtgttgaagatgcgaaattacgctctatgacaacgatcgttgcaaacacaacaatgctgccgggcgagatcaacaaaattttagaaccgtttgatatggctgttggcgccgggtatggctctaaaaaagaaacgcagatccgcattgctaacttccctgctcattcattggaacaggtgcataaactcgttcagacattaaaagaaaaaatt

SEQ ID NO: 33954 - DNA, 1620 bp, Cytophaga hutchinsonii
aagaaaaaaatccagacatggctgagcggcagttatgatgcagatacaaaaaaagaaattcaatctttagtagatgcgggcaaagaagacgaattgattgaatgtttctataaagatcttgaatttggtacaggtggtttgcgaggccttatgggtgttggttcaaacagaatgaacaaatatacgataggggctgcaacacaaggtttgtgtaattacttaaaaaagaattttcccggccaaccgttaaaagcagccatcgcacacgacagcagaaacaattcagacttttttgcccgtactacggcagaagtttttgcagcaaacggcattcaggtatatttctttaaagcactgcgttctacaccggaactttcgttcgctatccgtcatttcggttgccagacaggtgtagtgcttaccgcttcacacaacccgaaagaatataatggttacaaagcctattggaacgatggggcacaggtaattgctccgcacgataaaaacattataacagaagttcagaagatctccagcatcgacgatgtaaactttaatgcggaccaatcattgattacagagatcggtgaagaagttgataatgcttatctgaatgaaattgtaaagcttactgtttcacctgacgccatcaaacgtcagaaggacatgaaaatcgtttatacacccatccacggtacaggcattgtgctggttcctgagattttaaaacgttttggttttgaaaatgtacgcgtagtgcaggaacaggctgttccggatggcaacttccctaccgtagtatatccaaacccggaagaaaaagatgctttaagcttagctgtgaaacaggcaaccgaatggaacgcagaccttgtaatggcaaccgatccggatgcggatcgcgtaggcattgccattaaaaatgataagaatgaattccagttgttaaacggtaaccagacaggtagtttactgatcctgtatatgctgcaggcctggaagaatgcgaataaaatcaccggaaaagaattcattgttaagaccattgtaacaacggatctgatcgaaaagatcgcgaacaaatttggcgtgaagtattacaataccttaaccggtttcaaatacattgccgctaaaataaaagagcttgaaggcaaggaacaattcattgccggtggcgaagagagctacgggtacctgattggcgacagcgtacgcgataaagatgcgatcgcatcatgtgcgttcattgctgaaatggttgcgtatgcgaaagatcagggcaaatccttatacgacatgctgctggatatgtacgtggaatatggcttctacaaagaacacctcatctccctgacaaaaaaaggcaaatccggcgcggaagaaatccagaccatgatgaaagagcttcgtgctacgcctcctaaaacattaagcggttctccggttgaatggatgttcgattacgatagtcagcttgcaacaaacattatcaacggtactacaaagaaaattgaattgccgcaggaaaatgtattacagttcaaaacggcagacggcacattagtatctgcgcgcccatccggtacagaaccgaagatcaaattctatttcagtgtt

SEQ ID NO: 33955 - DNA, 1590 bp, Cytophaga hutchinsonii
caacgcgcagcacttttagagcatgccactcaggttgaatacggtcttatcgttatcggaggcggggtaacaggctgtggtatcgcattggatgcacagtccagaggcattccaaccttattgattgagatgcatgatattgcttcgggtacatcttcacgttctaccaaactgatccatggcggacttcgctacctgaagcagctggaattcggattggtaaaagagacgggtagagagcgcgctgttgtacatcacctggcaccgcatatcactattcctgaacctatgttattgccaattatcaaaggcggttctatgcctaaatggatggcttcaatgggtacattaatctacgattttttagctggtgttaagaaaagcgagcgcaggaaagtactcaataaagcagatacacttgctgcagagcccttattatcgggtttaaatgttaccggcggtatacgctactatgaataccggaccgatgatgcccgtttgactatggcgcttgcatgtaccgcaaaagcgcagggtacaacggtattgacctatacaaaagtagtgaaactgatgtaccaggcaggagagatcattggtgtaaaagtaattgaccgttttacagataaagaatatattttaaaatcggaagaagtgatcaatgctgccggcccctgggtcgacagcattgatgagcaggatgcggatatccgtaaaaataaactggtacttacaaagggcgtacacattgtagtggattttaaaaagtttccgattcagcaggccgtttattttgatgtgggagacgggcgtatggtgtttgctattccaagagaaaagaaaacgtacatcggtacaacagatactaaatacaccggagattataaagagccggggattgaagaggcagataaaacctatttgatcggatgtatccggacagcgtttccgggtgtaaccttgacggttgctgatatagaaagttattggtcgggcttacgtccgctgatccgtcagcgcgacagtaaatcgccttcggctatttcaagaaaagatgaagtctttcaaagcgcaaccggtctgttaagtattgccggggggaaacttaccggctatcgtaaaatggcggaacgtattgtcgatattgttgccgaacgcttaaaacttgcttatgatattgatacgtgccagacagagtttcatttattaagcggcggcgatattgctaagcacggcgggctagacacatttattgctgagatgctgcctgtattgaaagcatttggtttggataccaatacggcagcacgtatgatccgcttgtatggaagtaatattcatttgtatgaagccgaattaaaacacatagatgaaaggctggcttccatcaatcttccggattggcagaaagcacaattacagtacacgatcaaacatgagtttgtttgtaaacctgcagattttattgtccgccgtacggcagacttttatttcagacgtgctgaagccgagcagtatgcctcggaacttattaaagcaatgcagctgctgcttggctggacagaccaggagtatgcgctgtacaacgaa

SEQ ID NO: 33956 - DNA, 1134 bp, Cytophaga hutchinsonii
caccccttgaatttcgaagaacttaaattaaacagacaacttctcaatgctattgaagaagctggttatactgaacctactgaaattcagtctaaagcaataccgcagattctggcgggccacgacatcatcggtgtggcacaaaccggtaccggtaaaacggctgcctatgccctgcccattctgatgaaaatcaaatatgcacagggacataatccaagagcggtaattttcggaccaacccgcgagctggtgatgcagattgaaattgccatgaaacagctggcaaaatatacagacttacgcattgttgcactctatggcggcataggtcctaaacttcaaaaagaacacttacaaaaaggcgttgatattattgttgctaccccaggccgttttctggatctgtatctggaagaagaaattgtgttgaaggaagtaaaaacaatggtgctggatgaagccgataaaatgatggacatgggatttatgccgcagctgcgcaagatgctcgaagttattccgcggaaaagacagaacctgcttttctcggcaaccatgtctgagcgtgtggaacgtttaaccgaagagtttctggaatatccaatgaagatcgaggttacaccgcaggcgacaccagctacactcatcagtcagaagttgtacaaagtacccaactttaaaactaaaattcatttattagaatatttaattcgaaaagatgaatccgtaacccgtgccattatttttgtacgaacgaaaaaatcagcagacgatatatataaattcattatccgtaaaacaaccaatacctgccgcatcattcatgcaaacaaagatcagaacagccgcatcaatgcaatggatgattttaaagacggcaccatcaaaatactcgttgctaccgatgtggcagccagaggtattgatgtgcatgaagtaagccatgtgatcaattttgatgtaccgatcatttacgacgattacatacaccgcatcgggcgtacaggcagagctaatcatacaggcgttgcgatcacatttgctacggaagcagaaatgtatcacattgaaaagatcgaaaagattatccgtatgcagattccggtagaagagctacctgccgcggtagaa

SEQ ID NO: 33957 - DNA, 1731 bp, Cytophaga hutchinsonii
ctgctaaattatttaaagaattacaaaggacttattgcaatagcattgcttctggcatctacaagtcaggtcttttctttactggatccgcatataaccggtaaaatcgtcgataattttatagaaaaaaaagagatactttcccgtgcggagtttgttaagggcattttaattcttgtcggattttccatcggtgctgctatggtttcccggattgctaaaaatcttcaggactacttcacgagtattgttgtgcagaaattaggggcacagatgtatgccgatggtttaaaacattcgttagagctgccgtatcaaacgtttgaagaccaacgaagcggagagacgctgggtattcttcaaaaggtgcgtaccgattcagaaaaattcattacctcttttatcagtgttttattcgcaagtgtagtgggtttactgtttgttgttgtgtattccttatctgtaagttataaagtgacgctggtatacttcgctgcggttcctattatcgcttttacaagctggctgctgagccgtaagataaaagttgttcagaaaagtattgtaaaagaaactaccgcgctggctggttctactacagagtcgcttcgcaacattgaactggtgaagagccttggacttgccaatcaggaaattgaacggctgaataacacgacatttaagattctggctcttgagcttaaaaaagtaaaatacgtgcgcagtatgagttttctgcaaggtacaacggtaaactttatacgcagtgtgatggtggttattttactgctgctcatttttgataatgaattatcaccgggtatgtattttacgtttttgttttattccttctttttattcggtccgctgcaggagctgggaaatgtgatcattacataccgggaagcagaagtatccctgttaaattttgaccgtatattaaatcttccaaaagagattaaaccacaacgtccggaaacaatcggacagataaacaccttacgttttgatgccgtgagtttcaagcatcaatctgcccgcagcaatgcactcaatggcatttctttttcaacgcacaatggacaaactattgcgtttgttgggccgtcaggatcaggaaaaacaacattggtgaagctgctggtaggactgtacccgcctaaagacggaagtattctgtataacgatgtattaagtacaaacattgatctggatgaactgcgtgaaaagatcggatttgttacgcaggatacgcagttgttttccggaacgattcgtgagaatttattattcgtgagacctgatgcttcagacgaagagtgtttggctgtattgcataaagctgcttgcggcacattgttagcccgtgccgataaaggattagatacggtaataggcgagggtggagtaaaggtttcaggaggagaaaagcaacgcttatcgattgcacgcgcactgttgcgtcagccggatattctggtatttgatgaagccacatcgtcgctggactcaataacggaagaagaaattacccaaacgatccgcgaggtgtcgaccgttaaagatcatattaccatactaattgcacaccgtttatctactatcatgcatgccgatacaatatttgttcttgaaaaaggtaacatcattgaatccggcaaacacgaagacctgttgctcgaaaaaggattgtactacgcgatgtggcgtcagcagattggcgaaaaggca

SEQ ID NO: 33958 - DNA, 765 bp, Cytophaga hutchinsonii
atgaaaatagctacatataatgtgaatggagttaacggaagattacccgtgctgctacgttggctgcaagaagccagaccagatgttgtttgtttacaggaactaaaagcaccgcaggaaaaatttccggaagaagcgtttctgcaagccgggtatcatgcaatctggcacggacaaaaaagctggaacggtgtagccatcctttcacgcagcagcgatatccgtgagttgcgccgtgtattacccggagacccggaagacaaccacagccgctacattgaagcatttgtaaatggtattgttattggttgtctgtatctgcccaacggcaatcctgcaccgggccctaagtttgattataagctgaagtggtttaagcgtttaacggcacatgcagcagatctcatagaagcagacatgcccattgcactgatcggagattttaatgtcatgccaactgatctggatgtatataaaccggaaagctggattgatgatgccttgttccgtccggaagtacgcgccgcatttaaaaaacttatgaagcaaggctggacagatgccatccgcaaactgcatcccgatgaaaagatttatacgttctgggattattttagaaatgcatacggacgcaatgccggcttacgtattgatcatttcctgctaagccctcccctggctgccaaattaaaaaaagccggagtagacaaacacgtacgcgggtgggaaaaaagcagcgaccacgcccccacctggattattctg

SEQ ID NO: 33959 - DNA, 654 bp, Cytophaga hutchinsonii
cttatcaccggtgcaacgagcggcattggattagagctggcaaaattatttgcatacgataactacaacatggtgcttattgcacgtgatgaagaaagacttattgaaattgctacggaactgcaggaaatgggtgcaggaagaataaccattatcacgaaagatctgtgcctgcaaaatgctgcggcagaaatccaccacattacaagccagcacagcatccatatcgacgtactggttaataatgctggcatggctgaatacggattattttcagaaacagaggtgcaaaaagatctgtgtgtcattcagctgaatatagcatctatggtacagcttactaaattatacatgaaagatatgattgagcatgacaaagaagggcgtattctaaaccttgcctctgtctcttcctatcagcccagcccgatgctggctgtatatgcagcaacaaaagcctttgtactttctttcagcgatgccatagcagcagaattaagagataccgatattaaagttacctcactgatacccggacctaccgataccgatttcttccgtaaagccggaatggaacatacaagagctgcgcaggacaatccggaagatccggaaattgtagcgttagtaggataccaggcactgatcaagggt

SEQ ID NO: 33960 - DNA, 1041 bp, Cytophaga hutchinsonii
ggcgttatcactggcgatcaggttcaggatttatttgcagctgctaaaaaggcgaaacttgcattccctgcagtaaacgtagtaagtactggtactgtaaacgcagtattggaaacagcgaaacttgctaactctcctgttattgttcagttctctaacggtggtggtcaattctatgctggtaaatcattaccaaacggaaaacaggaagcgtctattgccggtgctatctctggtgcacaccacgttcatcaggtttctgaattatatggtgtaggtgttattttacatacagatcacgctgctaaaaaattacttccatggattgatggtttgttagatgcaggtgaagcattctacaaagtgcatggcaaaccattgtattcttctcacatgttagatctttctgaagagccattacatgaaaacatcgaagtttgcaaaagataccttgagcgtatgagcaaaatcggcatgacacttgaaattgaattaggtgttacgggtggtgaagaagatggtgttgataactcaggtattcaccaggatgaattatatacaaaaccggaagaagttgcatatgcatacgaagaacttatgaaagtaagtgataagtttacgattgctgctgcatttggtaacgtacacggtgtttatacatccggaagcgttaaattagagccgaaaattttgagaaaatctcaggatttcattaaagcgaactacggtcgtacggaagaaaatccattggatttcgtattccatggtggttctggttcttctcaggaagaaatccgtgaagcaatcggttatggcgtagttaaaatgaatttagatacagatttgcaatgggcattctgggaaggtgtattaaattactataaagcaaacgaagcatatcttcaaggacaaattggtaaccctaaaggtgctgatcaaccgaacaagaaattctatgatccacgcgtttggttacgtaaaggtgaagatacatttgtagcccgtttaaagaaagcattcgaagacttgaactcattcgat

SEQ ID NO: 33961 - DNA, 1167 bp, Cytophaga hutchinsonii
aaagtagtattggcctttagcggcggattggacacaacgtattgcgcaaaatatttatcagaagacctggggtatgaattgcatactgccattgttaatacaggcggtttttctaaagaagaattagctgacattgaaaagaaagcatacgaactgggtgtaacctctcatactacacttgacatcattgaaaaatattatgcggaatgtgttaagtacatggtgtacggaaacattttgcgtaacaatacctatccgctatctgtaagtgccgaacgtgtgtttcaggcgatggctattgcagaacatgctaagaaagttggggctacggctgtggcgcacggttctaccggggcaggtaatgaccaggttcgttttgatgtggtgttcatgatcatgaatccgggtattgaaatcattacaccgatccgcgatatgaaattatcccgtgaagcagaaattgaatacctgaagaaaaaaggggttgtgcgtgactggagcaaagcggcgtattcgatcaacgttggtatctggggtactagtgttggcggtaaagaaacattaacatctgacaaaacacttcctgaaagtgctttccctacacaggttactaaaacaggtgaagaagaagttgaactggaatttgaaaaaggacaattggttggtttgaatggcaaacgcatgaaatcaacggatgcaattgttgaattaaataaaattgttgctccttatggtatcggccgtgatattcacgttggtgacaccatcattggtatcaagggccgtgtaggttttgaagctgctgctccgatggtaatcatcaaggcacatcatacgttagaaaaacatacgcttacaaaatggcagatgtactggaaagagcaattggctaactggtacggaaactttgtacacgaaggtcagttccttgaaccggtaatgaggaacattgaaacatttttagaagatacgcaggtgcatgttaccggcaaagtaaaagtatttgctgcgccgtaccgttttcatgtagtaggtatcgaatctgcacatgacctgatgtctgctaagtttggtaaatacggagaagaaaataatgcatggtcgggcgacgatgttaaaggtttctctaaaatattcggcaaccagacgatgatttatcatagagtg

SEQ ID NO: 33962 - DNA, 942 bp, Cytophaga hutchinsonii
ataaaaataggcatcgttggcggtgcaggatatacaggcggagaattgcttcgtattctggtaaatcacccgaatgcggagattgtattcgtacacagcaacagcaatgcaggtaatccaatctataaagttcatacagaccttatcggcagcacggatcttgtttttacaggtgaattaagcaatgctattgatgtattattcttatgcgttggtcacggtgatgcaattaaattcctgcaagctaatccggttgagtcacacattaagatcatcgatttaagtcaggatttccgtattgaaaaagacggcaacgactttatttatggtttaccggaattacagcgtgataaaataaagcttgctaaaaatattgcaaacccgggttgtttcgcaacagcgattcagttgggcttacttccgcttgcagcagagaacgtattaacaaacgatgtgcatgtatctggcataacaggttcaaccggggccggacaatcgttatcacagacgtcacacttcagctggagaaataataatatgtctgtttacaaggcattaaatcaccagcatttaaaagagatccgccagagtttaacgaatctgcaatcttcattagagaagaatattcatttcatcccgtaccgaggtgattttacacgtggtatcatagcaaccatgtatacgccatgcagctggacaattgacgaagctatagcgaagtacaaagcgtactatgcttcgcatccattcacacatgtggtagatgagaacattgatctaaaacaagtagtgaatacaaacaactgcctgctgtatctggaaaagcacggcgaccagttaatgattgtaagcatcatcgacaacttgttgaaaggtgcttcgggccatgcggttcagaatatgaatctgatgttcgggctggaagagacagttggtttgagg

SEQ ID NO: 33963 - DNA, 987 bp, Cytophaga hutchinsonii
ttatttgatgtctaccccctaatcccaatcgaacctgtacgtgcacttggctcccgcctttgggatgcagcaggtacggaatatttagatctgtatggcggccacgctgtaatctctatcgggcattcacatccgtattacgttcagaaaattacagatcagataaataaaatcggcttctactcgaactcggttatcatttcccttcagcaggaattagcagataagttaggtgtggtgagcggccataatgattatcaattatttctttgcaattcaggagccgaagctaatgaaaatgcactgaagcttgcgtctttccataacggcaagaaaaagattgttgcatttaaaaaaggtttccacggcagaacgtctttagcagttgcagctaccgataatccttctattgttgcgcctgttaatgaaactgataacatcatcttcttaccatggaacgatgaggctgcattagaagcaacctttaaatcacacggcaatgagatcactgccgtaatcattgaaggcatacaaggcgtaggcggcatccacgaagcatccatgtccatgcttaaaaagatccgtacactgtgtgatgaatacaatgccgtttatattgcagactctgtacaatgtggctatggccgcagcggtaaattttactcacatgattttgccggtgtatctgcagatatctatagcatggctaaaggtatgggtaatggctttccgatcggtgcgatcagcattgcaccatatcttaaaccgaaacatggtttattgggtactacgtttggcggtaaccatttagcctgcgccgcggccattgcagtattggatgtgatcaaacaggaaaacctgttagagcatacaactcagctagggaattatattattgagcaggcacgcaagatccagggtgttaaagaagttcgtggtaaaggtttgatgattggtattgaactggaaattccatgtgcggaaatc

SEQ ID NO: 33964 - DNA, 906 bp, Cytophaga hutchinsonii
gatattcccggcctggttaaagaagcattggagcttaaaaaaaatccatatgcatttaaaaaacttggagaaaataaaaccatcgggttaattttcttaaatccaagtttgcgtacccgcatcagcacacagaaggctgctaagaatctgggcatggatacgattgttatgaacatggataaagaaggctgggcgcttgaaacgcaggatggcgtgatcatgaatcataataccgttgaacacatccgtgaagcggcagctgttatgggtcagtattgtgacattattggtgtacgttcctttccgcgcctggtagacaagaacgaagattattcagaagacttcttcaataaatttataaaatatgcaggtgtaccgattgtaagtttagaaagtgcaacgcttcaccccttacaatcacttgctgatttaattacgatcgaagaaacaaaaacaaaaccacgcccgaaggttgtattaacctgggccccgcatatcaaagccttgccgcaagcggtagcaaattcattttctgaatggatgtgtaaagcggatgtggaatttgtgatcacacatcccgaagggtatgatctggcaaacgaatttacaaacggtgcccgcattgaatacaatcaggacaaagcactggaagatgctgactatgtgtatgtaaagaactggtcttcgtatgaggattatggcaaagtacattccatggacagccattggatgatgaccaatgaaaaattaaaattaaccaacaacgcaaaagtaatgcattgtttgcctgttcgccgtggcattgaattagcagatgagatcctcgacggtccgaattcgctggtgatccaggaagcaagcaacagggtgtggagcgcgcaggcggtgctgaagagaatgctggag

SEQ ID NO: 33965 - DNA, 693 bp, Cytophaga hutchinsonii
atcataaaagtaggcggcaacatcatcgacaatccggaagcactaacaagcttcttaaaagattttgcgtcgctgaaagaaaataaaatactggttcatggcggtggtaaagttgctaccgagatcagtaaaggtttgggcattgaagcgcagatggtagatggcagaagaattacagatgctgaaaccctgaagatcgtgaccatggtatatggtggtttgatcaacaaaaatattgttgctaagcttcagtcgaatgaatgcaacgcaattggtttaacaggtgcagatgcaaacatcatgctctcgtctaaacgcccgcttaaaaatggcattgattacggatttgttggtgatgtaaagaaagtacatccacagccgttgatacatttgttatcgcagggtattacgcctgttgtggctccgcttacacacgatggcaacggaaccatgctgaataccaatgcagacactgtagcctcagagcttgcagtagcattatgcggagcatttgctgtaaatcttgtgtattgctttgaattgaaaggtgtattgagagatttcgaagataaagattctgtgatcagcactatcaatcctgatacttacgaagaattgaaatcaacaggcgttattaataaaggaatgatcccgaagttagataactcttttaatgcgataaacgccggtgtt

SEQ ID NO: 33966 - DNA, 1149 bp, Cytophaga hutchinsonii
gaagtaaataaagacattgagcgtttcactgttggaaaagaccgcgagatggatctgttccttgctccgttcgatgttcttggttcaatggcacacattacgatgctggaaagcattggcttgatcggtaaagatgaacttcccgtattgctgaacgaactccgcacgatctatactgaaatagaagcaggtaatttcaccattgaagatggtgttgaagatgtgcactcacaggttgagctgatcttaacacgtcgtcttggtgatcttggcaagaagattcacagcgggcgttcccgtaacgatcaggtgttggtagatttgaaattattcacccgtcatgctattcgtgaaacggttgaaaacaccaaagaattattcgatacattactttctcaaagcgaaaaatataaatcggtaatcattcccggttatacgcacttacaaattgcaatgccttcttcctttggcttgtggtttggcgcctatgcagaaagcttagctgacgacatgcacatgatgcttgcaggttaccgcatcagcaataaaaacccattaggctctgcagcaggctatggttcttcattcccattgaaccgtacgatgacgacaaacctgctgggctttgaagagttaaatcacaatgtggtttatgcacagatgggccgcggtaaaacagaaaaaaatgttaccgcagcgcttgcctctattgctgccactctgggacgaatgtcaatggatgtatgcctgtacatgaatcagaattttgactttatgactttgccggatgaattgacaacaggttcgagtatcatgccgcacaaaaaaaatccggatgtatttgaattgatccgtgcgcgctgcaaccgcttacaagctttgccgaatgaaatttctatgatcatggcaaaccttccttcgggttaccaccgcgacatgcagctgatcaaagaaaatttcattcctgcttttcaggatataaatgactgtttgcgtattgcaaattttatgctgaagcaggtgaaagtaaaagagaatatcgtaaaagatccaaagtacttatacatgtatagtgtggaagtagtaaataacatggttcttgaaggaatccctttccgcgatgcatataaaaaagtgggcggtatgatc

SEQ ID NO: 33967 - DNA, 1878 bp, Cytophaga hutchinsonii
ctgaaacagcgccggaagatcgccaatgaagtaaagattaaaaatacattactggaatatgcgcagcagattactcaaatggggacgtttgaatataacgttttcacaaatacattattctggtcaaatgaaatgtacaatatttttgaattagacagaagcgtaatccctgaaataaattttatagattctcttattaaagaagaatcagagattacacataacagaagaaagaaaaattttcagcctggagcaagctactcagatgaattaaaaatacgtacggtcaatggcaatgaaaaagttcttatatcgaatggatatgtagtgaatgaagaaaatgggctggttgtgcatggtgccattattgacattacaccattgaaaaaagcagaactaacagcacgcgaacaacaggaactcatgcgggttgccaaagaaaaagcagaaagtgccagtcagttcaaaacacgttttttatcaaacatgagccacgagatccgcacgccaatcaatgcgatccttggctttactgctattttaagtaagcaggaacttaccgaacaacaaaaaaaattactgaaaaatatttctatttcaggtgaactcttattaaaactgatcggcaatattttagatatcagtaaaattgaagaaggtaaagtaattattgaaagtaaatcgtttcacctcaaagaatcgatccgttccgtgttgagtccgtttcaacattcggcttctgaaaagggattacagtttcatttaattattgacaagtctattccggattatttgctgggcgattttccgcggatctctcaagtgttggtgaatctgatcggcaatgcattgaaatttaccagccatggaaatattactgtttctgttcttcttactaaaaaacaggatggactttcgtttgttgagtttgttataaatgatacaggtatcggaattcaagctaataaacaagacgaaatatttgaaagcttcacacaggctaatgaatctatttcggtaaaatatggcggttcagggcttggtttatcaatcgtacaggaggttgtacatttaatgggcggtaacatacaggttcaaagtcctgcacattataacgaacgcggcaaaggctacggaagtaaatttttctttacgcttccgtttaaattaggcgaaaagggcgctgatccgcaggcaaagaaaacagctgttcagccatttccacgcgtattacatattctggtggcagacgacaatgaaatgaaccgtacccttgcaacctatacattgcagtcgttaggctgtacgtttgagatcgtagaaaacggtttgcaggcaatacaaaaagcggctgccaatacctatgatatcatattaatggatatgcagatgcctgtttgcgatggcttacaggcaacacgtcagatcaggctgaataaaaatactactcctatcgttggcttaacggcaaacgttttccaggaagacattaaccgctgcctggatgcaggtatggacgggcatttaggaaaaccttatacagaagaagatttgtaccacattattgacaaatgggttttcaaaaatgaaaaaaatatcgcagcctcagtaccttcattttcaaattatgaatttatcgaaaagctttccaaaaatgatccggtgattttccgtgaaatgctggaaatgtttttgaatcagaatgcacaattattaaaaataatacatactgcaatcaatgccgaagatctggagacactttcctttaacgtacatcaatacaaatcatgtgcgcgcatgttaaacattgaaaaacagatttcgctgattaagcagattgaagaaaaaattgaagcgcgtgtttctcttgaaacaata

SEQ ID NO: 33968 - DNA, 1359 bp, Cytophaga hutchinsonii
agaggtaaagcatttatagcagataaagacggcacctacgatctttccggcggatggcatgattgcggtgatcacgtaaaattcgggcaaacagaattctattcagcttacatgttgttaaaaggatatgcagaatttccggctggttatggtgactattatgcatacgactatcaaggatataaaacatccggcagctggtcttttgaaggaacaggacacgcacctaatgggattccggacattttagatgaagtcaaacatgcaaccgattttttcatcaaatgcgccaaagatgcaacaactttttattaccaggttggccagggtgatccggatcacaaacaatgggtaacagcagtaaaaatgcagacgttatctgttgcaaacggcggacagacacgtgctacctataaaaacccgaacgatgcttccatgccttctttttgcggtgctaccttagcattaatgtcgcgtttatacagaccatatgatgccgcttatgccgatttatgtcttgtgcatgcaaaatatgcttatgactatgcaaaaacaaaaacttccactgttggttcacctgatggaagcttttatgctgcaaacgataattacaaggatgattattcaacaatgtgtgcagaattattctgggctacaaacaccgcctcctataaaacagaagcgctaagcttttcaataagtaccgctccgggccaaggagctgacatttatggaaaaaattacgggtttgattattcaaacaatggtgatattgcaatttataaccaggcattactaggcaatacatatgcaaaagatgtactaaattcaattgtaaattctttttatttaaataatacccgaagtgatggtcagtttaatgatggcaataccagctgggggccgctgcgttataatgccaacaccgctttcattgtggctttatggcaaaaactatatggtacaagcgctactcctaataaatacatttatgacaacatcgattatattttaggaaaaaactccagcaaccaatcatttgttgttggtttcggaacaaaatctcctgcgcacccacaccatagaaatgtttatttaagtgatgcaaacacgccggtaaacagcctggcaatacctgcaaaaaatcagcaatttggcttaatggtaggcggtacaagaaatgccggttcctttaatgacaatcttgaaacctatacacatacagaaggcggtattgattacaatgcttgcctggttggtgtattagcctacatcaattccgtactcagccctgtcgttacacactctacgccaagccttggcgccgaccagtctctatgcggcaaaacaagtattgtg

SEQ ID NO: 33969 - DNA, 873 bp, Cytophaga hutchinsonii
gaacagcaacttagacgcatgaagcaggacaaaggctttattgcagcattggaccaaagtggcggcagtacgcctaaagcattaaccggatatggcatacaggaaaatgcgtataaaaacgaagacgaaatgtatggtcttattcatgccatgcggtcacgtgtactgacagataaatccttcactggagataaaatcttaggcgttattctatttgaaaaaacattaaacgccaaggttgaaggtatgccaacgaccgagtatttgtggaagaaacacatcgttcctttcttaaagattgataaagggctggaagaaaaaaagaacgatgtgcaattaatgaaaccaatcccaaaccttgccggtatcattcaggatgcaaaaagcaagggagtatttggcacaaaaatgcgttccgtcatttttgcaaacaatcaggcaggcattgcagctgttgtgcagcagcagtttgaatttgcccgtatcattattgaaaatggcctggtaccaattattgagcccgaagtagatattcatgctgcagataaaaaagaaattgaagcaacattaaaagcagccttactggaacaattaaacaagcttacagcgaatcaaaacgtaatgctgaaattaacccttccagcagaaaataatttctatagcgatttaacaacgcatcctcaggtagtacgtgttgttgctttatcgggcggatatgattttgaaaaagcgacaaacttgctggcaaataataaaaacgtcattgcaagtttttcaagagcattgctggatgatctgagagttgaccaaacaacagaacaattctcaactgtactatcgaaagctattgatgggatatacaacgcatcgatt

SEQ ID NO: 33970 - DNA, 1941 bp, Cytophaga hutchinsonii
aaaggaatcgccctaattgaagacgacccatggctggagccctatgaagctgaaattcaagatcgcattatccggtataaacgcgcagtaaaagaaattaaagaacattacggagacctgttgacatttgccacaggacataaatactatggcataaatttcgatgaggacgagcgcggctggtattacagagaatgggctcctgaagcctatgaagtataccttacaggtgacttcaacgattgggacagacgttcacatccgttgacacgcaatgaatttggtgtgtggcagatcttccttccatacgatctgtatcaaaaacgttttgttcataaaagtaaaattaaagtacagattgtaggtgccaatggcacacacgaccgtattccggcatacataacccgcgttgtacaggatactgaaacaacagacttctccggacagctttggttcccgcaaaaaccttttgaatggacagaccgcgatttcaatttgcgcaagatcaaaaatccgattatctacgaagcacacgtagggatggcgcaggagaaagaaggtgttggtacgtacagagaatttgcggataagattgttccccgcatccgtcagatgggctataacagcattcagctgatggctgttatggaacacccgtattatggttcatttggttatcacgtttccaatttctttgctccttcttcccgcttcggcacgcctgaagatctgaaatacctggtagatcgtgcacataaattcggactggcagtaatcatggacgttgtgcattcacatgccgtaaaaaatctgtctgaaggcctgaatgaatttgatggcagcgatcatcaatacttccatccgggcgacagagggtatcatacgggctgggattctaaactatttgattacggcaagcttgaagtaaaacgctttctgctatcaaacctacgttactggctggaagaatatcactttgatggtttccgctttgatggtgttacttcgatgctgtattttgatcacggcatgaaaacatttgacagctacgacacctattttaaaggcggtgtggattttgatgccgttacgtatttacaattagccaacgaggtaacccataggtatttaaaagattccattacgattgctgaagatgtaagcggtatgccgggcttatcacgctccatacgagatggcggtgttggtttcgattaccgtttggcaatgggtatacctgatttctggatcaagtatttaaaacatttgcaggatgagcaatggaacatctatgaaatgtggagcacgttaacgaatcgacgctacaaagaaaaaacaattgcctatgcagagtcgcatgaccaggcaatggttggcgacaaaaccattgccttctggttaatggacaaggaaatgtatttccacatgcaggtagatgatcccaatccggtgattgaccgcggcattgcgatacataagctgctgcgtttatttacgtttgccctgggcggcgaagggtatttaaactttatgggcaatgaattcgggcatccggaatggattgattttccaagggaaggaaacggctggagttaccaatacgcccgccgccagtggtcgctggtagataatcctaaattgaaatatcaatacttaggagcatttgatgaagcgatgatgcgtctggtacgtaaaacacgattgcttgcagcagaacctgcacagcaattgaatatggacgaccacaacaaagtgattatcttcgaacgcaataatatgatctttgtattcaatttcagtgtaagcaattcggtatttgattataaattcaaatcattcgcaccgggtacatttgagatcgtattaaatagcgacgacacacgtttcggcggtcacggccgtgtagatgacacacttgaataccataccaacacagaaggt

SEQ ID NO: 33971 - DNA, 1293 bp, Cytophaga hutchinsonii
atagcaattattggtgcaggcatttcaggattaacacttgcgtatcagcttcaacaagctggcaagccttatatattatttgaatctaactcacgaccaggcggttatattaattctcaacgatttggtaaatacctgttagaggtaggtcccaactctattctggttgataaaaaattagaggaatttattcacgaattgaatctggataaattatttgaaccggcagccatcatcaataaaaacagatttatctataaagatgctaacatacagcaagtaccttccggaccgctgtcttttttaacaggacgttttttttcagcaaaaacgaagtatgcaatattcaaagagctttttaataaaagtatatcgaaagaaaatgaaacggtatacgatttctttgcccgaagattttctgcgccctttacgcagtataccatcgatccgtttgctaccggagtctatgcaggtgacattaaacagcttttaatagaagaaacatttccacagctggttgaattggaaaaacaatacggcagcatcattaaaggaatcttcaaaaaaggttttggcgaaaaaagaaaaaccggcacatttgtgcatggcttgcaaacacttacagatacactggctgcacagcttcattcccttcagcttaatacacgtgtattgaatctccgtaaacagatggataagattgtgctaaccacggatacgaaacatggtattgaagaattaacgtttgataaagttgttgtttgcggaacaacttttcaggcggctacattgatcaaagattcctatccggatctttcagccatactttcacaggtacaatatgcttctatgaaggctgtgtttgctgcctttaagcgtactgatgtaacacatccgatgaatggattcggatgtttatatccctctgcagagcaatcttttttagctggtaccatttggaacagcagcatttttaacgatcgctgtccggccgatgaagtactgacaacgtcattcatcggcggcatgcatcacccggagtatacagcgctttcagaatcagaactagaacaacgcgccatacagcagttaagcaaagatcttgggattacaggcaaaccaacgtttacacacgtagccggctggaacaaagccattccgcaatacgacatctatttaaaaaaggcacgtcttgcaagtaagctgttgagcgatgatcatatttacttccgttcaaactggacaaacggaatttctttaggcaattgcatacaaagtgcccgtgatttagcg

SEQ ID NO: 33972 - DNA, 474 bp, Cytophaga hutchinsonii
tccatcattgtcgcacaatcagaaaacagagctattggaatcaacaatacattgccgtggcatttgcccgcagacctgaaacgtttcaaagccattaccatggggcaccacatgatcatgggccgcaaaacctatgaatcgattggtaacccgttacccggccgtaccagcattgttgtaacacgtaataaagacctggtgtttgcaggctgtaccatggcccattcgctggctgaagcatttgagattgcacaaaataataacgactctgaagccttcgttattggtggtgcagaactgatcaaagaggcgatcaactcttgtgataaattataccttacaaccattcatcaaaattttgaaggagatacttttttagatgcattagcttcagactggaaagaaactgaacatgttgtacatgcgccggatgataagaatgcgtattcgtattcgtttattacgtatgaaaaa

SEQ ID NO: 33973 - DNA, 1728 bp, Cytophaga hutchinsonii
ccaagcagaaatgttcttaacccgatatacacacctactgcagcagaaatttctgccggtacattaaatctaacgctacagtcaaccggtaatggaaattgtaatgcagtatcttcaacaggaaccattacattctctcctgctccaaccgttactccaactacacctgtaaatgtgtgtgcggatttccctacagcaacaatttctgctacaagaacattggcaacaggcattgtatggtcaggaggtacaggaacaatagcgaacacaacagctgcatctacttcatatacaccttcccttagtgaaataacagcaggaactgctaccttaacggtaacaacaaccggtaatggaacatgttctcctgtttctgctaacgttactatattaatagcccctgcaccaactgttaatgcaggagcaaatcaggtagtctgcggtacggtttcaacggtttcaaatttatccggtaccgttaccggagcaacgggtggtacttggtcaaaggtttcgggtacaggtacttttggaaatgcaaataatacatctactacctatacgccatcaaatcaggatgtaataaatggtagtgttacacttagattaacctcaacaggaaatggattatgtcagccggtatctaatacaatgacaataagctatactcctgtaccttctattaatgcaggtgcagaccagattgtttgttctacagaattacctatttctctttctgctacaggatctccggctgtttggagtgctgcaggcggtgtttatggaaacgcaaattcattgacaacaacgtatatgccttctgccggtgaaattgctgccggtacagtaacgttaacaatcaatacaacaccaagtggtgcctgtcctacgaaatcaagtcagattactattacaataccagctggcccgattgttaatccaggtcctgccaatcaaacaatgtgcggtagtttagctacgtatcaacttacaggtacagtaacaaatgcaacaggcggcgtatggacaacaagcggaacaggttctttcttgccaaatgcaaatacactaaatgcaacgtattcgccatcagcaacagatcgtgcaaacggttctgtaaacataacattaacatctacaggcaacggattctgtaaacaggtagccagacaaattacgttaaccattactcctgccattacagtaagtgcaggccctaatcaaacgttctgtgcggatgccggcggctttgcattaaacggtacagtagctgttgctacaggcggtgtatggtcaatcacttccggttccggtactataggaacacctgcaagtttatctactacctatacgccttcagcggcagatcttactgctggttctgtttctttattattaacatcaacaggaaatggcggatgtccggcagtaacaagtgctgtaacatttacaatcacgccagcacctacacttacaataccttcaaatcttaccatatgcggtgactcagcatatgtacaattgagtgcaacatatacaattgcaacaggtgtggcatggacaacaagcggaacaggctcatttaccccaaatgcttctactgcttctgccagatacattccttcagctgcagatattgctgccggtacggtaacattaacggcaacaacaacaggtaatggcatatgtaatccgattgtaagaaatgtcacaatcacaattactcct

SEQ ID NO: 33974 - DNA, 1821 bp, Cytophaga hutchinsonii
ccgaacaatacagccgttcagccaacttatttcccatctgctgccgatattactgcaggcttagtaagaatagccggagtaacaacgggtaatggaacctgtctggctgttagagatactattaatatacgaataactccaagaccaactgttaatgcgggtacagatatagctatctgtgctgattcaggcggagttattttagatggcaattcaactattgcgggtggtgttagatggacgacttccggctcaggtacatttgtaccaagtgctttggttaaaaatgctgaatacattccttcaaatgcagatacaactgctaaaaacatcgttcttacattaactactaccaataacggcacatgtagaccagtatctgacaacgtaaatattacaattgcacctgtaccggttgttaatgcgggcagtgacagaacagtctgtgcggatgtcgatcagttattattaggcggtaaagtacttaacgctacaggtggtatctggacaacaagcggaagcggtgttttcgatccgaacaatacgacgttaaatccaaactactcgccttcagcctctgatttgaccgttggtacagttgtattaacattaacatcaaccgggaatgggttgtgtaacgcggtaagcgaaaatgtgaacctgcaattcaatccggttgcaaccatatcagccggaaataatcttcaggtttgtaacagtgtaccaaccgtaacagttaatgcttcaggaacaaacttatctaatgtaagctggattatattatccggcaacggaagtttatcatctgcatcgacattatcaacaacgtataacgtggatgcagcagatgcagttcctggcggcagtgtcaccttacgtatcataggatcagcgttaagcggctgttcaaatgttatggatgatgtggttatcacattcgttgctgcaccaccaattgacgctggcccatctaaaacagtatgtagtacagatcttccgattaaattagaaggtactggttcttctgcaaaatggtctggttatgcgggaacgtttaatccaaatgatgaaacattaaatgcgttgtatacgccttctgcaggagaaatttcagcagggacagtaacgttgacattaacaaccattaataatggagtttgttcggcagccacggataacgtaacatttacaatcatccctgggcctgtagtggatgcagggacagtacctagaatttgtacaaactctccgaatgtaggcttatccggaacaagtaatggtatcagcacaggagttatctggtctacctcaggatctggatcatttgcaaacggaacaacattaacgcctacctatacaccttcaaattcagataaaaatggcggtgaagtagtattgacaattacatctacaggcaacaatactgcttgtagagcagctacagatacggtaaaattatctatcgctcctgctccaaaaataaccgtaggatcaaaccaaacggtttgtggtgatgctactacagttgatgtcaattcaaccgttacaaatgcaacaggtgtactatggtcaaatgtaacagctaatggtacgtttgtaaacaatacagccacaagtacaaaatataatgttgctgtacctgctgacactacagccggaaccattactgttcaggtatctacgactggccagttaacaggttgccctgcggctactgcacaaatgagcattacattcacgcgccctccaaaagtaaatgcaggaagcccgatcacggtatgtacggatacaacgtctattcctttaaatggctctgtactg

SEQ ID NO: 33975 - DNA, 1835 bp, Cytophaga hutchinsonii
atagaaatgagtgaggatgctaaaatttatgaagaagaacttgccaaacaatccattcaggaacgcaaagaacttggtattacgtggtatccgttatttataaaatctgaatactatggttttgcagagcgcctgcacattgaagttgaacgcaaatacgaagcggatacaccaaatattttttattcaggagacaaagtacggatcttttcaaaccagcagcataatacaaaagaagattttattgatggtgtaattacggcgtccgccgggaatttggtaaccgtacagctgatgaaagatgaggcgccggattggctttcggatggaaagatcggtatggataaactatttgataagcatagttatgaaacgatgctttcaacgcttgattactgggcttcagacgatggattaacaaaagattcgatccggttacgcgatgttattttaggtgaaaaaactgcttcattcaatacaaaagaaaattacgcagcaccggacaagttagatattacacaaaagaaagcctgggaaaaagccatacaggcgcaggatgtagcaatcattcatggacctccgggcacaggtaaaacaactaccattgttgaaatagtaaaaactctgatagaaaaaggggagcgtgtattggtttgtgcttcgagtaatgcggctgttgatgtattaacggaaaggcttgctgccagaggcttgccggttgtacgattggggaacccttccaaaattacggagcagaatctgcagtattgcctggaccggcaagttgtgaatcacgaacaatttggtttagtgaaagaattgaaaaaacgtgcggaagaattttttcgcatggcgaataaatacaaacggaattttgaccgggaagaacgggaacagcgaaaagccatcttgaaggaagcccgcaatctgcgtggacaagccgacgatcacttacattttttacagcaaaatgtattagtaaaaaatcaagtggtaacgtgtacgcctgtagtttccatgcatagagagattggtaaagaaaaatttgacacgttgatttttgatgaatcgggtcaaaccatggaaccgatgtgctggatcccgattcaaaaagtgaagaaagtaattttggcaggcgatcatttacaactgccgccaacagtgaaatccgatgaagcggcgaaaaaaggcctggcgataagtttgcttgaaaaattaatgcctttgcccggtatttcggaaatgcttgccattcaataccgcatgaatgaaaagatcatgcagtttccatcccaatggttttatgacaataaactggaagcacacggcagtgttaaagatcatgcctttgatgacgatgttattcagtttattgatacggccggaacaggctatgaagaagaactggttggagcaccgtttggtatccggaataaacaggaggcagatcttgttcttgctattttgaataacgtagctgaattaaataaacaggcaagcatcggaattatcagtccgtataaattacagattcaatacattcgtgaacaattgatcgaacagaaaatcacgtctaaaaatattcaggtacaaccgtagatggttttcagggacaggagaaggatattattattataagtctggtacgttccaacggaaaacaggagatcggttttttaaaagacctgcgacgcatgaatgttgcaatcacacgtgcacgtaaaaagcttattgttataggagattcgtctacattgtcatcatcaaaattttacgccggttttcaggaatatattgaatcgcataatgggtatcactcagcctgggaatatatc

SEQ ID NO: 33976 - DNA, 1929 bp, Cytophaga hutchinsonii
ctagattcattaaatgatgttcagcgacaagcggttgaacaaacagatggccctgtaatgattatagccggtgccggctcaggaaagacccgtgtacttacctaccgtattgcccatttaatacaaaaaggtgtagaaccgtttaatatattatccctcacatttaccaataaagctgccaaagaaatgcagcaccggattcaggctgtatgcggcagtgaagcacgaaatgtaatgatgggaacgtttcactctgtattttcgcgtatcctgcgagttgaatctcagaaaattggatttccaagcaactttacgatctatgataccgaagattctaaatcgttgctgagaacgatattaaaggaacagaatttagacgacaaagtttacaagccgaatactgtttttaaccgcatcagtgcggcaaaaaacaggctcatttcatataaagagtatattgccaatccaaattatatggcagatgaccgggcagcattacgtcctgaaatgggtaaattgtaccagatgtatcaggaacgcctgatccgcgccggtgcgatggattttgacgatttacttttctatacctataaacttttcaatgaacatccggacgtgctgaataaataccagcataaattcaaatacatcatggtagatgagtttcaggatacaaacattgcacagtataacataaccaaaaagctggcggcgatgaaccgcaacatctgcgtggtgggtgatgatgcacaaagtatctatgccttccgtggtgcggatattcagaacatcttaaattttgaaaaagattatccggaattaaaagttttaaaactggaacagaattaccgttcaacaaaaacaattgttgaagcggcaaataatgttattacaaaaaataaagcgcagttaaaaaaggacgtatggacttcaaacgaatccggagaaaaaatccatgtataccgtgctgccagtgataatgaagaaggccggatcattgcgcagacaatctttgaaaacaaaatgaacatgcaattgcgaaacaaggattttgcaatcctgtaccgtaccaactcgcaatccagaagttttgaagaagcgcttcgtaagctcaacataaactacaaagtagttggcggtatgtctttctatcaacgaaaagaaattaaagatgtacttgcttatctgcgttttgtattaaatgatcaggatgaacagagtttcagacgtatcgttaattttcctaaacgcggtattggcgatacaaccatagcaaaactatttgtaattgcagatgaacaggggacaacggtttgggacattctttgcaatgttaaaagtattatgaccggccgtctggtaccggtaatagaaggttttgtagatctgatcaaatcctataaaatacttgccaatacaaaagatgcgtttgaagcagccaatgaaatagcaaaacaatcagggcttctgaaagaattatatgaagacaaaacggttgaaggtattgcacggtatgaaaacgtgcaggagcttttaaatggtattaaagaatttgtggatcgtcccgatcaggaagacaaatcattaggaagctacctacaggaaatatccttattgacagataccgaaaaagacaaagaagataaagattctgtaacgctcatgacgatacactctgcaaaaggacttgagttcaatcaggtatttgtagtgggtattgaagaagatctgtttccatcagcaatgatgctgaacagccgtgcagacctggaagaagaaagacgtttgttttatgtagcgatcacacgtgcagagaaacgattaaccttaagctttgcaacttcccgttaccgttttggacaattgaaaagctgttcgccaagcagatttttagaagaaattgatccgcgccatttgcaaatgacatct

SEQ ID NO: 33977 - DNA, 1305 bp, Cytophaga hutchinsonii
ttaatggcatctttcgaaataatcggcggtactaaactacgtggtgaaatcattccgcagggagcaaaaaacgaagcacttcaaattttatgtgcggtactaatatctcctgaacctattgttattcataatgtaccaaacattattgatgtcaataaactgatcgaattgttaaacgatatgggtgttctggttacaaaaataacctcatcgtcttatcgttttgaatcaaaagatatcaatctggattttttagatacagaagatttcaaaaagaaagcttctgccctacgcggctccatcatgatcataggtccgctattggcgcgctttggcaaggcaaagatgcctaagccgggtggtgacaaaatcggaagaagaagattggatacacactttattggcttacaaaaactaggtgcctcttttgattacgattcaaacgacagtttctataacatcagtgcatctgaattaaaaggctgttatatgctactggatgaggcatcggtaacaggtactgccaatgttgtgttagcggctgtaatggcaaaaggcgaaacaactatatataatgctgcctgtgagccttacttacagcagttgtgcagcatgctgaaccgcatgggtgctaagatcagcggcatcggctctaatttattaaagattgaaggtgttgattatttaggcggaacagaacatacgattcttccggatatgattgagatcggtagtttcattggacttgcagcaatgacaggttctgaaattacaattaaaaattgccgtattgatatgcttggcctgattccttctgtgttccagcgcttaggtattaagctggaattcagaggagatgatatctttattcccgaacaggaaaattatgaaatagacacttttattgatggttctatcttaaccgttgccgatcagatctggcctggcttcacgcctgacttattaagtattgtgctggttgtggcaacacaagctaaaggttctgtactcatccaccagaaaatgtttgagagccgtttattcttcgtagataaactgattgatatgggtgcgcagattattttgtgcgatccgcacagagcaaccgtaattggtttaggtaagcaggttgcgttaagaggtatatctatgagttctccggatatcagagccggggtatcgttattgatcgctgcgatgtctgcacagggaaaatctactattcataatattgaacagattgatcgtggttatcagaatattgatacacgattgaatgcattaggtgctaaaatctcacgtcta

SEQ ID NO: 33978 - DNA, 681 bp, Cytophaga hutchinsonii
ttagatgctttagtcaagcttcaatcaatcgactcaaaattagatgaaatcatcaaagtaagaggagaccttcctgaagaagtaagagacctggaagatgaattagctggctatgagacccgtttaaccaagcatgaaggtgaaattaatacgttagaagaaagtattaaaaacttcaaaaacggaattaaagaatccgaaaaacttataaagaaatacgaagagcagcaaaaaaacgtgcgtaacaaccgtgagtttgatgcaatcagtaaagaagtagagttacagcagttagagattcaggtttctgaaaaaagaattaaagaagcattgcagcagattgaattcaaaaaagaagaaatcaaaaaaacggattacaacttaagcgaacgtaaaaaagaccttgagaacaagaaacaggaattagaagtaatcgtttctgaaagtcaggatgaagaagttaaattgaacaaagaacgcgaaaaagcttcaaagcaaattgaagagcgtttattgaactcatatacaaaattagttaacaattaccgtaacggacttgctgtagtatccgtaaaacgtggcgcttgcggcggttgcttcaacactgttccaccacaacgtcaaggtgaaatccgtgaaagaaagaagatcattgtatgtgaacactgcggtcgtatttta

SEQ ID NO: 33979 - DNA, 1140 bp, Cytophaga hutchinsonii
atgaaatttgaaagttacgaccttgcaccgggcattaagaaaagtttagcagaagctggtttcaatcgcccgacagatatacagtttaaatctatcccgcctattctggcaggagaagatgtattggcgattgcacagacaggtacgggtaaaaccgctgcatttgttattcctgttttaaatacacttatcaacgttaaaaaatcggagcatacagacatatcctgtctggtaatggcgcctacgcgggaacttgctgttcagatctctgaggtttttaaaaaaataggagcgtatacacgcttacgtacggtatgcatcacaggtggtgtagagcaggaagcacagattgcagcagcggattatggcattgatattttagtggccacgccgggaaggatgtttgatttgatctatcagaaacatattaaaatcaccagggttaaaatattagtattggatgaagccgatcacatgcttgatctgggttttataaaagacattcaggatgtgaagaaatttcttccggccagacatcagacattatttttctctgcaaccattaacgaagagataaaaaaacttgcttattcactcgttaagaatccgatccgcattcagattgctcctaaagaccgtgtatcaaaaaacattacccattcggtagcttttattggtatggatgataaacgttttttcttagagcgtttattgaaagaacatcctgaaagcaaggtaattgtttttgtgcgtacacaagttcgtgcagaccgtgtacaggctgctatggaacgtgttggcttaaaatcagtaaccatgcatggcggtaaagaacagcaggcacgggatgctgctatggacgcatttaaaaacggaactgtacatgttttgattgcaacagatatcagtgcacgagggattgatattgccggagtagaatatgttgtaaattatgacatgcctgaagtggctgaaaattatgtacatagagtaggccgtacgggcaggggcgtttctaaaggttttgcaatatccttttgcagcatggaagaaaaacctgtactggatgaggtagaagaatttttaggaaaagaaatcaatgtgattgagattacaggtaaagactatgatgcaacctta

SEQ ID NO: 33980 - DNA, 1584 bp, Cytophaga hutchinsonii
atgcagtcatcccttttccgtacaaaaaatccaaacgaacttcatacagaagtctctgcattaaaaagaacacttacctttaaagacttaacagcgctgggcattgcagcggtaattggtgcgggcatttttggtaccatcggacaagctgcgtatgacggcggaccaggcattatattcctttttattattacttctcttggctgtttattttccgctttctgttatgcggaatttgccgcctctacgcctatttccggaagtgcttacacctatgcatacattagcttcggagaactcattgcctggatcattggctgggatcttttcatggaatatgccgttggtaatatggccgttgccatttcctggtcagattattttaccgcttttctgaaaggggttaacatcgaattcccgttgtggttaagcatggattattttacagccgtgcatcaaaaatcggcggcggcacaacaggcatatgtacacgctccccgcatatttgactttccggtgattgttgatttgcctgctattttaatcactgttcttatcaccatactggtctatatcggtattcaggaatcaaaacgtaccaataatgttttggtcgtatttaagatcattgtacttcttctatttataatcgtaggttttactacagtgaatacagcaaactggtcgccgtttatacccaatggctggtcaggaatcttcaaaggcacagcagcggtattcttcgcctacattggctttgatgcgttatcaaccactacagaagaatgtgtgaatccgaaacgggatttacctcgtgccattttttcttccttactgatctctaccctcatctacattgccatcgcgttagtaattaccggcatggtttcgtatcacgatttgaatgtcggtgacccgcttgcatacgcgcttgaaaaaacaggcttacacaaatttgccggactgctttcattcagtgccattgtatccatgaccggtgtattgcttgtgtttcagatcggacaaccacgtatctggatgaacatgagccgcgatggattgttacctaaagcactttccaggattcatcccagataccaaacgccttctgtagctacggtattaacaggtggcagcattattctgccgttattattccttgacctgaaagaagtagttgacttaacaagcattggtaccctgtttgcctttttaattgtatgtgcgggtatctggctgaaaaaagaaaagataaaaacagaatcctttaccgtaccttttataggcggccggtatttattacctgtcaccatgcttcctgttttatatttgtacctgcataccgtatcaacagaaaatgttttttcgtttacgcagattccgctctattcctgtattctggccatgatcgcaacaatcttttacgggagtgttagaaatctttccctgctcccgggtattggtgtatgtctgaatttacttctgctctcaaccatgcatcatcagaactggatccggtttgtagcatggctggccataggattaattgtgtatatgacgtatggaaggaagcattctgttttg

SEQ ID NO: 33981 - DNA, 267 bp, Cytophaga hutchinsonii
gtaaacatcaaaccactagcagacagagttctgattgagccggcagttgcagaatcaaaaacagcatctggcattattatccctgatacagcaaaagaaaaaccacttaaaggtattgtagtagcagtcggatctggtaaaaaggatgaacctatgacagtaaaagttggagattcagtactttatggtaaatattccagtactgaaatatctgtagatggaaaagattacttaatcatgaaagaatctgaaatctacgctattctt

SEQ ID NO: 33982 - DNA, 1626 bp, Cytophaga hutchinsonii
atggcaaagcaaattttatttgacagagacgcccgcgaaaaattgaaaaaaggtgttgatgcattggcagatgcagtaaaagtaacccttggccctaaaggaagaaatgtaattttagataaaaaattcggttcacctgctatcacaaaagatggggtttctgtagcaaaagacattgagttgaaagatgctatcgaaaatatgggcgcacaattagttaaagaagttgcatcaaaaaccgctgatcaggctggtgacggtacaacgactgcgactgttttaacgcaggcaattttcaatgcaggtttaaaaaacgttgcagccggcgctaacccaatggatcttaagagaggtattgataaagcagtttctgcgatcattgcagatcttaaagttcagtctaaaaaaatctctaattcaaacgagatcgcacaggttgctacaatctctgccaacaacgaccacgaaatcggtaaaatgattgcacatgcaatggataaagttggtaaagatggtgttattactgttgaagaagctaaaggtactgaaacagaagtaaaaactgttgaaggtatgcaatttgaccgtggatacttatcgccttacttcgttacgaatacagataaaatggaagttgagttagatcgtccatatattctgatctacgataaaaaagtttcttctatgaaggaattacttccgattcttgaacaagttgttcagtccggaagaccgttgttaatcattgcggaagatgttgacggtgaagcattagctacacttgttgtaaacaaaatccgtggtgcactgaaaatcgcggctgttaaagctccgggcttcggtgacagaagaaaagctatgttggaagacatcgcaattttaacaggcggtacagttatttctgaagaaagcggatacaaattagaaaacgctacacttgaatatttaggtacagctgaaaagatcaatattgataaagacaacacaacggttgttaatggttcaggtttaaaagataatatcgttgcacgtgttaaccagatcaaatctcagatggaaaatactacgtctgattacgatcgcgaaaaacttcaggagcgtttagctaaattatccggtggcgttgctatcatgtatattggtgcagctacagaagttgaaatgaaagagaaaaaagaccgtgtggatgatgcattgcatgctacacgtgctgctgttgaagaaggtatcgtaccaggtggtggcgttgcgttgatcagagcaggtgctgctttagataacgttgcattccacaatgaagatgaaaaaacaggcattcagatcatccgtacggcaattgaatctcctttacgtgctatcgtgtacaatgcaggccttgaaggttctgtaattgttcagaaagtgaaagaaggcacaggcgattacggatacaatgcccgtgaagacagatacgaagcaatgattgctgcaggtattattgaccctactaaagtaactcgtttggcgttagaaaatgctgcttctgtggcatctcttctattaactacggaatgtgtagtggctgacgaaccggaagaaaaatctgctatgcctccaatgggcggcggcggaatgggtggcatgatg

SEQ ID NO: 33983 - DNA, 543 bp, Cytophaga hutchinsonii
aagggattgatttttgatattgacggtaccctggctgataccatgcctgcgcattacagagcaagcctgcgtgtagccaggcaatttggttttgaatttccattagagttctttataaaaatggcaggcatccctacaacagatgtctttaaagagttattaaacctgcaacataaatcacacatttctacagaagaagtgtctgccttaaaggaaaaatattatctggaagaaattcctacgattcaacccatctcgtatacgatggacatcgttaaaaaatatgcgggcgtacttccaatgtctatgggaacgggcggaacgctggagatagcacttcccaatattaagcagataaaggctgatacatacatcgatattttagtaagtgccgaagatgtaaaaaaacacaaaccttttccggatacgtttttagaatgcgcgagacgcatgaacattgccccgggaaattgcctcgtctttgaagatgcactacaaggatttaaagcggcacaagccggagggatggattatattgatgtt

SEQ ID NO: 33984 - DNA, 2589 bp, Cytophaga hutchinsonii
aataattacacgattaaagggcaggaggcatttcagaaagcgatggaaattgttgctgccaacgaacagcaatccattgaatctgttcacttattgaaaggaataatcgttgcggatgaaaacgtggttccttttttattcaaaaaaaataatatcaatccggttacgtttaatcagacattggatgccgtaattaaaacctacggtaaagtttccggaggcagtccgtatttgtcaaacgatgccacgcaggtattaaataaagctacggctttatcaaaagagtttggcgacgaatatatttcgatcgagcacatgttgcttgcattggtttcagggaaagataaggctgcaacgttattaaaagatgccggcctttcggaaaagggcttgcgcgctgcgatccaggagttacgtggtacaagtaaagtaaccgatcagcatgcggaaggtaaataccggtcgcttgaaaaatattctaaaaatttaaatgacctggctcgttccggaaaaattgatccggtgattggccgggatgaagagatccgcagagtactgcagatcttatccagacgtaccaaaaataatccgattttattgggcgagccgggcgttggtaaaacagctatcgctgaaggccttgcacagcgtattgtttcgggtgatgttcctgaaaatttaaaaagcaaacaattaatctctctggatatgggtttgctggttgcaggtgcaaagtataaaggtgaatttgaagagcggttgaaatcggtgatcaaagaagtgatcgattcagatggcgagattgtgttattcattgatgagatccatacgttaattggtgccggcggcggggaaggtgcgatggatgcggcaaacttgctgaaacctgcacttgcacgtggtgagctgcatgcaatcggtgcaacaaccttaaaagaatatcagaaatacattgaaaaagataaagcgctggaacgtcgtttccaagcggtaattgttgacgagccgaatacacaggatgcaatttctatccttcgcgggatcaaagaaaaatacgaagtgcatcacggaatccggattcaggatgatgccatcattgctgcagtagaactttctcaacgctatatcagtgatcgttatttgcccgataaagcgattgatttgatggatgaagcatctgctaaattgcgtatcgagcttgattctatgccgcaggagctggatgaaattcttcgccgtatcatgcagctggaaattgaacgtgaagcgatccgtagagaaaataataaagagaaggaaacgattctttcccgtgaacttgcagaactgaatgagcagaagagccagatcatggctaagtggcaggaggaaaaacgtgtgatcgatggcttgaagcaagccaaggaagatatcgaccggtacaaaatggaagccgagcaagccgaacgtaatggtgattacggtaaggttgcagagatccgttatggtaaaattcaggagtctgaaaagcaattggtcgaattcaacaagcagctgcaggagttgaaacaaacacttggttcttcgatgctgaaagaagaagtgacgccggaagatattgcagaagttgttgcgaaatggacaggcataccggtttcaaaaatgcttcagagtgagagagaaaagttgcttcacttagaagaagagttaggtaaacgtgtcgccggacaagcggaagcgatagaggccatatccgatgcggtccgtaggagcagagcaggcttacaggatccgaagcgtccgataggttcttttattttcttaggaacaacaggtgttggtaaaaccgaactggcaaaagcactggctgattatttattcaacgacgacaatgctatggtacgtattgatatgtctgaatatcaggaaagccatgctgtaagtcgcttggttggtgcacctccgggatacatcggatatgaagaagggggacaattaacggaagctgttcgacggaagccgtattcagtaattttattggatgagattgaaaaggcccatccggatgtatttaatatattgcttcaggtattggatgaagggcgcttgacagataataaaggccgtgtagcgaactttaaaaatgcaatcattatcatgacatccaatatgggtgcgcatgtgattcaggagaattttgataagctaactgctgcaaatgaagatcaggtagttgaggaaacaaaaaatgaagtaattgatttattacgtaaaacgattcggccggagttcttgaatcgtgtcgatgaaattataatgttcagaccgctgacccgaaaagagattcgtaagattgttggtatacagtttagcttgatccaaaaacgtctcgaagagaacggaatcaaagttgaggcaagtaccgaagtattggataaattgggagagttaggtttcgatccgcaattcggtgcacgtccgttgaaacgtgtcatgcagcgtttgatcctgaatgaattgtccaaagaaattctttccggaaacattcagaaagaaagtgttgtaggcattacgcttggtgaagatgggaatctgcagtttttgaacttg

SEQ ID NO: 33985 - DNA, 1110 bp, Cytophaga hutchinsonii
atgacattctccgacctgggtttaaatgctgcgctacttcaatcccttagtgaaaataatatttcttcgccatcagaaattcagcaaaaagcaattcctgttattctgaattctactaaaaatgtagtaggcgttgcacaaaccggaacaggtaaaacagctgcatttggcttgcccgtattacaacagatcaatccttctttacagcaaacacaggtactggtgctggtacccaccagagaacttggccagcaggttgcaaaagatctgtttgtattctcccgctacatcgtgcgcatacatacagaagccgtttacggcgggaaaaagattgaagagcaaataaaaaagcttgaaacaccaaaacacattctggttgcaactcccggccggttgcttgacctgattgcgcgaaaggcggtgaacttaagtaacctgaaatacctgatcctggatgaagccgatgaaatgctcaatatgggctttcttccggatattgataagatcatgaagattgcaaagcccactgcacgtaagcttttgttcacctcaacacttggttctgaacttaagctgatcatccgggaatatttaggaaccgacatcgaagagattcgcataaagccgcaggagtatgtaaatagaaatattgaacatcagtacctggcatatcaatacggatataaattagaatatctgaaagcatttttgctgaagcatagcaatgaacgcggcatcatattctgccgtacacaggccgcggctaaattactggggcagcagctggccggttttgatattgttgtcgggtcactttacggcgacctcaatcaatatgagcgtacaaaagtgatgcatgcatttaaagacaaacgcattgaggtacttattgcaacggatattgcagcccggggcattgatgtgagcgatctgaattatgtgattcattatcatttgccggataacgaagcgcaatatgttaaccgcagcggaagaacggcgcgcgccggaaaaaaaggcaaatccattgccttgttacaaagcgatgaactatatcataaagatgattttgaagatgcgttacgcatcaggtttgaacccataaagctg

SEQ ID NO: 33986 - DNA, 2469 bp, Cytophaga hutchinsonii
atgaatcaataccccattgcagaaatagttgaagagattaaagaaacactgaatcttcagacaactgttattctgcaggcaccgcccggtgcagggaaaagtaccattcttccgcttgaattattgaaggcagactggcttgaagaaaaaaagattattttacttgagccacggcgcatggccgcgcgcagtgttgcacagcgtatggccgatctgctgggtgaggaagtaggaaaaaccgttggttaccgggtacgttttgatcagcgtgtttcagcacagacacgaattgaagttgtaacagaaggaattctgacacgacgattgcagcaggataatacactggaaggtgtaggcatggttatttttgatgagtttcacgaacgtagtttacatagtgatctgtcgcttgcattgtgcagagacctgcaacagatcctgcgggaagatttgcgcatcctgatcatgtctgcaacgctggacggagaaaatctttcagccattttagataaagcacccatcataacaagtaagggccgccaatatccgattgatgtgcggtacacgtcgattgatacaaacgcaccgataagcggacaaataacaacggttataagtaaagtactaaaagaagaaacaggggacatacttgtatttttacccggtgtacgggagattcagcaaacagccgctgcattaacagaacgacacggcgatattgctgttcgtccgctgtacggagaactgagcctgaatgcacagcaggaagcaatccgccccgatgcacagcagcgtcgaaaagttgtactggctacgtcaattgcggaaaccagtttgacgatagaaggcatacatatcgttattgacagcggtcttgcacgtgtaccaaagtttgatccaaacagcggcatgacaaagctggaaaccgtaaaggtaacacaggacgctgccgaccagcgtgcgggccgtgcaggcaggcttggtcctggtatcgcgatccggttgtggccggaagcaacccagcagtatctcaaacctcaacgcgtaccagaaattgcagaagcagatctggctccgctggtattggagttagcacaatggggtgtgagggatatacaatccatgacctggattactgcccctccatcaggatcggtagatcaggcgaggacattgctgcaggagcttgatgccatacagaacggtgtgataacagaagatgggaaagcgctggcgaatttaccgacacatccccgtaccgcacatttattactgaaaggaaaagaacatactatacttccgcttgccattgatctggtttgtattctcgaagaacgcgatgcactgggcaaacatgcaggagcagatataagtttgcgagttgacgccctgcaggcatggcgcgcaggtaaacgttttcagggcgacacatttatcctggaacgcattgaacgtgcagtacaatcctggcgaaaaattttttccattaaatcatctgtttatgaatttgatacggattccatcggcttattgattgctgctgcatacccggaacggattgcccgtctggtagatgcagcttcagcaagatacagaatggcaaacagccgcaatgtacggctgcatgaaaatgatgttctggtaaaagaagaatggctggcggttgcgcatgccgatgccggggtaggtgaaggccgtatttactgggccgctgcgttaaacccgatgctgctcacagatcgtatggtacaggaggctcgtatccggtgggatgaaacaaaaggtgtcttgttgcagcaggaagaaacccgcatcgggagtttgaccgttacatcaaaacccttaaaagaagtagatgaaacgttgcgtgcagcagcattatgcgaagcggtgcgaaaagaaggactgaaaatttttaactgggatgaagcctgtgtacaatggcaggcacgaattctttctcttaagcaatggcggccaaccgaagcatggccgaatgtagatgcggaagggttgcttcaaacccttgaagactggctgcctttttatctgaaacaggtaaagcgcagagaagactttaaaaaaataccattgcccgaagtattacataccatccttccctgggaacaggcaaagatacttgctaagcttgcgcctacgcatattgatgtgcccagcggttcatccattgcattggaatacaaaacagatggaagctttcccgttttatctgtacgcctgcaggaactctttggccttacagatacgccaacggtgaatgaaggaagaacaaaagtaatgattcatttactttcacccggctataaaccggtacaggtaacacaggatttaaaaagtttctgggcgaatacataccctgaagtacgtaaagaattacgcatgcggtatccgaaacattcctggccggaagatccatggaacgcagaagcggtgcgtggtgttaaaaga

SEQ ID NO: 33987 - DNA, 1884 bp, Cytophaga hutchinsonii
atgggaaaaattatcggtatcgacttaggaacaacaaactcatgcgttgcagtaatggaaggcagtgaggcagttgtaattccaaacagcgaaggtaaaagaacaacaccttcaatagtggcgtttcttgaaaatggcgaacgtaaagtaggtgatcctgctaaacgccaggctattaccaaccctacaaacacgatcagttcgattaagcgtttcatgggtaaaaaattcagcgaatcaaaaagtgaagctgaccgtgcaacatacaaattagaagctggcagtaacgatacaccaagagtccgtatcgcagacagacaatatacacctcaggagctttctgcaatgattcttcagaaaatgaagactacagcagaagaatacttaggtcatgaagtaaaagaagcagttattacagtacctgcttatttcaatgatgcagaacgtcaggcaactaaagaagcaggtcagattgctggtttagaagttaaacgtatcatcaatgagcctactgctgctgcgcttgcgtacggtatggataaaaaaggcaaagacatgactgttgcagtattcgatttaggtggcggtacgtttgatgtatctgtacttgaattgggcgacggtgtatttgaagtaaaatctaccaatggtgatgtacacttaggtggtgacaactttgatgaagtgatcattgactggttggctggcgaatttaaatctgaagaaggcctggatctccgtcaggacccgatggcgttacaacgtttgaaagaagctgctgaaaaagctaaaattgaattatcaagttccgcttctacagaaatcaacctgccatacatcatgccggttaatggtatgccaaagcacttagttaaaacattaacaagagcaaaattcgaacaacttgcagatagcttaattaaacgtacgttagatccttgtaagcaggcattgaaagatgcaggtttatcaatcggtcagattgacgaagtaatcctggtaggtggttctacacgtattccaagaattcaggaagaagttgaaaaattcttcggtaaaaaaccttctaaaggtgttaacccggatgaagtagttgcattaggtgctgcgattcaaggtggtgtattaacaggtgaagtaaccgatgtcttattgttagacgttattccattgtctcttggtatcgaaacaatgggtggtgtgttcactaaattgatcgaagcaaacacaacaattccttctaaaaaatctgaggtattctctacggcatctgataatcagccttcggttgaaattcacgtattgcagggtgagcgtgcatttgcaaaggataacagatctatcggacgtttccacttaggcgatattcctcctgctccgcgtaacgttcctcagattgaagttacgtttgatatcgatgcaaacggtatcttaaacgtatctgctaaagataaaggaactggcaaagagcagaaaatccgtatcgaagcatcttcaggtttatctgcggatgaaatcgaacgtatgagaaacgaagcgaaagcaaacgaaggtaaagacagagaagaaaaagagaagattgaaaaaatcaatcaggctgattcaatgatcttccagacagaaaaacaattgaaagagtttggtgacaaactttctgccggaaacaaatctgcgatcgaagcttcgttagaagatttgaaaaaagcgtttgaagcaaaagacatctctgcaattgatacagcaatggctgcgatcaacacggcatggcaggcagcttctcaggaaatgtacagcgctgaacaaggtgctggtcagccaggagcggatgcaggtcagtctggcccttcagacagcgttactgacgttgaatttgaagaagtagac

SEQ ID NO: 33988 - DNA, 1176 bp, Cytophaga hutchinsonii
gtaaatcataccatcacgcctcctgcttctaaaagcgagagtaatcgtgtattggtgatcgatgcacttacgggaagaaaatcacaattagataatttatccaacgcgcgcgatacacaaacgatgatccgtttgttagactccgacagcaatcctgtctgggatgtactggatgccggcaccaccatgcgtttcttaacagcattcagtgccttcaacggcaagccgcgtgaaatgacaggcacgccacgtatgaaagagcgtccgatcaaattactggttgacgccttacgtgagcttggtgctgtgattgaatacaaagaaaaagaaggttacccgcctattctcattcatccgttcaaaccggaattagcaaaaacagattacatcaagatcaaaggtgatgtgagttcgcaatacatcaccgccttgttgatgatcgcacctgtactaccaaaaggtttaacgatcgaattgttagggcacgtaggttcgaagccatatattgaaatgacgttgcgtttgatggaacactttggcgtaacatcggagtggaaagacaacatcataaaaatttctcatcagacatacaaaccggctcagtataaagttgaatcagattggtctggttccagctactggttcagtgtggcggcgcttgcaaaagaagccaacattgaattgaaaggctatgttaaaaattcacttcaaggtgatcacgtgattgttgacatcatggatcagttgggtgtgaagacagaattcactgcagacggattaaaactaaccaaacagcctgttaaaggaaacttagtttgggattttaccgactgtccggacctggcacaaacagttgctgtgatccttgcagccaaaggtgtagaaggaacattaagcggattgcaaagtttacgtatcaaagaaacggatcgtattgcagcgatccagaatgaactgcgcaagtttggtgcagacatgatcgagattgaaaaagatgttacctataaagttgtgccgggtaccttcaaggtagacggacaatcggtacatacctacgaagatcaccgcatggcaatggcgtttgcgccgcttgccttgttaggtaaggtaacaatcgaagaaccatcggtagtaaacaaatcctacccgttatactgggaagatttgaagaaggtg

SEQ ID NO: 33989 - DNA, 873 bp, Cytophaga hutchinsonii
atcaaaagcggagaaaaagaaaaaacacttgaaacctgttctgtaatctggtcacaaatgacagagcttgcgctggatcgtaaagcgttgctggtaaatcttggcggcggcgtaatcggtgatatgggcggcttctgtgcttctacctacaaacgaggcattgactttattcagattcctactaccctcctgtcgcaggtagatgcaagtgttggcggcaagctgggtatcgactttaccgatgcacacgaaaacgttttcaaaaatcacatcggcgtatttaatgtacccgttgcagtaattattgatccgacgtttttacaaacactcgatgcaaaggaattgcgttcgggttatgcagaggtcatcaaacattgtctgatcgctgataaagcaaaatggaatgaaattaaaaccgtaaccgatctgacaaaattagattggatggcactggcaaaacattctgttacaattaaagaaaagattacgatcgaagatccgttggaaaaaggtcttcgtaaaatattaaacttcggccataccgttgggcatgccatagaaagccattttctattcattccgcacaaacgtctgctgcatggcgaagccattgctgccggtatggtctgtgagtcctggctttctgtacaaaaaggatttatcacagaagcggaacataaagagatcgaagcgtatattctttcgatttacggacatacacatattttatttaccgagatcgatctgattgttccgcttacccttcaggacaagaaaaacgaacacggagccgtacagttttctttattagaaaaagtaggcaccgctaattacaatatatctttaactaaagaagagatcaccgcatcttta

SEQ ID NO: 33990 - DNA, 720 bp, Cytophaga hutchinsonii
atcatcgctggcccttgtagcgccgaaacacctgagcagttgatgtcaacagccaagcttttaaaagacttaggtaaagttgatgtattacgtgccggtatctggaaaccaagaactagaccgaacgcttttgaaggatcaggagaagaaggtttgaaatggttggcagaagttaaaaaagaactaggtatccagatcggtactgaagttgcgaatccggaacatattgaactggcgttaaaatatggcgttgacgttctatgggtaggtgcccgtactactgtgagcccgtttgctattcaggaaatggcagatgctatggctggtgttaaagacaaagccgtattgatcaaaaaccctacgcaccctgagcttggcttatggatcggtgcatttgagcgtttctatcgcgcaggtgttcgtgatttagctgctatccaccgtggtttctctacgatcgataaatcgaaattccgtaacgttccgacatggtctattccaattgaattaaaacgtatcgctcctcaaattccaatcatttgtgaccctagtcacattggtggtaaaagagatcttatatttgaaatttctcagaaggcaatggatcttggcttcgatggtttgatgattgaaacacacatcgatccggacaaagcatggtctgatgcagaccagcaggtaactcctgagcgtttaggtgagatcttaacagatcttaaa

SEQ ID NO: 33991 - DNA, 606 bp, Cytophaga hutchinsonii
gaagaccacgtttcaacatcagcagaaacacctcttagagaagatgcttttgaaaaagacgatgcgttaaagattgaattgatacaaaaacattttaaagaaatcatgctcattctgggcctggatcttacagatgacagcctgaagggtacacccaaccgtgttgcaaaaatgtatgtgcaggaaatattcagcggattaaatcctgcgaataaacccagcatacgtttatttgaaaataaatataaatacagtgaaatgctggtggagaaagatattacgctctactcctattgcgaacatcactttgtgcctatcattggaaaggcacatgtagcatacatttccaatggaaaagttattggtttatcaaaaataaaccggctggttgaacatttttctaaaagaccacaggtacaggaacgtttaaccgtacagatcgctgaagcattaaaagaagcgttgcaaacagaagatgtagccattgttattgatgcggcacatttatgtgtatcttcccgtggtgtaaaggataccgcaagtactacgattactgctcactattctggtaagtttaccgaagatcaaacgaaaaatgaatttctg

SEQ ID NO: 33992 - DNA, 402 bp, Cytophaga hutchinsonii
aaattgaaaacagcaatattcaggaaagaacattttaatgcagcgcatcgcttatttaacgcatcctggagcgatgaaaaaaatgatgccgtatttggcaagtgtaataatccgaattttcatggacacaattacgaattgattgttaaattaactggagaaattgacccgataaccggctatgtttttgacacaaaagaattaagtaatttaattaagcagcatatattgacacgctacgatcacaaaaatctgaacctggattgtgaagagtttaaagatgtgaatccgacggctgaaaatattgcaaaacaaatctatactacccttcgctccctgatcgacgcgtcattggacctgaaagtgatattatatgaaacagaacgaaactttgttgaatac

SEQ ID NO: 33993 - DNA, 546 bp, Cytophaga hutchinsonii
gtattgttacatatactgagtgaatttgatccgtctattccggtatattttattaatacaggctaccatttccccgaaacggttctttacagagatcagattgcagatctgttcaatcttaaaaatattaaagttgtatcttctgctactccaagaaacatgcagaaagatgctgaaggcagattgctttttacatctgatccggattattgctgctatttaaataaagtacagccgctggatgctgttctaccggattatgatatctggattaatggtgtacgtgccgatcagagtgccgtgcgaaaaagtttctccgttgagcagcctgctccacatgatacgattcgtttccaccccatgctggattgggatgtgcgtatgatcgaaaagtatattaaagagcataaaattccccgtcatccgctggaagaaaaaggttatttaagtatcggctgcgaaccatgtacgcgtaagtttgatcttgaaacatacaacagacaaggccgttggtttggattgaataaaacggaatgtgggttaaat

SEQ ID NO: 33994 - DNA, 387 bp, Cytophaga hutchinsonii
aataaagaatcgattgaaaacttactcccccaccgaagtccgtttttatttgtcgatgaaatactttcggtaactgaagatgagattattggatacaaaacgttcggagaagaatgttcgtggttatctggaattttcccggaacacaatattattcccggaacaatattaatagaatcactggcacaatgcggaggtgcaggtatgagactcttaaaagatacaaatggactttttggtttagccagtattgaatcagctacgtttcttaaagcagcaacatttcataccccgattaaatatgtaattaaaaacatccggcttagtgataagcttgtaaaacaatcaggcattgcatttataaatgatgaagcattgctggaagca

SEQ ID NO: 33995 - DNA, 1305 bp, Cytophaga hutchinsonii
ttgacatttaacgattttaattttaactccggtttattagatagcttaagctccatgggctttaataaacccacaccgatccagacagaagcaatccctgtgattatgtcgaatagtgatctggtagcctgcgcacaaacaggcacaggcaagactgctgcatacatgcttcctatcttacataaaattattgaatcaaatacagatagtctggatacgctggttctagtaccaacgcgtgaacttgccatacagattgatcagcagatagaaggtttctcatacttcattaatgtgagctccattgctgtttatggcggtggtgatggtgcaacgtgggatcagcagcgcaaagcattgaccgatggtgccaacattgttattgcaaccccaggcagattgctggctcagttgcaatccggtacagcaaacttaaaacagatcaaacatcttgtactggatgaagccgatcgtatgctggacatgggtttttatgatgatattgtacgtgtaataagttatctgcctaccgagcgccaaactattatgttctctgcaaccatgcctacaaagatgcgtgcgttagcaaacaaactcatgaaagatccgcagcagatcaacattgcaatttctaaaccggcggaaggtattttacagcaagcatacctggtgtacgaagagcaaaaaaataaattaatcaaacacattctttcaagcggtaattttaacagcatcatcatcttttcttctacaaaggaacacgttaaaaaactcgaacgtgatttatccaatatgggcttctctttgaaaggttttcattcggatctggagcaggaagagcgtgaagagattatgcgcgcatttaaaagccgtcaattgcaaatgctgattggtactgacattctatcccgaggtattgatattgatggcattgatctggtgattaatgcggaagttccaggtgatgcagaaaattatattcaccgtattggccgtaccgctcgggcagcaacaacgggtacagccataacttttatcagcgataccgatcagtataaattcttgcagatcgaaaacctgatcggcagagaaattgaaaaattaaaaatcccgattgaaataggagaaggacctgcatacgaaccggagaaaaaacctaaatataacaacaaaggtttttcaaacaataaatctaaaagcggaagtaaaggtagtaatcgacctacaccgaaagaacattcaaaaccggtacaccgcgaaccaagtggtattaaacataccattgtaaaaaaacaaaatcctcca

SEQ ID NO: 33996 - DNA, 777 bp, Cytophaga hutchinsonii
ttaaaaggccagactgcccttatcacaggcggggattccggcataggaaaaggcattgcgttaaaaatggctgctgcaggcgccaatattcttgttaactacaactcagataaagacgccgcagaagaaaccgttgcacaattgaaggtactgggcgcttctgccatctgctatcaagctgatgtaagtgatgaagctgatgtacagaatatgttcagggaagcagtcaaacactttggcaccattgatatattggtaaacaatgccggccttcagcaggacgcagcgttcgttgacatgacattgaagcagtggaacaaagtgatcagtgtaaatcttacgggtcagtttttatgcgcacgtgaagcggtgcgtgagtttacaaaaagaggtgcacgtccggagatctcaaaagcattgggcaagatcatctgcatcagttctgttcacgaagtaattccatggggcggacatgtaaattatgcagcatctaaaggcggcatcatgatgttaatgaaatccatggcgcaggaattaggcggattaaaaatacgtattaacagcatcggaccgggtgccataaaaacggatatcaacaatgaggcctgggaaacaccggaagcagcggaaaaattattaaaactgattccatacaaccgtatcggtgagaccgaagatatcggtaacgtggctgtgtggctggcatcagacgagtcagactatgtgcatggcactaccttgtttgtggatggcggcatgacactctacccgggtttt

SEQ ID NO: 33997 - DNA, 396 bp, Cytophaga hutchinsonii
ttggatgtaaatcagatttataaattacttccacacagatacccattcaaactggttgataagattgtacaccttgacgagaatatgattatcggcgttaagaatgttaccatcaatgaaccgttttttgaagggcatttcccaggaaaccctgttatgccgggcgtacttcagattgaagcgatggctcaaacaggtggtatctttgtgatgcagtctgtaccggatccggaaaattactggacctatttcctgagtattgaaagtgcaaaattccgtcgcatggttgtaccgggcgatacattggttttcaaatgtgagttaacggcaccaatcaaacgcggcattgcaaaaatgcagggtcaggcttatgtaggaggaaatttagtttgtgaa

SEQ ID NO: 33998 - DNA, 591 bp, Cytophaga hutchinsonii
aaggggatcgccaccccaatgctgccacaggcatttttaaaaacagatgaggaaaaaatagcatctatcgcaggacattttaaagccattatggaaacattgggcctcgatctcagtgacgatagtcttgcaggtactcctcagcgcgtagctaaaatgtatgtgcaggaaatctttagcggactggatgagcggaataagcctaagattgctttatttgagaacaaatacagatacggacagatgcttgtggaaaaaaatataaccttttacagcaactgcgagcatcactttgttcctatttttggcaaagtacatgttgcatatatttcatccggtaaagtaatcggtctttccaagctgaatcggatcgtgaactattttgcgaagcggcctcaagtgcaggaacgtctgacgatgcagattgcgggtgaaatggagagcgtactcaacacaaaggatatcgcagtgcttattgatgcaaagcatttgtgtgtttcatcccgtggaattaaagatgataactctgctaccatcaccgcgtattacggtggcaggtttagcgatgatgccgttaagaatgagtttttg

SEQ ID NO: 33999 - DNA, 1353 bp, Cytophaga hutchinsonii
tccatcaatcccttttcaaaggaaaacatacaaaacctcgcgtttgaatcgattgaatccttgaatgaaaaactgatcagatctgattcggcttacaaaaactggaggaaatattccatcaacgaccgtaaaccttattttaaaaatctcatttcagttcttacaaaagaaaaagaactattggcgcgtgagattacgttagagatgggaaaacccctgctggaaagcattgcagaaatagataaatgtatcggtacaacagaatggtatctcaataatgttgatgcgattatacaacaacatctgccaactgtttccattgaacatatcaaaagtcaaatagcatttgaacctattggtgccgtacttggcattatgccctggaactttccatactggcaggttttccggtatgctattccaacgctgcttatcggaaatacggttctgctgaaacatgcgcccaatgtacccggttgtgcgcaatcgctggaaaaaatatttaaactggccggatttccagatgacctgtttctttctctgtacccggctgttgaagatattgaatatatcattgcctcacctgccgtgcaggctgtaactgttacaggcagtgaacgtgcgggccgttctgtggctagccttgcaggaaaacacttaaaaaaatgcgtgcttgaacttggcggcagtgatccgtttattgttctcgctgatgcaccgattaaacaaactgttgcggaagcaattaaaggccgattgcaaaacaacggacaaagctgtattgctgcaaaacggtttattattcacgaacagtgttatgacgcttttttaaaagaacttaaagagcagctaaacgctcgcattatcggtgacccgatgcttaaagaaacgcaccttggccccatggcgcgtgctgatctgaaagaacaattatcaaaacaggtgcagagctctgtagcagcaggtgctgactgtacctacaaacatccgtttgacgattcaaattcaaatttcttttctccgctgatacttgaaaacattccggcaaacagccctgcccgtgccgaagaactgttcggacctgtatttagctgcatacgtgtaacagatacgaatgaagcgattgcggttgcaaatgaaacacgctttggactgggcgccagtatatggagcaatactattacagaagctgaaaagctgtctcaacatattgaagcaggttctgtattcatcaatgggataacgcgctctgatgcccgccttccttttggaggtatcaaacaatcaggttttggcagagaactatctgtatttggcttgcaggaatttgtaaatgtaaaaacgtattgggtt

SEQ ID NO: 34000 - DNA, 1257 bp, Cytophaga hutchinsonii
ttttcacgtgccaaagaagttattccgggaggcgtaaattctccggtacgtgcattcagagcagtaggagggaatccgctttttataaaaagagcccatggagcgtatttagttgatgaagatgacaaccaatacatcgaactgatcaattcctgggggccgatgattcttgggcatggcaatgagctgattgaaaaagcagttcgggatgccttgtcaaactccttgtcatttggcgcaccgtcgagaaaagaagttgaaatggctgaattaattgttagtatggttccgtcggttgagatggtgcgcatggttaattcaggtacagaagctacgatgtcggctatacgcgttgcgagagggtatacaggtaaagaaaaaattataaaatttgaaggctgctatcacggtcacggtgattcgtttttaattgcagcaggcagcggcgctgttaccatgggtgtgcccgatagcccgggtgtaccgcaaggtgtagccaacgatacgttaaccgcgccctataatgatattgaagcggttaggatattagtagaaaaaaacaaaaataaaattgcagctataatcattgaacctgttgcaggaaatatgggatgcgtgctgcctaaagcaggctttttagaagcgctccgggaaatttgtgatcaggaaaatatcgttttgatatttgatgaagtaatgagcggttttaggttgtctgtatccggagcgcagggagtttacggcgtgcagccggatatgacaaccatgggtaaaattattggcggcggaatgcctgtgggcgcttacggcggaaaaaaagagatcatgcaaaatgtttctccatccggcccgatctaccaggcaggaaccttgtccggtaaccctatagcaatgtctgctggtttagctattctacaatacttacaagccagtcctgcgttatatactcaattaaatgatcagacagattatctcatacacggtatgcggaaggcgaataatctgttaggccttgattatacattcaatcacgtaggatctatgtttaccatgttctttaccaatattggtgtgtatgatttcgaaacggctaaaaaatctgacctgtcaaaattcgcagcttattttcaggctatgttatcaagaggtatctatctggctccatctcaatttgaaagtctgtttatttcatctgcaatcacaaaacaattagcagatcagattattcaggcacatgcggaaagcatgaaagaaatt

SEQ ID NO: 34001 - DNA, 798 bp, Cytophaga hutchinsonii
aatatgaaaatagcaattttaggtggaggcaatatgggtatgacttatgcaaaagcatttgtcagcagaaaaattgtttcgaaagatgaattattgattattgaaaaacatgatgaaaaaagagaacaattaaaacaggaaggagtagcttctttgtctgctgatatcgatgattcgattaagaattacgatattttaattgttgcagtaaaaccacaggattttagagttttatctgaaacgctgaaaaaatatctgacagaaaatcaaatgatactttccattatggcgggtattcagattgctcagattcaaaccttacttgaacataaaaacgtagtacgtgccatgccgaatacacctgcgcagttgggctttggtattacagcatttacagttgctaaagatgcttcgtttgaaaatataagtgttgtagatatgcttttggaaactaccgggaaagcaatttttatgaaagacgaaaccatgctggatgcagtaacagcattaagcggaagcggccctgcgtatttttattatatcgttcagaacatgatcgaagccggtaaacaaatgggcgtggacgaaaatgtggctggcatgctcgtgaaagaaaccatgatgggcgcttttcagattttgaaccattcaaaatcatccattgatgaattgattgccatggttgcttcaaaaggtggtacgacagaggctgctttaaatacgttaaaacagagagaagttggtgcgcatatcatcgaagcactgaaaaatgccgaaaaaagggcaaaagaactctcc

SEQ ID NO: 34002 - DNA, 771 bp, Cytophaga hutchinsonii
acctatgcactcataacgggggcaagcaaaggaatagggaaatcaatagcagaggagcttgcagctaagggcaaaaatctgttattggtttctcgttctgaagaaaccctcaacgaattacgtttatcacttatacagcgctataatgttcatgtagcgtatttagccattgatctgtctgcagccgaggcgccacaacttgtttcaaactggtgcacatcaaataactacagcattgatgtgcttgttaataatgccggttatggactttgggggccttttgaaaaagtttctcttgaaagccaccaggaaatgctgcagctgaacatgcttacggttgtacagcttacttatgcattattacctgagttaaaaaaacatgcttcttcctatattctgaatgttgcaagtactgccgcttatcaggccgtgcctacactcagtttgtatgctgcaagtaaatcgtttgtcttgctgtttacaagaggcatccggcttgagcttgaaggtacaggcgtctccgtaagttgtttatgccccggaccaacatctactgattttgttacacgcgcaggtatgagtttggcaatccagaaaaaatctgatactttcagtatgacttccgaagccgtggcacgtattggtgtgcgcggtatgtataaccataaggcagaaattattccgggactgttaaataaaattattgttgctgctacggcatggctgccaaaatatgtaaccgaaaaaattgcaaacgatctgtacaaaaaa

SEQ ID NO: 34003 - DNA, 942 bp, Cytophaga hutchinsonii
aagccggacatacttgtttctgttccttctgatattggcgcgcagcgcatgggcacttcacttgccgtggatgcgctgttggtagcagatgcagaaagagctcaaccagtattaaaacaattttctaaaaaaacactttcaagttttcctgaaaaaagaggcgaaacaggcccgtatgtacagggaaaatatgcaaaactcttgtctgaattaaataacaatacagcgaaagaaatttctgcgatcgtaaaaaaacaatatccgttggttatcagtggtgaccatagtaacgctattggtattatggccggtatccgtgaagcaatcggtgcagataaaaagttaggcgtgatttgggtagacgcacatgccgatctgcatacaccttatactaccccttccggtaatttacacggcatgtcgctatcagcatctatggggtatgataatattgaactttccagaagtacgattgatgcgggcttgaaacctttctgggaagaattgaaacattgcggagcaagccgccttacaccaaagattggtccggaagatattttctttattggtctgcgcgatttcgaaattcaggaatatcatttgatccgtgattataaattaaatcattacagcccgtatgatgtaaaagcaaaaggtttaacctatatcctggatcaggcagtaacctattttgcggattacgatgcggtgtatgtttctttcgatgttgatgtgcttgacacaagtgtttctaccggtacgggtacacctgtgtataacgggctgctcttgcctgaagcgaagcaggttgtcgataccttaaaacgtttgaagaatatccgtttatgggaatttaccgaaataaatccattgcttgataacaacaacagcatgagcaaagcggtgattgagctgattgatgtgctgatggaagactagctg

SEQ ID NO: 34004 - DNA, 1842 bp, Cytophaga hutchinsonii
cccgaagagctgagaaaactcgatgaaactcaactcattcaggtaagtgaagagttacgtcaatttattgtagacaatgtctcagtatatggcgggcattttgccgcgagcctaggtgtggttgaactgaccgttgccttacattatgtatttaatacacctgtagatcagcttgtgtgggatgttggccaccaggcatacgggcataaaatattaaccggccgtatggaaaatttccatacaaaccgaacctataacggactttcgggttttccgaaacgttccgaaagcccatatgatacgtttggtgtcggacactcttcaacctctatatcggcagcactgggtatggctgtagccagtcagtatcaaaaagacaaccgccagcacattgccgtaatcggtgacggtgcattaacaggcggaatggcttttgaagcgatgaatcatgccggtgttaccaattcaaatttgctgatcgtgcttaacgacaattgcatggcaattgatccgaatgtgggtgcgctgaaagattatctggttgacatcacaacttcccgcacgtacaaccgtgtgcgggatgaagtatggaacatgcttggaaaaataagtaagttcggacccaatgcgcaggcaatagcttctaaagttgaaagcgggttaaaagcatcgttgcttaagcaaagcaacttatttgaatcgctgcatatacgttatttcggtccggtagatggccatgacctgaaccacctggtacaggtgctgaatgatttaaaagatattcccggaccaaagatcttacacaccctgaccgttaaaggcaaggggtatgcgcttgccgaaaaagatcaggttaaatggcacgcgccgggaaaatttgataaagtaacgggacaaattcacgttaagacctacgatacacctcaggctcctaaataccaggatgtttttggaaataccattattgaactggcggaaaagaatgataagatcatgggtattacgcctgccatgccttcaggatgttcgctgaatttaatgatggaaaaaatgcccgaccgggcatttgatgtaggcattgccgaacagcatgccgttactttttctgccggtttagccacacagggattaattcctttctgtaatatttattcaacattcatgcagcgcgcatacgatcaggtaatccatgatgtgtgtattcagaatttgcatgttattttctgcctggatcgtgcgggctttgccggtgtcgacggaccaacacaccacggcgcctatgatcttgcttttttccgctgcataccaaacttagtggtttctgctccgatgaatgaacaggaactgcggaacttaatgtatacagctcaactgcaaaaaaataaagggcctttctctatccgttacccacgcggccagggtgtaatgcccaactggaaaacaccttttgaagaaattacgattggcaagggcagaaaagtaagtgacggagatgatgttgccatcctcagcataggccatatcggtaattatgttattgaagcaaaagcattactgcgcgaagaagaattatctcctgcccattttgatatgcgttttgttaaaccaattgatgaagaaatgcttcacctggtgtttaagaaatttaaaaaaataattacggtggaagatggctgcttaatgggtggctttggttcggccgtattggaatttatggcagataacaactatgcggcgcaagtaatccggctgggtattcccgaccgtattgttgaacatggtgagcaggctgaactgcacaaagaatgcggcttcgacccgcaaagcattgccagaaccgtt

SEQ ID NO: 34005 - DNA, 411 bp, Cytophaga hutchinsonii
atgggaggtaatagaacattttcaatgatcaaacccgatgccgtaaaagacgggcatagtggtagtattttaaaaatgattgaaggcgcagggtttagaattgttgcgattaagttaacgtatttaagtgctgaacgtgcaggggaattttatgctgtgcatacaggtaaacctttttatgacagcctgaaatcaatcatgtctgaaagcccgataatagctcttattttagagaaagaaaatgctgttgaagatttcagaaaacttattggtgcaacaaatcctgccaatgcagatgcgggtactatacgcaagttgtttgcaaaatctctggaacgtaatgccgtgcacggttctgattcggatgaaaatgcgcagattgaaggaagtttctttttcagtgcattagag

SEQ ID NO: 34006 - DNA, 1170 bp, Cytophaga hutchinsonii
cttaaagccggcgaagacgtacagacaacctacatcggaagcttattaagcaacggttctgtatttgataagtctgccccgggcgattattttaaattccgtttaggttccggacaagttattcaaggctgggatcaaggcttcctaaaattaaaacacggcgacaaggcactgattttaattccttcccgtttagcttatggtaccagaggtgccggaggaagtattccgccgaatgcaccattggtatttgaagttcaggtaaaataaattaaaacaccaatgaataaagtatacatcattctgggtttttgttttctaagcatatctgtttttgctcagaaaaaacaaaagactccaagcaaggcatctctatttcatgaaaaggatgtagcctatacaccctcaggtttggcatacaaatacagacttgatgtgccgggtaaaaccggggcagtaggtgatgttgtaaaactgcattttgtattgcgtaacagtaaagattcaattctgcgcagtaccatagaggaagacaggatggttattacaaccattcaaaaaccaaggtatgcagcatcctttgaagaaggtctgggaatgctttctaaaggagacagttgtgcattctggatttcagcagattcactttttaaaaaaggtattggtgctgaaatgccgccctttattgaaaaaggaagcttccttcgttttgaagtaaagatgtatgacgtattaacaatggcagaatatgttgaggaacaagaaattatggcaaaaaaagtaaaagcagatgaagatgcggcattagcatcatacatcaaaacaaataatattccggctgtgttagacacggcaacaggtgtatattaccaggtggttcaggcaggcacaggtgctaaacctaaaaaaggaaacaaagtaattgttcattataccgggcatttattaaacggagaaatttttgacagttcactcgatcggggagatccgtttgattttatcatcggacaaggccgcgtaattgaaggctgggatgaaggtattccattgatgcgaaaaggagaaaaaggaattttatacattccatcctatcgcggttatggagagcagcgtgccggaagcattccccctaattctacattgatatttgaagttgaattgctggatata

SEQ ID NO: 34007 - DNA, 1275 bp, Cytophaga hutchinsonii
gttgcccatacagcgaaatctgtttttgtaacaggtaaagcaggtacgggaaaaactacttttttaaaacagcttagggagcatacaccaaaaaaacttgccgttgctgcaccaaccggtgttgcggctatccatgcaggtggtgtaacgttacattctctttttcaattgccgtttaaaccatttttgcctacagtttccaacgcgttatttcagcaggaacagaatttctgtgatcagaaaacactttttacaacaacgcatttaagtgctgctaaaatcgatgtgataaaagaactggaagtactgattattgatgaagtttcaatggtccgtgcagatttgctggatgcaatagatactatattaagacattaccggggaaatgaaagtccgtttggtggtttacaaatggttttcattggggatctctatcagctgccgccggtagttagaaatgaagaatggagcgtgatgcagctgtattacgatagtccgttttttttcgaggcacacgcgcttcgtgctttaaatccgctggtgattgaactgcaaaaaacatatcgtcagaaagatggtttatttctggatattttaaacagaatccgtgtaaatggggtacatccaacagatttagaccatttaaatacctattataaaccaacttttcgcccatctcccggagaagcttatattaccttaacaacgcataacgacaaagccgaaacaattaataagcatcagcttaatcaattaaaaacggaagaaagaaagtacaaagcatttgtaaccggagattttaacgaaagaagttatccggttgaattgcagctgcagctgaaggtgaatgcacaggtgatgtttattaaaaatgacaaaggagataaccggaaattttataatggcatgcttgcggtagttaccgaacttgcagatgaatacattatggttaaacctgtttccggagccgatgtaatgaaagttgaacgggaaacctggaaaaacatacgctatcaggcaaacaaagagcaggataaaattgaagaggaagaacttggttcgtttgttcagtttccattgcgcttggcctgggcaattaccattcataaaagccagggtttaacctttgaccgcgccattgtagatgcaggagattcctttgcagccggtcaggtatatgtggcgttgagtagattaacttctacaaaagaactcgtgctgtattctaaaatttcgacccacagcatccgtgtagatgagcggatcttaaaatat

SEQ ID NO: 34008 - DNA, 507 bp, Cytophaga hutchinsonii
ttagaaacagataaactccgcatcgattttattaaatccgataaaatagatgcacactcacttgcccttactattttgcccggaagaaaggattacagcagagacctttcggaagatcttaaagaaataaaagaacagcagattgattgtgtggtatcgctcattacaaaagacgagatggatatgtatggtgttccggagcttttagacgtatataaaaagcagggggttgaatgtctgcatgtacctgttattgatcagaaaataccggtaaaagcagagatcgaaagaattaatgcatttataaacgcgcagcaaaaaaagcataagaaggtattgattcactgtgtcggcgggctaggccgttcaggacttgtggcagcctgttatttaaaatcattgggctatccttcagacgatgccattaaaatagtgcgggaagcacgctcatcaagagcgattgaaagtacagaacaggaaaaatttgtatatgattacaatgaacgt

SEQ ID NO: 34009 - DNA, 1128 bp, Cytophaga hutchinsonii
atgcttaacttcgattataaaaacccaacaaagattcttttcggtaaagggcagattgctgcgctcgcaaaagagattcctgtacaagctaaagtgcttatgctttacggcggtggcagtatcaaaacaaacggtgtgtacgaacaagtaaaaaatgccctgaaagactttgaagtagttgagtttggcggtattcctgcaaatccggaatacgatattttgatggaagcactggctattattaaaaaagaaaacattacctacctgctggccgttggaggaggctctgtaatcgacggtacgaagtttttatcgtcagccgcactctataccggcgaagagccatgggatatcctcacgaagcctatacgtacggaaaaaggcatgcctttcggaacagtactcacgttacctgcaacaggttcagaaatgaactcaggggccgtaatcacgcgccgttccacccaacagaaattagggatgggcggtccgggtctgtttccgatattttctgttttagatccgcaggtgatcaattccatacctgacaggcagattgcaaacggtataactgacgcgttcacacacgtgctggaacaatacatgacctaccctgcgaaggcgttactgcaggaccggattgctgaaagcattatgcagacactgatcgagattgcaccggttattttaaaagataaatcgaattacgaagcagcctctgattttatgtggagctgtaccatggcgctgaatggacttatacaaaaaggtgtacctaccgactggtcggtacacgcgatcggacatgaattaactgccttatacgatattgatcacgcacgcacgctggcaatcattgcgcctagtctgtaccggtataagttcaatactaaaaaagagaaactggcacaatatgccgaacgtatctggaacattcaaacaggaagtgttgaagagaaagccatgcaagcaattgagaagacggaagcattctttcattcactgaatataaaaacaaaactttcggaatacacggatgattataagaagtgtgcaggctttgcggccgaacgtttaaagagccgcggctggatcgcattgggtgaacgaaaagatattaccccggat

SEQ ID NO: 34010 - DNA, 582 bp, Cytophaga hutchinsonii
attgattttcaaaaaggcggcggattagtacccgtgatcattcaggatgcagtaaccagaaatgtactcatgctgggctatatgaatgaagaagcctatacaaagaccaaagcagaaggtaaagtaacgttcttcagcagaaccaaaaaccgtctctggacaaaaggcgaaacaacaggccattttctgcatgtggtggatattaaaattgactgcgataacgataccttacttattaaagtgaaacctgatggtccgacctgccatacgggtacagatacctgctggtcggaagtgaacagcggcagaactttctttatcgagaagctggcaaacgtgatcaaagaccgccgcaacaatcctacagacgtttcttacacggcatcgctgtttaaaaaaggcatcaataagattgcgcagaaagtaggcgaggaagcggttgaaattgtgatcgaagcaaaagacaataacgacgacctgtttaaaggcgaagcagcagatctcctataccattacctgatcctgctggaagcgaagaatattccgctggatgacgtgattcaagtgctggagtcaagacag

SEQ ID NO: 34011 - DNA, 2127 bp, Cytophaga hutchinsonii
ctggccaggctcaacactgcacaacgtgaagcagttgaaaccattgaaggtcctgtgcttgtaattgccggccctggcaccggtaaaacacagatcctttccgcacgtatcggtaaaattctggcctcacctgatttacaggtgcagccgcataatattctctgccttacctttaccgaagccggtacagttgccatgcgcaagcgcttacttgattttattggtccggaagcatatcgcgtgcatgtatacacgtttcatggtttctgtaatcaggtcattcaggaaaatctggactactttggcgtacggaatttacagccaatctctgaattggaaacgattgagttatatcaaaaactcatcgataactttgatgcaacaagtaagctgaagcgctttaaaggagacatatattatgaccagattggcctgaaagaacttttcaaaaatatgaaaagtgaaggctggtcggaagagtccatgtatatcctgattgatcgttatgtagacgaattgaaagatgatcccgaacatcaatataaacgcaagtcaggaaacaacaacaaaggggatttaaaggctagctattatacagagattgaaaagatggccaaacttaaagcggccattgcagagtttgcaaacttcaatgctgctatgggtgccatacgtcgttacgattacaacgatatgattctttgggtgctgaaagcgtttaaagaaaatgaattgctgctgcgcaactatcaggaacggtatcaatacatcttagttgatgagtaccaggatacaagcggctcgcagaacgaagtagtagatctgcttgcttcgtactgggaacgcccgaacttatttgttgttggcgatgacgatcaatccatttaccgttttcagggagcaaatattaaaaacatcattgattttaatagtaaatataaccctgcacttattgtgcttaaagagaattaccgttctacacaagccgtgctggatgcttccatggctgttataaaaaataacaacgaacggttggtaaacagtgtacaaggactcgataaacaacttacggctaaaggcataattgcagcgtcgcatgttgaaccgaaaattattgaatattataatgaactgcatgaagaagcgtctgttgttgaacagctggaaaaacttcatcacgaaggcgttgacttatctgaggttgcagtgatctaccgcaaacactcaaaagtagccgatattataaaggtgctggagaaacgcaaaattccgttaaacattaaacaaagtattaatgtactgcacttgccattcgttcagaatctgattgatattttagcttacattcaaaaagaaaatgaatacccggattcaggagaagaacagttgttccggttaatgcattttgaatattttaatattgacccgacagatattgcaaacatttccagaaaaacacgacgtacgtctgaaagttccgctatccgctggcgcgaactgatgtctaaaaaagaagagctggcaaaactgaatctgcattcgttgccatccattctttcactggaagcaaacttaacctattggcaaaaagaatttcataacattaccttacaggtgttgtttgaaaaaattacaacacgcggcggcatactttcctggatcatgaattcgtctgaaaagacctggtacatgcaggtattaacaacgttctttgatttcttaaaagaagaaaccgcacgcaatccattgctgtcgctgaaagaatttttgtcaaccatacagaagatgcttgataatgatgtgcggcttaatcttcaaaaaattattcatgcagaaaaaggtgtaaattttgttaccgcgcactcttcaaaaggattggaataccggtatgtgtttctgatcggctgtaactccaggcaatgggagggacaggccgagcggagttttggatttaaaattccaagtactataacagaaaacgttgaacacgataaagaagaagatgaacgccggttgttttatgttgcattaacacgtgcgaaagaatatttatacatatcctatccggcaaaagatgttaatgaaaaggaattggtctgcagccgttttctggtagaacttaccgaa

SEQ ID NO: 34012 - DNA, 750 bp, Cytophaga hutchinsonii
attatgagaaagaaagtaattgcaggaaattggaaaatgaacaaaacacttgaagaaggcttgtcattagcttctgaagtggcaaatatggcaaaggatgaagttcctgcagatgtaaatcttgtaatgtgtattccttatatctcattggctgctgtttcaaaagtaatcaacgataaagtagctatcggcgcgcaaaacgtatatcaaaaagaatccggtgcatttacaggtgagatttcagctccgatgttgaagtctgtaggtgtaaagtatgtaatcatcggacacagcgaaagaagagaatattttggtgaaacaaatcagcaattggctgataaagtaactatttccctggcaaatggtttaacgccattattctgctgcggagaaacacttgcacaaagagaagcaggtatccacatcaattttgtaaatgctcagttaacagaaagcttattccatttatcaccggaagatttcaaaaaagtagttattgcatacgaaccaatctgggcaatcggaacaggcgttacagcttctgacgagcaggcacaggaaatgcacgcgaagatccgtgagcacctggcatctaaatatggtgctgcagtagcagatgagatcagcattttatatggtggcagcatgaaaccggacaatgcaaaaggcctgttggcttgcaaagatattgacggggggttgatcggcggtgcatcgttaaagtcacgtgactttattgatatcgctaag

SEQ ID NO: 34013 - DNA, 2739 bp, Cytophaga hutchinsonii
atgcctaaggatacaagtatcaaacacattttgattatcggtagcggtccaattgtaatcggacaagcttgcgaatttgattatgctggctcacaagctgcacgttctcttcgtgaagaaggaattgaagttaccctgatcaactcgaatccggctacaattatgactgataaagttgtagcggacaatgtgtatttattgccattagagaaaaaatcaatcattaagatccttgaaaatcacaaaatcgatgcggtattgccaacgatggggggccagactgccttgaaccttgcgatggaatgtgataaagccggtgtctggaaaaaatttggtgtccgtatgatcggtgttgatattaacgcgattgagactacagaagaccgtgagaaattccgtttgaaaatgattgagattggtgttggagtttgtaaaggcgcaacagcaacatctttcttacagggaaaagaaatcgctcaggaaatcggttttccactggtaatccgtccttccttcacccttggcggtacaggcggcggtttcgtgcacacggcagataaatttgatgaagcgttaacaaaaggtcttcacgcttcgccaacgcatgaggtattggttgagcaaagtatcttaggctggaaagaatacgaattggagatcttacgtgatagtatcggtaacatgatcatcatctgttcgatcgagaactttgacccgatgggtattcataccggtgactctattactgtagcgcctgctatgacgctgccggataccatctatcaggaaatgcgtgatcaatccatcaaaatgatgaaagcgatcggtaatttcgcgggtggctgtaacgtacagttctccgtttgcccggatacagatcatatcattggtattgagattaacccgcgtgtatcacgttcttctgcacttgcttcaaaagctacgggttacccgattgcaaagatctctgcgaaacttgcgattggttataacttagatgaattaaaaaaccagatcactaaaacaacaagtgccttcttcgaaccggcattggattatgtgatcgtaaaagttccgcgctggaacttcgataaatttaaaggtgctgaccgtacccttggtttacaaatgaaatctgttggtgaaacaatgggtatcggccgtaacttccaggaagcattacagaaagcatgtcagtcattagaaattaaacgtaacggtttaggtgctgacggtaaagaattaacaaaccaggatcagatcctggacagtctggcgaacccaagctggaaccgtttgttccatatttatgatgctttcaaattaggggttcagttcaagaccattcagaagctgacaaaaattgatccgtggttcttaacacagattgaagagcttgtgcttcttgagaaagaaattcagaaaacaacgatccagaacatcagcagagaaatgctgaaaacagctaagcaaaaaggatacgctgaccgccagatcgcgcacctgctccgttgtatggaaagtgaagtattttcaaaacgtcatgaattcggaatcaagcgtatttacaaaatcgttgatacctgttctgctgaatttgaagcaaaaacgccttattactattctacgtttgaaggtgagaacgaatccattccttcagataaaaagaaaattattgtattaggttcaggcccgaaccgtatcggacaagggatcgagtttgactactcgtgtgtacacggtgtattggcagcgaaagaatgcggttatgaaacgatcatgatcaactgcaaccctgaaacggtttctacagattttgatattgctgacaagttatatttcgaacctgtattctgggaacatatctacgaaatcattcttcttgaaaaaccggttggcgttattgttcagcttggcggacaaacagcgcttaaacttgccgagaaattagaacgatatggcatcaaaattatcggtactgatttccagtcactggatttagctgaagatcgcggccgtttctcttctttattaaaagagatcaacatcccttatccggaatttggtgtcattgagaacgcagacgaagctgttgcgatcagtaaaaaattaaacttcccgttattggttcgtccttcgtatgtattgggcggacagagcatgaagattgtgatcaacgaacaggagctggaacaacacgtggtgaacttattgaaagatcatccgggtaatcaggttcttgtggatcatttccttgaaaatgcaattgaagcggaagcagatgccatctgcgacggcgagaatgtacacatcatcggtatcatggaacacatagagccggcaggtattcactccggtgattcgcactctgtattgcctccgtttgatttaagtgatgacgtgatcagacagattgaagagcatacgaagaaaattgctatagcactaaaaacagtgggcctgatcaacattcagtttgcgatcaaaaacgaaatcgtttacatcattgaagccaacccaagagcttcccgtacggtgccgttcatctgtaaggcatacgatgagccttatgtaaattatgctaccaaggtgatgctgggtgaaaacaaagtaaccgactttaccttcaacccgaagaaaaacggttatgcgatcaaaattcctgtattctctttcaataaattcccgaatgtaaacaaggaacttggacctgaaatgaaatcaacgggagaagccatc

SEQ ID NO: 34014 - DNA, 825 bp, Cytophaga hutchinsonii
cctcagcaacaggaaaggccgggtaaagaaacggatatgaagccaaggcctcaatctgaaaataatgcaccgggcaataataaactgaaaaacaaaatcgctttgattaccggaggtgatagcggaattggtaaagctgttgcattgctttttgctaaagaaggagccgatgttgccattgtatatttaaatgaacatgctgatgcgcttgaaacacaaagcataatcaatgctaaatacagtaaacagtgcttgctgttaccgggcgacataagcaacgaatctttttgcagtaaggtgattgatcaggtgattgagacattcggacgcattgatattcttgtgaataatgctggtattcattacgaatgtgaggatctggcagaactggttactgaaaaaatgatcgcaacatttgaaaccaatgtgtatagtatgttctggattacgaagtatgcattgccgcatttgaaagccggaagttctatcataaacagttcttctgttacggcatatcgtggtagcaagcatctgattgattatgcagcaacaaaaggtgcaattgtttcttttacacgcagcttatcatcgagtttagtagacaaaggcattcgtgtaaatggcgtcgcacccggcccgatctggacaccgttgattccatcttcttttgaagaggacagagtggccaaacacggattgaatgcacccatgcacagagcaggagaaccttcggaagttgcaccttcttacctgtttctggcaagcgaagacgcttcttatataacaggacaattcctgcatccaaacggtggtgaaattattaat

SEQ ID NO: 34015 - DNA, 501 bp, Cytophaga hutchinsonii
agagtagcatacagatatgcaaaatcgctgattgatcttgcagcggagaatggtgttttggatcgggtgaatgctgacatggctggaattgaatctgttttcaaacagaatcatcagctggttgccgtaatgaaaaatccaattgttcaaggcgacaaaaaacacgctatactggaagcattattcggcggtaaggtagataactttaccatgtcattgctttcattattaacaaagaagcatagagaagctgtggtttttgaaatctcttctgaatttcaaagacaataccgtgaaaagatgggtattaaaattgttgaagtaacaacaacccagccaatcacagaagatcagcgtgcaaatttcaaagcaatcatggcatctaaagcatcgaaagttgaattgatcgaaaagatagatgaaaaaatattaggaggttttgtattgaaaatggacgatcagcaaatcgatgagtctgttattgcaaaactgaataaaata

SEQ ID NO: 34016 - DNA, 1542 bp, Cytophaga hutchinsonii
ctagacgttagacctgatgaggtatctgcagtattgagacagcagttatcaaactccttaaccgaagctcaattagaagaagtaggaactgttcttcaagtgggtgatggtgttgctcgtatttacggccttacgaaggctcaagctggtgaattattagaatttgaaggtggcctgaaagggatggtattgaatcttgaagaagataatgtaggtgccgttttattgggtgaatacagtgcaatcaaagaaggttctacagttaaaagaacaaaacagattgcattcgtaaatgttggcgaaggcatggttggccgtgttgttgatacgcttggtaatccgattgatggcaaaggcccgatcacgggtgaattatataaaatgccaatggaacgtaaagctccgggtgttatctaccgccagccggttacagaacctttacagactggtatcaaagcgattgatgcaatgattcctatcggtcgtggtcagcgtgaattaatcatcggtgaccgtcagactggtaaaacaacggttgcattagatgcaattatcaatcaaaaagaattctacgatagaggtgagcctgtattctgtatttatgtggcatgtggtcagaaagcatctactattgcaggtatcgttggtacacttgaaaagcatggtgcaatggcttatacagtagtagtagctgctactgcatctgatccggctccaatgcaatatttcgctccattcacaggcgctgccgttggtgagtacttccgtgatactggacgtccggcattggttgtttatgatgatttgtctaaacaggcagttgcttaccgtgaagtttctcttttattaagaagaccgccagggcgtgaagcatacccaggtgatgtattttacctacacagccgtttattagaaagagccgcaaaaatcaacaagtctgatgaaattgcagctgcaatgaacgacttacctgaatcattaaaaggtattgtaaaaggcggcggttcattaactgcgttaccaattatcgaaacacaagccggtgacgtttctgcttatatcccgacaaacgtaatttctattacagacggtcagatcttcttagagatcaacttattcaactctggtgttcgtccggcaattaacgtaggtatttcggtatcacgtgttggtggtaacgctcagatcaaatcaatgaaaaaagttgccggtacattgaaattagatcaggcacaattcagagaattagaagcgtttgctaaattcggttctgatcttgatgcttcaactaaactgacaattgaacgtggtagaagaaaccttgaaatattgaaacaacctgcattctctccggtttctgttgaagagcaagttgcaacaatctatgtttcaacaaacggtttcatggattcagttgtagtaaacaaagtacgtgatttcgaaaaagactttttaactgtcttgagaacttctcacaaagacacgttaaaagaaatcaaatccggaaagattgatgacgctatcacagaagtattgaaaaaa

SEQ ID NO: 34017 - DNA, 879 bp, Cytophaga hutchinsonii
atgccaagcttaaaagaggtccgcaatcggatagcttctgtaaattccacgcagcagattactaaagccatgaaaatggtttcagcagctaagctaagaagagcacaggatagagctatgaagattcgcccatatgctgaaaaactgaatggaattcttcaaaacattgctgcatctcttgaagatggtgcagataatgtttatgcagaagaaagagagttaaagcgtttgttgattgttgtagttacttcagacagaggtttggccggtgcatttaacgccaatattgttaaagctgccaatgcattgattgaagaaaagtattcaaacctttaccaggcaaataaagtagattttatctgtattggcaaaaaaggtgcagaggctatcacaaagcgcggcgaatcagcaaatctggagtatcagggcttattccagaatttaagttttgatacagcacgtggtgcttctgaatatgttatgaatgcttatttaacgggaaaatatgaccgagttgaagttatttataacgaattcaaaaatgtcgccactcaaattatccgtacagaacaatttctgccaattaaagggcaggcattaagtgcggtcaaacacagtgcaacagaagttgattacatctttgaaccaagtaaagaagagattgtaaaggaattaatccctaagtcactaaaagttcaattctacaaatacttgttagagtcgaatgcttctgagcacggtgcgcgtatgacagcaatggacaaagcaacagaaaatgccaaagaaatgctgaaggcattgaaattgacatacaaccgttcccgtcaggcggctattacaaaagaaatattggaaattgttggtggtgcagaagcattg

SEQ ID NO: 34018 - DNA, 660 bp, Cytophaga hutchinsonii
attgaaacttcctggaagcatagaattcaggatgaattcaataaaacatactttaaaaatctgatacaatttgtaaaagaacaatataaaacacgtgttatttatcctgccggaaaaaatattttcaaagcatttgatgcatgcccgtttgatgccgtagaggttgtgattattgggcaggatccgtatcatggtcctggacaggcaaatggcctgtgtttttcagtaaatgatggcattgtacagccgccatctttaaaaaacattttcaaggaaattgaatctgatctggggaaatctgcgccagtatccggtaatctggagcgttgggcaaatcagggtgtattattactcaacgcaacattaactgttgaagcaaatactccaggttcgcatcagaaaaaaggctgggaaacatttaccgatgctgttattaaaaaagtttctgatgaaaaagaacatgttgtatttattttatggggagcttacgcacagaaaaaaggtgaaatcattgatagagaaaaacatctggtgttgaaatcagctcatccatcaccgttttcagcatataatggttttttcgggaacaaacacttcagcaaaacaaatgcgtatcttaaatccgttggcaaaaaagaaattgactggtagatcagcgat

SEQ ID NO: 34019 - DNA, 1350 bp, Cytophaga hutchinsonii
atgttatttcaagatttaaaactgatagaccccattttgaaagcactttcagaagaaggctacacaactcccactcctattcagtctcaggctattccgtatgtattgcaaggcaaagacttattaggctgtgcacaaacaggaacaggcaaaacagctgctttttcaattcctattttacaattattaagtgtaaagaaaagtacggatcgtaaaagacccatccgaagccttattgttacaccaacgcgtgaacttgctatacaaatcggcgaaagcttacaggcatacggaaaatataccggattaacttctaccgtaatctttggcggtgttaatcaaagccgtcaggttacagccctgcaaaacggtattgatgtattggttgccactccgggccgtttactggatctgatgaaccagggttttatttcattgcgccacattgaaatatttgtactcgatgaagccgacaggatgctggacatgggttttgtacatgatgtaagacgcctgctgcttgctttgcctgccaaacgtcagtcgctgttcttctctgcaacgatgcctcctgaaattgtaaaacttgcagataatattttagtaaatccgtcaaaagtagaagtaaccccggtttcatctacagccgatacaatcaaacagttcatgtactttgttgacagaggaaataaaaacaatctgttggttgaagtattacaggatcccaaaataaaaacctgccttgttttcacacgtaccaaacacgttgcagataaagttgtaaaaatgctggcggagcataaaattaaagcagaagccatccacggaaataaaagtcagaatgcacgccagaatgcattgactaacttcaaagcacaaacaacacggatattggttgctactgatattgcagcacgtggtattgacgtagacaatttagaatttgtgatcaattacgaaattccgaatattccggaaacgtatgtacaccgcattggtcgtacaggcagagcgggtgcaaaaggaacagctttctctttctgcgatgcggaagaaaaagcatatctgaaagatattgaaaaactgatttcaaaaaagattcctgttattgatgaacatccgtatccattgatggaccacaatccgccaaagacaccacaaggccgccagcagcgccctgcctcatcatcacgacctaaggcagcctccggagcaaacagcggaagttcacgtgcaggaaatgccggcggaagccagcgcagcagtggttcttcttcccgcagcggaagcagtacaggcaaaaagaaatggtatggcaaatccggatcgaatactaaataaggttagccg

SEQ ID NO: 34020 - DNA, 708 bp, Cytophaga hutchinsonii
atgagaattgcattaataggttatggcaaaatgggcaaaacgatcgaacgtattgccatagaaagaggacacaccatttcagcgatcattgatgttcataacaaagaagacattaaaaacctgaacggttcaatggcggatgttgcaatagaattttcacaacctgaaagtgcttttttgaatatcagccactgcctggaaaataacctgccgatcgtatccggtacaaccggatggttaaagaaaaaacccgtactggatgaaatctgccgtcagaacaacggttcattcttctatgcttccaactacagcattggtgtaaatattttctttcacctgaataaaatattggccggattgatgaaaaaatttccggactatgctgtttccatggaagagattcaccacacagaaaagaaagatgcgccaagcggtacagcgattacattggcggaaggtttgatgagccagaactcagctaaaacaaaatgggtgaatgaagcatctgaaaacgatgatgaattagaaattatttccaaacgtatcgatgacgtgccgggtacacatactgtattttataattcaccgatcgatacaatagagatcaaacatactgcacacagccgcgaaggttttgctcagggggctgttatggctgccgagtggacagcaaaaaaccgtggtgtatttggtatgaatgatttgcta

SEQ ID NO: 34021 - DNA, 846 bp, Cytophaga hutchinsonii
ttttacggtacaggaacagctcttattactccgtttaaaaaagaccattcggtagattacgacgcgttcaaaaacttaattgaatttaacatctcttcgggtgttgattatatagttgtaaatggtactacagctgaatctgcaactacttcaaaagaagaaaaagcaaagctgcttgaagttgctctggacgtaaataatggtcgtgtgcctgtaatgtatggcattggcggcaatgacacggctgaagtgattcaacgcatcggttcggctgattttaaaggcgtagatgcattactttctgtttgcccgtactacaacaaaccttctcaggaaggcgtttttcagcattacaaagccattgccgaaaaatgtccggttccggtgttagcatacaacgttccgggaagaaccggtattaatatatctgctaaaacgtctatccgtttaagtgaggttaaaaacatatttggcattaaagaagcaagcggcgatttagttcaggcacttgaaatcattaaaaatacgccaaatgagtttttggttatttcaggcgacgatctgttagccgtaccaaccatttctctaggtgctgtaggagctatttcggttctttccaatacgtaccctgctaaattttcagaaatgattaaagcagccatacagtcccgttttcagcaggcaacgcaaatccttgcccgattcacggagatgaacccgttgatgtacgaagaaggcaatccggtgggcgttaaaagcttattggaacttatgggtatctgttcgagcgaagtacgtttacccttggtaaaagcatccggtgaattaattcataaaattgaacag

SEQ ID NO: 34022 - DNA, 1128 bp, Cytophaga hutchinsonii
tattttgcatttcctaaattggaaggcgatatcgctcctcatatgaaatttagagggaaagatgtattaaactggagtttgaataactatatagggttagcaaatcatccggaagtgcgtaaagctgatacagacggaacttctcaatatggtttagcttacccaatgggtgcgcgtatgatgtcaggtaactctaatttgattgaagagttcgaatcacagcttgcaaacttcatgggtaaagaagatgcaatggtattgaatttcggataccaaggtatcatgtctatcattgatgcgttactggatcgtcatgatatcgttatttacgattctgaatcacatgcatgtatcatagacggtatgcgtatgcacatcggaaagcgtttggttttcccgcacaacgatatcgataacttaaaaacacagttagagcgtgccaataaaatgattgaccctgctaaaggttcaattctagtaattactgaaggcgtattcggtatggcaggtgatatgggtaaattgaaggaaattgttgaattgaaaaaacactattcgttccgtttactgatagatgatgcacatggttttggtactatgggtaaaacgggtgcaggtgcagcggaagagcagggggtacaggatgaagtggatatttacttctctacgtttgctaaatctatggcgagtgtaggtgcatttgtagcttcaaaagaaaacattattgagtatttaagatataatacacgttctcagattttcgcaaaaacattgccgatggcattggttgtcggaaatatgaaacgtctggaattgcttcgtacacaacctcagttaagagataatctttggaatgtggttcgtgccttacaatcaggcttaaaagaaaaagggtttaatattggtaatacacaatcaccggtaacacctgtatatttgagcggaacggaatcagaagcagctcaaatgatcattgatttaagagagaattacggtatattctgttcgatagtaatatatccggttgttcctaagggagttatgatgcttcgtttaatcccgacagctgagcataccctggcagacgtaacaagaacgatcaatgcttttgctgaaatcgctgaaaaa

SEQ ID NO: 34023 - DNA, 954 bp, Cytophaga hutchinsonii
aaaattgcagtaataggtggaggaagttgggcaaccgcacttgttaaaatactttcagaacagaatgttcgcatcaattggtggttaaagaataaaaaagatgttgattatattttacagcatggcaagaaccccaattatttaagcaatgtcccgattgatacaaaaaaagttactccgactacaaatgtcagaaaagcattagaaggtgcctcggttgtaatttttgttgtgcccgcagcttttataggtgaggtactggaaacaattccggcagcagacttaaaagataaaattgtggtgtctgctatcaaaggtatgataccttctgaaaatatactggttacagacctgttacagaaaacacacgcggtaccttctcagaagatctgtatcatcgcggggccttgccacgccgaagaagtagccttagagaaacgttcttatttatccattgccggtgaagattttactgccgcatccgtagtagccgatctgcttcagtgcggttttgttaaagcaaccgttgttgaagatctgtatggcgtagaatattgtgccgtaatgaaaaatgttgtggccattgcctgcggtattgcaagaggattaaactacggagacaattttcaggcagttttagtatctaatgccatgttagagatcgaattgtttgtagatgcattaagtaaaaaggagcggaactggaatgcttctgcttacctgggagatttactggttacctgttattcaccatatagtcgcaaccgtaccttaggaaacatggttggcagaggatactcggttaaagccgcacaggtagaaatgaatatgattgcagaagggtattatgccgttaaatgtgtgtatgaactgaataaaaagctgcatgtacagatgccgattacaaaggctgtatataatattctatatgaaaaaatttcaccttcagtagaa

SEQ ID NO: 34024 - DNA, 1248 bp, Cytophaga hutchinsonii
ggtaaaagttataaattccctgtaattgaaggatctgaaggcgaaaaagcaattgatattgcgaaacttagagatttgacgggttatgttactttagatactggttacaaaaacactggcgctaccaaaagtgctattacatttttagatggagaacaaggtattttacgctacagaggctaccctattgagcagcttgcttctaaagcttccttcttggaagtttcctatttacttatatacggtgaacttccgactacatctcaattagagaatttcaaagaacgcatcagaaaacacacaaaccttcacgaagacattaaaaaggtatttgatggttttccgtcatctgctcacccaatgggggttttatcttcggcagtaagttctttaaccgcttattatcccggttcaattgatccaacagctaatgatgatgaagttgatatgacaattgtacgtttgatggctaaattaccaacaattgctgcatggtcatacagaaattctaaaggtcagccattaatgtatccgaaaccaaaattaggatactgtgaaaatttcctatacatgatgttcggccagcccaatgaagattttgaacttgacccggttgttgttgaagcattaaacaccttatttatcctgcatgctgatcacgaacaaaactgctctacgtcaactgtacgtattgtaggttctgcgcatgcaagtttatattcttctattgctgcaggtatcaacgcactgtgggggccgctacatggtggtgcaaaccaggaagtaattgaaatgcttgaagaaataaaagcttcaggaatttctactaaagattatatcgccaaggttaaaacaaaagaagttcgtttaatgggcttcggacacagagtttataaaaactttgatccgcgtgcaaaaatcatcaaaaaagcgtgtgatgatatcttaaataaattaggggtaaaggatcctgcattagaaattgcaaaagaacttgagcaggccgcgctaagtgatccatatttcgtagaacgcaaattatatccaaacgtcgatttctactctggtattatttacaaagcgttaggtttacgcagcgacttgtttaccgttatgtttgctatcggccgtcttccgggctggattgctcagtggaaagaacttagagatgctaaagaacctatcggcagaccaagacagatctacacaggttatacagaaagagattacgttagtattgataagaga

SEQ ID NO: 34025 - DNA, 750 bp, Cytophaga hutchinsonii
gtgcttacaaaacgtatcataccttgtctggatgttaaagacggaaaaacagtaaaaggagtaaatttcttaaacctgagagatgccggtgatcctgttgaattgggcgctttgtattctcagcaaggggcagacgaacttgtatttttagatatcacagctacattggaaaaaagaggtacactggttgaacttgttaagcgtgtagcacaacatataaatattcccttcactattggcggtggtattggttccattgaagatgtgtccgcttgcctgaatgccggtgcagataaagtttctgtaaactcttctgcaattaaaaatcccgcattgattgatcagttgtctaaggagtttggtaatcaatgtatcgttgttgcaatcgatacccgaaacgttgggggaatgaatctggttcattcacatggaggcacaaaacctacagacctggatacgattgcatgggcgaaagagatgcaggaacgtggcgcaggagaattacttctcacgtcaatggataaggatggaaccaaagctggttttgcaaatgaattgacagcatatatatctacacatgtttccattcccatcattgcatcaggcggtgccggtacgatggaacattttacagatgtatttacactcgggaaagcagatgctgccttggctgcaagcattttccactttaaagaaattgctatacctgaattaaaatcatatttatccggaaaagggattcatatgaga

SEQ ID NO: 34026 - DNA, 1116 bp, Cytophaga hutchinsonii
atgaaaaagaaagcattatttatcgatcgggatggaaccatcattacagagcccgcggatgaacagattgactcgttagagaaactggtatttcttccaagggtattaacagcactgtctaaaattgctgttgaaacagattacgaattggtaatggttaccaatcaggatggcttgggcacaaactcttttcctgaagagaccttctggccggcacagaataaaatgttgaaaacgctggaaggtgaaggcattgtattcaaacgcattcacgtagaccggtcttttcctaaggacaacctgccgacgcgcaagccgggtattggcatgcttactgaatacatgaacggcacgtatgatcttgaaaatagtttcgtaatcggtgatcgcgtaacggatgtgcagcttgctaaaaatttaggaacaaaagcgatttatataacaccgtctacaaaggccctggattggggacttggagaattgaaatatgcacttgctacagatgactggatggaaatttataaattcctggtaaagtctgaacgtatagcacgtgttaacagaaagacaaacgaaacagacattactatttacctggatctggatggtgaaggtaaaggtgtaatgaatacaggtcttggtttctttgatcacatgctggatcagctatgcaagcactccggcatagacctgtctgttgaagtgaaaggtgatttacacatcgatgaacatcacacgattgaagataccgctttggcacttggtgaagcatttctgctggcattgggctccaagcgtggaattgaccgttacggctttctattgccgatggatgaagcactggctcaggtagccattgatttttcaggcagaagctggctggtatgggatgcggaatataaacgtgagaaaatcggagacatgcctacagaaatgttctttcacttctttaagtcgttttgtgatacagcaaaatgtaatttgaatattaaggttgagggggataacgaacatcataagatcgaagcaacattcaaggcatttgcaaaagcgattaaagcagccatcagaaaagatcctgcgaatacacgtattccaagcactaaaggagtattg

SEQ ID NO: 34027 - DNA, 1032 bp, Cytophaga hutchinsonii
ttttcattagattcgattttaagggataatattaagaacgcaaagccatattcttctgcaagggatgaatataaagggacggaaggcatctttttagatgcaaatgaaaacccatatggttctgccatacaaaagatggttaaccggtacccggatccattacaacgtgatgttaaaacagctttgtctgcacttaaaaacgtttctgctgaacatatattctttggaaatggcagtgatgaaccgatcgatctattgatacgcgccacctgtcagcctggtaaagacagtatcctgatcttgcctcccacatacggtatgtatgaagtgagcgcaggcattaacgatgtagatattatttctgttccgcttacaaaagccttcgacctggatgttgacgcaattcttgctgctgtaaagactcatacaaaaatcattttcatctgttcgcctaataatcctacaggcaatctgatgagtgaagataaagtgaaacgtattttaaacgcattctccggaattgttgtggtggatgaagcatacattgatttcgccgatacaaaaggctttgtgcccttattggatcagtatccgaatatggtggtactgcagacattttccaaagcatggggaatggcagcgttgcgtttaggtactgcctttgcatccaaagaaatcgtttctgtgctgaataagatcaagccgccatacaacatcaacctgttaacgcaggaagcagcattggaagcattgcagaatgtttctgtgaaagatgagatggtgtacaaaatattaaaacagcgggattggttgcgtgaggaattaagtaaacttcctgtttgtctggagttatatccgtccgacgcgaactttatattgatgcgtaccgcggatgggaaaaaagtgtatgattacttagttgagcatattgtaatcaccagagaccgttcaaagatcattctatgtgaaggttgtgtgcgtattacagtaggtacagaggcggaaaataaacgtttgctggatgttttaaaa

SEQ ID NO: 34028 - DNA, 942 bp, Cytophaga hutchinsonii
gtgaaagacgacatgaaggacttcgaaaagaagttccgtgattcaatgaaatccaaagtgatgctgttggataagattatgtcgtatatcgtaaagcgcaacggcaagcaaatgcggccaatgtttgtatttttatccgctcatctggcagggaatgtaaacgactcaacacaacgcggcgccgcgctcatcgaattattgcatacagcaacgcttgtgcacgacgatgtggtagatgattcagattaccgtcgcggaatgttctctattaacgcactctggaaaaataagatcgctgttttggtaggcgattatctgttatcaaaaggtcttttgttatcaatcaatcacggcgatttccatctgctgaaaattgtatccaatgcggtacgtgaaatgagtgaaggtgagttgctgcagattgaaaaagcccgtaacctgaatattaacgaagagatctattttgaaattatccgtcagaagaccgcttcgctgattgcctcctgctgtgctgtaggtgtttcttctaccggtgcagatgaagcattggtagagcgtgcaaaaatgttcggggaaaaaatcggcatggcgtttcaggtgaaagatgatctgtttgattatgaaacatctgaaatgatcggtaaaccggtaggtatcgacattaaagaacgcaagatgacgcttccattgatttatgccttgaataaggcaagctggctggagaaaaaacggatcatgtttattatcaaaaatcaaacgcataaatcggcaaaggtaaaagaagtgctgcagtttgtgcgtgagtccgggggcattgaatacacacgcacggtaatggaaaatttcagagaagaagcttacggatttttagaagaatttcaggattccgtatataaaaaagcgctgcgtgacctggtagattatactattgcgcgcaaacac

SEQ ID NO: 34029 - DNA, 576 bp, Cytophaga hutchinsonii
atgcctattttagtaatcgtccgtcatggccaatccgaatggaatctgaaaaatctttttacaggctggtctgatgtagaattgacaccaacaggagaacatgaagcagaatatgcgggcattgtattgcgcccgtatcattttgatattgcatttacatcggtacttaaacgtgccattcataccttatcgattattctgaaccagacaggtgctaccattcccatcatagaaaatgaagcactcaatgaacgcaattacggcgacttacaagggctgaacaaagcagaagtaggagagaagtatggtgcgcagcagctcattgcgtggcgcagaagttatacggaagttccgcccggtggggaaagtctggaaaatacctgtcagcgtgtaatcccttattatcaggagaagatagaacctgaattaaaagacgggcgtaacgtattgatcgttgcacatggaaacagcctgcgtgcattaatgatgcatcttgaaaaaataagtccggaagatattgcacacgtagacttagcaacaggtgcgccaagattgtatgaattttcgagcaaatta

SEQ ID NO: 34030 - DNA, 1725 bp, Cytophaga hutchinsonii
atgctttcaaaaacagtttccgatcagcttgtagccatgttggtacaagccggtattaaaagagtttatgccgtgaccggcgatagtttgaattttgtaaatgacgccattcgcaggagcggtaaaattgaatggatccatgtgcgcaatgaagagacaggtgcgttcgcggcgggagctgaagcacaactcaaaggcatagcctgctgtgcgggcagcagcggtcctggtcacgtacatttgcttaacggcctgtatgatgcgcataaatcaagcgcatctgttctggcgattgcttctacatgccattccacagaattcggaacagattcttttcaggaaaccaataccattaaattatttgatgattgcagttgttacaatcagattgctgtaacaccgttgcagtttccacgcatgttgcaggcagctgtacaacatgccattcataaaaaaggcgtagctgtactcgggttgcccggtgaccttacaagcatggctgccgaattgagtcctacctctatggagatctaccattccaatcctgtaatacgaccttctgctgttgaattgatacagctagccgctatcttaaatgatcattcaaagattactattttttgtggcatcggagcatcggaggcgcacgaccaggttgttaaactttcaaaagtacttcaggcgcctgtagcatattcctttaaagcgaaaatgagcatgcagcataacaatccgaatgaaattggtatgaccggcttgctgggtctgccttcagcctttgaaagcatgcatgagtcagaggtcattcttttgttgggaacagattttccatatgcggattttatgccggttaaaaataaaatcattcagatcgatacggctcctgaaaaacttggcagaagagcaaagcttgacatgggcttatgcggaaatatacaggataccttagatgcattgttcccgttgattacacaaaaagaagatgattcttttttacagaaacaattgaatctatatacagaagtgaaagagcatttaaaaagttatgtggatgatccgggtaaagaaaatctgatacatccggagtacgtagcttcccgtattgatgcgctatctgctgaagatgccatctatacggttgatacaggcatgacgtgtgtttgggcagcgcgttacctgaatgcaacaggcaaacgtacactgcttggttcgtttaatcatggatccatggctaatgctatgccacaggccataggtgcagcattggcgtgccccggcaggcaggtaatagccatgtgtggagatggcggtatctctatgatgttgggagatatcatgacaattgtgcaatataaactgccgataaaactaattgtttttaataatcacagtttaggtatggtaaaacttgaaatggaagtttccggtttacctgactggcagacagacatggttaatcccgacttttctaaaattgcagaggcaatgggtatgcgtgccataaccgttaccgatccggcagatgttgatggggcattgattgaagcgtttgcttacagtggtgccatcttgttaaatattattactgatccgaatgctttagcaatgccgccgaaaattacgtttgaacagatgaaaggcatggcaacttcaatgacaaaactcatgttaagcgggcaaatggacgaagtatggaaaaaaattgaatcgaataaaaaacacctg

SEQ ID NO: 34031 - DNA, 1194 bp, Cytophaga hutchinsonii
atgaatattcacgagtatcaagcgaaggaaattcttaagaaatacaacgttaagatcggagaaggtatttatgccgattcgcctgagtctgcagtagaagcagctaaaaaattaaaggagcaaacaggaactgacatctttgttgttaaagcgcagatccatgctggtggtcgtggaaaaggtaaatttgttggtactgaacaccgtggtgtaatgattgccaagtcgtatgacgaagtaaaagaaaaagctgcacagatgttgggtaatacactggttacaatccagaccggaccttcaggtaaagtagtaagccgtttgcttgttgctgctgatgtataccagaaaggtgcttctgagccaaaagaattatacttatctatgttgcttgaccgtggtaccggccaggatgtaattattgcatctactgaaggcggtatggatattgaagaagttgcacacagcacgcctcacttgatcacaaaggaatttgttgatccggctgttggtcttcaagggttccaggctcgtaagattgccttcggtttgggtctttcaggaacagcattcaaagaaatggttacgtttgtgacacgtttgtatactgcatacaaagcaacgaacgctgaaatgattgagatcaacccggtattaaaaacatccaaagatgaaattttagcggttgatgctaaagtatctattgatgataacgcattattccgtcacccggatcttgctgcttaccgtgatgttacagaagaagatccattggaggttgaagcggcagaaagtcacttaaactatgtaaagcttgacggtaacgttggctgcatggtaaacggtgcaggtcttgcaatggctacgatggacgttattaaattagctggtggtgagcctgctaacttccttgacgttggaggtggagcaaacgcgaagacagttgaagctggttttcgtattatcttaaaagatccaaatgtaaaagctattttaatcaacgtatttggtggtatcgttcgttgcgaccgtgttgccaatggcgttgttgaagcttacaaaaatatcggcacaattaatattccgatcattgttcgtttacagggaacaaatgcggaagaaggtgctaaaatcatcaacgaatccggcttaaaagttcgttctgcggttatcttaaaagatgctgcgaaattggta

SEQ ID NO: 34032 - DNA, 1005 bp, Cytophaga hutchinsonii
atgagtgcttctatacatgaaattctcaaaacctattggggccattcaaactttcgtccgcttcaggaggatatcataaattctattttaggaggcaatgacaccgttgcgcttttaccaacgggcggaggcaaatctatttgctatcaggtgcccgccctggcaagagatggattggtattggttatcagtccgctcattgcattaatgaaagaccaggtagaacagttgcgccgtagaggcattattgctacagcaatccattcaggcctgcgcaaaacagaaatcgatattgcacttgataattgtatttatggaaatataaaattgctgtacgtttctcctgaacggttaaaatctgatctgtttaaagagcgtgtagagaagatgaagatcatttgtattgctatcgatgaagcgcattgtatctccgaatggggccatgatttcagacctgcttacagggagatcgcatcaatccgtacgctgcttcctgaagtgcctgtgattgcacttactgctacggccaatgaaatggtgctgaatgatatcatggatcaactggcgctccagaatccgcagatatttacacaaagttttacccgtaaaaatttatcgtactcgtgcttgtacgaagagaataaagagaaacgacttgtgtcgatgctgcaaaagattcccggcgtatgtatcgtatatgccaatacccgcgcacgtgtggtaaggattgcggagtttctgaatcggcagggcattccaacagaattctatcacggcggacttgatcataagcaacgcagcattaagcaggacgcatttatgaaaaataccgtacgtgtaatggttgctaccaatgcattcggtatgggcgttgacaagcccgatgtgcgactggttgtgcatatggatgtacccgattcactggaaggttattttcaggaagccggcagggcaggacgtgacggtaataaagcctttgctgttttgctgcatacaaagaaagac

SEQ ID NO: 34033 - DNA, 1647 bp, Cytophaga hutchinsonii
attaaaatgcctaaaatgagcgataccatgacagaaggtgttatcgcggcatggcacaaaaaagtaggagataaggtgaaatccggagaccttttagcagaagttgaaacggataaggctaccatggaaatggaatcttatgaagacggaacactcctatatatagcagctgaagcaaaaagtgcagtacctattgatggtgtaattgcagtaattggtaaagatggtgaaaatattgatgctttaattaaagaaatcaaaggtggcggtgcaccagctgaggctccaaaaacagaagctaaagcagaagcagaggtaccaaaagctgaaaagcctgcggaagcggctaaacaggctgcacctgcagtagatctttcttctatcaaagcagaagcgatcttaatgcctaaaatgagtgatacaatggttgaagggacaattgtagcatggcataaaaaagttggagatgcagttaagtctggtgagttacttgcagaagtagctactgataaggctaccatggaaatggaatcttatgaagacggaacacttcttcacattgaagtaaaagaaggagatgcggttcagatcgacggcctgattgccattattggtgaaaaaggaacagatgtaacaccgatcatcaacgcatataaaaacggcggtaagccatctgcagctccggcagcagcaagcgaaccggctaaacaggaaacagcttctgcacccgcatcaaacaatgctcctgcagcacaggcttcttcctcttcagatgaaagagccaagatttctccgctggcacgtaaaattgcttcagacaaaggaatcgatatcaaacaggttaaaggttcaggagatcacggccgtgttataaaacgcgacattgaaaactttaaagcggctccggctgaagcagctcctgctaaaggttccggcgctccggcagcttcattaccaaacatagttggtcaggaaggctttgacgaagtaccggtttcacaaatgcgtaaagtaatcgtgaaacgtttatctgaaagcttattcactgctccgcacttctatttaaccatggaaatcaacatggataaagcgatagaagcacgtgcaagcatcaatgaagtagctacagcgaaagtttcattcaatgatatggtgatccgtgcaagtgcagcagcgcttcgcaaacacccgatggtgaacgcttcgtggcagggagacaaaatccgtgtgaaccaccacattcacattggtgttgccattgctattgaagatggacttgttgttccggtagtacgtttcgcagattctaaatccttgtctcatatttctcaggaagtaaaagaacttggcggtaaagcaaagagcaaaaaaatacagcctgcagacatggccggcaatacattcacgatctctaacttaggtatgtttggtattgatgagtttacatcgatcatcaactctccggatgcatgtatcttatccgtaggcggtatcaaacagactccgatcgttaaaaacggacagattgtagttggtaacatcatgaaagtaaccttagcgtgcgatcaccgtgtagtagatggtgcagtaggttcagcgttcttacagacattaaaaagctaccttgaagatccggtacgtattctt

SEQ ID NO: 34034 - DNA, 966 bp, Cytophaga hutchinsonii
aagtcaaaattagagtacatctggcttgatggttacaaaccaactcaaagcttacgtagcaagactaaaattgaagagaattttagcggtaaattagaagacctgagcaactggtcatttgatggttcttcaacagaacaagcaaaaggtggttcttctgactgtttattgaaaccagtatttgtttgcccggatcctcagagaaaaaacggttatttagtaatgtgtgaagtattgaatgctgatggtactccgcaccctacaaatggccgtgctcagattgaagatgatgacaatgatttctggttcggtttcgaacaggaatatttcttatatgatttatctacaaacatgccgttaggtttccctgctggtggatatccaaaaccacaaggaccttactactgttcagtaggtgcacagaatgcttacggtcgtgagatcattgaagagcatttggatgtatgtcttgacgctggcttgaacgttgaaggtatcaacgctgaggtagctgcaggtcagtgggaattccagatcttcgctaaaggtgcgaaacgtgccggagatgaaatctgggttgctcgttacttattagaaagaatcggggagaaatacggtgtttatgttaactaccactgtaagccgcttggcgaccttgactggaatggttcaggtatgcacgcgaacttctctaacacattattaagaactgccggaagcaaagaagtattcgataaagtatgtgaagcattccgtccggttgttaaagagcacatcgaagtgtacggtgcacacaacgaattacgtttaactggtaagcacgagactgcaagtattcatgatttcagctacggtgtatctgatcgtggtgcttctatccgtatcccggttttagttccggcaaaaggctggagcggttacttagaagatcgtcgtccgaactctgcggctgatccatacaaagtt

SEQ ID NO: 34035 - DNA, 855 bp, Cytophaga hutchinsonii
caattactagacggtaaaatcacttccgatcagatcaaggaagaactgaagacaaaagttgaagctataaaagctaaaggtggtaagatcccgcatttagctgctgtattggtaggcgatagcggtgctgctgttacctatgtgaatgcaaaggtgaaagcatgtgaactggttggattcaaatcaacactggttaaacttcctgaaacaattacggaagctgatttgcttgcgaaagttgcagaaataaatgcagacaaagacattgatggatatattgttcaattgcctttacccaaacacatcgatgaacaaaaagtaacggaagccatttctccggataaagatgtggatggctttcacccgacaagcttaggccggatggtgttgaatttaccaacctatctgcctgctacaccttacggcattatgcagttactggaacgcaacggcattgagacttccggtaaacactgcgtggtaatgggcagaagtcatattgttggctctcccatgagcatcttgatggcgcgtaataccaaccccggtaacgcaacggtaaccatggtgcattcccgcacaaagaatttaaaagaactgactcttcaggcagatatattaattgttgccatcggtaagccggaatttgtaacagcggatatggttaaagaaggcgcggttgtagtggatgttggtatccaccgtattgatgatgctacaaaaaaatccgggttcagattattgggagatgtgaagtttgatgaagttgctcccaaaacttcgtatatttcgcctgtaccgggcggcgtaggtcctatgaccatagcttcactattaatgaatacactgcaggca

SEQ ID NO: 34036 - DNA, 1272 bp, Cytophaga hutchinsonii
gtattattagggttgcagtggggcgacgaaggtaaaggtaaagttgtagatgtgctggcacctaaatatgattatgttgcgcgttttcaaggcggacctaatgcaggacacacgctgatatttgatggacataaagttgttttacaccaaatcccatctggtgtgtttcgttcaaacattaccaatcttatcggtaatgggttggtattagacgtaatcgctttattcgaaaaagaaatcgataagcttgaagcgtttaaactgaacctgaataagaatttatttatctctaaaaaagcagccttgattttgccttcccacgtagagctggataaagcctatgaagcagctaaaggcgctggaaaaattggttcaacattaagaggaatcggacccacatatacagataaagtatccagacacggtttgcgtgtaggtgatatacttagtccggattttatggacaagtataataaactggtagatcagcacaaacagatcctggattttcataagcacgattattcagaaatgaaagaacgtgaagatttgttcttcaaatacattgatcgtttgcgtaaaatgaatctggtagatagtgaatacttcattaacgatgctatccaaagtaaaaaaacaattcttgctgaaggtgctcagggctccttactggatattgattttggttcctatccatttgttacatcttccagcacaatggttgcaggtgcatgtacaggtttgggcattgccccgaagcatatcggtaatgtgtttggtattttcaaagcatattgcacacgtgtaggtagcgggccttttcctacagaattacacgatgcagtaggtgaagaaatccgtaagcaaggaaacgagtttggctctactaccggacgtccgcgcagatgtggctggttggatttaccagcattaaaatatgcctgtatgatcaacggtgtttcacatctgttaatgatgaaagctgatgtattaaatgcattcgaagagcttcaggtatgtacgcactacaaattaggcaatggcgacattgtagatacactgccgtatgatatgtgtaccaatgatttaacaccggtatataaaacactaaaaggttggaatcaggatttatcaaattgcgaaacattcgattcattgcctcaggcattgttagattattcagcattcattgaagctgaattaggtttgccaatcacattgatctcaatcggaccagatcggaaagaaaccctgatcaaagatttcagtttt

SEQ ID NO: 34037 - DNA, 1398 bp, Cytophaga hutchinsonii
tacgatgtgtgtataataggtgctggacctgcaggatatgcggcagcaatgagagcgttggatttaaataaatctgttatcttaattgagaaggataaaattggtggggcgggtttatacaacggagcaatctcgtctaaaacattctgggaactggcaaaagatatacagacggcccgcaaacgtctggctcagtacagccccgatcagcatttctctgttacctaccagcaagtattacgtcaggtgcgtgaaggtattgcaaaccgccgttttcatttggaagggcagattgaatcgctggccaaacaacagacaagccgtttcagatatattaaaggatctgcaaaacttgttagccacaatacagtagaagtatcaaccggaacggaagaggaaattattgaagcagaaaacgttgttattgcaacaggcagcaagccacgcaaacttccgaatattccgattgatgaaaaaataattgttaccagtgatggtgttgaaaattttgagaactttcccaaaagccttgttattcttggcgccggcgtgattggctgcgaatgggcaaccatattttcaaactttggttatacttctgtaaacatcattgataaagctgaacgcattcttccgttcgaagacgatgatgttacagatgtggttgaagcaaacatgaagaaacagggcatcacggttcataaaaaatcgaacctgttaagcatgcgcattgtagatggtgaagttgaatacatcctggaatatacggatggcagaaaagaaatgcaccgcgttgaaaaagtattggtttctgtaggccgtattccaaatacacagaacttaggactggaacgggttggcgttaatattctggctaacggacaaatagaaaatacagacggacaaacaaatattccaaacatttatgttgccggtgatatttcttcagatgtagccttagtaaatgttgctgaactggaaggccgccatgtcattgaaaaaatgttcggcttaagcgattctgttattacctataataacgtttctaccatcatgtttgtacagcccgaggttgccggggttggtatgaatgagaaaaaagcattgcagaataagatgtcgtataaagttgtaaagattcgatacgatatgattccgcgtgccattgccatgcgcaacaacgatggtttctttaaaattcttgtaaccaatgatgcagatatgaagatcattggtatgcgtgccgttggtgttcatgcatcaagtgccatacaggctgtagcgcttctcatatctatggataaaggtgtggaagagctcgcggatatgattcacccgcatccatctatcattgaaggtattcaggaatgtatccgtatgttgcttggaaagtctgta

SEQ ID NO: 34038 - DNA, 633 bp, Cytophaga hutchinsonii
atgagtttacgattaggcgatattgcaccggattttaaagcagatactacagagggaccaatttcatttcacgaatggttgggcgataaatggggcgtattattttcgcacccagcagattatacgcctgtttgtacaacagaacttggtgcaacagcaaaacttaaatctgagtttgaaaagcgcaatgttaaagttgctgcgttaagtgttgatggtttagagtctcacaaaggctggatcaaggatatcaatgaaacacaaaacacaacggttaacttcccgatcattgcggatgaagatagaaaagttgctgaattgtatgatatgatacacccgaacgcaagtgaaaaattcactgtacgttctttatttattattggcaacgataaaaaaataaaattgatcattacatatccggcatctacaggaagaaacttcactgaaattcttcgtgtaattgattcgcttcaattaacggcaaactacagtgttgcaacacctgctaactggaaagatggcgaagacgttgtcattacaccggctgttaaagacgaagacattgcagctaaattccctaaaggatacacacgcgttaagccttacttaagaacaacgccgcagccgaataaa

SEQ ID NO: 34039 - DNA, 840 bp, Cytophaga hutchinsonii
aaatacatcctaataattggttcaggcacaatgggcagcggaattgcgcactcatttgcacagtttggatttcaggtatttttatgtgattcaaatgctgcagctttaaacaaagccatgctgcaaatttcaacgaacctagaacgacagatttccaaaggtattatccccgattccgaaaaagagacaattatttcgcgcattacccccattaccgattttaaagaagccgcaaaaacagtatccctcgtggttgaagcagtacccgaactgctggaaattaaagcagatctatttaaagaactggatatgcattgcccgccggaaacgattcttgccagcaatacctcctccatatcgatcaccacattagcaagttatacaagccggcctgaaaaagttatcgggatgcattttatgaatccggtgcctgtaatgcagctggttgaaattataaacggattattaacaagcagcgaaacaacgcgtcgtattgaagaaatcagtacacaattgaacaaaattcctgtacaaaccgctgattatccaggatttatttcaaaccggattcttatgccgatgatcaatgaagccatttactgtgtgcaggaaagagtagcaggaattgccgagattgatcagattatgaaactgggtatggcacacccaatgggtcctttacagcttgccgattatattgggctcgatgtttgtgttaatattttaaatgtgctgtacaaaggcttcgggaaccccaaatattccccttgtccgttgttagtcaacatggttcatgcaggacttctgggaagtaaaacaaaaaaaggattttatgattgg

SEQ ID NO: 34040 - DNA, 525 bp, Cytophaga hutchinsonii
attttagaacagacaataaaatcaaccattcgcgacattgttgattttcctgaaccgggtattatttttaaggacattactccattattaaaagacccgcaattatgtaaagcaatcgttcaatctattactgatcaattacggccgttacagccggatgcactggcttgtctggacagcagaggcttctggttcgggttatccattgccatggaattgggtataccgatgataccaatccgtaaaaaaggaaaactgccttatgaaaccgtatacgaagaatatgccttggaatatgggaccaatacaattgaaatgcatacagacgctgttcagcccggatgccgggtagctattcacgatgatattttagctaccggcggcacagcagaggctacatctaagctgatcaaaaaagcgaagggtgaaattattgcttactcatttttaattgaactggactttctcaaaggcaaagataaactggccccttactgtacaaccattcaatcgctgatcaactat

SEQ ID NO: 34041 - DNA, 849 bp, Cytophaga hutchinsonii
gggttacaggataaattcggagagatccgtattaccgataccggtatccgtgaagcaaccatcgttggacaagccatcggcaccgctatgcgtggcctgcgtccgattgccgagatccagtatctagactatttattattcgctattgaaatattatcggatgatgtggcatcgctgcattaccgttcagccggcggacagaaagcaccgctgattatccgtacacgtggccaccggctggaaggcatgttccactcgggttcaccgatgcagatgatcttaggttctatccgtggcatgttcttatgtgtaccgcggaacatgacgcaggcagcaggtatgtacaacacactgatcaaaggcgacgaaccggcgatcatgattgaatcattaaatgcgtatcgcttgaaagaaaagcttccggagaacctgggagaatttaccgtgcagttgggtattgtagatgtattgagaccgggtacggatattaccattgttacatacggttctatgtgccgtattgtacaggaaggcgcaaacgaattacagcagttagggatctcgtgtgagatcattgacatacaaacgctgctgccgtttgacagaacacagcagattgttgaatcgattaagaaaacaaaccgtgtgttgtttgccgatgaagactattccgcaggtgcaacggcttatatgatgcagcaggtactggaagggcagaaggcatggcagtatctggactcagagccacgcacgcttgccgcacaggataacaggccagcatactctaccgatggagattattattctaagccaagctcagatgatgtcattgatgtagtatatgaaatg

SEQ ID NO: 34042 - DNA, 738 bp, Cytophaga hutchinsonii
aaaatagcactgattaccggcgggagccgtggattaggaaaaaatatggcattggcattggctcagaaaggtatagatattattcttacctaccattcaaaccaggcagccgccaatgaagtggtaacagccattgaattgatggggcagaaggcggttgcgtttcagctggacaccagtaatacggcaacgtttgattcttttattatgcaggttaaggactatttaaaagaaaattacagcagatccaatttcgattttctgatcaacaatgcaggcaccgcgttgtattcgttagcagcagaaacatctgaagagcaggtaatcgacatctttaatattcattataaaggtgtattttttttaacgcaaaaggcattgccaatcatgcatgatggcggtggaattgtaaatatttcatccggcttgtcgagaataaccatgccggggtcatctgtgtatgcatctatgaagagtgcgattgaaacctactcccgttatcttgcaaaggaattaggtgatcggaaaatcagagtaaatgtgattgcacccggtgcgattgaaacagattttggcggcggacgtgtacgcgacaacaaggaaatcaatgcaaacattgcaggcattactgctttgggacgtgttggtttgccggacgatataggaaaggttgtagcgttcttatgtacccaggatgcaggctgggtgaatgcacaacgcatagaggtttcaggcgga

SEQ ID NO: 34043 - DNA, 747 bp, Cytophaga hutchinsonii
ctggatattcaacacctgaaaaaagtatatcccacacctaaaggagattttaccgtattgcaggattttaatcttcaggttaagaaagaagaatttatttccatcattggtcattccggctgtggaaagtctaccattctttctatgattgctggtttaaatgaacttacagaaggcaacattattctgaatggcagaaagatcaccgaagcggggccggatagaggagtgatctttcaatcaccaagtctgatgccgtggatgactgctttagaaaatgttatgttaggtgtgaaccaggttttttcgcatatctcaaaaagcgaaagaacagatattgcaaaatattatttagcgaaagtcggtttggaagattcgtttaataaaaaagccagtgagctttcacaaggtatgaagcagcgtgtgggtattgcccgtgcatttgctttaaaaccaaagatgctgttgctggatgaaccctttggtatgctcgattcgttaacaagaggggagctgcaggatgtacttgtagatgtatggacgaaagaaaagattacggcaatcatgattacacacgacgtagatgaggctattctgttatccgatagggtggtgatgatgaccagcggacccttcgcaaaagtaggagatataatgggcgtgggaatggaacggccacggaatagaagaacactgatcgaacatccggaattttatgattacagagcttatttgatcgatttttta

SEQ ID NO: 34044 - DNA, 588 bp, Cytophaga hutchinsonii
ctcattaagatactaagagacaagggtattcaggatgaattggtattacaggccattgatcgggtaccccggcatatttttcttgacaatgcttttttagaacacgcctatcaggataaagcttttccaattggtgatggacaaaccatttctcaaccctatacggttgcctctcagacaagcttgctgaagctgagtccgggaatgaaagtacttgaaatcggtacaggttccggttatcaatgttctgttcttcttgaaatgggtgtaaatgtttttaccattgaataccataaaagtctgtttgagaaatcaaaaaaaatgcttcagtcgcttggctacaaagctcagttcttttgcggagacggcagcgaaggtttagcgcgcttcggcccgtatgaccgtatacttgctactgccggcgcaccgtatgtgccgcaaaagttattggaacagttaaaagttggcggcatattggttattccggttggagatcagaaaacacaaaaaatgctgcgcctcactaaagtaactgaaaaagaaatcacacaagaagagtgcggcgacttccgttttgtaccattggta

SEQ ID NO: 34045 - DNA, 882 bp, Cytophaga hutchinsonii
aaagaacacatcgaaaacgaatttcagaaaattcagcagcacatttgccgcgcgcttgaaacagctgacggcaaggcgacatttaaaacagatgaatggacacggccggaaggcggcggcggaaaaagtaaaatcattacagatggaaacactcttgaaaaaggcggtgtaaacttttctgccgtacatggcgaaacaccggataatatattacatgcgctgaagctttctaaagcagaattctatgcaacgggcgtatctattgtaatgcatacaacaaatccatgggtacccattattcacatgaacatccgttactttgaaatgagtaacggtatctggtggtttggcgggggtattgatctcacgccccattatgtgataaaggaagaagcggttgcttttcatcagtcactgaaagatttgtgtgatcagtttcatgaaagtttttatacgacattcaaagagtgggccgataactatttttacattaaacaccgcggggaatcaagaggtgtcggtgggattttctttgaccggcagggaaacgatgcaccggttagcaaagaatcattatttgaatttgtttgtgcgctcgggtatttatttccaaagatctatacaaaactgattgcagacaacaactccaaaaccttcacagaagcagaacgtaactggcagaagctgcgcagaggcagatacgtagagtttaacctggtgtatgataaaggaacgaaattcggactggataccaacggccggattgaatcaatcttaatgagcctgccacctgaagcaaactggacatacgactttcagcctgcagccggaagcaaagaagcacagacaattgaatggcttaaagctcaacctaactggctt

SEQ ID NO: 34046 - DNA, 1176 bp, Cytophaga hutchinsonii
atgaaacctgtgtatattgttgcggcaagccgtacacctattggcagtttagccggttctctatcttctttaaacgcctcgcagcttggcgcagctgctattaaaggctgtctgaataatcttgaacttccacttgacgccatacagaatgcatacatgggaaatgtattaagcgctggtcttggccaatctccggcacgccaggcatcgaagtttgcgggattaccggattcaacagaggcaactacgattaataaagtgtgtgcatccggcatgaaagctatacagcttggcactcagcagatcttatgcggcgatgcggagattgttgttgccggtggaatggaaagcatgtcaaatgtgccttactacctagacaaagcacgccaggggtataaacttggtaatgcccaggtgattgacggcattataaaagatggcttgtgggatgtatattataactgccacatgggcaacgcagcagaaaacacggcaaaggaattacatattacccgtgaaatgcaggatgcatatgcaattgaatcctataaacgttcagcgtctgcatggcaaaacggttcatttaaaaacgaaattgtaccggtaaatatatcaggtaagcccggacaggaaacagttgttgacacggatgaagaattttcaaaagtaaattttgataaaatcccccagttaaaacccgtctttgataaagaaggaacggtgaccgctgccaatgcatcatccattaacgatggcgctgccgcattaattctcgtaagcgaagatgccttaaaaaaatataacctcactcccattgcccgcatcttatcgtatgcagatgctgcgcaggacccgctgtggtttacaacagctccggtattgtctgttaataaagcgctggagaaagcaggactgaacatacaggatattgattactttgaattgaatgaagcttttgctgttgtatgcctggctattaacaacaaacttggtattgacagccgcaaagctaatgtctggggtggagcggtttcattgggccatccgattggtgcctccggagcacgtattgttgttacattagtaaacatactaaaaaccaacaacgctcgtttgggtgttgcaggtatttgcaatggcggcggtggctccagcgcacttgttattgaaaactta

SEQ ID NO: 34047 - DNA, 834 bp, Cytophaga hutchinsonii
gcaattgaatggaaaaccgttaaagaattcgacgatatcacctataaaaaatcaaacggtgtagcacgtattgcttttaaccgtccggatgtgcgcaatgccttcagaccgaagacaacatcagaattatacgatgccatgtacgatgcgtatgaagacgcttctatcggtgtggttttattatctgccgaaggtccgtcatcaaaagatggcatctactctttctgcagcggcggcgatcagaaagcgcgtggagaaaagggttatgttggcgaagatggcagacatcgtctgaatattttagaagtacaacgtctgatccgttttatgccaaaggtggttatcgcagtggtacccggctgggcggttggcggcggccatagcttacatgttgtatgtgatttaacacttgcgagtaaagaacatgcgatctttaaacagacagatgcggatgtaaccagctttgacggcggttacggttcggcctatttagcgaaaatggttggacagaaaaaagcgcgtgagatctttttcttaggcagaaattattccgctcaggaagcctttgacatgggcatggtaaacgccgtgatcccgcacgacgaacttgaaagtactgcctacgattgggcacaggaaatattagccaaatcccctacttcgattaagatgttaaagtttgccatgaacttaacagacgatggtatggttgggcagcagatctttgccggggaagcaacacgcctggcgtacggaacagatgaagccaaagaaggacgtaatgcatttcttgaaaaaagaaaaccggatttcggtgatattggctgggcacct

SEQ ID NO: 34048 - DNA, 990 bp, Cytophaga hutchinsonii
ctacattcacaacttttaggaacgggacattacgtacccgaacagatcgtaacgaacaacgaccttactgctttcatggaaacctccgatgcctggatccaggaacgcacaggaattaaggaacgccgcttctttaaagaaggtgttgatacggtttccaacatgggcgcaaaagctgcgcagatggcgttagcaaacgcaaagattgaagcgaaagaaattgacctgattgtgttcgcaaccttaagtccggattatgcattccccggtgcaggtgttttattgcagtgcgaattaggtgtgccgaacattccggcgctggatatccgtcagcagtgcgccggctttatctatgccctctctgtggccgaccagttcattaaaacaggcatgtataaaacggtgctggttgtaggaagtgaaattcaatccaacatcatggaactgtctgatcgtggccgcaatatggcggtgatctttggtgacggtgcgggcgcggttgtattaaaagcaacaacggaaaacaagggcgtcctttcaacgcatttacatgccgatggtacgcatgcagaagaactcatgctggaacacccgggcagcagaagcaaaacgcgtgtaaccactgaaatgattgagaatggagcgctgctacctgtgatgaacggacaaggtgtattcaaacaggcggttcagaaattccccgaagtaattaaagaagcgttggatgcaaataatttacaaacaaccgatatcagtttattgatcccgcaccaggccaatctgcgcatcgcagagtatgtgcagaagcaattgaagctggaagaccatcaggtattcaataacattcagaaatacggcaatacgacggcagcatctatcccgattgcattgagcgaagcggtacaggaaggcagattgaaatccggtgacctgctttgtttggcagcattcgggagcggctttgtttgggcgagtgcattggtgcggtat

SEQ ID NO: 34049 - DNA, 1819 bp, Cytophaga hutchinsonii
gaactgcaaaaagtttcatctcaggtaagaagagatattgtacgtatggtacacggcgctaaaggcggccacccgggtggtgcattaggctgtaccgatttattagtgcttctatattttaaattgatgaagcacgacaaaaacttcaatatggatggtattggagaagatatcttttatctttcaaacggacacatctctgcagtgttatatagtgtattggcacgttccggttattttccggtagacgaattggtttcgcaccgtaagatcaattcccgtttacaaggacaccctactccgcactcccatttaccaggcgtgcgtatggcatcgggttcattgggacaaggtttatccgtaggctgcggaactgcgcaagcaaaaaaattaaacaaagacgagcggtttgtatatgttttgatgggcgatggtgaacagcaggaaggccaggtttgggaagctgctatgtacgcaccgcacaataaattagataatctgatcggtttcgtggattacaacggtcagcagatcgacggtccgtgcgataaggtattatctcttggtgatcttgaaggtaaatacaaagcattcggctggaacgtgatcacatgcgacggacatgattttgcgtgcctggaagaaacaatcttaaaagcacaggctaataaaggcacaggtatcccgacaatgatcttaatgaaaacagaaatgggttacggtgtagattatatgatgggttcacacaagtggcatggtactgcaccgaacgatgctgaactggcatctgcattaggccagctggaagcaacacttggcgattattaatccattattaaagaaagacattacaacaatgaaaaaatatccatttactgaaaagaaagatacacgttccggctttggtgacggtatgactgaattgggaaaaacaaatccaaacgtagttgcactatgtgccgatttaactccgtcattaaaattaaacgatttcgaaaaacaaaatccggaacgttttttccagatcggtattgccgaagcaaacatgatcagcatggctgctggtatgacgatcggcggtaaaattccattcacagcaacgtttgcaaacttctctaccggccgtgtgtatgaccagatcagacaatcggttgcatattcagataagaacgtaaaaatctgtgcatcacacgcaggtttaacgttaggcgaagatggtgcaacacaccagattcttgaagatatcggtttgatgaaaatgcttccgggcatgaccgtaatcaacccatgcgattacaaccagacaaaagctgctaccattgcaattgcagatcataaaggtcctgtgtacttacgtttcggtcgcccggccttaccagtatttacagatccaaaccaaaagtttgagattggtaaagcatggatggtaaacgaaggaacagacgtaacaattattgctacaggtcacatggtgtgggaagcaatccttgcaggacagcagttagaagaacttggcatcagtgctgagatcatcaacattcatacaatcaaaccaattgatgaagaagctattttgaaatcagttggcaaaaccggttgtgttgtaacagctgaagaacacaacatcttaggtggtttaggcgaaagcgttgcacgggtattagcaagcaaccttcctactccgattgagtttgtggcggttaaagataccttcggcgaaagcggtacaccagatgaattgatggagaaatatggtttgaaagaccgccatattgttgaagcggttcaacgtgtgatcaagaagaagaaataaatcacc

SEQ ID NO: 34050 - DNA, 1101 bp, Cytophaga hutchinsonii
atgtctttcgcaacattaggtttatctcccgcaattttaaaagcattagaaaaacaattttataatgcgccgtatcccattcaggagcaagcgatccccgctattttaaaaggtaaggatatcttaggcattgcgcagacagggtcgggaaaaaccgcgagttttgtgttgcccatcttacagatgctgcaaacaaaacctctgggaaaaaacagacacatcaatgcactggtgcttgtgccgacaagagaacttgccgttcaggtaggacaggtatttcaggctttcagcaatgcacttccaaataaaataaaatcattagctgtgtatggcggtgtttcgatcaatccgcaaatgattcaattacaaggagtggaaatattgattgctacccccggccgtttgctggatctggttgattcaaaggccgtgtatttaagtgatgtggaagtgctcgtgctggatgaagcagataagatgttgaacctgggttttaaagaagagatggcaaatatctttaagctgcttccccaaaagagacagaatttgttgttctctgcaactctcggtaaagatgtagataccattactgaatttttattgcatgatccggttaaaattgaaattattgccgaagaacaaaacattgatctgattcagcagatagcctacgcggtagaagatgcacgcaaaggtcctttgctgcggtatctgataaaggaacaaaaaatgaatcaggttttgatttttacatcttccgtacaccgtgccgatgcggtagttgaaaaattaaaagcgaataatatattggcggcagctttacatagcaagaaaagccagggggcacgcaccgaagcattaaaacagtttaaggcaggcaatattcatgtgctggttgcaaccgatctgatgtctcgtggcattgatattccttttttgccttttgtaattaattatgaattgccgcgatctcctaaagactacatccatagaatcgggaggacgggtagagcagaagcatccggagtcgcaatcaatttaatcagtgaagaagaaacacatcattttagcgtcattcagaaaaaaatgggtaaaaaagta

SEQ ID NO: 34051 - DNA, 2379 bp, Cytophaga hutchinsonii
atgttagtacttaaacgagacggcagacgagagtctgtaaaattcgacaaaatcacatcccgcatcgaaagactttgctacgggctggacatgaactacgttgaccctacatccgttgcgaaacgagtgattgatgggttgtatgatggtgtaaccacagaggaactggatcatttagctgcagagactgctgcttctatgactaccaagcatcccgattacgctacattagctgctcgtattgctgtttctaacctgcataagaaaacaagtaaatcgtttgcaaacacgatgaagcgcttgtatacctatgtagatccaaagacgggtgaaaacgcgtctatgatctctaacgaggtgtatgaattcatccgtaagaatgcggcgatccttgactctgctattatttatgaccgcgattacggttatgattacttcggtttcaaaacacttgaaaaatcatacctgctgaaagtggatggtaaaatcgttgagcgcccgcagcacatgctgatgcgtgtatcctgcggtattcactccggtgatatcgacgcagcgattgaaacatacaacttaatgtctgaacgctggttcacacatgctacgcctaccttatttaactcaggtacgccaaaaccacaattatcttcttgtttcttactaacaacgcaggatgattccattgatggtatttacgaaacattaaaacaatgtgcaaagatctcccagtctgcgggcggaatcggtcttagcattcacaatatccgcgcaaccggttcttacattaaaggtaccaacggtacgtctaacggtattatcccgatgctgcgtgtatttaacgatacagcacgttatgtagatcagggcggcggaaagcgtaaaggggcttttgctatttaccttgagccatggcatgcagatgtatttgaattccttgacttaagaaagaaccacggtaaagaagaaatgcgcgcgcgtgatttgttctacgccatgtggatctcagatttattcatgaagcgtgtggaagaaaacggcgactggtccttattctgtccgcacgaagcgccaggtttggctgattgctatggcaaagacttcgaagctttgtatgagaaatacgaaaaagaaggacgtgcacgtaaaacaatcaaagcacaggaactttggtttgcgatcttagaagcacaggttgaaacaggtactccgtacatgttatacaaagatgctgcgaaccgtaaatcaaaccagaaaaacttaggtacaatcaagtcttcgaacttgtgtacagaaatcatggaatttacatcgccggaagaagttgccgtttgtaacctggcttctcttgccttgcctaagttcgtgatcaacggaaaatttgaccaccagaagttatatgatgtaacgtatgttgctacgaagaacttaaataagatcatcgatgtaaactactacccggtaccggaagcagaacgttccaacaaacgtcaccgtccgatcggtttgggtgtacagggcttagcagatgcgttcattttacttcgtatgccattcgaatccgatgaagcaaaacagctgaacatcgatattcacgaaacgatctattatgctgctatgacggcttctaaagatctggctgaaaaacttggaccatacgaaacatttaaaggttctccggtatcaaaaggaatcttccagtttgatatgtggggtgtaacacctgcatccggccgttatgactgggaagcgcttaaacgtgaggtgaagaaacacggtgtacgcaactcattattagttgcgccgatgcctactgcttctacgtctcagatcctgggtaacaacgaatgtttcgaaccatatacatccaacatttacacacgccgtgtattatcgggtgaatttgtagtggtgaacaaacacttattaaaagacctgattaaattgaatctttgggatgacaagatgaaaaacagactgatcgaaatgaacggttctgtacaaaacatcaacaacattccgcagaacataaaagatctgtacaaaacagcgtgggagatcaaaggtaaaacattgattgacatgtctgcagaccgcggcgcgtatatctgccagagccagagcttaaacatcttcatgccggaagcaaacttcggtaagcttacatcgatgcacttctatgcatggaacaaaggcttaaaaacaggtatgtactacttaagaacgaaatctgcggcaaacgcgatccagttcacggtagagaaacaggcggaagtacagttagcgcctggtacaacagaccagtctattgtagacgctgagaagaaagcaaaagacatggcgtgttcactggacaatccggaaggctgcgaaagctgcagc

SEQ ID NO: 34052 - DNA, 963 bp, Cytophaga hutchinsonii
ttagaagaaccattactaaaagagaataagaacagatttgttctattccctattaagcatgatgatatttgggcaatgtataagcaggaagaagcgagcttctggacggctgaagaaattgacctttctcaggatcttattgactgggctaatctgaatgacggtgagcgtcactttatttcgcatgtgcttgcgttttttgctgccagtgatggtatcgtaaacgaaaacctggccgttaattttcttgaaaaggtgcagatcccggaagcgaagtgcttctacgggttccagatcatgatggaaaacatccactctgagacctattcgctgttaattgacacctatattaaagatccgaaagaaaaagaccgtttattcaacgcgattgatacggttccttgtgtgaagaaaaaggctgactgggcgcttcgtttcatcgacaatggttctttcattgaaaatattatcgcatttgcagccgttgaaggtattttcttctccggttcgttctgttcggtattctggttgaaaaaacgcggtttaatgccaggtttgagcttttcgaacgaactaatctccagagacgaaggtttacattgtgacttcgcgtgtctgttgtatacgaaatacatcaacaataagcttccggcggaacgtgtgatccagatcatcctggaagccgtggagatcgaaaaagagttcgttacggattccttaccggttgaccttattggtatgaacgcacgtctgatgcagcaatacatcgaatttgttgcagaccgtttactggttgcgttaggtgtgccgaaacaattcaacgcaaccaacccgtttgacttcatggagatgatctctctgcagggaaaaacaaacttctttgaaaagagagtttctgagtatcagaaatctggtgtaatggcagaaaaagattcacaaaaattcagtctggacgaagatttt

SEQ ID NO: 34053 - DNA, 708 bp, Cytophaga hutchinsonii
aaagaacccacagaactatacgaaccgatccgatacattatggatttaggaggaaagcgcatgcgcccgctcctgaccattctgtctaattatatcttcaccgaagatacgaataacgttatgaatgctgccattgcggttgaagtgttccacaattttacgctcatgcacgatgatatcatggacaacgctcccttgcgcagaggaaaggcaaccgtgcatgcaaaatggaataccaacatcgcaatcctttccggtgatgtaatgctggttgaagcatacaaacaattgatgaccattgatgagaaatacctgaaacaggtgctggatcgttttaacgaaacagctgcaggtgtttgtgaaggacagcagtttgatatgaattttgaatcgctgcctactatttcggttgatgattatattaacatgatccgcctgaaaactgctgtgttattaggtttcagcatggagcttggcggtattcttggagatgcggacgaaaaaagctgtacgtatttaaacacggttggaatctctgccggcattgggtttcagttaaaagatgatctgctggatgtgtatggtgacgctgctacctttggtaaacaggttggcggtgatatccttgcaaacaaaaaaacgtttttactgatccgtgcgcttgaaaaagcagcaggcaaaacaaagaaagatctggaaaagctattg

SEQ ID NO: 34054 - DNA, 1626 bp, Cytophaga hutchinsonii
aatacatcagatttcacttcctggaagaagctaaacgagcattattctaaaagttcaaatttgcagatgcgcgacctgtttgcagcagacaaggacagattttctaaatactccgttcaattcaatgatatattagtcgattactcaaagaataggattacagatgaaaccatttcgttattgattgcgctggcagaagaagccggattgaagcaggcaatagaagatatgttcgctggaaaaaaaataaataatacagaaaaacgttcggtactgcacgttgccttacgcaatcgctctaatacgccaatcctttccgatggcaaagatgtgatgccggaagtaaatgctgtattagaaaaaatgaaaggtttctgcgaaaaagttcgcagcggtgcatggaaaggctatacaggcaaatccattacagacatcgtgaacatcggtatcggcggttctgatcttggcccggtaatggttaccgaagcattaaaaccttatggttcaccaacactccatgtgcacttcgtttcaaacgttgatggtacgcacattgttgaaacaacaaaaaaattaaatccggaaacaacattattcatcattgcttccaaaacatttaccacacaggaaaccattaccaatgctgaatctgcaaaagcatggttcctgcaaacagcaaaagacgaagcagccgttgccaaacattttgttgccctttctacaaacgcgaaatctgtagccgctttcggcattgatacagaaaacatgttcgaattctgggactgggttggcggccgttactccctttggtctgccattggtttatctattgcgctatacatcggatacgacaactacattgaattgctgagcggtgcacatgcaatggacaagcatttcaaagaaacgcctttcgctaaaaatattccggtgcttcttgccttgatcggtatctggtacaacaatttctataaagcagaatcacatgcaattcttccgtacgatcagtacatgcatcgttttgctgcgtacttccagcagggagacatggaaagcaatggtaaacgtgtaaccaaagacggaactgctgttacctactctaccggcccgatcatctggggtgaaccagggacgaacggtcagcatgccttctaccaattaattcaccagggaacaaaattgataccgtgtgatttcttagcgcctgttatcagtcagaatccgattggtgatcaccacccgaaattactggcaaacttttttgcacaaacggaagccttaatgaaaggtaaaacagctgcggaagcaaaagctgaattggaaaaagcaggactttctgctgaagatgttgctgccctggtaaaccacaaagtatttgaaggcaacagaccaaccaattccatcttctttaaaaaattaacaccatttacattaggatcattaatcgccatgtacgaacacaagatctatacacaaagtgtggtatggcaaatcaatgcatttgatcagtggggtgttgaattaggtaagcagctggcaaatgcgattctgcctgaattaaaagataacgcagcggtaacaagccacgacagctctacaaacgggctgatcaacttctacaaagcg

SEQ ID NO: 34055 - DNA, 1686 bp, Cytophaga hutchinsonii
atgcaagaaaaaggtaatatctccattcacaccgagaacattttccctatcattaaaaaattcctttactctgaccatgagatatttttacgcgaattagtatctaatgcagtggatgctacgcaaaaactgaagcgtttggctgctcttggcgaatatccgggcgaacttggcgacacaaaagttactgtcagtgtaaataaagaagcaggcacgatcaccattaccgatcgtggtatcggtatgacggcggaagaaattaaaaaatacatcaatcagattgcgttttccggtgctacagaatttatagaaaaatacaaagataaaacagataccaatcagatcattggccattttggtttgggtttctattcggcctttatggtttcttctaatgttgaaatcaataccctttcctaccagccaaattctaaagctgcacattggatctgcgacggttcaacggagtttgaaattaaactttctgataaagcggaacgtggttctgaaattacgctgcacatcgcagaagattcacttgaatttttagaaacaagcagaattcattctatccttgataaatactgccgctttcttcctgttgaaattgaatttgaaggtgaaatcattaataacccttctccgctctggaccaaacagccaagcgaattaaaagacgaagattatattgctttctataaagaattatatccgatgtctgaagacccattgttctggattcatctgaacgtggattatccattcagtttaacaggtgtattgtacttccctaaactgaaaaaagactttgaattccaacgcaataaaattcagttatactcccgccaggtatttattaccgatgaagtaaaagatattgtacccgagtttttaatgttgctgcatggcgttattgattctccggatattccgttaaacgtgtcgcgaagcttcctgcaggcggatggcaatgttaaaaaaattaatagccacattactaaaaaagtagcggataaactgaacgaactgtttaataatgaccgtgcgggctttgaggcaaaatgggatgatatcggcatgtttgtaaaatacggcatgatcagtgaagagaaattttatgataaggctaaaaatttctgtttactgaaaaacaccgacaatgcattgtctactattgaagaatacgaacagaaaattaaacccatacaaacggataaaaatgataagcttgtgtatttatacagtaacaatgctgtagcgcaggacattttcattcaggcggcgaagaaaaagcaatatgacgtattgttgctggattcggttattgactcgcacttccttggtcagctggagagtaaattagaaaaagtacaattcaagcgtattgattctgaaagcgttgataaactgattgaaaaagacgagccgaaattgagtctcttaacaaaagagcaggaaacgcaggcggaagaactgttcaaaaaagtagtgaataatgggaaggtaattatcaaacttgaacatctggctaccgacgatatgcctgtaaccattgttatctcagaattcatgcgccgaatgaaagacatggcagctacatccggacaaagtatgtttggcggttttgaattaacacacgaagttgtagtgaatacaaaccacccgctcatagcaaaagccatcgcg

SEQ ID NO: 34056 - DNA, 1419 bp, Cytophaga hutchinsonii
tcgccgattaacggagagcttttggcaactgttgagtatgcttcaaaagaaacgtataatgcattgattgaaaaagctcaggaggcttttcctgtatggagcgcattgcctgctcccaaacgtggtgaaatcatccggcagattggtgatgcattcagagaaaagaaacaggaattaggcgcgctcattacaatagagacaggaaagcttttacaggaaggtttgggtgaagtgcaggaaattattgatgtgtgcgattttgccgttggcttgtcacgccagctgtatggcttaaccatgcactctgaaagacctgatcacagaatgtatgaacaatatcacccgcttgggattgtcgggattatatccgcctttaactttcctgctgctgtctggtcgtggaacgcaatcattggcgctgtatgtggtaacgtatgtatctggaagccgtcagaaaaagcacctttgtcggcaattgcctgtcagtcggttgtttcagaagtaataaagaagaacggattgccggaaggaatattcaccatctaccagggagccgccgcgcaaggcagctggatggcggatgacgaacgcgtagcgcttgtttctgctaccgggtctgttgcaatgggtaaaaaagtgaatcaggctgttgccggtcgcttaggcaaagttttgttagaacttggcggtaacaatgcgatcattgttacagaaaaagccaatcttgacatggcaacacgtgccattgtttttggggcagtgggtacggctggtcagcgttgtacaacgacacgcaggttgattgtgcatgaaagcatatacaaaaagcttgttgatgatctgacacgtatttacgcacagctttctataggaagccctttggatgcagacacattggttggcccgttgattgatgaaacagctgtagaactgtatgaaaaacgcatagcgactgctcagaaggaaggggcggtattagtcacaggcggcaagcgtatgcagcctaaaggttttgaaaaaggaacatatgtgttgcctgctattttagaagccgacggtgcaataccatccattcaggaagaaacgtttgcgccgattttgtatatttcaaaatacaccggacacgtagaaaatgccataaaaatgaacaatggcgtgcgccagggtttatcttccgccatttttacaggagatttacaacaaatggaaagattcctttcaaataaagggtctgattgcggcattgccaatgtaaacataggaacgtcaggcgctgaaataggaggtgcatttggaggtgaaaaagaaaccggtggaggcagagagtctggttctgatagttggaaagcatatatgcgacgccaaacgaatacaattaattacgggaataccttgcctcttgctcaagggataaaattt

SEQ ID NO: 34057 - DNA, 1086 bp, Cytophaga hutchinsonii
aagaaagcattaattacaggagtaacgggtcaggatggcgcttatttgagcgagtttttattgaaaaaaggatacgaagttcacggcgttaaaagaagatcttcattgtttaacacagatcgtatagatcatttatatgtagatcagcatgaaaaaaatgtaaaattcaagttacattatggtgatttaacagattctaccaatttaatccgcattatccaggaagttcagccggatgaaatatataatttaggagccatgtctcacgtaaaagtgagctttgatacgccggaatatactgccaatgcagatggtatcggaacactgcgtatccttgaagcaatccgtattttaggtttggaaaaaaagactaaaatctatcaggcttctacatctgaactttacggtttggtacaggaagttccgcaaaaagaatcaactcctttctacccgcgttctccttatgctgttgcgaaaatgtatgcatactggatcacggttaactatagagaagcatataacatgtttgcctgtaacgggattttgtttaaccacgaatctccattacgtggagaaacatttgttacaagaaaaattacacgtgccgtagcacgtattgctttaggtgcacaggataaagtttacttaggcaatcttgattcaaagcgtgactggggacatgcaaaagattatgtagaagcaatgtggttaatcctgcaacagaaaaaaccacaagactttgtaattgctacgggtgttaccacaacggttagagattttgttaaaatggcgtttgcccgtgttggtatcgaagtagaatttaaaggcagtggcgtaaaagaaacagctgttgttaaatcttgcaaaaacaaagagtttcaattaaaaaaaggaactgttgttgttgcagtagataaagcctatttcagaccaactgaagttgatttgctgatcggagatccttccaagtgtaaaaagattttaaagtggaaaccgaagtacaaccttgctatgcttgtaaacgaaatggttgacgcagatgtgcaattattcaaaaaagacgaataccttaagaaaggtggattt

SEQ ID NO: 34058 - DNA, 1080 bp, Cytophaga hutchinsonii
aagagagattattacgaagtactggaaattacaaaatcagcttctgcagacgagattaaaaaagcgtaccgtaagttagcgattaaatttcacccggataaaaatccagacaatcctgaagcagaagaaaaatttaaagaagctgctgaggcatatgaagtattaagtacgccggaaaaacgtcagcgttacgatcaatacggtcatcaggctgctggcggcggcggttacggcggcggtatgaatatggatgacatattctcacaattcggggatgtatttggcagcggcggctctccgtttgaaagtttctttggcggcggtggcggcggcagaggacgtggtgttcgtaaaggttccaacctgcgcattaagttgaaactaaacttagaagaaattgcaaatggttgtgaaaagaaaataaaagttaagcgccaggttgcctgcgacgagtgcagcggtaccggagctaaaaatggtgccgtacagaagtgtggtacatgtaacggcacaggccaggtgaagcgtgtggtaaatacgatgcttggacagatgatgtctgcaactacctgccctacgtgtaatggcgaaggcacaacgattaaagataaatgtaccagctgccacgggcaaggtacggttgagaaagaagaaacaatcacgatcaaaatacctgcaggtgttgtagatggcatgcagctgtctatgagcggaaaagggaacatgcctccaagaggcggtgttgccggcgacttgttaatcctgatcgaagaaattgaagacgaacaattaaaacgggatggtttaaatatcatctacgaactatatgtaaccttctttgatgcggtattcggcaccagtgttgaagtaccaacggttgatggtaaagtgaagatcaaaattgaaccgggaacacaaagcggaaagattttacgtctgcgttctaaagggttaaaagatgtaaacagctaccagaaaggtgaccaactgatctacgttaatgtgtggacaccacaaactttatcaaaagaagaaaaagaattattggcaaccattaaagaatctgaaaacttcaaaccc

SEQ ID NO: 34059 - DNA, 2451 bp, Cytophaga hutchinsonii
  unsure (1)..(2451): unsure at all n locations
aatactatgaaagtgttaaagttcggtggtacctcagtaggttcagtagagagtatccgtaaagtcgcagaaattctttcttcatacaaaaagaaagaaaagtttgtagttgttttttctgccatgtcaggaattacaaatttacttgttgaagtaggtcagaaagcatctacaacagatatttcttatcagcaggttttaaaaacgattgaacagaaacacgtaagcacggcaaagacattgattgatgttaagaatcagggcaaagttattgcgcagctgaaattgatattaaacgaactgcaggatttattacacggcgtttatttattgaaagaattatcgccgcgctctaacgatcttgtgttaagttttggcgaaaggctttcttcatacctggtttctgagttcttgaaacaggaaggcgtagacgttacattcctggatgcccgtaaagtaattattaccgatagcagctttggttcagcgaaagttgatttcaaaaaaacagacaaagcgatcaaagattatttcaaagatattaagtccagtgtcgtaactaccggttttatcggttcaaccgataaaggtgaaacgacaacattaggcagaggcggttcggattataccgcttccgtttttggtgctgcgctggatagcgaaggcattgaaatatggacagacgttgatggcatcatgacggcagacccgcgtaaagtaaaacgcgcatttacgcttccgcaggtgtcctacatcgaagcaatggaaatgtcgcacttcggcgctaaagttatatatccgccaacattacagccggcattcaaaaaaagaattcccatctggattaaaaatacattcaatacagcatttgaaggaacgttgatcaacgagaaaacaagtgcaacggatcactccgtaaaaggtatttcttctatagaaaatatttctatgctgaaccttaccggcagcggtatggttggcgtaccgggagtatccggccgcttattcggggcattggcacgtaactttatcaatgttatcttaattacacaggcatcttcagaacattctatctgctttgtaattgattcaaaagaatcggcaaaagcgaaagatgctgttgaagaagagtttgaacatgagatcaaagcaggcaaaatagataaactgcacgaaaaagataatctggcaatcgttgcagttgttggcgataacatgcgccatacaccgggtattgcaggtaaactcttctcttctttaggaaaaaatggcatnnnnnnnnnnnnnnnnnnacaaggctcttcagagatcaacttgtctgtagtaatcggaaaagaagatttaacaaaagcattaaatgttattcatgaatcattcttcctgagtgatgtgaaaacgattaacgtgtttgtagtaggtgtaggtctgatcggcagtgcattattaaaacagctgcagaaacagtccacctatcttcagaaagaaaaaggctttaagatcaatgtggttggtttagcaaacagtaaaaaaatgcttatcaatgaaaatggtgtagcattgaccagctggaaagaaaaactggacgaaggagagaaagcaaatctgaaagaatttgtaaaacgaatgattgatttgaatcttcggaactccatttttgttgacaatacatccaacaaagatgtggtttcattctatcacaacatcttggatgagagcatttctatcgttacacccaacaaacttgctaattcaggtttatataaggattaccagaaacttcaggaaactgcctttaaacgtggtgtgaagttaatgtacgaaacgaacgttggtgcaggtcttcctgttatcaatacattaaacgatttaaaagacagcggtgataaaatcattcgcatagaaggtgttttatcggggacattatcatacattttcaacaacttcaaaggcgacaaaaagttcagcgatattgttaaagaagcgaaggaaaaaggctttaccgagccggatcccagagatgatttaaatggaaaagatgttgcacgtaagattttaatcctgtcacgtgaagcgggtttcaatctagagtttgatgatgtagtagtagaaaacattctgccggcaccctgtctgaaagcgaaaacagttgaagagttcttcgtcgaattagagaaaaataataatgtattctctaagaaacgtgatgaagcggataaagcaaataaagtattacgtttcattgcaaaacttgaaaacggaaaagcggaagtaagtttgcaatcggtagacagtacgcatccattcttctccctttcaggaagcgataacatgattgcgtatacaacggaaagatacaaagaaagaccattggtaattaaaggtcctggagctggtgcagaagttactgctgcaggtgtatttggtgatatcatccgtatcagtaattactta

SEQ ID NO: 34060 - DNA, 897 bp, Cytophaga hutchinsonii
aagcatttattaggaataaaagatcttacaacaaaagatattgagcttatattagaaactgccggtcaatttaaagaggtcatcaacagacctatcaaaaaagtaccttccctgcgtgatgtaaccattgccaatgtttttttcgaaaactcaacacgtacacgtttatcgtttgaattagcacaaaaaagattgtctgccgacaccattaatttttcagcggcagcaagttctgtaaaaaaaggagaaacacttttagataccgtaaataatattctggcaatgaaagtggatatgattgtgatgcgccatgcaagtgtaggtgcgccgcatttcttagccaaacacatcagtgcaaatattgtaaatgccggagatggaacacatgagcatccgacacaagcattattagacagcttttccattaaagaaaaattaggcggcgtagcagggaagaaggtttgtattttcggagacatcctgcattcacgtgtagccttatcaaatatttttgccttgcagaagcagggcgctgaagtgatggtttgcggcccgtcaacattgattccgaagtttatcggagagttaggcgttaaggtagaatttgatctgcgcaaagcccttcaatggtgcgatgtagcaaatgtgttgcggatacagcttgaacgtcagacaatcaaatattttcctacactgagagaatacgcacagtattacggcatcaacaaacaattgctggattcattgaacaaggaaattgtgatcatgcacccgggtccgatcaacagaggagttgaattaagcagcgatgtagccgacagcggtcattccattattttagatcaggtagaaaacggtgtggcagtacgcatggctgtattgtacctgcttgccggc

SEQ ID NO: 34061 - DNA, 873 bp, Cytophaga hutchinsonii
atgagcgttctagtaaataaaaattcaaaaatcatcgtacaaggttttacaggtacggaaggaacattccatgcacaacaaatgattgagtatggtacaaatgtagttggtggtgttacgccgggtaaaggtggttcttctcacttagacagaccgatattcaatacggttgctgaagctgttgctaaaacaggtgcagatgtttcaatcatatttgttccgcctgcatttgcggcagacgctattatggaagctgctgatggcggtatcaaagtgatcatctgcatcacagaaggtattccggtacgtgatatgatcgatgcgaaggcatatgtaacgaagcgtaaagttaccttgatcggaccgaactgtccgggtgtaattacaccggaagaagcgaaagttggtatcatgccgggctttatcttcaaaaaaggaagaataggtattgtatctaaatcaggtacgttaacatatgaagctgctgaccaggtggtgaaagcaggttacggtatttctactgcaatcggtattggtggtgatccgatcattggtactactacaaaagaagccgttgaattattgatgaacgatccggaaacagatggtatcattatgataggtgaaatcggtggtcagttagaaggcgatgcagcgaaatggatcaaagcaaacggtacaaagccggtagttggtttcattgccggacagacagcgcctccgggacgccgtatgggccacgcaggtgcaatcgttggcggtgcagacgatacagctgcagcaaagatgaagatcatggcagagtgcggtattcacgtagtacagtctcctgcagatatcggcgagacaatggcgaaagcaatgaagaaacaa

SEQ ID NO: 34062 - DNA, 1851 bp, Cytophaga hutchinsonii
gaatatacccgcgcatatgctgccagtattgcagatcccgaaaaatattgggacgatcaggctgcgcaatttatatggaagaagaaatgggataaaaccctggaatggaatttttctgatccggatgtaaagtggtttatagggggtaaattaaacatcactgaaaatattttagaccgtcatgcaacaaaaacacctgataaagtagcgatacactgggaatccaataaccccgatgaagcaggcaaagatataacctataagcaattgtatgaacaggtatgtgtgtttgcaggtgtattaaaacagaaaggcattaaaaaaggagatcgtgtatgtatctacatgccgatgattccggaattggcaattgctgtactggcctgcgcgcgtataggtgccatccattcggtgatttttgcaggtttttcagccagtgcggttgcagaccgtgtaaacgatgcgaaagccgtagctgtgcttacatccgatggctctttccgcggaacaaagagcattgctgtaaaagcgcttattgatgaagcgctgcagcagtgtgaaactgtaaagacagtgctggttgctaaacgtaccggcgatgcagtggctatgaaagacggtcgtgattactggtgggatgaagcgattgcaggggcaacaccagtatatgaagcagaagaaatggattcggaagatcccttgtttattttatatacttccggttcaaccggaaaaccaaaaggtgttgtacatacgattggcgggtatatggtgtatacagcattctcttttgcgaacgtgtttcagtataacgaaggcgatgtttatttctgcacggctgatatcggctggattaccggacatagttatttagtgtatggtcccttgctgcagggagctacacaggtaatgtttgaaggcatacctacgtatccggatgccggccgtttctggagcatcattgacaaatatgccgttacacatttctatacggcacctacagcgatccgttcactgatgtctttcggcgatacaatggtagaaaaatattcgttgaaatcgttgaaagtacttggctctgtaggcgaacccattaatgaagaagcctggcactggtttaatgaacacattggaaagaaaaactgtccgattgtggatacctggtggcagacagaaacaggtggaatcctgatttctccattggcgagcattacaccattggtgccctcgtatgcaaccttgccgctgccgggtgtgcagcctgtactcgtagatgcaaatggtacggtactggaagggaataatgtagaaggaaatttatgtatgaaatttccatggccatctatcatccgcactacatatggcgaccacgaacgttgtaaacaaacctatttttcaacctatccgaatctgtattttacaggcgacggctgtaagcgtgatgagaagggatattaccggatcatgggaagagtagatgatgtaatcaatgtatcgggtcaccgttttggaacagcagaaatagaaagtgccatcaatgaacaggccgatgtaattgagtcggcagtagtcggctatccgcatgaagttaaagggcaaggtatttatgcctatgtgatctgtgataaaacagataaaaatgaagaccagcttcgcaaggaaattctggatagtattgttaaactgatcgggcccatcgcgaaacccgataaaatccagattgtaacaggtttaccgaaaacacgttcaggaaaaattatgcgccgtattttacgtaaagttgcagaaggagacctgaataatctgggtgacacctctacgttgcttgatccggaaattgttgaagagatt

SEQ ID NO: 34063 - DNA, 1533 bp, Cytophaga hutchinsonii
cttggtttaaccatattgagcggtattttcctgtatctgcagcgcaagatcattatcggcacctcccgccgcattgaatacgatgtaaaaaatgaaatctacgatcattaccagcagcttccggtaagcttttataagcgcaacaacaccggcgatatcatgaaccggatttcagaagatgtgaaccaggtgcgtaactacctgggccctgccctgatgtatggcatgaacctgtttgccatattcattgtaactgttccgatcatgctttcggtgagcacggaattaacgttatatacactcattccattgccgttcctggtgatcagtatttacaccgtacagaatgttattaccaggcactctgaagaaatacagcgcagcatgtcgcgtttatcttcgctggtgcaggaaacattttcaggtatccgtgtggtgaaatcgtttggcagagaaacttccatgacaacacagtttgatgcgcaaagcaacgagtataaatcaaaatccattcacctgacacagattaatgccttgttttttccgctaatggtctttttgatcggtgcttccatcatctttattgtctggatcggtggtaaaaaagtaattgccggtgaaggtgtaacgaatggaaatattgcagaatttattttctacctgaataaactggcctggccggttacttctctgggctggatcactgtgatgataaagcgtgccgaggtatcgcaggaacgtatcaatcagtttttaaaacagaaaaatacccttcttaaaggaaaagaaattactacccctattaaaggcgcgatcgcatttaaggatgtttcttttacctatcccgatacgggcattgaagccagtaagcacatcagctttatggttgcaccgggtcagacacttgcaattatcggcaataccggttcaggtaaatcaaccatcgcttcattgctttgccgcttgtacgatacaagttccggcgacattgaaattgatggcatatccatacgtgattataacctgcaattcctgcgcagccagattggttttgtaccacaggatgtattcctgttttccgataccatccgcaacaacattgcctttggttttgacaatgtaacggaagaacagatcattgaagcagcaaaattttccgacctgtacacctccattcagcatttcccgatgggtctggataccattttaggtgagcgcggcattaccttatcgggcggtcagaaacaacgcctgtcgctggcacgtgcatttatcagaaatccacgtttatttatcctggatgattgtttatctgctgttgataccaagacagaagataccattctgaataatttaaaagttgtcttaggagaccgcagtacaattattatctcacatagggtctcttcggtgaaacttgcggacaaaattatcgttttagaagatggacagattgctcaaagcggctcgcatgaagaattaatggataaagaaggtatttaccggaatatttatctgaagcaattacacgaa

SEQ ID NO: 34064 - DNA, 471 bp, Cytophaga hutchinsonii
atggcagagaagaatcttattttaacgaagaaacaaattcagcagcgcatcaaacgtattgcatacgaaattctggaacagaactttaaagaaaaagaaatcgtttttgccggtatttatgatcgtggttattctgtagccaagttgctggaaaaagaatttaagtctatttcttctacacaaaccgtgctgatcaaagtaacgctggataagcaggctccttctcaaagtgaagtgacgctggatgtggatgttaagacattaaaaaacaaatgcatcattatcgtagatgatgtattaagcacaggccgtacgattgcctacagcttaaaaccttttttaaatatccgggtgaagcgtattcagacggctttcattgtagaccgtggccaccacaccttcccgatctccgctgattttgtgggctatgtaatggctactaccctgaatgaacacgttgaggttaatctt

SEQ ID NO: 34065 - DNA, 903 bp, Cytophaga hutchinsonii
gttcggattggaacacgcggcagtaagcttgctttgtggcaggcagaacatgtggcggcttgtttacagacaaaggggttagaaccgcaaattgtaatcatagatacaacaggcgataaaattttagatcagtctttatctaagatcgggtcgaaaggcttgtttaccgaagagctggaagaacagctgcatgccggcacgattgatatcgcggtgcacagtgccaaagatctgcagacgcatttaaaaggcggtatgtacattcttgccatcaccgaacgtgaactggtcaatgatgtattggtgagtcacaagccgattgatacattaaagaataatccagatcttattatcggaacatcttcgacacgcagaagagccttgctgcggaaattttatccgcaggcaaagatggttgatatgcgcggtaacctgcagacacgtatccgtaagatggaagaaggggcgtgcgacgccatgctgctcgcctatgccggtatgcaccgaatgggttatgattcgctgattaaagaaaaactttcgctggaagaatttattccggcagccggacaaggcacgctggcgatagaagcagcttcaaccttagataaagaaaaggcagcggttatccgtgccgtattgaatgatgcggcaacagagactgctgtgtcagcggaacgcgcatttctgcgtacactggaaggcggctgcagcattccggtatttgcattggctgttgaacgcgatacagattatctgttaacaggtggtattgtaagtttagacggaacgaaatacctgcgaaaagaaatccgttttaccgcagccgatgcagagcaacgcggcgtggaattagcaacggtactgctgaaggatggagcagatgagattctggcggaaatt

SEQ ID NO: 34066 - DNA, 1585 bp, Cytophaga hutchinsonii
ttattacaccgcatccttgattcaggaatatggcaaaagtacaacgttgatattcattgcgctttttctgatcagtacaaattttcttaccaacatctttaaatatttttcgcagctcatcaatacccgtttgcgtgcaacggttatttataacatgcgcgaacgtatgtttgataaggtagtgaagctggatgtaggttattttaccaatcagcgcaaaggcgatctgatgtcgcgtatgacaaatgatttaggtgaaatagaaaactccgtgatcggtgccttacaggtatttttcagagatccgttcaacctggttatttattttattacgctgttaatgatccagtgggaattaatgctttttacgctgctgatcctgccaatagcaggtttgggcgtttccatcattggtaaaaaattaaaaaaagaatccgaagaaagtcaacgctccgttgggcatatcctgtcgctgatcgatgaatccattagtggcattcgtatcatcaaaggatttattgccgaaaaatttgtcattaatcggtttaatgatcaggggaaaaaatatgcagatctgacaaactccatgggtaataaaagagaacttgcttctccgttaacagaattcatgggcgttaccatcgttgcgatcatcttatatatcggaggcaatcttgtattctccggaaaaatggaagcaagtacctttttcttatttattatctgcttctacaaaatacttgaaccggtaaaaagtcttgcctcttccattacatccatccagcgcggcattgcagccggcgaccggatttttgacatcctggatcatccggtatctattgaggatactccatcggcaaaaacactctctgcattcactacgggtgtaagcctgaagaacattggctttaaatatgaagaacatgaagtattgaaacatatttccattgacataccaaaaggaaaattgattgcacttgtgggaccaagcggcggcggtaaatctaccttagtcgacctcattccgagattctatgacccggcaacaggcagcgtagaaattgacggtgtcaatatcaaagactatacactgaattccttacgttcgtacattggtattgtaacgcaggaatcgattttatttaacgatactatttttaacaacattgcttttggtctgccgaacattacacaggaagatgttgaacgcgcagcacgtattgccaatgcgcatgaatttatcatccgtaccgaaaagggatatcagacttctatcggcgagcgcggttctaaattatcaggcggacagcgtcagcgtttaagcattgcccgtgcggtattaaaaaatccggacatcttaattttagatgaagcaacatctgcccttgataatgaatctgaaaaactggtacaggaagcattaaattatttaatgaaagaccgtacgtccattgttattgcacaccgtttaagcaccatccgtcacgccgatatgatccttgtactggacaaaggccagatcaaagaacaaggcacccacgaacaattgctggcgcaggaaggcatctattacaaattacaccag

SEQ ID NO: 34067 - DNA, 276 bp, Cytophaga hutchinsonii
ttatcagcagaagaattttctcaaaaaataaaaaaagaacccaatgcgctgattctggatgtacgaactccggaagaattttctgaagcacatattgccaatgcaacaaatgtaaactggaaagataattttgcatccggcataacggaagtaaataaaaatcaaccggtgttggtgtattgtttaagcgggggaagaagtgcttccgcttcagactacctgagaaaaaatggctacacacaggtatatgaactgcaaggcgggttattaaaatgg

SEQ ID NO: 34068 - DNA, 909 bp, Cytophaga hutchinsonii
attttaatttccgtacttttcgctgctgcctttgcagcatgcacacatgaaaaaccagctacacaggtaacgcttatggatacgcttagtgaaatagagatcttagatcctgaagcagaaaaattattttctaaagaaacaaaagctgaagttattgcatcaggctttttatggtcggaaggaccgctatggttaaaagacgaacaaaaattaattttttctgatgtgccaagaaacagaatcaacagctggtctgaaaaagacagcttacagctttatcttgaaccgtctggctatacagacaccattaaacgtggcggcgaaacaggatcaaatggtttgtgtttaagcaaagacggaaaattaattttagcacaacacggagacagacgtattgctgaaatgcaggcaccattaaatgcgccgaaggcagattttaaaacacttgccggcacatttaacggtaaacgtttcagcagcccgaacgatgtgtgtgcagacagcaaaggaaattattattttacagatcctccgtacggactagaaaaacaggaaaatgatccggcaaaagaacagccaaaagaaggcgtatatagaatcaatgcagatggatcggtagagcagcttattgattcattaacgcgccccaacggtgtaattgtttcaaatgacggcagtaaattatacgtagcgaactctgatccggcgcgggctatctgggcagtatacgatattgatgcagcaggtaaattgtccaatggaaaaatattgatggatgccactgcgtatgtacctaaaggtaaaggcttgccggacggtttaaaaatgaacaaggcgggctacatttatgctacaggcccttgcggtgtctgggtatttaatccttccggaaaacatattgcaacgata

SEQ ID NO: 34069 - DNA, 1428 bp, Cytophaga hutchinsonii
atgttctcatccctttttaaaacgaaaagcattcaatccattcttaaagaagaaaaaggagagctcaaaaaaacccttaccgcaacaagccttgtattactaggaatcggtgcaattatcggtgccggaattttttcccttacaggtatcgccgcagctgaaaatgctggtccggctgtaaccatttcctttgttgttgccggattaggctgtgcgtttgccggattatgttatgcggaatttgcttctatgttaccgattgccggaagcgcatacacctattcatacgctactcttggcgaatttatcgcctggatcataggctgggatctggttcttgaatatgccgtaggcgcagctaccgttgccataagctggtcacgttacttaattaagctgcttgaaaaacttggtgtagatcacattccttatcaatggatgatgtcaccgtttgaaacacatagggtaaacggaacagaattgcatggcatcgttaacattcccgcaatttttatcacgtgcctgatgtcattagtcctgatccggggaatgaaagaatctgcaaaattgaacaatgttattgtagcattaaaaataaccgttgtaattgcattcattattttaggctggagctacatggacccaatcaaccatgctgattatgtaccggacaatacaggtgtttttgagcactttggctggacaggcgtaatgaccggcgctgcagttgtatttttctcttttattggttttgatgccgtttccaccgctgcacaggaagctaaaaatccacagcgcgatatgcctatcggcatactgggctccctggttatctgcacgatcttatatgtattgttttcctatgtaatgactggccttgaaaattatcagaactttaaaggtgaagcagcaccggttgccttagcgatcgcggctacgccatatgcctttttccaggaactgattatcatagcaattcttgcaggttacacatctgtgatcatggtattattaatgggtcagtcccgtgtgttctttagcatgtctaaagatggtcttgtaccggcaatcttttcagaagtacatccgaaataccagacaccatggaaatcaaatattctgtttgccatattggtgagtttgtttgcaggcctggtgcctgtttcagtagtaggagagatgacaagcattggcaccttgttcgcttttgtactggtatgtataggtgtattggtgctgcgcaaaaagcagccggatgcaccaagagcgttccgtacaccatgggtaccgtttgtgccaatcatgggtattgttgtgtgcctgtacctgatgtacgcgcttccaatagacacctggatccgtttgattgtatggatggcaattggtatcgctatttactttttatacagcagacaccatagtaagatc

SEQ ID NO: 34070 - DNA, 1749 bp, Cytophaga hutchinsonii
aaaggaggcgagtacatcattcgcgaacaggaagcatccagtatcttcatcccggaacagtttgacgaagaacagaaaatgatggctgatatggccagagattttttagctactgaagtacacccgattcttgatcgtattgatgcgcaggaaccaggcttgatggaaaaattgcttgaaaaagcaggcgaactcggtttgcttgctacgtctattcccgaacaatacgaaggtttcggaaaggactttaacacatctttgttactaacagagattgttggtgcaggtcactcgtttgctgttgcacttgcagcgcatacaggtatcggtaccttaccgattctatattttggtacagaagaacaaaagaaaaaatatttaccgaagcttgccagtggtgagtggaaagcaagttattgcctgacagagccaggttcaggttcggatgcgttggctgctaaaacaaaagcagtactttctgcagatggcagccattatattttgaacggacaaaaaatgtggatcacaaacgctggttttgcagacacgtttattgtctttgctcagattgatggcgataagttcacaggttttatcgttgagaaaggtgaaggcgttacacttggtaacgaagagcacaaaatgggtatcaaaggttcttctacccgtcaggttttctttaacgactgcaaagtaccgaaagaaaatgtgttaggagaaattggtaaaggacacttgattgcattcaacattttaaatatcggacgtattaaattggccgctgccgccttaggtggttcaacacgtgtaagcacactttcaatccaatacgcaaaagaacgtattcaattcaaacaaccgatcgcaaacttcggtgccattcaatataaattagcagaacaggcaattaagatctataccgttcagtctgccatgtaccgtgccggacaaggcattcaggatgcagaagaagaattggtgaaacaaggtaagacttacgaagaagccttattagctgctgcgcaggaatatgccatcgaatgtgccatgttaaaagttgcaggttctgaaacattggattatgtaagtgatgaaggcgttcagatcttaggtggttatggtttctctgccgattatccgatggaccgttcgtacagagattcccgtatcaaccgtattttcgaagggacgaatgagatcaaccgtatgcttacgatggatatgttcctgaagaaagcaatgaaaggcgaactggatctaatgggccctgccatggcggtgcagaaagagttgatggcgatccctgattttggtgcagaagacgaaggtctgtttgcagatgaaaagaaagcgatcaaaaacatgaagaaagcattattaatgcttgcaggtgctgctgctcaaaagtacatggataagcttgccacagagcaggagatcttaatgaaccttgccgatattgcaatcgacatttatgttgctgaatctaccttacttcgtacagaaaaattaatttctattaaaggcgaagatgcagtgaaaggtcagatcgatatgacgaaagtgaatatatttgatgctgcagaccgcattaacattgcaggtaaaaacgcgatcaactctatgtcagatggcgacatgcaacgtatgatgttgatgggcttgaagcgttttacaaaagtagcgccgttaaatacgaaagatgctagaagaagaatcgctgctcaattgattgaggcgaatcagtat

SEQ ID NO: 34071 - DNA, 1170 bp, Cytophaga hutchinsonii
caagaagtatatatagtagcagcttatagaagtgccgtaggtaaagcacctcgcggactgttccgtttttatcgtgcagatgatctgggtgcagatgttgttaagcatcttgtagcttcggttcctgcattggataaagaccgcattgatgatgtgatcgttggtaatgctactcccgaagcggaacaaggattgaacattggtagaatgatctccttaatgggattgaatacggtaaaagttccgggcatgacggtgaaccgttattgctcatccgggttggaaaccatcgcgattgcggatgcaaaaattcgtgcgggctacgccgattgtatcattgcaggcggtgtggaaaccatgagtccgatcccattcggcggctggaaaacggttccgaattatgaactgactaaatcacatgctgattactattggggtatgggcttaaccgctgaagctgtagctgcacaatacaatgtatccagagaagatcaggatttgttttcgtacaactcgcatcagaaagctgtagcggctattaaaaacggccacttgcaggatggtattgttccgatcacgatcaaagaaacgtatctggatgaaaaagaaaaaaagaaaataaaagaatatcaagtattggtggatgaaggtccgcgtgcagatacaagcatcgctgccttagcgaaacttcgtccggtatttgcgaacggcggttcggtaacagccggtaactcttcgcaaacatccgatggtgcagcgtttgtattgttgatgtctgagaaaatggtaaaagagttaaatctgaaaccaatcgcccgtttggtatcctacgctgttgctggtgtcgaaccacgcatcatgggtattggtccggtggaagccattccgaaggcattaaagcttgcagacttaaaacaggacgatatcaatctgatcgaattgaacgaagcatttgcagcgcaatcattggctgtgattcgcacgctggggctagacgaatccaagatcaacgtaaacggtggtgctattgcattgggtcatccgctgggttgcaccggcgcgaagttgtctgtacagatcttcaatgagctgaaacgtaccaaccagaaatacggcatggttaccatgtgtgtagggtcgggccagggtgcagcaggtatctttgagatg

SEQ ID NO: 34072 - DNA, 2403 bp, Cytophaga hutchinsonii
atgagccatcgaaaaattcgcaaagttgcagtattgggttccggcgtaatggggtctcgaattgcttgtcattttgcaaacattggtttggaagtgttgcttctggacattgttccgaaagagcctaatgatgctgaaaaagcaaaaggcctgacgcttgaaagtaaagctgttcgtaaccgcattgtaaatgatgcgctgatggcttcacttaaatcaaatcctgctcctttgtatgatgctgcctttgcatcccgcatcacaacaggaaattttgatgacaacatgaaagacatcgcttcgttcgattggatcgttgaagcggttgttgaaaatatagatattaaaaagaaagtctacgagcaggttgaatcgttccgtacaccgggcaccctgatcacatcaaacacgtcggggatcccgatgcacctgatgtctgaagcacgcagcgaagattttcaaaaacatttctgtggtgtacactttttcaacccgccacgctacatgcgtttattggagatcattcccggaccgaaaacaagtccggaagttattgatttcttaatgctgtatggtgatctgtatttaggaaaaactaccgtactgtgtaaagatactcccggtttcattgcaaaccgcatcggtatctacggaattatggaagcgttgcataccattattgatcttggtttgtcggttgaagaagttgataaattaaccggtccggttattggtcgaccaaagtcagcaaccttccgtacgcttgatgtggtagggatcgacacggtgatcaaagttgcaaatggtttgcttgccggtgcaccgaacgatgaagcaaaggacatgtttgttcttcctgaaattctgaaaaaaattgatgagaacaaatggtatggtgataaatcacagcaaggtttttataagaaaactaaaaacgatgccggccaaacggagattctttcgttgaacctgaattcgttgttatacggtcagcagcaaaaagtaaagtttgctgctcttgaacaaacgaaagcaattgaagatctgaaaccacgtttttctgttttaataaaatcagcagacaaggcaggacaattttacagaagaacattcttaggtcttttcaaatacgtttcaaaccgtattcctgaaatctccgatgaattgtatcgcattgatgatgccatgcgcaccggtttcggctgggaacttggtccgtttgaaacatgggatgctgttggcgtagcgaaggctgtgaagttgatggaagaagatggtcgtaagcctgcgcagtgggtatacgaaatgcttgaagcaggcaacacaagtttctacaaatcagaaaacggaaagcgtttgtactatgatattccgagcaagtcgtacaaagtaattccgggtacagaatcatttattattttagatacacttcgtgcaaacaaaccggtgtttaaaaatgctggcgcaaccttacacgatattggcgatggaattgtaaatcttgagttccatacaaaaatgaatacgctgggcggcgaagtggtagatgcgatcaaccgttcgattggtatcgcagaaaaagatttccagggaatagtaatcggtaacgatggtgcaaacttctctgccggtgcaaaccttgcgctggtattgatgtacgcgatcgaacaggaatacgatgaaattgatttcatgatccgtgcattccagaataccatgatgcgtgcgcgttactcgtcgataccggttgttgtagcaccacacaatctaacacttggcggtggttgtgaaatgacgttacatgccgatcacgttcaagcatttgctgaaacctatattggtttggtagagtttggtgtaggtttgattcctgccggtggcggtacaaaagaatttacgctacgtgtaagtgattcattcgaagatggtgatatccaggtaaacaatctgaagaatatgtacatgcacattgcaacggctaaagttgcaacctctgcggaagaagcaagaagcatgggcatccttcgtaagagcgatggaattacattaaacagaagtcgtttgattgcggatgcaaaagcagcagcgatcagtttggcagaagcaggatatacgcaaccaaaacaacgcaaggatattaaagttcttggtcagtcggcattaggcatgttctatgcaggtgcaaactccatggtatccggtaaatatatgtcagagcacgatcgtaagatctctgagaagctggcgtacatcatgtgcggcggcgacttatctgcacctacattggtatcggagcaatacttactggatctcgaacgtgaagcgtttttgtcacttaccggtgaaaagaagacgttggagaggatacaaagtattttgacgagcggacgaccacttcgtaac

SEQ ID NO: 34073 - DNA, 1746 bp, Cytophaga hutchinsonii
cttttcgatttaattccgcagcagattgccaagtatcccaaacaagatgcactggcaaccaaagagaatggcacctggattagttattcttctgtgcgtgttcaagaaattattgataaagtaagtattggctttataaaatcgggtttacaaaaagacgataaagtagccattatttcaccaaaccgtccggaatggaattttattgatctgggactgcaacagataggagcggtgagtgtaccgatttatccgacacttacggtggaagattaccggtatatttttgatgacgccgaagttaaaatggtttttgtgtatgacgaacaattatttgcaaaagcaacagaagccgtaaacggttccagaacaaatcctgtaatatataccttgcaggatgtgaacggagcgaaaagctggaaagatatcacggcactggcagacggccaaccggcttcgatgcttgatccatataaggcaaatgtatttaacgacgatctgcttaccttgatttatacgtccggaactacaggtaagcccaagggtgttatgcttacacataacaatatattaagcaatgtactggcagcgattccgctgatgccggttaatcacaatcataaagcacttagttttttaccgttgtgccacgtgtatgaacgcatgttgtgttatctgtacctgtctcagggggtatctatctattatgcagaaagtacagatacagttggcgaaaatttaaaagaagtgcagccgcacatgtttgttacggtgccaaggctgcttgaaaaagtatacgataaaattgttgctaagggcgctgaacttacgggcattaaaaaattcctcttctattgggcacttgagctggggttaaaatatgatatgcagaaaaatcaaggcttcttttataacattcaactgaagcttgccaataaaataatcttcagtaaatggcgagaagcattgggtgggaatgtgattaccgttgtttcaggcggtgctgccttacagcctcgtttggcgcgtgttttctgggcggcgcagattccggtgatggaaggttacggtttaacagagacgtcgccggtgattgccgtaaacagattcaatccggatgaaacacgaatcagtactgttggtccgctgttgcccggagtagaagtgaagatcgcggaagacggagaaatcctgacgcgcggaccgcatattatgaaaggatactacaaacggccggatttaacggccgaagcaattgacagtgaaggctggtttcacacaggagatatcggtcagtttgtagaaaataaatatttaaagatcaccgaccgtaaaaaagaaatgtttaaaacctcgggtggtaagtacattgcaccgcagctggttgaaaataaatttaaagagtcgcgctacattgaacaaataatggtgattggtgaaggggagaaattcccttctgcgattgtggtgccgtcgtttgcagatgtaaaaagctggtgtgagatcaaaggcattccgtatacgacaaacgaagaaatggtttgcaatgcacaggtgatcgaaaaattccagaaagagtttgacgaaatgaatgaaaactttgcacagtatgaacgtgtaaagaaattcattttaatgccaaggccatttacgatagagagcggagaaatgacaccgacattgaaattgaaacgtaagatcattatgcagaattgccagggccagatagagaagatgtatgcgagg

SEQ ID NO: 34074 - DNA, 2010 bp, Cytophaga hutchinsonii
attgccgaaaaacctagtgttgccaaagatatcgctgaagtacttggtgctaaaaagcgcaacgatggctattgggaaggtaatggatatcaggtaacgtggacattcgggcatttttgtaccctgaaagaaccacatgattatctggacaggtggaagatgtggcgcctggaagatcttcctatgatcccccctagtttcggtattaaactgatcgacaattcaggcgttaaaaaacaatttaacgtaattcaaaaactggtaaatgcctgcgacgaagttataaattgtggtgatgccggacaggaaggagaactgattcagcgctgggtcttgctgaaagcaaaatgtgccgtaccggtaaagcgattatggatctcgtcgttaacaaccgaagcgattaaagaaggttttacaaaattaaaagaagcggaccaatataataatttatatgccgcaggcagtgcccgtgccatcggcgattggctgctgggtatgaatgctacgcgtctgttcactaaaaaattcggccagggcaaaattgttctgtctataggccgtgtgcagacacctacgctggcaatgatcgtagcgcggcagaaggaaatagacgccttcgtttcagaagagtactgggagttaaaaaccacctaccgtgaaacggaattcaccgctaccattgagcgtttaaagtcgctcgacaaagcaaacaaaggacttgagtatttaaaaggacatccgtttgtagttacatccttcgaaattaaagaaggcaaagaaggaaatccaaaactttttgatcttacgttacttcaggttgaagcaaataaaaaattcggttattcggctgaagacacgttgaaatatgtacagaccttatacgaaaaaaagtttgtcacctatccaagagtagataccacgtacctttctgaagatctgtacccaaaagtgaaaggcattttagaagacttaaccatttacagtcatttaacggctccggttctggccaaaccaattccgaaatcaaaggctgtttttgacgataaaaaagttacggatcaccacgccattattcctacgggtgttaccccgtctccgaatttacagattgaggaaaaacgtatttatgatttaatcgcacgccgttttattgctgtattctatccggaatgtaaagtgtccaacacaacggtattaggcactgtggggcaggtagagtttaaagctacgggaaagcagatcattgaagcaggctggaaagaagtctatgcaaacgataaaacggaaaagaaagaagaaggcgacgaagaaaaagtaatgcccaactttaccgtaggcgaaaccggaccgcacgagcccaaagtacatcaagggaaaacgtctccgccgaaagcatacactgaagcaacgctgctgcgtgctatggaaacagcaggcaaacaggttgaagacgaagagatgcgtgaactgttaaaggacaacggtatcggccgcccgtcaacacgcgccaatattattgaaacacttttcagacggaaatacatagaacgtaaaaagaaaaatatttttgctacgcaaacgggcatggatctgatcgattgcatccactctgaattattgaagagcgctgaactgaccggcaactgggaacgcaagctgcgcctgatggagaaaggcgaatatcagctcgaaaccttcaagcaggagttaattgatatggttaccgagattaccaaagaagttaaaagcaattcctacaaagcaatctacattgcaccggagaaatccaaagcaccggccaggtctgccccgaaagaaccggcaaccggcagcaaagaaggtaagacaaaggaagcaaaagaaaaaaagattaaggaagaggtttccattgaaacattaaaatgccctaagtgtaaagaatatctgctgaaaaaaggaaatactgcttacggctgttcaaattttcagcaatgcggatttaaaattccgtttgtaatgctgggtaaaaaa

SEQ ID NO: 34075 - DNA, 1335 bp, Cytophaga hutchinsonii
ttggtaatgcccaaaatgggagaaagcgtaatggaaggaacgattttaaactggttgaaaaaaccgggagatcgtatccaacaagatgaatctgttttggaagtagctacagacaaagtagacacagaagtgccttctccatttaacggaattttaaaagaaataaaagcgaatcagggtgatgttgttcaggtaggaacagcgatagctcttattgaaaccgacgtcaatcaggcggcaaatagtgagcctgcaaccactgctcctgcggcaaatacaaattctggtacggcaactacacaaacagtacaacagacagctgtggctgaaaaaatacctgtctccactcctcagactcatatccccgctcatacagctggtgccaaaggcggaagattctattcgccattggttttaaatattgctcgccaggaaaatatatctttggcggaagttgaaaccattgccggtacaggcaaagacggacgtgttacaaaaaatgatctgttcgattacctgcaggctaaaaaagaaggtaaggtaacggctgttactcaggaaactgttgttaacgaaacaccacaggcaacggaacaaaaagcaccagttgctgaacctgtttatgtgaacaaacctgcttcttctcaaagcggtaatgtagaaatcatacaaatggatcgcatgcgtaagatgattgcagaccgcatggttgaatcaaaacgcatttctccgcacgttacatcttttgttgaagcagatgtaaccaatattgtatactggagaaaccgctggaaaaatgatttcatggaacgtgaaaatgttgccttaacatttacacctattttcattgaagccgttgttaaagcaataaaagattacccgatggttaacatctctattgaagacgataaaatcattgtaaaaaaagatatcaatatcggtatagcggttgcacttccgaatggtaatttaattgttcctgtaattaaaaatgcagatcagttaaacattgtaggacttactaaaaaagtaaatgacctggcaaagcgtgcccgtcagaataaacttacagcggatgatctttccggaggaacctataccgtttcaaatgtcggctctttcggtaatttaatgggaacgcctatcattgttcagcctcaggcagccattcttgcgttgggtgctgtggttaaaaaacctgctgttattgaaacaccacaaggcgatacacttggtatccgccatatgatgttcttatcacactcttacgatcatcgcgcaattgatggttcactaggcggtatgtttgttcgcagagtggctgatttcttagaa

SEQ ID NO: 34076 - DNA, 2142 bp, Cytophaga hutchinsonii
acactgcctgtacaggaaattgttccgcaggttatcaatcactttcaagacaataccacccttattgtaaaggctccgccgggagccggtaaaagcaccttgcttccactgacttttttaaatgagtcgtggctggaaggtaaaaaaatcatcgtactggaaccccgcagacttgcagcaaaaacgattgctacgcgcatgagccagttgctgggcgaacaggcaggagaaaccgttggctaccgtatccgctttgaaacaaagatcagcgataagacgcgtatcgaagttgttacagaaggcatacttacacgtatgctgcaaacagataatacgttaaaagatgttgcgttggtaatctttgatgagttccacgaacgcagcatccatgcagatgttgccctggcgctatgtagggaagcacagctgaccaagcggaatgacctgcgcctgctgattatgtctgcaacaatggatctgccggagttatctgccaaactgaaagcgaaaatcattgaaagcgaaggtcgccaataccccgtcgaaattcattatacaggtgtaacagacatgcacctgctgcccgagctaaccgcacgtgtggtgagcaaagccagcaaagataataaaggagatattcttgttttcctgcccggccaggcagaaataaatgcctgcagagatctgcttgacaataaacttagcaataccgttgttcataccctttacggacaacttccttttgcacagcagcaggcagcgctcctgcccgatcagacaggcaaacgtaaagttgtactcgcaacttccattgcagaaacaagtttaacaatcgaaggtgtcacaacggttgttgattcgggttttggcaagcgttctaaatttgatccgcaatccggattatcccgtcttgaaacagtgaatatttctgtcgatgctgctgatcagcgtgcaggccgtgcggggcggttatctgctggtacctgttaccgcatgtggtcgaaggcgcagcatgaaaccttacagaagcaccaccagccggaaatagaaattacagacctctcttccctggtacttgaaatggccgtgtggggaatctccaatatttataacatggtctggcttacaccgccgccgcaatcacatgtaaaacaggccaaagaaacgctgcattacatcgatgcactcgatcgcaataaagttactgcgcatggaaaaaagatccatcagctgccttgcaacccacgtatcgcacacatgctgctgatggctgaaaaactggagcaggaagccttagcaacagatattgcggcaatcattgaagagaaagatccgcttacaatcaaagaagcaggcgttgacatcaacgaacggatcaaagcgctgcgccgcttcagaagaaatgacggtaaagggcgtgcctttggattgattgaacgtgttgcccgatcatacagagacctcatggaaattgaagtagaaaatgaaggctttgattctttcatgacaggtttgttattggcacatgcatatccggaacgtgttgcatttgcacgccccggtaatcaatcacagtttcagcttgcaaatggtacctatgcgcagttcagccacaaggattctttgtcgcgcgaatcatgggtatctgtttcacacattgatgcacgcgaaggaaccggaaaaatttttatggcttcaccgttgaatccaaaagatctgaagggcatggttaaaactgctgtatcggtacattgggatctgatcagcaatgatctgatcgtacatacagaattacgtatcggcaagattgtcttaaagtctttccccatggatgatccaaccgatgaagaacgttcaagagccttatgtgatgtggtaaaaaaagacggcagagaattattacattttacacctgaatttgaacagtggcaagcagctatgtttagagcacagcaacagcacccgctggcacagtttcccgatgtagatacagaatcgctcttgcttacctgcgacgactggctcacgcctttcgcagacgagatcgaagaaaaagatgatctgaaaaaactggatctgctgcagatcatttctgcacggattccgaaagagctgctgaagcttgttgattaggattcgccg

SEQ ID NO: 34077 - DNA, 1737 bp, Cytophaga hutchinsonii
atggaaaaaaagaaaaataaagtaacacttgcgcaggttttcaaaacatttatttggccacgaagaacaatcctgttgatcggtttaatcatgattattataagccggttggccagccttgttttaccgggagccagcaaatatttactggatgatgttgtggccaataaagacatcgatatgctttatacgctgctttgggttgttggtttatcgattgcggtaaatgctgccatgtcttttttactgacaaaactattaagtgtggaagcacaattgctgatttcaaaattacgtgtgcaggtgcagcgtaaaattctgggtttacccatcagttatttcgataataataaatcaggcgctttggtatcccggatcatgacggatgtagaaggggtacgaaacctgatcggtacgggtttggttcagctgatcggaggaacaattacgtcggtaatcgcgcttatactgctgataaaaatcagtcccgttatgacggtatatgttttgctgccggtagctatttttgcgttcattgcgatgaaagcattcggatacatccgcccgatctttaaagagcggggtataataaatgcagatgtaaccggccggttaacggaaactttaaacggtgtccgcatcattaaagggtttaacgcagaagagcaggaaaacaaaacgtttgaagcaggtgtggaacgcttgtttgataatgtgaaaaaaagtttaacctctacgtcactaataaccagcgcttcgttatttctcctgggtatggcaacattaggtatcatgggcatcggcggttacttaatgattaaaggtgaaatgaccagcggtgattttctttcgttcacgttatatcttggttttatgattgcgccgatcgttcagatgagtaatatcggaagccagctgacagaggcctttgccggcttggatcgtacggaagaaatcatgaatatggacccggaagaggatactgaaaaacggaaaacggtattgaaggaaattaaaggagacgttacctttgatggtgtttcgtttgcgtatcaggaaggaaaagaagtattacacgatgtaagctttgatgctcctgcgggaacggttacggcgcttgttggcacgtcaggttcaggtaaatcaaccattgccggtttggttgctacgttcctgaatcctgaatcaggaaaaatcacgattgatggagtagatttatccgaagttacgttgagcagctatcgcaaaaatttaggagtggtcttacaggatgattttctgtttgaaggaacgatcagagaaaacattttatttccacggccaaatgcaaccgaagaacaactgctcaatgccgtgaaagcagggtatgtaaatgaatttacagaccgttttgaaaaagggctggacacattaattggagagcgtggcgttaaattatcaggcgggcagcgtcagcggattgcaatagcacgtgcgatactggcagatcctaaaattattattctggatgaagcaacctcaaatcttgatacgcaaagcgaatcgctgatccagcagagcttagctgagttaatgaaaggcaggacaacatttgtgattgcacacaggttaagcacgatcaggcaggctaaccagattctggtaattgaaaacggaaaaattgccgaacagggaagccatgcagaattgattgcaaaagaaggacggtattatgaactgcatacataccaggcaaga

SEQ ID NO: 34078 - DNA, 756 bp, Cytophaga hutchinsonii
atgaaaattatcacctataatgtaaatggtattcgtgctgcaattacaaaaggcttattaacctgggttaaagcaaccaatgcagacgtactgtgttttcaggaaatcaaagcatctgtagatcaatttgatgtagaaagttttaaagccctgggttacactacctacgcgtttccggcacagaaaaaaggctacagcggtgtggcaatctgtacaaaagaaattcctgtgcatgttgaatatggctgcggcattgaaaaatacgacttcgaaggccgtgtgatccgtgctgattatccaacattttcggtaatgaatgtgtatatgccgtcaggctccagcggcgatgaccgtcaggcatttaagtttggatggatggatgatttcctgctttatatttcagaagtaagaaaaaaaattcctaacttaattgtgtgcggagattataacatctgccataaagcgattgatattcataatccaaaatcaaacgccaagacgtcgggttttttacctgaagagcgcgaatggatgagtaaattctttgactccggttttgttgatgcattcaggcattttaatgaagagccgcaccactatacctggtggagttaccgggccggatcaagaggtaaaaatctgggttggcgaattgattatcattcagtaacacaggaaatggttgggaaattaaagcgttccgtaattttaccggatgccatacattctgaccattgtcctgttttattagaaatt

SEQ ID NO: 34079 - DNA, 1011 bp, Cytophaga hutchinsonii
aaaaaatccaaaacagctgtctttctcattaatctgggtacaccagacagtccaaatacacctgacgtacgcaaatacctgcgccagtttttaatggacagacgtgttattgacattccctggcttaaccgttggctgctgattaacatgatcatagcacctttccgtgcacctaaatcggctcatgaatataaaaaactctggacggaacagggttctccgctcatgtttcatggggttgctgtgaaggaattactgcaacaggcgttgggcgatgaatataaagttgtgctgggtatgcgttatcagaacccgtctatagaatcagcagcaaaagaactggaagcaaaaggctataacaaagtaattgtagttcccctgtttccgcaatatgcttctgcttctaccggatctgccgttgaagaagcactgcgtgtattaggtaagtgggaaatcacaccgcacatagaagtaatctcgaaattttttgatcatccgttattcataaaagcctttgctgaaattggccgcaaatacctggctgaaagaaactgggatcatatcattttctcgtatcacggtattccggaaagacagattaaaaaagcttccatcggcgaccagtgcaaattaggtacctgctgtcaggtttatggttcaagaaatgaatattgctaccgtgcacagtgttatgaaacaacccgtttgctggttaaagaattgggtttggccgaaggatcgtattctgtttcgttccagtcgcgtttgggaaaaacaccgtggatcaaaccatacacagatcataacattgaagaactgggcaaagcaggaaagaaaagtattttatttttctcaccatcgtttattgcagattgcttagaaacaacggttgaaggcggagaagaatataaattactatttgaagaacacggcggtaaagactggcaactggttgaaagtttaaatacaaaccctacctgggtggaatgtttgaaggatatggtagtgagt

SEQ ID NO: 34080 - DNA, 1230 bp, Cytophaga hutchinsonii
ctatggcatccctatacgcccttattgaatacccgtccgtatgcagaagttgtttctgctaaaggcatgtacctgcatctggcagacggcacctcactgatcgatgcgatttcttcgtggtgggtgaatattcacggacatgcaaatgaagtacttgcagaaacaataaaaaatcagatcctgcagctggatcataccttgtttgcaggttttacgcataagcctgcagttgattttgctacaacctttttacgtgtactgggctgcaaccagcagcgtgtaatctattcagagaatggcagtacagcggtggaagtagccatgaagcttgccgttcagtactggaaaagcaaaggccggcagaaaacaacattccttgcgctggaaggcgcgtttcatggcgatacctttggcgccatgtccgttagtgcacgtggcttgtttaccgaagcatttgaatccttactgaatccggtgaaatttattccctttccggatgggacaaatgatgcgtttgtattagagtcgatggaaaagcacatacgggaaaacgcagtagcggcattcatctacgaaccgctgatacaaggtacaggcggcatgcgtacctacacagctgaaatgcttgataaaatgattacggtatgtaagcagaacgatgtgttgtgtattgcagacgaagtaatgaccggctttggcagaacaggcaacgcatttgcatcgcagtattgcacaacaacacccgacattatgtgcttttcaaaagcaatcaccggagggttgttgccgctgggggttaccacgtgcagcagagaagtggaagcaccttttttatcgggtgaattgcgccgtgccttttttcacggacattcgtatacggcaaatccaaccatctgccagctggcattggcaagcctgaaattgtttgaatcagaaacctgccagaacaatattaaacgtatcggtgccgcacatcaggcttttgtattaacacatgttaatcataggcatatcaaacgtatagaatcgttgggtacgatcctttccgttgagattaaaaccggacaacaggcaaattatgaacacgatatcaggcattttttgtacgatttctttataaaaaaaggtattttgctgcgaccgttgggtaatattatttacgtgtttccaccttatattattacagatcaggagttagaaaaaatttacagcgccattgtggaaatgttg

SEQ ID NO: 34081 - DNA, 1116 bp, Cytophaga hutchinsonii
attgcacaaaaacttcaggcacgcatggcagaaaatgccttgcgcagattaacggtacgtgaaggactgattgatttcttttcgaatgattaccttggcttcgcacgaagcaaagcgctgcacacagctattcagcaaaaagaagaaacatatcagttatctgtttgcaacggatcaacggggtcacgtttattatccggcaattccgcgttagcagagcaggttgagaaacaactcgcggttttttttcaggtagaaaagaccttgctttttaatgccgggtataatgcaaacgtaggtgtactttccgctattcctcaaaaaggagataccattttgtatgatgaattgattcatgcaagtttaaaagacggtgcacgcttatcttttgccgatcggctttcttttaagcacaacgatctggaagatctgcaacgcaagattaaaaaagcaaaaggagatctgtttattgttgttgaatccatttattccatggatggcgataaagctccgttaaaggaaattgcagcgcttgctaaacaatacggtgcctgtttcattgtagatgaagcacactcaaccggtacctttggtttgcagggccgcggacttgtgtacgaagaaaatttacagcatgaagtagatatacgcattcatacattcgggaaagctatgggtatacatggcgcctgtgtagcaggttcggccatgctgatcgattacctggtaaatttttcccgcgccttcatatatacaaccgcttttgctccgcatgcatttatttcggttcagtgtgcatttgaaatgctggaacaaaccgcggatgttatcccggcactcaataaaaatattaatcacctggcctcggcattgcgtacccacagctgctacatacccagcagcagcccgatacaggtattaaacatcggcggcaatgatgttgttaaaaatctggcagcaaccattcaggaaaaaggatttgatgtacggcctatactttcgcctactgttaaaaaaggagaagaacgtctgcgtatctgcgtgcatgcatttaatacccaacaggaaattgcagcgttagtaagctgcatcaacagtcagttatgaaaaaatatt

SEQ ID NO: 34082 - DNA, 1569 bp, Cytophaga hutchinsonii
gaacaggctgctattttttatcaggccgaacaatcttcagagatacatacaatcagctacggggcattaaaacagaaagtcattcaatatgcttccggattaagtaaaaatggttttgctgcacatgaccgcattattctttatttaccattcagcattgatgccattgcattctacctggcctgtatctacatgggcgctgagccggtactggtatccgatagtttttctgcgcaggaattaacaaaacgcattgccatcattaaggccaaagcagtgcttacaacggaccagtattggtatgcagacaaaaaaatagccgtgcttcccaaagtacttgaagcaaacccttgccgcatcattttatatagtgaagaacaatcggatgcatcaacaattcgtgcaaacaaagccgacctcttgctttcagaccttttagatgtatacggtacctcttatccgccttactatcacactacagctgatactatttcaattctgttttcttccggcacaaccaaagagcccaaggcgcttccatggaaagctgcgacaccaattaaatgtgcggttgatggtaagctgctgcaggacatccatgcaggtgatgttgtaacctggacaagcggaatgggctggatgatggctccctggctcatctttgctgcgctgcttaacaaagccagcattgccgtatatggcggcgcatattcaaaaaaagagtttttagattttacagtacagacacatgttactgttttaggaaccattccatctgttgttaaaagctggcgggcacaggcttttcagcctgtagcgaactggaaagtacgcatcttcagttctaccggtgaaccgtctgatgcagaggattatttttacctcatgtacctgaataatttcaatgcaccaatcattgaatattgcggcggcacagaaattggcggcggatatatcagcaatgttgttgaactgccgattgccttgtcttcttttaatacacctgcgccgggaagcacattcattctgttagatgaaaacaaacatgtcgttgagcaggcaggtgcaggagaagtttttcttattcctcctgccattggtttatcgcaggaaattctgaataaaagccacgctgaggagtattacgcaaatcttcctgtattgccggcatatccgctgctgcgcagacatggcgatgggtttcataaaaccaccatcgaaggaaccgcttattacagaagtatgggcagaacggatgactcgatgaatctgggcggaatcaaagtaagtgccgttgaaattgaaaccgttgtcaatacccatcccgatattatagaaagtgctgccgtagcgcttcagagcactggcggcggaccggaacgccttgtagtatttgtacataccacgcatgaaaccgataacgtgcagctgcaaaaagaactgcaaaaaataattcaggcagaattaaatcccttatttaaaatatacgatctggtttttaaagaaaattttccacgcacggcctccaataaactgatgcggaaagagctgcggaaagaactggcagga

SEQ ID NO: 34083 - DNA, 726 bp, Cytophaga hutchinsonii
atttccattaaagggctttataaatcttttggagagttgcatgtactgaaagggattgatcttgaagtgcataagggagaaaacgttgttgtacttggaaaatcaggaacaggaaaatctgttttaattaaaatattggttggcttattgaaaccggatgccggcgttgtgcaggtattgggtaaagaggttgataaactgaaccagaaagaattagatgcactgcgattacatataggttttgcttttcaaagcagtgctctctatgatagtatggatgtacgtcagaatctggaatttcctttactgatgaattttaaaaatctcagcaaagcagaagttaaggattcagtggaagaagtgcttgatgctgttggtttgattgataaactcaatcagatgccatctgatttgtctggcggtcagcgcaagcgtattggtattgcacgtacattaattctgaagcccaagattatgttgtacgatgagccaacatccggattggatccgattacatcttttgaaataaacgaattaataaatgaagttcaggagaaatataacacctcttcaatcattattacgcatgatttaacgtgtgcaaaagaaacatgcgatcgtgttgccatgttattagacggaacttttgtgaaaacaggtacttttgaagaagtatttgaagatcaggatgaacgtatacaaagtttttacaattacaattttatc

SEQ ID NO: 34084 - DNA, 996 bp, Cytophaga hutchinsonii
attaaagttggtattaatggctttggccgtattggtcgtttggttttccgtgctgcggttaacaatcctaacattcaaatagttggaatcaatgatttgattgatgttgactacatggcatacatgttaaagtatgactctactcacggtcgtttcagcggtacggtagatgttacagatggtaaattggttgtaaatggcaatgctatccgtgtaacggctgaaagagatcctgcaaatttaaagtggaatgaagttggtgctgaatacgttgtagaatccacaggtcttttccttacaatggatactgctgataaacatattgcagctggtgcaaaaagagttgtattatctgctccggcaaaagatgatactcctactttcgtaatgggtgtaaacaacaagtcatatacgaaagatatgacaatcgtttctaatgcttcctgtactacaaactgtttagctccggtagctaaagtattaaatgataacttcggtatccttgaaggtttaatgactactgttcacgctgcaactgcaactcaaaaaacagtagatggtccttcagctaaagactggagaggtggccgtggtgcttaccaaaacattatcccttcttctacaggcgctgctaaagcggttggtcttgttatccctcaattaaaaggaaaattaacgggtatgtctttccgtgttcctacaccagacgtttctgtagttgatttaacctgccgtttagaaaaagctgcttcttatgaaacaatcaaagctgctatgaaagctgcttctgaaggtgacatgaaaggcatccttggctatacggaagatgaagtagtttctactgacttcttaggtgatgcacgtacttctatcttcgatgcaaaagctggtatttcattgaatgacaactttgttaaagtagtatcctggtatgataacgagtggggttattctaacaaattggttgacttgattgtccacatggatactgttaag

SEQ ID NO: 34085 - DNA, 2313 bp, Cytophaga hutchinsonii
atggataaagaagaattcccttctgtattaccaatattacctgttcgcaatatagtgctattcccgggtgtagtgcttcccattactgttggccgccagaaatcaatacgtctggttaagaagttttataaaggagaccgcaccattggtgttgttgcgcaggaaaaccaaaagtctgaagaaccaagttttcaggatatatttaaagttggtacagtagccaaaattctccgcatgtttgtattgccggatggtaatacaacgattattattcaggggaaaagacgttttaagatcgaagagcaagttcaggacgaaccgttcatgcaggcaaaggtgagtatgttgaaagacattcacccggatatgagcaaaaaagaagtgaaggcacttctgcaatctgtaaaagaatcggcaactaaaattctgaaaatgaatcctgaaattccacaggatgcacagattgccatcaacaatattgaaagtgaaaattttctgacacatttcctttcttccaatatcaatgcggaattaaaggataaacaaaagttactggagtttgatgatgcggttgaacgtgctacgtggttattacagctgatggataaagacatccagatgctggaaataaaacgcgagattcataccaaagtgcataccgatattgatcagcagcagcgtgattatttcctgcgtcagcagatcaaagtattgcaggatgagcttggcgacttcagtagtgagcaggagtttgagcgtttaaaagaaaaagcattaacaaaaaaatggtcggataaagtacgtgcgcactttgataaagaaatgtcgaagctgcagcgtgtaaacccgatggcaccggattatccggtaacatttaattatttagagttgcttgttgatctgccgtggggcgaaaattcgaccgataattttgatctggtacgtgcgaaagaaattttagacgaagatcattttggcttgaccaaagtgaaacaacggatactggaatatctggccgtattgaaattgaaaaataacatgaaggcgccgatcctttgtttatacggtcctccgggtgttggtaaaacatcgttagggaaatccatagcaaaagcactggaccgtaaatacattcgtatgtcgttaggcggcgtacacgatgaatcagagatccgcggtcaccgtaaaacgtacataggtgctatgcccggtaaaatcattcagggtattaaacgctctgaaacatccaacccggtatttatattagatgaaatagataaaatctcgaaagatttcagaggtgatccatcttccgcattattagaagtactggatccggaacagaattcttctttcatggataatttcctggaagtagaatacgatctgtcaaaagtactgttcattgcaacctccaatgcgcttgataccatacagcctgctttgcgcgaccgtatggagatcatagagattaacggatatacactggaagaaaagattcagattgcgaaaaaatatttaattccaaagcaaaaggaagaacacggcttaaaagctaaagatataagctttacagatgctgccattgtaaaaatcattgaagactacaccagagaatccggtgtacgtaacttagaacgtaaaattggtgcggtagtgcgtaacatcgccgtagctatcgccatggaaacggcatatacaaagaaaattcagccggcacaggtacgtgaaattttaggatccgaagattttgaaaaagatacgtatcagcaggatgatttagccggtattgttacaggtcttgcctggacaccttacggcggagagatcttaacgatcgaatccatcatcagtaaaggaaaaggtaagttaacattgtctggtcagctgggtgatgtaatgaaagagtctgcatcggcagcactttctttactgcgcgcaaatgtagacgctatcggtattgatcaccgcgtatttgatcattttgatctgcacgtacacgtacctgccggtgctacacctaaagatggcccttcagcaggtattgccttatatacatcattggcgtctacgtttacacagcgcaagatcaaaccggcacttgccatgacaggagaaattaccctgcgtggtaaagtattgcctgttggcgggatcaaagaaaaaatccttgcggcaaaacgcgcaggtatcaaagaaattattttaagtaaaaagaataaaaaagatatcgaagaaatacacccgccggatattgcagatcttaaatttcactttgttgaaacggcagatgaagtattagccattgcctta

SEQ ID NO: 34086 - DNA, 759 bp, Cytophaga hutchinsonii
ttgaagggtaaaagaggaattatttttggtgctttggacgaaaactccattgcctggaaagtggctcagcgtgcgcacgaagaaggtgcagtatttacacttacaaatgctccgatagcgatgcgtatgggggaaataaataaactggctgaagcatgtggcgcagtggtaatacccgcagatgctacatccattgaggaattagaaaatctctttgacaaatctatggaaattctgggtggcaaaatagactttattttacactccatcggcatgagcccgaacatccgcaaaggcaaggaatatggtgatatgaattacgattggtttttgaaaaccttagatgtatcggcattatcctttcataaaatcatgcatgttgcagagaagaaagatgcgatgaatgaatatggttctatccttgccttatcctacattgccgcacaacgtgttttcccggattataccgacatggccgatgccaagtcaacacttgaatccattgccagaggatatggcgcacggtttgcaaaattgaaaaaagtacgtgtgaatacaatctctcaatctcctactaaaactacagcgggcaaaggcatttcaggttttggggctttttatgatttcgctgatcttatgtcgccgctgggtaatgccagtgcagatgaatgtgccggttattccattgtgctcttctctgatttaacgcgtaaagttaccatgcagaatctgatgcatgacggaggtttttcttccaca

SEQ ID NO: 34087 - DNA, 1647 bp, Cytophaga hutchinsonii
atgcttcaaaacttagttattcaaaattattcacttattgaagatctggagctagctccttcagcaaactttaatattataacaggtgaaaccggcgcgggtaaatccattatgcttggtgctgttggcttgttgcttggtaatcgcgcagacacgaaagtgttattgcatacagaccgcaaatgcattattgaaggaacgtttcagatcggttcgtataaattagaaacgttatttgaagagtatgatctggattataccaatcagtgtatcatccgccgggagataagcagcaatgggaagtcccgggcatttatcaatgatacaccggttacactggatgccttaaaaaaactgggcgattatttaatggatgtgcattcgcagcacgatacattgttgctgggcagtgttgcctatcaactatccctgctggatggctttgcttctaatcaatcagctcttaaggattatcagcaggcgtttaaaaaatacaaagacttacagcaccggtttcagctgaaaaaaaatgaactgcaggaattgcagcagcaagccgactataaccagtttatctatacagaacttgcagaggcagcgctgatagaaggggagatggaagcgaaggaagcggagctcaaaaagatagagcacgcggaagatataaagcaaaaactggaagctacgctggatgcgttaagtaattccgaacaaagtattttatcaaccctgcagaattacaacaaacagcttcaatcgattaagcaatggtccattgcttacgaaacactggcaaaccgactgcagtctgtttttgttgaactgaaagatatagaagcagaacttgaagcagaatctgcgcaggtagaatttaatccaaagcttattccgcctattgaagagcggttgaacagcatatattccttacttaaaaagcatcgtgtacaaacagtttccgaattgctgatacttgaaaaaacgcttgaaggcaaagtggtttcattggatcaattaaatgaagaagtgctacagcttgagaaagaagttaagcatacgtatgacgttgtgcttagcaaagctaaagtagtttctgaaaacaggatcaaagcggtgccgaaatttgaacaatcggttaaagcgctgttaaaagaattgtcgatgcccgatgcccacattcagctggtgttgagtgcagatgcacctactatgtacggtattgacaaaatcaatatgctgtttagtgcaaacaaaggtgtggcacctaatgagctgaaacaagttgcttccggcggtgaattttcaaggttgatgctggcgattaaatatgtgctggcagataaggtagcgttgccgacaattatttttgatgaaattgataccggtatttccggtgaagtatcgatcaaaatgggtaaaatgatccgggagatgtctgcccgtcaccaggtggtagttatcacacatttgccgcagattgcatccatgggtgacaagcattattttgtatttaaagatgccagcggcgaacgttcggtaagtaagatgaaagaattgcttgcaaaggagcgggttacagagatagccaaaatgatcgggggtgaaaaaccaagcgaaacggctctgaagaatgcaatggaaatgcttgaa

SEQ ID NO: 34088 - DNA, 912 bp, Cytophaga hutchinsonii
aaagtaacagtagttggtgctggtaatgttggtgctacttgcgcagacgtattagcatacagagaaattgtaaatgaagtaattctacttgatattaaagaaggtgtagcagaaggcaaagctttggatatctggcagaaagctccaatcacacagtacgacactaaaacaacaggtgtaacaaatgattattctaaaacagctaattcagatgtagtcgtgatcacttcaggtttaccacgtaagccaggtatgacacgtgatgatttgatctctacaaacgctggtattgttagagctgtaactgaaagcgttgttaagtattctccgaatgcgatcattattgtggtatcaaacccgttagacgtaatgacgtattgcgcgcacatcacatcaaaattaccaagaaataaagttatcggcatggcgggtgttcttgacacagcccgttaccgtgcattccttgcagacgaaatcggctgttctccaaaagagattcagggtatgttattaggtggccatggtgatacaatggttccgcttccccgttacacaacggttggtggtattccggtaactgaattggtagaagcagataaattaaacgcaatcatcgaacgcactaaaaatggtggtggtgaattagtaaaattaatgggtacttctgcatggtatgcaccgggtgcagcggcagcccagatggttgaagcgatcgtaaaagatcagaaaaaaatcatcccggtttgtatcaagcttgaaggtgaatacggcatagacgactgttatttaggtgttcctgcagtaatcggtaaaaacggtattgaaaaagtaattgaattgaaattgaatgccgaagaaaaagcattgatggaaacttcaagaaaacacgttaaagaagtaatgaatgtactg

SEQ ID NO: 34089 - DNA, 2307 bp, Cytophaga hutchinsonii
gcacacaatttaggttacccgcgtatcggtgataaccgcgaacttaaaaaagcatgcgaacaatactggtcgggtgccattacacagcagaagctgcaggacgttgcgaaagcaatccgtaccaacaactggcttacacaaaaagatgccggccttgatctgattccctgcaacgatttttctttctacgatcaggtactggatatgtcttttatgcttggcctgataccggaacgtttttcttcgttattacaaaaaaaagatcttaccgagctggatatttattttgctatggcacgcggataccagaaagacggctatgatatcactgctatggaaatgacaaagtggtttgataccaattaccattacatcgtacccgagtttcgaaaggatcagaaattttcacccatttctgaaaaagcgatccgtgaatacaccgaagcaaaagttgttataggaaaagctgcaaagccggtattattaggccctgtaagttatctgcttgccggaaaagaaaaagaagccggcttcaaccgcattgaattaattgaaaatttattacctgtgtatacaaagcttcttgctacgctgcagcagaacggtgcagaatggattcagctggatgaacccttcttagtgatggatcttactgtgcaggaacgcaaaacatacgaaacaacctataccgcgttacgcaatttattcccgtctttaaaatttattgttgctacgtattttgaatgcacaggaaccaatattgatatagctgccaaacttccggtagatgccttacacctggatctggttcgttgtccgtctcagttaagcgatattcttacaccggctttcatttcatcaaacaccatgctttcacttggtgttgttgatggccgcaatgtatggaaaaatgatttctcaacatcaagtacattcattaccaaagctattgctgcattgggtaaagagcgcgtaatgattgccccttcctgctcactgctgcacgtaccgtgcgacctggacaatgaaaaaaatggaaatgtattaacgccggaaattaaaaactggatggcatttgccaaacagaaactgcatgaagttgctgcactgaaaaaactgaatcgtgcgccgatgcaatcggaagagttacggttactgaaagcaaatacagaatcgattgaaaatagagccaaatctaaactcattcataaacaacatgtaaaggcacgagtgaaagcagtacagccgtcagactcacaacgtaagagtttatttaaatcccgtcagcagattcaggaaaaagccttgcagctacccttaatgccgacaacaacaatcggttcttttccgcagacagatgaagtacgtgcaaaccgcgctaaatataaaaaaggcgatatcacattagctcaatacgaagactttgtaaaaaccgaaatgacaaaggcaattgagtggcaggaaaaaattggcattgatgtattggtgcatggtgagtttgagcgcaacgacatggttgaatattttggtgaacaattaaaaggatatgtattctctgaaaacggctgggtacaaagctatggttcgcgttgtgtaaaaccgcctattatttatggcgacattgaacgtacagaaccaatgaccgttgcctggacaacacttgcccaatcgcttacaaaaaaatacatgaaaggcatgcttaccggtccggtaacaattttacaatggtcgtttgtacgcgatgaccagccacgcagagatacctgtatgcagattgcttttgctatccgcgatgaagttgtagatctggaagccgccggcattaagattatacagatcgatgaacctgcgatccgtgaagggttgccgttgcggagagagaattgggaaacatatttaaactgggcggtagaatgtttccgtatttccgcatcgggtgtgaaagatgaaacacagattcatacacatatgtgttattcagaattcaatgatatcataaaaaatattgctgccatggatgcggatgtgattacgattgaaacatcccgttcacaaatggaattactcgacgcctttgtggacttcaattatccgaatgagatcgggcccggtgtatacgacatccacagcccgcggataccaacaaccgatgaaatggcagacctgttaaacaaagccatgcatgtgcttccggtacgcaacatctgggtaaatcctgattgcggattaaaaacacgcagatggcctgaaacagaagcagcattgattaacatggtagctgccgctcaaaagatccgtaaagagatc

SEQ ID NO: 34090 - DNA, 621 bp, Cytophaga hutchinsonii
gtaacgatgaaactgaaagtttgtggtatgaagtatcccgataatgtaagcgcagcgacagcactggcgccggattacatgggttttattttctacaaaccatccaaaagatattgtggcgaaacacttacaccagcatttgtaaaaggattacctgcttctattataacaacaggtgtttttgtaaatgaatcgttggaaaaagttctccgcatttgtgcatcgtacggattcaaagctgttcagctacatggccacgaaacaccggatttctgtttaagctgtaaagaagctggtctggaagtcattaaagtttttcatgttggcgaagaaatggattggtcaatcttagaaccgtataaaaaggccacagactatttcctgttcgatactaaaacacctgaatatggtggtagcggtaaccgcttcaactgggaattgctgaaacaatatgacaatgaaattccgctgtttttaagcggcggtgtggatgaaacgattttagaagaattggatatacttaagaacgttaacatctatgcgctggatattaacagccgctttgagtcagagccgggcttgaaagatgtagcccggattaaaaaatttaagtcagcatta

SEQ ID NO: 34091 - DNA, 1227 bp, Cytophaga hutchinsonii
ttattaccctgtatgcaagtaacaaaccgcacgtacgaatttcaaggagtttccctgactgaattagcaaccgaatatggcacgccattgtatgtttataacagtgaaaaaatactttctcaatataaacggttacacgatgctttttcaggcgtgaatgtgcgcattaaatatgcagcgaaagcattaaccaatcaggccattttaaaattattaaaaggtgccggtgcaggagtagatgttgtttccattcaggagctgcaactggcgctaaaggctggttttgataaaaaggacattatgttcacgccaaactgtgttgatttttcagaaattgaagaagcagtagggtatggtgttcagataaacattgacaacattccgttcttgaaacaattcggccaagtttatgggagcagcgttccatgctgtgtacgcatcaatccgcatattgatgccggaggaaatgttaaaatcatgaccggtcacaaaggttctaaatttggaatctccattgaacaggtgaatgagatctatgaagtagtagacgaatatgaaatccttgtaaacggggtacacgtacacagcggatcggatttcaaaagtgccgatgcatttgtccgcgcagctgaagttgtttattccgtagccatgcagtttgataaacttacgtttctggatttcggaagcggctttaaagtttcatacaaagaaggtgattacgtaaccgacattgaagagcttggtaaaaaaatgacagactcgtttaatgcattctgtttaaactatggtaaaaaattagacatctggtttgaaccgggaaagtttttagtaagtgaatcgggcatgctgctggttacgtgtacggtgattaaggaaacgcctgcctgtaatttcattggtgttaactccggactgaatcacctgatcagaccaatgatgtatggctctcaccatgacattgtgaatgtgagcaacccggatggcgataaaaaaatgtataccgtggtaggatacatttgcgagacggatacattcggttcggatttatttattgaagaaacaaaagccggtgatatcattggtttaaaaaatgcaggtgcatatggattcagcatgagttcaaattacaactcacgtttcagacctgccgaagttcttgttcataaaggcaaacatcagttgattcgtaaacgcgaaacgatggaagatttgttaaaaaatcag

SEQ ID NO: 34092 - DNA, 1368 bp, Cytophaga hutchinsonii
tacgacgtagtagttatcggttctggtcctggtgggtatgtagcagcaatccgttgcgcacagcttggtatgaagaccgcattgattgaaaaatatagcacgctgggtggtacctgcttaaacgtaggttgtattccttcaaaagctttactggattcatctgaacattattacaatgcaacacacacgttcaaagaacatggcattgatgtaaaagatgtaaaagtgaatctgaaacaaatgattgaccgcaaggcaggtgttgtaaaacaaacatgcgacggcatcaactatttgatgaagaagaataaagtcgatgtgcatacaggcatcggttctttcgttgataaaaacacgattaaagtaaccgctgctgacggaagcgtgaaagaattgaaaacagcgaaaacaattatcgctaccggttctaagcctacatcgttaccaaatgttgcaatcgataaaaaacgaatcataacttctacggaagcattggaactgacagaagtaccaaaacacctgatcgttattggtggcggcgttattggtatggaacttggttcggtatatgcacgtttgggcgcgaaagtttctgtcgttgaattcatggataccttgattcctacgatggataaagcgttgggtaaagaattgatcaaagtttctaaaaaccatttaggtttcgatttttacttcagtcataaagtaacaggcgcaacggctaaaggcaaggaagtaacggttacggcagaagataaagacggtaaagtactggaattgaaaggtgattatgtgttggtagcaacagggcgccgtccgtacacagaaggtttaggccttgaagcagcaggtgtaaaattagacgaacgcggcagagtagctgttgacggccacttacagacaaacgttccgggcatttatgcaatcggtgacgtggttgttggcgccatgcttgcacacaaagcagaagaagaaggcgtgtttgttgcagaatcgatcgccggacaaaaaccacacatcaattataacttaataccgggtgttgtgtatacctggccggaagttgcagcggttggttataccgaagagcaattgaaaaaggacggcaaagcatacaaagtaggaaacttcccgttcaaagcatccggtagagcgagagcgagcatggatctggatggttttgtaaaagtacttgccgacaaagaaacagacgaaattttaggtgtacatatgatcgggccacgtgtggcagatatgatcgcagaagcagtggttgcaatggaattcagagcatcagctgaagacatcagcagaatgtctcatgcgcatccaacgttcacagaatcatttaaagaagcgtgtttagct

SEQ ID NO: 34093 - DNA, 1206 bp, Cytophaga hutchinsonii
gtagaagttaaaataccaaccgttggcgaatccattacagaagtaaccttaggtgcatggtctgttaaatcaggcgatgcagtaaaggctggtgatctgttattggaaatagaatcagacaaagcaacatttgaattgcatgctgaaacaacaggtacaatagaaatattatctaaatccggcgatacagtagcgatcggaacagtcgtttgcaaaatcgttccgggtgcgggcggtgcttcacaggcagcagctccagcttctgcgccggcagcaacagcagcagcttcatctggcggcgcaaactatgcaggagggcatgcttctccggcagctggtaaaatattaaatgaaaaaggcgttgatgcttctgcggttgcaggttcaggtaaagatggccgcattacaaaagaagacgcactgaaagcatctgcagctccggcagcagcagcaaaaccagcagcagcagcttcaacagcggctccggcagctaaagcatcagcagcgggccgtgcagacgaccgcgtaaaaatgacaagccttcgtaaaaccattgcacgccgtttggttgccgtgaaaaacgaaacagccatgcttactacgttcaacgaagtagacatgaagcctgttatggacatgcgttctaaatacaaggataccttcaaggaaaaatacggcattggcttaggctttatgtcattcttcacgaaagcggtatgtatggcgcttcaggaattccctgccgtaaacgcatacatcgatggagatgaaattgtataccataacttctgtgacgtatcggtagcggtatctacgccgaaaggtttagtagttcctgtaatccgtaatgcggaaacaatgagcttcaatgagatcgaagcagagatcgtacgtttggcaacacgcgcacgtgacggtaaattaagcatcgacgaaatgtctggcggtacatttaccatcacaaacggtggtatcttcggttctatgttgtctacaccgatcatcaactcaccgcaatctgcgatcttaggtatgcacaacatcgttgagcgtccggtagcagtaggcggacaggtagtgatccgtccgatcatgtacttagcactttcttacgatcaccgtatcattgacggccgtgagtctgtaggtttcctggtacgtgtgaaacaattgctggaagatccgagcagattgttactaggagtt

SEQ ID NO: 34094 - DNA, 2766 bp, Cytophaga hutchinsonii
tcatacgtgtcaaatgcagaaatctcatacgtagatgagatgtatcaatcttaccgcaaagatccttcatcggtagatgaaacctggcagaaattttttgaaggatacaatttctctctgcagaaatacggcgaaaaaggtgcaacaaacggcgggagcgctgaagctccttctggcaatggtgtagcagcggttgcatcaagcccggcaacaaccgtttcagaaaaagaagtacgtgtacactatttgatacacgcctatagaagcagaggtcacttaagatctaaaaccaacccggtacgtgagcgtaaggaccgcaagccgttgttggagcttacagactttggacttacggatgcagatctggatgtggtgtttgaagcagggaacgaaatcggtatcggtgctgcctcacttcgtaaaattgtagagacattaaaattcatctacgaaggtgcgatcggttttgaatatatgtatatccgtaagccggaaaaactggcgtggttacgtaacaagatcgaaaaagaatcgcttgcgcataatttaacattagacgaaaagaaacgcattctttctaaactgaatgaagcggttgttttcgaaaactttcttcatacaaaatatgtaggtcagaaacgtttctctcttgaaggtggtgaaactacgattcctgcattggataaaatgattactgccagtgccgaacttggtgttgaagaagtagtgatcggtatggctcaccgtggccgtttgaacgtattggcaaacatcatgggtaaaacctacgaacagatctttaacgagttcgaaggaaatatcaagccggatatgaccatgggtgacggcgacgtgaaataccacatggggtattcaagcgaagtggttacaccaaaaggtcagaagatcaatttgaaattaatgccgaacccttctcacctggaagcggtagatcctgtggtattgggatttgtacgtgctaaaggagatcgtttgtatggctacgattataaaaaagtattgcctgtattgatacacggtgatgcagcggttgcggcacagggtattgtgtatgaaattgtacagatgagtaaacttgccggttaccagactggcggtaccattcactttgtaattaacaaccaggttggttttacaacggattttgaagacgcacgttcttcgatctattgtacggatgttgctaaaattgttgatgcgcctgtaatgcacgtaaatggtgatgatccggaagcggtgacgttctgcatgcgtttagcggctgaatacagacaaaaattcaacgaagatattttcattgatatggtgtgctaccgtcgccacggtcacaacgagagtgatgaacctaagttcacacaaccaaaattatacaatgtaatttcccgccacgcaaacccacgtgaattatacaatcagaaattgattgaacgcggtgatgtagatgctgagattgctaagaacatggatcgcgaattcagagacatgttgcaggatcgtctgaaccaggtgaagcaaaaaccgcttccatattccttacagaaaatggaaaaagagtggacggaacttcgcaaggcgacaaaagaagattttgatcaatcgcccgatacatcaattacacaagaagtaattgataaagtaggaaaggcgatcacagatattccggcagatttcaaaccgttgaaacaaattgaaaaattattaaaagaccgtaaagaacaattccaggatacaaaaattgtgaactgggcaacggcagaattacttgcatacggttcattattattagaaaagaaaattgttcgcttcagcggccaggatgttcagcgcggtactttctctcaccgtcatgcggtattgaaagatgctgaaacaaacgaaccatactacagcttaaatcacatttcagataaccagaaacgtttccgtatctataactccttattatctgaatatggtgtgttaggttttgaatacggttatgcaatggcaaacccaagtgctcttgtaatttgggaagcacagtttggggactttgcaaacggcacacaggttatgattgatcagtttgttacttcaggtgaaacgaagtggcagcgtcagaacggcttggtaatgcaattgccgcacggttatgaaggacaaggtccggagcactcttcagcacgtttagagcgtttcttaggattgtgtgcgaacaacaacatcatcgttacaaacatcacaacgcctgcaaacatgttccatgcactacgcagacagctgaagtgggaattccgtaagccgttgatcaacatggcaccgaagtctttattaagacacccgttggttgtttctgacttaaaagaatttacaagcggacgtttccaggaagtgatcgacgatgcaaacgtagatgctaaaaaagtaaaacgtgtattgttctgtacaggtaaagtgtattacgatctgtttgaagaacaaaaaaatgcgaagcgtaatgatgttgcgattgttcgtatcgagcaattatatccatatcctgaaaaacaaatggctgctgtatttgagaaatacaaaggtgcagaatatgtttgggtacaggaagaaccatataacatgggcgcgtggggttacatcttacgtagaatgtatttgatgaacaatacaggtatcgaagttatcgcccgtgatgaagcatcttctccggcagtaggttatttaaaagcacacaacgaaaagcaggcagagcttgtgaaacgtgccttt

SEQ ID NO: 34095 - DNA, 1503 bp, Cytophaga hutchinsonii
gttcgagttcgatttgctccatcccctacggggcctttacatattggcggtgtgcgcacggctttatacaattatttatttgcccgtaaaatgggcggtaaaatgttgttgcgtatagaagataccgatcagaaccgttttgtaccaggtgcggaagcatacattcaggaagcacttgcatgggttggtattgtaatagatgaaggagccggcgttggtgggccgcatgcaccgtataagcagtctgagcgtaagccgatgtatcgggagtatgcagaaaaattaattgctgaaggaaacgcttattatgcgtttgatacatccgaagaattagaagctatgaaagagcggttgaaagcagcaaaggttgcttcaccttcttacaacatggttacacgtatgcaaatgaacaattcattaaccttgcctgaagacgaagtgaaaagacgtctggatgcaggagatgaatatgtaatccgtttgaaagttccgcgtaaagaagaaatacgcctgaatgatatgatccgtggctgggtagtagtacactcttcaaccattgatgataaagtattgttaaaatcggatggtatgccaacataccatttagcaaatattgttgatgatcacttaatggagatcacacacgtaatacgtggcgaagaatggctgccttctgcacccttgcatgtattgctttatcgtttcttaggctgggaagataccatgccgcaatttgcgcacttaccgttattgctaaagccggatgggaatggtaaattaagcaaacgtgatgcggatgcgggcggtttcccgatattcccgttagattggaaagacccggcaagcggagacacttggatcggctttaaacaacagggatatttacaggaagcaacgacaaacttcttagcctttttaggctggaacccgggtacacaacaagagttgtttaccatggatgaactgatcgaagcatttacagtagagcgtattggtaaatcgggaacgaagttcgatattaataaagcaaagtggtacaaccagcaatacatgcggcagttgcccgatgaaactttaacacgtttattaaaagaagaagcagataaacatcaggcaaaatatgatgcggctaaacttccattgatcgcgcagatgttaaaagaacgtttgacgtttgctaaagattactggatcgaaggacaattcttttttgaagcacctgaaacatttgatgagaaggtggcaagtacaaaatggaatgccgaagcagtaactgttatcagtgcgtacaaagaggcattagctgcttacacaggcgaattcaatgcagaaaacgtgaaacatgtattgcacgaagtactggaaaaagcggatgtcaaaataggcaagatcatgcaggcacttcgcctggctttaaccggcgcaggtgcaggacctgatctgatgcaattcatagaaattgttggaaaagaagaggcgataaaaagaatgcagtttgccctt

SEQ ID NO: 34096 - DNA, 855 bp, Cytophaga hutchinsonii
aaaggtattttattggcgggaggaacaggttcacgtttgcatccattgacattggcaatgagcaaacagatgatgccgatctatgataagccgatgatttattatccattatcctgtttgatgctggcaggaataagagaaatattaattatttctacccctcaggatttaccgaactttcagaagttgctaggtgatgggagtgcgctgggctgtagatttgaatacgctgtacagccctcaccggatgggctcgcgcaggcatttgtaattggagaacaatttatcggaaacgataaagtagcattaatcttaggagataatattttttatggctctggccttggccggttattgcattcacacaatgatccggatggcgcagtgatatttgcttatcacgttacagatccggaacgttacggcgttgttgattttgatgatgatatgaatgcattgtcgattgaagaaaaaccaatcaaaccaaaatctaattatgcggtaccaggtgtatatttctacgacaacagtgtaattgatatagctaagaatttaaaaccaagttcaagaggtgagcttgaaattacggatgtaaataaaatctatttagaaaaaaataaattaaaagttgctgtattgaacagaggtacagcctggctggatacgggtacatttgcttctttaatgcaggctggtgagtttgtccgtgtaattgaagagcgccagggtttaaaagtaggctgcattgaagaaattgcttataccatgaagtttataacaaaagaacaattggaggcattggcaaagccgttaatgaaaagcggctatggccagtatttacttggcctgatcaaa

SEQ ID NO: 34097 - DNA, 1224 bp, Cytophaga hutchinsonii
aatcaaacgttagctgttataggcttgggttatgtaggcttaccaattgctttagcttttgcaaaaaaagttaaagtaattggttttgatatcaattcgaaacgaatcgatatcatgaaaaaaaatatagatccaagcggcgagcttagagaaagtgattttttaaacagcgatattttttttacagctgaattatctgatttaaaaaaggcatccttttatattgttaccgtaccaacacctattgacgagtttaatcatcctgatcttgcaccacttgtttctgcaaccagaacaattgctaaagtattaaaacaaggtgattatgttgtgtatgaatctaccgtatatcctggatgtacagaagaagaatgtattccgttgctggaggaactttccggtttggtatgcggcaaagattttaaagtcggttattcgcctgaaagaattaatccgggagacaaggaacatacacttgctaaaattacaaaagtagttgccggctgtgatgcagaaagtcttgacatcattgcacaaacctatgagattgtagttgatgcaggtatccataaagcatcatccattaaagtagcagaagccgcaaagattattgaaaacacacagcgtgatgtaaacattgcactcatgaatgagttatctgtgatttgtgataaactaaacatcaatacgcttgaagtattagaggccgccagtacaaaatggaatttcctgccttttacaccgggccttgtaggcggacattgtattggtgttgacccctattacttaacgtataaagccagaaagcttggcttaaacccaaacgttattttgagcggcagattgatcaatgatcaaatgccgatgaacattgcaaaaaaaatcgttaagtctttaatcaaatccggtacagatatttcaaaaggacgggtattggtgttaggcgttacgtttaaagagaatgttgaagacataagaaattctaaggttgcagaattaataaaggaattacaatcttatagcctgcaggtagatgctgtagatccatacgcatcttttcaggaatttaaacatgaatataatttagatttttcaacagaaataacgggtacatatgacgttgttatattagccgtatctcataaagaatatcaaaaactgaacattgagtacttcgaaaacctgttaacagaaaaaggtatttttgtagatattaaaggacta

SEQ ID NO: 34098 - DNA, 1308 bp, Cytophaga hutchinsonii
atgaaaatagtaatagtaggaacgggatacgttggtttagtaacgggaacgtgttttgcagaagtaggtatcgaagttgtatgtgtagatatcgatcagaaaaaaatagacaatcttaaaaacgggattttaccgatatacgagccaggcctggaagaaatggtagaacgcaacgttaaaaaggggcgtttgaagttttctacagatttatctcaaagcattgttgatgcagaagtagcctttattgctgttggtacccctcccggagaggatggaagcgcggatctgaaatatgtattggctgttgcaactgcaatcggacaatctatgaaaaatgatattgttgttgttacaaaaagtacggttccggtaggtacttccttaaaagttaaaaaagcacttcaggaagaactgggaaaacgtaatgcttccttaacggcatatgtatcttccaaccccgaattcttaaaagaaggtgccgctattgatgacttcatgaaacctgaccgtattgtggttggtatagatgctcctcaggcagaagaaaccatgcgcaaattatacaagccgttcctgttaaacggtcacccgattttcttcatggatattccttcagctgaaatgactaagtatgcggcaaactctatgcttgcaactaagatcagctttatgaacgacattgcaaacttatgtgagatcgtaggtgcagatgttaatctggttcgcaaaggaatcggttcggatgcacgtatcggaaataaattcatttatccgggtgtaggttatggcggttcctgttttccaaaagatgtgaaagcactgatcaagacagcgaaacaaaacgggtacgacatgcgcgtgttaagcgctgttgaagatgtaaatgacgatcagaaatacgtacttgttaaaaaagtaaacaagtatttcaacaacgatctgaaaggaaagaaattcggcgtttggggtttatctttcaaaccaaagacagatgatatgcgtgaggcgccatcattggtaatcattccggagttattaaaagcaggcgcaagcgttattgcatatgacccggttgccatgcatgaagcatctcatacattaaaagacaccatcacctatgcacaggatccgctggaagtattggagggtattgatggattactgatcgttaccgaatggtctgaattccgttctccggattttgacgtggtaaaaagcaaaatgaagggtaaggcaattttcgacggaagaaatatttatgatcccaaagaaatgaaaacactgggatttgattactactgcatcgga

SEQ ID NO: 34099 - DNA, 1137 bp, Cytophaga hutchinsonii
atgaatttagaacctactgaaaaccaacggctcattgcttcaatggccaaggatgttgcagaaaaatacattcggcccaatattatgaaatgggatgaagtacaggaatttcctgtagatctgtttcacaaaatgggtgagttcggtctgttaggtgttttagtaccggagcagtatggcggtgcaggaatgggatatttcgaatatataactgcattagaggaaatatcaaaagtgtgtggttcgataggtttatcaatggctgcgcacaattcactatgtaccggacatattctggcgtttggtaatgaagaacaaaaagctaaatatcttccgctcctggctaccggcaaatggattggagcctgggccttaacagaagcaaatacaggatcagattccggaaatatgaaaacggttgccaggcaagacggtgattattggattctgaatggcagcaaaaactttataacgcacgctaaatcctctaatgtagtagttgtgctggcacgtcatgcagatagtgaagacaagaaattctcttcggcctttattattgaaaaaggtacggaaggccttacacatggccgtaaagaaaataaaatgggtatgcgggcttccgaaacctgcgagttattgctagataatgttcgcgtgcataaaagtcagcttctgggaaatatcggagacggcttcaagcaagcgatgaaagttttggatggaggcaggatttcaattgctgcgttaagtttaggtatcgcccagggggcatatgaagcagcacttcagtattcaaaagagcggcagcagtttaaccagccaatcggtaattttcaaggtatctccttcaaactggtagatatggctacagaaattgaagctgcccgcttattaacatataaagcggcagatatgaaaatgaagggacaacccatgacacgtgaagcagcaatggcaaaattatatgcctcagaagtatccgtacgtgttgcaaatgaagccgttcaaatttttggggggtatgggtatacaaaagattacccggtagagaaattttacagagacgcaaaactctgcacaattggggagggaacttctgaaatacagaaaattgtgattgccaagtccttacaaaaa

SEQ ID NO: 34100 - DNA, 1254 bp, Cytophaga hutchinsonii
atgccttatttatttacatcagaatctgtttctgaaggtcacccggataaagtagcagatcaaatatcagatgctcttattgatcactttttagcatttgatcccaatgcaaaagtagcttgtgaaacattagtaactacaggtcaggttgtattggctggtgaagttaaatcaaaggcatatttggatgtgcaggaaattgcacgtgaagtaatccgtaaaatcggatacacaaaatccgagtatatgtttgaagcaaactcctgcggtatcttctctgctattcatgagcaatctgcagatatcaatcagggtgttgaccgtaagaaaaaagaagaacaaggcgcaggtgatcagggtatgatgtttggttatgcaactaacgaaacaaatgattatatgccattggcacttgatcttgcacataaactattaatcgaacttgcggcacttcgtcgtgaaggcaagcaaatcaaataccttcgtccggatgcaaaatctcaggtaacacttgagtatgatgataacaaccgcccggttcgtattgatgcaatcgtactttctacacagcatgatgatttcgatacagaagaaaaaatgcataagaaaatcgaaaaagatattgtttcaattcttattccgcgcatcgtttctaaatatccgaagtataaaaaattctttgatggaaaaacaaaaatcaaatatcatatcaatcctacaggtaaatttgtaatcggtggtccgcacggcgacacaggtttaactggcagaaagattattgtagatacatacggtggtaaaggtgcacatggtggtggcgctttttcaggtaaagatccatcaaaagttgaccgttctgcagcgtatgctacaagacacattgctaaaaatttagttgcagcgggtttgtgtgacgaagtattggtacaggtatcttacgcaatcggtgttgctaaaccaatgggtatttatgtaaatacatatggtacagctaaggttaaaaagaacgatggtgagattgctaagatcgttgagaaactgtttgatatgcgcccttacgctatcgaacaacgtctgcagcttcgcaacccgatttacagcgaaacagctgcatatggccacatgggacgtaaaccggagacggtaacaaaatcattcaagagcaatgatggaaaaataattaagaaaaaagtcgaattgtttacatgggaaaaattagactatgtagataaagtaagaaaagcgtttggtatt

SEQ ID NO: 34101 - DNA, 2427 bp, Cytophaga hutchinsonii
cagccggttaaaaaagagacgcctaaagcggaaacgcagaagcctcctgttgccgataaacctgctgaaaaaacaccagttgttgaagagcctgcggcacctgttgcagacgttccagtgcaagttgttcaggcacatgctgacaaactgcagggtttaactgtacttggtaaaattcaacttccggataaaaagaaagaaccaacacgtgtggcttcttcggatgaagttgtagataaaaataaaaataagcgtaagcgcaaacgtcttaacgacggacccaataaacctgccggagctaatccgaacggaccaagaccagctggcagcaatccaaacgggccaagaccgcaaggtactaatccgaacggaccgagaccacagggccagggtggtaatccgaacgggccaagaccagccggcggaccaaatcgtccgggtgttccgaaccgtcctaacagcaacggaccaaaacctacgttaacaaaagcaagcgaaaaaggtgaagtaaccggaaaacagattcaggataaaattaaagctaccatggcaaaattgtctggtggcggtacaaaatccggtccggttaacagagccaaataccgtaaagataaacgttctgcaatggcagatgctgaagaagaacgtttaatggcggagcaggaagatgctaaatcgttaaaagtagctgaatttatttctgcaagtgatttagcatctcttatggatgtgagcatcaatgaagtaatttctaaatgtatggcaatgggtatgtttgtatccatcaaccagcgtttggatgctgaagcgatcaccatcattgcagatgagtttggttatgatgtaaacttccagactacaggtgaagaagacgatgttacagatgtagatcaggatgatcctgcatccttgattgatcgtgcaccgattgtaaccatcatgggtcacgtcgatcacggtaaaacttctttgcttgattatatccgtaaatcaaaagttgtagcgggtgaagccggcggtattacgcagcacattggtgcatacaatgtaatgaccgattcaggtaaaccgattacattcttagatactccgggtcacgaagcctttacagcgatgcgtgcccgtggtgccaagatcacggatattgtaattattgtggtagctgccgatgactcggtgatgcctcagacaaaagaagcaatcaaccacgcgcgtgtagcaggtgtaccgattattattgcaatcaataaaattgataagccagctgccaacccggataagattaaagaagaactttcgaaagaaaatattcttgttgaagactggggcggtaaataccagtgccaggcaatttctgcaaaagcaggaaccggtatcagcgaattgcttgataaagtattgcttgaagcagagatgcttgaattaaaagcaaacccggataaacgtgccattggtgcggttatcgaagcgtctcttgataaaggcagaggttatgtaaccaacgtactggttgaagcaggtaccttacgtattggtgatatcatcttagcgggtgcacacttcggccgtgtgaaagcaatggttgaccataccggtaaaaaattaaaagaagcaggaccagccatgccattacaggtattgggtcttaacggtgcaccacaggcgggtgacaagttccaggtaatggagacagaacgtgaagcgagagagatctcttctaaacgtgagcagttattgcgtgagcaaagcatccgtaccaagaaacacattacattggatgaaatcggccgtcgtttggcgatcggtaacttcaaagaacttaacatcatcgttaaagccgatgtggatggttctgtggaagccttgtccgattcattattgaaattatctaccgaagaaattcagatccgtatcctgcacaaaggtgttgggcagatctctgaatcagatatcttactggcatctgcatcggatgcgatcattgttgccttccaggtacgtccttctacaagtgcacgtaaacttgccgagcaggaacagattgagatccgtatgtactcaatcatctacgacgcgatcaacgaagtgaaagatgcgatggaaggtatgcttgagccgaaaatggaagaggttgtacttggtacaatcgatgtccgtgacgtattcaagatcaccaaagtgggtaccgttgccggggcatatgtatctgaaggtattgttaaacgtaataaccaggttcgtttgatccgtgatggtattgttatgttcacaggtacaatcagtgcattgaaacgtttcaaagacgatgtttctgaagtgaaaacaagttatgaatgcggtatcagcttaaaaggatacaacgacattcagatcggtgaccagatcgaagcattcgaacagaaagaagttaaacgtacactgtagtta

SEQ ID NO: 34102 - DNA, 735 bp, Cytophaga hutchinsonii
atagaatctaaggtcgttgtattggtccgcactacgcattcaattgcaaaagcagccgcagaaaaattttgtgatcagggttttcgtgttgttttgtgggaagataataaaacgaaagtagatgaaagcatcatcgcatcctgcaatttgagaaaaggatcgtgtgtcgtggaaagttttgatttcagcatacaggataattttgaaaaagcagccgtgcatgttattaaaaaatacggacgtattgatgtactcgtaaacaatcccaaacttgctccggtatcaaaagtgccgaatctgtctacagaagcctggcacgaaaccattgatgcaaatctctctgtattcctgaattcaataagtgtgatagcaccctttatgcagcaacagaaaataggcagcatcatcaattgctgtttacctttgcgcatacacgatagcttaacagacaggcattatgacggcatccgcgagggcgttaaaggcatcacacaactttgggcaagagaacttgggcaaagcggcattacagtcaatacaattattccgggttacatagaagaagataatttgcctttggctgattccgcagaactgacacagttccgcttgaaaattccggtacgccgttttgctaaagcgcttgatgttgttaatgcctattcatttttaataaccgatgacgcatcttatattaccggtacagagctggtgatcgatggcggtgtacggata

SEQ ID NO: 34103 - DNA, 1257 bp, Cytophaga hutchinsonii
aatttcaaatccatcagtttaacatatagaaaagcaccgcttgaaatccgtgagcgtgttgcattaaacgaagcagaatgtaaaagtttgatgttacgaatcaaagattttacagatactgctgaattactgatcctttctacgtgcaaccgcaccgaaatatactatacttccaacgaagattacagcaacgatattattaagttgcttggtgttgaaaaaaacatcaccggactgattcagcaaaaagaatattttgaaatatacaacgaacaggcagatgctgtactgcatttgtttgaagtaggcattggtcttgactcacaggtagtaggtgatatgcagatcgtaaaccaggtgaaatatgcataccaatggagtgcagatctgaaccttgccggtccgtttttgcaccgattgatgcacacgatcttcttcaccaataaacgtgtggttcaggaaacagcgttccgcgacggagctgcatctgtatcgtacgctactgttgagctttcagaagaattgctgagtgccacaccgaatgcaaacattttaattgttggccttggtgaaatcggtgccgatgtatgccgtaacttcaaggcaaatacgtctttcaaaaatattaccttaacaaaccgctctccgcttaaatcagaagccctggctgctgaatgcggcattgaacacgttccttttgaaacactttgggaagccgttgccaaagctgatctggtgatcagttcggttgcaaaagaagagcctttattcacaaaagaagagatacagaaattatcgattctttctcataaatactttattgacctgtctgttccgagaagtgtagacgcacgcgcggaagaattgccgggtattattgtgtacgacatcgatcatatccagaaccgttcaaacgaagcgctggagaaccgattgaatgcgattccgcatgttcgcaagattattcttgattctattgttgaattcaatgagtggtctaaagagatggaagtttctccaacaatcaacaaactgaaaaatgccctggagcagatccgcaaagaagaattatcgcgctttgtgaaacagttaagtgatgaagaagctaaaaaggtagatgaaatcacgaagagcatcatgcaaaaaattattaagcttcctgtactgcaattaaaagctgcctgcaaacggggcgaagctgaaacattgattgatgtattgaatgacctgtttaatctggataaacaaccggaacaa

SEQ ID NO: 34104 - DNA, 1485 bp, Cytophaga hutchinsonii
ggtaaaatcactcagattattggtccggttgtagacgttggatttgaaggagagtacgctcttccgcaaattttagatgcattggaagtaactcgtccggatggacaaaaagtaatccttgaatgtcagcagcatttaggagaagatcgtgtacgtacaatcgcgatggactctacagatggtttgacaagaggaatggaagttaaaacatacggtatgccgatttctatgcctgtaggcgaagatatccgtggccgtttatataatgtggttggcgatgcaatcgatggtattccatcgggagtagctgctaaccgtatgtcaattcaccgtcaggctcctaaatttgaagatttatctacaaatacagaagtattgtttacgggtatcaaagtaattgatttgcttgagccatatgtaaaaggtggtaaaatcggtcttttcggtggtgccggtgtaggtaaaacagtgttgatcatggaattgatcaacaacattgcaaaagcatatgcaggtctttctgtatttgccggtgttggtgagcgtacacgtgaaggaaacgatttgcttcgtgaaatgattgaatcaaacgtaatccgttacggggatgaattcaaacattctatggaaaaaggagagtgggatttatctaaagtagatgctactgaattattaaagtctcaggcaacattggtgttcggtcagatgaacgaacctcctggagcaagagcaagagttgcgttggctggtcttacagttgcggaatatttccgtgatggagatggccagggccagggccgtgatatcttattctttattgataacatattcagatttacacaagcaggttcagaagtatctgccttgttaggtcgtatgccatctgccgtaggttaccaaccgacattggcaacagaaatgggtgcgatgcaggaacgtattacttcaacaaaaagaggttctattacatctgtacaagccgtttatgtaccagctgatgatttaaccgatccggctccggcaactacatttgcgcacttggatgctacaacggtattgaaccgtaaaatttctgaattaggtatctatcctgctgtggatccattggattctacatcacgtatccttagccctgaaattttaggtagcgaacattacgattgcgcacaacgtgtaaaagaaattttacagcgttacaaagaacttcaggatatcatcgccattcttggtatggatgaactttctgaagaagataagcaggcggttcaccgcgcgcgtcgtgtgcaacgtttcttatctcagcctttccacgtagcggaacagtttacaggtctaaaaggtgagttagtaaatattaaagatactatcaaaggatttaacatgatcatggacggtgcattagaccacttgcctgaagcagcgtttaaccttgtaggtagcattgagcaggcaattgctaaaggcgagaagcttgttgctgattct

SEQ ID NO: 34105 - DNA, 1107 bp, Cytophaga hutchinsonii
atcaaaccattggggaccatcttcatcaaactgcttcaaatgcttgcgatcccgctaatcatcacatcgatcattagcgggatcgcaggtttacgggatatcaataaacttggccgcattggcggccgcacgcttgttctgtttaccattacctgcttcacgtccacaattctgggcgttatactggcaagtgcatttacaccaggcaatgccattccggaaaaaacaaaaagcgaattatttgcatcgtatcaggataaaacaaccggactgatagataaagcgcagcaaggcaccggcagtgctatggatatgatcacggaaatgtttccgaataatattttttatgcgatgagcaataatggtatgatgctgcaggtagttattttttctattttattcggcatagcattatcaaaagttgatgtttcaaaatcagagattgttattcagtttgtcgaagggttaaatgaaacctttatgaaactggttatgctgattatggggatcgctccggttggtgtattcgccctgatcgcatcgattagttttgatgccaaagtttttttatctctgctgtattatatgcttacagtcattgcaggactggctgttatattatttattctgtatccgcttattatccggttgttttcaaaaatttcctatggaaagttttttaaaactatgcagccggttttcttaatggctttttctaccagctcaagcgcggcaacattacctgttacgatggaacgtgtttcaaatggttttagtatcaaaaaagaaatttctgattttgtcctttcactgggtacaaccataaatatggatggcactgcattgtatcaaagcattgcagctgtatttattgcacaggcaacaggaatcgatcttacactcggacaaatggttatcattgcattaacagcaacgctttcagcagttggtgcggcaggcattccgggtgcaggcatgatcacactgatcattgtattagacgccattcatgtaccaattgaagcaattgcttttataatggctccggatcgtttactggacatgttccgtaccgttattaatgtggcaggtgatgcctgcggtgcg

SEQ ID NO: 34106 - DNA, 1068 bp, Cytophaga hutchinsonii
atgagcaatacatacggcacaatatttcgcattacaacctttggagaatcacatggtaatgctgttggagttatagtggatggttgtccgcctaatatcgaaatcgacgaagcgtttattcaatctgaaatggcccgcagaaaacccggtcagtccaagatcgttacacagcgtcaggaagacgatgagatagaaattttatccggtgtatttgaaggaaaatctaccggtacgcctattgctatgatggtgcgtaacgccgatcagcgcagtaaagattattcacacattgcagatcgtttccgcccgtctcatgcagattacacctatcaggaaaaatatggcttccgtgattaccgcggcggcggcagaagttctgcccgggaaacgctggcacgcgtagctgctggcgcactggctaaaatgattctggctaaagtaaatattaagattcaggcatatgtttcacaggttggtccgttgaaacttacgaccgattataaagcactgaatattccgaacgcggaaaccaatatcatccgttgtccggatgatgctgtagcagcaaaaatgattgaatttattgatgaaacacgtaaaaataaagataccattggtggtgttgtaagctgcgtaattgaaggtgttccggttggtttaggcgaaccggtatttgataaactgcatgcagaacttggcaaagccatgttaagcatcaatgccgtaaaagggtttgaatacggaagcgggtttgaaggtgtagaacagttcgggtcacagcacaacgataaattttatgcggatgaacagggcaatgtacgtacacaaaccaacaattcaggcggtattcagggcggtatcagcaacggagaagatatttatttccgcgtggcatttaaacctgtagctacaattatgattgaccaggaaagcatcaacgacaaaggtgaaacggttactgtaagcggtaaaggccgccatgacccatgcgtggttcccagagccgtaccgattgttgaagcaatggcggcaattgttatggtggatttctacttaagaaataaagca

SEQ ID NO: 34107 - DNA, 1179 bp, Cytophaga hutchinsonii
agaattgttgttacagggatcggtattataagcgccatcggcgattcgcttgaaagcaaccggtcatcgttgcaaaaaaaagtatgcggcatcagtacggttgaactttttcaaacgcgttatgcagccatacttccttttggtgaaataaaatacacgaacgaatctctgaaacaacagctgaacgtaaatacccttaatgtaacgcgtacaagcctgcttgcgcagcatgcctttgaacaagctatacgcgatagtgcattaaccgctgcagaagtttcttcttttgatactgcctttataaatgctacaacggttggcggcatgtgcctgaccgatgaattataccgggacgcgaacaatcaatccgatcattcgccctatgttacctcgtatgatcttgcatctgttgctatttatttacaggagcttcataacatacagggcatctgcaatacaattaatacagcctgctcttcgtctgcgaacgcaatcatgtacggagcccgcttaattaaacaggggaaagctaaacgcgctattgttggtggtacagacagcctggcaaaatttaccattaatggttttaatgcgctgcatatcctatcacctgaaaaatgtaaaccatttgatcagaacagatcgggtttaaatttaggtgaagctgccgcatttttagtattagaaacagaagaaaactgtaaaggtaaaaaagcgtatgccgtattaagcgggtatgcaaatgcaaacgatgcctaccatgcttcagccctctccgatacaggtgatggcccttacgaagcaatgaagcaggcgctgaatgtagcgaacctaaaagcatctgatatcagctttgtcaatgcacatgggacaggtacagaaaataacgacaaggctgaaagttttgccatgcagcggatcttccatactcctcccccatttgcttcctctaaatcaaatacggggcatacacttggtgcagctgccgcaatagaagcggtgtacagcatattgtccatcacacatcaggaattatatcctgaaataaattttgaggtgccaatcgaagaaaccggattgatacccctacagacattccggcaagcacctgtaaaacatgtaatgtcaaattcatttggctttgccggaaattgcagttcacttattttctcttccctg

SEQ ID NO: 34108 - DNA, 654 bp, Cytophaga hutchinsonii
aatttaactgtttttgaaggcgaacgctttggtttatttggaccaaatggtgccggcaaatccaccctaataagccttatgacaggcttgttaaaacccgtaagtggcgtggtgactttgttcaatgaagatatccatgcaaagtgtacgcggaaattattcgggtttgtgccgcaggatttctctctgtatgatgaattaagcccgatcgaaaatttacagttcttcggtgcatgggcaggcttgtctaaaaaagaaataacaaaccgaacaacagagcttctggatatattaggattgacagatgttaaacataaagcagtcaaaactttttcaggaggaatgaaacgcagggtaaatctggctattggtgtaatacaccagccccgtattttatttttagatgagccaaccgttggtgtagatattcagacacgccatgcgattattgaatatttaaaacaattgaataaagcaggtatgacccttgtctatacctcacatcagttagccgaagcagaaagtctgtgtaacagaattgcattgatagacaatggtcaactgattgcatgcaatgacattccggatctgttagcctcacatcatgaagaagacctcgaatcccttttcttacacttaaccggtaaagcattt

SEQ ID NO: 34109 - DNA, 2121 bp, Cytophaga hutchinsonii
ccatcatatatataagaacgaaaggagtaaaagatgaatgacgaaaaaagattaattattgtagcatatagaataccttttaaagttacgtttaaagaaagcggagagcgcgtattacaacaaaattcaggagggcttgtttccgctatcctatcattggcagaaaaaggagatgtgtttggtaaaaatcaaaaaattcattggtttggttattccacaccagatattttacaggagggagaaacgcaggttgaaaatgaaaattttattgtacatcctgtcttaattgaagatgcactaaatgatgcgtattacgaaggattttgtaacagtacgatttggcccatttcgcattattatccctatctcaccagctttaatgaagaggattatgaagcgtatgtaaaagcaaataaaatatttgcagatcagattaatgcctttatccgtccgggagatatggtctggatacaggattatcagctgatgttattgcctggcatgctccgttcagaaaatccggatgcttctatcggttatttccatcacatcccttttgcaacgtttgaaatttttcgtttgcttccgaaacaatggcaaacagaattgttaaaaggtatgatcggcgcagatctggttggttttcataccaatgattacagccagtattttttgagaagtgtgcagcgtgtattaggctatgatactactgcccgcgacataagtattccaaacaggatcgtgcgggtagacacatttcccatcagcattgattataataaatttcaggaattgtataatgatccgggcgtaattgaaaaaaggaaagagtttttaaaagacctcagtgcagagaaaaatattttttccgttgaccggctagattattcaaaaggattgatccatcggttaaatgggtttgaatattttctggatcagtatccgcaatggcatacacgtgttgtacttacaatgattgtagttccttcgcgtgaaacaatcctgaagtatgctgagatgaaacacgaactggaagaagcggtaggccgcattaacggtaagtacggtaccttaggctggcgtccggttatatatctgtaccgttcgttaagctttgaagaattaggcgcgttatatacactggccgatgtggcactcatcacgcccatccgtgacgggatgaatttagttgcaaaagaatttgttgctacgcgtaccgataaaaaaggcgtattgattttaagtgaaatggcaggtgcgtcgctggaattgaatggtgcaatactgatcaacccaacagacaagaggacactggccgcagccattattcaggcattaaccatggacgagcaggagcagacacaacgtatgcagatgatgcaggaccggatccgtgtgtatgatatatttaaatggacagaagactacatggatcaattagatattataaaattgaaacaaatggaattcgaagagaaaattataaaccaggatgtgttaaaaagtttcaaacagatttttgatgaatcaagccggcgcttgtttttattggattatgacggaaccttatctcccattgttcctgacccctccagttctaagccaagtgtaggtattgttgatgtattaaaaaaactcagcagtgattttaatgtaaatgttgctatcataagcggaagagataaagagtttttgaattatatctttgatccaaatacaattctgtctgcagagcatggcgcgttcttacgtattccgggtcaggattgggagctgcaatatgattacaatgatcagtggaagcgttctgtattgccggtgtttcagaagtataccgatcgttgcgccggatcttttattgaaaataaatcaacatcacttgcctggcattacagaaatacagaaaaagaatatgctcatatccgttccagagaatttattgaagaactggaaaacaaagttgggataaaatcaaatctcgccattattgatggtgataaagtaattgaaatgaaaccttctgatgtagataaggggattgctgcgcggaaaatatgtgatctgtatcagccggattttattttatctattggagatgaccggactgatgaagacatgttt

SEQ ID NO: 34110 - DNA, 1704 bp, Cytophaga hutchinsonii
attttaagtagattatttcaatttgtaaaaccttacaaaaatctattttacacacaggtagctttaacccttacaggagcagtacttgcatcggtaaaaccgtatttagttaaagttgccattgacgataaaattgccagccatgacctgaatggtttgtatgtaatgattggcttaatggttgtggtgttagttgcgcaggcattcatgcagtattttgatacctatctggcaggcaaactcggacagacaattattcgcgatatccgaatccgtttattcaaacatttattaaaattccgtttgggcttttttgacaaaacacctatcggccgtttggtaacccgcaacatatcagacattgaaacactttcgaattttacatccgacggattagcaggcattctgggcgatttccttcagttgattttcatctttggttttatgctgtatatcgattggcgtttaacgctgatctgtttgtgtccgctgccaatcttattattcagtacctatgtatttaaggaacgcatcaaacattcgttcaacgaagtgcgtattgccgtttccaatctcaacacctttgttcaggagcatattaccggaatgagtattgttcagatctttaacagcgaacaacgcgaatatgcgaaattcaaaaagatcaatattgaacaccgcgattcaaatttaaaatcggtaaacgcatactctgtttattttccgattgctgaatttatcggatcgctgggactggtacttctaatatggtttggttctacactggtattaggcgaaacaagttctttcggaacgctcgtttcatttatcatgtacatctctatgttcttccgccccatacgcatgatcgcagaccgcttcaatacattgcaattatctgttgtaagttcagaccgtatcttaaaattattagacgaccatacgcccattcagtcaaccggagaaaaaccgttgcctgaaattaaaggagatgtgcagttcaataatgttttcttcagctacatcgaagggcaaacggtactaaaagatattaatttccatgttccgcagggcggaagtattgcctttgtaggttcaaccggtgcgggcaaatcttcgatcatcaatttgctgaatcgtttttatgatatcgaaaaagggcatatccttattgatggtaccgatatccgtgattataatctgcatgaactgcgtttacagattggtttggtattacaggatgtgtttttattttcagggagtatccgtaataatatcacgctctataacccagacatcacagatgaaaaaatatgggaagctatccgtatggttggcgcagaacgtttcatagagcgtttacccggagggctggattatgaagtaatggagcgcggcagcaccctttcttccggtcagcgccagattatttcctttatccgtgtaatggtttatgatcctaaaatattaattctggatgaagctacttcttctattgattctgaaacagaagaactgattcaggaagcaacggcaaaaataatgctgggcagaacgtctattattattgcacaccgcttatcaacgatacagcacgtggatacaatttttgtattggaaaaaggcgaaatagtagaatccggttcgcatgaagtgctgttaggccagcaggggctttacagccagctcagcgcgctgcagtac

SEQ ID NO: 34111 - DNA, 1275 bp, Cytophaga hutchinsonii
gatgcgttgaatgctgcaatcggtgcatataaaaatggtaccggcgaatggccgactatgtctgttgaaggccgtatccgtgccatggagaagtttgttaaagccatgaaatcaaaacgcacagaagtggtaaaaacattgatgtgggaaattggtaaaaacattaaagactctgaaaaagaatttgaccgtacggtagaatatattttagataccattgaggcatacaaaaagttagaccgtacttcttcaaactttcagtttgagcaaggcatcatcggaaagatcagacggagcccgcttggtgttgtattgtgcatgggaccatacaactatccgttaaatgaaacattcacaaccttgattccggcgttaatcatgggaaataccgtgatcttcaagccagctaaaattggtgtattgctgcaccgcccgttacttgaggcattcagagattctttccctaaaggtgtaatcaatgtagtattcggccgcggccgtgctaccgttggaccattgatgacaacgggaaaaattgatgtgttagctttcattggtacaagtaagtctgcaaacatcatgaagatgcagcatccaagaccaaatcgcttacgttcggttcttgccctggaagcgaagaatccggctattgttttaaaccacgcagatcttgatcttgctgtaaaagaatgtgcattaggttctttatcctataatggccaacgttgcacggcattaaaaattattttcgttcagaaaaatgttgtcgatacattcatcaacaaattcctgaaagaagttgaaggattgaagtggggtatgccatgggaaaacggcgcacagatcacacctttaccagagccggaaaaaccaggcctgttaaaggaattgattgaagatgcggaagtacatggcgctaaagtaatcaatgcaggcggcggtactattgagcataccttctatgccccggcagtggtatatccggtaaacaataaaatgaaattgtattacgaagaacaattcggacctgttgttccgattgttgcttacgataaaattgaagaagttattcagtacatggttgaatcaaattacggccagcaggcaagtatcttcggtacagataatgatgaaatggctacgttgattgataatctcgtaaatcaggtttgccgtttgaatattaacagtcaatgtcagcgtggtccggatgtatatccgttcacaggcagaaaagattcaggagaaggcacgttatctgtttcagatgcgctg

SEQ ID NO: 34112 - DNA, 762 bp, Cytophaga hutchinsonii
ttaggtggagctgctacctacatcggtttatcttcttcttatttcaaccctaaaataaatcttgttggcgttgtcggatctgattttcctgaatcagacataaaaatgcttcagtctcattccatcaatacagaaggccttcagatcaaagaaaacgaaaaaacgtttttctggtctgggcgctaccacaacgatatgaacacgcgtgatacgcttgttacagaattgaatgtgttaggaacgtttgatcctattattcctgcatcttaccaggattgtgaattcctgatgctgggcaatcttgcaccagctgttcagcgctcggtgattgaacggttaaaaaaccgtccgaagctgattgttatggataccatgaatttctggatggacattgcaatggatgatctgaagcagacattagcattgatagatgtattatctatcaatgatgaagaagcacgtcagttatccggtgaatattcactggtgaaagctgcacgcaagatcatagcaatggggccaaaagtattgatcatcaaaaaaggtgagcacggtgcgttgctgttcaatcaggatcaggtattctttgctccggccttaccgttggaagatgtatttgacccgacaggcgcaggtgatacatttgccggcggcttcatcggttacattgcaagtacaaaagatacttctttcgaaaatatgaaacgtgccattatttatggttcggcaatggcttctttctgtgtagaaaaattcggcaca

SEQ ID NO: 34113 - DNA, 1269 bp, Cytophaga hutchinsonii
tttgaaacattacaattacacgccggccaagaagtagaccctactacacagtcacgcgcagttcctatttatcaaacaacttcttatgtatttaaagattccaatcacggagctaatttatttgcgctgaaagaatttggcaacatttatacgcgtatcatgaatcccaccacagatgtgtttgaaaaacgcatcgctgcgctcgaaggcggtgtagcagcacttgctacatcatccggacaatcggcacagttcattgcattaacaaatattctgcaggcaggagataattttgtaacgacatcatttttatatggcggtacatacaatcagtttaaagtttcatttaaacgattgggtattgaggcgcgctttgccgaaggtgatcaggttgcaagttttgaaaaacttattgatgccaaaacaaaagcactgtatgtagaaaccatcggcaatccggagtttaatattccggattttgaagcttttgcagcattggcaaaaaaacatgacctgccgttgattgtagataatacgtttggtgccggcggatatttattcagaccattggaacatggcgccaatgttgtagtggagtctgcaacaaaatggatcggcggacatggtacttctgtaggcggtgtaattgttgacggtggaaattacaattgggggaatggtaagtttccgcaattctctgaaccatctgaaggatatcatggattagttttctgggatgtgttcggaacaaacggtccgtttggaaacattgcgtttatcattcgcgcgcgcgtggaagggctccgcgattttggtccgtctcaaagtccgttcaactccttcctgttactgcaaggtttagaaacactttcattacgtgtggatcgccatgtacagaatgcacagaaacttgcagaatggttagagcaacatgcagatgttgcaaccgtaaattatccgggtttgcaaagcagcaaatatcataacttggcaaaaaaatatttaaaacgtggttttggcggcgtattatcttttgaaattaaaggcggaaaatcacgtgcggcacagtttataaacagcttgaaattagcaagccatcttgctaatgtcggcgatgctaaaacgcttattatacatcctgcttcaacaacacatcaacagttaagcgatgaagaacaaaaagtagcaggtgtatcagccgggctgttgcgcgtgtctgttggtattgagcacatcgatgatattattgcagattttgaacaggcattt

SEQ ID NO: 34114 - DNA, 993 bp, Cytophaga hutchinsonii
atgaaagtagctattaacggcttcggtagaatcggaaggatttcttaccgggcattattaaaaaagaaaaacatagaagttgttgcgatcaatgacctgacagatactaaaacgctcgcacacctgttcaaatttgattcctcgcacggggtatttgacggagaggtaagttatgatgcagagaacctaatcattaatggtaaaaaagtaaaagtgctatccgttaaaaatcctgctgacctgccatggaaagccttgggtgttgacgttgtattggaatcaacgggcttctttactgaaaaagaaaaagctgaagcacacattacagccggtgcaaaaaaagtaatcatctctgctcctgcaaccggtgatttgaaaacaattgtattaggcgttaacgacaacattctggatggcagtgaaaccgttatttcaaatgcatcttgtacaaccaattgtttagcgccaatggttaaagtattggaagacaattttgggattgaaagtggttttatgaatacgatacacgcatacacatccgaccagcgtctgcaggatgcgccgcacaaagacctgagacgtgcccgttcagcagcgctgtctattataccaaccagtacaggagctgctaaagccttaggacttgtgatcccatcggtacaagggaaattaaatggcacgtcgttacgtgtacctgttccagttggttcaatcacagactttactgcaacattaaaaagaacggtaactaaagacgaaattaatgcagcgttcaaaaaagcagctgaagaaggaagtctgaaaggatacttagcgtattcggaagatcctttggtatccgttgatattgttggcaatccggcatccagtatctttgacagtgaactaacaatggtacagggaaataatgttaaagtattcggctggtacgacaacgaattcggttattcaaaccgcacggcagatttgatcgaactggtaggaaagcagatc

SEQ ID NO: 34115 - DNA, 1536 bp, Cytophaga hutchinsonii
aaaattaaagggtttcgtgataatacgattgattcagaaaagtttcgttctttccgtttaacgcgtggtgtttatggccagcgtcaggaaggtgttcaaatgattcgtattaaattaccatacggaaaagttacaacagatcagatcattcgtattgctgatatttctgataaatatggttcaagcaatctgcatttaacaacgcgccaggatatacagcttcactatgtgaagcttgaaaatgccccattggtttggaatgaactggaagaagttggtgtaacgcttcgcgaagcctgcggtaacgcggttcggaatattacggcatcgtatactgccggtgttgatccaaacgaaccgtttgatgtttcgccgtatgcacacagcatgttcgaatattttttacgtaacccgatctgtcaggatatgggccgtaaatttaaaatatcattttcaacctcagaagcggatactgcgttcggtttcattcacgatcttggttttattccgcgtgtgaaaacggtaaacggtaaagaagtaagaggttttaaagttttattggcaggcggtttgggtgcacagccatttgttgcgcataacgtacacgaattcctggaagaagatcagctgattcctttctctacagctgtcatccgtgtgtttgaccgctttggcgaacgttcaaaacgtcataaagcgcgtttgaaatatttagtaaatggtatcggcgttgaagcgttcatggagcacgttgcgaaagaacgtatcgcgattaaagataaatcggttgttatcgaccgcaatcgtgtagatgaaatcattcttcctgcggtaacttcattcacggaagcaacgccggtagatgctgttaagtttgaacgttttgttaaagcaaatgtatttgaacaaaaacaaaaagggtattttggtgttcagttaaaacaacacctgggtgatttgaaaagtgacaaggcacgcgtgtttgctgctattgtaaaaaaatatgcatcggatgatgtccgcatcacagttaaccagggctggttattaaagtttgtaaagaaagaagcacttccagcattgtttaatgaattaaacgaaatcggattggctgaaccgggctttgacagtatggccgatattacagcttgcccgggtacagatacctgtaaccttggtatttcaagcagcacaggactttctgttgaaattgaaaaaatgctgctggaagaatttccggataccgtattcaacaaaaatattaaaataaaaatcagtggctgtatgaatgcgtgcggccagcatacaatcggaaacattggtttccatggtatgtcgatcaaaaatggtacgaatgtattgccggcgatgcaggtaatgttgggcggcggtctggagccggacggcacaggtacgattgcagataaaattcttaaacttcctacaagacgttgtgtagaggctgttcgtgaaatcttaacagactacgatacgaatgcaacggaaggggaatatttcaacgattattacagaaga

SEQ ID NO: 34116 - DNA, 1140 bp, Cytophaga hutchinsonii
acactggccatccgtacacaaacagaaagaagtcaaaacagagagcatagtgctccgatttacatgacctccagttttgtatttgaagacgcagaacaggcaagagccatgtttgctgatgaagtaggtggaaatttatatacccgtttttcaaacccgaacaattcggaattcattgaaaaaatgtgcctgatggaaggcgctgaagatggctttgctactgcttcaggcatgtctgccgtattttcaagtatggcaccgtttctcaactcgggcgatcatattttattatgcaaatctgtattcggatcaagcttgcagatcgtaacacagatatttccaaaatggggtattgaatatacctttgctccgattgacaaacctgaaacatgggaaagcctgatcaaaccaaatacaaaaatggttatgatcgaaacaccttcaaatcccgcgcttgatttaattgatcttgaatggctttcttctttgtgtaaaaaacacaagatcttactaaatgttgacaattgttttgcaacaccatatttgcagaatccaattaagttaggtgctgatattgttacacattctgctactaagtttattgacggccagggacgtgccatcggtggtatcatcttagcatccaaagaactgatcaaacaggtacgtttcttttgcagacataccggaccggctctgtctccctttaattcctggattttttctaaaagccttgaaacacttgctgtacgtatggacagacattgtgaaaatgcattgaagcttgcaacatttttagaacagcatccggatgtagagcttgtgaaatatccgtttttaccaagccatccgcaatatcaattagccaaaaaacaaatgcgtgcaggcggcggtattgttacattcattattaaaggcggtgttgacagagggcgtaaatttctgaatgcaacagaaatggcttctcattctgcaaacctgggtgatacacgcactattgttacacacccggcatctacgacacattcaaaattatcggatgcagacagagagtctgtaggaatcttccccggcacgatccgtatctctgttgggcttgaacattcggatgatataatcgcagaaatcagacaggcattg

SEQ ID NO: 34117 - DNA, 979 bp, Cytophaga hutchinsonii
atgagagaaatacaattccgtgaagcgcttcgtgaagcgatgaacgaagaaatgagaagagacccaaatgtattgttattgggtgaagaagttgctgaatataatggtgcatataaagtaagccaggggcatgttggatgaattcggtgcaaaacgaatcattgatacccctatttctgaattaggttttgcaggtattggcgttggtgctgcgatgaacggcctccgtccgattatcgaatttatgacattcaacttttcacttgttgctattgaccagattatcaatggtgcagcgaaaatcatgtctatgtcaggcggtcaatatacagctcctattgtatttagagggcctacaggtaacgccggacaattgagttcacaacactctcagaactttgaaaactggtttgcaaacacgccgggtttaaaagttgttgttcctgcaaatccatatgacgcaaaaggtttattaaaatcggctatccgtgacaatgatcctgtaatcttcatggaatctgaagttatgtacggcgataaaggacccgttcctgaaggtgaatatttattgcctatcggtgttgcagatgtaaaacgtgaaggtacagatgttacgctggtatcttacggtaaaatattaaaagtagcgttacaagctgctgaagaccttgcaaaagaaggtgtctctgctgaagtaattgacttacgtactgttcgtccgattgattttgaagcaatcgttcattcagttaagaaaacaaacagacttgttattgttgaagaaacatggccattggcgagtatttcatctgaaatctcttaccatgtacaacgttatgccttcgaccacctggactctcctatacttcgtgtaacaagccgtgacttaccgcttccatatgcgccaacattaatccaggaaatccttccaaatgtaaaacgtactattgatgctgttaaaacagttatgtaccagaag

SEQ ID NO: 34118 - DNA, 1020 bp, Cytophaga hutchinsonii
cttataaaacccattctgttctgttttacacctgaacgcgcgcatcacattacctttacgggattaaaaatcttattcaaaattccgggcgtaagcagcattttccgttcaatatatgccgtacaagataaacgattagagcgtaccgtatttggtatcacatttcccaatccggttggtttagcagcaggctttgataaagatgctaaaattgtagatgagttttcatcgcttggctttgggtttattgagatcggtacagtaacaccggtaccgcaggcaggaaatgataagccacgtctgttccgtttgccggaagataaagcgatcatcaaccgcatgggattcaacaatggcggtatgaaagaagtagctgcgcgcctgcgtaagcgcaaatccagggtgttgattggaggtaatattggtaaaaataaagtgacaccaaatgaagaagcgttaaatgattatatcaaagcgtttaatgaattgtttgattgtgtagattactttgttgtaaatgtaagttcgcccaatacacccggtttacgtgccttgcaggaaaaaggaccgttaacggaattgttaaaccggttacaggaagttaataatcagaaaagcgttccgaaaccaattctgttgaaaatagcacccgacttgacgaacgaacaattagatgacatcgttgaaataattaccgaaacaaaacttagcggtatcattgcaaccaatacaaccatttccagagatggtttaacaacggaaaaagaaaaggtagaaaaaatcggaatgggtggtttaagcggcaaaccattaacggtaaggtctacagaagtaatccggtatcttgtaaaaaaatcaaacggtagtattccggtgattggtgttggtggaattcattcaccgaaagatgcactggaaaaactggaagcaggcgcttcgctgattcagttatattccggttttatttacgaaggcccggcattagtgggagcgatcaataaggaaattttaagaaatata

SEQ ID NO: 34119 - DNA, 399 bp, Cytophaga hutchinsonii
cttatactcaacggcccgaatttaaatctgcttggtaaaagagagccgggtatatacggtgctgcatcagcagaagatatttacaacgatctgaaaaaagcctatccggctatttcattttcgtatttccaatccaatgttgaaggtgaactggtaaataaattacacgaagttggttttgattacgacggtattgtttttaatgcaggtgcctacacacatacatctattgctattgccgacgctgtagcaggtattaaaacacctgtgatcgaagttcatatttccaatgtatatgcacgcgaagaataccgccataaaagcctgatggctaaaaattgtatgggtattattaccggctttggaatgaaaagctatgcgttagctgtacatcacttt

SEQ ID NO: 34120 - DNA, 621 bp, Cytophaga hutchinsonii
ttagtaggaaaaaaagcaccatcatttgttgcaccagccgtattaaacggatatgaagttgttgaagcgttttcattagatcagtacttaggaaaaaaatatgtcgtattttatttttacccaaaggatttcacatttgtatgcccgactgaaattttagcttttcaggaaaaattagctgcttttgaagcaaaagatacagttgtagttggctgttcaaccgatacggaaaactctcacttcgcatggttatcaatgcctaaaaacaaaggcggtattcaaggtgttaaatatccgttggtagctgatacagcaaaaacaattgctactaactacggtgtattgggcggtaactttgacattgatgacaatggtcaaatgatctttgttggtgcaccgatcgcatacagaggtacattcctgattgacaaagaaggtattgtccgtcatgaaacggtgaatgatttcccattgggccgtaacattgatgagacattacgtatggttgaggcattacagcacgttgaaaaattcggcgaagtttgtcctgcaaactggggcgaaggtaaagaagccatgaaagctacggttgaaggtgtttctgattacttagctaagaat

SEQ ID NO: 34121 - DNA, 963 bp, Cytophaga hutchinsonii
atgaagaaaatagcagtatatacatctgggggcgatgcgccaggaatgaatgcatgtattcgcgcggcggttcgtgcgggtcattaccataatcttgaagtttatggtattgttcgtggatatgacgggatgattaatgggaattttatcgaacttgacaatcgtgctgttagtaacattattcaaaaaggcggaacgattctaaaatctgcgcgcagcgaagaattcagatctccggagggaagacgcaaagcgttcgatcagattcagaaattcggtatcgacggtttggttgccattggcggtaacggaacatttaccggagctgaattattttacaatgaatatcaaatcccttgtgttggcgcaccgggaacaatagataatgatctgtatggttctgattttaccattgggtatgatactgccgtaaacacatgtttagcagcaatcgataagatccgtgatacggcagatgcacacgaacgtgtattctttattgaagtaatgggccgtgatacaggctacatcgctgtacgctcggctatttcaggcggagcagaaatggcgattatacccgagtttccgtatgacaaaaatgttgttatcaaccgtttgaaacatggcacaagtgacactaaagcatctcacattattattgttgctgaaggtcaccaggaaggtcgtgcaagtatgattgcaagagatattaaagaagcgctacctcaattagattgcagagtaaccacattaggacacgtgcaacgtggaggcgggccatcagcggctgatcgcgtattagccagccgtctgggtctggctacggtggaaggcttacttgaaggaagagcaaatgtaatggctggcattatcgatcataaagtagtttatactccttttattgatacaattaccaagagaaagccgatcaatgaagatttactttcattggcagaaaaatta

SEQ ID NO: 34122 - DNA, 1266 bp, Cytophaga hutchinsonii
atagaagaaatcgttgcacgtcagatttttgactcaagaggaaatcctactatcgaagtagatgtaattacagaaaatggtttaatcggtagagcagcagttccatctggtgcatcaactggtaagcacgaggcggttgaattgagagataatgacaaatcaatatacatgggcaaaagcgttttaaaagcggttgcaaacgtaaatgatatcattgctcctgaattgatcggttctcacgtattcgagcaaaatttgatcgatcgtttaatgattgatttagatggtactgctaataaaggtaaattaggtgctaacgcaatcttaggtgtttctttagcattagctaaagctgctgctcaggaagctggtttaccattgtacagatatgtaggtggtgttagtgctaacacattgcctgtaccaatgatgaacatcatcaacggtggttctcacgcagataactcaatcgatttccaggagtttatgattatgcctactggtgcaaaatcattcactgaggctatgcgcatggggtctgagattttccataatcttgcaaaagtattgaaatcaaaaggcatgtctacaaacgtaggtgatgaaggtggtttcgctccaaacattgcttctaacgaagatgcattgatcactgttattcaggctatcgaagcagctggttacagaccgggtgaagatgttatgattgcatttgatgctgcttcttctgaattttatgattctgaaacaaagttataccacttcaaaaaatcaaccggtgataaattaacgtcttctcaaatggcttcttactgggctgatttggttaagcgttatccaatcgtatctatcgaagatggtatggatgaagatgactggtctggttgggctgaattgactaaactggttggcgataaagtacaattagtaggtgatgatttgtttgttacaaacgtaagccgtttacagcaaggtatcgaccagggaattgctaactctattcttgttaaagtaaaccaaatcggttcattaacggaaacaatctctgctgttaacttagcgaagagaaattcatatacttcagttatgtctcaccgttcaggtgaaacagaagacaatacaatcgctgacttggcagttgcattgaattgtggtcaaatcaaaacgggttcttgttcccgttctgatcgtatggcgaaatacaaccaattgttacgtattgaagaagaattgggtgaagctgcatacttccctggtaagaacatg

SEQ ID NO: 34123 - DNA, 1062 bp, Cytophaga hutchinsonii
aaagaagcatatttaatgcttgaagatggtacctggtacaaaggtattgcagttggtaaaatcgggactacatcaggcgagatttgtttcaatacagggatgacagggtatcaggaaatttataccgatccgtcgtattatgggcaaatcattgtaaacactacaagccatattggaaattatggtgttaaagaagacgaacaggaatctgccggtgttaaattcagcggattggtttgcagaaatttttcagaaatgttttcacggaaggacggcgatggatcacttcaggcttacttcgagaaaaataatattgtaggtatcagcgatgttgatacacgtgaactggttcgttatatccgttctaaaggaacaatgaatgcagtgatttcttctgaaattttagatgtggaaaaactgaaagaagaagttaaaaaggttccttctatgaaaggccttgaactttcaagcagagtttctactaaagaaagttatttcttaggaaatccggatgctaaatacaaagtggctgtattggatcttggtgttaaaaccaacattttaaaaaaccttacagacagagattgttacttaaaagtattcccggctaagacaacctatgctgaaatgaagcaatggtcaccaaatggttattttatttctaatgggcctggtgacccagctgtaacaagctatgcaattgatacggtaaaaaatattttatctgaaaacagaccgatgtttggaatttgcctggggcatcagatcttagcggaagcaaatggtattccgacatataaaatgccaaatggccacagaggtttgaatcatccggtaaaaaacttaatttcgggtttgtctgaagtgacttctcaaaatcacggatttgcagtggatgcaaatgcagtgcctaaggacagcaatgttgagatcacacacataaacttaaatgataatacagtagaaggtattcggttgaaagataagaatgcattctctgtacagtatcaccctgagtcttctccggggccacatgattccagatacttatttgatcaattt

SEQ ID NO: 34124 - DNA, 816 bp, Cytophaga hutchinsonii
atgtcactgaaaaaattcagaccgattacacctggtacaagatttagagtagccgcatcatacgatgacgtaactacatctactcctgaaaagtcacttgttgtttctattaagaaatcaggtggccgtaacagccaaggtaaaatgactatgcgctatattggcggtggtcacaaacaacagtatcgtattatcgatttcaaacgcgataagcacgctattcctgcagtagttaaaacgatcgaatacgatccaaaccgtactgcacgtatcgctttattgtcttatgcagacggtgaaaaaagatacatcattgctccaacgggattagaagtaggtaatactattctttccggacctggtattgcaccagaagttggcaattgtcttcctttatcagatattcctctaggtactgttgtacacaatattgagttaaaaccaggcaaaggtgctgcaatggcacgtagcgcaggtacatatgctcagttggtagcacgtgaaggtaaatatgctacgcttaaattaccttccggtgaaatgagaatggttcttgtagtttgctacgcatctatcggaacggtttctaacgctgatcacatgaaccttacaaaaggtaaagccggcgccacaagatgggcaggtagaagaccacgtgttagaggtgttgcaatgaacccggttgatcaccctatgggtggtggtgaaggtcgttcatctggcggtcacccaagatctagaaaaggcttgtatgctaaaggtggtaaaaccagaagcgcaaacaagtattctaagaatatgatagttaaaaaaaga

SEQ ID NO: 34125 - DNA, 4170 bp, Cytophaga hutchinsonii
ttcacaaaagtaaccatcagtcttgcttctccagaatcaattcttgaaggctctcatggtgaggttacacaaccggaaacaatcaactacagaacatacaagccagagatgggtggtttgttctgtgagcggattttcggtccggtaaaagactgggaatgtcactgcggtaaatacaaacgtattcgttacaaaggcattatttgtgatcgttgcggggttgaagtaacagagaaaaaagttcgtcgtgaacgtatgggtcacatcgaattagttgtacctgtagcacacatctggtatttccgttcattaccaaacaagatcggttacatgttaggtttacctacaaagaaacttgatcagatcatatactacgaacgttatgttgttattcaatcaggtgttaaatctgaagacggtatcaactaccttgatttccttactgaagatgaatatctggatatcttagataaacttcctcgtgagaatcaattattagacgataaagatccaaataaattcatcgctaagatgggtgcagacgcgttagaaacacttctttcccgtttgaacttagatgaattatcatacagcttacgtcatgcggcagcaaacgacacttctcagcaacgtaaagcggaagcgcttaaacgtttgaaagttgttgaagctttccgtgatgcaagatcccgtatagaaaacaaaccggaatggatgattatccgcatggttcctgtgattcccccggaattacgtccattagtgccgttggatggtggtcgtttcgctacatccgatttaaatgatctttacagacgtgttattatccgtaacaaccgtttgaaaagattgatcgaaatcaaagctccggaagtaatcttacgtaacgaaaaacgtatgcttcaggaagcggtagattcattgttcgacaactcacgtaagataaacgctgtacgtgcagaaggtaacagagcattgaaatcactttcagatatgttgaaaggtaagcagggacgtttccgtcagaacttacttggtaaacgtgtcgattactctggccgttctgtaatcgttgtaggacctgaattgaaaatgcacgaatgcggtcttccgaaagatatggcagctgaattattcaagccatttatcattcgtaagctgatcgaacgtggtatcgtaaaaacagttaagtctgctaagaaaatagtggatcgtaaagatccggttgtttgggatattcttgaaaacgtattgaaaggtcacccgatccttttaaaccgtgctcctacacttcaccgtttaggtattcaggcattccagccaaaattgattgaaggaaaagcaattcagttacaccccttagtgtgtactgccttcaacgccgatttcgatggtgaccagatggcggttcacgttccactgggacatgaggctattcttgaagcatcattattgatgattgcatctcataacatcctgaaccctgcgaatggtgcgccaattacagtaccatctcaagacatggttcttggattatattatgtaacaaaaggccgtaagtctacacctgagcacccgatcaaaggtgaaggtatggcattctacggtgctgaagaagttgtgatcgctatcaacgaaggtcgcttatcacaacatgcacatatcaaagttaaaggtatcgtacgtacagatgccggtgaattagttgaacaaatgattgataccgttgccggtagagtattgttcaacttagtagttccggaagaagtaggtttcgtaaacgaactgttaacgaagaaaaaattacagttgatcattggtatggtattcaagatcgctggtatgtctaaaactgcgaagttcctggatgatatcaagcagatcggattccagatggccttcagaggtggtctttctatcggtttggataacattggtatccccgctgataaaaatacattgatcgatggcgctaagaaagaagttgattcagtatggagcaactacttaatgggtcttatcacagacaacgaacgttacaaccaggttattgatatctggacgcgtgtgaactctgagatcacagatacattgatgaaacagcttgaagctgatcagcaaggtttcaacccgatctacatgatgatgcactccggagcacgtggttctcgtgagcagatccgtcaattaggtggtatgagaggtttgatggctaagccacaaaagaacttacaaggttcagttggtgagatcatcgaaaacccgatcctttccaacttcaaagaaggtctggatgtaatcgaatactttatctctacacacggtgctcgtaaaggtcttgccgatacagcccttaaaacggccgatgcaggttacttaacacgtcgtttggttgacgtcgcacaagatgcaattatcaacgaacaggattgcggtacattaagaggtcttacagtttctgcattaaaagacaacgacgatatcgttgaaccgttaacagaacgtatccttggtagagtaagcgttcacgatgtattccatattatttcaaatgaattgttggtttcttccggacaggaaattacagaagaaattgcaagaagcatagatgattcaggcattgaatctgttgaaatcagatccgttcttacgtgtgaatcaagaagaggatgttgtgcaaaatgttacggtagaaacttgtcatccggtcaaatggttggtattggagaatctgtaggtgttatcgcagcacaatccattggtgaaccaggtacacagttaacacttcgtacattccacgtgggtggtacggcatctaacattactgttgatgcaaacatcaaagctaagtttgatggtgtagttgcttttgatgatttaagagtaattcaatctacaaacttagaaggcgataaagtaactgtagtaatgggccgttcaggtgagattcgtatcgttgagccggtatctggcaaaacgttattgagtaaccacgttccatacggtgcattcttaaatgtgaaagatggtgaaacggttaaaaaaggtcaggaactttgcttctgggatccatataacgctgttatcttatctgaattcgaaggtacaatccaattcgattcaatcgaagaaggtgtaacataccgcgaagaatctgatgaacagactggccacagagaaaaagttattgttgatacaaaagataaaacgaaaaaccctgcaatcattgtaaaccataagaaaggcgaaccaaaaggatacagcatcccggtaggcgcccacttagcagttgaagatggacaggatgttaaacctggtcaggtattagttaagatccctcgttctgttggtaaaacaagagatattacgggtggtcttccacgtgtaactgaattgttcgaagcacgtaacccttctaatcctgctgtagtaagtgagattgatggtatcgtaacgtacggcgcaattaagagaggtaacagagagatctttattgaatcaaaagatggtgttaaaaagagatacatggtaccgctttccaaacacatccttgttcaggacaacgatttcatccgttcaggaaatccgttgacagatggagcaattactccatcagatatcttatcaatcaaaggacctacagctgttcaggaatatcttgtaaatgaaattcaagaagtataccgtctgcaaggtgtaaaaatcaatgataaacacattgagattattgttagacagatgatgcaaaaggttcagattatcgaagccggggatacatctttcttaacaaaccaggcagtggatcgtttcaaattcagagaagaaaacgataatatcctggataagaaagttgttgtagaatgtggcgactcagaaaaattaagaccaggtatgatcattactgcacgtcagttaagagacgaaaactctagcttgaaacgtaaggatcaacgtttggtagtagttagagatgctgaaccagcagtttctatgccaacacttcaaggtattactcaagcttctttggatacagaaagtttcatctctgcagcgtcgttccaggaaacgacaaaagtactcagcgaagcagcagtaagaggaaaagtagatttcttaaaaggcttgaaagaaaacgtaatcgtaggtcacttaatccctgcaggtacaggt

SEQ ID NO: 34126 - DNA, 3843 bp, Cytophaga hutchinsonii
agaaagagctttgcaaaaactagaagtacggttgaatacccagatttcctagatatccaagttagatctttcaaagatttttttcagattgatactcctgctgaaaatagattcaaagagggactttataaagtttttgcagaaaatttcccaatctctgactcccgtgataattttattttggacttcatcgattacaacatcgatacgccgaaatataatgttgacgagtgtattgaccgcggattaacttacgctgtacctcttaaagcaaaacttcgtcttacatgtaacgataaggacaacgaagacttccagacaatcgaacaggaagtgttccttggaaatattccatacatgactgaacgtggatctttcgttatcaatggcgctgagcgggtaatcgtatcacagttgcaccgttctccgggtgtattctttgctcaaagcaagcacaccaacggaactaaactttactccgcaagagtaattcctttcaaaggatcctggatcgaatttgcaacagacgtgaacaacgtaatgtttgcatacattgatcgtaaaaagaaattccctgtaactacgctgttaagagcaatcggatacggtagtgataaagatatattagacttattcggtttatctgaagaagttgaagctactaaagctaatattaaaaaagctataggtagaaaattggctgcccgcgtacttcgtacatggacagaagatttcgtagatgaagatactggtgaagttgtttcaatcgaccgtaacgaagttcttttagaacgtgattcgatcattaaagaagaagacatcaacatcattgttgaatctggttctaaatcaattattcttcaccgtgaagacgtaaatattgctgattacacaatcatctataacacgcttcagaaggataactcaaactctgaaaaagaagcggttgagcaaatctaccgtcaattaagaaatacagacgctcctgatgaacagacagcacgtgatatcattcacaacctgttcttcagtgataaacgttatgatcttggtgaagttggtcgttacagaattaataaaaaattaggtagcggcatgggtagtgaggttaaagtccttacaaaagaagacatcatcaacattgtaaaatatctgatcggtcttatcaactcacgtgctgttgttgatgatattgatcacttgagcaaccgtcgtgttcgtacgatgggtgaacagctttacagccagttcagcgttggtcttgcacgtatggcaagaacaatcaaagaacgtatgaatgttcgtgacaacgaagatttcaaacctgtagatctgatcaatgcgcgtacactttcttcagtaatcaactcattcttcggaacaaaccagttatctcaattcatggatcaaaccaatccattggctgagattacgcacaaacgccgtatgtcggctcttgggccaggtggtttatccagagaacgtgccggtttcgaggttcgggatgttcactatacgcactacggtcgtttgtgtacaatcgaaactcctgaaggtccaaacattggtttgatttcctctctttgcgttcacgcaaaagtaaatagcatgggtttcatcgaaactccttaccgtaaagttattgatggtatcgttgacgttaaaaaccaaccggtattcttaactgcggaagaagaagacggtgcacacatcgcacaggcaaacgctatgtacgacgataatggtaacttcattagcgatcgtatcaaagccagatatgaaggtgacttcccggttattgctccggataaagttgacttaattgatattgcaacaaaccagattgtttctgttgccgcatctcttattcctttccttgagcatgatgatgccaaccgtgcattgatgggatcaaacatgcagcgccaggcagttcctttattaagaccggaagcaccaattgttggtactggtcttgaaagacgcgtggcaatggattcaagaacattattgattgcagaagcagatggtgttgttgagtttgtagatgcaaacgaaatcaaaatgcgttacgatcttactgatgaagatcgtttagtaagttttgattcagatataatcacatatagcttaattaaattcagaagaaccaaccaggatacctgtatcaatcttaaaccggttattcaacatggtgaaagagttaaaaaaggtcaggtattgtgtgaagggtatgcaacggataaaggtgaattagcattaggtagaaacttaatggtagcgttcatgccttggcaagggtataacttcgaagatgcgattgttatcagtgagaaagtagtacgtgatgatatctttacttcaattcacatcgaagaatttgaattagaagttagagatacaaaacgtggtgaagaagaattaacttctgagattccaaacgtaagtgaagaagccgttaaaaatcttgatgaaaacggtattattcgtacgggtgctgaaattaaagaaggtgatatattaatcggtaaaatcacacctaaaggtgaatcagatcctacaccggaagagaaattgcttcgcgcgatcttcggtgataaagcaggtgatgttaaggatgcttctatgaaagcgcctccatctttacgtggtgttgttattgatacgaaattgttctcccgtcctaaaaaggataaagatttgcgtataaaatctaagaagcaagttgagacaataaaaggtaagtacagcaaagatcttttagctttaagagagcaaatgatcgaaaagcttgctgctttattggatggacagacttctcaaggtgttaagcataaattcggagatgaagtaatttctaaaggtgttaaattctcccgtaaaaatattgaggcgaatgtcttcccggacaaaaacccatacagagatgagagcaattataacgttcaggaagaagcgaacttattaggtgatttgattattgataattggacatctgataaaaaaattaacgaaaacgttttacgtttagttaaaaactatttgacaaaacgtaatgaaactgctggtaaattcaaacgcgagcgcttcacattagaagttggggatgaattacctgctggtattgttcaattagcaaaagtttacattgctaagaaacgtaagttgaaagttggtgataagatggctggtcgtcacggtaacaaaggggttgttgcccgtattgtccgtgatgaagatatgccattcttagaagacggaactccggttgatatcgtacttaacccgcttggggtaccttcgcgtatgaacatcggtcagatctatgaaacattattaggtcttgccggcaagaaattaggtagaaaatatgcaactccaatcttcgatggtgcttctgaagaagaagtaatcaacgaattaagagatgcaggtttacctacaatcggtcgtacgaaactggtagatggtttatccggtaatccttttgaccaaccagttacggtaggtgttatttatatgatgaaacttggtcacttggttgatgataagatgcacgctcgttctatcgggccatactctcttattacacaacaaccgttgggtggtaaagctcaattcggtggtcagcgttttggtgaaatggaggtttgggcacttgaagcattcggtgcagcaaacattcttcaggaaatccttacagtgaaatctgatgatgttgtaggtcgtgctaaaacatacgaatgtattgttaaaggcgaaaacctaccgagaccaaacatcccggaatcattcaatgtattggtgcatgaacttagaggtttagctcttgagatcacactt

SEQ ID NO: 34127 - DNA, 1203 bp, Cytophaga hutchinsonii
ttagataacgggttgaaagtttttgtacacgaagaccgtacaacctccatggcagcgttaaatattttatatgatgtaggttcaaaagacgaagtagttactaaaacgggttttgcacacctctttgaacacttaatgtttggcggttctaaacacattccatcttacgatgaagcgcttcagaaagcgggtggagaaaacaatgcattcacgtctccggatataaccaactattatattaccattccggctaataatattgaaaccgctttctggctggaaagcgatcgtatgatggcgctgtcgtttgacccgaaagtactggaagtgcagcgaagcgtagtgattgaagaatttaaacagcgttacctgaaccagccctatggcgatgtgtggctgaagctgcgcccgcttgcatataaagaacattcgtacaaatgggcaaccatcggtaaagaaatttcacatattgaagaagcaaccatggatgatgtgcgcgacttcttttattcgtactatctgccgaataatgcgtacatggttgttgccggaaatgtaacgctggaacaggtaaaaaaactttctgaaaaatggtttgccccgattccttccggtacaagaagaaaacgaaacattccggcagaaccgaaacaaacggcagcacgcttcgaacagacagaagcaaaagtaccgttagacgcgctgtataagacgtaccacatgggcggaaaattatcggccgatttttattcaaccgatctggtaagcgatatattaggcagaggaaaatcatcccgtctgtatgataagctggttcaggaaaaaaagatgttctcatcattgaatgcatatattatgagttccgtggatcccggcttgctggtgatcgatggaaaactttccaaaggtgttcaattgaaagacgcggacgatgcaatctcagaattgatagagaaatttacacaggaacagttttctgaaaaggaattaaacaaagtaaaaaaccaggcagagtcaacgttattgtttggtgaagtagaagtgctgaatagagccatgaacctggcatatgcagcgatgttaggcgatccggaaatcgtaaacagagaagctgcgaacatacaaaaagtaaccacagcagatatttcacgcgttgcgaaaacagttctgcaacctgaaaattgttctacgctgtattataaa

SEQ ID NO: 34128 - DNA, 528 bp, Cytophaga hutchinsonii
atgcttatttatcttattggccttcctggttcaggtaagtcaaccatcggaaaaacattggcgcaaaagctcaagtatacattctttgatatggatgatgctatctgcgcgcaggagaaaaaaaccatagaagaaatttttgcagataaaggagaaaattatttcagagagttagaacatagtatcctgcacgatacgtttgaattaaagaatgcaattatttcaacaggaggtggtgtgccgtgttactttgacaatatcacagaaatgaaaaagcatgggttaactatttttattaatccttctgcggatgaattagccaatagacttgtgggccagggtggacagaaccgccccatgttgaaaggtaaaacacacaaacaggtattggattttattgaaacgaaatacagggaacgtgcaccttattacgaacaggcaaaactgattttcagtacaaataaattgaatgcagaagaactgctgaaacacttaaaaaaggaaaaacttatttcttgaaaaaggaat

SEQ ID NO: 34129 - DNA, 228 bp, Cytophaga hutchinsonii
tttgaggaatcagttgcagcgtcaaaatcactgccaaatcaatcaaacgaaaatttattaaagttgtatagcctttataagcaggcttccgagggagatgtaaacgtagaaaagcctactaatttttttgattttgctgcaatcgcaaaatttaatgcatgggaatccttgaaaggagtatcaaaggaaaatgccatgcaacaatacattgatttagttaaaagcttg

SEQ ID NO: 34130 - DNA, 2067 bp, Cytophaga hutchinsonii
agtgaaaaaaatacacctaaaactatacaaacaagccgtggagcatacaacccaagcaatccgctttactgggatctgattcacaccaagcttgaagtatccttcgatttcaagaaaaaacatttgctgggtaaagcaacgctttctgcaaagccgcatttttacgcccaaaacacagtggtattacaggcgaaaggatttgatattcattccatcagttacctgaatggcgcaaagatcagcagttatacatacgattctaaagcaattaccattacgctggataaaaattatacccgtaccgataccttaaagcttgtcattgattataccgcaaaaccggatgaccttcccaaaacaggcagcgacgcgatcacagaggaaaaaggattgtactttattgatccattagaaacagatccgaaaaaacctacacaggtgtggacacaaggcgaaacgcaatctgcatcgtgctggttccctacgtttgattcgcccaatcaacgcagcacccaggagatgtacattacagctgataaaaaatatcaggttatttcaaacggtgaattaaattataaaactgaaaatgcagacggcacgctgacctggtcgtggtcgatgaaaaaaccacatgccccttatttatttatgatggctgttggcgagtttgcaaaagtaacagatacctggaatggcattgaagtaagctattacgttgagccggcgtatgaaaaatatgcgcgcagcatttttggtgaaacaccagccatgatcgaattcttttcaacgaaattaaattatccgttcccttggccgaaatattctcagattgtggtgcgtgattttgtgtcaggagcaatggaaaatacgtctgccagtattttcatggaagcactggaagtggatgatcgttttttagtagatgataactgggaacagattatcgcacacgaattgttccaccattggtttggtgatctggtaacctgcgaaagctggtcgaacctgccattgaacgaatcgtttgcaaacttttctgagattgcctggtttgaacacaaacatggttacgaagccggattgaagcatgcacaggaagatctggaaggatatttatccgaagctgaaacgactcagaatccgttgatccgttttcattatacagacattgaagaaatgtttgacagacatagttacaacaaaggcgggcttgtattgaatatgctgcgtgatgcggttggagaagaagcattttataaatccttgaatctctatttaacacgcaatgcctattcacctgttgaaattgatgagctgcgtatggcttttgaagatgttaccggcgaagacatgcactggttctttgacacgtggttcatgaaacgcggacatgctcagctgagtgttgagcatcatgtttctaaagataaaaaaactgagatcgttattgaacagatgcaggacacaacagaaggtacgctgtatcgcattcccttacagattgattacagaacatccggcgacacaacgctgcgctctgcgcgttactggatcagccagaagaaagattctatcgtgctgccggtttcagtttcagaactatcttatctggttgtagacagcaagcatcttgttgttggtacggttcagcatgaaaaaaacagaacgttattgaaaggacaatttttatacgggacagattacctactgcgtaaaaatgcgtttgaagctttggtaaaaccagcttcagcaaaagataatccctaccttgttcagcctgaaaacatagactttcttactaaagcattgaatgaccgttctgctgaagtacgttcggttgccttattagaattcacaaaacgtgcggtaccaaatcttgagacggtatttattccaaaaatgaaagagatggcccagacagaaccaaatggcgagctgcgttctaaagctatttctctggttgcttccttagaaaataatgccgactatatttctatttataaaaaaggattgaatgatccttcttattacgtttccggtgcaagtctaaaagccttactggtattg

SEQ ID NO: 34131 - DNA, 1440 bp, Cytophaga hutchinsonii
aaaggccatcagatccatataatgaatcaccaggaggcaaatattaaccattatgcccgaacattacagaaaacaattgattttgtaacggcacatttcagaaataccacgcagcctttttccgggatcacacccgcagatctgaaaccagctgttcagtccattgattttaataccaccagttcaagtattgacgatttactgctggaggtaaaatccatttacagtcagcatgctgttgcctttcatttgccaaaatacattgcacatctaaattgcccggttgtaaccccctcacttgctgctgaaattattatcagcgcattgaattcgtctatggatacctgggatcagagtgcagggggcacgttgatggaaatgaaactgattgactggacctgtgaacaattgcacttgggtgcttctgcagacggtgtatttacaagcggcggcacacagtcaaatttaatggcgctgctgatggcccgcgattattatattaaccgcaccttgttatacaatgtaaaaatgcagggcttgccggaagatgcaaaacgcttccgggtattctgttcggaaaaaagtcacttcagcattaaaaaagcatgcagcatacttggcctcggtgagcatgcagtagtatgtgttcctgtaggaaatcgttttaaaatgaacacgaaggaattaaagaacctgatggaaaaagaaattgctcagggaaacattccgattgcaattgttgcaacagccggaactacagactttggcagtattgatccgttaatcgaattaggggagttggcgaaagaatacggtacctggtttcatgtggatgctgcatatggctgcggactgatgctgagcgataaccaccggtataaattaagcggtattgaatatgcgaattctgtaaccgttgattatcacaaatcctttttccagccggtaagctccagcgctttattggtaagcgataaagacacgttaagacttatgtgttaccatgcggattacctcaatccggtagagcaggaaaaagacggctatccaaaccaggtaaacaaaaccattcagacaacccgccggtttgatgcacttaaactttggttcacactgcgtttaatgggtaaagacgtattaggtgaatacattgaccagatcatttacaccgctaaacaggcagcgaatatgatcgataaagatcccgattttgaattgctgaaccatccggagatcagcacactgctgtttcgttataatccgtattccaccgaagtttcagcactgaataccttaaatcagtttattcggaaaaaactgatggattcaggaaaagcactggttgcaagtacaaaagtaaacaacgaagtatacctgaaatttaccctgctgaatccggcaacaactgcaaaagacatttcaaccattttagaattaata

SEQ ID NO: 34132 - DNA, 1284 bp, Cytophaga hutchinsonii
cacaaagtaaaagacatctccctggctgcatggggcagaaaagaaattgaattagctgaggctgaaatgccgggtttaatgtcaatccgtaaagaatttggaccttcaaaacctcttaagggtgcgcgtgtagctggttgtttacacatgactatccaaacggctgtattaattgaaacattgattgaattgggtgctgaagttacctggtcatcttgtaatatattctctacacaggatcatgctgctgctgctatcgctgctgcaggtatctctgtttatgcctggaaaggtatgaacgaagaagaatttgactggtgtattgaacagacattattcttcggtgaagaccgcaagccattgaacatgattcttgatgatggcggagatcttacaaacatggtattagaccgtttccctgaattggttaaagatatccgtggtatctctgaagaaacaacaacgggcgtgcttcgtttgaaagacagggaacgtaacggttcgttagtattacctgcgatcaacatcaacgattctgttacgaaatctaaatttgacaacaaatacggctgtaaagaatcattagtagacagtatccgtcgtgctacagatgttatgatggctggtaaagttgctgttgtagcgggttacggtgatgtaggaaaaggatctgctgcttcattaagaggtgcaggcgctcgtgtaattgttactgaaattgatccgatctgtgcattacaggcggcaatggatggttatgaagttaagaaaatggctgacgctgttaaacgtgcggatatcgtagttactgcaacgggtaacaaaaacatcatcacgggcgagcatttcaaagcaatgagagacaaagtgattgtttgtaacatcggtcactttgacaatgaaattgacatggcctggttgaacaaaacatatggttctacaaaagttactgttaagccgcaggttgacatctacaacgtagatggtcatgatgtaatcattctggcagaaggccgtttggttaaccttggctgtgctacaggtcacccttcctttgtcatgtcaagctcattctctaaccaggttattgctcagttagaattatgggaaaattcttctaaatatgaaaacaaggtttataccttgcctaaatcgctagatgaaaaagtagcccgcttgcatttatctaaaattgatgttgaattagacattttatctgcagatcaggcagcatacatcggcgtaacggttgatggcccatataaaaacgacgaatacagatac

SEQ ID NO: 34133 - DNA, 1987 bp, Cytophaga hutchinsonii
gagtatacctgaggataaaaaaaagaaaaagagtccaataccaaatccatcacaaaaaactaattatcagatttttttaattagtgcattattgctggttgttgtgggtatcgcttatttcagcggttccggcggcattcagaaaacaaccaagcaacgcttttttgatatggtgcttcagcacgatgttaaaaagattgttctggtaaacgaccgcaatgttgaggttaccattacagatgaagccttaaaaagcgggcgatacgatgaattgcttaaaagaacgaacagtccgttttcaggtacagcaacaggtcctcagtttcaatttgaaattacaccttcatatgattttgaagcgaaatacgaagagttcctgaacaaagaaaaggttcccaaagaatatcaggtgcccattgaagtggacagcaaccgtgctgaagtaaccagtcaattggtgaccttaggattctgggtattgttatttgtaggtacctggttcctgttcagaagagtttccggcggcggcgcaggcggacagatcttcaacataggtaaatctaaagcagcattatttgatcaggataacaaagtgaaaattacgttcgcggatgttgccggtttggatgaagcaaaggaagaagtaaaagagatcgtagatttcttacgtttcccgacaaagtttacaaaacttggcggtaagattcctaaaggcgctttgttggtaggccctccgggtacaggtaaaacgttgcttgcaaaggcagtagcaggagaagctggcgtaccgttcttctcactttcagggtcagactttgttgaaatgtttgtaggggtaggtgccgcacgtgtgcgtgacttatttaaacaggcaaaagaaaaggcgccatgtatcattttcattgatgagattgatgcgattggccgtatgcgtggcaaaggcggaaacatgccgggttcaaacgatgaaagagaaaatacattaaactctttattggttgaaatggatggtttcggaacagattcaggtgtgattatcttagctgcaacaaaccgtccggatgtattggattcagcgttgcttcgtccgggtcgttttgacagaatgatcagtatcgataaaccggatatcgttggtagagagcaaatctttaaagtacacctgaaaccattgaaattagggcctgatgttgatcctaaaaagattgcagcacagacaccgggttttgcaggtgcagagattatgaacgtatgtaacgaagctgcattgattgccgcgcgtagagataaatctgaaattgatatgcaggattttcaggatgccattgatcgtgtgatcggcgggcttgaaaagaaaacaaagatcatttcaccggaagagaaaaaaattgttgcataccatgaagccggacatgctgttgctggttggttcctggaacacgcagatccgttggttaaagtaagtatcgtacctcgcggtgtagctgcattgggatacgcgcagtacttaccaaaagaacaattcttatatacggtagaacagctcacagatgaaatgtgtatggcacttggtggccgtgccgctgaagacatcatcttcggtaaaatttctaccggagcgttaagtgatttagaacgtattactaaaatggcatacggaatggtatctatttatggtatgaatgataagatcggaaatatttctttctacgattccaaagctggtgattattcattcaacaagccatactctgaatcaacggcacagaccattgatgaggaagcacgcaacattgtacatgaagcatacaacagaacgaaaaaactgttgcttgaaaagcagccggaacttgaaatagttgcaaagcaattgctagagaaagaaatattattccagtcggatctggagaaactgattggtaagcgcccgtttgaagctgaaacaacctatcaggcatttacaaataaagtagatgctcctgaaaca

SEQ ID NO: 34134 - DNA, 1535 bp, Cytophaga hutchinsonii
gacttacttcgcttcactactgccggcagtgtagatgatggtaagagcacattgatcggtcgtttgttatatgactcaaaggcaatctttgaagatcagatggaacagattgaagaaatcagcacacgtaaaggtaaagggtatgttgacctttctttattgacagatggtttacgcgcagaacgtgaacaaggcatcacgattgatgttgcataccgctactttgctacaccaaagcgtaaattcattgttgccgatacgccgggccacgtacagtacacacgtaacatggttacaggtgcatctactgccaacttagcgatcatcctgattgatgcgcgccatggtgttattgagcagacgtgccgccactcattcattgcgtctttattacagattaagcacgtagttgtgtgtgtgaacaaaatggacttagtggatttcagcgaagagaagttcaataaaatccgtgaagactatacaaacttcgcatccaaattaaacattccggatatccgtttcattccaatctctgcattgatgggtgataacgtggtggaaccatctacaaacactccttggtaccagggcggaacattgatgtacacattggaaacagtaaacattgcttctgacctgaacatgatcgattcccgtttcccggtgcagtatgtgatccgtccgcagtcggacgagttccatgacttcagaggttttgcaggcaggatcgaaggtggcgtgtttaagccgggcgatgagatcatgcacttaccatccggtttaacaacaaaaatcaaaacggttgaaaccatcgatggtcagcttgaagaagccttccctccgatgtctgtaaccatgacactagaagataacatcgatatcagccgtggtgatatgatcgttaaaccgaacaatcaaccggaagttggtcaggatattgagttaatgctttgctggctgaatgaaaagaaaatgacaccgggtggtaaatactccatcaagcatactactaaagatgcgcgttgcgtgatcaaagaagtccgttataaaatgaacatcaacacgcttcacaaaattgaagatgataaaacaattggcttgaatgatatcggacgtgtattgatccgtacaacaagcccattgttctacgatagctataacaaaaaccgcattacaggcagtgttattctggtagatgagtttaccaacgaaaccgttggtgcgggtatgattttataacacctataaccatacattacaaagccccggccaaaaaccggggcttttatttttgacactacctgtttatcttgttatgtaataaacattgtaattatgaacggcaaaactatagcacttatctcctacattccttttataggctggcttatagcattcatcttgtatctggaaaacaatactaaagactcattagcaaggtttcacctgcgacagacacttggcatacaaatcatgtctattggaggttcaataatacttggtttctttcgtctgtattttttgttaggcccttt

SEQ ID NO: 34135 - DNA, 492 bp, Cytophaga hutchinsonii
ctgcaacgtgaggataaagaagcgcagttaaaacaacattccattgtaatatggatggttggcttatctggttctggtaaaagtacgcttgcaaaggctttagaaagagatctgcacgatcgtggttttttaactacgctgcttgatggcgataatcttcgtaccggtatcaataacaatcttggttttaccgaagcagaccgcacagaaaatatccgccgcgctgccgaaacgtctaagttatttgctgcctgcggtatcattacgatctgctcattgatcagccctacggaagaaatccgttccatgtcaaaaaacatcattggcgcaaacgattattttgaattgtttgttaatactccgattgaggtgtgcgaacagcgcgatgtaaaaggtttgtacaaaaaagcacgtgccggtgaaatcaaaaactttacaggaattgactctccgtttgaacacccgaaagccccgtcgttagaagtgcgcacc

SEQ ID NO: 34136 - DNA, 963 bp, Cytophaga hutchinsonii
ctcatgcgccgtccgagaagaaaccgtaagtcagaagctgtccgtcagttagtaaaagaacaccgggtatataccgaagatctgatgttcccgctttttttaaccggtggaacaaatgttaaaaccgagattgcttcgatgccgggcatctttcgtttttcagaagataatctgcttcgtgaaatcgacagctgcatgaatctggggttgcgttcgtttgtattgtttccgcattttccggatgaagtaaaagatccatatgcaaccatcagctaccaggagaatatgtatctgaaagcacttcgtgaaattaaaaagcgtttcccggaatgctgtctgatgaccgatgtggcacttgacccctactcttccgacgggcacgacggcattgttgtgaatggagaaattgtgaatgatgaaacattgattgtattgggtaagatggcggtagcacaggcacaggccggtgccgacatcgtcggaccatcggacatgatggacggccgtgttggttttatccgcgacatgctggacgatagcggttttacgaatacctccatcatggcatacacggcaaaatacgcaagcgctttttacggtccgttccgggatgcgctggattcggctccgaagtcgggtgataaaaaaacgtatcagatggatccggccaatgttaccgaagccttactggaggcagaactggatgttcaggaaggtgcggacatcattatggtaaaaccagcccttgcctatttagatgtaatcaaaaccttatatgaccaattcgatgtaccaatcgcagcgtataacgtgagcggtgagtatgccatggtaaaagctgctgctgccaacggctggatcgataacgataaggtgatgcttgaaaccttattaagcatgaaacgtgcgggtgcaaaaattatccttacctattttgcgaaggagtttgcgggtaaggtgaag

SEQ ID NO: 34137 - DNA, 1257 bp, Cytophaga hutchinsonii
cttatttcaaaatacatttaaaaacaatctattatgaacactactgtatctcttagtcagcaggctatcgaactcgaagataaatatggcgcacataactatcatccgcttccggtggttttagctaaaggagaaggtgttcatgtatgggatgtggaaggaaagcattactacgatttcctttctgcgtacagcgctgtaaatcaaggtcactgtcacccacgtattataaatgcactgattgagcaggcacaaacgttaacgcttacgtcgcgagcattttataacgataaattaggagaagcagaaaaattcatctgcgacctgtttgggtatgataaagcgttattaatgaattcaggcgcggaagcaaatgagtctgccatcaaattagcccgtaagtggggctatcaggtaaaaggcattcctacagaccaggcggtgatcgttgcggttgaacgcaatttccacggccgtacaaccggtattatctccgcttctaccgatccggattcaagaaataacttcggtccgtttatgccgggctaccagatcattccttataacgatgtaatagcactggaagaagcgcttaaaaatccaaacgtatgcggtttctgggtggaaccgattcaaggtgaagccggtgtgtttgtaccgggggatggctatctgaaaaaagcacaggaattgtgtacaaaatacaatgtgatcttaatgatggatgagatccagacgggttgcggcagaacaggtaaactgattgcttcaaatcacgaaggggtgcatcccgatatgctgatcttaggcaaagccttatctggcggaacgtatccggtatcgtgtgtgcttacttcggatgagatcatgttaacgatcaagccgggcgaacacggttctacctttggcggaaatccattggcatgcgctgtacttgttgaatcattagccgtattgatggacgaaggtctgatcgataatgcagcatctatgggtgaattgttcagagaccgcatgaatgctttaaaagacaaatgtgaacacgttacattagtacgtggcaaaggcttgctgaatgccatcatcattaagcctaccgctgatggccgtacggcatgggatgtttgtatgaagctgatggaaaatggtttgcttgccaaaccaacccatggtgacatcatccgctttgctccgccattgatcattaccgaagaacagatcaatgcgtgctgcgatattattgagaaaaccttgctt

SEQ ID NO: 34138 - DNA, 1074 bp, Cytophaga hutchinsonii
ttttttgatgcgtttcaaatgcacccgacacacatcagtaccgcaccgggcagaataaatatcatcggtgaacacaccgactataatgatggtttatccatgccttgtgcgatcaacaggtggattactgtaacgttttctccgcggtcagatgatcagatttatattataagcaaagactttaatcaggtattatttctttcaatgtacgccggttatcaaccagatagcgattggaaaaaatatatgtatggttgtattcagattttgtctgatgttaaaaaactgcatggtggtttcaatgcgctgatcgaaggaaatgttccggtaggttcgggggtttcgtcttcagctgcacttgaagtagcctttatgaatggcttaaatgctttttacaacctgaagcttgatccattggctattataaaattatgtcagcgtgtagaacatgaatacctaaaagttaagagcggtttacttgatcaatatgcttctcaattttcaaaagaaaataacttactggttcttgattttcaaaaaaatacccatacctatatttctgctgaaatggacgaatactgctgggtactctgcaactcaaatgtaacaaggtcgcttgctggaagtaaatatacagaacgggttatggaaacacaggctgcattaaatcagctttctgaaacgtttccggatatcaaacatttcagagatattaaagaaatacatatatctgctgtaaaaaatgtaacacagcaaaagcgcatcaaacattatgtattagaaaataaaagagtgcaggatgccattgcagcattagaacagcaggaccttacacactttggtgcactgctgactgcatcgcatctgtcccttcgtgatctttatgaagtaagctgtgatgaaatagattttttaatggaacaggcgatttcacttccctattgcctgggcagcagaatcatgggcggaggatttggtggctgtaccattaacttagtaaagaaaaactgcacacaggaattttcaaagtttatgaaattcgcttatttaaagcgatacaatatggttactgaa

SEQ ID NO: 34139 - DNA, 474 bp, Cytophaga hutchinsonii
gaagagtacgtattattggttgatgagcaggataatgaaatcggttccatggaaaagatggaagcacaccggaaaggactgcttcaccgggcattttctgtttttatttttaatacaaaaggagaattactacttcagcaacgtgctgcttctaaatatcactccccattaaagtggaccaatacatgctgcagccatcagcgtaaaaacgaaaccacactccaggccgcagcccgtagaatgcaggaagaaatgggtatcacctgcaacgtatcgctttcctatacattcatttataaggcagatgtcggacagggtttattcgaacatgaattagatcatgtattgatcggtacaacaacacaaacaactattccttttaataaaaatgaggtacatgcggtacggtttgcttcactggaagatatagaaaaagaaatgagcattaatccggaagactttacgaaatggttt

SEQ ID NO: 34140 - DNA, 1626 bp, Cytophaga hutchinsonii
ttttaaaccgcagtgcagatgactattaaaccggaaaaaataaacgaaaccctgttgcactatgcacccggctctgcggagcgttctgccgttcagcaaaaaataactgaacttaaagctgctgaagtaatcatacccatgatcattaatgggaaagaagtatttaccgatcagcatgtccgtatagcacctccgcatgagcatgcctatacactgggttatttctgcgaaggaaaaggggtacatgtttcaaatgcgatctcggcagcgctgcatgccaaacacagctgggcagtcaaatcactgaaagaacgggcagcagtatttctaaaagctgcagacctgatttctacaacctatcgggcagagatcaatgccgctaccatgctgggccagtctaaaaatgtgtaccaggctgaaattgattcggcctgcgaactgattgattttttccgtttgaatgtggcttttgcgtatgaaattgaaaccatccagccatgttcgcacgaaggtatcattaacagaatgatctaccgtccgctcgaaggatttatctttgctttaacacccttcaactttacagccattgcaggcaacctgcctgctgcacccgcattaatgggcaatacggtagtatggaaacccgcatacacacaaatctattccgcgcgtatcattatgaaagttttgatagaagcgggcttgccaaatggtgtcattaatttaatctatacagacggaccagtaaccggggatattatttttcagcaccggcaatttgcaggacttcactttacaggaagcacagctgtattcaagcagatttcaacaaccattcacaacaacattgacctgtaccagaattttccgcgtattgttggcgaaacaggcggaaaagattttgtactggcacacgcctcctgcgatgtacaggctttatctgtagcgcttgtgcggggcgcttttgaataccagggacaaaaatgttctgctgcttcaagagcgtatattccagcttccatctggccttcggttagggaacatatcgttcatatgcttgatgaaattaaaatgggaacggtagaagatttttcaaatttcataaatgctgtaatagacgaaaaagcatttgataaaattgtacgctacatcgatgctgctaaaaaagatccggaagcaagtatcatcgccggcggaaaatatgataaatccatcggttattttattgagcctacaattatagaagccagcaatccgcaatacgttaccatgcgcgaagagattttcggcccggtacttactgtgtatgtatataaagattccgaatggaaccaggtactgggtatagttgacacaactacaccgtatgcgcttaccggaagtatttttgctgcagatagcgcaatcattgaggaggctaaaaaagccttgtattacagtgcaggaaatttatacatcaatgataaacctaccggcgcggttgtgaatcagcagcctttcggcggtgcacgcttatccggcacaaacgacaaagctggctctgttttaaatttacttcggtgggtgagcccgttggtcgtaaaagaaaatctttcgccgccgcacgattatacctatgatttcatg

SEQ ID NO: 34141 - DNA, 369 bp, Cytophaga hutchinsonii
atgaactttccttctgaattaaaatacagcaaagatcacgaatgggttcgtgtagaaggccagacagcttatgttggcattactgattttgcgcaaaaagaattaggtgatattgtttacctggatgtaacatctgttggacaaacgattgataaagaagcaatcttcggaacaattgaagcagtaaaaacagtttcagatttatttatgccggttagcggggaagtattagaattcaatgctgaattggaatctgcgcctgaattagttaattcagatccatatggtaaaggctggatcgtgaaggttacgttagcgaatgcttcagacctggatgctttattagatgcagccgcctatacaacactg

SEQ ID NO: 34142 - DNA, 1827 bp, Cytophaga hutchinsonii
atgtcagatatcatacgtttattacccgataatattgcgaaccagattgcagcaggggaagttgttcagcggccggcctccgttgtaaaggaattgctggaaaactctgtggatgcaggaagtacaaatatacagctgattgtaaaagatgctgggaagcaattgattcaggtgattgataatgggaaaggtatgagcgatggagatgcgcgcctgtgttttgagcgtcatgcaacatctaagatccgcagtgcagacgacctgtttgcaatccgcacctttggtttcagaggtgaagcgatggcttccattgcttcggttgcccaggtagaaatgaaaacaaaactgccgggaaatgaattgggtacgctaatccgtattgaaggatctgctatacttgttcatgaacagacggcacatccgcagggtacttcaatttcagtaaaaaatcttttttataacgttccggcgcgccggaacttcttaaaatcaaattctgtggaaatgcgccacattatggatgaatttgtgcgtgttgccttagcacatccggaagtagcattttcattttaccacaacgatttggaattatttaacgtacctgaagagacactcagcaaaagagcggtttctttattgggcggaagttatagagaacaattaattccgtgtaaagaagaaacagatttcgtttctatatccggctatatcggcaaaccggagagtgcgcgtaaaacacggggagatcagtatttctttgtcaataaccggtatatacggagcaattatctgcatcacgcagttatgcatgcatttgaagagcttattcctacagatgcatttccgttttatcttttatttattgaaatagatccggcacatattgacgtaaatgtgcatccgacaaaaacggagatcaaattcgatgatgaaaaaacagtttatgcaatcattaaagcctgcgtaaaacgttcgctgggtacgcataatattatgccatcattggatttcgatttcaatgtaaacgtttcaggattcacagggatggggctttcagacagttcgggacgcgaatcgaacacaaatttcacaccaaaatcattttcaacatcagatagtattcaacggtcaaatcaatcaaactgggaacgcatgtatagtgggttagagaataatagagaagaagtatatcaggaatcgattaaaatggtcagtgctattaacggaacggaagatttaaaacagttaagtaaagaacagctgtacacagagaatacctcaacatttcagctgcatcagaaatatattgtaacacaggttaagtccggcgtgttattggtagatcagcaggcagcacacgaacgtattttatttgaaaaatacatcggcatgctgcagaaccgtttcggaagttcacagcagttcctgtttccgcagacacttgaattaagcgcggcagattttgcaatggttgttgaaatggaagaagatatccgcaagcttggatttgtatttaacgtattcagcaatacaacgatcgtagtaaacggcgtgccttcggatgttaaaagcggcaatgaaaaaaatctgtttgaaggcctgattgaacagttcaaacaaaacagaacagatttgaaaattgaccgtcaggaaaacctggcacgttcattggccaagcgttctgctatccgtgcgggtaataaattatcattaatggaaatgaactccattatagatcagctttttgcatgcaagtccccgaattatgcgccggacggcaatcttaccgttgtaatgctggatatggataagatcggcagattattt

SEQ ID NO: 34143 - DNA, 1101 bp, Cytophaga hutchinsonii
atgaaaataggtattgtttgttacccaacgtttggggggagtggtgttgtagcaacagaattagggaaagcgttggctgaacttggtaacccgattcattttattacatattctcaaccacacagattggatttttttcatgagaatattttctatcacgaagtaaccgttaaatcatacccgttatttgaatttgcaccgtacgaagtaattcttgcaagcaagattgtagatgttgtaaagcacgaaaaactggatctgctgcatgtacactacgcgatcccccacgcttcggcagcttttatggcgcgcgaaattcttaaaacccaaggtatttatattcccattattacaacactgcacggtacagatattacgttagtaggtaaagacccgtcgtttgcgccggtagtagcgttttgcataaaccagtcagacggcgttacagccgtttcggaagatcttaaaaaagatacgttcgagcattttgacatacacagagagattgaagcaataccaaactttattgatgtttcaagattcagaaaacagaagaaagaccattttaaaaaagccatttgcccgaatgatgagaaactgatcgtacatacatccaacttccgaaaggtaaagcgcgtggaagatgttgtatctgttttcaatattgtgcgccaaaccgttccttctaaattactgcttgtaggtgatggccccgagcgggttcttattgaaggtatgtgcagagagcttggcatttgcaacgatgtgcgctttttaggaaaactggacgccgtggaagaagtgctatctgtagccgatctctttattatgccttctgaaaaagaaagtttcggtttagccgcactggaagcaatggcttgtgaagttccggttatttcatcaaatgccggcggattgccggaattgaacattcaagggaaaacgggttttttaagcaatgtgggtgatgtgaaggaaatggccaaaaatgccattttcatattggataatgccaatttacaggaattcagaaaaaatgcactggaaagagctaaagagttcgattccaatcatatagtacctaaatatttggaatattac

SEQ ID NO: 34144 - DNA, 726 bp, Cytophaga hutchinsonii
aagacatacggtttaattggatttcgcttatcacattctttttcaaaaaaatactttactgaaaaatttctaaaggaaggaattgaagattgcgtatacgaaaattttcaattagatacggtaaaggaattttcagcactgcttcgtacagacgccaacctgaaagggttcaacgttaccattccatataaagaagaaatcattcctttcctgaatgacctggatgctgcagcaaaagaaatcggtgcggttaatgtcattaagattcaggaagacgggacactgatcggatacaattcggattattacggttttaaaacatcactcgaaacatttatcccgaaggaagtgtctcataaagcgcttgtattaggtaccggcggtgccgctaaagcggttgtaacagcgcttaatcatttaggcataccatatcagtacgtttcacgcaataagtcggcacaaagcctcagctacgaagaactggatcaaaatgtcatgcaggaatatacacttgtagtgaatacatccccattgggcatgtatccggaggttgattctttcccggcaattccatatgaatttttggatagcaggcattacctgtacgacctggtatataatccggaagaaaccctgtttatgaaaaaaggaattgcccggggcgcacacgtgatgaatggtttgcccatgctgatcgggcaggcagaaaaagcctgggagatctgg

SEQ ID NO: 34145 - DNA, 1833 bp, Cytophaga hutchinsonii
atgtgtggaattgttgcctatgttggtcacagagaagcgtgtccgattattataaagggattaaaaaggcttgaatatagagggtatgacagtgccggcattgcactcatgacacatgaactttctgtatataagaaaaaaggaaaagtaagcgagttagaagcgttcattaaaaatcttccgattaacagcaatattggtattggccatacacgttgggccacacacggcgaaccgaatgatgttaatgcacacccgcactacagctcaaacaaagagttagctattattcacaacggcattattgagaactacgcttctttaaagaccgaactggaatccagaggccatgtttttttaagtgaaacagattcagaagtatttatacatctgattgaagatgtaaagcagaataacgattgctcattggatgaagccgttcgtttagccttatcaatggttgttggcgcatatgctatcgtagtaatgagcaacaacgataaagaaatgcttattgctgcccgtaaaggaagtccgctggtaatcgggatcggtaaaaaagaattttttctggcttcggatgcatcgcctattattgaatacacaaatgatgttgtgtatttaaatgattacgaaattgcaatcatcaataaaggtgaattaaccattaaaaatataaatgcggtaacgcagactccttatattcaaacactggatcttgaattggatcagattgaaaaaggaggttatccgcacttcatgctgaaagaaatctttgaacagcctaagtcaattaaagacagcatgcgcggacgggtaaatgcatctttaggtcatttacagttaggcggtattcttcagtatgcgaataagctcaccaatgcggaacgtattattattgtcgcttgcggtacatcgtggcatgccggtttagtagcagaatatttattcgaagatatagcacgtataccggtagaagtagagtatgcatctgaattcagatacagaaatcctattatccgtgagggcgatgttgtaattgcaatttctcaatcgggagaaacagcagatacgttagcggctattgaattagcaaaatccaaaggcgcagttatttttggtgtatgtaatgtagttggctcatctatttcaagagcttcgcatgaaggcgcttatttacacgccggacctgagattggcgtagcaagtaccaaggcatttaccgcacaggtttccgtattggccatgatggcgatcatcgttgggaataaaaaaggcacgatcaccgaaagccagtatattgctttattaacggagcttgaaacaattcctcaaaaggtagagaaagccttaaaaagcaatgatcagattgttgaaattgcagagcagtttaaagacgctaaaaacttcctgtatttaggaagaggttataatttcccggttgcattagaaggcgcattaaagctgaaagaaatttcatacattcatgcagaaggctatcctgctgctgaaatgaagcatggcccgattgcattgattgatgctgaaatgccggtgtgtgttattgctccgcaggataattcatacgaaaaaattgtttcgaatattcaggaagtacgtgcacgcaaggggcgagtaattgctgtagtaacagaaggggatacgcatattaaaaacatggccgaatataccatagaagttcctgccacacacgaagcgttaatgcccttgctgacagttattccgttgcagttattatcgtaccacattgcggtaatgagaggctgcaacgtagatcagccaaggaatctggcgaagtcggtaacggttgaa

SEQ ID NO: 34146 - DNA, 1137 bp, Cytophaga hutchinsonii
atgaattttgatttaactgaagagcaaaaagcagtgcagttggcggcaagagattttgcacaaacggagttattgcctggggtgatagaacgtgatgaacagcagaaattccctgcggaacagatcaaaaaacttggcgcattgggattgatgggtatcatgacggctgaaacctatggcggcgctggcatggataccgtatcctatgtattggccatggaagaaatatgtaaagtagatgcttccacaggagtttgtatgtcggtaaataattcacttgtttgctggggccttgagcattttggctcagaagcgcaaaaacaaaaatatcttaaaccattagcttcgggcgagcgtatcggcgcattctgtttatctgaacctgaagctggttctgatgctacttctcagcgtacaacagctgtagaacagggcgatcattatattttaaacggcactaagaactggatcaccaatggcaattcagcttctgtttatttggtaattgcacaaacacacccggaattaaaacataaaggcattaatgtgtttattgttgaaaaagggacgcctggttttgtggtaggtaaaaaagaaaataaaatggggatccgggcatccgatacacactctttaatgtttacagatgtaaaaatacctaaagaaaacagggtcggtgacgatggttttggcttcaaattcgctatgcaaacacttaatggcggccggatcgggattgcggcacaggctttaggcattgcttccggtgcgctggaattatcgcttgcttattctaaagagcggaaatctttcggaacagaaatatttaaccatcaagctattcaatttaaactggctgacatggcaactaaaattgatgcggccagattgttggttttaaaggccgcttatttaaaagatcagcataaagactatactgaagcggcagcaatggctaagctttttgcgtctcaggtagctatggatacaaccatcgaagccgttcaaatacacggaggatatggttttgtgaaggaatatcatgttgagcgcatgatgcgcgatgccaaaattacgcagatttatgaaggaacttcagaaatacaaaaattggttatcggcagggaattattcaaa

SEQ ID NO: 34147 - DNA, 1332 bp, Cytophaga hutchinsonii
aaacaactggatgcttctttcgtttggggcgtatctgcctcagcgtatcaaacagaaggagcctataacatagatggtaaaggtccttccatatgggatacctttacaaatgaaaataaaaataagatcaaggacagaaaaaacgcaaacattgcctgcgatttttattcccgttatgaagatgatctgaaactcatgcaatcgctgggcatcaatcattttcgtttttcaatttcctggtcgcgcatcctgccttcgggcacgggtgagattaatccggcaggcattgctttttacgatcgtttaattgatacctgtctgcgttacggcatcacaccctgggtaaccctttatcactgggacttaccgcaggcgctggaaaagcgtggcggctggacgaacagagaagttgtaaactggtttaccggatatgttgccatatgcgtcaaacactttggtgaccgcgtgcagcactggatggtaatgaatgaaccgatggtgtttgttggtgcaggttattttttaggcttacatgcacccggccgcagaggcatgaaaaattttcttcccgctatccaccatgccgtattaagtatgtgcgaaggtgcacgtgctatcaaatccatttatcccaatgctacagtaggtactacattttcctgctcacacattgagccttaccgcaatattgagaaagatcacctggctgcgtataaagtagatgcgctgttaaaccgtatgttcattgaaccaacgcttggtatgggctatccgattgataccttaaaacccctgcagaatattcatcagtatattctgcccggcgatgagtataagatgaaatatgattttgattttattggtgttcagaattatacacgtgaatttgtaaaacattcctggtttacgccttacctgaatgcgcgccttatcacggccccaaaccggaaggtgccgcataccttaatgaactgggaagtttatccggaatctatttatcatatgatcagaaaatttgatgcgtatcctggcattaaaaaaatcctgatcacagagaatggcgctgcctttgaagacacacatcacgagagtctaatatccgatcatttacggaccacgtatttgcaggatcatattgaacaggttttacgtgcgcgggccgaaggctcaaaagttgatgggtattttgtctggacctggacagataattttgaatgggcggaaggctatcatccgcgctttggcttgatatacaccgactttaaaaatcaaaacagaattgtaaaagaatcaggtctctggtatggttcttttattcgggaataatagctt

SEQ ID NO: 34148 - DNA, 981 bp, Cytophaga hutchinsonii
gacgttcagcggaagattaaaattattgcttctaaaacaggaattgaaaagcggtattcggtgctaaaggattttaatgctcagccggaagattttgaattttttccaaaggatgcttcattacttccagaacccggattgtcaaaacgtatggagatctttaacaaagaagctcttcagctttccattaaaacaatatcaaagattccggaattcgatcatattaaaaatacaatcacgcacctgatcaccgtaacgtgtaccggtttatttgcaccgggtctggatatacagttgatccaggcattagcattgaagccgtccattaacagaagcagcattaattttatgggttgtaatgccgccatacttgcgttgaagcaggcggatgttatctgtaaggcaaatggaaatgcaaacgtactaattgtatgcacggaattatgttcgatccattttcaaaaagattattcggatgactatattatctcaaatcagttgttcggagatggttgtgctgctgtacttgtaacggctgatccggtagcatatgcaacggatcaattagttaaaataaatgaatttcactccttgcttttacataaaggctataatgatatggcctggcagttatcggaaacaggttttagaatgaatttgacaacgtatgtgtcagacctgatcaatggcaatattaaacagatgcttgcagacataaatgttgatgcgaatgccattaatttttgggccgtacatcccggaggcagaaaaattattgatggcttttgtgaggcattgcgattagataaaggtcagctggaagcttcttatgatgtattaaaaaattacggaaatatgtcttccccgacaatcctttttgtattgaaacaggtgcttgatggaaacaaagaatctgcaaaaggcaaatccctattgacagctgcgtttgggccaggattgagtatagaaacgcttacgctg

SEQ ID NO: 34149 - DNA, 1098 bp, Cytophaga hutchinsonii
tcaacaactcctcgtttaaagtttatcgacactaaaaattcgcagttctttgcaactgtgaagcgtaacgttgatttatatttcaaagaaaataatatttcaaaaaatgcaaatgcattgatgatctttaaaagtatctttttctttggtggtgtttgggttttttatggtttgattctttctcaaaacttttccttgtcagtcatgctgattctggctatgttaatgggggtatttaaagcagcgtctgcttttaatatttcacatgatgccatgcatggttcctattcttcaaaagaatgggtgaataatttacttgcgtatacattcaacattctgggtgcaaacatttctgtttgggtagtaagccacaatattgttcatcatacattcaccaacattgaagagcacgatgaagatctgatcattgctccgggtttgatccgacttacagatggtgataaaaaatcaaaaattcagcgtttccagcatttatatgccttcttcctgtatgggtttgcaagcctttcctgggtacttcgtaaagactatatgaaaatgttccaggataaaatcggccagcatgtaaccaagcattatacaaaaagagattatatcgaattgtttttatacaaggcaattaactataccatctttattgtaattcctttagttgtgctggatattacctggtggcagttcctgatcggctttattgcgatgcactttgcaatgggcttcacacttggccttgtgtttcaattggcgcacgtagttgaagagacatctttccctgttacgaatggtgaaggaaatattgaagaagcatgggccgtacatcagatgtgtacgactgccaacttcgggatggattcattcttaacaagctttatttgcggtggtttgaattttcaggttgaacaccatttgttcccaaaagtttgtcatatccattatccggctatttcaaagattgttagagaaacggctgaatctatgaatgtaccttatctatataacgatacattctttacagcgctacaatcacattatcaagtactcaaaaaattcagcctggaagctgcataaaatattgtt

SEQ ID NO: 34150 - DNA, 2030 bp, Cytophaga hutchinsonii
aagaccttattcgaaaaagtttggaatgcacacgtagtaacagaggttaaagatggtccaagtattttgtacatcgacaaacaattgattcacgaagtaacaagcccgcaagcatttgcagggattgaaaaaagaggtattggtgttttccgtccggaaagaacattagccactccggatcataacgttcctactaagggacagaatttgccgattgttgaagatctgtcacgttttcaggttgataaattaacagagaactgcaacaaattcggtgttacactttatggcttagggcacgcatctcaaggtgttgtacacgtagtagggcctgaaacaggaactacacttccgggtatgacaatcgtttgtggtgattcacacacatctacacacggtgcatttggttcaatcgcattcggtatcggtacttctgaagttgagcaggtattggctacacagtgtctgatgcagacaaaagcaaaaacattaaaaattgagatcaacggtaaacttgcgaaaggtgtaaccgcgaaagatgttattctttatgtgatcgctcagatctctgcagcaggtggcacaggttatttcgttgaatactgtggttctgcaatcacgtcgctttctatggaagcacgtatgacgatctgcaacatgagtatcgaaatgggtgcacgcggcggcatgattgctccggatgaaacgacattcaactacatcaaaggacgtgagttcgctcctaaaggtgctaagtgggatgaagcagttgcatactggaaaacattgtattcagattcagatgctgtattcgataaaacattgaaatacgatgcagcggatatcggaccgatgatcacatacggaacgaatccgggtatgggtatcagtgtaaataaaaacattccttctcttgattctattgaagaaagcaataaagtaacattcaacaaagcacttgactacatgggcttccatgctggtgactcgttgattggcaaacaagtaaactgggtattcttaggcagctgtacaaacggtcgtatcgaagatttaagacagtttgctgaatttgtaaaaggcaaacaaaaagctgcaaacatcaatgcattgatcgtgccgggttccaagcaggttgaaaaacaagccatcgcggaaggtattgataaagtattggctgaagcaggttttgaattaagagagccgggctgttctgcctgtcttgcaatgaatgaagacaaagttcctaaaggtgaatattgtgtatctacatcaaaccgtaacttcgaaggccgtcagggtcccggagcccgtacgttgcttgtaagtccgttgactgcagcagcaatcgcggtaagcggcaaaattgttgatgtacgtgaaatgttgaactaatcttcaacattcaaatttcattcattaaaagaatttaagattttaaaacattccgaacaatggaaaaatttataacaataaaatcaactgtcgttccgcttccgattgaagatgtggatacagatcaaattatacctgcacgttttttaaaggcaactacaaaagaaggttttggcaaaagccttttctgtgactggagatacaatcaggatggcacgcctaaagcggatttcgtaatgaacaatccgttgtacagcggacaaatattagtagctggtaaaaacttcggttgcggttcttcaagagagcacgctgcttgggcaattggcgatgctggtttccgcgttgtggtatcttctttctttgcagatattttccgtggtaacgcgttaaacaatggcattcttccggtacaggtatctgatgctttcttaaaaagcattttcgatgccgttgcagcaaatgcaaaacaggaattggttgttgatttagcaaaccaggtaatctcaattgccggcacagacttgaaagaaagttttgtgatcaacgaatacaaaaagacttgtctgatcaatgggtacgatgatatcgattatgtattaagcatcaaagataagatcgaagcgtacgagaag

SEQ ID NO: 34151 - DNA, 1158 bp, Cytophaga hutchinsonii
aaataaatagttcgaagtattattatgggaaagagaattttcgttttcgacacaacacttagagatggtgaacaggtccctggttgtcaattgaacactgaggaaaaaatcatcgttgcgaaagcgttggacgaattaggtgtcgacgtaatcgaagcaggtttcccggtttcaagcccaggagactttaattcagttgtagaaattaccaaagcagtaacgcgccctactatttgcgcacttacacgtgccaaagaagcggacatcaatattgccggtgaagccctgcgttttgcaaagcgcagccgtattcatacaggtattggcagttcggatattcatattgaacataaacttcgttctacccgtgaaaacattcttgaaatggctgtagctgctgtaaagcaagcgaagaaggttgttcatgaagttgagttcttctgcgaagatgcaggccgcgcagatcaggcattccttgcacgtatggttgaagcggtaattgaagcaggtgcagacgtagtaaacattcccgatacaacaggctatatgttgccatggcagtatggtgagcgtatcaaatatttgatggacaatgtatcaaatattgataaagctattttatctgcgcattgccacaacgatttagggttggcaacagctaattctcttgcagccttacaaaacggtgcacgtcaggttgaatgtacaatcaacggtatcggtgaacgtgccggtaatacagcacttgaagaagtagtaatggcgatggaatgtcacaaagagacgttaggccttgagacaggaatcaatcataagaaattggttccgatcagtcatttggtatccacgttgatgcgtatgcaggttcaatcaaacaaagcaattgttggcagaaatgcatttgcacactcttcaggtattcaccaggatggtttcttaaagcaccgtgaaacatacgagatcattgatccggctgctgttggagcagattcttcttcgatcattcttactgcacgcagcggacgtgcagcattgaatcaccgtttggcaacaatcggttacatgttgtctaaagatcaattggatcaggcatatacacagttcctggatatggccgatcatttgagaaaagtcgaagacgaaaacttacacgaatta

SEQ ID NO: 34152 - DNA, 1512 bp, Cytophaga hutchinsonii
aaaaaagtaatactaatgattctggatggctggggtttaggaacaaatcctaaagtttcagcaattgctgctgctaaaacaccttttgttgattctttatttgtcaactatccgcatagcaaactggaagcttctggtttagctgttggtttacctgttggtcaaatgggtaattcagaagttggacacatgaatatcggtgcaggaagaatcgtatatcaggacttggtaaaaatcaatttggctgttgaaaacaatacccttgcagatgaaccggcaatcaaagatgccttcaattatgcaaagacaaacaataaaaaagtacactttatcggtttggtttcagatgggggtgtacactctcatgtaaatcacgtgaaaggcttgtgtaacattgcaaaccagtatgggttaaaggatgtatatgtacatgcgtttaccgatggcagagattgtgatccgaaaagcggcttaggttttgtaaaagaattgcaggagtcaatggcaaaatcaacaggtaaaattgcttctttggtaggccgctattacgcaatggaccgcgataaccgttgggaacgtgtgaaacttgcctatgatgtaatggtaaatggcgaaggtacgcatgctgccgatgcattaaaagcgattgaagaatcgtatgcggcaggcgttaccgatgaattcattaagccggtagtactggtagatgccaacgacaaaccaatcgcaaagattgagccgggtgatgtagtgatctgcttcaacttccgtacagaccgtggccgtgaaattacggttgcacttacgcagaaagatttccatgaacagaacatgtttaagcttgacctgtattatgtaacaatgacaaactacgacgatacatttaataatgtaaaagtcatttttgataaagacaatctttctaataccctgggcgaagtattgcaaggcgcttcaaaaaagcagatccgtatagctgaaacagaaaaatatccgcacgttaccttcttcttctccggtggccgcgaagaaccatttaaaggagaaaagaggttaatggcagcatcacctaaagtagctacgtatgatttagcaccggaaatgagtgcaaatgaaattaaagagaaaattgttgttgaattaaaatcaaaagatccggacttcgttgtattaaactttgctaatccggacatggtaggccatacaggtgttttcgaagcagcagttaaagcatgtgaagtggttgacagctgcacagaagcggtagtaacaactgcccttgaaaacggctacacagcaattgttattgcagaccacggcaatgcagattacatgattaacgaagacggcacacctaatacagcgcatacaactaatctggtaccatgtattttaatcgacaatgaatacaaaaaaccacttaaagacggaaagctgggcgatttagcacctacaattcttgcattaatgggcattgagaagccaaaagaaatgaccggagagtcgttattg

SEQ ID NO: 34153 - DNA, 1212 bp, Cytophaga hutchinsonii
atgaacaaaatcagttgggtagttatatctgtgttgtgcttaatacatgttcaaacacacgctcagattaatacacctgcaggagcaacagtgccatttggctcaaacaattcttatgcatatggtatcttgcctacaaacttacctacaagcggtacgtacggaaagggtactgaagttgccgcaaagtatacggcatggaagtctgcctatatagaaaactgcggtaccgataaggcacgtgttaaatttgataacacatcagaaaccgtatcggaaggtattgcctatggtatgttattggcagcatatgccgctgatcaggatttatttaacagactttgggcatattataaacaacacagaaatgctaaaggtgtaatgcactggaagatcagtggctgtaattcagttattggtcagaatggcgctacagatgcagaattggatgcggcaatggcgttaattgtggcgaattatcaatggccgaacaccacttctccgcacaattataaaacagacgcagtatcattgataaatgctattaagaattacgagattaatgcgacagattttacatttgaaaatggagatgcgtggaaaccagcctgtagaaatccatcgtatcaggcaccgggttatgcacgcgtgtttaaattgtttatggcagagaatggccaggctaacaatacattctgggataatgtaattcaaaagacagaaaatttattaattaataatgcacatactacttccggtctatctacgaactggtgtacccctgctggcccgccaaattcatcgtgcagcggttcaggcacagcgccggataaattcggctatgatgcatgccgtgctccgtggaggcaggccacggattatatctggtatggcccatcaacaattttaactattacaaatagacaggcagcattctggattggcaaaggcggcgcaggttctgttcagggtggtgacggtgttaaccacgacggttcaggatcaggcaatcacaatgcagcatttgttggtccgattggtgcattatctttagctacaaccaatacaacagctaatcagcaattttgtaacgcactttattcagaaaataaaaatgatggtttagccagtggctactttaccaagattttacagatgttagggttatttgtgcaaactggtaatttctggaatccatatgcggtatcatct

SEQ ID NO: 34154 - DNA, 1443 bp, Cytophaga hutchinsonii
ggcttttgatcgtgccggcggcaagcatggcaacaaaggcgatgaagcagcgattacagcgctaaaaatgctggcacaaacgatttaaatcaagtaagaacaattaatagataatagataatgagagttttaaaatttggaggtacttcagtagggaaaccagagcgtatgcactctgtcgctaaattaatctctagtccggatcctaaagtagttgtattgtctgctgtgtcaggcacaacaaatgctttggtagatatatcaactaaattatgcaagaaagatatcaaggcggcagaagacgctattgaaaaactttttaccccataccacgcattcgtagaagaattatatacaaccgaagcaggtaaatataagggccacgcgatcatgcgcacctactatgaactgataaaaagttatgtaacggcaccttctttcggcgacaaagaaacgcgcttttttttggcacagggcgaattgatctctacaaatttatttcaggagtacctggccgaacaaggctattcatcagcgttattgcctgcgttagaattcatgaagacagatgcggacagtgagccgatgcttgagtatattgaagaaaaactgaacgaacaattagcaaaacatccaaacaagcaattatacattacacaaggatatgtttgtttaaattcagatggagaagttgacaacctgaaacgcggcggttctgactatacagctacgttgatcggtgctgcgcttcgtatggaagagattcagatctggacagacattgacggtatgcataacaacgatccgcgtatcgtaaaacgcaccttcccgatccctgaaatttcatttgatgaagctgctgagttagcatacttcggagcaaaaattttacaccccacatgtatccgtccggcacaggtacgtaaagtaccggtacggttattaaacaccatgcagcctgaacaaaaaggtactgtaataaacagtaaaccttcagaccgcgatattactgcgattgctgcaaaggatgatattactgcaataaaaataaaatcaagcagaatgcttcaggcgcatggcttccttcggaaagtgtttgaaatatttgaaaactataaaacatctgtggatatgatcacaacttctgaagttgctgtttcattaactattgatgatgccaaaaacttagagcagattgtaaaagaattaaaagaattctctattgtagaagtcgataccgatcagacaattatatgtattgttggtaatttcggaaaagaaaaaacgggaatcagcaaacggttgtttgatgctatggaaacaattccggtaagaatgatttcatatggcggaagtgcttcaaacatttctattcttattaacagcacgttgaaaaatgaaacgctgaacgctttgaatgagcggttgttttttcaggcggaa

SEQ ID NO: 34155 - DNA, 942 bp, Cytophaga hutchinsonii
aaagaaacataccttttctggtatgaaaaaatgcaattggtaagaaagtttgaagagaagacaggacaactttacggtcagcaaaagataaaaggtttctgtcacttatacattggccaggaagcttgtgctgcaggtgcagtgtcagcattaaagaaaggcgatcattatattacgacataccgtgatcacggccaaccattggttttaggaacagatcccaaagcaatcatggctgagatgtacggaaaagcaacaggtatttctaaaggcaaaggtggttctatgcacatctttgacaaagcagtaaactttgccggcggccacggtattgttggcggccagattccgcttggcgctggtttggcatttgcagaaatgtacaaaggtacagataatctgtgtgtatgttatatgggtgatggcgctgttcgtcagggtgcattacatgaaacattcaacttagccatgttgtggaacataccggtgatcttcgttatcgaaaataacggatatgcgatgggtacttctgtacagcgtacatctaacgtaacagaattatatcaaatcggcgaatcatatgacatgccctctgaagcagtagatgcaatgagcgtggaagaagttcacttgtctgtagcaagagctgctgaaagagccagaagcggtggcggccctacattattagagttcagaacatacagatacaaaggtcactctatgtctgaccctgctaaataccgtaccaaagaagaacttgagtcttacaaggcacaggatccgattgaaaaagttcgtgctgtaattttagagaaaaaacatgctacggaagctgacttagaagctatcgatgctaaaattaaagcaaccgttgaagaagcagtgaagtttgcagaagagtctccatatccggatgcttctgaagcatacaaagatgtttat

SEQ ID NO: 34156 - DNA, 1383 bp, Cytophaga hutchinsonii
tctattcgaattgaaaaagataccatgggtttggtggaagtgccggcagataaatattggggtgcacaaacccaacgttccatagaaaattttaaaatcggtgatgcttcaacgcgcatgccgatcgaaatcatacacgccttcgctatcttaaaaaaggcagctgcacaaacaaatctcgaattagggattttagataaagaaaaagcaggcagtatcgcagaagtctgcgatgaaattctggcaaaaaaactggatgatcaatttccgttggttgtatggcaaacaggttcgggtacacaatcaaatatgaatgtgaatgaagtgattgcaaaccgtgcacatgttttgcttggcggaaatttactggatgaaacaaaaaaaattcatccaaatgatgatgtaaataaatcgcagtcatcaaacgacacgtttcccacggctatgcacattgccgcttgcctgatgttaaaaaaagtaacgattccaggaatagagcaattgcagcatacgttacggacaaaaacagaacagtttaaagatgttgttaaaataggccgtacgcatttcatggatgcaacgcctttgacattgggccaggagttttccggatatgctgcgcaattaagctatgcattaaaagcaattcacaatgcctcggcacatctttcagaactagcgctgggtggaacagctgttggtacgggaattaatgcacccaaaggatatgcggaacgggttgccgggcacattgctgcgctcacaggttttccgtttacatcagcacccaataaatttgaagcacttgctacacacgacgcattggtagaaatgcacggcgcgttaaaaacgtctgcagtgagtctgatgaaaattgcaaatgacattcgcatgcttgcatccggtcccagaagcgggattggagaaatccacattccggataatgaacccggatcttcaatcatgccgggcaaggtgaatcctacacaggtagaagccttgacgatggtttgcgcgcaggtaatgggaaatgatgtaacattgtccgttgcaggttctatgggacagtttgaattgaatgtgttcaaaccggtgattatttataattttctgcaatctgcacggctgatcggtgatgcatgtgtttcatttaatgaaaaatgtgcaaaaggaatagagcctaatacagccaccattgaacgcaatgtagaaaactcgttgatgctggttacagccttaaatccgcatattggttatgataagtctgcagaaattgcaaaacatgcgcataaagaaaacacaagtctccggcaggctgcattagcattaggctatgttaccaacgaacagtttgatgcctgggtaaatcctaaaaatatgatc

SEQ ID NO: 34157 - DNA, 1158 bp, Cytophaga hutchinsonii
ataacccttacaaaagacggccagcatgtgattgccgccagtgacagtatgttgtataattataccattacgtcaaaaactgttgttgcctacaaactttatttatctgaaacggtaaatgatattgcgctttcattggatgaaaaagaaattcttgttgcctctgataatatgactgcgtgggcacttgaggccgctagcggaaaagtgatccgtacctatcagggggcgttgcaggagcaggataaaggcgggcttaactataatgcagacaattactgggaatataatattgcgcgttatcttcgacttaaaaatgaattgctgctgacaaaagatgacaataattttataacaggcaaaaccggggtaaatgccattcaatggaatatctcaaccggggctccgaataaattatacgaaggacatactaaagcggtgatcagcatggatcaatcggctgatggcagcatattagccacagcagacggtgcgggtgaagtatttctttggaacacaaaaacaggcgcgctgatcaatcgcattaaaccacataccgaacctatttttgatgtgtcgttgagcagagatggaaaatatgtagcaaccggttcgtgggatgcaagcattgaagtgtatgatgttcagacgggagaagtaagctcagatatgtatctgaaagaaaattcctgctatagcatttcctttactcccaacggactgtacctgctttgcggcagattagataaatcactggaattgcgtgaaccggattctaaaaaagttgtgctttcgtttataggtcacaccgatgttgtttcatctattgcgttcggagcagatccgaataaggcactcactgcctcatgggatggaaccgcgcgcatctgggatgtaactacaggcatgatgctgcaaaaatttaagggagccaggggtatgttgcacagcgcaatttattccacagacagtaaaaaaattattaccggaggggatgaccgtatcatccgcatctgggatatacaatccggccaagtattaaagaccttaaacggtcatcagtctgagattacttctttgtctttaagcaaagatggaaagatgcttgtttcatacagcacagatggtgttgttaaattctggaatttagagtcggga

SEQ ID NO: 34158 - DNA, 1007 bp, Sphingomonas aromaticivorans
cgccctcttctgaagacgctccagggtgagaacatttcccccgaccgatctggctcatgcgccaggccggacgctatctgcccgagtaccgcgagcttcgcgccgagaagggcggcttcctcgcgctggtctacgacactgacgcagcggccgaagttaccgtgcagccgatccgtcgtttcggcttcgacggcgcgatcctgttttccgacatcctgatcgtaccctatgcgatgggacaggatctccagttcctcgccggcgaaggtccgcacctgtcaccacgcttgctcgacgccgcgctgaacagcctcgtggcggtgcccgggcgcctctcgccgatctacgagacggttgccaaggtgaaggcccagctttcgcctgaaaccacgctgctcggctttgccggcagtccgtggacggtcgcaacctacatggtggccggcgaaggcagccgtgaccatcacgatacccgcgcgcttgcctatcgtgatccttcggcgttccaggcaatcatcgatgcgattacggaagtgaccatcgagtatctttcgggccaggtcgaagcgggtgcggaagggctgcaactgttcgattcttggtcgggcagccttgctccggccgaattcgaacgttgggtcatcgcgcccaacgccaggatcgcctccgcgatgcagcagcgttatccccacgtgcctgtgatcgggttccccaagggcgctggcgaaaagctttccgcctatgcccgcgagacaggcgtcaacgcggtcggcgtggacgaaaccatcgatccgttatgggctgcgcgcgaactcccggcgaacatgccggtacagggcaatctcgatccgcttctgctcctttcgggcggccctgagctggaacggcagacgatccgtgttctcgaagcctttgccgaccgcccgcacgtcttcaatcttggccacggcatcggtcagcacactccgatcgaaaacgtcgaagcgcttctgaagatcgtgcgaggc

SEQ ID NO: 34159 - DNA, 282 bp, Sphingomonas aromaticivorans
cgctatttcaccaaggaccacgaatggatcgcggtcgagggcagcgaagcgaccgtcggcatcaccgactacgcacagagccagctcggtgacatcaccttcgtcgaactgcccggcgagggcagcgaagtcggcaagggcgacagcgcatcggtggtggacagcgtcaaggccgcgtcggacgtgtacgccccggtttcgggcaaggtcactctcgccaatgccgcgctcgaagagcagcccgaactggtcaacaccgaccctgaaggcgagggctggctg

SEQ ID NO: 34160 - DNA, 1239 bp, Sphingomonas aromaticivorans
gaagcctatatcatcgacgccgtccgtacgccgcgcgggatcggcaagcccggcaagggcgccctttcgcacctgcacccgcagcatcttgccgcgacggtgctcaaggcgctgaaggaccgcaacgacctggacacctcgaccgtcgacgacatcatctggtcgacctcgtcgcaggtgggcaagcagggcggcgatcttggccgcatggcagcgctggcggcagggtacgacatctcggccagcggcacgacgctcgaccggttctgcggcggcggcatcacttcggtgaaccttgcctgcgcctcggtcatgtcgggcatggaagattgcgtgatcgccggcggcaccgagatgatgagcttcaccgccgcccacggcgcggagctggccaatgccgggatcaagccgctgggcatgggttcgggcaacatggaactggatgccctgcacccgcagtcgcaccagggcgtgtgcggcgatgccattgccgcgcgcgaggggatcgaccgcatggcgctcgacgcgctcgccctcgtaagccaggaacgcgccgaccgcgcgatccgcgaggggcgcttcgacaagtcggtggtcaccgtctacaaccccgacggcacggtggcgctcgaccacgaggaattcccgcgtccggaaacgacgatggaaggcctgtcctcgctcaaggcaagcttcgacggaattgccgacttcgaccttggcggcaccacgttccgcaagcagatccagcgccgctatccggaactggagtggaagggcgtgcatcacgcgggcaactcctccggcgtggtcgacggtgcggcggcgctgctgatcgtttcacccgcctatgccgagaagcatggcctgaagccgcgcgcgcgcatcgttgcctatgccaaccagggcgatgacccgacgctcatgctgaacgctccggtgccggcggcaaggaaggtcctcgacaaggctggcctttcgaaggacgacatcgacgtctgggaaatcaacgaggccttcgcggtcgtggccgagaagttcatccgcgatctcgaactggaccgcgacaaggtgaacatcaacggcggcgcgatggcattgggccatccgatcggcgcgacgggatcgatcctgatcggcaccgcgctcgacgaactggagcggtcgggcgggcgctatggcctggtcacgatgtgcgcggcaggcggcatggcaccggcgatcatcatcgaacgcatc

SEQ ID NO: 34161 - DNA, 1421 bp, Sphingomonas aromaticivorans
gacaagctctacatcgccggccgctgggtgccggcgcattcggggcggatgatcctgaactggtctcgcccaacaccgagctggtggtgggccgggttgccgaagccgacgagacggacatggacgccgccgttgccgccgcgcgtgatgccttcgatcacgggccatggccaaccacgcctccggccgagcgcatcgccgcattccggcgaatggtcgcgcaccttgaaacgcgcgtgcccgaactggcgaaggcgtggaccgcgcagatgggcgggctcgcctcgttcgcggggccgatgcacggcggcagcgtgatggcgctgggccagattgcggggtttgcggaaaagttcgagttcgtcgagcgccgcccgagcatggccgccgataccgcgctgatcgcctatgagccggttggggtcgtggcagcgatcgcgccgtggaacgggccgttcgggatcatggcgaacaaggtcgcctatgccctgctgaccggctgcacggtgatcatgaagccgtcgcccgaaacgccgctggaagcctatatcatcgccgaggcggccgaggcggctggtattccggccggcgtcgtcaatcttgtgacgggacaccgcgaggcgagcgatcaccttgtctgtaacgaaggcgtcgacaaggtgagtttcaccggatcgaccgtggccggcaagcgcatcgccagcgtttgcggttcgcgcatggcgcgctgcacgctggaactgggcggcaagtcggcagccatcgtgcgggacgatttccccatcgatgccgccgcgaagatgctggcggggacgatcacgatgatgtcgggccaggtctgtgcgatgctcagccgggtcatcgttccgcgccgccgtcacgatgaactcgccgaggcgatcgcggcggaaatgaagaaggtgcgcataggcaattccgacgatcccgagacccagctcggcccggtcgcgatgaagcggcagctcgaacggatagagatgtatatcgaggagggccggaagacggccgatctcgtcaccggcggcggacgcccggcccatctgaatcgcggctacttcatcgagcccacgcttttcgccaacgtcaggaacgagagccgcatcgcgcaggaggagattttcggccctgtcctcagcctgatcccggtcgaggacgaggaggacgccatccgcaccgccaatgccagcgcatatggcctcaacggatcggtcctgaccaacgatgccgaagccgcctatcgcatcgcccggcgcgtgcgcaccgggggcttcggtcagaacgggctgcgcatggacttcggcctgcccttcggcgggttcaagcaatccggcatcggccgcgaaggcgggccggaagggctcttcccctatctcgaaatgaagaccatcctgattgatggc

SEQ ID NO: 34162 - DNA, 1605 bp, Sphingomonas aromaticivorans
ttcgattacatcatcgtcggcgcgggttcggcgggctgcgtcctggccaaccggctcagcgccgatcccgccaaccgcgtcctgctgatcgaggatggcggcgacaaccagcacccgttcatcaagatggccggcggcttcatcaagatcatgggcaacccggactatttccgcgtgttcccgacagaaccgcgccccgggatgcgccccggcatccacacctacgggcgcgggctcggcggatcatcggcgatcaacggcacgtggtatctcaccggcatgcccaaggactttgacggctgggcgcaatccggccttgccggatggggctgggacgaaatcgcccgctgctaccgcaagttcgaggactatcgcgagcccggcgcccatcccggacgcggccgcggcggcgagcttcaggtcactgcctcgacctacgaatcgccggtgttcgatgccctcgcgcaagggttcgccgcgcagggcatgccctggctggacgacatcaccacgccgggcgtgcagggggtaggccgcagccagtacaccgtggaccgcaagggcgtgcgcgaaagcacctacaaggctttcgtcatgccgatcctgggccgccacaacctgacgatcgcacagcacaccgccgtcaagcgcgtgacgatcgaacagggccgcgccacgggcgtcgtcaccgaggcgcacgggcaggaaagcacccatgtcgccaagcgcgaagtgatcctcgccgccggcgtctatggctcgccccaactccttcagctctcgggcatcggcgcgggcgcggtgttgcaggagctcggcattccggtcctcaaggccctgccgatggtcggccgccagctttgcgaccacaccaagttcggcgtctcgttcgacctcaccaaccaccccggcaccaaccgcgagttcttcggctggcggctctatcgcaacgcgctgcaatacttccttaccggcaccggccacctcgcccgcgtcggcatgcccctgaccggcctatacgccagcgagggcacggacaaggactggcccgacctccaggtcgccgccgcgcccttcgcgatgcgcaccgtcaacgagatggccgcgcgtcccggcagcccgctcacgccgaacccgggcctcaccttctcgggctaccacctgcgcccgaagagccgcggatcgatccgcctggtctcccccgatttccgcgatgcgcccgtcgccgatgccgcgatctgggcagatcctcacgacaaggccaagagcctcgaactgttccgcctgttccgcgccatcgccgcatccgaaccgctgcggcccttcatcggcaaggagcgcatgccgggccccgacgtgcaggacgaagccgccatcctcgccgaactcggcaagatggttgaggtcggcctccacgggacaggcacctgttcgatgggcaccgacgaggcgacctccgtcaccgacgcccgcgcccgcgtccacggcgtcggcgcgctgcgcgtggtcgactgctcgatcatgccaacccccgtttcgggcaacaccaacggccccgccatggccttggccgaacgcgccgcggaactgatcctcgaggacgcc

SEQ ID NO: 34163 - DNA, 1296 bp, Sphingomonas aromaticivorans
cgccgcttcaccgccaatggcccgctcaagggccgcatcggcgtgcccggcgacaagtcgatcagccaccgctcgatcatgctcggcgcgctggcagtgggcgagacgcgcgtgaccggcctgctcgaaggcgaggacgtcctttccaccgccgccgcgatgcgcgcgatgggcgcgacgatcgaacgcgacgcggacggcatgtggcacgttcacggcgttggcgtgggcggcctgctccagccgcaacaggcgctggacatgggcaattcgggcacgtcgacccgcctgctgatgggccttgtcgcaacccacccgatcacggcgacgttcgtgggcgatgcttcgctgtcgaagcgcccgatgggccgcgtgatcgatccgctctcgacgatgggcgccgagttcaccgcatcgccgggtggccgcctgccccttaccctgcgcggaatttcacctgccgtgccaatcgaataccgcctccccgtcgcatcggcgcaggtgaagagcgcggtcctgctcgcgggcctcaacacgcccggcgtgaccacggtaatcgaaccgatccccacccgcgaccattccgaacgcatgctgcgcggcttcggcgcggagctgaccgtcgatgtcgccgccgatggcgcgcgcgtcatcagggtgcgcggcgaggccgaactcaagccgcaggacatcgccgtccccggcgacccgtcatccgccgcgttcttcgtggtggcggcgctgctggtcgaaggctcggacctcgtcgtcgagaacgtcggcctcaaccccacccgcgccgcgctgttcgacgtgctgcgcctgatgggcggctccatcgaggagctgaaccggcgcgaagtgggcggcgaaccggtggcggacctgcgcgtgcgccactcgctgctgaccggcatcgatgtcgatcccgccgtagtgccgagcatggtcgacgaattcccggtgctgttcgtcgccgccgcccttgccaagggccgcacggtgacgaccggcctcgaggaactgcgcgtgaaggaaagcgaccgcatcagcgcgatgcgcgccgcgctcgaactggcaggcgcgaccgtcaccgagaccgaggacggcctgatcatcgacggcaccggcggcgaccccctgcccggcaccgcagagggcgcgagcgtcgtcacgcacctcgaccaccgcatcgcgatgagcatggcgattgccggcatcgccagccgcaacggcgtggaagtggatgacacccgccccatcgccaccagcttcccggtgttcgagagcctgctg

SEQ ID NO: 34164 - DNA, 1227 bp, Sphingomonas aromaticivorans
tttcccgaaggcttcctgtggggcgcagccaccgccgcgcatcagatcgaaggcaacaatctcaacgccgacctctgggtgatcgaaaacgtccccggcaccatttttgcagaacggtcgggcgacgccgcaaacagcttcgaactgtggccggtcgaccttgatctcgtgaagggcatggggctcaattcctatcgcttcagcctcgaatgggcgcggatcgagccggatgaagggcatttctccaatgccatgctcgatcactacaaggcgatgatcgagggttgccgggcgcgggggctcaagccggtcgtcaccttcaaccatttcaccaccccgcgctggttcgcagccaagggcggatggcataatccggagtcatcggcgctcttcgcccgcttctgcgaacgggcggcgcgccatcttgcggcaggaatcgaactcgccacaacattgaacgagcccaatctggctggcgtgatcggcgagatcctgccgccgccactggtggcaggcgacaaggcaacgcaagaagcagcagcgaagcagctcggcgtggcgctttatacgcccggcgtcgcgctctacatcaaggagccgaagacctatcgcgccaacatgatggaaggccatcgccgtggggtcgccgcaatcaaggcggtgcggcccgacctgccggttggcgtaagcctggcgatgatcgacgatcaggcggttggcaagaactcgatgcgcgaccggatccgcgaacgctactacaacgagtggctgcgccttgcgggcgagacttgcgatttcatcggtgtgcagaactacgaacgcaaggtctggaccgacaagggcgagttgccgtcccccgccgatgcgcggcgcaatactggcggcgctgaagtctggcccgggtcgctggcgggcgcggtgcgctatgcccatgcagtgaccaagctgccggtctatgtcaccgaacacggcgtcaattccgacgacgacgcgctgcgccagtggttgatccccgaagcgcttaccgaactgaagcgtgcgatcgacgatggtgtgccggtgcgcggctatatccactggtcgctgatcgacaatttcgaatggggcttcggctacaagtaccgcttcggcttgcactcgttcgaccaaagcaccttccagcgaaccgccaaacccagcgcagcaattctgggcagaattgcacggcgaaataggctctgagaggcg

SEQ ID NO: 34165 - DNA, 624 bp, Sphingomonas aromaticivorans
atgaacgtgctctccccatccctcgccgcgtcgtccggcatggccgacgtgatcggcgaggacggcaagatcgtggtgccggccgacgtcgaggaggcgatccgcaccctcatccgctggtcaggcgaccagcccgagcgcgaaggcctgctcgacacgcccaagcgcgtggcgcgggcctggcgggaatattgcagcggctatgctcaggacccggggcttcacctgtcccgcacgttcgaggaagtcggcggctacgatgaagtcgtgctgttgcgcgacatcccctttcagagccactgcgaacaccacatggcgccgatcaccgggaccgcatcgatcgcctacctgccccgcgaccgggtggtcggcatctcgaagctcgcccgcgtactgcacggatttgcgcagcggctgcaggtgcaggaacggctgaccgcggaagtggcgcaatgcatctgggacaatctcaagccgcacggcgtcgcggtggtgatcgaggcgcagcatggctgcatgaccgggcgcggcgtcaggacgcacggcgtgggcatggttaccagccggatgctcggctgcttcctcgatgacgcgagcagccgcaaggaagttctggccctgatg

SEQ ID NO: 34166 - DNA, 829 bp, Sphingomonas aromaticivorans
gcctacaagatcatcgaccacacctacgacaccgtcgtcgtgggcgcgggcggttcgggcctgcgcgcgaccatgggttcggcccaggccggcctgcgcaccgcctgcatcaccaaggtcttcccgacccgttcgcacaccgtggcggcacagggtggcatcgccgccagcctcggcaacaattcgccggaccactggacctggcacatgtacgacaccgtcaaggggtctgactggctgggcgaccaggatgccatcgaatacatggtgcgcgaggctccggccgcggtctacgaactggaacacgcgggtgtcccgttcagccgcaaccccgaaggcacgatctaccagcgtccgttcggcggtcacatgcagaacatgggtgaaggcccgccggttcagcgcacctgcgccgccgccgaccgtaccggccacgccatgcttcacgcgctgtaccagcagagcctgaagtacgacgccgacttcttcatcgaatacttcgcgatcgacctgatcatggagaacggtgaatgccgcggcgtgatcgcgctgtgcatggacgacggctcgatccaccgcttccgcagccatgcggtcgtgctggcgaccggcggctatggccgttcgtacttcaccgcgacgtcggcccatacctgcaccggcgacggcggcggcatggtgctgcgcgcgggcctgccgctgcaggacatggaattcgtgcagttccacccgaccggcattacggcgcgggcgtgctcatcaccgaaggcgcgcgtggtgagggcggctacctgacgactccgagggcgagcgtttcatggagcgctat

SEQ ID NO: 34167 - DNA, 774 bp, Sphingomonas aromaticivorans
ttccgcaagatgcacgggctcggcaacgatttcgtggtgatcgacgcccgcgaggcggccgtttccatgaccgccgcgcgtgcggcggcgctcgccgaccgccgcaccggcatcggttgcgaccagctgatcgttcttgaaccgtcggacgtggccgacgtgcggatgcgcatcttcaacaacgacggcagcgaggtcgaggcctgcggcaacgccagccgcgccgtcggcctcctccttggcggcacgcaattcattgaaacgcttggcggactgatccgttcggaagcacggcccgatggcgtctctgtagacatgggcgcgccccgtctgcgctgggatgaaatcccggtctcctatgcgatggacacgctggaaatgccggtcggctgggaggacctggagaacccggtcggagtcaatgtcggcaacccgcacgtgatcttcttcgtggacgatgcggacgccgtcgatctcgcccgtctcggcccgctgatcgagaacgatccgctttttcccgagagaatcaacgtcaatgtcgccagcgtggttggccccgaccatctcaagctgcgcgtgtgggaacgcggtgccggtcttacccgggcctgcggaaccggcgcctgcgcgacggcggtcgccgcgatccgccgcaagctgacgggccgcaaggtccggatcgacctgcccggcggcccgctcaccatcacctggcctgaaggcgggaccatcgatatgaccgggcctgcgacgctgagcttcgaaggcgcgttc

SEQ ID NO: 34168 - DNA, 765 bp, Sphingomonas aromaticivorans
ctagatggcaaggtgtgcatcgtaaccggttccggcagtggcatgggacgggctagcgcaatggaaatggcacggcagggaggccgcgttgttgtcactgacatcaacaccagtgccggcgaggaaactgtcgaggcgatccgggccgaaaagggcgatgcaatcttcatcgcctgcaacttgcgcaaggcgcacgaaatcaaagtactgatgcaaaaaactgccgaccattttggcggcatcgatgtgctgcataacaatgccgcgattcatgaaactgatttaactgacaagacttcgatcgaggatttgcccgaggagatctgggatgcagtttatgaagtcaacctgaaggcactgtggctgactacgcgctatgcagtgccttggttaaagctttccaagggtgccgcgattgtcaatgtcgcttcaacaggatcctttgtttcctatcctcaagctggtgcttattgcgcaaccaaaggcggcgtactgttattgaccaaggcgaccgccgtcgaccttgcgaagtacggaattcgctgcaattgctactgtccgggtgcgatcgagactccgatgctacagaagtatctcgatgcagccgaagacaagaaggcaatcatgtcggtccttaccggggcgcatctgataccgcgtttgggcaagcctgaggaagttgccaagcttgcctgcttccttgcatcggacgattccagctttatcaacggtgcatcttacgtgatcgacggcggcacgctggcc

SEQ ID NO: 34169 - DNA, 1590 bp, Sphingomonas aromaticivorans
aactttggagacctactggatgcgaccgccgcaaatgtgcccggcgatcgccccgccatcatccgcggagaccgggtcgtcgaatggggggatttcgacgcgcggacgaaccggctggcgcgcgccatgctggcagccggcctgcctaccggcgcccgcgtcgccattctcgcacgcaacattccggaattcatcgagattgccgctgctgcgttcaaggcgcgactggcgcacgtcaacctcaattaccgctacacaacatccgaaatcgaatacgtcctgcgcgactgtcaggccgcagcaatcttttaccaggacgaattcgcaccggttgtggccccgctgatcaatgggtccatcgatcaccttagctatgcagtacagatcggcgatggcggtgcctatgacgacatcgtgaccatcggcgaccccgagcctctcgggatcgagcgctcccctgacgacggctatctgctctatacgggtggcacgaccggacggccgaagggggtgatgtggcgcgctgcagacgcgcggcagacgcaattggaatctccggtcgcagtgacttcccctgccagcatggatgaccatgtggcgcaggtcttggcgggccgcgctgggcgcgtcatgcctgcctgcccgctcatgcacggggccgggctgaccagttccctggcagaactgctcattggcgggaccgtagtgcttctgccatcgaacagattcagtgcgctggagttgtgggaggaggcctcgcgcaatcgcgtcacgcgcatcctgatcgtcggagacgcatttgcacgccccatggccgatacgctggctgccaatcgggaacgttggaacctggattcgctgcgcctgatctcgtcgggcggccttatgtggtcgcagcaggtcaaggaagcgctgctcgaggccctgcccggcatcacattgctggacacgttgggcgcctccgaggcttcgggcttcggttatgcaatcacgacaaaggatcgcgccacgcccaccgggctgttcgaacccgcaccgcatacggtgcttatcgaccctgacagggatcgagtgctcggaagcgatgaagcaggcaagggttggctggcccgacgtccgcccttcgccagcggatatcatggcgatcctgtgaaaaccgccagcgtgtatcgcatcatcgacggcgagcgcctggccgttcccggcgacatggcagaacgcttgcccgatgggcgacttcgcctcctcggtcgcgacagcatgtgcgtcaacacgggaggcgagaaggttttcgttgaagaggtcgaagaggcgctgaagcgcgtaaacggcgtcgccgatgccatggtgttcggcctgcccgacccaaaatggggaagcgtggtgacagcgctgatcgaggccggcccctctcccgatgacgaggtcatccgcaccgccctgtcgcacgatcttgccgcttacaagcagccgcgcacgatcattcgtgtcgcagtgctgccgcgacacgcgaatggcaagagcgactaccgcaccggcatggagatcgcacaacgacagatcgccaccgggccgtctgccgactgagtc

SEQ ID NO: 34170 - DNA, 2073 bp, Sphingomonas aromaticivorans
actgtcgacgcgctcgttgccgtcggagacgacctgatccggctcgatcccgtcggagtcgccccttcgccggatcgcgcgccggtgggcgaggcggtcggggccattgtcgtcgtgcccctgcccaacggccttcacgcccggcccgccgcgcgcctgggcgaagcggcgcgcgccttcgccgcggaaacgcgcatcgtgaagaacggccgggcggtttccacccgctcgccggtcggcctgctcggtctgtccatccagctgggcgacgaaattctcgtcgaggccagcggaccggacgcctcacaggcagtggctgcgctggtcgacctcatccgcagtgggctgggcgagggcgctgaacacgatgccgccgcagagccgcgcgcctcgtctgccggcatgccgcccttcgctccggtgccggatggcgcgctgcgcggcaatcttgcctcgcccggcttcgcgctcggcacctgccaccgcctcgaccgctccgaaccggaactgccggtgcagggaaagggcaaggaagaggagcgcattcgcctgctctcggcgatggaccatctgcggtcgcggctcgcgatctcgtccgaggtcagccctaaggcagcgatatgcagcgctcaccgcgcgctgctggacgatcccgaactcgaagccgcggccctttcgcgtatcgccgagggcgaagacgccgcccatgcctggcgcgaggcttgccgcgcttcggcggtggttctgcgcggcagcggttcggcccgctttgccgagcgcgcggacgacgttctcgacctcgggaggcagctcgtcaccatcctcatcggcgaactcgacgagacgttggcgtttcctccggggacgatcctcctggcagacgaactgctgccttcccagatcatgcagctcggcgccgaggttaccggcatcgcgctcgcgaacggtggcccgacctcgcatgtcgcgatccttgcggccagcatgggcattccaatgcttgtcgccatcggcgatgcgctcgcaggcgttcgcgcgggcgacaaggccattctcgatgccgacggcggctttctcctcccggcgcccggcgctgccgcgcttgccgaggcagaagcggaagttgccgcgcgtcaggcgaggcgcgccgatgccctcgccagcgcgagcgagctttgccacagccgcgacggcgcgcgcatcgaagtcttcgccaatctcggctcgctcgacgatgcccgtcgggcagtctccgccggggccgagggctgcggattgctgcgcacggaattcctgtttctcgaaagggaaagcgcgccgaccgtcgcccagcaggccgaactctacgccgggattgccgatgcgctgggcggtcgccccctgatcgtccgcctgctcgacatcggcggtgacaagcccgcaacctatctgcccatcgcgccagaggccaatccggcactcggtttgcgcggcatccgggtgggacttgcccatcccgatgtgctggaagaccagttgcgcgccattctttcggtcgaacgcggaggggcgctgcggatcatggtgccgatggtcaccggcgtcgccgaggtccgcgaggtgcgccagcgggtcgaccggatcagcgccgaacttggcctcgcgcagcgcgtcgaagtcggcatcatggtcgaaacgcctgccgccgccgccaccgcgttcctgctcgcgccgcacgccgatttcatgtccatcggcacgaacgacctgacccagtacgtcctcgcgatggaccgggacaatccggccgtggcgggtgggatcgacgggctccacccggccgtgctcaacctgatcgcgcagaccgtgcgcggcgcgcaatcggtcggtcgctggaccggagtttgcggcggacttgcggcagatcgccttgcggtgccgctgctcctcggcctcggcgtgaccgagctgtcggtgccgctgcgtcaattgcccgaaatcaaggcgctcgtgcgcgggctgtccatctcggactgcaagactctcgccctcgaggcgcttcagcttgaatccgctgccgaaatccgtgccctg

SEQ ID NO: 34171 - DNA, 2094 bp, Sphingomonas aromaticivorans
atgtccaacacaagacgcgatttcctgaaatccgccgcaatcggcggggttgcagggacccttccggccagcatcgcgcgggcgctcgccgtgcccgcgcgccggaccacaggtacgatccaggacgtgcggcacgtcgtcatcctgatgcaggaaaatcgctcgttcgatcactacttcggaacgctgaaaggcgtgcgcggcttcggtgatcgccatccagtgcccatggagggggggcgatccgtctggtggcagcacaatggggcgcgtcacttgccgccattccacctcgataccaggaccaccaatgcgctgaaggtgccaggcaccccgcatagcttcgccgatgcgcaggctgcttggaaccagggcaagttcggcctctggcccaaattcaagaccgactattcgatgggctactaccgccgggaggatattcccttccagttcgccttggccgaggctttcaccatctgcgacgcctatcactgctcggtgaccagcggaacggacccgaaccgcattgtcttctggtccggggcaggcttcgatcccgagctgtgcgcgcagggcatcaattcgcgtgccgaccgcagcgagcccgacaatctgcgctgctggatcaagggtgccctgcccgagccgggctacacctacgcctccaatgcgctgatgtggaaaaccattcccgaagtcctcgaagatgcaggcgtcgattggcggatctaccaggaccccaacgacaactggacaggcgcgatgcacggtggccttgccttcgagggcttccgcaagtcccgcccgggcgaaccgctctatgaaaagggcatgcgccaccattcgctcgagcagcttgcccgcgacgtgcagcagggcaccctgccggctgtctcgtgggtgctgccgcccaaaccctggtcggaacacccttcctcctcgtcgcctatcgagggagctgagtttaccgcacgcgtcctcgatgcgctttctgccaaccccgaagtgtggagcgggaccgtattcttccagaccttcgacgagaacgacggcctgtttgatcacctgccgcccgctgcgccgccgtcctacaacgccgatggtactctggcgggcaaggcgaccctcaggctcgatggacactacttcgatgacaacgaagaccgtcacacctctcgcgacgatgtgatttcaggccatctgcggccgttcggcctcggtccgcgcgtgccgatgtacgtggtttctccgtggagcaagggcggctgggtcaacagcgaggtgttcgatcatacctcggtcggccagttcctcgaaaagcgcttcgggatcactgttcccgcgatcagcccatggcaccgcgcagtgtgcggcgacatgacctcctgcttcgatttctcgagggacggagacgcccgctttcccgaactgccggacgtgtcgaactccgtggcgacgatctcacgccaccagcagcaagcccgtctgctgccgccgcgtgaaccgcagggccttttccaggagcagggtttgcgccgctcccgcgcgctgccctatcgtctcgaggtggatgccagcatcgaggcagggcgcgtcacgttggccttcgtcaacagcggcagcgtaggcgcggtcttccatgtctatgaccgccagcatctcgaccgcatcccccggcgctacacggtcgaggcgggcaagcagctagaagacgtctggcagttcggcggtgacgccggtttcgacctgtgggtgcttggcccgaacggtttcctgcgccacttcatgaagaaggcggcgacggcaggtgaagtgcccggcgtgcgcatccgcacatccgcccggcaggccaggcttgatcttgcattctccaacccgggcggagaaagcgtcgcggtcacgctaggcgacgatgcctacgggttcgctcaaacacgtcaggtcgtagtccccgccggcggaaccacgcgtgccgtctggaatgcggagcgaagccaggactggtacgatttcaccatcacgacggcaggagtcgccattcgtgcggccggacgcatcgagcgcggtatcgacggggttagcgacccgctcatg

SEQ ID NO: 34172 - DNA, 1479 bp, Sphingomonas aromaticivorans
cgccggctcgactacgaccagttcttcgcctggcgcgaccagctcgtgccgctgctccacgtgcggcgcggcgacagggtggccatcgccatgcgcaaccgcgccgaatggctcgtcgcgttcctggcggtaatgaaggcgggcggcgtcgcggtcctggtcaatagccggggctcggggccggaacttctggccatgctggaagatgtcgatcctgccgtcgtgctggccgataccgaccgcgccgatgccgtgcgcgacgcgggatacaagggccgcgtcctcgacctgaccaagccgcttcccgaagacgaactgacgcgccgggcggcagagccggcggccgatgccggcgtggccgatcccgaagatccctgcgctatcctgttcacctcgggcacgaccggacgggtcaagggcgcgatcctttcgcaccgcaacgtcatcaccgggctgatgagcacgcagatgtcgggcatggtcgtactgaccaacatggccgcgcagatgggcaccacggtagaggcgctgatcggccagatgccgcagcaggcttcgctgctggtctatccgctgttccacgtctcgggccttggcgccgggttcctctcgcccttcgtgagcgggggcaaggtcgtgatcatgcggcgctgggacgccgacgaggccgcgcgcctgatcgccgccgaacagatcagcatgttcagcgccgtgcccacgatgctgtgggacatcctccaccgcgcgcgcacggacggggccagcctcgtctcgctgcgcaacatcggcagcggcgggcaggccttgccggtgaacctggtcgaggaagtccacgcgctgtgcccccacgcccagatcggcaccggctatggcatgaccgaatgctcgggcgcgatcgcgcaggcggtggggccggacttcatgcgccgcccggcagcggcgggcagggtcctgccgatggtcgaagtgcggatcgagggccccgaaggacagatcctggcgcctggcgaggcgggcgagatcgtcgtgcgcggcgcgcaggtgatgaagggctactggaaccgcccggaagagaccgccgcggtgctgaccggcgacggttggctgcgtaccggcgacgtcggcttcgtcgacgaggatggctatgtcttcatcgtcgaccgcaagaaggacatggtcatctcgggcggggagaacatctactgcgccgaggtcgaacgggtgctgggcgaattgccgggcctgaccgaatgcgccgccttcggcctgccggacgagcggctgggcgaacggctggtggcagtggtcatcgccgccggaaatgacggcatcgacgaggcgggcgtgatcgaatgggtggccggccggcttgcccgctacaaggcgcccacccgcgtcgcctttgctaccacgacactgccgcgcaacgcgctgggcaaggtcgacaagatcgccctgcgcaagctgtggccgcaactt

SEQ ID NO: 34173 - DNA, 768 bp, Sphingomonas aromaticivorans
aagtgtgcgcttgtgactggctcgacctcgggcatcggccttgcctatgcgcgggctctcgcggcggaaggggcgcatatcgttctcaacggcttcggcgatccggccgagatcgaggcgctttgccgggaactcgccgacgccagcggcggacgagcgatctttgcggcgggggatcttacgcggcgcgagggcaccgaggcgatgatggcgacggcgctggccgaattcggcgcggtggacatcctgatcaacaacgccggcatgcagcacgtggcgccggtcgaggagttcccggtcgagaagtgggatgcgatcatcgcgctcaacctcacgtcggccttcgatgcctgccggctcgcaattccggggatgaaggccaagggctgggggcgcatcatcttcacggcttctgcccactcgctcacggcatcgccgttcaaggcggcctatgtctcggcaaagcacgggatcgcagggctgacgaagacgctggcgctggaactggcgacgcatggggtgaccgccaactgcatcagccccggctatgtctggactccgctggtcgagaaccagatccccgacacgatgaaggcgcgggggatgacgcgcgagcaggtgatcaacgacgtgctgctgacccgccagccgaccaagcagttcgtccagcccgaggacgtggccgcgctggcgctgttcctgtgccggcacgaggcgcgcaacatcaccggtgcgaactacaacatggatggtggctgggtggcggaa

SEQ ID NO: 34174 - DNA, 1437 bp, Sphingomonas aromaticivorans
ggccttaccttcgacgacgtgcttctgcgtcctgccgagtcggacatcgtgccatcccaggccgacacccgcacccgcctgaccaagggcatcggcctcaacatcccaatcctgtcctctgccatggacaccgtgaccgaggccgacatggccatcgtcatggcgcagcttggcgggatcggcgtactccaccgcaacctttcgatcgaagagcagtgcgccgcggtccgggcggtaaagcgcttcgagagcgggatggtcgtcaaccccatcaccatttcccccgatgccccgctgggcgaggcgcaggcgctgatgcgccagcacaagatcagcggcattccggtggtcgaggcgtccggcaagctcgtcggcattctcaccaaccgcgacgtgcgctttgccgacaacccgcagcagcccgtgcgcgaactcatgacgcacgagaacctggcgaccgtgaagctcggttcgagtggcgacgaggcgcgccgcctgctgcatcagcgccggatcgagaagctgctggtggtggacgatgccttccactgcattggcctcatcacggtgaaggacatcgagaaggcggtcactttccccaacgccaccaaggatgcggccggacgcctgcgcgttgccgccgccacgacggtcggcgaaaaaggcctcctgcgcacccaggcgctggtcgaggcggaatgcgacgtggtgatcatcgacaccgcccacgggcacaaccgtgacgttgcccgcgccgtcgaggcagcgaagaagctgtcgaattcggtccaggtgatcgccggcaacgtcgccacggccgaggcgacgcgttcgctgatcgatgcgggcgcggacggcgtgaagatcggcatcggccccggatcgatctgcaccacccgcatcgtcgcgggcgttggcgtgccccagctgaccgccgtgatggaatgcgccgccgaagcggaaaagtcgggcgtgccggtcattgccgacggcggcctgcggacttcgggcgacgctgcaaaggcgctggccgccggtgcaagctcggtcatgatcgggtcgatgcttgccggcaccgaggaagcgccgggcgagacgttcctctaccagggacgcgcctacaagtcgtatcgcggcatgggttcggtgggtgcgatggcgcgcggcagcgcggatcgctatttccagcaggacatcaaggaccaaatgaagctggtgcctgaaggcattgaaggccaggtgccctacaagggaccggccaaggatgtggtccaccagctcgtcggcggcatcaaggccgcgatgggctataccggcagccccacgatcgacgatctgcgcaagcgcgcgcagttcgtgcgcatcaccaatgcgggcctgcgcgaaagtcacgtccacgacgtgacgatcacgcgcgaggcgccgaactacaaggtg

SEQ ID NO: 34175 - DNA, 846 bp, Sphingomonas aromaticivorans
tgcgatggaactggtgcgcaattcctatttcaacggccagtgcatccgcctcgacggcgcgatccgcatggccccgcgctgaggatcgaaccgatgagccaatctcccttccgcgacgacgtcctcgccggcaagaccgcgttcatcgcgggcggaaccagcggcatcaatctgggcatcgcaaagcgctttgccgaactgggcgcgcgggtcgccgtcctcggtcgcaatcccgaaaaggcagcgtccgctgctgacgaaatcggccacgatgccatctggcgggccgccgacgtgcgcgattatggcgcgatctgcgaggcgatgaagtcggtccgcgacgagatcggcgcgctcgacatcgtcgtgtcgggggctgcgggcaatttcctggcgccggtactcggcatgtccgccaatgccttcaagacggtcgtcgacatcgatctcctcggcacgttcaacgtgttccgggggtgtcacgaactgctcaaccccggcgcgtcgctcatcgcgatcaccgccggacaggcggagcaggccatggcgatgcaggcccatgcctgcgccgcgaaggccgggatcaaccagctcgtgcgcacgctggcgatcgaatggggccccgatgtgcgagtcaacggcatttcgccgggtccgatcgcggataccgagggcatggcaagactggcacccgatgaatcgacgcgccagcagcactatgcgcgcatcccgatgaagcgctggggcacctgttacgagatcgccgaggcggcggtgtacctgtcgaccccggccgcaagctacgtgaccggcgcgatcctcgatgtggatggtggcagttcggtc

SEQ ID NO: 34176 - DNA, 1125 bp, Sphingomonas aromaticivorans
accgagcgggtcaccatggggcgtcctgcccgcgaggcgatccgtgaccaggcggagaagatgggggcgcgccgcgtgttcatcctcgcttcggacaccttgcggaccaaaaccgacgagatcgcagcgatcgagcgcgaacttggtgaacggcacgctgcgaccttcagcggcattgcgccccatgcaccccgatcggacgtcctgcgcgccgccgatgccgcacgcgcggctggcgcggatctgatcgtctcggtgggtggtggctccgtcaccgacagcgcgaagatcgtggcgctgctgctcaagcacgatgtgcgcagcgtcgaggcgttcgagccgctgcacgtctatgtcgacggcgatggcaatgtgatcaacccgctcgccgtcggcccggatgtgcgtgtcatatgtgtgccgaccacgctttccggcggcgagttcaacgcgctttcaggcgctaccgacgaagcggtgcagcacaagcagggctacgagcatcgcgacatggcgccggtcatggttgtgctggacccggcgctgacggtctacacccccgaatggctctggctttcgaccggggtccgatctgtcgaccatgcggtggagacgctcgcctcccacctttccaatgattttgcggatggccttgcggacagcgccctgcgccttctggtcgaagggctcagtcgtgccaaggcggacccgacagacatggaggcgcgcctgaagtgccagatcggtgcatggcaatcgatgatctcgatcatcggcggcgtgccgatgggcgccagccatgccatcggccacatcctcggcggcacttgcgacgtgccgcacggctatacgtcgtgcgtcatgtccccctatgtgctggcctggaatgccgagcatgacgcgagccggcaggggcgcattctgcagtgcctcggcaatacccacgcttcggcgtccgaagcgcttgacgccttcatccgcagcctgggcatgcctcgcaccctttccgaagtgggcgtcggcgaggaccgcttccagcaggtagcagaatataccatgcttgatatatgggggaggaccaatccgcggccggtccgttcgcccgctgatatcctggagatactg

SEQ ID NO: 34177 - DNA, 1521 bp, Sphingomonas aromaticivorans
ttcctgcgcttctgggcggaggatcgtccgcaaggcgtcgcgctcgacgggcccgatcgcaagctgacctatggcgaactggaggaaaccaccgcgcggatcgccggcgggcttgccgcaatggggatcgccaagggtgaccggatcgcctggttcggcaagaacagcacgctctacttcgcgctgttcttcgccgcggcgcgtcttggcgcggtgatggtgccgatcggctggcgccttgcgcccgtcgaggcgacatggatcgcgggcgatgcgcaggcgcgcatggtgtttcttggagaaggcttcgaaggcctggccgatgcattcgcggcgctgccggcggtcggtcactgcctgacccaggcagaggcatggcactggattgacggcctgcctgccggcgcgttcgagcccgcgggcgcggacgatgcggtgctccagctctatacctccggcacgaccggcaatcccaagggggcggtgctttccaaccgcaacctgttcggcctgcgcaagcagtcgatcggcaacgatcagccctatacgacgatgaccgacgacgaggcgatcctcgtcgccatgccctgcgcgcacatcggcggcaccgggcttggggtcatggccatcggcgcgggtctaccgggcatcgtgctggccgagttcgagccgcgcgcggtcttcgatgcggtggaacagaaaggcgtcacccgcttcttcatcgtgcccgccgcgttgcagatgctgctcaaccacccagattgcgccagcgtcgatttcagccgggtcaagtacatcatctacggcgcatcgccgatcccgctcgtcctgctgcgcgaatgcatcgccatgttcagcgccgaattcatccaggcctatggcatgaccgagaccaccggcacgatctgcatgcttccgcccgaggaccacgacgtcaacggcaaccagcgcatgcggtcggcagggaagccacttccgggcgtggaagtgcgcgtgatcgacgagaacggcaggtcgcttggtcccaacgagatcggtgagatccagacccgctcgtcgaacaacatgctgggctactggaacctgcccgaggcaaccgcaaagacgatgacgccggacggctggatttcgacgggtgacgccggctatctcgacgaagatggctatgtctacatgcacgaccgcatcaaggacatgatcatctcgggcggcgaaaacgtctatcccgcacaggtcgagagcgcgatctacggccatccggacgtgcaggaggtcgcggtgatcggtgtgcccgacgagaaatggggcgaggcggtcaaggccgtctgcgtccccaagccgggccacacgatcgaccctcagtcgatcatcgactggacccgcgagcggcttgccggcttcaaggtgcccaagtcggtcgatgtcatcgacgccctcccgcgcaacccttcgggcaagatcctgcgccggaccctgcgcgaaccctattgggcggggttcgagcggcaggtgaattgagga

SEQ ID NO: 34178 - DNA, 2128 bp, Sphingomonas aromaticivorans
cgctcgcccgcgctcgacaatgcgcttcgcgaccatcagcccggagcgggccagaccgatgaagcgactgctctcggcaatgccggggaaatccaccaggaggctgctgccgaaaacgatgcggctgccttcctgaccgacaacttcggccatcgcctgtccgacaaccagaatagcctcagggccggaatgcgcggtccgacgctgatcgaggacttcatcctccgcgagaagatcttccacttcgaccacgagcgcattccggagcggatcgtccacgcgcgcggatcgggtgcgcacggcgtgttcgaggtgacgcgcgcgatccccgacctgaccagggccgggttgttccagaaaaagggccagacctgcccggtcttcgtgcgcttttccaccgtggccggcggggccggctcgatcgacaccccgcgcgacgtgcgcggcttcgcggtcaaattctataccgacgagggcaactgggacctggtcggcaacaacatcccggtgttcttcatccaggacgcgatgaagtttcccgatctggtccattcggtgaagatggaagccgatcgcggctatccgcaggcggccagtgcccatgacaccttctgggacttcatcgggctgatgccggaatcgatgcacatgatcatgtgggcgatgagcgaccgcgccattccccgcacgctgcgcatgatggaaggctttggcgtgcacaccttccgcttcgtcaatgcggcgggcgaggggcggttcgtcaagttccactggaagccggtgctgggcatggaatcgctgatctgggacgaggcggtgaaggtcgccggggccgatcccgatttccatcgccgcgacctgttcgaatccatcgctgccgggcacttcccggcgtgggaccttggggtccaggtcttcgacgaggaattcgccgcgagccagccgtacgatgtgctcgatgcgaccaagctgattccggaagaggacgtccccgtcgagatcgtcgggcgcatgacgctgaaccgcaatgtcgacaacttcttcgccgagaccgagcaggtggcgttcctgccatcgaacgtgatcccgggtatcgacttctcgaacgacccgttgctgcaagggcgcctgttctcctacctcgatacgcagaaatcgaggcttggcacgacaaacttccaccagattccggtcaatgcgcccaagtgcccgttccataacatgcagcgcgacggcctgatgcagacgctggtgcccacaggccgcgccaactacgagcccaattcgctcgacgaagcgggcgaggacagcgggccgcgcgcctgcccggaaaccggcttcacgtcgttccgcgagaatggcgagcgccacgatccgaccgaaaaggtgcgcgtgcgggcggatctcttcgccgaccactacagccaggcggcgctgttcttccactcgcagaccgagagcgaacaggcgcacatcgcctctgcgctggtgttcgaactgtccaaggtcgcgctggaacatgtccgggcgcgggtcgtgtcgcggttgcgcaacattgacgagacgctggcgcagcgcgttgccgatggccttgcgatggacctgccggaaaaggcgcctgccgcacgccagccggtgaagatgaagccatcggacgccctgtcgatccagaagcaggcgaagaagacctttgccggacgcaaggtcggcattctctttgccgaaggatcggacaaggcgacgatcgacaagctgaaggcgggtgtggaggaggcgggtggcaccgtcttcctcgtcgcgcccaaggtcggcggcatcccggtcaagggcggcacgctgaaggccgatggcaagctggatggatcgccctccgtcctgttcgacgcggtggcatcggtgctgatgccggaagcggcggcgaagctcgccatgcagggtgcggccgtgcagtggttcatggatgcctatggccactgcaagacaatcgcccactgcaacggcacccggatcatcctcgagaaggccggggtggagcctgagcgagggcgtggtgcccaatgaaaagctgctcgaagtcggccctgtgcgccacttcgcgcgtgagccgaaggttcgcgatctggcctga

SEQ ID NO: 34179 - DNA, 1472 bp, Sphingomonas aromaticivorans
gtggtctccactaccgacggcgacgtgcgcggcaccgcgaacgcgggcgcggatgcgttcctcggcattccctatgccgcggcgccggttggcgcgaaccgctggcgcgagccgcaggcggcggcttcatggacaggcgtgcgtgatgcatcggcgttcggtccggtctgccagcagggcgtgccttcgccgtgggggccgtatactgcagagttcctggcgatgccgccgatgagcgaggactgcctgacgctcaacgtctggcgccctaagagcgcagccacgaagaagctgccggtgctggtcttcatccacggcggcggcttcggtggcggtgcgggcagcctgccgatctatgatggcgcgaagttggcggcgaatggcgcggtggtggtgacgatcaactaccgcgttggcgtgctgggcttcatggcccatcccgcgctcaccgcggaatcgccgctcggctcatcgggcaactacgggctgctcgaccagatcgccgcgctgaaatgggtgcgggccaatgccgcgcgctttggcggggatgcgggcaatgtgacggtgtcgggcgaaagcgcgggtgctgcttcggtcgcggacctcatggtttctcccatggccagcgggttgttcgacaaggcgatcgcgttcagcggtgcgagcatggcggtcgacgtgccgccgctggcgaagaacgagatgatcggcgcggaccttgcggcgaagctcggcaagacgagcatcgcacagatgcgcgaggttccggccgaagcgctgatagaggcgacgcgctacgttccgggcgcgaacagcggccccccgccgctgcgcttcgtgcccaatgtcgatggcaacggtcgtgccgttcgatccggtgcgcgccagtggtccggtggcaagcccggtgccgttgatcacgggctttaacgctgccgagatgatcgacccgtcggtacgcacgccggcgcaattcgagacggcggtgcgggggcgctatggcgatttcgccgacaggctcctctcgctctacccacacgcgacagaagcggaggcagtcgcctcgaacgcgctgctcgcgcgggatcggtacatggcgggcgtgctgctgtgggcgcgcgagcggacgcggacggcgcagcagccggtcttcgcctatctctatgaccacgcctatccggcggtgaagggcgggcaatcgtggggtgcgttccattcgtcgcaactgccctatgtattcggcaacatcggcattggcgagcgcacattcggtcccgccgacgcgcgcgtggtcaggcaatggcaggaccgcctgcttgccttcatgcgcagcggtaatccgggcaagggctggccccgtgtcacgcgcaccagcgcgagggtcatgggactgggcgaccgcgaaggcattcgggccgcagtgtccacgcccgaacggctggaggcgttccgcgcctatgccgcgagcggag

SEQ ID NO: 34180 - DNA, 1218 bp, Sphingomonas aromaticivorans
cggtgcaattaccggccgccgaaggagacaaggcatatggcgggaatggtccggttcgattgggaagacgcgctggggctcgaggggctcctgaccgacgacgagcggatgatccgcgatgccgcgcgcgcctttgcgcaggatcgcctccagccccgcgtgatcgacgcgtttgccaacgagcataccgacccggcgattttccgcgagatgggcgagcagggcctgctcggcgtgaccctgcccgaggactatggctgcgccggtgcgggctacgtgtcctacggcctcgtcgcacgagaggtggagcgggtcgactccggctaccgctcgatgatgagcgtgcagtcgagcctcgtcatgttcccgatctacgaatacggatcggaagagcagcgtcgcaagtacctgccccggctcgccagcggcgaatggatcggctgcttcggcctgaccgagcccgatgcgggatcggaccccggcgggatgcgcaccaccgcgcgcaaggtcgatggcggttatgtgctgagcggcagcaagacctggatctccaatgcgcccatcgccgacgtcttcgtcatttgggccaagagcgatgcgcacgatggcggcattcgcggcttcgtgctggaaaagggcatgaagggcctttccgccccgaagatcgagaacaaggtgtccttgcgcgcctcgatcaccggcatggtcgtgatggacgacgtgttcgtgcccgacgatgccctgctgcccaacgtgcagggcctgaaagggccgttcggctgcctcaaccgtgcccgctacggcatttcatggggttcgctcggtgcggcggagttctgctttgccgccgcgcggcagtacgggctcgaccggcaccagttcggccgcccgctggccgcaacgcagcttttccagaagaagctggccgacatgatgaccgatatcacgcttggccttcatgcctcgcttcgcgtcggccgcctgatggacgaaggcgccttcgcgcccgagatgatctcgatcgtcaagcgcaacaatgtcggcaaggcgctcgacatcgcgcgcattgcccgcgacatgcacggcggcaacggcatctcgggcgaatatcaggtcatccgccacatggtgaacctcgagacggtcaacacctacgagggcacgcacgacgtccatgcgcttatcctcggacgcgcgattaccggcatcccggcgttc

SEQ ID NO: 34181 - DNA, 726 bp, Sphingomonas aromaticivorans
ctgttcgacctttccggcaaggccgcgatcgtcaccggctccacgcgcgggatcggccgcgcgattgccgaggcgcttgtcgcggccggcgcgcgggtcgtgatttccagcgaggatgcggccgataccgcgcgcgtggcggcggagcttggcatgcccggctgcgcctgcgacgttgccgatgaccttcagcttgccgcccttgtcgagttttcgcttgcttcgctggggcggctcgacgtgctggtttgcaacgcggggatcaccggcaaggcgggccccttcgccgagatcgacatggacgattacgcacgcgtcatggcgatcaacctgcgcagccaggtcgtgatgtgcaaccttgccctgccgcacatcgcggcgggcgggggcggcgcagccattctggtggcgagcctgtcagccctgcgcggcaatggccggatcaatgcctatgccctcgccaaggcaggcgtcgcccagcttgcgcgcaaccttgcggtggagtggggaccacgggccgtccgggtcaatgcggtttcgccggggttcatcgcgaccgaattgtccggccctctgctggctgacgagggcttcatggcgcgccgcatgtcgatgaccccgctgcgccgccccggaacgcccgcggaggtcgcgggtgcggcggtgttccttgcctcgccggccggcggcttcgttaccgggcacaacctggtggtggacggagga

SEQ ID NO: 34182 - DNA, 1196 bp, Sphingomonas aromaticivorans
gtggaagcggcgctggccgacatcgagcagcggggcgacgatgccgtgcgcgagatgagcgtgaagttcgatggctgggaccgcgacgactatcgcctctcccaggcagagatcgatgcggcggtcgacagcctgagcccgcaggaacgcaaggacatcgaattcgcgcaggcgcaggtgcgcaacttcgcgcagatccagcgcgaaagcgtgaaggacgtcgaggtggaaaccatgcccggcgtcgtcctcggccaccggaacgtgccgatccaggcggccggctgctatgtcccgggcggcaagtatccgctgctcgcctcggcgcacatgtcggtcatcactgccaaggtcgcgggcgtgccgcgcgtgatcacttgcgcgccgcccttccagggcaagcccgcgcgcgccatcgtcgccgcgcaggccatggccggggccgacgcgatctacgcgctgggcggcatccaggcgatcggcgcgatggccatcggcacgcagagcatcgatccggtcgatatccttgtcggcccgggcaacgcattcgtcgcagaggccaagcgccagcttttcggccgcgtcggcatagacctcttcgccggccccaccgaaacgctcatcattgccgacgagatcggctgcgatcccgaaatggccgcgaccgacatccttggccaggtagagcacggaccggacagccccggcgtactgctgacaaattcggaaaagctcgcccgcgaaacgatggccgagatagagcgcctgctccggatcctgcccaccgccgaccatgcacgcaaggcatgggaaaccttcggcgaggtgatcgtggccgaaagctacgaggaaatggtccgcatcgccgacgacatcgccagcgagcacgtacaggtgatgaccgccgaccccgattacttcctgaacaacatgaccaattatggcgcgctgttcctcgggccccgaaccaacgtttccttcggcgacaaggtgatcggcacaaaccacacgcgccgacgaaaaaggcggcacgctataccgggggtctgtgggtcggcaagttcctcaagacctgcacctaccagaaggtcctgaccgacgaggcatcggcgctggtgggcgaatattgcagccgcctctgcgcactggaaggctttgcgggacacggtgaacaggccaacctgcgcgtgcgccgc

SEQ ID NO: 34183 - DNA, 1586 bp, Sphingomonas aromaticivorans
ccgtgacccgcaaggccgcgccagagcggcccaatatcgttttcatcatggccgacgacctcggctatgccgacacctcggccacgggttcgcgtcatatccgcacgccggccatcgacagcatcggcgccggtggcgtcatgttgcgccagggctattccagcacgccgatctgttcgccgacgcgcaccgcgctgctgaccgggtgctacgcgcagcgctttgccatcggggtggaggaaccgctcggccccaatgcccccgcggggatcggcgtgccgcttgaccggccgaccatcgcctcggtcatgaaggcgcttggttatcgcaccagccttgtcggcaagtggcacctcggcgaaccgccggcgcacgggcccttgaagcacggctacgaccatttcctcggcatcgtcgaaggcggcgccgactatttcgtgcaccgcatggtcatgagcggaaagcctgccggtgtcggccttgccgaggacgacgcgcagaccgaccgcactggttatctgaccgacatcttcggcgacgaggcggtgcgggtgatcgaagagggcggcaaccagccctttttcctcagtctccacttcaccgcgccgcactggccgtgggaagggcgcgaggacgagaagctggcacgcgcgctgcccagttcattccactacgaaggcggcaatctggcgaagtatcgcgagatggtcgagacgatggaccagaacgtcgccaaggtgctcgccgcgatcgaccgcagcggcaaggccgacaacaccgtcgtcgtcttcaccagcgacaacggcggcgagcgcttctccgacacctggcctttcgtcggccacaagggcgaagtgctggaaggtggggtgcgggtgccgctaatggtgcgctggccgcgccggatcaaggcggggagccgttccgaacaggtcatggtctcgatggacttcctgccgacgctgctgggcatggcgggcggcgatgcggcaaggatcggtcgcttcgacggcgcggacctttccgcccagcttgccggcgccgcgccggtcacgcgcacgctgttctggcgcttcaaggccagcgagcaggcggcggtgcgacagggcgacatgaagtacttgcgcatggcgggcaaggagtaccttttcgacctgtcgcaggacgagcgggagcaggcaaacctcgcccccgcgaacccggacaaggtcaacgcgatgcgcgcgctgtgggacgattggaaccgggaaatgatgccctaccgggtcgacgggtactcgcaggacgcgcgcaagagtttttccgacagatactgaggcttgatagatgcgggtggtggtgacgggcgccggtggattcgtgggccgcgagatcgtctcgcgccttctggcacgcggcgacgaggtgatcgggatcgacagccaggccggtggcgtgccctcgggcgcgcgggtgatcgcgggcgatctggccagcgccgacgtcaggaccggggcgcttgagcagggctgcgacgcgctgatccaccttgccaccgttcccgggggcgctgcggaagccgatccggcggcgtcgcggcgcatcaa

SEQ ID NO: 34184 - DNA, 816 bp, Sphingomonas aromaticivorans
cgcatggacggaaaggtggccatcgtgactggtggcgctggcgggataggcgaggcgacggcgcggcttctgaccgcgcgcggcgcctgcgtggtgatcgccgacatcgcgttcgaacgggccgaggcactggccgccgatcttgcaggcgccatcgcgcttccgctcgacctggagcaggagcaatcggtcgagacgctggtcgagcgcaccgtcgcgcatttcggcaggctcgacgtgctgcacaacaatgccgccctgctcgggcccgagatcgcgcaggccgatggcgatgtggagcgcatgggcacggcgttgtgggacaggacgttcgcggtgaacgtgcgcggcacgatgatcgcctgccgcgccgcgctgccacacctgcgcgagacgcgcgggtgcatcgtcaatacggtcagcaatctcgccttgcagggccacctgatccaggccgcctattccagcagcaaggcggcggtgatccagatgacccgcgccattgccgccagccacggcaaggccggggtgcggtgcaacgctgtggcgccgggaatgacgatgacgccagccctgcgcgaggcctttcccccggcgctgcgccaggtcgtggaggacgagacgctgcgcgaccggcttggcgatccgcgcgacattgccgaggccatcgccttcctcgcctcggacgcggcgcgcaacgtgaccgggcaggtcctcgtctgcgacggcggcggggccagccacgtgccggggcttgccggtttccgttccttcttcgcgggagaacagtgagatgagccagtacgacatcgtcgt

SEQ ID NO: 34185 - DNA, 1509 bp, Sphingomonas aromaticivorans
atgggcgcaggccacaatggcctgaccgccgccgcctacatggcgaaggccggtaagaaggtgctggtgctggagcgcaagccgcatttcggcggcggggtttcgacgcgcgaactgctgcaccccggcttctggcacgacgagcattccaacgtgcacatcatgatccagggcaatccgatgctgcgcgaggacgagctgggattgctgtcccggttcggcctggaatacatctatccggacctcgtccatgtctcgatctgggaggacgggacggtcatccgttcctacaaggacctcgaccggacgtgcgaggaactggcccgcgtcgccgggccgaaggacgccgaagcctatcgccggttcgtgaagatgagccagaccgcgctgccgatgctggtcagcgggctctattcgccgccgttcccgctgggcgcgttcgtggcgatgatggaccagtcggacgaggggcgctttctactcgatctcatgcagcgcagcgcgctcgacatcgtcgacgcctatttcgagagcgacctgctgaagctccacatcgtgcgcatggtgaccgagaacctgcagatgcccgacgaactgggcaccggcatgggcgccttcgtcatgcccggcatcatccacacttacggctgttcgatgcccaagggcggttcgggccagctttccagggcgctggtccgcgcgatcgagcatttcggcggcgaagtgcgctgcaatgccgaagtcgcgcgggtgatcgtgtcgggcgggaaggcggtcgggctcgagctgacggacggcgagaccttcatggcgcgcgacggggtgatcggggcgatccacccgcacgtcctgcgcaagttcgtgggcgaaacgcccgagccggtgctggagcgggccgagcgcgtgacccagtccaccttctcgatcaatctcacgcacatgacgctgaaggagcggctgcgcctcaaggtcggtaacgactgcaacgcgatgatgaccgagctgatggacttctactcgatccgggagatgctgctcgaatacgacaagcttcgtcgcggcgaggtcagcgagcggttgatcgcgggcggcgacaacacgattttcgatccctcgcgcgcgccggaaggcgccggggtgttctacggcgtgaacttcgcgccctatgacctccatcccggcggatccggatcgtgggacgaacgcaaggaggaagtcgccgaccgcgccttggcgcagtaccgcaagttctacgcgaaccttgccgacgagaacatcaccggccgcctgatccgctcgccagtcgaccatgagcgcgacagcccggcaagcttcgtgcgcggcgacatccatggttgcgcgccattcttctaccagtctgcgggacaccgcccgacgccggatctcggctcgttccgggtgccgggggtggaggggctctatctggtggggccgttcatgcacccgggcggcggcgtgttcggcgcaggacgggcgaccgccatccag

SEQ ID NO: 34186 - DNA, 715 bp, Sphingomonas aromaticivorans
ggacggcgcgcactggtgccaggcccgggcccggggtatcgggctgcgatggccaccgcccctggccgagccgggtgcggcggtcacgctcgtggctcgctctgcgggcgagatcgaggcagcggcggcggcgatcggcaatggcgctgtggccgcaacgctcgacgtttcggacctcgatgcggttgccgctttcttcacggcgcgcgagccgttccacgtgcttgtcaacaacgccggaaccaaccgccccaagccgatgtgggacgtgaccgaggccgactatgacgccgttctcgacctcaacctcaaggccgcgttcttcgtcgcgcaggcctgtgcgcggcggatgatcgagaccggcacgcaaggctcgctcattcacatgggcagccagatgggccacgtcggcgggcccaaccggtcgctctattgcgcgagcaagtgggcgctcgaaggcatgaacaagtccttcgctctcgatctggcaacccacggcatccgctccaacaccatcgccccgaccttcatcgaaaccccgctgacgcagccgatgttcgcggacccggcgttcaaggccagcgtcctgtcgaagatcaagcttggccgcatcggccgggtcgaggatcttatgggcgcggtgctgttcctcgcttccgatgcctcggcattgatgaccggaaccagccttgtcgtcgacggcggctggaccgca

SEQ ID NO: 34187 - DNA, 768 bp, Sphingomonas aromaticivorans
ctgaaagggcgcagcgcgctcgtcaccggtggcggtcagggcgtgggccagggcattgcccgcgcgctcgcggccgaaggcgcggacgtgatgatcgcccagcgcgggcttgaggccgccgaagccgaagccgtgcacctgcgcgcgacgtacggcgtcaacgccatcgcccgtcaggtcgacgtgaccgtgcgcggcgaggtagacgccatggtcgatgcctgcgccgccgcgttcggacggctcgacattctcgtcaacaatgccggcggcagcttccccaagcggctggagaaccataccgacgaggacatggaagggtccttcctgctcaactactggtccgcgttctggtccatgcgcgcggcctttccgctaatgaaggcgcagaagtacgggcggatcgtcaacctcggctcgctcaatggcgtaaacgcgcacatgttcaccgccgcctacaatgccagcaaggaagcggtccgcgcgctgacccgcaccgcggcggtcgaatggggcggccacggcattaccgccaacgtcatctgcccttccgcgctcagcccggccgcgcgcgattatttcgatgccaacccggaaatggcgcaggccatcctcggccaggttccggtgggccgcttcggggagtcggcgggcgatatcgggccggtcgcggtgttccttgccggcgaggcgtcgagctacatgaccgggaacacgctctacgtcgatggcggcgggcacatcaacggcgtcgcctggcgccccgaa

SEQ ID NO: 34188 - DNA, 744 bp, Sphingomonas aromaticivorans
atgactggcaaggtcgccatcgtcaccggcggaagcgacggcatcggcctcgccacggctcgccttctggccgcgcgtggcgccaccgttgtcatctgcgcccgccgcgaggacaagctcgaggccgcccgtgccgagatcgccaaggtcggcaaggtcgaggcggtgaagctcgacgtctccgacgaagcggccttcaccgcgctggtcgaagatgtggccgcgcgccacggtcggctcgacatgctggtcaacaacgccatgtcggtgcactacgcacccatcgccaagctgcggctcgaccattggcgcaaggacttcgcggtcaatgccgatgccgtgttcgtcggcaccaaggcggcgatgaaggtcatggccgcgcaggaacagcggggccgccagcgcggcgccatcgtcaacatcgcatcgacctgcggcatccgcgccgcgcccaacatggcaagctattcggcctcgaaggcagccatggtccacttcaccgccgcagcggcaatggaaggcgcgccgcttggcatccgcgtcaacgccatcgtgcccggccaggtgatgaccgcggccacccaggaattcgccgaccgcgcgcccgaagtcgccgcgcgcaccaccggcgcgatccctatgcagcgcggcggcgagccggaagaactggccgaagccatcgtcttcatgctgtccgaagccgccagctacgtcaccggcactgcgctgccggtcgatggcggc

SEQ ID NO: 34189 - DNA, 1167 bp, Sphingomonas aromaticivorans
atgaagctcggattttccgcagaggaagaagccttccgcgccgaatgcgccgactggcttcagggccagatggccggcgaattcaaggacattcgcggcatcacccagctcaccgccatgcccgaacggcgcaaggagtgggaacagcagcttggcgaacaccgctggggctgcatcggctggccgacgcaatggggcgggcgcgatgccacccttgcccagcaggtgatctttgccgaggaatatgctcgtgccggggttccgggccgcatcaaccacatcggcgttgagctggccggcccgacgatcctgaccttcggcaccgaagagcagaagcgccgcttcctgcccgacatcgccgccgggcgcacgatcttctgccagggcttttccgaacccaacgccgggtccgaccttgccagcgtgcgaacgaagggcaggatcgaggacggccattgggtggtcaacggccagaagatctggaccagccttgcccacatcgccgactggattttcgtcgtcacccgcaccgaggaaggctcgcaggggcccaagggcctgtcgttcctgatgatgccgctcgaccagccgggcatcgaagtccgcccgatccgccagatcaacggcgacgccgaattcaacgagaccttcttcaccgatgcgcgctgcccggccgacagcctgatcggcgcgcccggcgacggctggaagatcgcgatgggcctgctcgcgttcgagcgcggggtctccacgctcggccagcagatgggcttccgcaacgagctggacgagatcgttgcggccgcgaaggccaatggccgcgccgccgacccggtgatccgccagcgcatcgcgcaggcccagatcgggctcagcctgatgcgttatggcgcattgcggatgctatccaacgccgaccattcgcgcatcgacggcgcggcgctgacctacaagatccagtgggccacgtggcgccgcaatcttggcgaactggcgatggacgtgctcggccaggcgggcgagatcgcggcgggcgatgcctatgaatgggatgtcctgcccaacctctacctcttcagccggtccgacacgatctatggcggcaccaaccagatccagcgcaacctgattgccgaacgcggcctcggcctgccgcgcgaaccgcgc

SEQ ID NO: 34190 - DNA, 723 bp, Sphingomonas aromaticivorans
atggcaggcgtgcttgaaggcaaagtcgttgccgtgaccggggctggacgcgggatcggacgggagattgccctgctttgcgcacgcgaaggcgcggcagtcgtcgtcaacgatcccggcgtggcgcaaggcggcgatggctcggacgaaggcccggcccagaccaccgtcaacgacatcgttgcggcaggcggcagagcctgggcaaaccttgccagcgttgccgatcccatgggcgccaccagcatcgtcgaggatgccgtgcagcgctttggccggatcgatgcggtggtcaacaatgccggcatcctgcgcgacacgatctggcacaagatgtcctacgaggactggaccagcgtgatcgacgtgaaccttactggcgcgttcaacgtgtcgaaggcggcgactccctatttccgcgagcagtcttccggcagcttcatccacttcacgtccacctccggcctgatcggcaacctcggccaggcgaactactcggcggcaaagctggggctggtcgcgatgtcgcaatccatcgcgctcgacatggcgcgctggggcgtgcgctccaactgcatcgcgcccttcgcgtggagccgcatgaccgcctcgatcccggccgaaacgccagagcagaagcagcgcgtggaacggatgaagacgatgagcgcggacaagatcgcgccgctcgtcgcctatctcgcctcggacctctcgcaggac

SEQ ID NO: 34191 - DNA, 1113 bp, Sphingomonas aromaticivorans
atcgagcagttgcgccgctacgtacgcgagcggctgatccccgccgaggacgaggtgattgcccaggatcgcatcccggacgacatccttgccgaaatgcgcgaaatgggcctgttcgggataaccattcccgaagagttcggcggcgcgggcatgaacatcagccagtacatcgaaacggtaaagcagcttagctacgcgtcgccagctttccgctccaccatctcgatcaacatcggcatgactggcagcgcgatcaagaacttcggcacgcccgaacagaaggccgaatggctgccacggatcgccagcggcgaaatcgcctgcttcggcctgaccgagccgggttcgggatcggacagcgcggcaatgcagaccatggcagtgcgcgatggcaacggctaccgccttaacggcaccaagcgctatatcaccaacagcccgagcgcgaagatcgggctgatcatggcgcgcacctcgaaagaggcgctgccgcgcaacgcccacgtctcggccttcatcgtcgacatgaccgcacctggcatcagcatcggcaagcccgacaagaagatgggccagtctggcgcgcagatcgccgacgtgatcatggaagacgtccacgtccccggatcggcactggtcggcggagaggaaggacgcggcttccagatcgcaatgcagagcctcgacaacgggcgcctttcagttgcgggcatgggcgtgggcatggggcgccgcgcgctcgacaccgcgatccgctacgccaccgaacgcaaggccttcggcgaagccatcgccaacttccagctcatccaggcgatgctcgccgatagcgaggcggaactctacgccgccgaatgcatgatcgccgacgcctgcgcccgcgccgaccgtggcgaaagcgtccagcgcaaggcagcagcggccaagctgttctcctccgaagcctgcggccgcgtggtcgatcgctgcgtgcaggtctatggcggggcaggctacctcgccgaatatccggccgagcgcttcttccgcgacgcccgcatcctgcgcatctacgaaggcaccagccagatcatgcagttgcagatcgccaagcacctgctgcgcgaattc

SEQ ID NO: 34192 - DNA, 1182 bp, Sphingomonas aromaticivorans
atcgtcgcccccatccgcaccgccgtgggcaagttcggcggctcgctgtcgcctctcaccgccgggcaactgggcgcaacgatcctcacggcgctgatggaccgcacaaggatcgaccccgcgcgcgtcgatgacgtgatcttcgcgcagggttacggcaacggcgaggcgccgtgcatctcgcactggtcgtggctgctcgcgggcctgcccgaggaagttcccggctaccagctcgatcgccgctgcggctcgggcctccagtcgatcgtcaatgcggcgatgatggtgcagaccggggtttccgacgtcgtcgtggcgggcggcgtggaatcgatgtccaacgtcgagcactataccactgacgtccgcaagggcgtgcgcgcgggctcgctgacccttcacgaccgccttacccgtggccgcgtgatgagccagccgatcgagcgctatggcgtgatcagcggcatgatcgagacggcggaaaacctcgccaaggactttgccatcacccgcgaagcctgcgacgcctatgccgtgcgcagccaccagcgcgcggctgctgcatgggccaacggcctgttcgacgacgaactcgttccggtctccatcccccagaaaaagggcgaccccgttctcttcgcccacgacgagggttaccgtgccgacgccagcatggaaacgcttggcaagctgcgccccctcgaaggcggcgtcgtgacggcaggcaacgccagccagcagaacgacgcggccgccgcctgcctcgtcgtcgcggaagacaagctcgccgaactcggcctcgaacccatcgcgtggttccattcctgggcggcagcgggctgcgatccgagccgcatgggctatggccctgtccccgctaccgagcgcctgttcgcccgcaacggcctgacgtggaacgacatcgacctcatcgaactgaacgaggccttcgcccctcaggttctcgcctgcctcaagggctggggctggtcggacgacgacagccgccacgagatgctgaacgtcaatggctcgggcatcagcctcggccatcccatcggcgccaccggcgggcgcatcctcgccaaccttacgcgcgaattgaagcggcgcggcgggcgctatggccttgaaaccatgtgcattggtggcggtcagggaatcgcggcggtgttcgag

SEQ ID NO: 34193 - DNA, 1146 bp, Sphingomonas aromaticivorans
agcgaagaccacggcgaaatccgtgagggcgttcgcaagctatgcgcccagtttccgggcgagtactggcgcaagctcgacgagaagcgcgagtatccgaccgacttcgtcaacgcgctgaccgaggcgggctacctttccgtcctcatccccgaggaatacggcggctcgggcctcggccttggtgctgcggcggcgatcctcgagacgatccagtcggagggcggcaacggcggcgcctgtcatgcgcagatgtacatcatgggcacgatccttcgccacgggtcggaagaacagaagcgcgcataccttccccgtatcgccgccgggaccttgcgcctccaggccttcggcgtgaccgagccgaccagcggcaccgacaccaccagcttgcgcaccttcgcccgccgcgagggcgacgaatatgtcgtcaatggccagaagatctggaccagccgcgccgaacattccgatctcatgctcctcctcgcccgcaccaccgcgcgcgaggacgtggcgaagaagaccgacggcctgtcagtcttcatcgtcgacatgcgcgacgtcgtgggcaagtcgctcactatccgcccgatccgcacgatgatgaaccacgcgacgaccgaggtcttcttcgacaacatgcgcattcccgccgcaaaccttctcggcgaggagggcaagggcttccgttacatcctgtcgggcatgaacgccgaacgggtgctgatcgcggcggaatgcgtgggcgacgccaagtggttcacgcggcggtcggtcgaatatgccggggagcgaaaggtcttcggccgtgccatcggcgccaatcagggcgtcgccttccccatcgccaaggcctacgcaaacatgcgcgccgccgaactcatggtgcgcgaagccgcgcgcatgtacgaggcgggtttgcctatgggcgcggaagcgaacatggccaagatgcttgcggctgatgcatcatgggaagccggcaacgcctgcgtccagacgcacggcggcttcggctttgccgaggagtacgacatcgaacgcaagctgcgcgagacccggctctaccaggtggcgccgatcagcacgaacctgatcctgtcgttcctggccgaacacgttctgggcctgccccgcagctac

SEQ ID NO: 34194 - DNA, 933 bp, Sphingomonas aromaticivorans
gtgagccaggccctcaagcacttcctgaacctgacggatgcgggcggcgatgccatcgccgcgatgctgaacgacgcgctcgaccgcaagtccgcgcgcgctggccagccgaagggcaaggccgatgccgacgcccctctcggcgggcgggtcctggccatggttttcgagaagaattcgacccgcacgcgcgtgtcattcgacatcgcgatgcgccagctcggcggttcggcgctgatcctcgacgcgggcacgacccagttgggccgcggcgagaccatcgccgataccgcccgcgtactgagccgcatggccgatgccatcatgctgcggacggacgaccacgccaaggtcgaggaactggcgcgccacgctaccgtgccggtgatcaacgggctgaccgacctgtcgcatccctgccagatcatggctgatcttctgacggtgatcgagcatggcaaggccctgcccggacttgaggtggcttggctgggcgacggcaacaacgtgctcaattcgatcgtcgaggcggcgggactgatgaagttcaacgtgcgcatcggcgttcccgaaggctatgagtccgatgcgggaatgatcgaggccgccgttctggccggcgccggcatccgtgtgatccgcgatccggtggaagccgtgcgcggggcggatgtcgtcgtgaccgacacctggatctcgatgggccaggcgcatgccgaagcgaagcttgcggcaatggcgccctatcaggtcaacgacgcgctcatggcccacgccaagccggatgcggtcttcctgcactgcctgcccgcgcaccgcggtgaggaggtgaccgatgccgtcatcgacgggccgcgctcggtggtctgggacgaggcggaaaaccgtatccatgcccagaagtcggttctgcgctgggtattcggacagatt

SEQ ID NO: 34195 - DNA, 1149 bp, Sphingomonas aromaticivorans
ctgatgcccgtgtatccccggtgcggcgtgcgtcctgtgcgaggcgagcattgccacctgatctccgaggacggcacccgctaccttgatttcgcaagcggcatcgcggtgaatctgctcggccattcgaacgaacacctgatcggcgcgatccagaagcaggcggcgacgctcatgcacgtgtcgaatctctacgggagcccgcagggcgagcatctggcccagcgcctggtcgacctgaccttcgccgacacggtgttcttcaccaattccggcgcggaggcggtggaatgcgcgatcaagaccgcgcgcgcatatcactcgtcggtgggcaatgaccacaagtacgagctgatcaccttcaagaacgccttccacggccgcacgatggccacgatcagcgcctccaaacaggagaagatgcacaagggcttcctgccgctgctggaaggcttcaagtacgtcgacttcgacgatctggaaggtgcgaaggccgcgatgggcccaaacacggcgggcttcctcgtcgagccgatccagggcgaaggcggcatccgcgatgcctctgacgaatttctcaagggccttcgcgcgctttgcgacgaacatgacctcgtgctgatcttcgatgaagtgcagtgcggcgtggcgcgcaccggcacgctctatgcctacgagcagtacggcatcacgcccgacgtgatggcgaccgccaagggaatcggcggcggcttcccgatcggcgcctgccttgccaccgaaaaggctgcgcgcggcatggtcgccggcacccacggcagcacttatggcggtaacccgctggccatggctgcgggcgaggccgtgctcgacgtcgtggcgaacgaggaatttctcggcgaagtgcgggccaagggcgaacgcctgcgcgggcggatcgagcagttcatcggcaactaccccgatctgttcatcggcgtgcgcgggcgcggcctgatgctcggcctgatgatgaaggtggagccgcgtccgttcgtggcgcacatgcgcgacaaccatcagttgctcactgtctcggccggtgacaacaccgtgcgcgtgatcccgccgctggtcatcgacgacagccacatcgacgaattcatggagcggctttcggccgctgccgca

SEQ ID NO: 34196 - DNA, 1431 bp, Sphingomonas aromaticivorans
ctcgagcgcagcgatttcctgaccggccaaccacttgtcgacggcaccgagatctgtgccggctctacctacgcggtcactaacccggcaaccggcaaaacgctggcgaatgtcgtcaagctgggcgctgcccagacgcgtcgggcaattgaaagcaattcccgcgccttgatcgattggcgcaagcggcccgctcaggaacgcgcgcgcctgctgcatgactggctggcgctggtccggctccatcgccacgatcttggtttgctgatgaccgccgaacagggcaaaccgctggccgaagcgctgggcgaggtcgattacgccgcaagtttcatccagtggttcgctgaagaggcgcgccgtgtctatggcgaggtcattccggccagcgctgaccggcggatcgtcgtgatccgtcagccggtcggcgtggcgggcgccattacgccgtggaactttcccgccgcgatgatcacccgcaaggtcgcgcctgcactggcggcgggctgcaccgtgaccctcaaaccgtccgaactcacccccatgaccgctttcgctctggcgaagctcgctcgcgaagcgggcgttccgcccggcgtgttcaacgtggtctgcggggatgcgcccgaaatcggatcggtcctgaccagccatcccgatgttacgaagttcaccttcaccggttcgaccgcgattggcaagctgttgaccgctcaatgcgctgccacgctcaagcgggtttcgatggaactgggcggcaatgccccgctgctggtgttcgacgatgccgatctcgatcaggctgtcgagggggcgatcgcctcgaaattccgtaacaccggacagacctgcgtttgcgccaaccggatcctcgtgcaaagcggcattcatgaccgcttcgtcgaggcgctggccgccagggtctccgcgttccgggtcggaaacggccttgaaggtgcaaccgaccagggaccgttaatcaccgcatcagccttggccaaggttcagggacatgtcgccgatgccgtggcgcaaggtgcccagctggtcaccggcggcaagagacacgaggccggagaactgttcttccaaccaactgtgctgactggagcgagaccggcgatgcggctggcggacgaggagaccttcgggccggtggccccggtgttccgtttcgaaaccgaggccgaagcgctggcgcttgccaacgccacgcactcggggctggcggcctatgccttcacccgcgacattgaccgcgcctggcgggtttccgaaggccttgagaccgggatggtcggcttgaacagcggcatcgtctcgaccgagaccgccccgtttggcggcatcaaggaatcgggactgggccgagaaggttcgcgacacggtattgaagaattcctggagatgaagaccatcagtgttggggtc

SEQ ID NO: 34197 - DNA, 1419 bp, Sphingomonas aromaticivorans
atgacgcaaattgagcactggattggcggcaccgccgtggctgcaacgggcggggcctatttcgacgatcttaacccggtcgatgattcggtctattcccgggttcccgccggcaccgcggaagacgtgaaccgcgccgtggagaacgcgcatcaggcctatctccagcatcgcgatctgcccgccgcagtgcgcgaagggtggatcgcgaaagccgccgaaatcatggagcgcgataccgccaaattcgccgacgtgctggtcgacgaaatcggttcgccgatcgccaaggccgggttcgaaacccgcttcgcggtcagcttcctgcgcgcggcgatcggcgtgccgcgccggattcggggggaaacgatcccttcggacacccctgggcggttcagcatgagcctgcgccagccggtcggtgtggtcgccgggattaccccgttcaacgtgccgctgatcaaggggatcaaacagtcggccatggccctggccacaggcaacgccttcgtgctgctaccctcggaagccgcgccaatgatcgccgatctgctcgctaaattgtggaaggaggccggcgttcccgacggcttgttcaacgtggtctacggcaatggcgcggagatcggcgacgtgctgaccggccatcccaaggtcgcatcgataaccttcaccgggtcctcgcgcgtcggcaagcacatcgccgaaatcgcggcccgcaacctcaagaagtacacgctggagctgggcggcaagagcccgctggtgatctgcgccgatgccgatctggacaaggcggtcaacgccgcgctgttcagcatcttcatgtaccagggccaggtctgcatgggggcttcgcggatctatgtggaacggtcgatcttcgaccagttcaccaaggccttcgccgccgcgacaggccgcgccaacagcggcgacctgcgcgatcctaccaccatgctgggcccgataatttccgaacgccagcgcgaccgcgtccgccgccacatcgacgatgcccggtccaagggcgccgcggtgctggccggcggcgagtggagcggaaacagctgcgcggccaccatcctgagtggcgttaccgcggaaatgaccgtgttcgaggaagagaccttcggcccggtcacctcgctctttccgttcgacacacttgaggaagccctcgaactcgccaacaacaccgaatacggcctcagcgcctctatcttcacccgcgatctcgacaaggcgctggcctttgcccagcgggccgaagcggggatggtccacatcaacgcgccgaccctgcacgacgagccgcacgttccgttcggcggaacgaaggcctctgggttcgggcgcgaaggcaccgaagccgatctcgagatcatgaccgaatggaaatgggtcacgatccagtcg

SEQ ID NO: 34198 - DNA, 1516 bp, Sphingomonas aromaticivorans
atgttcggtcgcgtcaaaccgctcgacgccattcttgcaactgcagaaaagaaatcgttgcaccgctcgctgggtccggtccagctcactcttctcggtgtcggtgccattatcggtaccggcattttcgtgcttacggccgccgccgcgcaaaaggccgggccgggcatgatgtggagcttcgtgatcgcgggcttcgtctgcgcggttgcggctctgtgctattccgagctggcctcgatggtcccggtctcgggttcggcctatacctacagctatgccgtggtcggcgaaatgctggcctggatggtcggctgggcactgatcctcgaatatgccgtggccgcgtccgccgtgtcggtcgggtggtccggctatttcatgggacttctcaagagtttgaccgggtttgaattaccggcgatgctacaagctgggccaacctggacgatgaacggcctgctgccccacgctgatttctccactggcctgatcaacgtgcccgcaatcgtcgtggcactgctcgtcacctggctgctcatgctcggcaccaaggaaagcgccacgttcaacgcgatcctcgtggcgatcaaggtcgcggcgctgaccatgttcatcgtgctgaccctgccggcgatcgagcgcgagcacttcgccccattcgcccccaacggctggttcggccctgccggaacgaccgggatgggcatcgtcggcgcggcgtcgtcgatcttctttgcctacgtcggcttcgacgcggtctcgaccgctgccgaagaaaccaagaacccgcagcgcaacgtgccgatcggcctgatcggaagccttgcgatctgcaccgtgttctacctgctggtcgccgctggcgcgattggttcgatcggtgcgcagccgaccgctctgggcgtcgcgccgggttcggccgagttcacccagcagtgcgccgcgctgcttgcttcgggccaggaaccgctggtctgctcgaacgaggctctggcccatgtcctgcgcgccatcaactacacctatgctggcgacctgatcggccttgcggccaacctcgcgctgcccgtcggtcatcctgatgatgctctacggccagacgcgcatcttcttcgtcatggcgcgcgatggcctgcttccggagaaactggccaccgtccaccccaagtggaaaacgcctcacatcgtgaccgcaatgaccggcgtattcgtcgccatcgcggcggcgctgcttccggttggtcagcttgccgacatctcaaattcgggcacgctcttcgcgttcttcatggtcgcgatcgcggtcatgctgctccgcgcccgcgacccgaaccgcgtccgtccgttccgcacaccggcggtgtgggtcgtcggcccgatcgccgcgattggctgtatcttcctctactggaacctgccgttcgaggcgaagatggtccttcccgtctggggcgccatcgggctcgtgttctacttcgcctacggctatcgcaagagccacgtcggccagggc

SEQ ID NO: 34199 - DNA, 1569 bp, Sphingomonas aromaticivorans
ttcgactatgtcatcgttggtgccggttcggccggttgcgtcctcgcaaaccggctatcggccgatcccgacgtgagtgtcctggtactcgaggcgggcgggcgcgacaccagtccgttcatccacatgccggcgggcttcttccagttgttgcagagtggcagcaatgcctggcactaccagacggcgccgcaggagcacctgaacggccgcgtacttgccgacgcccgaggcaaggtgctgggcggcagcagttccatcaacggcatgtgctacagccgcggcagtcccgagatattcgaccactgggcggaactcggcaacgatggctggtcatacaaagacgtgctgccctggttccgcaaggccgagggcaacccgggcgccgatccttacttccacggccaggatggtcccttgtccgttacccatgcttcggtcaccaacccggcgcagttggcctggcttcgggctgcgcaggaagcaggctttccctacagcgacgaccacaacggtgccgccccggagggcttcgggccgggggaacacacaatccgcaacgggcggaggatcagcacggctgtcgcgtatctcaaaccggcgatgcgacgtcgcaacctcgttgtacgaactcgcgcgcatgccacgcgggtcttgctcgagggcgcgcgcgcaacaggagtggaatatcggcagggaagggcgctgcagaaggtccacgccagtcgcgaagtgatcctttgtggtggcactttccagtcgccgcaattgttgatgctgtcgggcatcggagacggcgcacatcttcagccgctcggtatacgtacggtggtcgacctgaaaggcgtgggccgcaacctccacgatcacattggcacgcaagtccagatgacctgcccagagcccgtgtccgacttctcggtagcgacgaacccgttgcggatggcgctggcgggccttcagtatctcgtcgcgcgcaaggggcctctggcccggagcggaaccgacgtcgttgcctatctgcgctcgggcgcgcccgggcacgatgaactcgatctcaagttctatttcatcccgctgctgttcaacgagggtggcggcattgcacggcagcatggcttctccaacctggttatcctgacccggcccgaaagtcgcggggagctgcgcctccgctctgccaacccggtggatcagccgctgatcgattcgaattacctggcggaagggcgcgaccgcgatgcgctgcgccgcggggttggcattgttcgccggatctttgcccagcctgcgtttgcccgctttcgcggcgtcgaatgcacgccgggcgccgacattgccgatgacgttgcgctcgatggcttcttccgcgagacctgcaacgtcaattacgaggccgtgggcacctgtcggatgggtgatgacgaactcgccgtggtcgatccggggttgcgagttcggggtgtggaaggtcttcgcgtcgttgacgggtcggtaatgccccgcatcacgaccggggaccccaatgcgacgatcgtgatgatcgcggaaaaggccgcacagatgatc

SEQ ID NO: 34200 - DNA, 1179 bp, Sphingomonas aromaticivorans
atggccaatgtaaccgtgattggtgcccagtggggcgatgaaggcaagggcaagatcgtggactggctcgccagccgcgccgatgccgtcgtccgtttccagggcggccacaatgccggccacaccctcgtcgtgggcgaacaggtctacaagctctcgctgctgccttcgggcatcgtcaccggcacgctgtcgatcatcggcaacggcgtcgtgctcgatccctgggccttgaaggcagagatcgagaagctgaccggccagggcgtcgagatcaatgccgagaacttcgccattgccgacaattgcccgctgattctcccgctccaccgcgatctcgacggcctgcgcgaacaggccgccggcgccggcaagatcggcaccaccggtcggggcatcggcccggcctatgaagacaaggtcggccgccgcgcgatccgcgtctgcgacctcgctcatctcgatgcgctcgatgcgcagctcgaccgcctttgcgcccaccacgatgcactgcgcgccggcttcggccagccgccggtggaccgcgccgccctgatcgaggaactgcgtgaaatcgcgccatacgtgctgcagttcgcccagcccgtgtggaagcgcctcaataccgtccgcaaggccggcgcgcgcatcctgttcgaaggcgcccagggcgtgctgctcgacgtcgatcacggcacctatccgttcgtcacctcgtcgaacaccgtttccggcaccgccgcttcgggttcgggcctcggccccgcgcagaccggcttcgtgctgggcatcgtcaaggcctacaccacccgcgtcggctccggtcccttcccgaccgagctcgaggacgagaccggccagcgccttggcgaacgcggccacgaattcggcacggtcacgggccgcaagcgccgctgcggctggttcgacgccgtgctggtgcgccagtcctgcgcgatctccggcgtgaccggcatcgcgctgaccaagctcgacgtgctcgacggctttgaaaaggtgaagatctgcaccggctaccgcctgcgcggcaaggtgctggactacttccccagccacgcggccgaccaggccgaagtcgagccgatctacgaggaaatggacggctggagcggcaccaccgccggtgcccgctcatgggccgatctgcctgcccaggcg

SEQ ID NO: 34201 - DNA, 2725 bp, Sphingomonas aromaticivorans
cgtccggtgtcgaactcgagcgcgttggtcgcggcaaagcccgttccgctaatcgttccggtgatgcgaatggctccgccgggaatctgcgtctgcaagtcgcccgtcgcaaagatgatccggccggcggtgccggtcgcaatgctgttcccggcggttcccccggccgtcacgctgagattgccgatgagcatgtcggtcgcattgccggcaacgtcggtcgccgcgacaagcaggcggcccgtggatatcaagccgatttcagtgttgccaagcgcatagccactgccgaacagcccgtcgccgatcaatgctggcgagttagcggtcgatatgagatccaccgagccggattccagcgtcttgagacccgaaagaatctgcccgccggtcggcgaggtggcggtcccgttgtcgatgatcgaaatatcggcggagcgaattgtaatcgagttgccgccccactgctcctggactgtcacaagtccgcccgaggtcacgtcaaccgaaccaaagcccacgaggctccggcccgacattgcaccggttgaagcactgagaacgcttccgccgacagcggtgttgactgtcgtggtaccgccgttggcgaccggtgccgctgcaaacaacgcattgtagtcgatcgcgcccggcgttgccgtggaggccagcatcgaggagttggcaaggatgatgcgcccggtggcgttggtcaccgcgttggtcaccgggtcaatcaccagtccgccgagcacctgctggaccgcaatgttgccgcccgaaagcagcgcaacgtcgcgcgcgaagatcgtgccgacggtcaagcccaacgcaccgctcgccgttacgtcggacccggtgtttgcggatgccaggttcagcgtcccgctcgacaacagttcgattctgccgccgctcgaaaggttggcgaaagtcgcatttccgccgctggtgaaaccgatggagccgggagccgaaatggcggctgtcgttaccgtgccgttcgtggccccacggatcgtgttcgcggtcgaggtcccgttgatacctatcgcgccattggtggcgacggcaggtgcggcaaagacaagttccttgtcgaataccgtggcagtctggccgagcgccgtcattgaaacgtccgcaatcagcacgcggttgacggcgttgaggctcgcaagcgtgatgttgctgccgcccagcacgagcatgtcgtacccctgaagagcaccggtgctgatcgtcccgcccgccgagatgccgatgtcggaggccgcattgaccgcccccacgggtgacgttgccaccggccgtgagagcgattgtattgaggtcgccgttcgcacccgttggcgtaccggtgcctgcgctcaggttgcccgtcgagatgctgccctgcgaacgcgcggtgatcgaggtctgcgccaccaggttgccggtcgcgatggcggcaattgcatcgaggtcgatggattcacctgcgctggcatcgccgatcgtgatggagccgcccgccgtgaggtcgatgaacccgccggccgtcagcgcccccaggtcgatgcgtccgggcgccaggatggacaagccggccagcgtgttcaggttggcgtaggcgacgatatcctggccggacgaaaggctgatcccgttcgttcccgtcagcaagccggtgttcgtcggcgcgctggctcccagcacccagttgccggccccgatcacaacgttgtcagccgtcaggaacgactggtcgagcgtcagcgaaaatgcgttgggcgtctcgaagaaaagcgccccactgatgttggcggtgctgttcagaagcgaaatgaagtccgcaggcgcaccggcggcgacactgtcagccgatgcactcagcgagaggctggccgcattcagcgtgccgctgaccatgtccaggtcgacagcatcgccagcaatcgacgcgatacccgctgtcgagcccgttccgccaactgcaagcgcgctgaaattgaggtcacctgccgtaaggctgccggtctgcgcaggctggttgaaacggttggtcacggtcagcgatgcgccggatacctggttcgtcgcaccggcgctgccgatcgtggcatcgccgcctgcgccaaccacggggcccgagccgccattgccgccgatggcgttgacgaaggcattggtggtggcgccggtaacggtcatggaagcgccacgcaccaacacggtcacgccgccgccctgcgccgcaccgcctgcaccgccgctaccgctggtggcgctgccttgccctccagcaccgccgttgccgccggaagctccggccgtgaggttgatcgacccgtaaagggcagatccggtattgatcgttccagtatcgaagccgctggcgataccaagctgcagcagcccgccgattgctgcgccgccatctccgccgtcgccaccaaggccaccgcccccgcccgatgccgaggcgtagccggtgaccgatccgacctccatccggccattgcccgccgtaccgaaaatctggatcgagccgccttgggccgcaccgccagctccgccgatgtcacctggaatcgccgcatcgctaccgaagccgccgaaagccgacgcatcagcattaagcgaattgatggtgaccaggcttgcgccctccacggcactattggcgaagatctggatctcgcccccggtcgcactgccgccagccccgcccgaaagcccatag

SEQ ID NO: 34202 - DNA, 1143 bp, Sphingomonas aromaticivorans
gctggatacaaggactggggccggtgcgacctgacgtatgtcgaactgtcgcaaggcactgctgtcgcgggcgtcttcacccgcaacgtttgctgttcctcggaagttgagcttggccgcgcgaacgttgcccggggccgcgcacgggcgctggtcgtgaatgccggcaactccaatgccttcaccggctatcgcgggcgcgaggcggtggagcagatcatgacgcaggtcgccgcaaacctcggctgcgcgcaggaagaggtcttcgtttcctccaccggcgtgatcggcgtgcccttgcccaaggacaaggccagggcgggcatcgaggcggcgctggcggccgatgaatgcacctgggaagaggccgcgcgcacgatcggtacgaccgacaccttccccaagggagcgtccgccaaggcgcagctaggtgccgttcaggtacacttcagcgcaatcataaagggaagcggcatgatcgcacccgacatggcgacgatgctcggctacgtcttcaccgacgcagccgtaagccctgaatttcttcaggaatgcctgtctgcggccaaccgccgcaccttctcgtgcatcactgtcgacagcgatacgtcaaccagcgacaccgtcctcgctttcgccaccggcaaggccggcaacgagcccctgacctcgttcgacagccccggtgccgatgccttcgcggccgcgctggaggacatctgccgccagctttcccatctcgtggtcaaggacggcgaaggcgcgcagaagttcatcgccgtcgccgtctcgggcgctgtctcggacgagagcgcccgcaaggtcggcctcgccatcgccaactcgccactggtcaagaccgcaatcgccggcgaggatgccaactgggggcgcgtcgtcatggccgtgggcaaggccggccaaccggcagaccgcgaccgcctgtccattggcttcggcggtacctgggccgcgcgcgacggacagccgcttgccgactacgacgaagcgcccgtcgccgcgcatctcaagggccgggaaatctcgatcgaggtagatctcggcctcggcgatggcagggcgacggtctggacctgcgacctgacgcacggctacatctcgatcaacgccgactatcgcagt

SEQ ID NO: 34203 - DNA, 1223 bp, Sphingomonas aromaticivorans
acggacatggcgaagatcaaggtgaagaacccggtcgtcgagatcgacggcgacgaaatgacccggatcatctgggaatggatccgcgaacgcctgatcctcccctacctcgacatcgatctcaagtactacgacctctcggtccagaagcgcgacgagacgaacgaccagatcacgatcgattccgccaacgcgatcaagcagtatggcgtcggcgtgaagtgcgccacgatcacccccgacgaagcgcgcgtcgaggaattcaacctcaagtcgatgtggaagtcgccgaacggcacgatccgtaacatcctgggcggcgtggtgttccgcgaacccatcgtgatccagaacgtgccgcgtctggtccccggctggaccgaccccatcgtcgtcggccgtcacgctttcggcgaccagtaccgcgccaccgacttcgtcgtgccgggtccgggcaagctgcgcctcgtgtgggaaggcgacaatggcgaaaccatcgaccgcgaggtgttcaactacccctcgggcggcgttgccatggcgatgtacaacctcgacgattcgatccgcgacttcgcccgcgcctcgttcaactatggcctcggcctgggttggccggtgtacctttcgaccaagaacacgatcctcaaggcctatgacggccgcttcaaggatctgttccaggaagtgttcgacaccgaaggcttcaaggaaaagttcgccgccgccggcatcgtctacgaacaccgcctgatcgacgacatggtcgcctctgcgctcaagtggtcgggcaagttcgtctgggcgtgcaagaactacgacggcgacgtccagtcggacaccgtcgcgcagggcttcggctcgctcggcctgatgacctcggtcctgatgacgccggacggcaagaccgtcgaggctgaagccgcgcacggcaccgtgacccgtcactaccgccagcaccagcagggcaagcagacttcgaccaacccgatcgcgtcgatcttcgcctggacccgcggcctgatctatcgcggcaagttcgacgagacgccggaagtggtgaagttcgccgaaacgctggagcgcgtctgcatcgaaaccgtcgagagcggaagatgaccaaggacctcgcgctgctcatcgggccggaccaggcctggatgaccaccgagaagttcttcgaggccatcgtcgagaaactcgagaacgaaatgaagaactgg

SEQ ID NO: 34204 - DNA, 1395 bp, Sphingomonas aromaticivorans
ctgctcgggcccaaggggctgacgacgtcggcggaagacatggcaccgtggctgacggactggcgcgggcgctataccggaaaggcgctcgccctcgcctcgccggccagcacggcggaagtctcggcgctggtcaggctgtgtgccgaacacggcgtgccgatcgtgccacagggcggaaacagcggcatgtcgggcggcgcgacgccattcgagagcggaaccgaactcgtcctctcgctgcggcggatgaatcgcatccttgcgctggacccggccgcgcgcaccgcgacgtgcgaggccggcgtcatcctccaggtgcttcacgaggcggcggagaaggaagggctgcgctttccgctgtcgctgggcggcaagggttcggcgaccgtgggcgggctggtctcgaccaatgcggggggcacgcaggtcctgcgccacggatcgatgcgcgcgctggtgctgggactggagggggtgctggcagacgggtccgtgctgaaccagctcaccccgctcaagaaggacaaccgcgggttcgacctgaagcaggtgctgatcgggtcggaaggaacgctggggatcgtgacggcggcgacgctgaagcttgagccgggaatcgcgggccgttcggtgatgtgggcgggaaccgcatcgctgcacgacgcgcgcgccctgctgttgctggcgggcgacatggccggcagcctgctggaaggtttcgaggtcctgccgcagcacagcctcgaggcggtgcttgcctacctgccggatgcccgcgcgcccctggccgggccgcacgagtggcatgcgctgatcgaactcgtggcgggagacgccgagaccgccgcgcggctgcccgagatatcggagcgcctgctgaccgaggccttcgagcgcggtctcgtggccgacgcgacgatcgcggcgagcgaggaccaggccgagcggctgtggctgatccgcgagaccatctctcccgccgaacgcgcgatcggccccgccatgcagcacgacatttcggtgccggtggagaagatgccggctttcgtcgaggcggcggtgccccagctcgaggcggactggcctggaacgcaggcggtgtgcttcgggcacctgggcgacggcaacgtccacttccacgtcatcgccccacccggcagcgagcgggcggcgtgggaggcgggcgacggcaaggcgatcagcgcgcaggtccacgacatggtgacagcctggggcggatcgatatcggccgaacacggcatcggccgcctgaagcgcgacgaactcgaccggctgggcgacccggtgatgctggccacgatgcgcgcgatcaagcgggcgcttgaccccaaagggctgctaaaccccggaaagctggtgtgacgcggcttg

SEQ ID NO: 34205 - DNA, 1350 bp, Sphingomonas aromaticivorans
atgaagtttgccgacctcggcctctcggatgaattgctcaagtcggtactggacgccggctacgacgagccgactccgatccaggcgcaggccattcccgctgtcctcatgatgaaggacatcatcggcattgcccagaccggcaccggcaagaccgccggcttcgtgctgccgatgatcgacatcctcgcccacggacgccgacgcgcgttgatgccgcgctcgctgattctcgaacccacgcgcgaactggccgcccaggtcgccgagaacttcgaaaagtacggcaagaaccacgatctcaagatggcactgctcatcggcggcgtgcagatgggcgaccaggtcaaggcgctgcaggaaggcgtcgacgtgctgatcgccacgccgggccgtctgatggacctgttcgaacgcggcaagatcctcctcaccggctgcgagatgctggtgatcgacgaggctgaccgcatgctcgacatgggcttcatccccgatatcgagaacatctgctcgaagctgccgaccacgcgccagacgctgctgttctcggccaccatgccgccgccgatcaagaagctggccgacaagttcctgtcgaaccccaagtcgatcgaggtggcccgcccggcggcgaccaacaccaacatcgcccagttcaaggtccgcagcaccacccgccagaagcgcgaagtcctgcgccacctgctgcgcaccgacaacgtcagcaccgcgatcatcttcgccaaccgcaagacgaccgtgcgtgaactggccaagtccttgcagcgccacggctttgccgccggcgaaatccatggcgacatggaccagagcgcccgcaacgccgaactccagaagttcaaggacggcgaaatctcgatcctgtgcgcgtccgatgtcgccgcccgcgggctcgacgtgaagggcgtgagccacgtcttcaacttcgacacgccctggcatccggacgattacgtccaccgcgtcggccgcaccggtcgcggcggcgccaccggtcgcgccttcacgctggtctccgacgaggacagcgaatcgatcgagaacgtcgagaagctgcagggcaccaagatccccgagttcaaggtcgaactcccgggcaaggaagagcgcaagccgcgcgaatccggcgccgaacgcgacgaagagcccaagcgtggcagccgccgcgaacgccccgcgcgcgaggaacgcaagccccgcgccgaacgcgaatctcgccccgaacgcgaagcccgtccggaacgcgaagtccgcgccgaacgtgctccgcgccgcgagccgacgccctaccgcgaccagtccgagccgccgtcgaagcccggcgag

SEQ ID NO: 34206 - DNA, 1377 bp, Sphingomonas aromaticivorans
atgagcaggctgatagtcatttcgaaccgcgtcagcgccggtgggggcgcgcaaggcggacttgccgtcgcgctttcggcggccttgcgcgaacatggagggatctggttcggctggtccggcaacgagaccagcgagtttaccggccacatcaacatggaacgcgtcgatggcgtgaccacggccacggtggatctggaagagcaggacatcgaggaatactacgatggctacgccaaccgtacactctggccgctgttccactaccggatcgacctggccgaatacgaacgcagcttcgccgatggctacaagcgcgccaacgaacgctttgccgaaacggcactgccgctgatcgagccggacgatctggtctgggtccaggattaccatatgtttccgctgggcaaggaactgcgcgcgcgcggggtcgaaaaccggatcggcttcttcctgcacattccctggccgccccgccgcctgctggcgaccttgcccgaggcacgcgcgctgaccgaaagtcttctcgcctatgacctgatcggcttccacaccgaggaatggctgcaatccttttgcgattacgtgtcgcacgaactgggcggtacgatcggcgacgatggctggctgtccgtgggcgagcgccgtgtgcgtctgatcgcttgcccggtcggcatcgatgcaaaggaatttgccgcccttgccgcaagcgaaaaggccaaggaaacctacgaacgtgtccgtgtgagtgccgttgggcgcacgatgatcgtcggggttgatcggctggactattccaagggcctggaagagcgcttcctcggctacgagcggttccttgtcgagcacccggaggagcgcaaggaagttaccctcttgcagatcgccccgccctcgcgcggcacggtcgacagctaccagcgcatccgcagcacgctcgaaggtttggccggacgcataaacggggcccatgcaggtcttgattgggttccgatccgatacgtgaaccaaggctacacgcgcgacatgcttgccggggtctatcgcgccagcaaggtggggcttgtcacccccttgcgcgatggcatgaaccttgtcgccaaggagtatgtcgccgcgcaggatcccggtgatcccggcgtgctgatcctgtcacgctttgccggtgcggcagagcagatgcccgaagcgctgctggtcaatccgcacagcgctgaagagatatccgacgctttgagccgcgccatcacgatgccgggtgaagaacggatccgacgttggcgaacgctcatgaatggcgtggaacagcacgacgtgacgtggtggtcgaagcattttaccgacgcgcttaaggactgccatgaacacgcttgcggc

SEQ ID NO: 34207 - DNA, 1527 bp, Sphingomonas aromaticivorans
acatacggggacgcagcccgcctgtccgtcgagcttgccggcggcctgaaggcacggggcatcaagaagggcgaaagggtcggcctcatcatggccaacgacccgttgacggtgcctctgctgttcgcgatctggcgggcaggggcaatcgcggtcccgctcaacacactgtatcgccccgacgagataaggttcgcgcttgctgaggctggttgcgcgctgcttattgcgatggacaggttcgcttccaggaacttcgcgcaggaactcgaggaaggcttgccgggatggcaggctggagcctgccacgatctgccggaacttcgcggtggcctgatttttgaccgcgccgctcccggtcgcctcgttgagaaactctcgggccaaggtgggggcgcggaagatcatgagcgcgtcgaaggcggcgataccgcgcttatcctgttcacgtccggcacgaccgggtcgcccaagggtgtcgaaatcagtcacgacaacctcctgcgggcgatgtacgccggggcctaccaccaggcattcgaggacggacgcagggcagtgttctcgttgcctctctatcacggcttcggacttgtcgtcggccttctttcgggcatggtttcgggcggcgcgatcattccgctgctgcggttcgatccgcaccagatccttgctgcgacggagcgccatcgcgccacctacctgatgggagtgccgactatgacgatcgcgttgctcgagcaggccaagcgccagcactacgatctgtcatccctgaatgcgatccacagcgcggccgcgccgacgccgagctgggtatgggaggacatacgcgcgacgttcgggtgcgaagagatcatcaccagctatggccagaccgaggtcaccgccacggtcatctgtacggcgccgggggattcgatcgagacggtgtcggaaacgcagggtcggatcgtcgaggcgggcatcgcgggcatgccggatcagggcggccggatagcggagttcaagataatcgaccccgaaaccggtgcagacctgccgtggggcgcctcgggcgagctgtgctgtcgcagtccgatgaacagtaagggctactttcggcgtcctaaagcgaccgcggcactctttctcgaaggtggctggatcaggatgggagaccttgggcaatttcggcccgacggaaacctgttcctgaccggacgcaccaaggagctttacaagagcaagggcgaactcgtgtcgcccaaggaactcgaacagatactcacggcaaatccgggggtatcccaggcgttcttcattgggatgccggacgaccaatttggcgaatgcggctgtgcttgggtcgtcagggccgagggcagcgggatatgcgagggggaggtcatggattaccttcgcgaacgcattcccgcctacaagatgccccgcgaggtctggttcatcgaagacgaggccctgcccaagaccggcacgggcaaggtccagaaggcggagctgcgcaacatggcgctggcgatgctt

SEQ ID NO: 34208 - DNA, 930 bp, Sphingomonas aromaticivorans
atggaaggtgatcggtggcggtgcctctgggatgccaaggctatcctcggcgaaggcacgatctgggacgagcgcgacggctgcatctattgggtggacatcgaagcccccagcgtgaactggttcaaccttgaaacgggcagcaagggcacctgggttccgccgaagtgggtcagcgccatagcgccacgttcgtcaggtggcttcatcgcctcttccgccgatgggttcgtccacatcgatccgcacgcggacatctatcacccgctcgttcatccgatctccgacccccggattgcgaggctgaacgacggcgtggtcgaccgaagcggccgctactggtcaggctcctgcgactgcagccaatgggacgaaagcaccacggccgaggacaaggaaagcacgctcggcaaccttgacgcccggaacactggcgaactctaccgcctcgccgcggacggcacggtctcctcgcaggaacagaacatcgtcactgcaaatggcccggccttcagccccgatggcaagaccgcttacgtcaacgactccatgccgctggtgagctgggcctacgatgtggacgcagacggaaacctccgcaaccggcgcgatttcctccgcttcaagccagaagacggctaccccgacggaatggcggtggacgtggagggctgcatctggatggcattctacgaaagctggatgctgcgccgtttcgcgccggacggcaccttgctggaagatcgccaattgcctgtacggcgcggcctgcgccctgcctttggcgggaccgaccattcccggctgttcctgatcaccggatcgcagggctacggagccgaacagttcgcccagcaacctctcgcgggcgggcttttcgaaattcttgatcctcctgccgctggcgtgccaaacgtgccatttgcaggt

SEQ ID NO: 34209 - DNA, 777 bp, Sphingomonas aromaticivorans
ttgatgggacgcttgaatggcaaggtcgcgatcatcaccggcgcggcacgcgggatgggcgaatcccatgcgcgcacctttgtccgggaaggcgcccgggtcgtgctgaccgatctcagcgaggaggccggaaaggccctcgtcgcagaactgggcgacaacgcagtgttcctgaagcaggacgtcacggacccacaatcctggaatgccgtcgtcgaaaccgcagttcgagagtttgggacgatcgatatcctcgtcaacaacgcgggcatccttggccccatggcgccgacggacagcctcgacgacgaaggatatcgcaaggtctgcgcggtaaaccaggactcggtcttcttcggcatgcgcgccgtcctgcccgtgatggtaaaggcccgcaggggttccatcgtgaacatctcctcgatcgccggcatggccgcaaactacggcttcccaagcctcgcctatgttgccagcaagtttgcggtccgcggcatgaccaaggcaactgcggtcgagttcggcaagcacaacatccgcgtcaactcggtgcacccgggcttcatccagacccccatgatggtcgaggcaaccgacgaggtaggcggcgaagcgctcgcacagatccccctgggccgcatcgccgatccgtccgaggtttcgaacctcgtgctctttctggcctcggacgagtcctcctacatcaccggctcagagcatctggtcgatgccggcatgctggcccactgagggcgccgaacgatggcttcggtcgaa

SEQ ID NO: 34210 - DNA, 960 bp, Sphingomonas aromaticivorans
atggcacgcaagaagatcgcgctgatcggcgcgggcaacatcggtggcactcttgcccacctcgccgcccagaaggaacttggcgacatcgtcctgttcgacgtcgttgaaggcgtgccccagggcaaggcgctcgacctttcgcagtgcggtccggtcgaaggcttcgacgccaacatcatcggcaccaacgactacaagggcatcgcaggcgcggacgtgatcatcgtcaccgccggcgtcgcccgcaagcccggcatgagccgcgacgacctgctcggcatcaacctcaaggtgatgaaggccgtcggcgaaggcatccgcgacaacgcgcccgacgcgttcgtgatctgcatcaccaacccgctcgacgcgatggtctgggcgctgcgcgagttctcgggcctgcccgcgaacaaggtcgtcggcatggccggcgtgctcgactcggcgcgcttcagcacgttcctggcatgggaattcggcgtctcgatccgcgacgtgaacacgttcgttctcggcggccacggcgacaccatggttccggtcacccagtactcgaccgtcaacggcatcccggtgcccgacctcgtcaagatgggcctgtccacccaggaaaagatcgacgcgatcgtgcagcgcacccgttcgggcggcggcgagatcgtcgggctgctcaagaccggttcggcgttctacgcgcctgccgcatcgggcatcgcgatggccgaagcctatctcaacgaccagaagcgcatcctgccctgcgccgcctacgttgacggcgaatacggcgtgaacggtctttacgtcggcgtgccggtgctgatcggcgcgaacggcgtcgagaaggtgatcgagatcgaactcgacgacgaagccaagggcaacctccaggtctccgtcgacgcggtcaaggaactgctggaagcctgcaagggcatcgaccccagcctcgcc

SEQ ID NO: 34211 - DNA, 882 bp, Sphingomonas aromaticivorans
atgagcattctcgtcgacaagaataccaaggtcatcacccaggggatgacgggtgccaccggcaccttccacaccgaacaggcgctggcatacggcacccagatggtcggcggcgtgacgccgggcaagggcggcacgacccacatcggcctgcccaacttcaacaccgttgccgaagccaaggccgcgaccggcgcgactgcttcgtgcatctacgttccgccgccgttcgctgccgattcgatcctcgaggcgatcgacgccgagatggaactgatcgtctgcatcaccgaaggcatcccggtcctcgacatggtcaaggtgaagcgcgccctttccggttcgaagagccgcctgatcggtcccaactgccccggcgtcctgaccccgaacgaatgcaagatcggcatcatgccgggctcgatcttcaagaagggttcggtcggcgtcgtctcgcgttcgggcaccctcacctatgaagcggtgttccagacctcgaacatcggcctgggccagaccaccgctgtcggcatcggcggcgacccggtcaacggcaccaacttcatcgacgtgctggaactgttcctggccgacgacgaaaccaagtcgatcatcatgatcggcgaaatcggcggttcggccgaagaagaagcggcacagttcctcaaggacgaagccaagcgcggtcgcaagaagccgatggtcggtttcatcgccggtcgcacggcgcctccgggccgccgcatgggccacgccggcgcgatcgtctcgggcggccagggcggcgccgaagacaagatcgcggcgatggaagaggccggcatccgtgtcagcccctcgccttcgctgctcggcgaaacgcttgccgaagtgctgaaggaa

SEQ ID NO: 34212 - DNA, 2751 bp, Sphingomonas aromaticivorans
ggtccttcgtggcagagcaagcgctggccgatcaccgatgcggcggcgggcgacgacctgacccaggcgatggacccgatggcgctcaggctcgtcatccagaagtccgcgaagaagggcggcgcgccgctcgacgaggccgcgctgcagcaggccgcgatggacgcgatccgcgcgatgaccctgatccgcacgtaccgcgtgcgcgggcatctcgccgccgacctcgacccgctgggccttgcccgccagaagctgccggccgacctttcgcccgaatactatggcttcaccgccgccgacatgacccgcaaggtctatctcggcggggcgctggggctggaatgggcgacggtgaacgaactcgtcgcgatcctgcgcgccaactactgcgggcatgttggcttcgagtacatgcacatctccgacgtggaggagcgccgcttcatccaggaccgcatcgagggcggcgacaagtcgatcgacttcacccccaacggcaagaaggcgatcctcgccgctgtcgttcgcggcgagcagtacgagaagttcctcggcaagaagtacgtcggcaccaagcgcttcggcctcgacggcggcgaatcgatgatcccggcgctggaagcgctgatcaagtacggcgggcagctcggcgtgcgcgagatcgtctacggcatggcccaccgcggtcgcctcaacgtactcgccaacgtgatggccaagccctatcgcgtgatcttccacgagttctcgggcggatcggccaaccccgaggacgtgggcggatcgggcgacgtgaagtaccacctcggcacctcgaccgaccgcgagttcgacgggatcaaggttcacatgagcctggtgcccaacccctcgcacctcgagacggtcgatccggtggtgctcggcaaggtccgcgcgcagcaggtcttccgcgacgacatcggtgacgatgtgggccccgacgcgcgccacaagcaggtcctgcccgtgctgatccacggcgacgcggcctttgccggacagggcatcgtgtgggagtgcttcggcctttcgggcgtgaagggctacaacaccggcggttgcatccacttcatcatcaacaaccagatcggcttcaccaccagcccgcagttctcgcgcgggtcgccctacccctcggacgtcgccaagggcgtccaggcgccgatcatccacgtcaacggcgacgatccggaagccgtgaccttcgcctgcaagctggcgatcgactaccgccagaagttcggccgcgacatcgtggtcgacatgtggtgctaccgccgcttcggccacaacgaaggcgacgagccttcgttcacccagccgctgatgtacgcgaagatccgccagcatccgggcgtgagcgacatctacgccaagcgcctcgtcgccgagggcgtgatcgacgcgaaccacaagggcgaggtcgaaagccacttcaccgcgacgctcgagaccgagttcgaggcgtccaagggctacaaggccaacgaggccgactggttcggcggtcgctggtcggggctgaacaagcccgccgaccccgtcaccgcgcgccgcaacgtggcgaccggcatcgaccagaagatgttcgacagcctgggccgcacgctgaccaccgtccccgaggacctgaccgtccacaagacgctgggccgcgtgatcgacgccaagcgcgagatgttcacgagcggacagggcttcgactgggcgaccggcgaggcactggcgttcggcagcctcgtgatggaaggctatggcgtgcgcctctcgggccaggactgcggacgcggcaccttcagccagcgccacgcggtgtgggtcgaccagaaggacgagcgcaagtacgtgccgctgacgacgctgccgcacggctcgttcgaggtgctcgacagcccgctttccgaatatggcgtgctcggcttcgagtatggctatgccagcgccgacccgaagagcctggtgctgtgggaaggccagttcggcgacttcgccaacggcgcgcagatcgtgatcgaccagtacatcgccgcatccgaagccaagtggctgcgcgccaacggcctcgtcatgctgctgccgcacgggtacgaaggccaggggccggagcattcgtcggcacgtctggagcgctatctgcagctctgcgcggaagacaacctccaggtgtgcaacatcaccacgccggccaactacttccacgtgctgcgccggcagatgcaccgtccgttccgcaagccgctcatcatcatgacgcccaagagcctgctgcgccacccgatggcaaagtcggtcgcttcggacttcatcggcgaagggcacttcatgcgcatcctttcggacacgaacggcgcggcggacaaggacacccgccgggtcgtgctgtgttcgggcaaggtcgcatacgacctgatcgaggcgcgcaacgcggccgagcttgcggacgtacaggtcatccgcctcgagcagctctaccccttccccggcgagcccctggccctgcgcctttcgcgcatgcccaacctcgaggaagtggtgtggtgccaggaagagccgaagaacaacggttcgtggttcttcgtcgagccgctgatcgaggaatcgctgaaggccgcgaagagcaaggtggcgcgcccgcgttatgcaggtcgccacgcctcggcatcgcccgcaacgggcctcgccagccgtcacgccagcgagcagggcgcgcttgtcgccgatgcgctt

SEQ ID NO: 34213 - DNA, 1215 bp, Sphingomonas aromaticivorans
gaagtgaaggttccgacgctgggtgaaagcgtcagcgaagcaaccgtcggccaatggctgaagaagcccggcgaagccgtggcgctggacgagcccatcgtcagcctggagaccgacaaggtcgcggtcgaagtgcccgcacctgccgcaggcgtgcttggcgcgctggtggcgaacgagggcgacaccgttgcggtcggcgcactgcttgcgctgatcgaggacggcgtggcggcggcgggcgcacaggcccctgccccgcgcaccgaagcgccggttccgcccgcttcggcatcggaagcccctgccgctccggcaggcgacgccgccgtgctttcgcccgccgtgcgccgcgcggtgctggaatacggtatcgacccgtcgaccgttaagggcaccggcaaggacggccgcctgaccaaggaagacgtcatggccgccgccgccgccaagcaggccgcgcccgccgctgcggtttcggcccaggccgcaacccccgcggcggctccggccggtggtcgcaacgaagagcgcgtcaagatgacgcgcctgcgccagaccatcgccaagcgcctcaagagcgcgcaggaaaccgccgccctgctcaccacgttcaacgacgtggacatgagcgcggtgatggaagcgcgcgccaagtacaaggacgtgttcgagaagaagcacggcgtgaagctgggcctcatgtcgttcttcgccaaggcttcggtcctggcgctgaaggacatcccctcggtcaacgcgcagatccagggtgatgagatcgtctacttcgactacgtggacatctcggtcgcggtctcggccccgaacgggctggtcgtgccggtggtgcgcgacgtcgacaagatgagcttcgccgacatcgagaagtcgatcgccgactatggcaagaaggcacgcgatggcgcgctgaccatggcagacatggcgggcggcacgttcaccatctcgaacggcggcgttttcgggggcctgatgtcgaccccgatcatcaacccgccgcagtcggccgtgcttggcctgcaccgcatcgaggatcgcccggtcgtgcgcaacggcgagatcgtgatccgcccgatgatgtacatcgcgctgtcctacgaccatcgcatcattgacggacgcgaggcggttacggcactcaagacgatcaaggaagcgatcgaggatccgacgcgcctgctgatcgatctg

SEQ ID NO: 34214 - DNA, 678 bp, Sphingomonas aromaticivorans
ctgcacgaagccacgcttttcctggatctcgacggcactctattcgaacttgtcgacaaccccgaggatgtccgcgccgatcatcggacacaggccctgatcgggcaactcttgcagcacatggatggcagggtcgcagtggtcagcggacgttcgctggcccagattgacgacatgctgggcgatgctgcgggtacgctctggatttccggcagccatggctgcgaataccgctgggacggtgtcatccaaagcccctcgcgcccggccgcgcttgacgacgtcgcagccagtttccgcaattttgcgcaaaaccagcccggcgttctggtcgaggagaagagcctcggcgttgccctgcattaccgcacggcccccgaagccggggcctctgccctcgcgctggcgcaggaaatggctggcctgcacgacctctatcttcagcacggcaagtccatggtggaactgcgcgcaggcagcgagaacaaaggtagcgccatcctcaccatgatggcgcacccgggccttgccggcacgaccccggtcttcgctggcgacgacgtgaccgatgaacccggcttcgaagcggtcctcgaacttggcggccacgcgatccttgtcggcgaacccaggcccacgcttgccaccttccgcctgcgctcgccggaggaacttcgc

SEQ ID NO: 34215 - DNA, 723 bp, Sphingomonas aromaticivorans
atgacgcgcccgctcgcgctggtcacgggcggctggcgccggattggcggcgcgatcgctcgcaagctggcgagcgagggctgggaccttgcccttcacgcccaccacgaccgttcgttcgatgccgagttcaaggctcagctcgaatggctgggggcgacggtctttccggtatcgggcgatctcgacgacagggactttccggcgcgcctgctggccgaagtcgtcggcgccgcgggccgatcgccggagctgctggtcaactcggcctcgctgttccacgacgaccgggtagagacgatcaccccggaagagcttgagcagcatttccgcgtgaacctcttcgcgccgctgctgttgacgcgcgctttcgccgaggcgctgggtgaccgtgacggttcggtcgtcaacatcctcgaccagcgcgtgctcaaccccgtgcccgaccagatcagctacacgatctccaagcaggcgcttcacgcctcggtgcgcacgctggcccgcgcgatggcgcccagggtccgcgtgaacggcgttgcgccgggcctgatcctgcccactgcggactacgatgccgaacaatggcgccggctggaagagatcatgccgctgcggcgcttgcccggcgcggacgagattgccgacgcggtgcacttcctcgcatcggccaggtcggtgacggggcagactttgttcgtcgatgccggcgcgagccttgaa

SEQ ID NO: 34216 - DNA, 1821 bp, Sphingomonas aromaticivorans
atgtgcggaatcatcggaatcgtcggcaaggaacaggttgcggaccggctggtcgacggcctgcggcggatggaataccgcggctatgacagcgccggcgtgtgcaccgtggaaggcggccggctgatccgccgtcgcgccgagggcaagctgaacaacctggtcgcggaactggtgcgcaatcccgcgtcgggcctgatcggcatcgcgcatactcgctgggcgacgcacggcgcaccgaccaccagcaacgcgcacccccatgcgaccgacgaggtggcgctggtccacaacggcatcatcgagaacttcaagccgctgcgcgaagccctgatcgcgcgggggcgcaggttcgagagcgagaccgataccgaagtgatcgcgcacctggtgtccgagcaggtcgaggcggggctttcgccgcaggatgcggtgaaggcggtactgccgcaactgcgcggcgcattcgccatcgccgtggcctttcgcagccacgacgacatgctgatcggcgcgcgcctgggctcgccgctggtggttgggtatggcgaaggcgagacctatctgggatcggacgccatcgccctggcgccgctgacccagcgcatcgcctatctggaggaaggcgactgggtcgtcgtcaagcgcgagggcgcgcagatcttcgatgccgagaacaagccggtcacgcgcccgatcgtggcttcgggcgcgacggcggcggcgatcgagaagggcaactatcgccacttcatgcagaaggaaatcttcgagcagcccgccgtcgtcgcccagaccttgcgcagctacctgcgccgcgtggagcagaccgtggcgctgccacagatcgacttcgaccttgccagcatcaaccgcgtcaccatcgtcgcctgcgggacgagctactatgccggcatggtggcgaagtactggttcgaacagttcgcccgcctgccggtggacatcgacgtggcatccgagttccgttaccgcgacccggtgctcgagccgggcgggctggcgctgttcatctcgcagagcggcgagaccgccgatacgctggcggcgctgcgccactgcaaggcggccggacagaccatcgcggtcgtcgtcaacgtgccgacaagctcgatggcgcgcgaggcggacctgctgctgccgacccacgcgggcccggaaatcggcgtcgcttcgaccaaggcgttcacctgccagcttgccgtcctcgccgcgctcgccgcgcaccttgcagtaaagcgcgggcggctgacgcgcgaggaggaggcggccatcgtagagcagcttgtcgagacgccggccgcgctcaatgccgcgctttcgcacgacgaggaaatcgcgggcatggcccacctcatcgcgcccgcgcgcgacgtgctctacctcgggcgcgggccggactatccgctggcgctggaaggcgcgctcaagctcaaggaaatcagctacatccatgccgagggttacgcctcgggcgagatgaagcacgggcccatcgcgctgatcgacgaggccgtgccggtgatcgtgctggcgccgagcggccccctgttcgagaagacggtcagcaacatgcaggaagtgcgggcgcggggcggcaagatcgtgctcatttccgacgcggaagggctggccgaggcgggcgaggggtgcctcgccacgatcgaaatgccgaaggtccacccgctgatcgcgccgctggtctacgccgtgccggtgcagcttctcgcctaccacgtggccgtggccaagggcaccgacgtcgaccagccgcgcaaccttgccaagagcgtgacggtggag

SEQ ID NO: 34217 - DNA, 645 bp, Sphingomonas aromaticivorans
ccttatgcgatcgtcggcttcgacctcgacgggacgctgctcgatacctcccgcgatctcggcaccgcgctcaatcacgcgctggcgctcgccggtcgcccgccggttctcctggaagaggtaacccgccacatcggcggcggcgcggcccagatgctgcgctcggcgctcacggaatcgggcggggtcgacgaggaagccttcccccgcctccaggccgaactcatcgccttctacgcaagcaacatcgcccaccacaccacgctgtttccgggcggcgaagccatgctcgacgcgctcgatgcacgcggcgtgaaagtcgccatcgccacgaacaagaaggaatcgctggcggtccgcctgttcgaggaactgggcatgacccaccgcttcgcgacgatcatcggcggggacacgctcggccccggcaccgccaagccgcgcccggacatgctccacgccatggtcgaacgctgcggcggcggcccggccgccttcgtcggcgacaccacgttcgatgtcggcgcggcccgcgcggcgggcctgcccgtcgtcgccgtccgcttcggcttcaacgaccttccggctgacgagttgaacgccgatgcagtgatcgatcacttcgacgaactcgtccccgcgctg

SEQ ID NO: 34218 - DNA, 1299 bp, Sphingomonas aromaticivorans
gacatcgcacgcgtcttcgcactccagcaggcgcacatgtgggaggccaaggcctccaccgcggccgagcgcaaggaaaagctcgcgcgcctcaaggccgccgtcgaagcccacgccgacgacatcgtcgccgccgtcctcgaagacacgcgcaagccggttggcgaaatccgcgtgaccgaagtcctcaacgtcaccgccaacatccagcgcaacatcgacaatctcgatgaatggatgaagccggtcgaggtcgccacctcgctcaatcccgccgaccgcgcgcagatcatccacgaagcgcgcggcgtctgcctgatccttggcccctggaacttccccctcggcctcgcgctcggtccggtcgccgctgccatcgccgcaggcaacacctgcatcgtgaagctcaccgacctctgccccgccaccgcaagggtggcctcggtgatcgtcagggaagcgttcgacgaaaaggatgtggctctgttcgaaggcgacgtctcggtcgccaccgcgctcctcgatctgccgttcaaccacgtcttcttcaccggctcgccccgcgtcggcaagatcgtgatggccgctgccgcaaagcacctcaccagcgtcacgctcgaacttggcgggaagtcgcccgtcatcgtcgacgatagcgccgacatcgatcaggtcgccgcccagctcgccgcggccaagcagttcaacggcgggcaggcctgcatcagcccggactacgtcttcgtgaaggaagacaagaaggccgcgctggtcgaaggcttccgggccaacgtgcagaagaacctctatgacgatgccggcaacctgaagaaggacagcatcgcccaggtggtcaacaaggcgaacttcgaccgcgtgaaggccatgttcgacgatgccgtcgccaagggcgcgaccgtcgccgccggcggaacgttcgaagccgatgacctcaccatccatccgaccatgctgaccggcgtcaccccgcagatgaccatcctccaggacgaaatcttcgcccccgtcatcccggtgatgacctacgacacgctcgaccaggcgatcggctacatcgaagcccgcgacaagccgctcgcactctatgtctacagcaaggacgaagcgaacgtcgaaaaggtcctcgcccgcacctcgtcgggcggtgtcacggtgaatggcgtgttctcgcactacctggaaaacaacctgccgttcggcggcgtcaacaccagcggcatgggcagctaccacggcgtgttcggcttcaagtgcttcagccacgaacgggctgtctac

SEQ ID NO: 34219 - DNA, 1182 bp, Sphingomonas aromaticivorans
aagaaggtcgtcctcgcctactccggcggtctcgacacctccgtcatcctcaagtggctgcaggtcacctacaactgcgaggtggtcaccttcaccgccgacctcggccagggcgaggagctcgaacccgcgcgcgccaaggcaaagctgatgggcgtgcccgatcaccacatctacatcgacgacctgcgcgaggaattcgtgcgcgacttcgtcttcccgatgatgcgcgccaatgcccgctacgagggcgattacctgctcggcacctcgatcgcccgtccgctgatctccaagcgcctgatcgaaatcgcgcgcgaaaccggagccgatgccgtcgcccacggcgcgaccggcaagggcaacgaccaggtccgcttcgaactgtccgcctacgccctcgaaccgggcatcaaggttatcgcgccctggcgcgaatgggatctcaccagccgcaccgcgctgatcgcctgggccgaagcgcaccagattccggtccccaaggacaagcgcggcgaaagcccgttctcgaccgacgccaacctcctccacacctcgtccgaaggcaaggtgctggaagatccgtggcaggaaaccccggactacgtctactcgcgcaccgtcaatccggaagacgcgcccgacacccctgagtacatcaccatcgacttcgagaagggcgatggcgtcgcgctcaacggcgaggccatgtcgcccgccacgctgctcgccgccctcaacgacctcggccgcaagcacggcatcggccgtctcgatctcgtcgagaaccgcttcgtcggcatgaagagccgcggcatgtacgaaacgcccggcggcgagatctatgcccgtgcccatcgcggcatcgaaagcatcaccctcgaccggggcgcggcgcacctcaaggacgagctgatgcccaagtacgcggagctgatctacaacggcttctggttctcgcccgagcgcgagatgctgcaggccgcgatcgatcactcgcaggcccgcgtgaacggcaccgtccggctcaagctctacaagggcagcgcctcggtcgtcggccgcaagtcgcccgacagcctctactccgaacgccacgtgacgttcgaggacgatgccggcgcctacgaccagaaggacgcggcgggcttcatcaagctcaacgccctgcgccttcgcctg

SEQ ID NO: 34220 - DNA, 699 bp, Sphingomonas aromaticivorans
gaggcatcggcggtaccttccgaagcgtcgggcggtccccgactgcgggccgagccggatctggtcatcgatgtgcgcgggctgaccaaacggttcggcggacggacagtggtcgacgaggtgagcttgcaggtggcgcgcgggtcgatctgcgggttcctcgggccgaacgggtcgggcaagacgacgacgctgcggatgatctgcgggctgctgatccccgatgcgggcgagggcgaagtgctggggctggacctgaggcgccagcggggggcgatcaagggacgggtcgggtacatgacccagaagttcgggctgttttccgatctgacgattgccgagaacctcgagttcttcgcgcgggtgcacgggctggaccggcgccgggagcgggtggccgaagccttggaagggttgggtctcgccacacgttcggatcagctggcaggcaagctttcgggcgggtggaagcagcgactggcgctggcggcggcggtgctgcacgagccggaaatcctgctgctcgacgaaccgacggcgggcgtcgacccgcaggcgcgacgcgagttctgggaccagatccacgatcttgcccagggcgggatgacggtgctggtgtcgacccattacatggacgaggccgagcgctgccacgagattgcctatatcgcctatggccgcatgctggcgcgcgggacg

SEQ ID NO: 34221 - DNA, 948 bp, Sphingomonas aromaticivorans
gtcgtcggcgcgggcgcatggggcacggcgctggcgcagatgctatccagcgacgggcgcgaggtcctgctgtgggcgcgcgagagcgaagtggtccgcgaaatcaacgaggaccggcgcaatggaccgttcctgccttccgcctgtctcaatccgacgatcaccgccaccgcagaccttgccgacatggcgcgcatcccggtcctgctgctggtgacgccggcccagcatcttgcgtccgttcttggcgggatcgggcgtgacggtggggacgtggtcctgtgctcaaaggggatcgaggccggaaccgggcggttgatggccgacgtcgcccgcgacgcggcaccggacgcgagcatcgccgtgctttccggcccgacctttgcgcatgaagtggcggacgggttgccgacggcggttaccctcgcctgtgccgggggagaggaacagtggctgcggctttcgaccgccatcgcccgcccgacgttccgtccctattattcggacgacgtgaccggggccgagatcggcggcgcggtgaagaacgtgctggccattgcctgcggcgtggtcgagggactgcgtctcggccagaacgcccgggcggcgctgatcagccggggtttcgccgaaatgcagcgtttcgggcttgcgctgggggcgcggccgaaaacattgtcggggctctcgggtttgggagacctggtgttgacatgttcttccacttcgagccgcaatttctcgctcggcaaggcgctgggcgagggagcaagcgcaacggccgtcatggccgaccgcgcgacggtggccgagggggcgttcaccgccccggtgcttgccgaccttgcgcgcggccgcgggatttccatgccgatcgtcgaggccgtggtcacgctgctcgaaggcgcggcaccggcgcgcgaggtggtcgcgggcctgctctcgcgt

SEQ ID NO: 34222 - DNA, 897 bp, Sphingomonas aromaticivorans
ccgcaaaggcccctgaagctgggcacccgccgctctccccttgccatggcacaggccgaggaagcccgtgcccgcctctgcgcggcgcatggctgggccgaatcgcaggtggaacttgtcccggtgacggccagcggcgacaagatccaggaccgtccgctcgccgacatcggcggcaaggcgctctggaccaaggagctcgacgcctggctcgtctcgggcgagatcgactttgccgtgcattcgatgaaggacgtcgagacgatccgtcctgaaaacttcgccatcgccgccgtccttccccgcgccgacgtgcgcgacgtgctgatcggcgcggcctccatccacgcaatcccgcccggtgcgcgcgtcggcaccagcgccccgcgccgcgccgcgcagatgctccacgcccggcccgacctcactgtggtttcgttccggggcaatgtcgcgacccgtctggcaaagctccaggcgggcgaggccgacgtgaccctgcttgccgccgccggcctcggacgcctgggcgagaccggggtcggccatccgctttcggagtacgagtggctccccgcgcctgcccagggcgcgatcggaatcgaatgcctcgcgtcgagagccgatctctgcgcatggctcggcgccatcgacgacaagccgacccatcacgcgatccgcgccgaacgcgccctgctcctcgcgctcggcggcaattgccacagcccgatcgcggtcctgaccacgcatcacgaaagctcgctgacgcttcgcgccgcgttgttcagcccggacggtgccgagcgcgtcgaagcgcacgagaccttcgcggcgggcgacgatgcaggccccgcccatctcgcccatcgcctcctaggcgaagcgcccgacgcgatc

SEQ ID NO: 34223 - DNA, 753 bp, Sphingomonas aromaticivorans
tcgcttgaaggccgcatcgcgttgattacgggggcttcttcgggccttggcgcgcatttcgcacggctctttgcggcggcaggcgcggcggtcgtggtcggcgcgcggcgggtggagcgcgtggcggcgctggctgacgagatcaatgcgggcggtggcaaggctctcgccgtggcgctcgacgtgaccgacgaggcttccatcatcgcggcgttcgatgcggccgaggcggcgcttggcgtgccggacgtggtcgttgccaatgccgggatcgtcgaggcggggcggtcggtggatcttccggccgaggcgatgcggcgggtggtcgatacaaacttcaacggagtctacctgaccgcgcgcgaaggggcgcggcggatgatcgcggcgggatccaggcagtcggagaagggacggatcatcctgaccggatcgatcaccgcgcagatgactgcgaccggcgacgcggcctatgccgcgaccaagctggcggtccagcacctggggcgccagttcgcgcgagagtgggcgcggctggggatcaacgtcaacgtgatccagcccggctacatccgtaccgagatcgacggcgagtggttcgacaccgaaggcggcaaggcgcagatcgcctcgtggccgaggaagcggctgaccgaggtctccgcactggacgacatgatgctgttcttcgcctctgacgcatcgcgtcaggtgacggggacgttcatttcggtggacgacgggcagagcctg

SEQ ID NO: 34224 - DNA, 1134 bp, Sphingomonas aromaticivorans
gcaatcaatcttccccgcgtgatccgggctggcggcggtgcgctggccgaactgcccgatgcaatggcgcagtgcggcctttcgcgccccttcgtggtgaccgacgcgttcctcgtgcagagcgggatggtcgcgcggatgctcgaggtgctggacggcgctgggattgcggccacggtcttcgatgcgacggtgcccgatccgacggttgcggtggtcgaacaggcgcttggcgcgctgcgcgaggcggagtgcgattgcgtgatcgggttcggcgggggcagcccgatcgacacctcgaaggccatcgccgccctggcgctggagccgcgcgcggtgcaatcgatgaaggcgccggcgacgaccgacgtcccggggctgccgatcatcgccgtcccgacgaccgcgggcaccggctcggaggcgacgaagttcaccatcgtgaccgatgaggcgacgagcgagaagatgctctgcgcgggcctggccttcctgccgaccatcgccatcgtcgatttcgagctgaccatgggcaagccggcgcggctaactgccgacaccggcatcgattcgctgacccatgcgatcgaggcctatgtttcgaagaaggccaatccgttttcggatgcgatggcgatctcggcgatgaagctgatcgcgccgaacatccgcaccgcctgcgccgaacccggaaaccgggcggcgcgcgaggcgatgatgattggcgcgcaccatgccggtatcgcgttttccaacgcgagcgtggcgctggtgcacgggatgagccgccccatcggcgcgttctttcatgtgccgcacggactttccaacgcgatgttgctgcctgcgatcaccgcgttttccgctccgtcggcgctgccacgctatgccgattgcgcccgcgcgatgggggtggctttggaaagcgagggcgaccagtcggcggtggcgcggctgctcgacgagctggcggcgctgaacgcggacctttcggtcccgacgccgcagtcgcatgggatcagcgcggaccgctggttcgaggtcgtgccggaaatggcgcggcaggcgatcgcgtcaggctcgcccggcaataatccccgcgtgcctgatgcggcggaaatcgagcggctctat

SEQ ID NO: 34225 - DNA, 756 bp, Sphingomonas aromaticivorans
ggcagtacacgtgatttcacaggcaagaccgcgttcattaccggcggcgtcaacggcataggcttcggcattgcgcgggctttcgcgctcgcgggcatggatctcatcctcacctaccgcaaggacgaggaccgcgacgacgccgcccgttggctggctgacaacggccttgcccccgcccgcttcgtccgtctcgacgtgaccgaccgcgcccggttcgcgcaagtcgccgccgaagttggaaaggtccacgttctcgtcaacaacgcaggcgtcagcgtcttcggtcccaccgacgaggccagctatgacgactacgactggatcatgggggtgaacttcggtggcgtggtcaacggcctcgtctccttcctgccgggcatgaaggcccatggcgagggtggccacgtggtaaacgtcgcctcgatggcggcctacctttcggggccacaggcaggcatctacaccgccagcaagttcgcggtgcgcggcctgacagaatgcctgcgctacaacctcgccccgcacggcatcggcgtttccctgatgtgccccggcctgacccgcaccaacgcctggaccagcgcgctcaagcgcccggacagtttcgccgaatcgggcttcaagcccgcagacgccaccgagctggaacagttcggcaccgcattcgagctgggcatggacccgtttgaggtcgggcaaaagacgctcgccggcatgatcgagaaccgtggcctcatcctgacccacggcgaa

SEQ ID NO: 34226 - DNA, 3420 bp, Sphingomonas aromaticivorans
ttcgccgcattcgcgccccgccattccgtgccctccgacctgcgccgggcgattaccgccgccacccgccgcgcggaacgcgagtgcatggtcatgctcctgccggaagcaaccttgccacaggcaacccgggcttcggcacaggcgctggcacgcaagctggtcgaggccctgcgcgccaagccgcgcgggaacggggtggagcaactcgtgcaggagtatgccctctcgacgcacgaaggcgtcgccctgatgtgtcttgccgaggcgttgttgcgcattcccgataacgatacgcgcgacgatctcatccgcgacaagatcgcgggaggcgactggctggcgcacctcggcggcgaccgttcgctcttcgtcaacgccgcgacgtggggcctcgtcgtcaccgggaagcttgcctccagcgtcgacgacaccggccttggcgcggccctcacccgcctcatcgcccgtgcgggcgaacctgtcatccgccgcggcgtcgacctcgccatgcgcatgatgggcgaacagttcgtcaccggcgagaccatcgacgaggcgctgaagcgcgcccgtccgctcgaggatcgtggcttccgctacagctatgacatgctgggcgaggcggccatgactgcaagcgacgccgcccgctaccatgcagattaccaggccgccatccacgcaatcggcaaggccgccgcacgtcgcggcgtctacgaaggccccggcatctcgatcaagctctccgcgctgcacccgcgttacgcgcgcgcgcagcaggaccgcgtgttcgccgaactcctgccccgtctcaaggcgctggcttatctcgcgttgcgctacgacatcggcctcaacatcgatgccgaagaggccgaccgcctcgaactctcgctcgacctgctcgaagagctggcgatggacccggagcttgcaggctggaacggactgggcttcgtcgtccaggcctacggcaagcgctgccccttcgtaatcgactggattgtcgatcttgcccgcaggtcgggccgcaggatcatggtccgcctcgtcaagggcgcctattgggacgcagagatcaagcgtgcgcaggtcgacgggcagtccggcttcccggtctacacccgcaaggcccacaccgatgtcgcctatatcgcctgtgcccgccggctgctcgccgcgaccgacgtcgtgttcccccagttcgccacccacaacgcccagacactcgccaccatccacgagatggcaggcccggactttgctgttggccgttacgagttccagtgcctccacggcatgggcgaaccgctctatgacgaggttgtcggcaaggacaagctggaccgcccctgccgcatctacgcgccggtcggcacgcacgaaacgctgctggcctacctcgtccgccgcttgctggaaaacggcgcgaactcttcattcgtcaaccgcatcgccaacccggacgtgccggtcgatgaaatcgttgccgatcccgtggcgcaggttgccgctgatgccgatcccggcgcgccccatcccctgatcgcccttcccgccgcgctttatcccgaccgccgcaacagcagcggtctcgaccttgcggacgaaagcaccctcgccgccctcacggaccgattccaggcgatttccgcccattcgcgtcacgcccacccgtccgccgacctgccccacgtcaatccgcgcccggttctgaatccggcgaaccacagggatgtagttggccacgtcagcgaggccgcaccagcggctgctggcatggcagccagcctcgccgcagcctcgcgctggagcgcgacgcccgtagccgcccgcgccatgatcctggaacgcgcggcagacgccatgcaggcggctatgcccgaactcatcgcgctgatcgtgcgcgaggctggaaagtccgtgtccaacgccattgccgaagtgcgcgaggctgtggatttcctgcgctattacgccagccaggcgcctgccatgtccggttcgcggcctctcggggtcgccttgtgcatcagcccgtggaacttccccctcgccatcttcaccggccaggtggcggccgcgctcatggcgggcaacccggtcctcgccaagcctgccgaagaaacgccgctcattgcctctgaagccgtgcgcatcctccatgaagcgggcgtacccgacgatgccctcgtattcctgccgggagacggcgccatcggagccgcactggtcgctgcgccggaaatcgccgccgtgcttttcaccggatcgacggaagtcggccgtttgatccagcgccagctcgccacccggctttccgcggagggccgcccgatccctctgattgccgaaaccggcggccagaacgcgatgatcgtcgacagttccgcgcttgccgaacaggtcgtggccgatgtgatcgcatctgccttcgacagcgcgggccaacgctgttcggccctgcgcgtcctgtgcctccaggaggacgttgcggatcacgtcctcgccatgctgcgcggcgcgctggcggaactcacggtcggtccgaccgaccgcctcagcgccgacattggccccgtcatcgccgccgaggcgcgcgaagcgatcgaggcgcacgtcgcccgcatggaagctgccggttgcccagtccaccgcctgccgctcggcaccgccaccaacgagggcactttcgttgccccgacgatcatcgaactgtccgcccccgatctcctcacgcgcgaggtcttcgggccggtcctccacgtcatccgcttccgccgagccgacatggacgccatggtcgagcgcatcaatgcctggggctatggcctgaccttcggcctccacacccgcctcgacgagacggtcgcccgcgttacggcgaaggcccatgctggcaacatctacgtcaaccggaacgtcattggcgcggtggtcggcgtccagccgttcggcggccacggcctgtccggcacgggcccgaaagcaggcggcccgctttacctgcgccgccttgtcgccagcgcccctgccgcacccgcactggagttgactgagcgcgaactgcctggccccgtcggcgaacgcaacatctacgccctgcgccccgtaggccgggtccttgtcgccgcccagtcgccagagcgccttgccgccctcaccagccgcgtcgaacggctcggcggcacacccatcgcggccgacgatggctggcaggcgcaaggccccttcgcccgcgcccttgtcgaaggcgacgcggcgttcatcctctctttccagcaggccgtggcggccctcgacgggcccatcgcacctgtccttgcctctgcggacgacgacacgatgctggtggccgaggtgtcgctctcgatcaacaccaccgccgctggcggcaacgccagcctgatggccatg

SEQ ID NO: 34227 - DNA, 1353 bp, Sphingomonas aromaticivorans
catgaacccgcaaccggcgccgaagtgtggcgcggcaaggttggtgacgtcgaagaggtcgtggcgcgggcccgccgggcctggcctgcctgggcagcgcaacccctggccacgcgcatcgaactcgtcaggcgcttcgccaacgaagtgcgcaaggacgcggacaatctggcgacgatgatctcgcgcgagacgggcaagccgctatgggaagcccgcaccgaagtggacagcgtggtcaacaaggtcgagatctcgatccgcgcctatgccgaccgcacatcccagcgaaagctcgactccgcactccagggcaccgccgcgctgcggcacaagccgcatggcgtgctggcggtgctggggccgtacaatttccccgcgcatctgcccaacggccacatcgtgcccgcgctgatcgccggtaacgcggtggtcttcaagccttcggaaaagacgccggcgacgggcgagatgctggcccagtgcttccatcgcgcgggcattccggcagccgtggtgcaggtcctgataggcggtccggaagagggccaggcgctggtcgcgcatgacggcatcgacggcgtgctgttcaccggctcggcccacgcgggcatcgcgatcaaccgcaagctcgcgtcgaacccgggcaagatcgtggcgctggagatgggcggcaacaaccccatcgtcgtctgggatacgcccaagatcgaggacgcggccacgctgatcgtccagtcggccttcaccagcgccggccagcgttgcacggcagcacgccggttgatcatcaaggcctcgatgttcgacgaggtgatcgaccacgtgaagcggcttgcggaccgcatcatcgtcggcgcgccgttcgacgatccggcacccttcatgggcccggtgatcgacaatcgcaccgccgacgggctgaccgaaagcttcgtctacctgctgtcgtcgggcgggcggccaatcaagcacatggtccgcctgcaggaagaccgcccgttcctttcgccagcgatcatcgacgtgaccgccgttgccgaccggcccgacgtggaactgttcggccccctcctgcaggtcgtcagggtcgacgatttcgacgaggccatcgccgaggcgaacaacacgcgcttcgggctgtcggcgtcgctgatcggcggcgacccgcaggactacaaccggttctgggcgaacatccgcgcgggcgtggtcaactggaaccggccgaccaacggcgcgtcatcggccgcaccgttcggcggcgtcgggttgtcgggcaatcatcggcccagcgcctattacgcggcggactattgcgcctatccggtcgcctcgaccgaagtcgatcag

SEQ ID NO: 34228 - DNA, 1308 bp, Sphingomonas aromaticivorans
aagctgttcatcgccaatcgcggagagatcgctctccgcgtgatccgcaccgcgcgcgccatggggatcgaaaccgtccttggcgcatccgaggccgatgcctcctcgctcccggccaagcttgccgaccacgttgcgatcgtcggccccggcccctcgtcgcagggctatctgtcgattgaacgcgtcgtcgatgcagcggtcaggtccggctgcgacgcggtccacccgggctatggcttcctttccgaaaacgccggtttcgcccgtgcggtcgctgccgccggcatccgcttcgtcgggccggacatcgcgacgctcgaaggcatgggcgacaagctcgctgcccgcgctctcgcggtcgaggcgggcctgcccgtcctccccggcggcgaggccgcgacccgcgccgatgtccacgcccgcgccacggagaccggctacccgctcctgctcaaggcggttgcgggcggcggcggcaagggcatgcgccgggttgaccgacccgaagacctcgatgccgcgctcgacatggcccaggccgaagcgcaggccgcgttcggcaacggcgcggtctatgtcgaacgcttcgtcgcgcgcggacgccatgttgaagtccagcttcttggcgacggaaccaacgccatccatctcggcacgcgcgactgctcgatccagcgccgattccagaagctcgtcgaggaagcacccgctcccgccatgccgctcgcctcgcgcgagggcatcgaacaggccgcggtccgcctcgcccgtcatctcggctatcgcggcgccggcactgccgagttcctcgtcgatgccgaggacttctcgttctatttcctcgaactcaacgcgcgcatccaggttgagcatccggtgaccgaggcgatcaccggcgtcgacctcgtcgagcaacagcttcttgtcgccatgggcaagcccctgtcgctgacccaggcgatggtccgccccaacgggcatgccatcgaggtgcgcataaacgccgaagatcccgacgcggacttccgcccctcccccggccgcgcaacccgcgccgcctggcccgcaggcgaaggcgtccgggtagacacccacatcggcctcgggggtgaagtgccgccgttctacgattcgctcatgggcaagctcatcgtccacggcgcaacccgcgaacaggcggtcgagcgccttcgcaaggctctggattcactgcacatcgaaggcctgccgaccaccgcaccgctccaccgccgcatcgtcctcgacccgcgcttcgtcgccggcggggtcgacaccggcttcctg

SEQ ID NO: 34229 - DNA, 2639 bp, Sphingomonas aromaticivorans
gtattccacttcggcggcggcgccacctcttcggaaccgcgcgcgaaggacaagaccatcgtcggcggcaagggtgcgaacctggccgagatggcgggcatcggtctgccggtgccccccggatttacgatcagcaccgaagtctgcacggcctacaatgccagcggcaagactttcgacgatgccctgcgcgccggcgttgcggcgggcgtctcccatatcgagaaggcgacaggccgcacgtttggcgatgccgcgaatcctctgctggtctcggtccgctcgggcgcgcgcgtctcgatgccgggcatgatggacaccgtgctcaacctcggcctcaacgacgcgaccgtcgaaggcctggccgccggttcgggtgatccgcgcttcgcctgggacagctaccgccgcttcatccagatgtattccgacgtggtgcttggcctcgaccatcaccggttcgaggacgcgctggaaatcgtcaaggaagacaatggcttcttcaacgacgtggaacttggcgccaatcattggcaggcgcttgtcggcgaatacaagtccatcgtcgaagaccagctcggccgcccgttcccgcaggacgtccacgaacagctctggggcgcgatcggcgccgtgttcgacagctgggaaagcgaccgcgccaaggtctatcgcaagctcaacgacattccgcacgactggggcaccgccgtcaacgtgcaggccatggtcttcggcaacatgggcgatacctcggccaccggcgtcgcgttcacccgtgaccctgcgaccggcgagaaggcctactacggcgaatggctggttaacgcacagggcgaggacgtcgtcgccggcatccgcaccccgcagtacctgacgctggccgcgcgcgaacgtgccggggccaagccgctgtcgatggaagaggccatgcccggggcatacgccgaactcgccgccgtgttcgagctgctggaaaagcactatcgcgacatgcaggacatcgagttcaccgtcgagcagggcaagctgtggatgctgcagacccgttcgggcaagcgcaccgccaaggccgcgctcaagatggcggtggacatggtcggcgaaggcctgatcgacgaggcgaccgcgatcaagcgcatcgacccgatggcgctcgaccagctccttcaccccacgctcgatcccaaggccgcgcgcgacgtgctgaccaagggcctgccggcttcgcccggcgcggcttcgggcacggtcgtgttcgatgccgacaccgcccaggccaaggccgagcgcggcgatgcggtgatcctggtgcgcgtggaaacctcgcccgaagacatccacggcatgcacgccgccaagggcatcctcacggcacgcggcggcatgaccagccacgcggcggtggtggcgcgcggcatgggccgtccctgcgtctcgggcgcttcggcgctgtcgatcgacatggccagccgcaccgcgcgcatcggcaaccgcgaaatccgcgagggcgacgtgatcacgctcgacggttcgaacggcgatgtcatggccggcaaggtcccgacggtcgaacctgaactggtcggcgatttcggcacgctgatggcgtgggccgacaagcatcgtcgcatgaaggtgcgcaccaacgccgagaccccgctcgactgccaggtcgcgcgccagttcggagccgagggcatcggcctgtgccggaccgagcacatgttcttcgaagcgggccgcatcagcgccgtgcgccagatgatccttgccgaggacgaggccggccgtcgcgccgcgctggccaagctgctgcccgagcagcgcagcgacttccagtcgatcttcgaggtcatggccggcctgcccgtcacgatccgtctcctcgacccgccgctgcacgagttcctgccccacggcgagaccgagttcgcggaactggccgaagcgaccggcctcggcatcgagcatctgaaacgccgcgcgggcgaactgcacgagttcaatccgatgctcggccatcgcggctgccgcctcggcatcacgttcccggaaatctacgagatgcaggcccgcgccatcttcgaggcagcctgcgacgttgccgaacagagcggcgatgcgccgattcccgaagtgatgatcccgctcgtcgcgacgaagaaggaactcgagatccttcgcgcgctggtcgacagggtgccgccagagttcttcgccgagaaggccgcacgctcgaatatatggtcggcaccatgatcgaactgccgcgcgcagcactcatggcgggcgagatcgcggaagaggcgaagttcttctcgttcggcaccaacgacctcacccagacgacgctgggcgtcagccgtgacgatgccgcgcgcttcctcaacccctatgtcgaccagggcatctacccgcgcgatcccttcgtgagcctcgacatcgagggcgtcggccagcttgtcgaacttgcggcggagcgcgggcgcaagacccgtcccgatatcaagctcggcatctgcggcgagcatggcggcgatccggccagcatcgcgttctgtgagaagaccggcctcgattacgtctcggccagcccctatcgcgtgccgatcgcccggctttcggcggcgcaagcg

SEQ ID NO: 34230 - DNA, 1104 bp, Sphingomonas aromaticivorans
ccggctcgcaagcctgcgcgccccttcttctcgtccggtccctgcgccaagccgcccggatactcccccgaaaagctcgccaccgaatcgctcggccgctcgcatcgcgccaagatcggcaagacgcgccttcagtactgcatcgacctgatgcgcgaagtgctgcagcttcccgatacgcatcgcatcggcatcgtgccgggttcggacaccggcgctttcgagatggcgatgtggacgatgctgggtgcccgcccggtgacgacgcttgcctgggaatcgttcggtgaaggttgggtcaccgatgccgccaagcagctcaagctcgatcccacggtgctgcgcgccgactatggccagatccccgatctgaacgcgatcgactggtcgaacgacgtgctgttcacctggaacggcacgacttcgggcgtgcgcgtgccgaacgccgatttcatccccgccgaccgcgagggcctggccttcgccgacgccacttcggcggttttcgcctacgacatcgactggtcgaagatcgacgtcgccaccttctcctggcagaaggtgctgggcggcgaaggcggccacggcgtgctgatcctcggcccccgcgctgtcgaacggcttgaaacctacacccctgcctggccgctgcccaaggtgttccgcctcgtgtccaagggcaagctcgccgagggcgtgttcaagggcgaaacgatcaacaccccctcgatgctcgcggtcgaagacgcgatcttcgcgctcgaatgggcaaagggtcttggcggtctcgaaggcctccaggcacgcagcgatgccaatgcggcggcgctgaacaagatcgtcgaagaacgctcgtggctctcgcacctcgccgccgacgaagcgacccggtcgaagacctcggtctgcctctcggtcgaaggcgcggatgccgacttcatcaagaagttcgcaggcctgctcgaaaagcagggcgcggcctatgacatcgccggttaccgcgatgccccggccggcctgcgcatctggtgcggcgcgaccgtcaatgccgaggacatcgccgatctcggtccgtggctcgactgggcctacgagacgaccagg

SEQ ID NO: 34231 - DNA, 1398 bp, Sphingomonas aromaticivorans
atgagcggcaattcgggctccaaccagatgtggggcgggcgcttcgcaggcggtccctcggcgatcatgcgcgagatcaacgcctcgattcccttcgacaaggcgttgtggcggcaggacatcgccgcgtcaaaggcccatgtggacatgctgggcgcgcaagggatcgtctcggccgaggatgcggcgctgatcgccagtgggctcgatcaggtggcagcggagtacgaggccaacggggtgcccgagaactgggacctcgaggacatccacatgaccaccgagagccgccttgccgaactgatcggcccggcggcggggcgcctgcacaccgcgcgcagccgcaacgaccaggtggcgaccgactttcgcctgtgggttcgcgacgcgatggaccaggccgagctgggcctgaagcagttgcaggtcgcgctggtgagccgcgcgggcgagcatgccgcttcgatcatgcccggcttcacgcacctgcagaccgcgcagccggtgacgctgggccaccacctgatggcctattacgagatgatcgggcgcgaccgttcgcgctttgccgatgcgcgggtgcgcatgaaccgcagcccgctcggctcggcggcgctggccggcaccggctttcccatcgaccgcttccgcactgccgaggcgctgggcttcgatgggccgactgacaacagcctcgattcggtgtcggaccgcgacttcgcgttggactacctgatggccgccgcgcagtgctcgctgcacctgtcgcggctggccgaggaattcatcatctgggcgagccagcccttcggcttcgtgacgctgcccgacagcctttcgaccggcagcagcatcatgccgcagaagaagaaccccgacgcggccgaactggtgcgcggccattcgggccggatcgtcggctgcctgaccgcgctgatgatcacgatgaagggcctgccgctggcctattccaaggacatgcaggacgacaagccgccggtgttcgaggccgccagcctgctggcgctgtccatcgcggcaatgaccgggatggtggccgaggcgaagttccggaccgaccgcatgcgcgccgccgccgagcttggctatgccacggcgaccgaccttgccgactggctggtgcggcaggccaacatcccgttccgcgaggcgcaccacatcaccggttccgcggtgaagctggccgaatcgcgcgggatagcgctcgaccagctttcgatcgaggacctcaaggcgatcgacgagcgcatcgacgagcgcgtctatgcggctctgtcggtcgaggcgagcgtggcggcgcgttgcagccatggcggaaccgcgccggacgaggtaaggaagcgcgtggcccaggcgcgcgtggcgctggggctggag

SEQ ID NO: 34232 - DNA, 1254 bp, Sphingomonas aromaticivorans
atggaccattttgaagtttcgaacggcgtgctccatgccgaagacgttgccctgccggtgatcgcggccgaagtcggcacgcctgtctatgtctattcgcgtgccacgctgacgcgccacgcccgcgtgttccgcgatgcactgtcgatcctgccggcggtgaagatcgccttcgcggtcaagtccaaccccaacctcgccgtgctcaaggtgctggccgccgaaggttatggtgccgatgtcgtctcgggcggcgaaatggagcgggcgctggccgcgggcatgaagcctgacggcatcgtgttttccggcgtcggcaagaccgaggccgagatgcgccgggggatcgaggcagggatcggccagttcaacctcgaaagcgaggaagaggggctcgagcttgccgagatcgccgcgtcgatgggcaaggtggcctctgccgctctgcgcgtgaatccggatgtcgacgccggaacgcacggcaagatctcaacgggcaaggccgagaacaagttcggcgtgccgttcgaccgggcggctgcgatctatgcgcggctggcggatacgccggggctgaacatgcgcggccttgcgctgcacatcggcagccagctttcgaagctcgatccgctggaagccgcgttcaccaaggttggcggactgatgcgcgcgatccgcgagggtggccatgcggtgacgcacatggatctgggcggcggcgttggcgtgccctacaaggcgggcgaagtcttcccgcaacctgcggaatatgcggcgatggtcgccaaggtgacggcggactggggcgtgaccctgatgttcgagccgggccgcgtgatcaccggaaacaccggcgtgctgatgacgcaggtggtgcgggtgaaggaaggcgcggggcacccgtgggtcgtggtcgacgcggccatgaacgatctggcgcggccggcactttacgatgcctggcatgattttgctgcggtggagcccaccggcgagacctttgtcgccaacatcgtcggcccgatctgcgaaagctcggacacgttcgccatggcgcggaccatcgacaaggtcgggcgcggggacctggcggttttccgcaccgccggggcctatggcgcgacgatggccaacacctacaactcgcgtccgctggtgcccgaggtgatggtcgatggcgagaagtgggccgtggtggccgaccgtatcgaccccgccacgatccttgccgccgagcgcgtgccggacttcctg

SEQ ID NO: 34233 - DNA, 819 bp, Sphingomonas aromaticivorans
gaaggccgcgtagcgatcgtcaccggagcgggcggtggccttggccgcgcttacgcgctcgaactggcccgtcgcggcgcgaaggtcgtcgtgaacgatctgggcgggtcgcgcgatggcaccggccattccgacgccgcgctgaaggtggtcgaggaaatcgaggccatgggcggcgaagccatgtcgaacggcggttcggtcagcgaatacgaacagatggtcgagatggtcgccaagacgaaggagcgctggggcggcgtccacgtcctgatcaacaacgcgggcatcctgcgcgacaagagcttcaccaagatggacccggccgacttcgagatggtcgtgcgcgtccaccttatcggctcggccttcgccaccaaggcctgctgggatctgatgcgcgaacaaaactacggccgcatcctgatgaccgcctcgtccaccggcctgttcggcaacttcggccaggccaactatggcgcggccaagctcggcctcgcgggcctcaccaagaccctctacctcgaaggcgcgaagaacaacatcaaggtcaacacgctggcccccgtggccgccacgcgcatgaccgaggacatcttccccgaggaagcgttcaagctgttcggtcccgaaaacgtcgttcccgccgcgctcttcctggtctcggatgatgccccgacgaacgccatcgtcggcgcaggcggcggtgcataccacggcgcgtgggtgacgatgaacaagggcgtcctcctgccccccgccgaacgcacggtcgaaggattcgccgccaactgggaaaagatcaacgaccgcaccggc

SEQ ID NO: 34234 - DNA, 1171 bp, Sphingomonas aromaticivorans
atcacccgcaagtggcgccccgcaacccaggcgattcgcgggggcacgtggcgctcggagatgggcgagacatccgaagcgctgttcctcacctcgggcttcacgtacgacgacgccgccaccgttgcggcgcggttcgccggcgaagcggaaggcatgacctactcccgcctgcagaatccgaccgtgcagatgctggaagaacgcatcgccctgctcgaaggcgcggaagcttgccgcacacaggcaacgggcatggccgcgatgaccaccgcccttctctgccagctttccgcgggcgaccacatcgtcgccgccaaggccgcgttcggctcgtgccgctggctcgtcgacaacctgctgccccgtttcggcgtccaggggcacgacgatcgatgcctcggacaatgccgcctgggaagcggcgatccggcccaacacgaaggtgttcttcttcgaaagcccggcaaacccgacgatggacatcgtcgatctcgagttcgtctgcggcctcgccaaaaagcatggcatcaccaccgtggtcgacaatgccttcgccacggccgccctccagcgcccgatggacttcggcgccgacgtggttgcctattcggctaccaagatgatggacggccagggccgcgtcatggcaggcgccgtctgcggctcggccgactggatcaacaacgtgctgctgccgttccagcgcaacaccggcccgaacatcgccgcattcaatgcctgggtcgtgctcaagggcctcgaaacgctcgacctgcgcatccaccggcagagcgagaacgcgctgaaggtcgccagcttcgtcgagaagcgcgtgccgcgcctgctctatccgggcctgccgagccacccccagcatgccctcgcgcaaaagcagatgaaggccggcgggacgatcttctcgttcgatctcgacggtggccgggcccaggcgcacgcactgctggacgcgctgcaactgatcgacatctcgaacaacatcggcgactcgcgttcgctcatgtgccacccggcctcgaccacgcatcacggcgtcgggcccgagactcgcgcggacatgggcgttggcgaaggcatgctgcgcctcaacgtgggcctggaagacgcggacgacctgatcgaggatcttgaccaggcactgcggaaagcc

SEQ ID NO: 34235 - DNA, 1581 bp, Sphingomonas aromaticivorans
gacctcccgctcattccgatgcccgccagcgtcgtcgccggacaaggcgcgctgcgaatcggggcggatacgccggtcgtcgcggcatccggtgacgcaggggccgagcgcgcggcgcggttcctcgccgaaagggcgaaggcgcagcgtgggctctcgctggcgaccgcaagcatggcttcgggcccggccatacggttcgtccgggacaacgcgatcgcgggcgaagaggcctatcggctcaccgtcacggccaagggcgcgaccgtcgcggcatccggcgaccgcggcatgatctggggggcggcaacgctggtgcagctcctgtcgcccgacgggcgcaccggccagccggtgcaggttccggcaatgaccatagaggacgcgccgcgctattcctggcgcgggctgatgatggacgtggcgcggcacttccagccgatcgagacgctctatccggtggtcgacgcaatggccgagcagaagctcaacgtgctccacctccacctcagcgacgaccagggctggcgggtggagatcaagcgctatccgaaactgaccgagatcggcgcctggcgcacgccgccatccgccggggagccgacggccgcgaaagtcggcgggttctacacgcaggaacagctcaaggcgctggtcgcctatgccggcgcgcgcgggatcaccgttgtccccgaaatcgacatgcccggccacgcgcaagccgcggttgccgcctatccggaagaagtcggcgtgctgggcgacaggccgcaggtggggcatgactggggcgtcaatccgtggctgttctcaccatcggaaggcagcatgacctttatccgcaacgtgctcgacgaactggtcgaggtgttcccctcgcccttcatccacgtcggcggcgacgaggcggtcaaggaccagtggcaacggtcgcccgaagtgcaggcgcagatggccgcgctcgggctcaagaccgagaaccagcttcagggctggatgatcgcagaactgggcaagcatctggccaccaagggccggcgcctgatcggctgggacgaaatcctcgagggtgacgtgccgacgagcgcctcggtcatgtcgtggcgcggcgaaaaaggtgcggtcgaagccgcgaacaaggggcacgacgtggtgctgtcccccgcccccgacctctatctcgacaaccttcaatcagaccgctccgacgagcccccgggtcgcatcggcatccgcacgctggagcaggtctaccgctatgaaccgacgccttcgggcatcgcgccggagcggctgaagcatgttctgggcgcgcaagccaatgcctggtcggagtacctggcgacggcgaagcagaaggaacatgcaatattcccgcggctttccgccgttgccgaagtgacatggacagcgcccgcacgtcgtgactggaagagcttcgtcgcccggctggagccccagatgctgcgctactcgcgcgagggcatcgcggcggccgacagcgcctttgcggtaaacttccgcatgaaggaaagccggggcgaagcgctgcgtggcggcaggctgacgctggcgatggat

SEQ ID NO: 34236 - DNA, 999 bp, Sphingomonas aromaticivorans
atgcggcgcgaagcagcggaagccggcactgccgtcacccgtttcctggcgcacaacgaaaagaacctgaaggccctcgccgaacgtctgcgcgcatatccgcccaatgtggtggtcacctgcgcacgcggctcttcggaccatgcggcgacgttcggcaagtaccttgtcgaaacgcgtctcggcattcccgtgtcttccgccgcgccctctgtggcttcggtcttcgcgtccgacgtgcgccgcaccggctcggtgctcgtcgcgatctcgcaatccggacgcagccccgatcttcttgccacggtggaaagccaccgcgcggcaggcgcctatgtggtggccctggtcaaccagccggattccccgctcgaaaagcttgccgactgcttcctgccgctctgcgccggcccggaactgtcggtagcggcgacgaaatccttcgtcgtctcgctcgcggcccttgcagccatcgtcgcgtggtggagcgaggacgaggcgctgaaggatgcgcttcacggcctgcccgcgctgctcgaccaggcatatgcccgcgattggaccgctttggtcgatgcactcgcgccggccaataatctcctcgtcgtcgggcgcggctatggcctctcggtcgcgcaggaagcggcgctcaagctcaaggaaacctgcggcctccacgccgaggccttcagcagcgccgaagtccgccatggccccatggccatcgttggggaaggctttccgatcctcgccctcgccacgtccgacgcttcgggcgatgacgtgcgcgccgtcgcgggcgagttctccggtcgtggcgcccgggtccttctcgcagactgctcgcaatccgccggcacgcttccggcagtcccggcgcaccccgtgatcgagccgatcctgctggtccagtcgttctattcggcggtcgaaaccctggcccgcgcccgggggatggagcccgacaatcccccgttcctgcgaaaggtgacagagacg

SEQ ID NO: 34237 - DNA, 1620 bp, Sphingomonas aromaticivorans
cgcaggctctggccgtggctgcgccctcacgccccgcgccttgcgctggtcctgctcgccagccttctcgcgacaggcctcaacctcgcgcagccgtggatctccaagctgatgatcgacgaggccctgctcaagcgcgactgggacgcgctactacggatcgccggcctcatggtggcggccaccgtcggcggcttcgcagtcaatgcgctcgtctcctaccgctacgtcgcgatttccgcgcagatgctgttcgacatgcgcgtcgcgctgctacgtcacctccagacgctcagcccccgcttctacggcagtttccgcctcggcgatctcatgtcgcgcctcaacagcgacgtttccgatgtccagcgcgcagccggggacacgctcctctcggtcctcagcaatgtcctgttcttcgccggcagcgtcggcatgatgctgtggctcgactggaagctgttccttgtcggcacgctgctggtgccgctggccgtcgccagcttcctccacttccagcgccgcatgaccgaccttacccgccagatgcgcgagcgcggggccgatatcggcagcctgctggtcgacacgatcatgggcatgcgcacggtcaatgcgctcggcgccgaagcacacgaggccgaccgtttccgcgccgccaacgctggctttatccacgcgatgttgcggatgcagaccgtctcgttcctcaccggcgccttgcccggcaccatcgtcaccgcctcgactgcggccgtgatcgtctttggcggcaagcagatcatcgacggcaccatgaccatcggcgctctggtcgcgttcctcacctatcacggcaggctgctcgcgccggtccaggcgctgatgggcctgaccgccaccctcgcctccgcccgcgtcgcactggcgcgcatcttcgagcttttcgacacatcggcggaagtcgcggacgcccccgcgccgcgcccgcttccgccggtgaccagggcgatccgcctcgacggcgtgaccatgcaccacgggcgcgaaccggtcctgcgcgatgtcagcctgaccatccccgctggcagcctgaccgccatcctgggcgcttcgggcgcgggcaaatcgaccctggccgacctcctggtgcgcttcctcgaccctgtcgccgggcgcatcaccatcgacggtatcgacctccgcgacctcgctcttgccgacctgcgccgccgcgcgctgctggtcgaccagtcgcccttcctgttcaacgccacgatagccgaaaacatcgcgttcgcccgcacaggtgcgctcccggcagaggtcgccgccgcagccggcgccgccggtctggacccgctgatcgcccgcctgccggaaggcctcgccacccgcaccggcgaacgcggccttgctctctctgccggagaacgccaccgcatcgcgctcgcccgcgcgcttctgcgcaagcccgacgtgctgatcctcgacgagcccactgccgcgctcgacgaggcgaccgagcggctcgtcgcgtcaggcctgcgccgcgcgctgcccgatgcaacgctcgtcgtcatcacccacaagccggcgctcgccgatctggccgaccatgtcgtgcggctcgaacagggc

SEQ ID NO: 34238 - DNA, 759 bp, Sphingomonas aromaticivorans
cgttttgacggcaaggtcatggtcgtgaccggggcggcgcaggggatcgggcgcggcgtggcggagcgcgcggctgccgagggcgcacaggtcctgctggttgatcgtgccgacttcgtgacagatgttgcggcagcgatcgggccgaaggcgcatgcgttcgtggcagacctcgaggggcatgcgggcgctgcggccgccgtggcgcacgggcttgcggttttcggtcggatcgacatcctgatcaacaacgtcggcggcgcgatccgcatgcggccttacgatcagttcacgtccgagcagatcgatgccgaaatccgccgctcgctgatgccgacgctctactgctgccatgcggtgctgccgccgatgctggcgcaaggggcggggacgatcgtcaacgtatcgtccaatgccacgcgtgggatacggcgcgggccgtactcggcggcgaagggcgggatcaacgctctgacccagagcctcgccatggagtatggcgagcaaggcatccgcgtcgtcgccacggcgccgggcggcacgagtgcgcccgcacgcaaggttccgcgcaatgccgagggcgacagcgcgcaggagcaggcttggatggcagaggcggtggagcaggtgacccggtccaccttcatgaaacgctatggcacgctcgaggagcagatcgcaccgatcctgttcctcgcgtccgacgaggcaagttacattacgggaaccgtcctgcccgttgcgggcggtgatctcggc

SEQ ID NO: 34239 - DNA, 1221 bp, Sphingomonas aromaticivorans
tttccgaaaggtttcctctggggcgcgtcgaccgctccgcaccagatcgagggcaacaacaccgcgtccgatctgtggtttctggaaaaccagcagccgaccgtctttgccgagccatccggcgatgctgccaacagcctgttgctgtgggagcgcgatctggacctggcgcgcgatatcggcctcaacacctatcggttcggcgtcgagtgggcgcggatcgagccggagaagggccgcttcagccaggcgatgctcgaccattaccgccgtgtcgtagatggatgccgcgcgcgcgggctggtccccatcgtcacctacagccatttcaccgctccgcgctggttcagcgcgcagggcgggtggaccaatcccgaaagcgcggaactgttcgcgcgctattgcacgaaggtcacccaggccatcggcgatgcgatccattccgcgatcacgctgaacgagccgaacatcctgctgatcctcaagcccatgctgccgcaggcggtgtgggatatccagaagctgacgctcgagacggcgggcaggcgtcttggcgtcgaaaagttcgtctgcgccaatgtcgccgcgttcgaggatctgccggcgctgcagcatggactgctggccgcacacaaggcaggccgcgccgcaatcaaggcggtacgtcccgctttgcccgtcggcgtatccatcgccatgctcgacgaccaggccgtcggtcgcaattcgatccgtgaccgcattcgcagcgaactctacggcgcgtggctggacgtcgcgaaggcggacgatttcatcggcgttcagaactacgagcgcgcgctgtggggtgacaaggggcggttgccggcgccccaggacgccccccgcaactggtcgggcacggaaatctggcccggatcgctggccggcgcggttcgttacgcgcacgccatgaccggtcgtccggtgctggtctccgaacatggcgtcggcaccgatgacgatgcggtgcgagctgccctcattccgccagccctcggcgcgctcaagcaggcgatggacgatggcgtgcctgtcctcggctattgccattggtcgctggtcgacaacttcgaatggatcttcggttacaagccccgtttcggccttgccaccttcgatcccgtcaccttcgagcgcaaggcgaaaccgagtgcacgggtctatggcgcgatagccagggccaatgccctgacggcg

SEQ ID NO: 34240 - DNA, 1002 bp, Sphingomonas aromaticivorans
ttttcaacagacgatcacccgcatcgtcgccagaacctgcttacgggaaagtgggtccttgtctcgccgcaccgcgccaagcggccgtggcagggcgagactggcgatcccgcgccaacgggaggaccgtctcacgatcccggctgctatctctgccccggaaacgcccggacaagcggtgagcgcaacccggactatcccggcgccttcgccttcgacaacgatttccccgccctcatgcccgacaatcccgcgcccgaaggcggcgatcctgtcttccgcgtggccgaagcgcgcgggaccgctcgggtcatctgctattctcccgatcactcgaagacgatgcccgacatggatgtcgcggccatccgcagtctggtcaattgctgggcacaggaaagcgagacgctcggtgcgcattttgccaatgtccagatcttcgagaacaagggcgcgatgatgggctgttccagcccgcacccgcatggccagatctgggccagcgacttcatcccgaccgaagtggcggacgaggaccgggaacaggcagcgtggcacgcctcgcgcgggcgcgtgctgcttgacgaagtcgccgaacgcgaactcgcctcgggcgaacgcgtggtcgaggcgaacgagcactggctcgcggtcgtgccctggtgggcgacatggcccttcgagatattgctggtcgcgcgcgacggcgttggccggatcgaggagctttcggatgcctcgcgtgatgccctcgcgtccatcctgcgtgctgtcacgcgccgctacgacgcgttgttcaacgccagttttccctattccatgggctggcaccagcgcccggcgggcagctccgatcccgctgcctggcggcttcatgcccatttcaacccgccgctgctgcgctcggccacggtgcgcaagttcatggtcggcttcgagatgttcggcgaaagccagcgcgacatcaccccggagaccgccgccgcgcgtctgcgcgcgctg

SEQ ID NO: 34241 - DNA, 1398 bp, Sphingomonas aromaticivorans
ttgaccctccccgccacccacatccgccggctgctcggctggggccgcacgctcgcgcgccatggcgccctgcgcgggatcgagaacgatccgaacaccccgtcgccggtgcgcacgctgtgccggattgcgcggctcggcacgatccagccgcgcgatcccgattatgccggcgccttccgtgctatcggccccgccgcgatcaagctcggccagacccttgccacccgccccgaccttgtgggcgaggatgcggcgcacaacctcctggccctgcaggacaacctgccgccggtcgactaccggctgatccgggcagagatcgaacgcacattcgaaaagccgctcgaagcccttttcgcgcagttcgatcccgaaccgatcggcgcggcctcgatcgcgcaggtccaccgcgcggtcaccactgaaggccacaaggtcgcggtcaaggtgctgcgcccgggcgtgcgcgacaagctcgcgcgcgacatcgacacctacgaatgggccgccgcccatctcgaagcattcggcggcgaggcggagcgcctgcgcccgcgtctcgtgatcgccaatttcaagcgctggaccgtgcgcgagctggacctgcgccgcgaagccgcgtcggcatcggaactggccgacgtgatgaaggcccacgccggctaccgcgtgcccgccatcgactgggaccgcaccaacggccgggtgatgacgctcgactggatcgatggcatcaagatcagcgacactgccgcgctcgaagccgccgggcacgatcgcaaggcgctggcctcgaggctcgtcctcgccttcctgacccaggcgatcagcggcggattcttccatgccgacatgcaccagggcaacctcttcgtgcagcccgacggcaccattgccgccatcgacttcggcatcatgggccggatcgaccgccgcgctcgccagtggctggccgaaattctctacggcctcaccaccggaaactaccgccgcgtggccgaaatccatttcgaggcacaatacgtgccgagctaccactcggtcgacgaattcgcgaccgcgctgcgcgccgtgggcgaacccatgcgcggcaagccggtcagcgagttgtccgtcggccagatgctcgacggccttttcgccatcacccgcgatttcgacatgcagacccagccgcacctgctgcttctgcaaaagaccatggtcatggtcgaaggcatcgccacccagctcgatccgaccatcaacatgtgggatgtctccgctcccttcgtgcgcaactggattcgcgacgagcttggtcccgaggccgcgattgccgagcgcatccgcgaggacacgcagaccctgctgcgcatccccgatctcatccgccgcatcgaggaccgcttcccc

SEQ ID NO: 34242 - DNA, 1062 bp, Sphingomonas aromaticivorans
aacccgctcggcctcgacggcttcgaattcatcgagttctccgcaccggaagcgggcagcctcgagccagtcttcgcgcgcatgggcttcacccacatcgccaaccatcgctccaagcaggtccagctctggcgccagggcggcatcaacctcatcgccaaccacgaaccgcgcagccctgcggcctacttcgccgccgagcacggcccatcggcctgcggcatgggctggcgcgtgcgcaacgcggccaaggcctatgccaccgctatcgagcgcggggccgagccggtcgaggtccgcaccggaccgatggaactgcgcctgcccgcgatccgcggcatcggcggttcgatcatctatctcatcgaccgctacgaaggcggccagttcggcgacctctcgatctacgacatcgacttcgaatatctccccggagtggaccggcatcccgtcggcgcgggtttccacaccatcgaccacctgacccacaacgtctacggcgggcgcatggcgcactgggcttcgttctacgagcgcgtgttcggcttccgcgagatccgctacttcgacatcaagggcgaatataccggcctcaccagccgagcgatgaccgcgcccgatggcaagatccgcattccgctgaacgaggaagccaaggcaggcggcggccagatcgaggagttcctgcgcgcctacaacggcgagggcatccagcacatcgccttcgcctgcgacgacctgctcggcgggtgggacaagctcaaggccattggcacccccttcatgtccccgccgcccgcgacctactacgaaatgctcgacgaacgcctgcccggccatggcgagccggtggcggaactgcagaagcgcggcatcctgctcgacggctccaccgaagagggcgatccccgcctcctgctgcagatcttctccgaaacccagatcggcccggtgttcttcgagttcatccagcgcaagcgcgacgaaggctttggcgaaggcaatttcaccgccctgttcaagtcgatggaacgcgaccagcttcgtcgcggcgtgctcaag

SEQ ID NO: 34243 - DNA, 2703 bp, Sphingomonas aromaticivorans
cagggcgaacacggcgttaccgaagaggtcatgggcgtcgatctggtcgaatggatggtccggggcggcggcggcgatttcgggttcctcgacgacgacccgccgcgtccatccgggcactcgatccaggtccggctctatgccgaagatcccgcactcgactatcgtccgacctcgggcacccttaccgcagtgactttcccggaaggcgtccggacagagacatggtgcatggccggaaccacggtcagcacgtggtacgacccgatgctggccaagctgatcgtccacgccgaatcacgcgaggcagcagtggcggcgatgcaggacgcgctcgaccgcagtcgcattgacgggttcgaaaccaacctgcgctggctgcgtgatgtcgtgcgctcgcccgccttcaccagcggcgaggtctccacccgcgccctgtctcacgtcgctcacgtgccacgcagcataaccgtcgtcagcggcggcaccgcgacgatggcgcaggactggcccggacggcagcggctctgggcagtgggcgtcccgccatccggaccgatggacgacctgtcgttccggctcggcaaccgcctgctcggcaatcccgagggtactgccggtctcgaagtggcgatcaccggcccgaccctcacgttcaatacagccgcccgcgtgtgcgtgaccggcgcggatttcggggcgcggctcgacgggcagcctgtcccgcgcggcatggccatcgacattgccgctggccagacgctcgcgctcggtcgcgcctcgggcggagggatgcgcggctacatcctgtttgccggcggcctcgacatcgcgccgtacctcggcagccgcagcacgttcgaactcggccagttcggcggtcacgccgcgcgccgcctgctggcgggcgacacgctccatctcggcgacgaaccggcgcagcccgcccttcccgccgcaaacctgcccgaactgtcgaacgaatgggcgctgcgcgtcatgtacgggccgcacggcgcacccgacttcttcacccgcgaagacatcgacacgctggtcgccgctgaatggcaggtgcactacaacagcaaccgcactggcatccggcttgtcggccccaagccgcagtgggcgcgcgaggacggcggcgaggcgggcctgcacccctcgaacatccacgacaatccctatgcgatcggcgcggtcgacttcaccggcgacatgccgatcatcctcggaccggacggtccctcgctcggcggcttcgtctgccccttcgtggtgatcgcggcggaccgctggaagatcggccagctcacgccgggcgacaagctccgcttcgttccggtaaattgcgcggatgccgccgcggcgaacgaccagcaacggcgcttcctcgaaaccggcaagcccgcgcagggctgtccggggaggccgatggagacgctctcgcccatcctcgccgtcatcgatgaaagcccgcgcagcccccggaccgtctatcgccagcagggcgaccgcaacatcctggtagaatacgggccgatcgtactcgacatcgaattgcgcatccgcgtgcaggcgctgatgaccgagctggaacggctcgccctgcccggcgtgatcgacatcgtcccgggcatccgctcgctccagttccatttcgacggcgatgcgatgacccaggaggccgcgctctcggtcctgatcgcggcagaggagcggctgggcgacctcgaggacttcaccatcccctcgcgcatcgtccatctgccgctgagctggcgcgatccggccacgatcgaaacgatcgagaagtacatgggcgccgtgcgcgacgacgcgccatggtgtcccgacaacatcgagttcatacgccggatcaacggcctgcccgacgtggcggcggtggagaacctgatcttcgaggcgaactacctcgtcctcggcctgggcgacgtctatctcggtgcaccggtggcgacgcccgtcgatccccgccatcggctggtcacgaccaagtacaacccggcgcgcacctggacgccgccgaacgtggtcggcatcggcggtgcctacatgtgcatctacgggatggaaggccccggcggctaccagctcttcggccgcaccatccaggtgtggaacacccaccgccagaccgatgccttcatcgatggcaagccgtggctgctgcgcttcttcgaccagatccgcttctacccggtcagcgccgaagagcttgaagaatggcggcgggactttcccgcgggccggcgctcgatccggatcgagccttccgagttccgccttgccgactaccgtcgctacctggccgacaatgccgaagggatcgccgagttcgaggcaaggcgtcaggccgctttcgacgaggaacgcgccgaatggcaaaggcgcggagaattcgaccgcaccgacctggtcgaacccgaagcggccgaagcgggcaccgtcgaagtgcccgatggcgcggacctcgtcgaagcacccttcggcgggagcgtctggaaaatgctcgtgtcggtgggcgacgaggtcgaggccggcgagaccatcgcgatcatcgaggcgatgaagatggaatgccgggtcgaaagtccgggggcgggcactgtcgccgcgctctatgcgcaggagcgccagtcggtccagcccggcacgccgatgctcgccctgacgagg

SEQ ID NO: 34244 - DNA, 1269 bp, Sphingomonas aromaticivorans
atgaccgcgatcattgacatccatgcacgcgaaatcctcgacagccgcggcaacccgaccgtggaagtcgacgtgctgctggaagacggcagcttcggccgcgccgccgttccttcgggcgcgtccaccggcgcgcatgaagcggtcgaactgcgcgacggcgacaaggcacgctacctcggcaagggcgtgaccaaggccgtcaccgccgtgaactcggacatcgccgaatgcattcttggcctggacgctgaagaccagcgcgacatcgatcttgccatgatcgaactggacggcaccgagaacaagagccgccttggcgcgaacgccatcctcggcaccagccttgccgtggcgaaggccgccgccgatgcgcggggcctgccgctctacagctacgtcggcggcgtttccgcgcatgttctgccggtgccgatgatgaacatcatcaacggcggcgagcatgccgacaatccgatcgacttccaggaattcatgatcatgccggtcggcgcgccctcgctcgccgaagccgtgcgctggggcgcggaagtgttccacaccctgaagaagggcctgcacgaaaagggtcttgccactgccgtgggcgacgagggcggcttcgctcccaaccttgccagcacgcgcgacgcgctcgacttcgtgatggcttcgatcgagaaggccggtttcaagccgggcgaggacatgatgctcgcgctcgactgcgcggcgaccgaattcttcaagaacggcaagtacgagatcagcggtgaaggcctctcgctctcgcccgacgccatggccgactaccttgccgccctgtgcgatgcctatccgatcatctcgatcgaggatggcatgggcgaggacgatttcgagggctgggccgcgctgacggccaaggtcggcaagcgcgtgcagctcgtcggtgacgaccttttcgtgacgaacccgaagcgcctcgagatgggcattggcaaggggctggcgaactcgctgctggtcaaggtcaaccagatcgggtcgctcaccgagacgctcgaagctgtcagcatcgcacagcgcaacggctacaccgccgtcatgtcgcaccgttcgggcgagaccgaggacgcgaccatcgccgacctcgcggttgccaccaactgcggccagatcaagaccggttcgctcgcccgttcggaccgtctcgccaagtacaaccagctcatccgcatcgaggaagagctgggcgtctcggcgcgctatgccggcaagaccgcgttc

SEQ ID NO: 34245 - DNA, 3318 bp, Sphingomonas aromaticivorans
atgcccaaacgcactgacatctcctcgatcctgatcatcggcgccgggccgatcatcatcggccaggcttgcgagttcgattattcgggcacgcaggcggtgaaggcgctcaaggaagagggctatcgcatcatcctggtcaactcgaaccccgcgacgatcatgaccgatccggatatggcgcacgcgacctatgtcgagccgatcacgcccgaagtcgtcgccaggatcatcgagaaggagcgccccgatgcgctgctccccacgatgggcgggcagaccgcgctcaacaccgcgctcgcgctgttcaacgatggcacgctggaaaagtatggcgtccagatgatcggcgccaatgccgatgcgatcgacaaggccgaagaccgccagcgcttccgcgaggcgatggacaagatcggcctcgaatccgcgcgttcgggcgtggcacacaccatcgacgaagcgcttgaggttctcgagcgcaccggcttgccctcgatcatccgccccagcttcaccatgggcggcaccggcggcggcattgcctacaacaaggaagagttcgtcaagatcgtgaagggcgggctcgaggcctcgcccaccaccgaagtcctgatcgaggaatcgctcctcggctggaaggaatacgagatggaggttgtccgcgacaggaaggacaacgccatcatcatctgctcgatcgagaacgtcgatccgatgggcgtccacaccggcgactcgatcaccgtcgcgcccgcgttgacgctgaccgacaaggaataccagatcatgcgcaacgccagcatcgctgtgctgcgcgagatcggtgtcgagaccggcggttccaacgtgcagttcgcggtcaaccccgccgacggccgcctgatcgtgatcgagatgaacccgcgcgtctcgcgctcctcggcgctggcgtcgaaggccaccggcttcccgatcgccaaggtcgcggccaagctcgccgtgggctatacgctcgacgagatcatgaacgacatcaccggggccaccccggcggcgttcgagccgaccatcgactacgtcgtcaccaagatcccgcgcttcgcgttcgagaagttcaagggctccgaaccgctgctcggcaccgcgatgaagtcggttggcgaagtcatggcgatcggccgcaacatcaaggaatcgatgcagaaggccctgcgcggcctcgaaaccggcctcgacggcttcaaccgcgtggtcgagctggaaggcgccagccgcgacgagatcaccgccgcgctcgcccgcgccacgcccgaacgcctgctggtcatcgcccaggccttccgcgaaggcctgtctgtcgatgaagtccatgcggtcaccaagtacgagccctggttcctgcgccacatccacgagatcgtgagcgaggaaaaggccatacagcaggacggcttgcccaacgacgccgccggcctgcgccggctcaaggcgatgggcttttccgacaagcggctggcgacgctcgccgtgcgttcggtcggtgttgcgggcgggttgggcgagacccaggccaagcgctcgggcctgctgcacgatactttgcgcgccatggccggtgccaccagcgaagacgaggtgcgcgcgctacgccacaagctcggcgtgcgcccggtgttcaagcgcatcgatagctgcgcggccgagttcgaggcggtcacgccctatatgtactcgacctacgaaggcgcgctgttcggcgagcccgagaacgaggcgaacccgtccgaccgcaagaagatcgtgatcctcggcggcggcccgaaccgcatcgggcagggcatcgagttcgactactgctgctgccacgcatgctacgcgctggatgaggcagggttcgagaccatcatggtcaactgcaacccggaaaccgtgtcgaccgactacgacacttccgatcgactctacttcgagccgctgacggccgaggacgtgctggaaatcctcgcggtcgagcaatcgaagggcgaactggtcggcgtgatcgtgcagttcggcggacagaccccgctcaagctggcgcaggcgctgcaggatgcgggcatcccgatcctcggcacgtcgccggactcgatcgacctggccgaagaccgcgagcgctttgccgcgctggtcgccaggctcgggctcaagcagccggccaacggcatcgcccgcagccgcgacgaggccgtcgcggtggccagtcgcatcggctatccggttctcatccgtcccagctatgtgcttggtggccgcgcgatggaaatcgtcgacagccaggcccagctcgacgactacatcgccaccgccgttcaggtctcgggtgacagcccggtgctgatcgaccagtacctgcgcgatgcgatcgagtgcgacgtcgatgcgctggccgatggcgacgaagtcaccgtcgctggcgtcatgcagcacatcgaggaagccggcatccactcgggcgacagtgcctgcaccctgccgccttacagcctgccggccgagatcgtggccgagatggagcgccaggcggtccttctcgcgcgcggcctcgacgtgcgcggtctgatgaacatccagttcgcggtgaaggacggcgaggtctacctgatcgaggtcaacccgcgcgccagccgtaccgtgcccttcgtcgccaaggccgtgggccagcccatcgccaagtttgcagctcgcatcatggcgggtgaaaagctgaccgacctcccgccgatcaagcgcgagatcgactacatggcggtcaaggaagctgtgttcccgtttgcccgtttccccggcatcgacccggtgctttcgcccgagatgaagtcgacgggcgaagtcatgggcatcgatggaaccttcgcggtcgccttcgccaagtcgcagctcggcgcgggtgtgcgcctgccgcagggcgggacgctgttcgtctcggtcaaggattcggacaagccggtggttctgcccgccgtgcgcaagctggccgaactgggcttccgcattgtcgccaccggcggcaccgctcgctacctttcggacgagggcgtgaacgtcgagcgtgtgaacaaggtggccgaaggccgtccgcatatcgtcgatcgcatcatcgacggcgagatcgccttgatcttcaacaccaccgaaggttggcagagccacaaggactcgcagtcgatccgcgcttcggcactgggggcgaaggtgccgtacttcacgactgccgccgcatcggttgcaacagttgaggcgatcgaggctctgcggactgccgaacttgaagtgcgttcgttgcaagactattat

SEQ ID NO: 34246 - DNA, 1080 bp, Sphingomonas aromaticivorans
tggggacgtggatttggcgctgctggtgcggccgttggcgaggtgtgcttcaacaccgcgatgaccggataccaggaagtgatgaccgatccgtcctatgcgggacaggtcgtcaccttcacttttccgcacatcggcaacgtcggcaccaatccggacgacatggaaagccatgacacgccgggcgccgtgggctgcgtggtgcgcgaggacgtgaccgcgcccgccaacttccgcgctgccggcaccttccagcagtggatggagcagcagggcaagatcggcatctccggcctcgacacccgcgcgctgacgcgccgtatccgcctttcaggcgcgccgaacgcggtgatcgcgcacgatccgaagggccagttcgacattcccgcgctgatcgaacgcgcgcggtcctggcccggtctcgaaggcatggaccttgcccgcgtcgttacacgcgacgggcaggaagcctgggaaggctcggtctggcatctgggcgagggcttcaccaagccccaaggcactggccgtccgcacgtcgtcgccatggatttcggcgcgaaggacaacattttccgcaatctggtgaaggccggcgcggacgtgacgatcgtgcccgccgaaaccagcctcgagacgatcctttcgctcaagcccgcaggcgtgttcctgtcgaacggtccgggcgacccggcggcgaccggcgcctacgccgtgccggtgatccagaagctgctcgagatggacatgccggttttcggcatctgcctcggccaccagatgctggcgctcgccgccggtgcacgcaccaccaagatgcaccagggccaccgcggtgcgaaccacccggtcaagcgcatcgaggacggcgtcgtcgagatcacctcgatgaaccacggctttgctgtcgacaacgcgccgggcgcgctgggcgacaaggtgatcgaaactcacgtctcgctgttcgacggctcgaactgcggtatcgcggtcaagggcaagaaggcgttcggcgtgcaataccacccggaagcttcgcccggcccgcaggacagtttctacctgttcgagaagtttgta

SEQ ID NO: 34247 - DNA, 425 bp, Sphingomonas aromaticivorans
gacgtgcgcaaggtaatggcggcgcttccgcaccgctatcccctgctgctggtcgatcgcgtggcgtcgctgacgctgaacgagcgcatccatgcggtgaaggccgtgtcgataacgagcagttcttccagggccatttccccggccgtccgatcatgccgggcgttctccagatcgaggcgctggcgcaggccgccggcgttctcgccgtggaatcgcttggcctcgccggttcgggcaagctcgtctacttcatggcgatcgaggacgcgaagttccgcaatcccgtggaaccgggcgtgctgctcgacctgcacgtcgagttcacccagaagcgctcgcgcgtctgcaagttttccggcaaggcgatgatcggcgacaaggtgacctgcgaggtcaactttaccgcgatgatcgcggatagc

SEQ ID NO: 34248 - DNA, 795 bp, Sphingomonas aromaticivorans
atcaaggggcgcagtgcgctcgtcacaggcgcggcttcgggcatcggactggcctatgccgaggcgatggccgaggcgggggcggcagtgacgctgaccgacatcgacgcggaaggcgcggagcgcgaggctgctcgtcttcgtgccgaagggtacgaagtccgtgccgagaagctggacgtttccgactgggacaacgtcgcggccgccttcgacgcgcacgacaaggcctatggcgggctggacatctgctttgccaatgccggtatcgacaccggtgcgggattctggaaccctgcggggcaccggaaccccgagggccaggtcgatacctacgaccacaagcgctgggacaggtcgatccagatcaacctcaacggggttttctataccgtgagcaacgcggtgcggatcatgaagaaggaaggccgcgccaatggccgcaccggcgggtcgatcgttacgaccgcatcgaacgccggcctcgtgaccgagccgatcgtcggcctgccctatatgcccgcaaaggccggcgtcctgcacatggtgcgcgcgctgggactggagctggccgaattcggcatccgcatcaacgcgatcgcgccggggccgttcgtgaccaacatcggtggtggctggctcaagaaggacccggtcgcgcgggctgcgtgggatgccatcgtgccgcttggatcggttgcggagaccgatcagatcaagccgctggcgctgctgctggcgtcggacgcttcggactacatgaccggcagccacgtggtgatcgatggcggcatg

SEQ ID NO: 34249 - DNA, 1002 bp, Sphingomonas aromaticivorans
atgcgcgccgccgtgatgcagggcctgcacaagccgctggccatcgatacgatccccgatccgacgccgggcgagggtgatgtcgtggtcaaggtcgggcgctgcggcatctgcgggtccgacctgcacatgaccgaggacccggcatacgggcagggcgcgggttcggtgctgggtcacgagtttgcgggcgaagtcgttgcgctgggcaagggcgtggagggcctcaggaccggggatctcgtctcggtcatcccgttacaaagttgcggtcaatgtcattcgtgtcgcacgggcgaagtgcagtggtgcgagaggttcggtcttcagggtggcggctatgccgaatttgccctgacgcggccgaaccagtgcgtgcgcctgccggcaagcgccagcatggctgatggcgccatcgtcgaaccgctagccgtggctctgcacggcctggcgcttagccggatgaagatcggcgacaaggtgctggtgctgggcgcgggaccgatcggtctcgccgtcgcgttctgggcccggcgcttcggggctgggcgcgtggtggtgcaggacctggcggagtggcagcgcgaccgcgctttgcagatgggcgcgcacgatttcgtcgtcgatgcggccgatccggtggggagcgccgggcgcgcgctgggcggcaaggccgatatagtattcgaatgcgtgggcgtgccgggactgatcgcgcaggctgtggagcaggtgcgcaatgacgggaccatcacgctgcttggcctgtgtacgcggcccgatacgttcaacagcttcgcgatgctgtccaagcaggtgaagctggtgacgtccgcgttcttcaccaggcaggaatacgaagcggcgctcgacgccctcgtccgtggtgcggtggagccgcgccttctggtaaccgacaccatttcgctcgatgcaacgccggacgtgttcgagagcctgcgcaagcgcacgcatcagtgcaaggtgctgataaatccgggc

SEQ ID NO: 34250 - DNA, 897 bp, Sphingomonas aromaticivorans
attgaaaccttcgcgggacgaaccgcattcgtcaccggtggagcatccggaataggcctgggcatcgtcaaggcgctcgcccggcgggacgccttcgtggtgatcgcggacatgcgcaccgatcacatctcgagggcattgaaggcgctggcatcagcaggtctgggcgagagcgttgccgcagtggaactcgatgtgacggaccgggccgcatatgcgagcatggcgcgccgcatggatgaagagttcggcgggatagacgttctggtcaacaatgccggcgtgggtgtcgaagggcccattctgcaggcgacctaccccgactgggacttcgggcttggcgtcaacctgggcggcgtggtcaacgggcttcaggcaatgctgccgcagatgatcgcgcatgggcgcggcggccatgtcgtcaacaccgcatcgctggctgccacggtcgtcatgcccggtcatcttgcgatctatgccgcaggcaaggcggcggtgctgaacctgaccgagaacatgcgtgccgatcttgccgggcgcgggataggcagcagcgtgctgtgccccggtttcgtccggtctaacatccatgaagccgcgcgcaaccggccggcccacctgcgcgagggaagtggctttgcggcttccgagcaggcgttgtcgatgcgggagacgggcagcgagtggatggatccggatgccgtgggcgaaatggtggcggacgccattctcgccgatcaactctatgtcatcactcacggtgaattcgcaaaccggatgcgcgagcgcgccgaagcgctgcttgcggccaccccggtctgcgagatgcagttctgaccggtcaggttgaaatgccgatggtggtcgttgcggtgtagccgccggataccgacccgg

SEQ ID NO: 34251 - DNA, 2019 bp, Sphingomonas aromaticivorans
gcgtggcggcacttcggcccccggctgacagccgacgggatccggccgatccgggaccagcgcgcgcctgcgtcatactcgctggacgacgacgtaccgttcgccgtcgcaccggcggccgggctgggctggttcggaccttcggccatgtgcttgcggcgcggctcagtcgcactcgtgccggcaatggcgggggcgtccgtcgccggggatgccggctccgtgcgcatcatcacgcgcgatccggttgcgggcgtggagcttgaacaggtgttcgaagcagttggcggtgctttcgtctgccgcagcgtcgtgcgcaacatcggcagtgaaacgttcgaggtcgactggctgtcgagcgcgctcctccccatcgcgggttccgcgcgcgagatcgtgtcgtggcgtggacgccacaacgccgaactggtcgaatgccgcgagccgatgccgcagcattcgtgggtgcgcgaaggtcggcgcgggatttccgggcacggcggccctccgggcctgttcgtgctcgacgaaggcgctacgtatcacgcgggcactgtccgcgcgctgcagcttgcgtggtctggcgatgcgcgcatcgaggtcgagcgcgacgacgagggtttctggacgttgaacgcgggcgcggtgcttcaacctggcgaggccagccttgcgcccggcgagagctggcagtcgcccgacgccatcgtgacggtatcaacctccggccggaacggcgcggcgcaggcgtttcacgatgcagtccgcgcgcgcatccgctggccggacggggccatgcgcccacggcccgtgcacctcaactcgtgggaagcctgctatttcgaccacgacgaggagcgcatcgttgcccttgcggaagcggcggcatccgtgggcgtggagcggttcattctcgacgatggctggttccggggccgcaacgacgacacggcgggactgggcgactggacaaccgatcccgtcaagtatccgcacggactgcgcaccctggcagaccgcgtcaatgcgctgggcatggagttcgggctctgggtcgaaccggaaatgatcaatcccgatagcgacctctatcgggcgtatccggactgggcgcttgcgcttccggggcggaaacgaccgactgcccggaaccagctcgtgcttgacatgcggcgacgggacgttcgcgaccacctcttcggctgcatcgacgcgctgctgcgcgaattgccgatcacctacctcaagtgggaccacaaccgcgacctcgcgcctgctggcggggcggcgcagatgaggggggcgtatgaactgttcgcgcgggtccgcgcagcgcatcccgccgtggagatcgaggcctgtgctggcggcggcgggcgcaacgatgcaggtatggccgactattgccatcgctactggaccagcgacaatatcgacgcggccagtcgcatcggtatccagcgcgggttcctgtcgttcctccctcccgaggtgatgggatcgcacatcgccgcaagccccgcccatgccacggggcgcaggcattccctgggcttccgggctgccatggcgatggccggtcatctcggcgtggaaatggacccgcgcacgctgggcgatgcagagcgcgccgaactggccgactggatcgcctttcacaagcaatggcgcggattgctgcaccagggcactgtctggctgggcgagggtgcggatgcagcgttctggcaggcgcaggggaatgcagcggaactgctgctcttcgtgatccgcgcggacccgccgctggaccgtcgcccgcagcctttgccactgcctttcgcgggccaggatggaacatgggacatccggcttcttcgtatcgccgggggcgagggcgggcatgccgcgcattccgctgcgctgttcgaggcaatgaaggccgcccctcaggcgttcccggctgactggctctcggccaacggcctgccgctcccgccctgcaaggcggagacggtcaccatcttccatctgcgcaaa

SEQ ID NO: 34252 - DNA, 1029 bp, Sphingomonas aromaticivorans
ccgctcatcgaagccgccgatgtcgtgcgcctcttcgacgacctggacctgtgggactgctggcccctcgcgcacgaggacgggcgtacggttgagcatctgggacgcaactggtggttctttctttcggcgccggtcttccccgatccggtcgaacggcatggccatgcccgcatccgcctcgtctcgctgggggaggatggatggaaggatcacggcaacgcctttcccgatggtctcacgcccggcagccgcgaatgggcgggttcggccgtgctgatggacgacgggcgcaccgtgcagcatttcttcaccgccgcaggacggcgcggcgaggctgcaccgaccttcgagcaacgcatattcgtcagcgaaggcaccctgaccgaggccggccctggcggatggcaagccccgcgcgagatattcgaggccgatggcctacgctacgtgctcgaccggcaggacagtggggcgccgggccagatcaagggttttcgcgatcccgcgtggcttcgagatccggccaccggcagggcgcacatcctgttcaccggcagcgccgcatggtcggatcatcctttcaacggcaatgtggggatcgccacgctcgagggtgacacctgggttctcggcaatccactggtcgaggcgatcgacgtgaacaacgagcttgaacggccgcacatcctggtgcgcgacgggctgtactatctcttctggtcgacccagacccacactttcgcgcccgctgcggtggcagggcccaacggcctctacggcatggtggctgaaagccttgcgggcccctggcgcatgctcaacgaaggcgggctggtcgcggcgaacccggatgcggaagcaaagcagtcctacagttggtgggtcaccggcgagggcgaagtgtggagcttcgtcgactactggggcatggcagggcgcaccgtcgaggagcaacccgaattgctgcgcagcaatttcgggggaacccccgcacctcggttcatgcttaacttcgatggcgagcgg

SEQ ID NO: 34253 - DNA, 810 bp, Sphingomonas aromaticivorans
ccaggacgaggggatttctacgaaaagtatctggaatccctggattactggcattgcgaagggtggcgggtcaccgcgctcgactggcgagggcaagctggctccggtcggctttcgtcggatccgatgacagggcatgttcccgatttcgggctgtggctggacgaccttggcgcgttctggacggattgggttcgtgacacgcccggtccccatgtggtcgtgggccattcgatgggcgggcatctcgtgcttcgcgccctcgccgagcgccggatcgatccggccgcggtggtgctgagcgcgcccatgctcggattcctgacaccaggcccgaatcgggttcttcaccgggtggccgagttcatgtgccgaatcggcgaccccgaacgaagcgcctggaagagcagcgaaaagcccggggcaaccacggccgcgcgcaatacgctcctcacgcatgacgaggcccgttacggtgacgagacgcactggaagacggtgcggcccgaacttgcaatggggccgggaagctggcgctgggtggagcgggcctacgcctcgatgctggtgctggacagaccggggctgctggaggcggtcgacgtgccggtgcttttgcttgccgcgcgccatgacgggctcgtttcctggcgcgcgatcgagcgtgcggcgcggcgcctgccgcgcgcgcaactgatgacctggggccgcgaggcaaggcacgagttgctccgtgaggccgatccggtaagggacaaggtcatgcacgccatcgacgattttcttgaccgccttgccccgccgaccggg

SEQ ID NO: 34254 - DNA, 1551 bp, Sphingomonas aromaticivorans
accgttggcgacctgctgctccgtgcggcagacttgcacgcggaacgtacggcactggcgctgcccggggtggctgtatcctaccgtgaactgcgcgacggagcttttcgggttgcacgagcactgattgggcttggcattgctcgaggcgagcatgtcgcattgctgatgccaaactcggtcgaatttgcagaagccctgttcgggatcatgttggccggctgcgtcgcagtgccgcttaatgcgcggcatcgcgccgctgaaatcggctatatcattgacaactcccaggcgcgcatactgcttacaagtcgtcatgatagcgatccggtaaacttcatcgaggttatcgaacaggcactgccgacaccgtctgccgcaccggctctgcgctatgtggcgctgttgagaggcgaaggctcgggtgacgtgcttggccgcgaagctttcctctcgcagggcgtgcggacagatccggcggaagtcgagcacacccgccgcagcgtgcgggtgcgcgatgcagcattgatcatctacacctctggcaccactgccaatcccaaaggctgtgtgctaccgcacgaggcggtgacgcgtggccctgtggagcgtgctcgttaccgcttgtctgcgaacggggtcgatgtcacctgggcaggcgggccgctgttccacatcggcagcctggcaccattcatcggctcggttggggtggcaggcacgtttctggcggacagttatttcgagccgggcagggcgatcgcactcatggaaaaacacgcggtgacgcttgcgtggccgtggtttgctgcaatcgtccagggcatcatcgatcaccccgaattcagcgctgaaaagttcgcgcacctgaaatacctattcctgatcgctccgccaactttggtagaacgtgtccaggacctgctgccccacaccgagatcatccaagcctgcggcatgaccgagacttcgggcgtttttgccctgtgtgacactgacgaggaccgcgaatcgcgcattttcacgcagggcaaggcgtgcccgggtatcgagatccggatcgtcgatcccgagaccggccaggacctgcccgacgggacgatgggtgagattctcgtgcgcgggtacaacgtgatggacggatactgggacgcgcccgaaaagacgagcgaggcgctggtcggccatggttggctcaagacgggcgatctctacacccgtcagcccaacggtagcctaatcttcggcgggcgctgcaaggatatgctcaaagttggtggcgagaatgtcgccgcgattgaggtcgaagcgttcctgtgcacacatccggcggtaaagaccgccgaagtcgttggtcggcctgatccacgcctcgacgaagtgcctgtggccttcatcgagctctatgacggtgagacgatcaatgaggaggaactgatcgcgttctgtcgcggtcgtatcgcaagttacaaggtgcctcgcgcgatccgtttcatgtcggccgccgattggccgatgtcggcgaccaagattgacaagcgggcactgcga

SEQ ID NO: 34255 - DNA, 789 bp, Sphingomonas aromaticivorans
cccggcccggaactcctgatcgagcattccggttcgatcagctggatcgtgctcaaccgcccggcccaggccaacgcgctgtcgcgcacgctgatcgagagcttctcggcagcgctgcgcacgctcgaggacgaaggcgcgccggtcatcggcatccgcgccaacggcaagggtttctgctccggcatggaccttggccagtacggcggcgccgccgttctcgatcccaccgccgattccaggcgcctcaacgagaacgtcgcgcgctggctggcgatctgggatcatcccaagccggtcatcgctgcggtccatgggtattgcgccggcgttgcggcgcagatgtgcatctttgctgacctcaccgtggtggcagacaacgttcgcatcagcgaaccgggcgtgcccatcggtggcggcttcatcgcgccgacatgggtggcccaggtcggcgccaagcgggcgaaggaattcgccttcctgcccggcaacagcatcgacgggccgacggcggtggaatggggctgggccaaccactgcgtgcccgccgaccgtctcgtcgagtcagtcgagagcctggctgcgcgcatggccctgatcccgtcggacgtgctgcggatcaaaaagctgtcgatcaaccgcgccgccgaggccgcaggctttcgcaccgccaccggtggcatcgccgagatggactcgctgctgcatgccgcaccgtccgttctcgccatccgcgagcgcatgaccacgctcggcctcaaggccgtcctcgacgaataccgcggtcct

SEQ ID NO: 34256 - DNA, 1893 bp, Sphingomonas aromaticivorans
gttcggggtgttcaggatgtgatggaggccagaccgatgatcaaatccctcctcgtcgccaatcgcggcgaaattgcctgtcgcgtgatccgtacagcgcggcgcatgggcgttcgcacagtggcggtctattccgatgccgatgccaatgccctgcacgtccgctcggccgacgaagcagtccacataggtccggcagcagcgcgcgaaagctatctggtgggagagcgcatcattgccgccgcgctcaccactggcgctgaggccatccaccccggctatgggttcctctcggagaatgccgagttcgctcaggccgttctcgacgcgggcctggtctgggttggcccgaagccgcactcgatcaccgcgatgggcctcaaggacgccgccaaggcccgcatgatcgcggcaggcgtgccggtgacgccgggatatctgggcgaggatcaatcggcggagcgattgcaggccgaggccgacgccatcggctacccggtactgatcaaggccgtcgcgggcggaggcggcaagggcatgcggcgcgtcgatgccgcggcggactttgccgaagcgctcgcctcgtgccgccgtgaggctgcctcctcgttcggcgacgaccgtgtgcttatcgagaagtacatcctttccccgcggcacattgaggttcaggtcttcggcgacgcccacggcaacgtcgtccacctgttcgaacgcgactgctcgcttcagcggcggcaccagaaggtgatcgaggaggcccctgcgcccggcatggacgaagcgacccgcgaggctgtctgcgcggccgccgtccgcgcggccaaggcggtcgactatgaaggcgcgggcaccatcgaattcatcgccgatggctccgaaggcctgcgcgcggaccggatctggttcatggaaatgaacacgcgcctgcaggtggaacatccggtgaccgaggagatcaccggcgtcgacctcgtcgaatggcagctccgcgtcgcgtcgggtgagccgctgcccaagcggcaagacgagctatcgatcaacggctgggcgatggaagcccggctctacgccgaggacccgacccggggcttcctgcccagcatcgggcgcgtcgacgatttccacttcccgcaccatcatgcgcgcattgatacgggggtagaggcgggcgcggaaatctcgcccttctacgatccgatgatcgccaagctcatcgtccaccgcccgacccggactgaagccgtctctgcgctgcgcgagacacttgacgaaggcatcgtcggaccgctcgtcaccaacagcggcttcctctggcgcctgctgggccacgcggcgttcgaggccggggtcgtcgacaccggcctgatcgagcgcaatctcgaaaccctcgccacccggcccgagccttcccgcgagggtctggctctggccgcaatgcgccttgccggcacgccgggcgcgacgccatggtcgagccggtccggcttccgcatgaacgctgccccgcgccgcgacgttcgtctttccgaccagttcggccggacgttcacgaccgaactgccacccgaaccggcgttcgactactggcccggcgaagacgcgacgacgatcgacgaaggtggcgagcgctttcgcgtgcgcctggcgcgggccgacgggggctccggcggcgcagcctcggatggggccatcctcgcccccatgcccggcaaggtcatctcggtcgatgtatccgcaggccagtcggtgaccaagggccagaaactcatggtgctcgaggcaatgaagatggaacatgccctcaccgcccccttcgacggtgtcgtggccgaactcaacgccgcgccgggcggacaggttcaggtcgaggcactgctggcgaagatcgaa

SEQ ID NO: 34257 - DNA, 1125 bp, Sphingomonas aromaticivorans
tttggactgaccgaaagcgccctgatgatccgcgaggccgccggtcgcttcgccgacgagcagattgcccccctcgccgccgagatcgaccgcaacgaccgcttcccaagggaactgtgggagccgatgggcgcgctcggtctgcatggcatcacggtggaggaagaattcggcggccttggcctgggctatctcgatcacgtcatcgcggtcgaggaagtgagccgggcaagcggttcggttgggctgtcctacggcgcgcactcgaacctctgcgtcaaccagatacggcgctggggcaacgacgagcagaaggcgaagtacctgccgaagctgatctcgggcgaacacgtcggcagcctggccatgtcggaagcaggcgccgggtctgacgtggtctcgatgaagctgcgcgccgatgcggtagccggcggcttccgcctcaacggaacgaaattctggatcaccaacggcacttatgccgatacgctggtggtctacgccaagacctcgcccgaagcgggcagccggggcatctccgccttcctgatcgagaaggacatgcccggcttctccatcggccagaagatcgacaagatgggcctgcgcggctcgcccacctgcgaactggtgttcgacgactgcttcgttccggaagaaaacgtaatgggtccgctccacggcggcgtcggcgtgttgatgagcgggctggactatgaacgcgtggtgctggcaggcatgcagatcggcatcatgcaggcatgcctcgacacggtcatcccctacgtgcgcgaacgcaagcagttcggccagccgatcggcacgttccagctgatgcaggccaaggtcgccgacatgtatgtcgcgattcagtcggcccgggcctatgtctatgccgtggccaaggcttgcgatgcaggccagaccacgcggttcgacgccgccggggccatccttctggcgagcgagaacgccttccgcgtttcgggcgaggccgtgcaggcgctcggcggcgcgggctataccaaggactggccggtggaacgctacctgcgcgatgccaaactgctcgacatcggcgccggaaccaatgaaatccgcaggatgctgatcggcagggagctg

SEQ ID NO: 34258 - DNA, 1677 bp, Sphingomonas aromaticivorans
ttctccgtccgctcccctcgcgccgaggcactgacgctctgcctgttcgaggacgaagccgagcagcgtatcgcgatgacccgcgtcggcgataactggatcgttgaaattccaagggatctgcgtggcattcgctacggctaccgcgcgtctggcgaatggaacccgccggatggtctgtggttcgatcctgccaagttgcttgtcgatccctacgcaatcgagttggacggcagctttgtgcaacacacgagcttgtccacctacggcgctgacacgtcgaaaattgttcccaaagcagtggttaccgcaccgccggtgatttctcacctctcgccgctgttccgccacggcgggttgatctacgaagtcaacgtgcgcgggcttaccatgctccatccggatgtcccgcagccgctccggggcaccgtcgccgcgctcgctcacccggcaatcatcggccatctcaagcagttgcacgtctcggcggtggaactcatgccaatcgtcgcctggatcgacgagcggcacctgcccccgctcggcctcaccaacgcctggggatacaaccccgtcgcccccatggctctcgatccccgcgtctgtccgggcggagtcagggaactgcgcgaaaccgtggccacgttgcgagccgaagggatcggcgtaatcctcgatatcgtattgaatcacagcggggaatccgacgttctcggccccgtcctttgcctccgcggtctcgatgacgcggcctataccaaggcgcccgacggtaggctgatcaacgacaccggctgcggcaatacgctcgatttcggaaatcctgccgttcgcgcgctggcgctcgataccctgcgccacttcacaaggcattgcggcgtcgacggtttccgcttcgacctcgctcccatcctcgcccgcagccccggcttcgccgccgacgcgccgatcttccgcgagatcgccgccgacccggtgctggccgaccgggtgatgatcgcggagccttgggacattgggcccgggggataccagctcggaggtttcccttctaactggctggaatggaacgacagattccgagacgacgtacgacgattctggaagggtgagaccggcgtcggcgcgcttgcaacgcggattgccgggtcttccgatatcttcggcaaggcctgccgaacggtcaatttcctggcggcccacgacggctttactctcgccgatacgcttgcctacgagcagcgccacaactgggcgaacggcgaggagaaccgcgatggacacggcgaaaattttagctggaacaacggcatggagggagaaacggacaatctggacgtcctttcccgccgcgccgcccttgtacgcgccatgctcgggacactgttcatttcgaccggtacgatcctgctgaccgccggcgacgaatttggccggagccagcgcggcaacaacaatgcctatgcgcaggacaacgaaatcacctggatcgactgggaccggcgggaccgtgccctggaagcgtggaccttcgggctatccgcctggcgccatttgagaatttcatccttcaccaggtttccggaggatggaacctggcgtgacctgaacggcaccgaactgcacacgagcgcgtgggaaagcgacctgacccagggatttttctggcagaatggc

SEQ ID NO: 34259 - DNA, 1626 bp, Sphingomonas aromaticivorans
atgactcgtaccgttccgtcgacgccctgttccggccagaagccgggcacgtccggcctgcgcaagaaagtgaaggtcttccaacagccgaactacgcggaaaacttcatccagtcggtattcgacgtggtcgagcgcgcgcctggcagcgcgctggtcgttggcggcgacggccgctaccacaaccgcaccgtcatccagcaggccatccgcatcgccgccgccaacggctatggcaaggttctggtcggtcggggcggcatcctttccacccccgccgcatccaacgtcatccgcaagtacggcgcttctggcggcctgatcctgtcggccagccacaaccccggcggtccggacgaggatttcggcatcaagtacaacattgccaacggcggccctgctcccgaggctgtaaccgaggcgatctatgcccgcacccagacaatcgaccgctggctgaccgtcgacgcgccggacgtcgacctcgacaggctcggctcaacccaggtcgaagcgatgacagtggacgtcatagactccgtttccgattacgccgaactcatggaatcccttttcgatttcaatgcaatacgcgccaatgttgagggcgggttcaccatggccttcgacgcgatgagcgcggtcaccggtccctacgccatcgagatcctcgaaaaccgcctcggctttcccaagggcacggtgcgcaacggcattccgctcgaggactttgggggtcatcaccccgatcccaacatggtccacgcccacgagctgttcgatacgatgttcggcccggacgctccggatttcggcgccgcctccgatggcgacggcgatcgcaacctgatcgtcggccggcaccgcttcgtcaccccgtccgacagcctggccatgctcgccgccaatgcgcacctcgcaccgggctatgccggcggtctcaacggcattgcccgctcgatgccgacaagcgctgcggctgatcgtgtggcggaggcactgggcctgccctgcttcgagacgccaaccggctggaaattcttcggaaaccttctcgatgccggcatggccacgatctgcggcgaggaaagcgcgggcaccggaagcgaccatgtacgcgaaaaggacggcctctgggcggtgctgctatggctcaacatcctcgcggttcgcaggatcggcgtcgatcagctcgcacgggagcattgggcgcggttcggccgcaactactacgcccgccacgactacgaggcgctgccgaccgacagggccgatgcactcatggcagaactcaaccaatcgctctcaagtctttcaggcaagccattcggaaatttgactatttcgacagccgacaacttctcctatctcgacccggtcgatggatcgaccagcagcaatcagggtgtccgcatcctgttcgaaggtggctcgcgcgtggtcttccgtctttccggcaccggcaccgaaggcgccaccctgcgcgtctatctcgaacgctacgaaccggtgggcggcgatctcgaccgtgaaacgcctgaaatgcttgccgatctcatccgggcggcagacgccatcgccggcatcgcgcgtcacaccggacgcaccgcgcccgacgtggtgacg

SEQ ID NO: 34260 - DNA, 1443 bp, Sphingomonas aromaticivorans
atcaaggtcctttccgtcgcctcagaggccgtcccgcttgtgaagactggcggcctcgccgacgttgccggcgccctgccctcggcagtggcgccacacggcgtcgggatgacgacgatcctccccggatatccggcggtgatgaaggcgctcgcccgcccgcgcgcccttcacacctggaacagcctgctgggagagaaggcccgcctcgtatccggaaagatcgacggccatcccctgctggtcctcgatgcgcccgcctttttccagcgcgacggaaccccctatgtcgacagctcgggccgggactgggcggacaattggcgccgcttcgccgcgttcggacgcgctgcggccgatgtcgctggcggtgcggtcaagggtcgcgccttcgatctcgtccacgcgcacgactggcaggcagccatggctctggcctacctccgcttcgcgccgccgcccgggggacgccgcgtgccctcggtcatgacgatccacaacatggctttccagggtcactacggcgcggacctcttccccgcgctcggcctcccgccccaggcctgggcgatggacggcgtcgagtatcacggcggggtcggctacctgaaggcgggcctcgaagccgccagcgccatcacgaccgtaagcccaacctacgcccgcgaaatccgcacgcccgaattcggcatgggcctcgaaggtctggtcgtcagccggggcaaccgcgtgtcgggcatcgtcaacggcatcgacacggcccagtggaaccctgaaaccgatccagcactcgccgcccgcttcggcgtcaagtcgctcgcccgccgggtgaccaacaagcgcgcgctcgaggccgaattcgcgctggaggccgatgatggaccgctcttcgtcgtcataacccgcctgacctggcagaagggcatcgacgtcctgctcgaatgcatcgaccacctcgtcggcatcggcggccggctcgccctgctcggctccggcgacaaggcgatggaaaacgctttccacgcagccgccacgcgccatcccggcaaggtcggggtgcggatcggctatgacgaagcgctgtcccaccgcatgcaggcggggggcgatgcgatcctcgtaccctctcgcttcgaaccctgcggcctcacccagctctatggccttgcctatggctgcgtacctgtcgtcgcacgaaccgggggccttgccgatacggtgatagatgccaacctggcagcggtcatggccggcgtcgcaaccggcgtgcaattcgaaggcgtgaactatcccagcgtgtcggacgctatcagccgggccgtaacgctctaccggcaaccggatgtctggcgcgcgatgcagcgagccggcatgaagaccgacttttcgtggagccgctcgggcaaggcctatgcggacctctacgccgccctcatcgcggag

SEQ ID NO: 34261 - DNA, 1254 bp, Sphingomonas aromaticivorans
atgcgcgatacctactctcagccgctggcgcgcgatgcgatggcctatgtcctggccggcggacgcggcagccgcctcaaggaactgaccgataaccgcgccaagcccgcggtctactttggcggcaagtcgcgcatcatcgacttcgccctttccaacgcgatcaattcgggcatccgccgcattggcgtcgccacgcagtacaaggcgcactcgctgatccgccacatgcagcgcgcgtggaacttcatgcggcccgaacgcaacgagagcttcgacatcctccctgcctcgcagcgcgtgtccgaacaccaatggtacgaaggcactgccgacgccgtctaccagaacctcgatatcatcgcgtcctacgcgcccaagtacatggtcattctcgcgggcgaccacatctacaagatggactacgagctgatgctccgccagcacgtcgaaagcggcgcggatgtgaccatcggctgcctcgtcgtgccgcgcatcgaagcgaccggtttcggcgtcatggcggtcgacacgtccgacacgatcaccgctttcgtcgaaaagcccgccaatccgcccggcattcccggcaatgaggacatggcgctggcatcgatgggcatctacgtcttcgacacgaagttcctgttcgacatcctgcgcgaggatgccgccgatccctcgtcgtcgcgcgacttcggcaacgacatcatccccaagatcgtccggaacggaaaggccgtcgcccaccgcttcaccgcgtcgtgcatccgcgcggcggaagaaatcgaggaatactggcgcgatgtcggcacgctcgacgcctatttcgaggccaacctcgacctgaccgacgttgtgcccaagctcaacatgtacgaccgcgactggccgatctggaccgaccagatcatcgccgcccccgccaagttcgtgcacgacgaggatggccgtcgcggcatggcgatatcctcgctgatctcgcaggattgcatcgtgtcgggcgccatcgccaggcgcagcctgctcttcaccggcgtcaagatgggctcgttctcctcgtgcgaggaagcggtgatcctgccatattgcaacatcggcaggggtgcacgcctcagccgcgtgatcctcgactccggcgtccgcattcccgaagggctcgtagtgggcgaggaccccgagcttgacgcccgccgctttcagcggaccgaaagcggggtgtgcctcatcaccaagcggatgatcgaccagttg

SEQ ID NO: 34262 - DNA, 2391 bp, Sphingomonas aromaticivorans
aagaattccagggccgcagagatcgatgcgcagatcatcgacgtcctgcgccaccgcgtcggcaaggacgagcgcgcggcaaagccgcacgactggtacaccgcaacggtcctcaccctgcgcgatgcgatcatcgaccgctggatggaatccacccgcaagacttatgcggaaagcggaaagcgggtctattacctcagcctcgagttcctgatcggccggctgctgcgcgatgccctgtccaacatgggcctgacgcgcgacatggaactggccctgcgcgaacacggcttcgacctttccgcgctggaagacctcgagcctgatgccgcgctcggcaatggcgggctcggccgcctcgccgcctgcttcatggaaagcctcgccagcctcgacatccccgcttacggctacggcatccgctatgtgaacggcatgttccgccagcggatcgacgatgggtggcaggtcgaactgcccgaaacctggctgtcgcacggcaacccatgggaattcgatcgccgcgaaagcgcctacatcatcggcttcggcggcgaagtggtggagaaggccgacggcgtcgaatggcgcccggccgaaaaggtcgaggcgagcgcggtcgacaccccggtcgtcggctggcgcggcaagcgcgtcaacaccttgcgcctgtggacagcacacgccttcgatccgctgcgcctcgacgccttcaacgcgggcgaccacttcggcgcgcttgccgaacaggtccgcgccgatagcctcgtgcgcgtgctctatccggcggactctacccccgccgggcaggaactgcgcctcaggcaggagtatttcttcacctccgcgtcgatccaggacatcgtgcgccgccacgtccagtacaatggcgacatccgcaccctgccagaaaaggccgcgatccagctcaacgatacgcacccggccgttgccgttgccgaactgatgcgcctgatggtcgatgtccacggcctggaattcaacgaggcgtgggaagtgaccaaggcgacggtcggctacaccaaccacacgctcctgcccgaagcgctcgaatcctggcccctgcccctgttcgaacgcctgctcccgcgccacatgcagatcgtctacgccatcaacagccgtgtcctgcgcgaagcgcgcaaggcgggcctcgatgacgccgcgatctcggcgatcagcctgatcgacgaaggcggcgaacgccgcgtgcgcatggccaatctcgctttctcgggcgcgcacagcgtcaatggcgtggcagcgctccataccgagctgatgaagaccaccgtcttttcagacctgcacaagctctacccggcgcgcatcaacaacaagaccaacggcgttaccccgcgccggtggttgcagcagtgcaatcccggcctgacctcggtcctgaaggacgcgatcggcgactgttttcttgacgacgccgaaaagctctccgatctcaacgcgctggccgacgatcccgcgctgggagagcggattgcagaggtcaagcgcaccaacaagatcgcactggcaaagcacgtcaaggaactgatgggcatccgcctcgatcccgacgcgctgttcgacgtccagatcaagcgcatccacgaatacaagcgccagctgctcaacctgatagagaccgtcgcgctctacgaccagatccgcagccaccctgaacgcgactgggtgccgcgcgtaaagatcttcggcggcaaggccgcatcgagctatcacaacgccaagctcatcatcaaactggccaacgacatcgcccgccgcgtcaactccgacccttcggtcggcggcctgctcaaggtcgtgttcgtgccgaactacaacgtcagcctggccgagaagatcataccggcggccgacctttccgaacagatttccaccgccggcatggaagcttccggcaccggcaacatgaagttcgccctcaacggtgcgctcaccatcggcacgctcgacggcgccaacatcgagatcaaggaccgcgtgggcgacgccaacatcgagattttcggcctcaccgcgcaggaggtcgaggacaagcgcgccaacggctacaacccgcgcgaagtgatcgaaagctcgcgcgaattgcagcaggccatcgcggcaatcgccaccggcgtcttttcgcccgacgacccgcagcgctatgcaggcctgatgggcggcatctacgaccacgactggttcatggtcgccgctgatttcgatgcctaccacgcggcgcaacgcaacatcgatcgccgctgggaacagcagccgtcgtggcgcgcttcggcaatccgcaacattgccaacgtaggctggttctcgtccgatcgcacgatcggcgaatatgcccgcgacatctgg

SEQ ID NO: 34263 - DNA, 1446 bp, Sphingomonas aromaticivorans
gtgttcgcccggctgcacaagctcagcttgcgcttccaccttgcccgccgcaccggcgaggtgaccaaggtgatcgagcgcggcaccaagagcatcgacacgatgctctacttcctgctgttcaacatcgcgccgacggtgatcgagttgaccgccgtgatcgtgatcttctggctcaacttcggcctcggcctcgtcacggccacgatcctcgcggtcatcgcctatgtctggacgacgcgcaccatcaccgaatggcgcacgcacctgcgcgaaaagatgaaccgcctcgacggacaggcgctggcccgcgcggtggactcgctgctgaactacgagacggtgaagtatttcggtgcggaatcgcgtgaggaggcacgctatgcctccgctgcccgcgcctatgccgatgccgcggtgaagagcgagaacagcctcggcttgctcaacatcgcgcaggcgctgatcgtgaacctgctgatggcgggcgcaatggcctggacggtctatggctggtcgcaaggcaagctgacggtgggcgacctcgtcttcgtcaatacatacctcacccagctcttccgcccgctcgacatgctcggaatggtctatcgcacgatccggcaggggctgatcgacatggccgaaatgttccgcctgatcgacacccacatcgaagtggccgacgttccgaatgcccctgcgctggtggtcaatcgtccttcggtcaccttcgacaatgtcgtgttcggctacgaccgtgaccgcgagattctccacggcctctcgtttgaggtggccgccggaagccgcgtcgccatcgtcgggccttcgggcgcgggcaagtcgacaatcgcccggctgttgttccgcttctacgatccgtgggaagggcgcattctgatcgacggccaggacatcgcccatgtcactcagaccagcttgcgcgctgccctcggcatcgtcccgcaggattcggtgctgttcaacgacaccatcggctacaacatcgcctatggccgcgatggcgccagcagggccgaagtcgacgcagccgcaaagggcgccgccatcgcagacttcatcgcccgcctgccgcagggctatgacaccgaagtcggagagcgcggcctcaagctttcaggcggcgagaagcagcgcgttgccatcgcccgcacgctggtcaagaatcctccgatcctgcttttcgacgaagccaccagcgcgctcgacacccggaccgagcaggacatcctctccaccatgcgcgccgtcgccagccaccggacgacgatctcgatcgcccaccggctctcgacgatcgcggattccgacacgatccttgtgctggatcagggacggcttgccgaacaaggcagccacctcgacctgctgcgccgcgacgggctctatgcggagatgtgggcgcgtcaggcggcggaaagcgcc

SEQ ID NO: 34264 - DNA, 1497 bp, Sphingomonas aromaticivorans
gccgaagcggaaacgtactggacggcgctggccgggctgccgcgcccgacgctcaaggagctgttctccgatgccggccgtctcgatcgctacgccgctacgctcgacctgccgggcggcccgatccgcttcgactggtccaagacgcacctctccgccgaagtggaagcggtgttcgccgcgcttgcatcggcgatggacttcgaaggccgccgcgccgcgctgatcgagggcgcgaaaatcaacaacaccgaaggccgcgcggccgagcacaccgctcagcgcggcatcggcaacgaggccagcgtcgaggaagccgaggcgctccacgcccgcatgcgcatgctggtcgacgcgatccacgccggtgcgcttggcgaagtgcgcagcctgatccacattggcatcggcggttcggcgctcgggccggcgctggcgatcgacgcactgacccgcgacggcgcgaaggtggccgtccacgtcgtgtcgaacatcgacggctgcgcgctcgaagccgctatgaaggcctgcgatccggcaacgacgatgatcgccgttgcctccaagaccttcaccacgaccgagacgatgaccaacgctgcctcggcgcttgaatggctgcgcgagaacggcgttgccgatccctatggccaggtcgttgcgctcaccgccgcgcccgagaaggcggtcgagtggggcgtcgacgaaacccgcgtcctgccgttctccgaaaccgtgggcgggcgttactcgctgtggtcgtcgatcggtttcccggtcgcgatggcgctggggtgggaaggcttcgccgcgttcctcgacggtgcggcggctatcgatcgccatttcatcgacgcagacctggccggcaacgtcgtcgttcgcgccgcctttgccgatctctattacactcaggttcgcgggtgccagacgcgtgcggtcttcgcctatgacgaacgcctcgcgcttctgccggactatctccagcagctcgaaatggaatcaaacggcaagcgcgtcctcgccgatggctctccacttacacggccaagcgcgccggttacctggggcggcgtcgggaccgatgcacagcatgccgtgttccagctcctgcaccagggtacgcacttgattccggtcgatttccttgccgtcaagacgcagggccacgacctcgacccggcgcatcaccagatcctgctttccaactgcttcgcccagggtgctgcgctcatggccggcaaggcgagcgatgacggcgcgcgtgcctatcccggcgaccgtccttccgcgacgatcctgtgcgacgatctcaaccccgcgacgctcggcgcgctgatcgccttccacgagcatcgcacgttcgtctctgcggtgatgctcggcatcaatcccttcgaccagttcggcgtcgaactgggcaaggccattgccaagcagatcgagtctggcggcggcgaaggcttcgatccgtcgaccgaagcactcctggcagcg

SEQ ID NO: 34265 - DNA, 642 bp, Sphingomonas aromaticivorans
gtggagctatcgggaaagaccgtgctggtgaccggcgcgacggacgggatcggcgcgcagatcgcacgccagttacgtaacaagggcgcgacggtcattgggcagggccgcaccccggcgcgggtggcggcggcgagggccgatggctttgaaatcgtcgaggcggacctatccctgccgcaaggcgtggaaacgctgatctcggccatggcaggtcgccagatcgatgtgctggtcaataatgccggggctggagtggatcacgatttccgcgacggtcagcccgatgcggcggcggcggatcgcacgatcttcctcaatctcaatgcccccattcaccttatcaccgcgctcatgcctgggctgaaggcacggcccgaggcaatgatcgtcaacgtgacgtccggcctcgccatcgcgccgcgtgcgggtggcccggtctattgcgccaccaaggccgcgctgcgcagctacacgcaggctctgcgcgcacagttggcgggaaccggagtgcatgtcgtcgaagccctgccgcccgtcgtcgacacccaactcaccgcggggcgcggcaatcgcaagatgcctgccgccgaatgcgcacgccagatcgtcgacgggatggagcgcaacgtaaccgaaatc

SEQ ID NO: 34266 - DNA, 1494 bp, Sphingomonas aromaticivorans
atttgcaggaacccgcgcatgaagcgtgcatgtgtcatcggcgccggatttggcggcctcgccctcgccatccgcctgcaatcggggggcgtccagacgaccctgatcgaggctcgcgacaagccgggcgggcgcgcctatttctgggagaaggacggcttcaccttcgacggcggcccgaccgtcatcaccgatccggcgtgcctggaagagctgtgggcgctcaagggccatcgcatggccgacgacgtggaactcatgccggtcatgccgttctaccgcctcaactgggcggacggcaccaacttcgactattccaacgacgacgcgagcctgcgcgctgagatcgccaagctggagccggcggacgttgccggatacgacgatttcctgcgctattccgccggcgtgttcgaggaaggctacgtcaagctcggcgccgtgccgttcctcgacttcgcgagcatgatcaaggccgcgcccgcgctggcccgctaccaggcctggcgctcggtctattcgatggtctccagcttcgtccgcaacgagaagctgcgcgaggccttcagtttccacactctgctggtcggcggaaacccgatgacgaccagcgcgatctatgcgctgatccacaagctggagaaagacggcggcgtgtggtgggccaagggcggcaccaaccgcctgatcgagggcatggtgacccatttccggcggatcggcggggaagtgcggatcggcgatccggtaacgcgcgtcgagacgctgggaacccgggtgaccggggtcgagacccgcagcggctggtcgggcaagttcgacgccgtagcgtcgaatgccgacgtcatgcattcgtaccgcgaccttctgtctgacaactcacatgcaaaacgccgcgcaaagtctctcggcaaaaagagattttcaccaagcctcttcgtcgtccacttcggcatcgaaggaacctggcccggtatcccgcatcacatgatcctgttcggcccgcgctacaaggggctgctcgacgacatctacacccatggcgtgctgccgcaggacttctcgatctacctgcaccatcccaccgtgacggacccctcggtcgcgcccgaaggtatgagcacgttctacgcgctggtgccggtggcgaacatgggcaagttgccggtcaactgggacgaggtcggtcccatcctcgagaagcgcatactggatgaagtgggccgcaggctcatccccgatatccacacgcgtatcgtaacgaagttccattacgctccgagcgacttctcgaccgatctttccgcgcacctcggaagtgcattcagccttgaaccgctgctcacgcaaagtgcatggttccgggcacataatcgcgacgacgcgatttccaatttctaccttgtcggcgcggggacgcaccccggtgccggcattccgggcgtggtcggctctgccaaggccacggcaaggctgatgctggaggatctttcg

SEQ ID NO: 34267 - DNA, 1314 bp, Sphingomonas aromaticivorans
cgcctggacgtcgtgaacccggcgaacgagcaggtgattgcgtgtgttcccgatgctggcgctgccgaactggacgcagcggtcgctgccgcgcgcaaggcgttcccaggctgggcggcgacccctatcgcagagcgcaaggccatgctcgacgcacttgccgattcgatcttcgccaatgtcgacggcttcaagcgcctgctgaccgcagagcagggcaagccgcaccatgaggcgcagggcgagatcatgggggcgggctactggctcaaggcctataccgcgctcgacctgcccgagacggtgaacgaggattcggacgaacgcctgtcgatcacccggcacgtgccgctgggggtggtcggcgcaatcgccccgtggaacttcccgatgatcctcgcgatgttcaaggtcgcgccggggcttctggcgggcaacaccatggtgctgaagccttcgcccttcaccccgctttgcaccctgaagttcgctgagctggcgaaggaaatcctgccggcgggcgtgctcaacgtgatcaccggcggcgatcatctcggcccgctgatgaccgcacatccaggcttcgacaagatcagcttcaccgggtcgacccagacagggcgccgcgtgatggcatcggccgcgccgacgctgaagcgcgtgacgctggagcttggcggcaacgacgcggccatcgtgatgcctgacgtggatgtcgagaagattgccgaacagctcttctgggcggccttcaccaacaacggccagatctgcatcgccaccaagcgcatgtacatccacaaggacatctatgagccgctgcgggatgcgctcgtcgcctatgcccgtacggtgaaggtcggcgatggctcggagcagggcacccagatcgggccgatcaacaacgaggcgcagtacaaccgtgtgctggacctgatccaggacgcgaaggacaatggctacaagttcctgctcggcggcgagaaggccgaggtgccgggatacttcgttccgatcaccattctcgacaatccgcccgaggacagccgtatcgtgcaggaagagcagttcggtccggtcctgccgctgatccggttcgacgatttcgaggacgtgctgaaccgagtgaatgccagcgactatggccttggcggatcggtctggggcagcgacgaggacaaggccttcgaacttgcccagcgcgtacaatcgggcactgtctgggtcaacgagacgcagcacctttcgccgcttgcggcctttggcggcatgaagcagtcgggcgtaggcgtggaaggcgggctggaaggcctg

SEQ ID NO: 34268 - DNA, 726 bp, Sphingomonas aromaticivorans
atgatggacgatactgatttcaccggccgccgcgtgctggtcgtgggcggctcgagcggcatcggcaacggcatcgcgcaggcattccgcgaccggggcgccgaagtccacgtctggggcacgcgcgccaatgccgccggctatgacccggccgaaggctcagaccttgctggcctgggctatacctgcgtcgatgtcggcagccccgatgccatcgaagctgctccagcccccttccccgcgctcgacgtgctggtcctgtgccagggcaccgtcgtctacaagcgcggggaattcgagcgcgaaggatgggacaaggtcatggccgtcaacctcgacagcctgatgcactgttctcgcaagttccgcccgcaactcgctgaaaccggcggctcaatcatcatcgtcagctcgatctcggggctcaaggcgaacatcggaaaccccgcgtatgccgcctccaaggccggggcgatcagcctgaccaagtcgctcggccaagcctttgccgccgacggcatccgcgtgaacggcctcgcccccggccttgtggataccaagctgaccaaggtgacgaccgcccatccccagcgcctcgaaggagcgatcgccaacatcccgcagcggcgcatgggcacgcccgcggacatggccggcgccgcgatcttccttgcctccccgctcgcctcctacgtcaccggccatacactcgtggtcgatggcggc

SEQ ID NO: 34269 - DNA, 1182 bp, Sphingomonas aromaticivorans
ttcgaacactccgacaaggtcaagaacctcctcgcccgcctcgaagccttcatggacgagcacatctacccggtcgaacaggcctactatgatttcgtccatgatcagcagaacctctgggccgaatggccggggatggaaccgctcaaggaaaaggcgcgcgcagcaggcctgtggaacctgttcctgccgcacgagtacggcgcatggtcacccggcctcaccaacctcgaatatgccccgctggccgaagtcatgggccgggtgccgtggtccagccaggtgttcaactgctccgcgcccgataccggcaacatggaagtgctggccaagttcggcagccccgaacagcaggaactctggctgaagccgctcctcgccggggaaatccgctccgcctacgtgatgaccgaaccgcaggtcgcctcctcggatgcaaccaatctcgaactctcgatcatccctgatggcgacgaatacgtgataaacggtcgcaagtggtggatctcgaacgcgatgcacccgcgctgcgagatcatgatcgtcatgggcaagaccttcttcgaagggccgcgccacagccagcactcgcagatcctcgttccccgcgatacgccgggcgtcaccgtggtgcgccacctcaaggtcttcggctccagcaattctcccggcggtgaagtggaactgcgcttcgacaacgtccgcgtgccgaagcagaacatgatccttggagaaggtcgcggcttcgagatcgcgcaggggcgcctcgggccgggccgtatccaccactgcatgcgctcgatcggccaggcccagcgcgcactcgaatggatggcccgccgcgccgattcccgcgtcgcattcggcaagaagctcgccgatcagtcgagcgtccggcaggacgtcgcccgctcgttctgcgaggtggagatggcgcgcctgctgaccctcaaggccgccgacgccatggatcgtctcggcaacaaggccgcgcgcgacctcatcgccgcgatcaaggtcgtcgccccgtcgatggcccagcaggtggccgaccgcgcgatccaggtccacggcggcatgggcgtcagcgaggatggcccgatggcctacttcttcacgctcaaccgctacgtccgcctcaccgatgggccggaggaagtgcacatgagccagctcggcaag

SEQ ID NO: 34270 - DNA, 1068 bp, Sphingomonas aromaticivorans
atgaaggccctgcgctactacggtgcccgcgacatccgccatgaatcgatggatgatccgacgccgcaatcggaccgcgacgcaatcgtgaaggtcgatgcctgctcgatctgcggctccgaccttcacatctaccacggccacggcttttccgaggatatcggcttctgcgtgggccatgaagcggtgggcgaagtggtcgaggtcgggcgcggcgtccaccggctcaaggtcgggcaaaaggtgatgatccccgccgcggtcggctgcggggcctgccgctcgtgcctcgcaggggtggtcaacacctgcgaaaacaatggctcgggctgctacggcctgtccgcgaagctacagggatcgcaggcagaggcggtgcgcgttcccgctgcggatgccaatgcggtcgccattcccgaaggcgtcagcaccgaacaggcgctgatgatgaccgacgcgctcgccacggcatggttcggtgcacgccaggccgatatccgccccggcagttcggtcggcatcatcggcctcgggccgatcggcctcatggcggcggagagcgcattcgtgatgggcgcacatgttgtctatgcgatcgatcccgtgccggaacgccgcgccatcgcggaaagcctcggggccattgccttgcatccggacgaggcttccgcgcggatcaaggaggacacgcacggcaggcgcctcgattgcgtggtggaagtcgtcggatcggatgccaccgtcgacatggccctgcggctcgtgcgcgtgcgcggcacggtctcggtgatcggcgtccagcaatcgcgccgctttcccttcccgctcgagcgggccttcgccggcggactcaccttccgcgtgggcacctgctcggtcccggaggaactgccagctctgttcccgcttgtcgcttcgggccgcctgcgccccgaacgctacatcagccaccgcctgcccctgtcgcagggcgccgaagcctaccgcatgttcgaggcgcgcgaggcaggcgcgctcaagatggtgcttgtgccggactgactgcgcgccgcgcagcaaaccacggac

SEQ ID NO: 34271 - DNA, 747 bp, Sphingomonas aromaticivorans
atgatgcgcttcgatggaaaggcagtcctcgtgacgggggcggcgaccggcatcggcagggccaccgccctcgccttcgctcgcgaaggggcctcggtcatgatcggcgacatagacgagcgggcagacgaaaccgtcgcgttgatcctctcggagggcgggcgcgctgccttccgcaagaccgacgtgcggcgcgcggccgacctggatgaactggtggcgcagtgcctcgaccggttcgggcggatggacgcggcgttcaacaatgccggggtcctcccgccccagcgcccgatccacgaagtgcccgaggacgaactggacctcgcgatcgacgtggacttcaagggcgtcttcttcgcgatgcaagcggaaatccgccatttcctcaaagtcggcggcggtgccatcgtcaataccgccagcgtcggcgcgctgatcgcggacccgaacatgagcgcctactgcgcgatgaagcacgcggtatcgggcctaaccaaggccgccgccgtcgagtacgcgcaagccggcatccgcgtgaacgccatcgccccgggcttcgtcgtcaccccgatgacccagcactgggccgacagcaacgagttcacccagatgttcttcgcccagaacatctcgggccgcgcggcccgcccggaagagatcgcgcccaccgttctgcacctgtgctccgatggcgcgagcttcatcaacggggcgacattcaccatcgatggcggccagaccgct

SEQ ID NO: 34272 - DNA, 2541 bp, Sphingomonas aromaticivorans
atgaaggacatccgcaccacatgcgcctactgcggtgtcggctgcggtatccgggcgacggtgacgggcgaccgggccgtttcgatcaagggcgacccggagcaccccgcgaacttcgggcgcctgtgctcgaaggggacgcacctgggcgaaacggtgggacttgaggggcggctgcttcacccgatggtggatgcagagcgcgcaacctggaacgaggcgctcgatcttgcggcggcgcggatgcgcgaatgcatcgagcgccacggccccgacagcgttgccttctacgtttcgggacaactgctcaccgaggactactacgtcgccaacaagctgatgaagggcttcatcggcagcggcaacatcgacaccaacagccggctgtgcatggccagcgcggtggcggctcataaccgcgccttcggcgaggacctggtgccatgcacctacgacgacctggaggcggccgacctcgtcctgctggtcggctcgaacacggcgtggtgccacccggtgatctggcagaggatcgaagcggctcgctcggcacgcgggacaaggctggtcgtgatcgacccgcgccgtacggagaccgccgagcaggccgacctgcacgtcgcgctcgcgcccgacggcgacatcgcgctgttcaacgcccttctggccgagatgcgcgaccgcgatcttctggacgaggccttcatggccgagcggtgcgccgtgcccgagggatacgtcgccgggctcgatccgcgcggtcacgggatagatcccgcgacgttccgcgcgcttgcagacctcgtcgcggccagcccgcgcatggtgacactgttcagccagggggcgaatcagtcgcgctgcgggaccgacaagggcaacgcgatcatcaacctccaccttgcgcttggccggatcagccagaccggtgcggggccgttctcgatcaccggccagcccaatgcgatgggcggacgcgaagttggcgggctggcgaacatgcttgcgtgtcacctgggcttttcgtccgaggagcgcgcggatgcggcgatcttctggaacgcgcccaatatctgcgcagggccggggctgaaggcggtggacctgtttcgcgcggttcacgatggccgcgtgaagttcgtttgggtcatggcgacgaacccggcggtgtcgatgcccgacgcgggcttcgtgcgcgaagcgctggcgcggtgtgaaacgctggtcgtctccgacgtgatcgcggatacggacacggcgcgcctcgcgcatatccgcctgcccgcgctggcgtggggcgaaaaggacggcaccgtcaccaattccgagcggcgaatcagccgccagcgcgcgctgttcgaggcacccggccaagcgcgggccgactgggcgatcctgtgcgatttcgccgagcggatgggttggggccgggccttcgcctttccgaccgctgccgcgatattccgcgaatacgcggcgatgaccgcccttgccggcgcgcggggcaaggcgctcgacctgtcgcatctggcggggcttggcgacgctgcctacgaagcactggagccgacgctgtggggcggggtgcatccgacggcccggacgttcagccaccctgacggcaaggcccggctggtggcggtcgaagcgccggtcgcggctcctgctgatcctgagttcccgttccgcctcaacaccgggcgttatcgtgaccagtggcacacgatgacgcgcaccgggctttccccgacgctgtcgcagcaccggcgcgaacccctgctcgaaatccatccggaagacgcggcgcttgcagggatcgaggatggcgggctggcgaggctggcgacgcgcgtgggcgcgacggttttccgagtcctgcattcgacagcccagcggcgcggcgatctgttcgtgccgatgcactggaccgatgcgatggctggcgaaggccgcgccaaccgcctgccgcttcaggaaaccgatccgctttcaggccagcccgggttcaaggacacgcccgcgcgcgtggaaccggtcgtgccggaatggcgcgcgttcctggcgacacgtgatgaggccgcgcttccatcgcttttgtggtggagccgcgccaaggtcgccaatggatggctctgcgaactggcaggcaacggcgcgccggatctggaagtgatacttccgaagggtacgtggcttgaagcggcggacatggtgcgcggcatgcgccggatcatcgtgctggataaggcgggcgggcttctggccgcgctttatctgacgcgcaacggcgaacttccgccccgggactgggtagcggcgcagatcggcaacgccgaggcatcggcgctcgaacttctggctgggcgtccggcagttgccttgcccgatcgcgggcccatcgtgtgcgtctgccacggcgtcggcgtgaacgagattgccgctgccgcctgcgctggcgcgatgacgctcgaagcgatcgcgggatgcacccgcgccggatcgaattgcggaagctgccgcccggccatcgcccggatgctc

SEQ ID NO: 34273 - DNA, 1557 bp, Sphingomonas aromaticivorans
cctcaccagcaggccttcgcgcaacgcggggcctggaacctgcggacgctggcagacctcgcgcgcgaacgggcggcgtcagatcccgatttcgtctgcttcgtcgatggcgaaggccaatataccttcgcgcaggtcctggcagaagcggaagcgctttccgcgtcgttgcacgcgcgtgggtttcgcgccggcgatgtcatcgcattccaggtgccgaactggcgcgaggccgccgtcatcaacctgtcggcggcgatgtctggcttcgtggtcaatccgatcgtgccgatctatcgcgatgccgaagtcacgatgatgcttggcgattgccgggccgccgcgatcttcgtgccgcaggtgttccgcaaggtcgactacgccgaaatggcgcgtcgctgccagaaggcgctgcccgatcttgcgcacgtcttcaccgtgcggggcgaggggccggacgatttcgccactctcgtcgcacaggggcgcgctctttccttcgaagtgccaacggtcgatccgatgggcgtcaagatggtgctctatacctcgggcacgaccggtcggcccaagggcgtcctgcacagccattgcacgttgcagcgcatcgtcgcggaaagcgggcggcactggggcctcggggcaggggaggcgacgctgatgccttcgccggtcacgcacgtctcgggatatgccaatggcctcgaagcgccgttcatctgcggcatccgctcggttctcatggaagcgtggaacgcccaggatgcgctggccctgatcgagaagcacgaccttgtcggcacggttgctgcaacgcccttcctggtcgaacttgcggcagcggcgcgagcggcgggcaccggcctgccaagcttccgcttcttcgcctgcggcggtgcggcggtgccggcggaccttatcccggccgccaacgccgccttcgagaactgccgggcctttcgcgtcttcggcgcgtccgaagttccgctcgttaccttcggctggccgcacgacgagcgccttgccgcgaccaccgatggcgaggtggtggactacgaagtccgcatcgtcgaccacgaggacaatgatcttccgcgcggtgtcgaaggcgaaatccttgcgcgcggtcccggcatgatgatgggctatgccgacgccgcgcagaccgcagaggcgatcacgcccgacggcttcttccgcaccggcgacctgggcgtgctgtccgaagagggtgcggtaacgatcaccgggcgcaagaaggacctcatcatccgcggcggagagaacatctcggccaaggaaatcgaggacgtgctgcacagccatgacgcggtgaaggaagcctcggtcgtcgccatgccgcacgaacgccttggcgagggcatctgcgcctatgtgatcctgtccgccgcagtcgacgcggcggtgcttgccgcgcatgttgccgcttcgggcatggcgaagcagaagatccccgaacgcttcgaattcgtagaggactttccccgcaccgctagcggcaaggtccgcaaggaccagctgcgggcgatgatccgg

SEQ ID NO: 34274 - DNA, 759 bp, Sphingomonas aromaticivorans
aggatcatggccggtaattctggacgacttgaaggcaagaaggcaatcgtgctgggcgccagcagcgaaggcaacatgggtcaggtcatcgcacagcgcctgatcgacgaaggcgcggaagtgctcgtggcagggcgcaaggatgccgtgctcaaggcctttgccgacaagaccggttgccactggacctcgtgcgacatcaccgacgaggcaagcgtcaatgccctggccgacacggcagtggccacgatgggcggcatcgacatcgcgatcaactcgaccggctggggcctgctcaagcccttcctcgacgtgacgcgcgaggatctggacgccatgaccgcgctgcaactcgtcggcccgcaccagttcttccaggcaatggtgcgcaagatggcgcgatcgctgggcgggcgcggcggatcgatcatcacgatcagttcggccacggccacgatcatgctcaacgaccacgcgatctacatgggaaccaaggccggtaccgaccacatcgtgcgctgcatcgcgcacgagttcggtcacgagggcatccgcgccaactcgatctcgccgggtctcaccgatacaccgatgaacgaggacgcgaagcaggttccggggctgttcgaaagcttccgcaattcctatcccctcggccgctggggcacgtcggaagacgtcgccgccgccgccgtgttcctggcaagcgacgagtgcttcatgaccggagagaacctgcaggtgaacggcggcctgacc

SEQ ID NO: 34275 - DNA, 744 bp, Sphingomonas aromaticivorans
ctcggactcaagggcaagaaggtcatcctgaccggcgggagccgcggcatcggccgggcgacggcggaactgctcgccgccgaaggcgcggacatcgcgttctgctcgcgcaatccggaacaggtcgccgaaaccgtcgccagcctcgaaaagcatggcggcaagatctacggttcggccttcgacatggattccggacatgacgcctaccgcgcctggctgaccgacgcggcagaaaagctcggcggttgcgacatcttcatcccgatgatctcgacctcgggctcgggccagaccggcgactggcagaagggcctcgatcacgacatcatgggttccgtcatcggcgtcgaagtgctggagcagtacctcgaaaagtcgtcctcgccttcggtcgtcatcctctcgtcgacggcgggcctcgagaccttcatcgtgccgcagggctacaatgcgctgaagggtgcgctgatcgtctatgccggccagctcagccaggcgctcggtcccaagggcattcgcgtgaacaccgtctcgcccggtccgatcaagttcaccggcggtagctgggacgtgatcgaaggcgcggcgcccgatctctacaagtcggtggaggccggctttgccctcggccgattcggcgcgcccgatgaggtggccaaggcggtcgtgttcctcgccagcccggcttcgtcctacaccaccggcaccaacctggtggtcgacggcggcttcaccaagcgc

SEQ ID NO: 34276 - DNA, 1431 bp, Sphingomonas aromaticivorans
ctcctgatcgggaatgcggatgtcgccgcaagcggcggcgctacgttcgaacgcaccggcccgctgggcggggaaccgacggtcgcggctgccgccagtgcggccgacgccatcgccgccgccgatgccgcggctgccgcgcttcccgcttgggcggcgcttggccccaacgaacgccgccgcctgctgctggctggtgccgatgcgttggaagcgcagacgggggccttcgtcgaggccatggccgccgagaccggcgcatcaaacggctgggccggtttcaacgtccacctcgcggcaggtctcctgcgcgaggcggccgcgctgaccacgcaggtcaagggcgagacgatcctgtcggaccgcccaggctgctatgccatgaccctgcgccggcccgccggcgtcgtgcttggcatcgcaccgtggaatgcgccggtcatccttggcgtgcgggccatcgccacgccgcttgcctgcgggaacaccgtggtgctcaaggcatcggagcattgcccagcaacgcaccgcctgatcggcaccgcgctgcgttcggccggcttccccgccggcgtggtcaacgtcgtgaccaacgcgcctgccgatgcgggcgaagtcgtggccgcgctggtgaaccaccgggcggtccgccgcatcaactttaccggctcgacaagggtcgggcggatcatcgcgggtcttgccgcacagcagctcaaaccgtgcctccttgagcttggcggcaaggccccgatgatcgtgctggacgatgccgacctcgacgcggcagtcgccgcggcaggctttggcgcctacatgaacagcgggcagatctgcatgtcgaccgaaaggatcatcctcgaggacggcatcgccgacgccttcgtcgaacgcttcagagccagggtcgacgggctgacggcgggcgatccgcgcgccggcagcgctccgctgggctcggtggtcgacgaggccaccggcaggcgcgttcgccacctgatcgaggatgcggtcggcaaaggcgcgcgcgcccacggcgactggcagacgggcggaacgctgatccccgcgatagtggtcgacggggtgacgccggacatgctgctctattccgaggaatcgttcggaccggtcacgaccatcctgcgcgcagccaacgaggacgtggccgtgcgcattgccaacgacaccgaatatggcctgacgtcatcggttttcagccagaatatcgcccgggcgctgcgcgtggcggaacggatcgaggccggtatgtgccacatcaacggcgctaccgttcacgacgaggcgcagatgccgttcggcggcaccaaggcatcgggctacggccgcttcggcggcgaggcaggcatcgcggagttcaccgaactcaagtgggtgaccatcgatacgcagacgccgcactggccgatc

SEQ ID NO: 34277 - DNA, 1524 bp, Sphingomonas aromaticivorans
gccgtgctgcccgccggcgtcagcgcaaccgacatggcatccgccattgcagaattcgtcgcgatcctcgggccgcagaacgtgctgaccgatgccgatcacatcgccccctataccaaggtgatgatcgcggagagcgaggacctgcaccgcccctcggccgtgctctatgctcgcgaggtcggcgagatccagaagatcctgaaggtctgcaacgactacaaggtgccgatctggacgatctcgaccgggcgcaatttcggctacggatctgccgcgccgcaaagcgccggacaggtcgtcctcgatctcaagcacatgaaccgcattctcgaggtcgacccggtgctgtgcaccgcgctggtcgaaccgggcgtgacctaccagcagctcaaggactatctggaagagcatgacatcccgctgtggctgtcgtgcccggcgccgtcggctatcgccggaccgcttggcaacacggtggatcgcggcgtcggctacacgccctatggcgaacacttcatgatgcagtgcgggatggaagtcgtcctagcgaacggcgaagtcctgcgcaccggcatgggcggggtcgaagggaccagcgcctggcaggtgttcaagtggggttacggaccctatctcgacggcatcttcacgcagtcgaactatggcatcgtgaccaagatgggcatgtggctgatgccaaagccgcccgtctacaagccgttctgcatccgctacgacaacgacgaggacatccacgacatcgtggagacgctgcgcccgctgcgcatcgcgaacgtcattcccaacgcgatggtgttcgccaacgtgatgtgggaagccgccgcgctgatgccgcgcagcaagtactatgacggcaccggcaccacccccgacagcgtgcttgaagagatcaaggccaaggaaggcctgggcgcttggaacgtctatgccgcgctttacggcaccaaggagcaggtcgacgtcaactggcagatcatcaccggcgcgatcaaggccagcggcaagggcaagatcatcaccgaggaagaggccggcgacacccagcctttcaactatcgcgccaagctgatgcgcggcgacatgacgatgcaggaattcggcctctatcgctggcgcggtggcggcggatcgatgtggttcgcgccggttaccgcagccaagggcagcgaaaccgtggagcagacgcgtctcgccaaggaaatcctgggcgaatacgggctcgattatgtggccgaatacatcgtcggcatgcgcgacatgcaccacatcatcgacgtgctctacgaccgctccgatccggaggagatgaagcgcgcgcacgaatgcttcggcaagctgctgagcgagttcggcaagcgtggatatgcggtctatcgcgtcaacaccgcgttcatggaccagacggcggacctctatggcccggtcaagcgcaaggtcgaccagacgctgaagcgcgcgctcgacccgaacggcatcctcgcgccgggcaagtccggcatc

SEQ ID NO: 34278 - DNA, 1512 bp, Sphingomonas aromaticivorans
aatcttgccgaattcctcgccgcggccctcgcgcgcgatccggaaggcgaggccgtggtcgagggcgagaggcgcatgacctatgcggggctggaccgcgcagcccgcgcgctcgctgcgcgcatgatcgcactgggcgtgacgcccggagaccgggtcgcggtgctcctcggcaaccgaatcgagtatcccgtcatcgtcctcgcctgcacctttgccggcgctatcgcggtgccgatgaacattcggcagaccgccgccgaaaccgcccatgcccttgccgccagcggcgcacgcctgcttttccacgaagcggacgcccgcctgccggaccgcgcccaagtgccggcgctcgcggcgctggtggccattgccgatgatgcgccgctggcggaaacgctcgcgccgcaggatgtgcccgtttccgccctccccccgctgcccggagaggacgagcccgccgtcatcctcttcacctcgggcacgaccggcaagcccaagggcgcggtgctgacccattgcaacatcgctcactcgatcctgcatttctgccaccattatgccctgcgcgaaggcgagcgctgcctgcttgccgtccccgccagccacgtgaccggcctcgtcgcgctgctcgccaccagcctcggcctcggcggctgcctcgtcatcatgcgcgaattcaaggcgggcgaattcctgcgcctcatggcgcaagagcaggtcggctatacgcttgtcgttccggccatgctcacgctcgcgctgatgcagccgcagttcgaatccgccgccctttcgaactggcgcgtctgcggcttcggcggagccccgatgcccgacgcgaccatcgcagacctcgcgttgcgcctgccgggcctcgccctccacaatacctacggcgcgaccgagaccacctcgccggccgtgatcatgcctgccgaccaggccgccgcacgcagccgccagcttggtctgccggtcctgtgctgcgacctgctggtcatggacgaccaggggcgggaatgcccgcccggagagcagggcgagatctggatggccgggccgatggtcatcccccgctactggaacgacaccgcggcaaccgcggcagccttcgtccacggctactggaaatcgggcgacatcggcagccgcgatgccgacggccatgtctcgatccacgaccggatgaaggacatgatcaaccggggcggcttcaagatctactcggtcgaggtcgaaaacgcgctctgcgcccatcccgccgtcatcgaggccgccgtcgtcggacgaccctgcccggttctgggcgagcgcgtcgtcgctttcgtccatgccggcgcgcccgcatccgccgaagagctgcgcgcccacgtcgcggcacgcctgtcggactacaaggtgccggaagacatccgtttcgaaaccgtgccgctgccgcgcaatgccaacggcaagctgctcaaacatgccctgcgcgaccgtctggtcggcgcctgatcgaggaaactg

SEQ ID NO: 34279 - DNA, 794 bp, Sphingomonas aromaticivorans
cggctggaagggaaggtggcgatcgtcaccggggcggggcgcgtcggcaatatcggcgtcgccgttgcgcgggcgttcctgcgcgagggagcacaggcggtggtcggcaccgacttccgtcgcgaggaagccgaggcgattgccgacctcgtgaaggcggacggttcgcagggcagtttcgtgctgatggagcaggacgtcaccagcgaggccgactgggcgcgggttagccgggagaccgtcgaccggttcggccagatcgatgttttggtgaacaatgccggcatttcgatccacggcagcatcgcgggcacttcgctggatgacctgcgcaaggtcatggccgtgaaccacgatgcgttgttcctggggatcaaggcctgcgcgccgcatctggccggcgcggtggcgcggttcggcggtggcggggcgatcatcaacaacctgtcgatggcgtcctacatgccgaacgccaccaacatcggctatcacgtgtcgaaggcggcggggcggatgctcacggtttgcgcggcgctggaatacggacgcagaagatccgcgtcaattcaatccatcccggcgtgacgatgacgccgatccttcgcgaggggctggatgcctatgtcgccaatggcatgtgggattcgaccgaggcggcggaacaggcgctggcggcgatgaacccgctgggaatatcgagcgtgccagaggatgcggcgaacgccttcgtctatcttgccagcgaggaggcgcgcttcgtgaccggcgctgcgatctgccacgatggcggcatc

SEQ ID NO: 34280 - DNA, 753 bp, Sphingomonas aromaticivorans
gtcgaacgcgatggtcccgtcgtcgtcgccacgctcaaccgccccgaaacgcgaaacgccatttccgaaaccgcccacagcgaggaaatcgccgctttctgtgccgaggtgacccgcgacccgggcgtgcgcgcggtcgtgctgaccggcgcgggcaaggcgttctgcgcgggcggcaacgtcaagcacatggccgacaagaccggcatgttcggcggctcgcccttctcgatccggaaccagtatcgcaccgggatccagctcattccggcggcgctctacgaactggaagtgccggtgatcgcggcggtcaacggcccggccatcggcgcaggcctcgaccttgcctgcatgaccgacatccgcatcgcgtccgacaatgcggtcttcgccgaaagcttcgtcaagctcggcatcgttccgggcgacggcggagcgtggctgctgccgcgcgtcatcggcatggcccgcgccagcctgatgacgctgaccggcgataccatcgatgcggcaaaggcgctggaatacgggctcgtcagcgaagtcgtcgctcccgaccaactgctgccccgcgccctcgagatcgcgcaatcgatcgccgccaatccgggccacgccacgcgcatggccaagcgcctgctgcgcgaagggcaggacatgaagctgggccccctgctggaactctccgccgcctatcaggcgcttgcccaccacacccacgatcaccacgaggcggtcagcgccttcctcgaa

SEQ ID NO: 34281 - DNA, 972 bp, Sphingomonas aromaticivorans
atgagcgtgcggtccgtaatccgtggcagcggttcggccctgccgcgtcgcgcggtatcgaatgccgaaatgaccaccatggtcgacacgaccgatgaatggatcgtcgagcgcaccggtatccgcaaccgctacatcgcgggcgaaggtgaaaccacctcgacgcttgccaccgaagcggcgcgcaaggcgctcgaagccgccggcgtagacgcctcgcgcatcgaccttatcgttctggcaacggcgacgcccgaccagaccttcccggcgaccgcaacgatcgtccagcacaacctcgggtgcaacggcggcatcgcctttgacgtggcggcggtctgctcgggcttcctttatgcgctcgccactgcggattcgatgatccgttccggcatggcgcgctgcgcgctggtgatcggcgccgagaccatgagccggctgctcgactgggaagatcgcacgacctgcgtccttttcggcgatggtgccggtgcggtcgtgcttgaagctgtcgatgtcgacgaaacggacccgaaggcgcccggcattctggcaacgcgcctccacgccgacggcgcgcacaacgagctgctctatgtcgatggcggtccctccacgacggggacggtcggcaagctgcgcatgaagggccgtgaggtcttccgtcacgccgtcaccaaccttgcgaatgtcctgaaggaagttcttgagacgacggggcatgacgcggaagaaatcgattgggtcgtaccacatcaggcgaacttccgcattctcgacgctaccgcgcgcaagctcgatcttcccgcggacaaggtgatcgtcacggtcgaccatcacgccaacaccagtgctgcctcggttccgctcgcctatgacaccgctgtgcgggacgggcggatcaagcccggcgacctcgtcatgttcgaggcgatgggcggtggattcacctggggcgccagtttggcccgg

SEQ ID NO: 34282 - DNA, 900 bp, Sphingomonas aromaticivorans
cgtgacctgaccggcatcggccagcttgcgcgccacgagattctctacctcctcgacgaggcggaacagtgggtggaactgaaccggcagagccagaagacgaccgatcttctcaacggcctgacgattatcaacgccttcttcgagaactcgacccgcacgctgctgagcttcgagatcgcgggcaaaaggctgggcgcggacgtggtcaacatgcacgccgccaccagcagcgtgaagaagggcgaaacgctgatcgacacggcgatgacgctcaatgccatgcgcgcggacgcaatcgtcatccgtcacgccagttcgggcgcggtgcgcctcatcgcggaaaaggtggactgcccggtgctgaatgccggcgacggacagcacgagcacccgacgcaggccctgctcgatgcgctgacgatgcgccatgcgatgaagctgcccgcaggatcggacctcaatggtctgaaagtgacgatctgcggggacatcctgcacagccgcgtggcgcgatccaacattctgagcctgaccgccctgggcgcggaagtccgcgtatgcgcgcctcccgcgctgatgccggccgagatcgaggcaatgggcgtgacgcccttccacgacttcgacgcggcgctcaaaggggccaacatcgtgatgatgctgcgccttcagcaggagcgcatgtcgggacagttcatcccctccccgcgcgagtatcgccacctctacgggttgacgcccgaacggctggccagggcggaggccgacgctttcgtgatgcatcccgggccgatgaaccgcggcatagagatcgattcgaccgtggcggaccatcccacgcgcagcctgatcacgcggcaggtcgaaatgggtgttgccatccgcatggcctgcctc

SEQ ID NO: 34283 - DNA, 1402 bp, Sphingomonas aromaticivorans
cgcctttacatcgatggcgattgggtggaacccgcccgccccgacccgccgatcccggtaatcaatcctgcaaccgaaatggcgtgcggctcagatcaggcccggaagcgcgctcgatgtcgatcgcgcggtggcagcggggcgccgggcatttgcgtcattctccgtgagccctgcgcaggagcgtattgccctgctcggcagaattctctccctgatggaggaaagggcggaagctctcgctcaggccgtcacgctggaaatggggtgcgcaatctcgttttctcgtacggctcaggtacctttcggtgtcgcccatgttcgcgcagcactcaaagtgctgcatgacttcccgttcctcactccacagggttccaccgcgatcctgcgtgaacccatcggcgtctgcgggctcatcacgccgtggaactggccgctgtaccagatcacggcgaagcttgcgccggcgcttgccgcagggtgcaccgttgtgttgaagcccagcgagctgtcgccgttcagcgcggcgctgctggcgcagatcgtccacgatgccggcacaccggctggcgtattcaacatggtgaccggcaccggccccggggtgggagaggccatcgctgcgcatggcgacatcgacatggtctcgataaccggctcgacgcgtgcgggtgtgcttgtcgcccaggctgccgcgaccacggtaaagcgggtaacgcaggagctaggtggcaagtcgccgaacatcctgctcgacgatgccgatttcgagcgggtcgttcccctaggcatcgcggcgggcatgcgcaacgtcggccagtcctgcagcgcgccgacgcgcatgctggtgccgcgccatcgcctgaccgaagtggagcagcttgccgcgaatgccgccaacgcgctcgttgtcggggatccgctggccgaagcgacggacctcggaccggttgccaacagccgccagttcgacaaggtccaacagatgatcgccgtcggccaggccgaaggcgcccgtctgctgtgtggcggccccggcaggcccgaagggctggatcgcggcttcttctgcaggccgacggtattcacctgcgatgatccggcgatgcgcgtagcgcaggaggagatcttcgggccggtgatctgcgtgatcccctacgacgatgacgaccacgccgtccgcattgccaatgacacgatctacgggctcggctcgcacgtccagtccgcagatatcgaccgcgcacgaactgtggcggcaaggatccgggcggggcaggtccacatcaaccatcccgcctgggacgggcatgcagccttcggcggttacaagcagtctggaaacgggcgtgaatatgggcgtttcggcctggaggaatacctcgagaccaaggccgttctg

SEQ ID NO: 34284 - DNA, 1386 bp, Sphingomonas aromaticivorans
attgatggcaagtgggtagacagcgagggtggcaagcgccacgaggtcatcaatccgacgaccgaggaaccctgctgcgtcatcacgctgggcacgcaggccgatgtcgacaaggcagtggccgcggcccagcgcgccttcaagaccttcagcaagacgacgcgcgaggagcgactcgcgctgcttgaacgcatcgtcgaggaatacaagaagcgcgtccccgatctcgccgccgcgatggccgaggaaatgggcgctccggtaagcttcgccagcaccgcgcaggtcggcgccggcatcggcgccttcctcggcaccatggccgcgctccgcaacttctccttcgtcgaggacaacggtgcgttcaaggtcgcctacgaaccgatcggcgtcgtcggcatgatcacgccatggaactggcccctcaaccagatcgcgctcaaggtcgcaccggcgctggccgcgggcaacaccatgatcctcaagccgtccgaggaatgccccaccaacgccgcgatctttaccgagatcctcgatgccgccggcgtcccgccaggcgtcttcaacctcatccagggcgatggtcccggcgtcggcactgcgatcagctcgcacccgggcatcgacatggtcagcttcaccggctcgacccgcgcgggcatcctcgtggcgaaggctgcggccgataccgtcaagcgcgtccatcaggagcttggcggcaagtcgcccaacgtcgtcctgcccgatgcagacttcgccaagtacctgccgtcgaccgcgtccggcccgttggtcaacagcggccagagctgcatttcgcccacccgcattctcgtaccccgcgaacgcgaagccgaagccgcggcgttcgtttcggcgatgtactcggcaaccccggtcggcgatccgatgcaggaaggtgcgcacatcggcccggtggtcaacaaggcgcagttcgacaagatccgcggcctgatccagtcggcgatcgacgaaggcgcgaagctcgagaccggcggccccgacctcccggccaacgtcaaccgcggctactacatcaagcccacggtcttctccggcgtcacgcccgacatgcgcattgcgcaggaggaaatcttcggcccggtcgcgacgatcatggcgtacgacagcctcgaggaggccatcgagatcgccaacgacaccgcctatggcctgtcggcctgcatcaccggcgatccggcgaaggcggctgaagtcgcgcccgagcttcgcgccggcatggtcgcgatcaacaactggggccccaccccgggcgcgccgttcggcggctacaagcagtccggcaacggccgcgagggcgggctctatggcctcaaggacttcatggaaatgaaggcgatcagc

SEQ ID NO: 34285 - DNA, 909 bp, Sphingomonas aromaticivorans
gtattcatcgacggtgcggcaggcaccacgggcctcgagatcgcggagcggctgtccggacgcagcgagttcgcgctgatcgctctcgaagacgcgcgccgcaaggacgatgccgcgcgggccgaggcgatcaacgacgccgacgtcgtgatcctgtgcctgcctgacgatgccgcgcgcgatgccgtggcgatgatccgcaacgaccgcacccgtgtaatcgacgcttcgaccgcgcatcgcgtcgccgatggctggacatacggctttcccgaaatcgtcggccgcgagaccgtggcgcaggccaagcgcgtttcgaatcccggctgctatccgacgggtttcctcggcctgcttgccccgctggtgcacaatggcctgctgccggcggcatggccctatagctgcaccggcgtgtccggctactcaggcggcggcaaggcgctgatcgcacggttcgagcaggaccgcgacatcgcctggcgtggctatggcctgaccttcgggcacaagcacgtgcccgagatgcagcgctatgccggccttgccattgcgccgatgttctcgccggcggtggtcccggcgcaccgcggcatggtggtcgagatcccgctgccgctgggcgtgatgccgggcaacgttcctgccgaactgttgcgcgccgcgctcacccagttctacgccggatcgccgatcgtgacggtggctcaggaattgccggcggacggcgaaatgctgatgcgcgcctcgatggagccgtgggacggcctcgaactgcacgtcatgggcagcagcgacggcgaacaggcgcggctcgtcgcggttctcgacaacctcggcaagggcgcgagcggggcggcggtacagacgctgaacctgatggcgggactggacgaaacggcgggcctg

SEQ ID NO: 34286 - DNA, 1711 bp, Sphingomonas aromaticivorans
aaggcaagtggaaatccaagcgagaaagcgctaggcgcgctcgccatgagcgacgagcagaacaagccagagagctacagctacgccaaagccggcgtgaacattgctgcgggcaacgcattggtgaaggccataggcccccttgcgaagtccaccgcccgccccggcgcggacgcggaactcggcggctttggcggcttcttcgatctcaaggccgctggctacaacgaccctctgctggtcgccggcaacgacggcgtgggcaccaaggtcaagctcgccatcgaccatgaccggcacgaccagatcggcatcgatcttgtcgcgatgtgcgtcaacgacctcatcgtccagggcgcggagcccctgttcttcctcgactatttcgccaccggacgtctcgataacggcgttgccgaacgtgtcgtcgcgggcatcgccgatggctgcaagctggccggttgcgccctcatcggcggcgagaccgccgaaatgcccggcatgtatgccgacggcgactacgaccttgccggcttctgcgtcggtgcggtcgaacggggcgagcaactgaccggagaccgcgtggccgaaggcgacgtgctgctcggcctcgcttcctcgggcgtccattccaacggctattccctcgtccgccgccttgccgccgacaagggctggaagctcgatcgcccggccctgttcgacaacgagcgcctgttgatcgattacctgatcgaaccgacccgcatctatgtgaagagcctgctgcccttcatccgcagcggccggatcaacgcgctggcccacatcaccggcggcggcctgcttgagaacgtcccgcgcgtcctgccgcgtggcctccacgcccggatcgacgccgacagctgggaacaaagccgcctgatggccttcctccaggcccagggcaacatcgagcccgaggaaatggcccgcaccttcaactgcggcatcggcatgatcctcgcggtcaatccggcacaggcggatgcgcttgccgcagacctcgccgccgccggcgagacggtctaccgcgtcggcaccatcgtgaagggcgaaaagggctgcaccgtcaccggaagcgccgagacctggtccgcccgctcggcctgggaagccacccacattggctgaacgcacgcccgtcgcggtcttcatctccggcagcggcaccaacatggccgcgctgctctatgcctcgcgcatggcgggctgcccctacgagatcgcgctcgtcctctcgaacaatcccgatgcttccgggctcaggttggcccaggccgaaagcgttcccaccttctgcctgccccacaagggcattccccgcgccgagcatgacgccctgatggaagccgaagtgctcaagtcgggcgcgcagctcatcgcgctcgccggctacatgcgcatcctcagcgcggaattcgtcgcgcgctgggaagggcgaatgctcaacatccacccttcgctcctgccgaagtacaagggcctgcacacccacgaccgcgcgatcgaggccggcgacacccacggcggctgcacggtccacctggtgacggcggaactcgacgacggcccgatcctcggccagcttcccgtcgccattctccccggcgacaccggcgaaacccttgccgcccgcgtgctctttgccgaacaccagctctattcgcgggtgctctcgaccttcgccatc

SEQ ID NO: 34287 - DNA, 420 bp, Sphingomonas aromaticivorans
atggcggttacccgcaccttctcgatcatcaagcccgatgccacgcgccgcaacctgacgggcgctgtcaccaagatgctggaagaggccggcctgcgcgtcgtcgcttccaagcgcatccacatgagccgcgagcaggccgaaggcttctacgcggtccacaaggaacgccccttcttcggcgaactcgtcgaattcatgatctcgggcccggtggtcgtgcaggttctcgaaggcgaggacgccgtgaagcgcaaccgcgacatcatgggcgccaccaaccccaaggacgccgctccgggcaccatccgcaaggaactggctgaatcgatcgaggccaactcggtccacggttcggacagcgaagagaacgcagcgatcgaaattgcctacttcttcaagccggaagaaatcgtcggc

SEQ ID NO: 34288 - DNA, 852 bp, Sphingomonas aromaticivorans
tccccgatcgcatggggcatgtggcgcctcgccgagaacgggcgcacccccgccgacgcggcaaagctcgtccacgcggcgctcgatgcggggatcaacttcctcgacacggccgacatctacggcttcgacggctcggcgggttttggcgacgcggaagcactgctgggcgaagtcctcgcggccgagccagccctgcgcgaacgcatgattcttgccaccaagggcggcatccttcctccgttgccctacgaccagagcgccgactacctgcgcaaggccatcgacgattcccttgcccggctgaaggtcgatgtgatcgacctgtggcagatccaccgccccgacatcctggcccatccctatgaagtcgcgcgtgtgctcgacgatgcggtttcgtcaggcaaggtccgcgcgcttggcgtctcgaacttcaccaaggaccagatcgccgcgctcaaccacttccttggcgaaaagctggcgacgacccagcccgagatcagccccttgcgcatcgactgcttcgagaacggcgaacttgatcaggcgatgatgctcggcctgacgccgatggcgtggtcgccgcttggcggaggccgtcttgcctcaccccagacggcgcgggacaaggctgttgccgacgcgctcgatgccgtcgcgcaggcgcagggcgtttcgcgcactgtcgccgcctattcgtggctcatggcgcatccggccgggatcgtcccgatcattggatcgcaacaggccgcgcgcatcgccgaaggggccgaagcgctgaaagtccgctggaaccggcaggactggtatgccgtgctggtagcggcgcggggagagcggctcccc

SEQ ID NO: 34289 - DNA, 1446 bp, Sphingomonas aromaticivorans
gacgtcgccgtcatcggcggcggcgtcaacggctgcggcatcgcccgcgatgccgcaggacgcggggcaagtgtgctgctgctcgaggccaacgacctcgcgagcggcacctcgtccaattccagcaagctcatccacggcggcctgcgctatctcgaacactacgagttcggcctcgtgcgcgaagcgctgtctgagcgcgagaagctgtgggccatcgcgccgcacatcatctggccgatgcgtttcgtactgccgtgggtgcggggcctgcgtccgcgctggcttttgcggaccggcctgtttctttacgatcatatcggcgcgcgcaagcttttgcccgcgaccgagacgatccggctggaccgccacccggcgggccggccgctgaagcccgagttcgtgcacggtttcgtctattcggatggatgggtggacgatgcgaggctcgtggtgctgaatgcgcgcgatgcggcgaaccggggggcggaggtgcgtacgcgctgtcccgtcacggcgctgcggcgtgaggacgacctgtggtcgatcgaaaccgcgcacggtcggttcctcgcgcgctcggtcataaacgcggcgggaccctccgtgcttgccatcctgggttgcagcggcgagccgcccaggcagtcgatccggctggtgcgcgggtcgcacatcgtggtgcgcaagctgttcgatcatccgcacccctatttcttccagcttcctgacggccgcattttcttcgctatcccctatgagcacgacttcaccctgatcggcaccaccgaccgcgaccaccggcccggcgatccgatcgaggcgagcgcggaggagatcgcctatctctgcgaaggggcgagccgcttcttcagaaagccggtcgtgccggccgacgtggtgtggacctatgccggcgttcgcccgttggtggacgacggctcgggcaagccggaggcggcgacgcgcggctatcgcttcgacatcagcgacgagaacgaaggcgcgccgatcctctccgtgttcggcgggaagatcacgacctaccgcaccctgtcccaggaagcggtcgaccgcatggccacgcgcattcccgcgctggaaggcaggcactggacagacaatagcgccttgcctggcggggatttcggcgtgaacgaggtcgaccggctgatcgccgatttgcgcgggcgctatccgttcctcgaacctgcctgggcggacaggctggtgcggtcctacggcacgctggcctttctcgttcttggcgaggcgcatacgctgaacgactgtggccgccatttcggccacggacttaccgagcgggaggttcgctacctcctcgccaacgaatgggcgagagaggccggggacgtgctttggcggcggaccaagctgggcctgcggctggacgcggcggagcaggccgacctggcgcaattcatg

SEQ ID NO: 34290 - DNA, 1494 bp, Sphingomonas aromaticivorans
atgactgacgagcgccgcatccttgttctcgacgaaggaacgacctcgacccgtgcgatcctctattccgcgcgaggcgaggtgctgggctgtgcgcaggaagaactgacgcaatactatcccgcgcccggccttgtcgaacacgatgcggccgagatctgggagcggaccctgcgctgcgcgcgcgccatggtggcgcaggcgggcggggccgggcgaattgccggtatcggcgtcaccaaccagcgtgaaactgtcgtcgcctgggatcgttcgaccggcaagccgctgacccgtgccatcgtgtggcaggaccgccgaactgaagagcgttgccgcgagctgcgcgatgcaggtcatgaggcggcgatccagcaggcaaccggcctgctgctcgatccctacttttcagccagcaagatggagtggattctccgaaacgtccccgaagcgcgcgcgctgggttcgcggctggcgttcgggacggtggaaagctggctggtctggaacctgaccggtggcctgcatgtcagcgacgtgaccaatgccagccgcacctcgctgtttccgctcgaaggcgcgagctgggacgaaggactgtgcgatctgttcggcgtgcccctttcggccttgcccgaagtggtgccgagcgcaggcgcattcggcacgacgcgggcagacctgctgggcggagcgattcccgtcaccgggcttgccggcgatcagcaggccgcgacaatcgggcagggctgtttccgtgcgggcgaggccaaggcgacgctcggcaccggggccttcatccttgccaacatgggcacccgaccgccgcgttcggcgcatcgcctgcttggcacggtactgtgcgaggtggacggcgtgcgcactttcgcgctggaaggttcggtctttgccgcgggcagcgtggtcaagtggctgcgcgacagcattggcctgctgggcacgtcagcggagagcgaggcgctggcaaggtccgtgccggacagcggcggcgtggtcgtcgttccggcgttgtcggggctgggcgcgccctactggaaacccgatgcgcgcgcgagcatccacggcctgtcctttgcgacgacgcgggcgcatctcgtgcgtgcggcgctcgaggcgatggcgcacgtgttccatgacctcggtcatgcctttgccgcagatggggcagggtggcaggtgctgcgcctggacggcggtatgagcgccaacgactggctggcacaggacatcgccgacgtgctcggcatccgctgcgagcggccggtcgacgtggagacgaccgcacgcggggccgcgatcctggcggcgatcggtgctgggctatgcccttcgctcgaccatgcgcgaaccatcgtcgcaccttccgccgcgttcgagccagggatggcggcgcaagaacgtcacgggcgtttggtccggtggcgcgaggctatcgggggatagcccccggcccgatcagcggaacgcgaggac

SEQ ID NO: 34291 - DNA, 1215 bp, Sphingomonas aromaticivorans
acgctcatgctgaaccacggttacgacccgcacctgtccgaaggcgcggtgaagccgccggtgttcctgacctcgaccttcgtgttccccacggccgaggaggggcgcgacttcttcgactatgtcgccggccgcaaggagccgccgccgggacagggccggggcctcgtctattcgcgcttcaaccatcccaacagcgagatcgtcgaggacaggctggccgtctacgagggcgccgaggcgggcgtcgtgttctcctctggcatggcggcgatcaccactgcgctgcttgccttcgcgcgaccgggcgacgtgatcctgcattcgcagccgctctacggcgggaccgagacgctgctggcgaagacgttcgccaacctcggcatcggcgcggtcggatttgccgacgggctgggcgatgaagagatcgcggcggcggccgatgcggcgatggggcgcggcagggtgtcggtcgtgctgatcgagacgccggccaacccgaccaacagccttgtcgacatcgcgctggcccggcgcgtctgcgatgcgatcggcgaggcgcaggggcaccggccgctgctgatgtgcgacaatacgctgctcggtccggtcttccagcgaccgctcgatcatggcgcggacgtctcgctctattcgctgacgaagtacgtcggcgggcattcggacctggttgccggtgcggcgctgggttcggcggcgatcatgcgcgagatccggctgctgcgcagcgccatcggcacgcagctcgatccgcacagttgctggatgcttggccgctcgctcgagacgctggcgctgaggatggaaaaggcgaatgccaacgctgcggtcgcggcggcattcctgcgcgaccatcccaaggtgcggcatgtctcctatccgttgttcaacgaaccggattcgccccaggctcgtctctttgcccggcaatgtaccggggccggatcgacgttctcgttcgatatcgttggcggtcaggatgccgccttccgcttcctcaacgcactccagatcttcaaactggcggtgagccttggcggcacggagtcgcttgccagccatccggggaccacgacgcattcgggcgttccggccgacgtgcgcgagcggatcggcgtacacgagacgacagttcgcctgtccatcggcatcgagcatccggacgatatcgtcgccgacctcgcgcaggcgctg

SEQ ID NO: 34292 - DNA, 750 bp, Sphingomonas aromaticivorans
atggaattgcaagggaagatcgccttggtcactggcgccgcatcggcggcgggcctcggctttgccacggcacgcctgctcgcgcggcgcggggcggcggtctggcttaccgatatcgacgccgccggtgccgaggcccgtgccgctgaactggctgcccaagggtttgccgcgcgcggcatggggcatgacgtgaccagcgccagtggctgggccgaagtgcttttcgccatcgcccggcaggacggtcgcggaccggacattctcgtgaacaacgcgggcatcgccgtgttgcgctggacgcccgatctcgaaccggacgaatggcagcgccagatcgatgtcaacctgaccagcgtctacctcggctgccgcgcagtccttcccgcgatgcgcgcggcgggcgatggcgccatcgtcaatatctcgtcggttgcgggccttgtcggcattccgggggcctccgcctatgccgccagcaagggcggggtgcggctctacaccaagtcgctggcgatggagtgcgcgcgcgagggaatccgcgtcaattccgtccatcccggcgtgatctggaccgagatgcagcaggtcgcgatccgcgacaacccggaccagtacgatgcgatcaacgcctcgatcccggccgggcgcatgggtgaacccgatgatatcgcgcaggccgtcgcgttcctcgcgtcgcctgccgcaagatacatcaccggcgcggaacttgccgtcgatggcgggctg

SEQ ID NO: 34293 - DNA, 1053 bp, Sphingomonas aromaticivorans
ggcgaaaaggcgcgcctgcgctcgctcgctccgcggcgcggggtggacttcgcatcgaacgactacctcgccatgtcctcctcgccccgactggcaggggcagtgcaggaagccgtgacgcggggtgtgccgttgggttcgggtggatcgaggctgctgcgaggcaatgatcccgaacacgagttgctggagacggaagccgcccgcttcttcggctcggaaagcgccctgttcttctcgtcaggctacgccgccaatgttgcactgctttccactcttccgcagcgcggtgacctgattatctatgacgaactggtccatgcctcaatgcacgagggcctgcgcctgacgcgcgccaccagcgtcagtgccgcccacaacgatccgcagagcttcgacgatgctgcgcttgactggcgcgccaagggcaacaccggccgcgtctggctcgcgttcgagacgctctattccatggacggcgacatggcaccggttgccgagatggcgcagatcgcggaacgccacgacgcggtcatgctgatcgacgaagcccacgcgacgggcgtgttcggcgtcgatggacgcggccttgccgccagccttgacgggcgggccgataccattgttctgcgcacttgcggcaaagccatgggctgtgaaggtgccctcgtcctggcgccgcgtgtcgtccgcgacttcctcgtcaatcggggccgtcctttcatcttctcgaccgctccttcaccgctcgtatgcgccgcagtgcgcgaggcgatgcgcatgatggcagacgagcccgagcgccgcgagaacttgcgtacgctcgtagcccacgccgaacgtgcactcgtccgccacggcgccgaaccaacaggttcgcagatccttccgctaatcctgggcgaagacgcgcgcaccatggcagtcgccgcttctctccaggcaagcggtttcgacgtgcgcggcatccgcccacccacagtgccgcaaggcaccagccgcctgcgcatctcgctgacgctcaacgccacgcgcgacgacgtcgatgcgctt

SEQ ID NO: 34294 - DNA, 2884 bp, Sphingomonas aromaticivorans
atgggttatgaacgccaggccgatttcggcacaccggaagttcgcagcgagaccgaggtcacctgcttcattgacggacgcgaggtcactgtcccggtcgggcacgacggtcatgcgcgcggcggcgctgaccgggggctcgatccccaagactctgacgcgacggacaatctcaagcaattcggctcgtgccgcctttgcctgtgtcgagatcgacgggatgcgcgggacgccggcaagctgcaccacgccggtggcatcgggcatgaaggtccacacccagaccccgcgcctcgaaaagctgcggcgcggggtgatggagctgtacatctccgaccacccgctcgactgcctgacctgcagcgccaacaacgattgcgaactgcaggaccaggcggcagcggtgggcttgcgcgacgtgcgcttcggctatgagggcgagaaccaccttggcgccgcgaccgacacctccaacccgtatttcgacttcgacccttccaagtgcatcgtgtgttcgcgctgcgtgcgcgcctgcgacgaggtgcaggggacattcgcgctgacgatcgacgggcgcggctttgcatcgaaggtctcggcagggcttggttcggacgactatctctcgtccgaatgtgtaagctgcggcgcctgcgtccaggcttgcccgactgccacgttgcaggaaaaggcggtcaaggaaatcgggaagcccgagcgcgcggtggtcacgacttgcgcctattgcggcgtgggctgcactttccgcgccgagatgcgcggtgagcagctcgtgcgcatggtgccgtggaaggacggcaaggccaatcgcgggcattcctgcgtcaagggtcgtttcgcctggggctatgcccagcaccaggagcgcgtgctttcgccgatgatccgcgagtccatcgaccagccctggcgcgaagtttcgtgggaagaggcgctttcccataccgcgcgcgagatcaaccgcatccgcgagacctacgggcgcaacgccctgggcgggataacgtcgagccgctgcaccaacgaggagacgttcctcgtccagaagctgatccgcgccggtttcggcaccaacaacgtcgatacctgcgcgcgcgtttgccattcgcccaccggctatggcctgaagacgaccttcggcacatctgcggggacgcaggacttcgacagcgtcgaggacaccgacgtgatccttgtgatcggcgcgaacccgaccgacgggcatccggtcttcgccagccgcatgaagcggcggctgcgccagggtgcgaagctgatcgtgatcgatccgcgccggaccgatctggtgcgttcgccgcatgtcgaggcggacttccacctgccgctgcgcccgggcaccaatgtcgccgtgctgaccgcgatggcccacgttatcgtgaccgagggacttgccgacgaggccttcatccgcgagcgttgcgactgggacgaataccagcattgggccgagttcgtctcggcggcacgcaacagccccgagttcctttcgccggtgatcggtgtaggcgccgacgccattcgtggcgcggcgcggctttatgcgaccggcggcaacggtgcgatctactatgggctgggcgtgaccgagcacagtcagggttcctcgaccgtcatggccatcgccaacctggccatggcgaccggcaacatcggtcggcgcggcgtgggcgtgaacccgttgcgcggtcagaacaacgtgcagggcgcctgtgacatggggtcgttcccgcacgagctttcgggctatcgccatgtctcggacgccgagacgcgcgccctgttcgaggcagaatggggcgtgccgatcgaccccgaaccgggcctgcgcatccccaacatgctcgatgcggcgaccgacggggtcttcaaggcgatctacatccagggcgaggacattctccagtctgaccccgacacccgccacgtcgcggccggccttgccgcgatggaatgcgtgatcgtccacgacttgttcctgaacgagaccgccaactacgcgcacgtcttcctgccgggctccaccttcctcgaaaagaacggcacgttcacgaacgcggagcgccgtatccagccggtgcgcaaggtgatggagccgttgaacgggtatgaagactggcaggtgacgcaggagctggcccgcgcgattgggcttgactggaactatacccacccgtccgagatcatggacgagatcgcacggctgacgcccactttcgcgggcgtgaactacaagcggctcgatgccgaaggctccctgcaatggcccgtcaatgacaaggcgcccgatggcagtccgatcatgcacatcgacggcttcgtgcgcgggcgcggcaagttcgtggtcaccgactacgtgccgaccgatgaacgcaccggcccgcgcttcccgttgttgctgaccacggggcgcatcctgtcgcagtacaacgtcggagcgcagacccggcgcaccgcgaacacggtgtggcatcccgaggacgtgctggaaatgcacccgaccgatgccgagaaccgtggcgtgaaaaccggtgactgggtgcgccttgccagccgctcgggcgagacgaccttgcgtgcgctggtgaccgaccgcgtggcacccggtgtggtctatacgacgttccaccaccctgcgacgcaggccaatgtcgtgacgaccgactattccgactgggccaccaattgcccggaatacaaggtgaccgcagtgcaggtcacgcccagcaacgggccgagcgactggcaggaggactacgaggcgcaagcagcccgttcgcgccgcatcgcgggccacgagggcgcgatggagcccgccgaatgagtgcgcatacggtcgaaaagc

SEQ ID NO: 34295 - DNA, 2574 bp, Sphingomonas aromaticivorans
atgaacctcgagaaattcaccgaccgcgccaagggcttcctgcaggccgcgcagaccgttgcgatccgcatgaaccaccagcggatcacgcccgaccacatcctcaaggccctgctggaagacagcgagggcatggccagtggcctgatccagcgcgcgggcggcaatgccgccctggcgcagaccgaagtcgacaaggcgctggcgaagatcccggcggtgtccggttcgggtgcccaggcgacgccggggctcgacaacgatgccgtgcgcgtgctcgattccgccgagcagatcgcggccaagtccaacgacagcttcgtcaccgtcgagcgcatgctcgtcgcgctgacgctcgccaccacgacgtcggcggggcaggcgctcaaggccgcgaacgtgaccgcgcaggcgctggaagcggcgatcacgcagcttcgcggcggtcgcacggcggacagcgcgagcgcggaaaacgcctatgacgcgatgaagaagtacgcgcgcgacctgaccgaggcggcgcgcgagggcaagctcgacccggtgatcggccgtgacgaggagatccgccgcaccgtgcagatcctcgcccggcgcaccaagaacaacccggcgctgatcggcgagccgggcgttggcaagaccgcgatcgccgaaggcctcgcgctgcgcatcgccaatggcgacgtgccggattcgctgaaggaccgccgcctcatggcgctcgacatgggttcgctcattgccggtgcgaagtatcgcggcgagttcgaggagcgcctgaaggccgtgctcgacgaggtgaagggcgcggaaggcgagatcatcctgttcatcgacgagatgcacaccctgatcggggcgggcaagagcgagggcgcgatggacgcgggcaacctgctcaagccagccctggcgcgcggcgaactgcactgcatcggcgcgacgacgctggacgagtaccagaagtacgtcgagaaggaccccgcgctgcagcggcggttccagccggtattcgtgggcgagccgaccgtcgaggacacgatcagcatcctgcgcggcatcaaggacaagtacgagctgcaccacggcgtacgcattgccgacaatgcgatcgtggctgcggcgacgctttcgaaccgctacatctccgaccgcttcctgcccgacaaggccatcgacctgatggacgaggcggcgagccgcatccgcatggaagtggaaagcaagcccgaggaaatcgagaagctcgaccggcgcatcatccagatgaagatcgaggagatggcgcttgcgaaggagaccgaccaggcgtcgaaggaccggctggcgaccctgcgcgaggaactggcgaaccaggagcagcaatcggccgagctgaccacccgctggcagaacgagcgcgacaagatcgccgccgagggcaaggtcaaggaagcgctggatgcggcgcgcagcgagctggaggtggcgcagcgcaacggcgacctggcgaaggccggcgagcttgcctatggccgcattcccgagcttgagcggcaactggccgaagcgcagggcgtgagccagaacgcgatgctgcgcgaggaagtgaccgccgaggacatcgccgccgtcgtcagcaagtggaccggcgtgcccgtcgaccggatgatggaaggcgagcgcgagaagctgctgcacatggaagaggcgctgggcaagcgcgtgattggtcagaaggatgcggtgctggccgtgtccaaggccgtccgccgggcccgcgcggggcttcaggacccgaaccgtccgctgggcagcttcctgttcctgggccccacgggcgtgggcaagaccgagctgaccaaggcgctggcgggcttcctgttcgacgacgacaacgcgatggtgcgcatcgacatgtccgagttcatggaaaagcactccgtcagccggctgatcggcgcgcctccgggctatgtcggttacgatgaaggcggcgttctgaccgaagcaatccgcaggcggccctaccaggtcgtgctgttcgacgaggtcgagaaggcgcactcggacgtgttcaatgtgctgttgcaggtgctcgacgacgggcgcctgaccgatgggcagggccgcgtggtggacttcaccaacacgctgatcatcctgaccagcaacctcggcagccagtacctcgccaatctggaggaggggcaggacgtgcagagcgtcgagccgcaagtcatggacgtcgtgcgcgctcatttccggcccgagttcctcaaccgtctggacgagatcatcctgttccaccggctgggccacgaacacatggcgccgatcgtcgacatccaggtgggccgcgtggcgaacctgctcaaggatcgcaagatcgtgctcgacctcaccgacgcggccaagcgctggctgggacgggtcggctacgacccggtctatggcgctcgtccgttgaagcgggccgtgcagcggtacttgcaggacccgctggccgaaaagctgctgggcggcgaagtgcccgatggcagcacggtgcggatcgacgagggcgatggggccctgagcttcgtgatc

SEQ ID NO: 34296 - DNA, 1077 bp, Sphingomonas aromaticivorans
gtgtgcaacggtcgcgagacgatcctgctcggcacctacaactacatgggcatgactttcgaccccgacgtgatcgcggcgggcaagcaggcgctggacgacttcggttcgggcaccaccggcagccgcgtgctgaacggcacctatgccggccacaaggcctgcgaagaggcgctcaaggagttctatggcatggatcatgccatggtgttctccaccggataccaggcgaacctgggcatcatcagcacgatcgccggcaagggcgactacatcatcctcgacatcgacagccacgcgtcgatctgggacggctgcaagatgggcgacgccgaagtggtgccgttcaagcacaacgatatcgaggcgatggaaaagcgcctgaagcgcgtgccggaaggcgcgggcaagctggtggtgcttgaaggcgtctattcgatgctgggggacatcgccccgctcaaggaaatgatccgcatcgccaaggaacacggcgcgatggtgctggtcgacgaggcgcattcgatgggcttcatcggccccaacgggcgcggcgtggccgaagaacagggcgttctcgaccaggtcgacttcgtgatcggcacgttctcgaaatcggtcggcacggtcggcggcttctgtgtctcgaaccacccgaagttcgagatcctgcgcctcgtctgccgcccctatgtcttcaccgcctcgcttccgccgagcgtggtccacaccgccgcgacttcgatccgcaagctcatgcacgcagggaacaagcgcgcgcacctgtgggagaactcgaagacgctgcacaagggcctgcgcgacaagggcttccagcttggcacgaccgagccgcagagcgcgatcatctcggtcatcatgcccgacctggaacgcggcgcggcgatgtgggaagcactgctgcacgagggactctacgtgaacctcgcgcggccgcccgcgacgcctgcgggcatgacgctactgcgctgctcgctgtgtgccgagcacacagccgaacaggtgcagacgatcatcggcatgttcgagcgcgccggaaaggccgtgggcatcatc

SEQ ID NO: 34297 - DNA, 522 bp, Sphingomonas aromaticivorans
caagcaacggccatcctcgcgggcggatgcttctggtgcaccgaagcggtctttcgcgacgtgatcggggtcagcaacgtcgagagcggctatatcggcggcacggtcgagagcccgacctacaagcaggtctgctccggcagcaccggccatgccgaagcgatccgcgtgaccttcgacccgcaggtcatcgggtatggccagatcctcgacatctttttcgcgacacacgatccgacccagctcaaccgccagggcaacgacatcggcacccagtaccgctcggccctgttcccgctggacgacgaacagcgcagcgaggccaaagccgccattggacgcgcgcagcccgactggccgcggcccatcgtgacgacgatcgaaggccccgccacatggtatccggccgaggactatcaccaggaatactgggaaggcgaaggccagcggaacccctactgcctggcggtgatcccgcccaagctgatgaagttgcgcaagagcttcgccaacaaggtgaag

SEQ ID NO: 34298 - DNA, 1383 bp, Sphingomonas aromaticivorans
atggcaatcgaactgaagatgcccgcgctctccccgacgatggaggagggcaccttggccaagtggctcgtcaaggctggcgacgaagtccggtccggcgacattcttgcagagatcgagaccgacaaggccacgatggaattcgaagccgtggatgaaggcgtgatcgccgaaatcctcgtcgccgaaggcaccgagggcgtgaaggtcggcaccgtgatcgcgacgatccagggcgagggcgaggatgccgcacccgcagcggcaactcctgccgttgaacagaaggtcgaaatgagcgaagccgcgccaagcgtcgaggccagggccgcacccgcagttgcgatcgcgccgaaggtcgacgcaaagccggcagtagatcctgagattcccgccggcacggcgatggtcccgaccaccgttcgcgaagccctgcgcgacgctatggccgaggaaatgcgcgccgacgaccgcgtcttcgtgatgggcgaggaagtggccgagtaccaaggtgcctacaaggttacccaaggcctgctcgatgaattcggtccgcgccgtgtgattgacaccccgatcaccgagtacggttttgcgggcattggcgcaggcgccgcgatgggcggccttcgcccgatcatcgaattcatgacgttcaacttcgccatgcaggcgatcgaccacatcatcaattcggcggccaagaccaactacatgtccggtggccagatgcgctgcccgatcgtgttccgtggccccaacggcgctgcaagccgcgtcggtgcacagcactcccagaactacggcccgtggtacgccaacgttcccgggctggttgtcatcgcgccatatgacagcgccgatgccaaaggcctgatgaaggctgcaatccgcagtgaagacccggtggtcttcctggaaaacgagcttgtctacggacgcactttcgacgtgccgcagatggacgactttgtactgcccatcggcaaggcgcgcatcgtccgtcagggcaaggacgtgaccatcgtatcatattcgatcggcgtcgggcttgctcttgaagcggcggagactcttgccgcagagggtatcgatgccgaagtgatcgatcttcgcacgctgcgtccgctcgacaaggacacggtgctggcctcgcttgccaagacgaatcgtctggttgtggcggaagaagggttcccggtctgctcgattgcttcggaaatcatggcaatctgcatggaggacgggttcgatcatctcgacgcaccggtcctgcgcgtatgcgacgaagacgtgccactgccttatgccgccaacctcgagaaggctgcgcttatcgatgccggcaagatcgctgcggccgtgcgcaaggtctgctatcgc

SEQ ID NO: 34299 - DNA, 972 bp, Sphingomonas aromaticivorans
cgttacgacgcgagcgatgcggaactgctgaagttctatgagcagatggtcctgatccgccggttcgaggaaaaggcgggccagctttacggcctcggcctcatcggcgggttctgccatctttacatcggccaggaagccgtggcagtcggtcttcagtcggcgctgaaggaaggtcacgatagcgtgatcaccggctatcgcgatcacgggcacatgcttgcctacggcatcgatccgaaggtgatcatggcagagttgaccggtcgcggcgcgggcatctcgcgcggcaagggcggttcgatgcacatgttcagcacggaccacaagttctacggcggtcacggcatcgtcggagcgcaggttccgctcggagcgggccttgcctttgcacacaagtatcgcggtgacgacggcgtgtgcatggcttacttcggcgacggcgcggcaaaccagggccaggtctacgagaccttcaacatggccgccctgtggaagctgccgatcatcttcgtggtcgagaacaacggctacgccatgggaaccgcggtcaagcgggggtcggcagagaccgagttctatcgccgtggcaccgcgttccgcattccaggcatggacgtcaacggcatggacgttctcgaagtgcgccaagccgccgaggtcgcgctcgagtatgttcgtgcgggcaacggccccgtgctcatggaactcaacacctaccgttaccgcgggcattcgatgtccgaccccgcaaagtatcgcagtcgcgaggaagtgcaggaaatgcgggacaagcacgatcctatcgaaggcgccaaggcagaactgctgaagcggggcgtgaccgaggacaagatcaaggaaatcgacaagcgcattcgccagatcgtcgcggaatcggccgactttgccgaaacctcgcccgagccggacatggccgagctctacactgacgtgctggtggagaagtac

SEQ ID NO: 34300 - DNA, 1062 bp, Sphingomonas aromaticivorans
atggctgtaatccccgtcgccatcgccggagcgccctatgaagtgcggatcgaggccggcgttctggcccgtgcgggcgaacattgccgcccctttctgcgcaaggaccgcgtggctatcgtcaccgacgagcacgtcgccgcagagtggcgggaaaccgtcactgcctcgttcgacagcgtcggcgtgcgcagcgaatggctcgttctccccgctggcgagagcaccaagagctgggaacacctcgcccgcctggtcgactggctgctggaacaggaagtcgagcgcaaggaccgtattgtcgcgctcggcggaggcgtgatcggcgatctcaccgggtttgccgcctcgatcgtcaagcgtggctgcggtttcatccagatcccgacgaccctcctggcgcaggtcgattccagcgtcggcggaaagaccgcgatcaacacgcccgctggcaagaacctcgtcggcgcgtttcaccagcctgcgctggtcctcgccgatccgctcgcgctcgacacgctgccgctgcgcgatgtgcgggccgggtacgccgaagtggtgaaatatggcctgatcgacgatgcgcccttcttcgagtggtgtgaggcgaacggcgcaaagctcctcgcaggcgacctggcagcgcgcgagacggccatcgcacacagcgtcgcggcaaaggcgcggatcgtggcggcggacgagaaggaaatcgccggcatccgtgcgctactcaatctcgggcacactttcgggcacgcgctcgaggccgagaccggctttaccgatcgcctgcaccatggcgaaggcgtggcgctggggatggtgctggcggcacgattctcggcgcggcaggggctgatgtcgaggcaggatgccgaacgcgtggctcgccatgtcgaagcggtgggcctgcctgccacgctccgcgagcttgggctttcctgcgacggccgccgccttgccgatcacatgcttcacgacaagaagatggacgcgggcacattgcccttccttctcatgcgcgggatcgggcagaccttcctggcaaaggacgtcgat

SEQ ID NO: 34301 - DNA, 1443 bp, Sphingomonas aromaticivorans
atcgagtccagctgttccgcactgctgctgttcggcgcgaccggcgacctttcccgccggatgcttctgccttcgctctacgcccttcacgaagacggcctgatccggccggacctgcgcatcgtgggcacggcccggtccgagcatgacgacgccgagttccgcgaattcgcccgcgaggcgcttgccgaattcctgcccgaggaccggcgggacgaggaaaagctcgcgagtttcctcgaacggctcgaataccagaccctcgatgcctcgaatgtcgatggcttcggcgaactggcccgcaagctgggcgacacctcgtgcggcctctcgattttcctgtccaccgcgccgttcctgttcgaaccgacgatcgaaggcctgcgccgggcgggcttggcccatgagaacgtgcggatcggccttgaaaagccgctcgggaacgaccttgcatcgtccacccgtatcaacgatgcggttgccgccgcctttgccgaggaacagatcttccggatcgaccattaccttggcaaggaaacggtccagaacctcatggcactgcgctttgccaacatgatgttcgagccgttgtggaacgcaggcggtatcgaccatgtgcagatcacggttagcgagacggtcggcctcgaagggcgcaagggcttctacgacgacaccggcgcactgcgcgacatggtgcagaaccacatgctccagttgctcgccctgaccgcaatggagccgccggcaagcctcgacgccacgtcgatccgcgacgaaaaggtcaaggtcctgcgcgcgcttcgcccggtcaaggcggaggaaatggtgcggggccagtaccgcgccggggcggtgaagggcacgtcggtcaccggataccaggaagaccttggcgaagtgtccgacacggagaccttcgtggcgatcaaggcccatgtcgacaactggcgttggaccggcgtgccgttctacctgcgcaccggcaagcgacttggcgagcggcgcagcgagatcgtggtcgagttcaagcctgttccgcacaacctctttgccgagcgcgggggaaggcttcgccccaaccgcctcgtcatccgcctccagcccgaggaatatgtgcggctgcaggtgatggcgaaggagccggggctcgaccgtggcggtattgtgctgcgcgacgtcaatctcgacctttcgttgaccgcagccttcgccaaggcgcgccgccgcattgcctacgaacgcctgctgctcgacctgatcgagggcgaacagaccttgttcgtccggcgagacgaagtggaagcgcagtggaagtgggtcgacgccatccgcaaggtctgggccgacaccgacatggaagccaagccctatgccgcaggaagctgggggccgaacgcaggcatcgcccttaccgagcgggacgggagaagctggaatgac

SEQ ID NO: 34302 - DNA, 1005 bp, Sphingomonas aromaticivorans
cgctgccagtattacctgcacaacttcctatccagccagccccaggtaaacgcccacaatcccgaagtgcaggaagcgctgctcggggcgatgaagttctggctggaccggggtgttgacggcttccgcctcgatgccctgaacttcctgatgcatgacccgaccttgcgggacaatccgccggcgccggacgatggccgacgcaagacgcggccattcgacttccagctcaagatctacaaccagtcgcaccccgacatcctgaagttcatccagcgggtgcggaacctgtgcgacgactatggcgcggtgttcacagtcgcggaagtcggcggagaccttgccgagacggagatgaaggcgttcactgcgggggacaggcatctcaacagcgcctacggcttcgacttcctctacgcggacaggctgacgccgcatttcgtggaaaaggccgtggccaaatggcccgatgcacccggcatgggctggccgagctgggccttcgagaaccacgatgcgccgcgcgcgctttcgcgctggtgcgcgccggaccagcgcgagccgttcgcccggctgaaggccatgctcttcgcttcgttgcgggggaacatcatcgtctaccagggcgaggaactgggactgacgcaggtcgacattccgttcgagcagttgcaggaccccgaggccatcgccaattggccgctgacgctttcacgcgacggtgcacgcacgccgatgccctggttagtacaatcgggcgagggcgggttcacgtcgggcgcgccctggttgccgctgggcgaggaaaacctgtcgcgggccgtcgaccggcaggaaggcgatccggcatcgctcttgaacctgaccacgcgcctgcttcgcctgcgccgcgagacgcccgcgttacggatcggttccttcgaggtgatccatgcagacgaatgccttcttgccattcggcgcgttttgggtgagcaatcgattgcagggctgttcaacctgtcc

SEQ ID NO: 34303 - DNA, 933 bp, Sphingomonas aromaticivorans
cgacccctgtaccattacgcgcccgccgccaactggctgagcgaccccaacggcctcgtgtggcaggatggggagtggcacctgttctaccagtacaatcccttcggcgaggactgggggcacatgtcctggggccacgcggtcagtcgcgatcttgtgacttggcaggaactgccggtggctcttgccgaagaagacgggacgatgatcttctcgggatctgcagtcatcgatcaccagggcagcgcgggcttcggaaagggcgcgatggtcgcggtctataccggcgcgcgaaccgaccgggcgcatcagttccagagcattgccgccagcacggaccgggggcgcactttcaccaagttcacgggcaacccggtgctcgacctgcaaatggcggacttccgcgatccgaacgtgttctggcacgggccgtcgggccggtggatcatgtcggtcgtgctttcggaggagaaccgcgcgcaattgtacgcttcggtggacttgaggcactgggatctgctgtccgatattgggcgcgacggtgcgcccgggcacttgtgggaatgcccctggatggtcgagttgccggtggagggcaccgacgagacacgttggctgttcaaggtcgatgtcctgtccggcgcggcaggccaggcatcgccgtggcgcgtggggcatttcgacggaaggcggttcgttccggagaccggttgggcggtgggtgaccacgggcctgacttctatgcggcaatcggttggaacgccgccccggatgcggaaggacgacccgtctggatcggatgggcgggcaatcacgcctatcagaagtacctcgagccgcagggctggcgcggcgcgatgacgctgccgcgccgtgtctcgcttcgccgtgacgaaagtggctacgcgctggtgcaggaagtggaaccggcc

SEQ ID NO: 34304 - DNA, 876 bp, Sphingomonas aromaticivorans
ctcaagccagcccttgcggctatcgccgaggacatcgaccgcagcttcgacctgctgctgccggtcccgggcgacccgcgcgaccggctggtcgaagccatgcgctatgcggccattggtggcggcaagcggctgcgcccgttgctggtctgcgcgaccggcgccctgcacggcgtttcgcgcgaggcggcggtgcgggtcggcacggcgatcgaggccatccacgtctattcgctgatccacgacgacctgccctgcatggacaatgacgggctgcgccatggcaagcccaccgtccacgtggcgttcgacgatgcaaccgcggtgctggccggcgatgccctgcacgacttcgctttcgaagtgttgtccgatcccgcgaccagcggcgaccctttcacgcggatcgaactgatccgcacgcttgccaccgcgagcggcatgaacggcatgtgcggcgggcagatgatggacatcgtcgccgagacttccagtttcgacctgcccaccgtgacccggctccagcagctcaagacgggcgcattgctgggcgcatctgtggaactgggcgcgatccttgggaaggtgccgcccgaagggcgcacccatctgcgtggctatgcgcgcgacatcggccttgccttccagatcgcggatgacctgctcgacgccgaaggcgacgaagccgccgccggcaaggcgctgcgcaaggacgccgcgcagggcaaggagaccttcctgtcgctgctgggcgccgatcgcgctcgtgaacaggcccgactgctggtgaaccaggcggtcgaacatcttgcaagctatggtcccgaagcggacctgctgcgcgaacttgcgcgcttcatcgtggagaggaaccac

SEQ ID NO: 34305 - DNA, 627 bp, Sphingomonas aromaticivorans
atgatcagcgtgcgcgatctccgcaaggtgtacacgacgcggttcggcaagaagctcgtgctcgacggcgtcagcttcgacctgaacaagggagagcgccttggcgtcctcgggcgaaacggggcaggcaagtccaccatggtccgcctggtcagcggggctgagcggccgacctcgggttcgatcgaccggcgcatgtcggtgtcgtggccgctcgcctttggcggggcgttccagtacaacctcaccgggctggacaacatccgtttcatcagccgcatctatgatcaggatttcgagcgcaacctcgcctacgtcgaggagttcgccgagcttggtccctacatgcgcgagccgcttaggtcctattcttcgggaatgaaggcgcggttggcgttcgcgatctccatgatcatcgagttcgattgcttcctgatcgatgagatcgcctcggttggcgatgcccgttttcacgacaagtgcaatcacgagctgttcgagcggcggggcgaccgggcgatgatcatcatctcgcacgacgcggcttacgtccgcgaccactgcacgcgctggggcgtgctccatgacgggaggctcgaactctacggcgatttcgaggtcgcatac

SEQ ID NO: 34306 - DNA, 1419 bp, Sphingomonas aromaticivorans
gtgtatcttggaatcgatattggcacgtccggcgtgaaggccgtgctggtggaagaacgcggcgccatcgcggctcaggggacggcagcgcatgatgtcagccgaccctaccagatgtggtcggagcaggaccccgccgcgtgggtgcgcgcaaccgaggaggcggtgctcgcgctgccgtcgaccttgcgcggagcggtaaagggtgtcggccttgcggggcaaatgcacggggcgaccctgctcggcgcggacgacaggccattgcgcccggcgatcctgtggaacgacggtcgaagctttgccgaatgtgtcgaactggaggccgcggaaccccacacccgcgcgatcacgggtaatatcgccatgcccggcttcaccgcgcccaagcttgcctgggtgcgcaagcacgagcccgaaatcttcgcgcaagtgcggacggtgctgctgccgaaggactatgtgcgccttgtcctcacgggcgacaaggcttccgacatggccgacagcgccgggaccctgtggctcgacggcgcggcccgtaactggtccgatgccatgctcgcggccactggtcttgctcgctcgatgatgccgaagctctacgagggcagcgcggcgaccggggtgctttcggccgaggtcgcggcgcgctgggggatgggccgagtgccggtcgctgcgggcggcggcgacaacgcggctggcgcggctggcgtcggtgtggtcggcgatggcgatgcgttgctctcgcttggcacttcgggggtgatcttcgtggcgacgcgcgacttccggcccaatccggcccgcgcggtccatgccttctgccactgccttccggatctctggcaccagatgagcgtccacctttccgcagcaagctgcctcgattgggcggcggcggccatgggcgtcgacgtgcccgcactgctggcgctggctgaacagtccggaccggcaagcgggccggaactgttccttccctacctttcgggcgagcgcacgccgcacaacgatccggcagtgcgcgccgctttcttgcgcatgggcaacgaaaccggtcctggccagcttgccgcagccgttcttgaaggcgtcgccttcgcccatgccgacggactcgacgcgctgcgcgaggctggcaccgacgtcgcggcgctctcggtcatcggcggcggcgcgcggtcgcgccactgggggcgcatcctcgcctcggtcctcgatgtccggctggattacctcgaaggcggggaagtggggcctgccctcggcgcggccaagcttgcccagatcgccgtcaccggggcggacccggccgaagtctgccagcgtccgccgcttgcccattccatcgaacccgaccgggacctggcggaacgcctggccccgaagcttgccgcattccgcgccgcctat

SEQ ID NO: 34307 - DNA, 816 bp, Sphingomonas aromaticivorans
atggcactcaagagctataacccgaccagccccgcccgtcgcggcctggtcctcgtcgacaagtcggcgctgtggaagggcaagcctgtcaaggctctgaccgaaggcaagcgcaagaccggcggccgcaacaacaagggtcatgtcacttcgcgtggcattgccggtggtcacaagcagaagtaccgctacgtcgacttcaagcgtcgcaagtgggacatgccggctaccgtcgagcgtctggaatatgaccccaaccgcaccgcgttcatcgcgctggtcaagtacgaggacggcgaactcgcctacatcctcgcgccgcagcgccttggcgttggcgatcaggtcatcgccggcgagaagaccgacgtgaagcctggcaacgccatgctcctgtcgcagatgccggtcggcaccatcatccacaacgtggagatgaagccgggcaagggcggtcagatcgcccgttccgcaggcacttatgtccagctcgtcggtcgtgaccgcggcatggtcatcgttcgcctgaactcgggcgagcagcgctacctgcgcggtgactgcatgggcaccgtcggcgccgtgtcgaaccccgacaatggcaaccagaacctcgccaaggccggccgcaaccgctggctgggcaagcgtccgcttacccgcggcgttgcgaagaacccggtcgaccacccgcacggtggtggtgaaggccgtacttcgggtggccgtcatcctgtgactccgtggggcaagccgaccaagggcgcccgcacccgtcacaacaaggcgacggacaagatgatcatccgttcgcgc

SEQ ID NO: 34308 - DNA, 1314 bp, Sphingomonas aromaticivorans
atggagggcgtgaagaagcgcaatccctatcagcccgaattcgtccaggctgtgcaggaggttgccgaggacatcttcgacttcatcgaggacaaggaggaataccacgcccagcagatcctgcgccgcatcgcggagccggaccgggtcgtgtcgttccgggtgtgctgggaggatgacaatggcaacgtccgtgtccagcgcggttggcgcgtgcagaacaacaatgccatcggcccctacaagggcggcatccgctttcatccctcggtcaatgagtccgtcctgaagttcctcgctttcgagcagaccttcaagaacgcgctgacgggcttgcccatggggggtggcaagggcggttcgaacttcaaccccaagggcaagagcgtgcgcgagatcatgcgcttctgccagtcgttcatgaccgagctctatcgccacatcggcgccgacgtcgacgttccggcgggcgatatcggtgttggcgggcgcgagatcggctacatgttcggtcagtacaagcgcatcaccaaccacttcaccggcgtgctgacgggcaagggtctcgaatggggtggctcgcttatccgtaccgaggcgaccggttacggcgcggtctatttcctcgccaacatgctggcgaccaagggtgaggaccttcgtggcaagacggcggtgatctccggttcgggcaacgtcgcgacgcatgccgccgagaagatcgtccagttgggcggaaaggttctgacgctgtccgattccggcgggttcatccatgaccccgacggcatcgaccaggagaagatcgactgggtgaagacccacaagactcatcgtcgcgggcgcatcgaggaatacgtcgatgcctttccaggagcgtcgttccatgcaggcaagacgccgtggggcgtgccctgcgatgtcgcgctgccctgcgccacgcagaacgaactgctgggcgaggatgcgcgcacgctcatcgccaacggctgcaagggcgtggccgaaggcgccaacatgccgaccgacctcgaaggcgtgcatgtgttcaaggctgccaggattctctacgcgccgggcaaggcatcgaacgcggggggcgtcgcggtttctggcctcgagatgagccagaactccgaacgtcgctcgtggaaggagcatgaactgcagcagatgttgaaggacatcatggccggcatccacaagtcctgcctgacgtacggcgaccagggcggcggctatatcgactacgtgaagggcgcgaacatcgccggcttcaagaaggttgccgatgccatgctggctttcggcgtg

SEQ ID NO: 34309 - DNA, 606 bp, Sphingomonas aromaticivorans
atcatcgtccatcacctgaacaacagccgctcccagcgggtcctgtggttgctggaagaactgggggtcgattacgagattcgccactatcagcgcgatgcggtgacgaaccttgctccgcccgaactcaaggcggtgcatcccctcggcaagtcgcccttgctggaaatcgacggccgcgtgatcgaggagtccggggcaatcgtgcaggtgctttgcgagcgctatggcaatggcaagtggctgcctcggcaaggctcggacgacgcgctgcgccaccttgaactcatgcattttgccgaaggctcggcaatgacgccgatcctgctccagctctacacttcgcgcctcggcgaagcggcggcgccgctccagccgcgcatcgccgaacagcttgccgcgcacttcggctacatggagcagatcctgcgcccttcagggcatttcgtcggcgacgactggaccggtgccgacgtgatgctgagcttcccggcagagatcgcggtcatgcaggggcaggcaggctcgcttccgaagctctccgcattcgtggcagcggtccatgcacgccccgcctggcagcgggcgcgggagaagggcggcgcc

SEQ ID NO: 34310 - DNA, 2397 bp, Sphingomonas aromaticivorans
gaagtgcccatgaatctctatcctctgcttccccttcgcgacatcgtcgtgttccccggcatggtcgtgcctctgttcgtggggcgcgagaaatcggtggctgcgctcgaggcggcgatgtccggcgacaaggatatcttcctgctcgcgcagctcgatccaggttgcgacgacccggaccgcgacgatctttacgataccggcgtgattgccagcgtcctgcaattgctaaagctgcccgacggcaccgtgcgcgtgctcgtggaagggcgcgagcgtgcgatgctggaaggtctgcgcgaggaaaccaccgcgcagggcgcgatgctgattgcccaggtcgagccgatcgagccggtggtatcgcaaggcaccgaaatttcggcgatgatgcgttcggtcgtcgatcaattcgccgagtacgccaagctttccaagaagctgccgcaggatgcgggtggtcagctcggtgatatcgaggacgctggcaagctggcggattcggtcgcggcgaaccttgccgcgaaggtcgccgacaagcaggcggtgctttccgaaaacgaccccatgaagcggctcgagatggtgctttccttcatggaaggcgagcttggtgtgctgcaggtggagcgcaagatccgtggccgcgtgaagcgtcagatggagaagacgcagcgcgagtactacctgaacgagcaactcaaggcgatccagtcggagctgggcggcggcgacggtgaggaagccaacgagatcgccgaactgcaggagaagatcgacaagctcaagctgtcgaaggaagcgcgcgccaaggcgacggctgagctgaagaagctcaagaccatgcagccgatgagcgcggaggcgaccgtcatccgcaattacctcgacgtgctgctgggcttgccgtggggcaagcgcagcaagctcaagaaggacatcccggcggcgcaggccgtgctcgatgccgatcactatgcgctcgacaaggtcaaggaccggatcgtcgagtacctggcggtgcaggcccgcacgaacaagctcaaggggccgatcctgtgcctcgtcggccctccgggcgtcggcaagaccagccttggcaagtccatcgccaaggctacggggcgccaattcgtgcgccagtctctgggcggcgtgcgtgacgaggccgagatccgcgggcatcgccgcacctacatcggctcgctgccgggcaagatcgtgaccaacctcaagaaggcgggtacggccaatcccttgttcctgctggatgagatcgacaagttgggccaggacttccgcggcgatccggcttcggcactgctcgaggtgctggacccggaacagaacgccaagttccaggaccattacctggagctggacatcgacctgtccgacgtgatgttcgtgtgcaccgcgaacagcctcaacctgcctcagcctttgcttgaccgcatggagatcatccggctcgagggctataccgaggacgagaaggtcgaaatcgccgagcgtcatctggtgcgcaagcaggtggaggcacatggcctcaagaagggtgagttcaccttgacccaggaaggcctgcgcgatctgatccgctattacacccgcgaggcgggcgtgcgtacgctggagcgcgagatcgcgcggctggcgcgcaagtcgctgcgtcagattctcgagggcaagaccaagagcgtgacgatcacgtcggacaacctttccgacttcgccggggtccgcaagttccggcatggcgtttcggacgaggagaaccaggtcggcgcggtcacgggtctcgcctggacggaagtcggcggcgaactgctgacgatcgagagcgtgacggtgcccggcaagggcgcggtcaagaccaccggcaagctgggcgaggtaatgagcgagagcgtccagatggcgttcagcttcgtcaaggcgcgcagccctgcctacggcatcaagccttcgatcttcaatcgcaaggacctgcatatccacctgcccgaaggcgcggtgcccaaggacggaccaagcgccggcatcggcatggtcacggcaatggtctcgacgctgacgggcattccggtgcgggcggacgtggccatgaccggcgaagtcaccttgcgcggtcgcgtgctggcgatcggtggcctcaaggaaaagctgctggccgcgctgcgcggcggcatcaagacggtgttgatcccggaagagaaccgcaaggaccttgccgagattccgaccaacatcaaggaaggtctcgagatcgtgcctgtgagccacgtggacgaagtgctggcgcgggcgctggtcacgacgcccgaggcgatcgagtggactgaagcggacgatctggcgacccagcccgcccctacggtcgctggccctgcgacc

SEQ ID NO: 34311 - DNA, 2412 bp, Sphingomonas aromaticivorans
ctgccgatccattccgtcctgccggacctgcttgccgcgctgcgccagcgggagagcgcggtgctgatcgcgccgcccggcgcgggaaagaccactgcggtggcgcccgccttgctggcggaaccctggtgcaccgggcaggtcatcgtgctgtcgccccgccgcgttgccgcgcgcgcagcggccgagcgtatggccgagatgctcggcgaagaagcgggcggcaccatcggctacgttacccggctcgacagcaggcgttcggcacggacacgggtgctggtggtgaccgaggcgatcttcgtcgccacgattctggatgatcccgaactgtccggcgtttcggcggtgctctttgacgaagcccacgaacgccacctcgatagcgaccttggcctcgcgctcgcggtggaggctcagggtgtgcttcgcgaggacctgcggatcgtcgtgatgtcagccacgatcgacggctcccgcttcgccgcgctgctgggcgatgcgccggtgatcgagagcgagggcaaggcccatccgctcgcgatcaggtggcttggcgcccggcccgacgcgaaggtcgaggtggcgatggcctcggcgatacagacggcatggcgcgaggaggagggcgacatcctcgccttcctgcccggcgttgcccagatcgaacggaccgcagagactctggccgaacgccttccgcaggcgctgatcctgccgctgcacggacaggttgagcccggcggccagcgcgcggcaatccggcgcgatccctccggacgtcggcgcatcgtgctggccactgcgattgccgaaacgtcgctgacgctggatggcgtgtccgtggtggtggacgccgggctgtcgcgccgggcagaattcgacaaggcagcgggagtcacgcgccttgtcaccacgcgggcgagtcaggcatcggctgcccagcgcgcgggtcgcgcggcgcggcaggggccgggcgttgcctatcgactgtgggaagaggcgtcccacgcgggccgtccggcgttcgacccgcctgaaatggttaccagcgaccttgcgccgctggcgctcacactggcgcagtggggcgcgggcgatccggccacgatggcctggcttgatccgcccccggctgctgccatggcggcggcccaaggtgcgctggcggcgttgggtgcgctcgacaaagacaggcggatcaccacgcatggccgcgcgatggcgaagctgccgatggagccggcgctggcccatatgctccttttcgccgccgagcgcgggcaggcagaggaggcggcgcggcttgcgctgctgttgcaggaacgtggccttggcggacgcggcgaagacctcgcgcggcggctggaccgctgggcgagcgagcgcggcagccgtgccgaggcttcgcgcaagctggcggggcgctgggcgcgcatggctgagcgactcgccccgcgcggcagggcaggcgaggtgccgaccggcgttcttctggccgaggcattccccgatcgtatcgcgcgcgcgcgttcggtttcgggcgaggaatggctgtcgtctggcgggcgcgggtatcgcctcgaccctgcctcgcctcttgcgaccgcccgctggctggttattggcgatgcccagggtgaggcgaagggcgcgcggatcaccgcagcggcggctctcgaggaaagtgatgtcacccgccacctcgcgcaccgggtcgaggaacgccatacgctgtcgtggaacgcagcggacggccgtgtcgaagcgcggctggagcggcggctgggcgctatcgtgctggcacgcgtgcccgatccagcgcccgatgcagaggccgcggcgcggctcctgatcgatgaagtgcgctcgcgcgggctggatcttctgccgctgggggagggcgccaaggcgctgctcgtgcgggcgggccatgccggccttgcggccttgtcggacgccgccttgctggacgatctggaggcgtggctactgccgctggtgaagggcaggcgggatctggcagtcggggctggcaggctgcacgatgcgctgctggggcggctggactggaacgaacggcagatgctcgacaagctggcacctgccgagttccgatctcccgcggggacgagccatgcgatcgactatggccacgagggcggaccttgcgtggaactgcgcgtgcaggcgctgttcgggatcgaccggcatccttgcgtgggccagccgccgcgcccgttgttgttgagcctgaccagccccggcgggaagccgatccagacgacggcggacctccccggcttctggcgcgggtcgtggaaagacgtctgcaaggacatgaaggggcgctatcccaagcaccgctggcccgacgaaccgtggagcgaggaccccagcctgaagacgaag

SEQ ID NO: 34312 - DNA, 927 bp, Sphingomonas aromaticivorans
atgaacagcgtcaacgccgtgattctcgacaggatgcagtcgcgcatcccgttgattccgacgctggcgggtcacctcatcgccggcggtggcaagcggatgcgccccatgctcacgctggcgagcgcggcgctgctgggctacggcggcagccgccattacaagctcgcggcggcagtcgaattcatccacaccgcaacgctcctgcatgacgacgtcgtcgatggctccgacatgcgtcgcggcaagaagaccgcgaatatcgtctacggcaacccggcgacggtccttgtcggcgacttcctgttcagccgcagcttcgaactcatggtcgaggacggctcgctcaaggtcctgcgcatcctgtcgaacgcatcggcggtcatctccgaaggggaggtcgaccagctcgtcgcccagcgccagatcgacacgaccgaggaaatgtacctcgatatcattgccgccaagactgccgcgctgttttcggccgcctgccgcatcgcggccgtcgtcgccgagcggcccgatgccgacgaactcgcgctcgatgcctatggccgcaatctcggcattgccttccagcttgccgacgatgccatcgactacgattccgatgccgccgaaatgggcaaggaccagggcgacgatttccgcgagggcaagatgacgctcccggtgatcctcgcctacgcccgcggcgacgaggaagaacgcgggttctggcagcaggccatcgcgggagagcgttcctccgacgcggacctggcccatgccatttcccttatccggcggcacgatgcggtccatgcgacgcgcgaacgcgcccggatgtatgcgcagcgcgccatcgacgcgatctcgggcttcccggcaagtgcggcgaaggcggcaatgacggaagcggccgagttcgccgtcgcccgg

SEQ ID NO: 34313 - DNA, 1215 bp, Sphingomonas aromaticivorans
cacgtctggcttccctatacccagatgaagacggcacgcccgccgctgccggtggcttcagccgaaggggtgaagcttcgcctcgcggacgggcgcgaactggtcgacggcatttcgagctggtgggccacggttcacggctatcgtcacccgcacatcgaggaggcgatccggcgccagcttgaaaccctgccgcacgtcatgctgggcgggctggcgcacgaacaggcctatacccttgcgcggcggcttgcaggaatgctgccgggcgacctcgatcatgtgttcttcagcgattccgggtctgtcgcagtcgaggttgcgatgaagatggcggcgcagttctggctcaaccaagggcaccggcgcgtgaagttcctgtgcttccgtggcggttaccatggagacacctttgccacgatgagcgtgtgcgaccctgacgagggcatgcacagcctgttccgtggtgcgctgctggaacaggtggtggtcgacctgccaagggatgcggaaggcgaagcggcgcttggcgccttgatcgagcagcatcgcggggaactcgccgggatcgtggtcgagcccttggtgcagggggcaggggggatggtgttccatgacccgtttacgctccaggcgctgcggcggctcgcggatgagcatgagcttctgctgatcttcgacgagatcttcgtcggccttggcaggctgggcgatgcgatgttcgcctgtcagatcgcgggcgtgcagccggatatcgtgacattgtccaaggcgctgaccgggggcaacctgccgctcgccgccaccatcgccagcgggcgcatctacgacgcattcctctctgacgatccgatgcatgcgctgatgcacgggccgacctacatggggaatgcgctgggctgcgccgcggccaatgcctcgctcgacctcttcgagagcgagcccaggctggagcaggcgcaggccatcggacgcgggctcgagcaggcgctggaggtattgcgcggcctgccgggcgtgcgcgacgtgcgcgtgcgcggcgccatcggcgtgatccagcttgaccgaaccgcccccgccgaccgcctctccgcggcctgcatcgaccgcggcgtgtggctgcgcccgttccgcgatattctctacactacgcccccgctggtgacgggtgaggaagaccttgcgaggatcaccagcgcaatggttgaagcagtc

SEQ ID NO: 34314 - DNA, 1254 bp, Sphingomonas aromaticivorans
cgtcgtgtcgtcgtaaccggacttggactggtcaccccgctgggtgcggacgttgaaacagtgtggaagaacctgcttgccggcaagagcggcgcggggctcatcaccaagttcgacaccacggaccagaagtgcaagatcgcctgtgaggtgaagccggccgaccacgagtatggtttcgatgccggcaagcgcgtggaccacaagatccagcgccaggtcgatcccttcatcgtcttcggcatcgatgccgcagggcaggcgctcgaagacgcagggctcgccgacatggacgacgatctcaagatgcgcaccggctgctcgatcggttcgggcatcggcggcctgccgggaatcgagagcgaatcgatcatcctgcacgaaaagggccccggccgtgtttcgccgcacttcgtccatggtcgcctgatcaacctgatttccggtcaggtctcgatcaagtacggcctgatggggccgaaccatgcggtcgtcaccgcctgctcgaccggcgcacactcgatcggcgacgccgcgcgcatgatcaaggacggagatgccgacgtcatgctggccggcggcgccgagagcacgatcaacccgctgggcgttgccggcttcgcccaggcccgcgcgctgaactgcagctacaacgaccgcccgaccgaggcgagccggccctacgacaaggaccgcgacggcttcgtcatgggcgagggcgcgggcgttgtggtgctcgaggaatacgagcacgccaaggcgcgcggcgcgaagatctatgccgaagtcgtcggttatggcctgtcgggcgacgcttaccacgtcacggcgccgcatcctgaaggcaagggcgcggaactggcgatgcgcatggcgctgcgcaaggcaggtctttcggccggcgacatcgattacgtcaatgcccacggcacctcgaccatggccgacacgatcgagctggcggccgtgaagcgcgtgctgggcgacgacctttccggcgcttcgatgagcagtaccaagtctgccattggccaccttcttggcggtgccggcgcggtcgagacgatcttctgcatcctggcgatccgcgaccagatcgtgccgccgacgctcaacctgcacaatccggacgaaggcaccgaaggcgtggacctcgtcccgctcaaggccaagccccgcaaggtgcgcgcggcgctgaacaattcgttcggctttggcggcaccaatgccagtgtgatcgtcaaggcggtcgaa

SEQ ID NO: 34315 - DNA, 228 bp, Sphingomonas aromaticivorans
atgagcgataccgccgaccgcgttaagaagatcgttgtcgagcacctcggcgtcgaggctgacaaggtcaccgaagaagccagcttcatcgacgatctgggcgctgactcgctcgacatcgtcgagctggtcatggccttcgaagaagaatttggcgtcgagatccccgacgatgcggccgagaagatctcgaccgtttcggacgcgatcaagtacatcgacgaaaac

SEQ ID NO: 34316 - DNA, 1227 bp, Sphingomonas aromaticivorans
gtctgtgtcgtcggccttggctatatcggacttcccaccgccgccatcattgcccgcgccggctgccgcgtgctgggcctcgacgtttcgcagaaggtggtcgacacgatcaaccggggcgagattcacatcgaggaagtggacctcgacggtcttgtccatggcgtcgtccagcgcgggctgctgcgcgcctcgaccgagattgcgcccgccgacgtcttcgtgatcgcggtgccgacgcctttcgagaaggacggccaccacacgcccgacatttcctatgtgctggccgctgcgacgcaggtggccgccgtgctcaaggcgggcgacacggtgatcctcgaatcgacctcgccggtcggcacgaccgaacagatgcgcgacctgatggcggggctgcggccggacctgaagtttccgggcaagacgcgcgagacgcccgacgtttcgatcgcctattgccccgagcgcgtgctgccggggcgcatcctggaagagctgaccaacaacgaccgttccatcggcggcatcacgccgcgctgcgcacgcaaggcactggcattctacaagcgcttcgtgcgcggaacctgcgtgaccaccgatgcccgctctgccgaaatgaccaagctggtcgagaacgcctatcgcgacgtcaacatcgccttcgcaaacgagctttcgatggtcgcggaccgcatggggctagacgtgtgggaggtcatccgtcttgccaaccgccacccgcgcgtgaacatcctccagccagggccgggcgtgggcgggcattgcatcgcggtggacccgtggttcatcgtcgccggcgcacccgacgagacgccgcttatccgcaccgcgcgcaacgtcaacgacggcaagatgcatcacgtggtgaagaaggcgacggaactggtcgaagctcaccccggcgaaaaggtcgcgtgcctcggcctcgcgttcaaggcgaacatcgacgacttccgcgagagcccggcgcgctatgtcgcggcgagcctagcccggcgcttcggcagccgcgtccacatcgtcgagccctatgccggcaccctgccgcgcgaattcgagggcaccggcgcggtgcagatcgacgtcgacacggcgctggaggattgcggcgtgctgatcgtgctggtcgaccacgacgtgttcaaggtgatcccgctcgccgagcgcgcgggcaaggtggtctacgacacgcgcggcatctgg

SEQ ID NO: 34317 - DNA, 1185 bp, Sphingomonas aromaticivorans
gtcaccgtgctaggtctcggctatgtcggcctgccgctggccgtagcgctggccaagcgattcttcgtcaccggcttcgacatcgacgtcgaacgcatttccgagctgtccgaaggccacgaccgcacccgcgagatcgaacccgcgctgctgtcgatgtcgagcctgggccttacctgcgatgccggggtctgtccgccaagcgatttctacatcgtcaccgtgcccacccctatcgacgccgccaaccgccccaacctgcgcctggtcgaggccgcttcgcgcacggtcggccagatgcttccccgggccgtggccgaaggccgccagcccatcgtcgtctacgaaagcaccgtctatcccggcgtcaccgaggacatctgcggcccgatcctcgagcaggtctccggcctcaggtgcggcacggacttcttcctcggctacagcccggaacgcatcaacccgggcgaccgcgaacacaccatcgagcggataaccaaggtcgtctcgggccagacacccgaagtgctcgaccgcgtggccgacctctatggcgcgatcacttcgggcggcgtcttccgcgccgcctcgatcaaggccgccgaggccgccaaggtcatcgagaacgcccagcgcgacatcaacatcgccttcatgaacgagatcacgcaaatcttctcgcgcatggacctttcggtctgggacgtgctcgcggcggcgggcaccaaatggaacttcctgcccttcacccccggcctcgtcggcggacactgcatcggcgtcgatccctactacctctccgcgcgcgccgaagcgctgggccatgacccgcaggtgatcctcgccggtcgcggcgtgaacgacggcatggcgaaatgggtcgcgggcgagcttcacgcgcggcgcggcggcaagcccggctcggtcctcgtgctgggcctgacgttcaaggaaaacgtgcccgacctgcgcaattccaaggtggccgacgtcatcgccgaactgaaggccctgggccatgcggtcgacgtgcacgatccccacgccgataccgccgaggctctgctcgaatatggcctcgaactcgccggcgacgcgttcgagcagacctacgatctcgtgttcctcgccgtgccgcacaagtactacctggcagcaggcgcggaccgtatcgctgcgctcgtc

SEQ ID NO: 34318 - DNA, 1395 bp, Sphingomonas aromaticivorans
ccggtgcactttcaccccaagtaccatgccaccgcaaatcccgatcgcgcagccgtgatcatgggcggcagcggcgaggtgatgacctatgccgagctggaggcccgatcgaaccgcttcgcgcagctcatgcgcgcgcgcggattgcagatcggcgataccatcgcgctgtgccttgagaaccgtgccgactactttcccatcgcctggggcgcgcagcgcgccgggctggtctatgtcgccatatccagccgccttgccgcgcccgagatcgcctacatcgccaaggacagcggaagccggttgctgatcggctctgcctatacggcgccggtactcgacgaagtggcgaagctggaaccgggcgtgccgcaactgcggctcgataccgatggcccgctttcactcgacgcggcgatggcggaaatgccggatacccccatcgacgacgaacgcgccgggtgcgacatgctctattcgtcgggcacgaccggcaagcccaagggcgtgcgcatccccctgcccgaagacccggagatcggcgcggccaattccctcatggccatcgccaaccaggccttcggcatcggcggcgatgcggtctacctctcgcccgcgccgctctatcatgcggcgccgctgcgctggtcgatgaccatccaccgcttgggcggcacggtggtggcaatggagaagttcgatcccgaacacgcgctcgaactgatcgagaagcacaaggtgaccgacagccaatgggtgccgacgcatttcgtgcggatgctcaagctgccggacgaggtgcggtcgaagtacgatacctcctcgctcaagctcgcgatccatgccgccgcgccctgcccggtgccggtaaagcaggcgatgatcgaatggtgggggccggcgctgcgcgaatactacgccgggaccgaaggcaacggcttcaccttcatttccagcgaggaatggctgaagcggcccggatcggtcggccgcgcgctgcttggcaccatccgcatctgcgacgagaacggcgatgaggtgccgccgcgcaccgaagggcaggtcttcttcgagggcggcagcccgttcagctaccacaacgatcccgacaagacccgcgacgccaccaacaagcatggctggaccagccttggcgacgtgggctgggtggacgaggacggctacctgttcctcaccgaccgcaagagcttcatgatcatttcgggtggcgtgaacatctatccgcaggagatcgagaacctgctggtcacgcatcccaaggtggctgacgtggcggtgatcggcgcgcccgatccggacatgggcgaacgcgtggtggcggtggtccagccgcgcgacatggccgaggccgggcccgcgctggcggcggaactg

SEQ ID NO: 34319 - DNA, 1395 bp, Sphingomonas aromaticivorans
tcgcaacaaccgcagccgggcggcaatctcggcttcatcgggcttatcgtggcggttgccacgattggcggcttcatgttcggctacgattcgggtgccatcaacggcacgcaggacgggctcaagcatgccttcggactgggcgaagccgagcttggcctgaccgtcagcgcactcctgcccggttgcgcgctcggcgcgttcctggcgggacggtttgccgacatctggggccgccgcgcggtcatgatgatggcggcagcgctgttcattctctcggcgctcggctcgggggcagcgccctcggccatcgttcttgcagttgcgcgcttcttcgcgggcgcggcggtgggtgccgcaagcgtgctttcgccggcctatatctccgaagtcactccggcccacgtgcgcggacgtctgtcgagcgcgcagcaggtcatgatcatttcgggcctgaccggagctttcctcgcaaactactggctggctggggccgccgggtcctcgctcggtgcgttctggtgcggttatccggcatggcgctggatgttctgggtccaggcagcgccggccatcctgttcctcgtcacgcttctgctcatccccgaaagcccgcgcttcctcgtggcgaagggccgcaccgaagaagcccgctcggttctcgcccgtctgttcggcgatgccaccgcggacgccaagctcggcgaaatccgcgcctcgcttgccgccgatcaccagccgagccttgccgacatccgcaagccgggcggcggctggcgccccatcgtctgggtcggcatcggccttgccgtgttccagcagctcgtcggcatcaacgtggtgttctactatggcgcggtgctgtggcaggcggtcggcttttccgaggcggacgcgctcaagatcaacatcctttcgggcgtcgtctcgatcgcggcctgcctcgtctcgatcggcctcgtggacaagcttggccgcaagccgctgctgctgatcggttcggcggggatgaccgcgacgctgggcgcgcttgcctggtgctttgcgcaggcatcgaccggccccgacggcgcgcttgtcctgcccgagggcgtcggcaccatcgcgctctacgcggccaacatctacgtcgttttcttcaacatgagctggggcccggtgatgtgggtcatgctgggtgaaatgttccccaaccagatgcgcggatcggccctggcggtggcgggcgcggcgcagtggctggcgaatttcgcggtcagctcgagcttcccgtggctggcaggcaacatcggcctgcccgtcacttacgccgcctacaccctgttcgccgccatctcgctggtcttcgtctggacctcggtcaaggagaccaagggcaaggaactcgaggccatg

SEQ ID NO: 34320 - DNA, 1935 bp, Sphingomonas aromaticivorans
tggctcgatggcctgaacccgccccagcgcgaggccgtgacgacgaccgaggggccggtgctgatgctggccggcgcgggcaccggaaagaccgccgccctgaccgcacgccttgccaacctgctgcgccagcggctggcctggccgagcgagatcctgtgcgtgacctttaccaacaaggccgcgcgcgaaatgcgcgagcgcgtggggaacctgatcggaccggcggtggaaggcatgccttggctgggcacattccatgccatcgcggcgaagatgctgcgccgccatgccgaactggtcggactgcaatcgaacttcacgatcatcgacaccgacgaccagcttcggctgctcaagcagcttgtcgtggcggaaggcattgacgaaaagcgctggcccgcgcgccagctcgccgggctgatcgacaagtggaagaaccgggggctcaaccctgccgacctcgatgcgctggaaaacgaggcctatgccaacggcaagggccagcggttctatgcactctaccagaatcgcctgcgcgaactgaatgcctgcgatttcggcgacctgctgatgcacatgctcaacatcttccggcgcgaacgcgaggtgctggaaatgtggcagcagcgcttcaagtacgtgatggtggacgaataccaggacaccaacgcggtgcagtacctgtggctgcggctgctggcgcagaaccgcaagaacatctgcgtggtgggtgacgacgaccagtccatctattcctggcgcggcgcggaagtggccaacatactgcgcttcgaaaaggattttcccggcgcgaaggtgatccggctggagcagaactaccggtctaccccgcatatcctgggtgctgcatcggggctgatcgcggagaattccgagcggctcggcaagacattgtggaccgaggtcgacggcggcgacaaggtgcgcgtgatcggcgtgtgggacgcgccggaggaagcgcggcggatcggcgacgagatcgaacggctggagcgcgagggcgcgccgctcgaccgtgtggcgatactggtgcgcgcgcagttccagacgcggacgatcgaagacaggttcatccagatcgggctgggctatcgcatcgtcggcggtttccggttctacgagcgcgcggagatccgcgatgcgctcgcctacctgcggatcatcgcaagcccgcaggacgacctcgccttcgagcggatctacaatacgcccaagcgcgggcttggcgacaagacgctggagaagctgcaccgccacgcacgggcgcggagcattccgctgtcgctggcatcggtcgagatcctcgacaccgacgagcttccggcgcgggcgcggggcacgctggcagcactgatgcgcgacttcggccggtggcgcgatgcgtcgaagtcgctcgtcccggcggaactggcgcgcacgatcctcgacgaaagcggctataccgccgcccttcaggcggagaagaccgcggaggccgccggacgccttgaaaaccttaccgaacttgcccgcgcgatggaggaatacgagacgctgggggacttcctcgagcatgtcagcctggtgatggacaacgaggccgtggccgacgaggaaaaggtcacgatcatgaccatccacgcggccaaggggctggaattcgacaacgtgttcctgcccggatgggaggaaggcgtgtttccttcgcaacgctcgctcgacgaaggcggcctggcctcgctggaagaagagcgccgccttgcctatgtggcgatcacccgcgctcggcggcattgcaccatccttcacgccgccaatcgccagatctatggccagtggaccagttcgatcccctcgcgcttcatcggcgaactgcctgcggagcacatcgaggaagagaccacgctatcgggcggcgcatcgatgtggcgg

SEQ ID NO: 34321 - DNA, 1305 bp, Sphingomonas aromaticivorans
atctccgaaaacccggcggtccaggcgcagcttgaccgcctcggcgcgctgtcgctcccatcggggcggcttggcctagataccgcgcgcgaactctgcgcccggctcggcaatccgcaggaccgcctgccgccggtgttccacgttgcagggacgaacggcaagggctccacctgcacttacctgcgctacatcctcgaggccgagggcctgacggtccactccgccacgaagccgcacctcgtccgctacaacgaacgcatccgtctcgccggcaagctgatcgaggacgaactgctggcggacctgctcaaggaagtgctcgatgcgggcgcggacctcgagccgagcttcttcgaggtgaccaccgtcgccaccttcctcgcctatgcccgcacgccggcggacgcctgcgtgatcgagaccggacttggcggcaggctcgacgcaaccaacgtgatgcccacggcggctgtgtgcggcatcgccacgctggggctggaccacgaagccttcctgctctcgcccgaagatggtgtgcccaccgaaccgctggcgagaatcgccttcgaaaaggccagcattgccaagcccggcgtgccgctggtcacaatggcctaccccccgcttgccgccgatgaggtcgcgcgcaccgccgcccggctcggcgcaccgctcatcatgcgcggacgcgactgggacgcggaaatcgccggctcgatcctttaccgcgacgaacgcggcgaactgccgctgcccctgcccgccatgcccggcgtccatcaggcggaaaacgccgcgctggctgtcgccatgatccgccatcagaacgcggtgcaggtccatctcggcgcggtcggcaagggcatcgtcgatgcgcgctggcccgcccgcctgcaacggctgggccatggcccgctcggcgcgttggccggcaatcgcacgatctggctcgatggcggccacaatcccgatgcgggccgggccatcgcgcggcatctggaagggcagccgccggtccacttgatcatgggcatgctggcaaacaaggacccgtctgcgatcctcaggccgctggcggaccgggccctgtcgatctcggtcgtccccgcgccggggcacgacgcgcacaagccggaggacttcgcgccgttcacgagccttgcagtgggcagcttcgccaccgtgcccgaggcgctcgcggcgctcccgcctgaaggcgatgtcctgatcgtcggctcactctacctcgcaggcgaagtgctgcgcctgaacgaagagattcccgactgacctgccgttcgt

SEQ ID NO: 34322 - DNA, 759 bp, Sphingomonas aromaticivorans
ccggttcaccagttcacgatcgagacccttttcgggaccgatcactggtcgattggcggttacaacatcgctttcaccaactctgcgctgtggatggctatcaccactgccgtcctgatcgtgttcgttgccggcggcgccaagcgcgaactggttccgggccgttggcagatggcggtcgaggggctgaccggcttcgtcgacaacctgcttcaggcgaacatcggcaaggctggtcgcaagtacctgccttacgtgttctcgctgttcgcgttcatccttttcgccaacatgctcggcctgctgccgctggctctcgttggcgtgcatccgttcacggcgaccagccatttcaccgtcaccggtgtgctcgcgatcatgagcttcgccatcgtgctcggcgtcggctttgccaagcacggcctgcacttcttctcgcttttcgtgccgcacggtacgcccgtcccgatgatcccgatcattttcccgatcgagctgatctcgttcatggtgcgtccgttcagccttggccttcgtctcttcgtggcgatgatggccgggcacgtgctgctcgaagtgctctcgggcttcgtcatctccggcaccaatgccggtgtgggcaccttcttcctcgccgccgttcccagcttcctgctgatgatcggtatctgcgcgctggaacttctggtggcaggcatccaggcttacgtctttgccctgctcacctgcgtctatctgaatgacgccgagaaccttcac

SEQ ID NO: 34323 - DNA, 759 bp, Sphingomonas aromaticivorans
atgacgctagagatccaccagttcccgtgcctgtccgacaactacggcttcctcgtccacgattccgacagcggcgagaccgcgtgcatcgacacgcccgatgccgaagcctacctgcgcgaggcaaacgccagaggctggcggatcacgcagatctggaacacgcactggcaccccgaccatgcgggcggcaacgaggcgatcaaggcggcaaccggatgcaccgtcgtcgcgcccgaggatgacgccggcaagatcgcgggcgtggaccgcgccgtcgcgcatggcgataccgtgcagcttggcagcttcaccgccgaggtgatcgacgtcggcgggcataccatgggccactgcgcctaccacctgccggaagcctccgtcgcgttcgtcggcgacgcgctgttcccgctgggctgcggccgcatgttcgaggggacgccgccacagttctgggccagcctctcgcgcatcaaggccctgccccccgggacgacgctctacagcgctcacgaatatacccagtccaacgcccgcttcgcgcttcacgccgatcccgacaatgccgcgctgcgcgcttatgcggacggggtcgaagcaaggcgcgcgcgcggcgaatggaccgtgcccacgacgcttgccgccgaactcgcggcgaaccccttcctgcgcgccgatacgcccgggatggccgcgcgctggggcgggtcttcgcccgtcgacacatttgccgccctgcgcgccgccaaggatactttc

SEQ ID NO: 34324 - DNA, 531 bp, Sphingomonas aromaticivorans
accaccgacgatctcaagcgacttgtccgtaccgtcccggatttcccctcccccggaatcctgttccgcgacatcacgaccctgatcgcgcatggcgaaggtctctcggcctgcatcgaccacctcgcccacaaggcacgcgcggccggggcacaggccgttgcgggaatggaggcgcgcggcttcatcttcggcgcggcggtggctgcaaggatgggactgggcttcattccggtgcgcaagccgggcaagcttccggtcaagaccatcggcatcgactatgcactggaatacgggcgcgaccggctggagatcgatcccaccgccattcgcgaaggccagcgcgttgtgatcgtcgacgacctcatcgcgaccggcggcactgccctggccgcggccgaactgctccgcatggcgggcgcacatgtcacgcacgccctcttcgtgatcgacctgcccgaactgcatggcgccgaacgacttcgcggtgctggtttgaccgtcgaagcgctcatggactttccagggcac

SEQ ID NO: 34325 - DNA, 1533 bp, Sphingomonas aromaticivorans
tattttgcctatttctcagccactcacggcgacaagacctttattgtcgacggcgacctgcggctgtcctttgccgacgtctacaaggccgcgcgccacgttgcgggcggactggtcgaaggcatcgagctgcagaaaggcgagcgtgtcggtatcgcggcgcgcaattccgccaactggatcatcgcctacatggccgtgctcatggccggcggctgtgcgaccctgctcaatggctggtggcagggtgaggaacttgcacacggcatcgagctggtcagttgccgctacgtgattgccgacagcgcgcgcgcggcccggctcgaaggtcatgcccatggtgccaccgtgctcccgatgtcgcacgactgcggctatgagcagggccttgccgcgctgctcgccaggggcggaggcatggaaacgctcttgccggacctgaccggggacgatctggcgacggtcctgttcacctcgggttcgactggcacggccaagggggcctattccgaccatcgtggcgtcgtacaggggacgatgaactacgtctgccagtcggccgctatgctcgccatcctcaccgcccggggcgaggcgccggctcccgatgcgcagccgaccacgctggtcaacgtgcccctgttccacgtgaccggcgaagtcccggtattccttcagtcgttcgcgctcggtcgcaagctggtgctcatggccaagtgggatgcggtcgacgctatgcgattgatcgaaaaggaaaaagtctcctatttcgtcggcgtaccgctgatgagcttcgagatcgccacccaccccgatcgcgacaaatacgacctgtcgacctgcgtttccttcgcagccggcggggcgccgcgccccgtcgaacacgtcgaccggttgcgcaaggccttgccacacgccttcccgctcctgggctacggcctgaccgagaccaacggagtgggctgcggcaacctgaacgaaaactacctcgcaaagccgggtagcaccggcaccgcatcgcggccgctggtcgacctcgcgatcctcgacgatgccggcaatccgctgccgaccggcgaagtcggggaagtctcgatccgttcgatcgccaatttcctgggctactgggataacgagaaggccacgcgcgaggcgatcacccccgatggttacttccgcagcggggacctcggttatctcgatcccgagggctacctgttcatcgtcgaccgcaagaaggacatcatcatccgtggcggcgagaatatctcgtgcatcgaggtggaaagcgcgatctacgcccacccttgcatcgcggaagccagcgtgttcggcctgcccgacgaaaagttcggcgaagtgccggcggcggtctatcttgccaaggaaggctgttcggccaccgatgacgagttgcgcaccttccttgccgaacatatcgccccgttcaagattccggtgcgtttctgggaggtccacgaggcgctgccccgccttggcaccgagaaagtcgacaagcgcactttgcgcgag

SEQ ID NO: 34326 - DNA, 1113 bp, Sphingomonas aromaticivorans
atggcaaacgctccgcaactcccggcatctcctcagcccaaggactggatcctcggcattcacgcctatgtccccggcaagtcgaccggcaaggacgggcaggtgctgaccaagctgtcggcgaacgaaaatccgctcgggacaagcgccgccgcgctcgaagcgcgggcacatgcgggcgatccggcgcgctatcctgatcctgacagcaaggatcttcgcgccgccatcggcgaagtccacggcatcgatccatcccggatcgtcatgggcaccggttctgacgaactgctcaacctggccgcgcaggcctatgccggccccggcgatgaagtgctctacgtgcgctacggcttctcggtctacgacatcgccgcgcgccgctgcggggcagtgcctgtcgttgcgcccgacgccgattacggcaccgatgtcgatgcgctgctcgcctgcgtgaccgagcgtacgcgcgtcgtcttccttgccaatccgaacaacccgactggaagctggttgccccgcgaagaggttgcgcggctccacgcgggtctgcgctccgacatcctgctggtactcgacggtgcctacgccgagtaccttgatccggcgaacgatgatggcgccctcgacctggcggtcaccgcctgcaacgttctggtcacgcgcacgttttcaaagatatacggccttgccggggagcgtattggctggggcaccggccatccggccattgtcgatatgctcaatcggattcgcggtcctttcaacatctcgctgaccggacaggctgcaggccttgccgctgttcgcgatcaggcctttgttgaagcctcgcgccgccacaacgcacatcagcgcacgcggttcgtcggcaagctcgaagccctcggcaatcacggcgtccgcccgttgcccagccaggcgaacttcgtgctgatcctgttcgagggcaaggtgactgccgaagacgtttacctcggcctcatggactacggctacatcacccgctggctgccggggcagggcctgccccaggcgctgcgcatcaccataggcaccgaggcgcagatggacgagatcgccgatgccatccgccggatgtgcgaggctgca

SEQ ID NO: 34327 - DNA, 921 bp, Sphingomonas aromaticivorans
gcgatggcactggcgaagctaccacagcttgagagcgtatttctgactgatgccggccttgagaccgacttcatctttaaccgcggcatcgatctgccatacttcgcctcaatcaccctgcttcagtcgagcgatggaaagattgcccttgaagagtactttcgcggctttctcgagctcgctcggcgcatgcgatgcggcctgattctggaaagcgccacatggcgcgcaagcccggactgggctgaaccgctcggtttgtcgcagcaagagctcgatacgttgaacacgagtgcaatcgcgatcctgcgagatctgcgcgacgaatttggatcaaccatgcctgcagtcgtgatcagtgggtgccttgggccgaggggcgacgggtatgatcctggcaagatcatgtccgaggaaggagcggaagcctatcatcgccaccaagctgaggtactcgcctcggccggcgtggaccagttgaccgcgatcacgatgactaacgtgcccgaggcaatcgggattgcaaaggcagcgaagagtctggcggtaccagtcgcgatcagctttactgtcgagaccgacggaaggctccccaccggcgacaggctctctgatgctctgcgtgcggttgaccaggcgacggcttcaaccccggcctattacatgatcaactgcgcacatcccagccacttcgctgccgtactcgaggatggggccgactgggtaaaccggattggtgggttgagggcaaatgcgtctcggtgcagccatgccgaggtagatgccatgagcgagcttgatcggggcaatcctgaggaacttgcggctctgcattccgaacttcggctgcggtttccgcacatcaacgtgctcggaggctgctgcggcactgatcttgatcacatcaccgcgatcgcagag

SEQ ID NO: 34328 - DNA, 1053 bp, Sphingomonas aromaticivorans
aagattgcggttctgccgggcgacggcatcggtcccgaagtgacgcgcgaagcggtgcgcgtgatcgaggcacttggccttggcgacatcgagatgaaggaagccccggtcggcggcgcggcctacaaggcctatggccacccgctgccgcccgagacactggagatcgcgcgtctttccgacggcatcctgttcggcgcggtgggcgaccccgactgcgactcgcttgaacgccacctgcgcccggaacaggcgatcctcggcctgcgcaaggcgctgacgctgttcgccaacctgcgccccgcgcgggtgttcaagggcatggaagacttttccgccctgcgccccgaagtggccggcgcgatcgacctgctgatcgtgcgcgaactgaacggtgacgtgtacttcggagaaaagggcttccgcaccgccgccaacggcgaccgcgaaggctacgacgtcatgtcctacagcgagagcgaagtgcgccgcattgcccacgtcgcgttccgcgccgcgatgggccgcaagaagcgcctgtgctcggtcgacaaggccaacgtcctcgagaccagccagctctggcgcgacgtgatgctcgaagtggcgaaagactatcccgaagtcgcgctcgagcacatgtacgtcgacaacgccgcgatgcagctcgtccgcgctcccggcaacttcgacgtcgtcgttaccggcaacctgttcggcgacatcctttcggaccaggcatcgatgtgcgtcggctcgatcgggctcctggcctcggcctcgctcggcgaacgcgagaccgaatacggcacgttcggcctgtacgagccgatccacggctcggctcccgacatcgcgggcaagggccttgcgaacccgatggccacgatcctttcggcggccatgctgctgcgccactcgctcggcctcgaagtggctgcggaccgcatcgaggcggctgttgccaaggcgctggccgacggcgtgcttggccgcgaccttggcggaaccgcaggtacgacggaaattggtgacgcggtgcttgcaaggctg

SEQ ID NO: 34329 - DNA, 777 bp, Sphingomonas aromaticivorans
cagttgctgcccggcatggacggcgacgttcgcaaggaagcggccaagatcttcaagaagcagggcatggagctgaagctcggcaccaaggtgacgggcgttgcggtgaatggcgggacggcgacgctgaccgtcgaaccatcgaagggcggcgaagcgtcgacgatcgaggccgactgcgtgctggtcgccattggccgccgtcccaacgtggacggcctcgggctcgacaagatcggacttgaactgaacgcacgcgggcagatcgagaccgaccacgactttgccacgaagatccccggcgtatgggcgatcggcgacgtgatccccggcccgatgctggcgcacaaggccgaggacgaaggcatcgccgtggccgagaacatcgcagggcttaccggcatcgtgaaccatgacgtgatcccgggtgtggtctacaccatgccggagttcgcgggcgtggggcttacggaagaagcggccaaggaacgcggcgagatcaaggttggcaagtttccgatgctggccaacagccgcgcaaagaccaaccacgagccggacggtttcgtgaaggtcatttccgacgccaagaccgaccgcgtgctgggcgtgtggtgcatcgcgagcgttgccggcacgatgatcgcgcaggcggcgcaagccatggaattcggcgcgacaagcgaagacatcgcctatacctgccatgcgcacccgacccattcggaagcgctgaaggaagccgccatggcggtcacgggcaagccgatccacatg

SEQ ID NO: 34330 - DNA, 765 bp, Sphingomonas aromaticivorans
ggctgcggcaacatgggcggagccatgctcaagggctggcttgccggcggtctggcgccggaaaccttcaccgtggtcgatccctatctcgaagcggcgccgcacggcgttcgcctgctcgaagctgcgcccgccggcgaggatgcgttcgacatcgtcctgctcggcttcaagccgcagcagttgcccgacgcggcgcaggccgtgcgccccttcgtcgggccgcgcaccctgttgctgtcgatacttgcgggcgtcgacctcgccaccttgcgccgtactttccccgaagcgcgtgcaatcgtccgcgtcatgcccaacctggccgccgcgctaggcaagtccccgatcgcgctgttcggcgatgcggacgaggccgcccgtgccgagactgacgcgctgatggcaccgttggggcaggcggaatggctctcgggcgaggatcagatggaccttgtcaccgcgctcgctggttcgggtcctgccttcgtgtaccgcttcatcgatgccctggccgaaggcgctgccgctctcggcctgccgcgcgaccaggctgaccgcctggcgctgtcgatggtggagggttcggccatgctcgccgccgcctccgaacactcgccgggtgaactcgcgcgccgggtcgccagccccggcggggtcacgcaggttggcatcgacatcctcgacgccgagcgccgtcttgcgcgcctcgtggaggacaccttgcgcggtgcgcgcgaccgcagcgccgagatgacggagcag

SEQ ID NO: 34331 - DNA, 1584 bp, Sphingomonas aromaticivorans
cttggtgcaatgcaggactggaagctgcgcgttacgcacctgatcgatcatgccgcgcgcgagcacgggcagcgcgaaatcgtcagccgctgggcagatggcagcgaaagccgcacgacctgggcgggcatccgtcacgacgcattgcgcatgacgcaggccctgcgccgccttggcgtgaagccgggcgaccgcatcgccacgcttgcgatgaaccaccaccgccacctggtaagctggtacggttcggtcggcgtcggcgggattctccatacgctcaacccgcgcctgttcgacgaccagctcgaatacatcgtcaatcacgccgaagaccgcgtgatgctgttcgacaagcagtggacccccatcatcgagcgcatgaagtcgcgctggcccacggtcgaacattacatctgcttcgacagcagcgagcccgcgcttcatttcgaggagtggatcgcttccgaagacgggcagaccgaatgggccgacggcgatgagcgcgacccttgcatgctctgctacaccagcggcacgaccggcaatcccaagggtgtactgtacgaacaccgctcgaccgtgctccacgcaatgagcgcgatcagccccccgatcttcgggctcgattgccgttcggtcatgctgccgatcgtgccgatgttccacgcggcaagctggggcttgccctgggcgggcgcggcggcgggcgcgaagttcgtatattccgcggtcaatgacggcgcggtcctgtgcgacctgatgaaccgcgagaaggtgacctgttcggccggcgtgcccactgtctggctggcgctgctccagcatgtcgatgcccacaatggcggcgaaattccaccgaccctgcagaccatcgtctgcggcggctcggccatgccgcgcgcgatgatcgaacgcttcatgcgcgccggccgccgcgtggcccacgcctggggcatgaccgagacgtcgccgatcggcactaccggcgcggaaacgtggaactgggacgacctcagcttcgacgaaaaggtgaccgtcaaggcaatgcagggccgtccgcccttcggcgtcgagatccgttgcgtcgatcttggcgatcccggcaaggtgctaccgcgcgatggcgtgacggcgggggccttgcaagtgcgcgggccgtggatcgtcaagcgctacttcaaggccgaacaggatgcggtggccgccgggcagtggttcgacacgggcgatgtcggcgtgatccatccggacggaaccctgcaactgacggatcgcacgaaggacgtcatcaagtcgggcggcgaatggatcagttcggtcgaactggagaatgccgccatcggccacccggccgttgccgaggccgccgcgattggcgtctaccatcccaagtgggacgagcggccgctgcttgtcgtgatccgcaagccgggaatggacgtcaaccaggaggaattgcgaagctacctccagcagcacgtcgccaagtggtgggtgcccgatgcggtggcattcgtggaccagatcccgcataccggcaccggaaagatcagcaagaaggacctgcgcgaccagttccgtgac

SEQ ID NO: 34332 - DNA, 737 bp, Sphingomonas aromaticivorans
gacgggtatcacgagctggaaacgctgttcgcgttcgtcgatgcgggggatgagctgacggcgaagccggctcctgcggactccttgcgagtcttcggcgagtttggcggggcgctggacgatccgttcggtaacatcgtagccaggcgctcgggaccttgccgcatggcgagggctgggcggtgacgctggagaagcatctcccggtcgccgcgggcctcggtggaggatccgccgatgcgggggcggtcttccgcatggtggagcgcagccacggccttccggcagactggcatgcccgcgctgccaggctgggcgcggatgtccccgcctgtgtcgaaagcgcggcctgcatcggtcgcggcacgggaaccgaactcgaacccatccctaacgaccttgccggaacgccggttcttctcgtcaatccgcgcatcccgcttgcgaccggcccggtgttcaaggcctgggatggcgtggaccggggcgcgcttgaaggcgccaccgctcgcgaagtcgcctttgccggacgcaacgacctcgaggcgcccgcgctctcgctcgtgccggagatcggcgctgtcctcgttaccctgcgccagactggcggatggctcacgcgcatgtccggctcgggcgcaacctgcttcgcgctctacgacacgccggagcagcgcgatctggcgcaggccgcgatgccgccatcgtggtggacactggggggagccctgcgttga

SEQ ID NO: 34333 - DNA, 1008 bp, Sphingomonas aromaticivorans
ctctatgcggtgaaggccaatccttcggccgatctgctgcgcgtcctttgggattcgggcgtgactcactacgatgttgcgtcgatcgcggaagtgcgcctcgtgcgcgcgacgctgccggaagcgacgctttgcttcatgcacccggtaaaggcgcccgccgccatccgcgaagcctacgaacagcacggcgtgcgcgtgttcagcctcgattccttcgaggaactggaaaagatcaaggaagcctgcggctttgccgaggacctgacgctttgcgtgcgcctgcgcgtctcttccgattattcggaactcagccttgcatccaagttcggttgcgatctgaccaatgccgcggaactgctccaggcaacgcgtcaggctgcggattctctcggcgtctgcttccacgtcggcagccagtcgatgagcccgcatgcctatgtccaggcgctggagcgcgtgcgcgcggccatcgtcgacgcgtcggtcacggtcgacatcatcgatgttggcggcggctttccgtcgatctatccgggcatggaaccgcccccgctcgaagattacttcggcgtgatcgaccgcacctatgaatcgttgccgatttcctactcggcggaactgtggtgcgaaccgggccgtgcgctctgcgccgaatacaactcgatgatcgtgcgggtcgagcgccgtcgcggcgcggagctctacatcaacgacggcgcctatggcgcgctgttcgatgccgcccacgtcggttggcgcttccccgttcgcgtcctgcgcgaagaggtggcgaacgacggcgtggaaatcgagatggagcccttcagcttctacggcccgacctgcgacgacatggaccacatggaaggtccgttcgagcttccggccgacatgaaggtgggcgactacatcgagatcggcatgcttggcgcttatggcgcggctatgaagaccgcgttcaacggcttcggcgcaaccgaggtcttcgaagtctccgacgaaccg

SEQ ID NO: 34334 - DNA, 1032 bp, Sphingomonas aromaticivorans
atgggccagcaccccaaggtgatcgcggccatggaagaggcgttgcacaacgtcggcgcgggctcgggcggtacgcgcaacatcggcggcaacacccactaccacatcgagcttgagcacgagctggccgaccttcacggcaaggacggggcgctgctgttcacgtcgggttacgtctcgaacgacgcgacgctgtcgacgctcgccaagatcctgcctggctgcgtgatcttctcggacgaactgaaccacgcatcgatgatcgcgggcatccgcaactcgggtgcggaaaagcgggtgttccgccacaacgacgtggaacacctcgaacagcttctcgccgagaccgaccctgcgctgccaaagctgatcgcgttcgagtcggtctattcgatggatggcgacattgcgccgatccatgcgatctgcgacctggccgagaagtacaacgcgctgacctacatcgatgaagtgcatgccgtcggcatgtacggaccgcgcggcggcggcatcaccgatcgtgacgaggcggcccaccgcatcgacatcatcgagggcacgctgggcaaggccttcggcgtgatgggcggctatatcgcggcagacacgcggatcatcgacgtgatccgatcctatgcgccggggttcatcttcaccacctcgctttcgccggttctggtagcgggcgttctcgcatcggtccgccacctcaaggcgtcgagcgccgagcgcgacgggcagcaggcggcggcggcctacctcaagaaggcgttcgccgacgccggccttcccgtgatgccatcgaccacgcacatcgtgccgctgatggtcggtgatccggtaaaggccaagaagatcagcgacatacttctggcggagtatggcgtatacgtgcagcccatcaacttcccgaccgtgccgcgcgggaccgagcgcctgcgcttcactccgggaccgtcgcacaccgaggcgatgatggacgagcttaccggagcgctggtggaaatctggcagcgcatggaaatggaactg

SEQ ID NO: 34335 - DNA, 1095 bp, Sphingomonas aromaticivorans
ttctacgaactgctcgaagtggagcgcaccgcggacgacaaggtgctgaagtccgcttatcgcaagctggcgatgaagtaccacccggacaagaatcccgggtgcgcggattccgaagccaggttcaagcagatcaacgaggcctatgcctgcctctccgacccgcagaagcgggcggcctacgatcgctatggccacgccgcgttccagcagggcgccggtggaggagccgggggcggtggcttcggcgggggcgacttcggcgacatcggcgacattttcgagacgatcttcggtggcgccttcggcggcggcggccggcagcagccgcgccgtggggccgacctgcgctacgacatggaaatcagcctggaagacgccttccacggcaaggatgccgaaatcgaggtcgaggtttcgcagaagtgcgatccctgtggtggatcgggcgcgacgcccggcacgtccgcgcggcgctgcaacctttgtggcggccacggcaaggtccgtgcccagcagggcttcttcatggtcgagcggccgtgtcccaattgccacgggcgcggcgaagtgatcgaaaagccttgcaagcattgccgtggcgagggccgggtcgatgccgagcagcgattgcaggtcacgatcccggccggggtggacaatggcacccgcatccgccttgccggaaagggcgaggcggggccgttcggtgcgcctccgggcgacctctacatcttcctccacatccagcggcaccgggtgttcgagcgcgaaggcacgacgctgctgacccgttgcccgatcagcttcaccactgcggcgcttggcggcgagatcgagattccgggcctcgacggcaaggtccacgccatcgagattcccgccggcatccagtccggcaagcagttgcgcaagcgtggcgcgggcatgcccgtgcttcagggacgcggaattggcgatctcgtggtggagatccacgtcgagacgccgaccaagctgtccgcgcgccagaaggaactgctgcgcgagttccaggcgaccgagaccggcgaggaatgcccccagtcgaagggcttcttcgaacggatcaaggac

SEQ ID NO: 34336 - DNA, 1909 bp, Sphingomonas aromaticivorans
atggcaaaagttatcggcatcgacctgggtacgaccaacagctgcgttgcggtgatggacgggggcacgcccaaggtcattgagaactcggaaggtgcgcgcaccacgccgtcgatcgtcgccttcaccaaggatggcgagcgtctgatcggccagccggccaagcgccaggcggtgacgaacccggacaacacgattttcgcggtgaagcgcctcatcggccgccgctttgacgatccgatgacccagaaggacacggaactcgtcccctacaccatcaccaagggcaagaacggcgacgcctgggtcaaggcgggcgggcaggactacagcccttcgcagatctcggccttcaccctgcagaagatgaaggaaaccgccgaggcctatctcggcgagaccgtgacgcaggcggtgatcaccgttccggcatacttcaacgacgcgcagcgccaggcgaccaaggacgccggccagatcgcgggcctcgaagtgctgcgcatcatcaacgagccgaccgcggcggcgctggcctatggcctcgacaagcaggacggcaagacgatcgcggtctatgaccttggcggcggcaccttcgacatctcgatcctcgagatcggcgatggcgtgttcgaggtgaagtcgaccaacggcgacaccttcctcggcggcgaagacttcgacaccgcggtggtcgagtatctggcggacaagttcaaggccaaggaaggcatggacctgaagaccgacaagctcgccctgcagcgcctgaaggaagcggcggaaaaggccaagatcgagctttcgtcggcacagacgaccgagatcaacctgccgttcatcacggcccgcatggaaggcggcgcgaccacgccgctgcacctggtggaaaccgtcacccgcgccgaccttgaaaagcttgtcgccggcctgatccagcgcacgctcgatccgtgcaagaaggcgctggccgatgccggcatctcggccaaggagatcgacgacgtcgttctcgtgggcggcatgacccgcatgcccaaggtccgcgaagtggtgaaggacttcttcggcaaggaaccgcacaccggcgtgaatcctgacgaagtcgtggcgatgggcgcggcaatccaggccggcgttctccagggcgacgtcaaggacgtgctgcttctcgacgtgaccccgctttcgctgggcatcgagacgctgggcggcatcatgaccaagatgatcgaccgcaacaccacgatcccgaccaagaagagccaggtctattcgactgccgaggacaatcagcaggcggtgacgatccgggtcttccagggcgaacgcgaaatggcgcaggacaacaagctccttggccagttcgacctcgtcggcatcccgcccgcacggcgcggcgtgccgcagatcgaggtgacgttcgatatcgacgccaatggcatcgtcaacgtctcggccaaggacaagggcaccggcaaggagcagcagatccgcatccaggcctcgggcggtctttcggacgcagacatcgaccagatggtccgcgatgccgagaagttcgctgaagaggacaagaagcgccgtgcggcggccgaggcgaagaacaacgccgaaagcctgatccatgcgaccgagcgccagcttgaggaaaacggggacaaggtcgacgcgggcctcaaggccgagatcgaagcggccatcgccgaggcgaagacagccgtcgagagcggcgacatcgacgccatgaacgccaaggcgcaggccctgacggacaaggccatgaagatgggccaggccatctacgagaaggagcaggcaactggcggcttctccgggtgccgaagccccgaaggccgacgatgacgtcgtcgacgccgagttctcggaagtcgacgagaacaagtga

SEQ ID NO: 34337 - DNA, 420 bp, Sphingomonas aromaticivorans
gtgttcgtgctcaatggcccgaacctcaacctgctgggcctgcgcgagcccgagatctacggatcgcagacgctcgacgacatcgccggaatgctcgaggatcgcgcccgggaactgggcctcgaaatcgacatgcgccaatcgaaccacgaagggcacctcgtcgactggctgcacgaagcgcaggcgacgggcgcgaaggccgtgctggtcaacgcgggcgcctacacccacacctctgtcgcgcttcacgatgcgatcaaggcaatcaaggtgccggtgatcgaagtccacctttcgaacccgcacacgcgcgaaggcttccgccacaaatcctatgtcggcatggcagccaagggcaccgtcgccggcttcggcgcgaacagctacgtggtggctctcgaagccgtcgcacggctc

SEQ ID NO: 34338 - DNA, 1326 bp, Sphingomonas aromaticivorans
atcaagcgcctgctgatcgccaatcgcggcgagatcgcgctgcgcatccatcgcgcggctcacgaaatgggcatcgagacggtcgcggtgcactccaccgccgatgccgatgcgatgcacgtgcgccttgccgaccatgcggtctgcatcggcccgcccgccgcgaaggacagctatctcaacgtcgccgcgatcatctcggctgccgagatcacccatgccgacgcgatccatccgggctacggcttcctttcggaaaacgccaagttcgcggaaatcgtcgaagcgcacggtatcacctgggtcggtcccaagccagaacacatccgcacgatgggcgacaaggtcgaggccaagcgcaccgcgggcgcgctcggcctgccgctggtccccggttccgacggcgcggtgtccgaaatcgacgaggccaagaagatcgccgatgccatcggctatccggtgatcatcaaggcagcctcgggcggcggcggtcgcggcatgaaggtttgcaacagcgccgaccagctcgaaacgctgatgcagcaagccggcagcgaggcgaaggccgcgttcggcgatgccaccgtctatatcgagaagtatctcggcaacccgcgccacatcgaattccagatcttcggtgacggcaacggcaacgcgatccacctgggcgagcgcgactgctcgctccagcgccgccaccagaaggtgctcgaggaagcgccctcgcccgtcatctcggccgacgaacgtgcgcgcatgggcggcatcgtcgccaaggccatggccgacatggggtatcgcggcgcgggcacgatcgagttcctgtgggagaacggcgagttctacttcatcgagatgaacacccgccttcaggtggaacatccggtgaccgaggcgatcaccggcgtcgacctggtgcgcgaacagatccgcattgccgatggcaagccgctttcggtcacgcaggacgagatcgagttcaagggacacgcgatcgagtgccgcatcaatgcggaagacccgttcacatttgccccctcgccgggactggtgaagagctatcacgcagcgggcggcatgcacgtgcgcgtcgattcaggtctctacgccgggtacaagatcccgccgtactatgactcgatgattgccaagctgatcgtctacggccggacccgcgaaggctgcatcatgcggctgaagcgcgcgctcgaggaaatggtgatcgaaggccccaagacctcgatcccgctccaccagcgcctgctgagccagcccgacttcctcagcggcgactacacgatcaagtggctcgaggaatggctg

SEQ ID NO: 34339 - DNA, 754 bp, Sphingomonas aromaticivorans
ctcgataaccgcgcggcagtcgtcactggtgcggcggacgggatcggcgaaggcatcgcccgccgcttcgccgccgagggcgcggccgtcgtcgtcgccgactatgacgacgaacgcggtcccgccgtggcgcgcgacttgcgcgggcttggcgcacgggcggagttcattcgctgcgacgtcagccggcgcgaggacgtgatcggtgcggtcgatctttgcgtcgagcgcttcggctccgtcgatatcctcgtcaacaatgcctatcgcggcgaaggcccggtgcggatcgagaagaagaccgacgagcgtttcgacgaggcgctcaggatgtgcctcttcgccaccaagtgggcgatggagcgcgcgctgccgcacatgaaggcgaaaggctggggccagggtgatcaacatggcctcgctcaacggcgtaaacgcgcacatgggcagcgccgactacaatgtcgccaaggaggccgtccgcgcctattcgcgcaccgccgcgcgcgagtgggcgccatatggcatctgcgtcaacgtgatctgcccggctgcggtctcggcggcctatcgccggttcgcggaaatggcgccccaggtcgccgcggcaaccgccgcagccaacccgatgggccgcatgggcgatccggaaagcgatatcggcggcgtcgccgccttcctcgccagcgaagacgcgcgctacctgactggcaacacgctcttcgtcgatggcggcgggcacatcaacggcgtg

SEQ ID NO: 34340 - DNA, 777 bp, Sphingomonas aromaticivorans
cttgcgggcaaagccgccatcgttacgggcggggcgcggggcgtcgccaagggcgtagccgccgccttcgtgaaggccggcgcgaaagtgctgatcgtagaccgcgaagccgagctgggcgaggccacggcggccgagctttccgcgttcggcgaagtcgcgttcatgcaggtcgacctgatggaccgcgaggcgctgcccggcgtggtggaggaagcggtccgccgtttcggccggctcgacacgctggtgaacgcggcgcaggcctcgcaacagctcctgctcaaggatactacgaccgaggccatgaaccttgcgttcggcacgggtttctgggcaacgttcctgctgatgcaggcagcctatccgcatctcgtcgcgtcgcacggttcggtcataaacttcggcagcggcgccgggatcgagggaatgccgacgcaggcatcctatggcgcggcgaaggaagccatccgcagcctttccaaggtcgccgcgaccgagtggggccccgagggcgtgcgcgtgaacgtgatctgccccttcgccaattcgccgggcgtggagctgtggcgccagcacttccccgatgcctatgccggccagatcgccaaggtgccactgcggcgcatcggcgactgcgagaccgacatcggcgcggcagcggtgttcctcgccagcgaggcagccggatacattaccggccagacgctcatggtcgacggcgggcaggtgaaatccttctgacgctgcctgttgcacgtccccggggaccgatca

SEQ ID NO: 34341 - DNA, 711 bp, Sphingomonas aromaticivorans
gtcatcacaggaggcgcatcgggcatcgggctggcttgcgccgatgctcttgccgccgttgggcgtccggtcgccatctgggacatcaacgcgcaaggcgcgcaacgcgaggcagagcggatttcggagcagtatggctgcaaggcgatcggcctcgccgccgatctgcgcgatccgcaaggcgtcacgccggctgcgctggccacgcgcgaagcgctcggtccggttggcggcatcgtccacgcggcggggacggcggtccagaccggcatcatgggcgcaacgcccgaagtgttcgacgcggggatggcgcttcacgtgcgcgcgctgctcctgcttacccaggccttcatggaggacctgaaggcgaatcccggcagcgcgatcgtggcggtatcgtctatcaacgcctggttcggcaatgccatgatcccgatctatacggcggccaagggcgcggtcatctcgctcgtgcggtcgatggccgacgagctggccgggtccggcatccggatcaacgcgctcagcccgggcatgatcgacacgccgatccttggcgagatgcgcgatgggatggagcaggtcttcggcccgcgcatcttcctcggccgcttcggtgaaccgcacgaaatcgcgcgaactgtccgctttcttctttcggacgaagcaagctacatcaccgcaacggaaatcgtcgtcgatggcggcatc

SEQ ID NO: 34342 - DNA, 747 bp, Sphingomonas aromaticivorans
atggaactgaacggcaaggtcatactggtcaccggaggtggcagtggtattggtgcggcaacgtgccggttgctcggcaaggccggggcgcaggttatcgtggcagaccgcgccggtgcgcgcgcagaggcggtggcggccgacatacccggtgcctggggtgtcgtggtcgatgtcgtggacgcggctgcgtgcgaagcgatggtcgaaggcattcgcgagcggttcggccggcttgacggtgcgttcaacaatgcgggcatcaccgaggtaacagcgctgggcggagcgccgatccccgaaacgcacgcgctccctcttgaagtatggcgcaaggtgctgtcggtcgatctggacggcgtgttcaactgcctgcgcgcagaaataccgctcatgctggcatcgggcggcggggcgatcgtcaacacgacgtcgctccaggcgcatatcagctatccgcgaacggcggcctataccgcagccaagcacggcgtgctgggactgaccaaggcgatcgccaaggaatatggcgagcagggcatccgctgcaattcggtgtcgccgggggtggtggataccccgctgaccgcgggcgtgatccattccccgcagtacaaggacatgctgctggcgccgatcccgctgaagcgtttcgcgacgcccgaggacatcgccaaggcggcactctggttgctgtcggacgaatctgcatacatcaacggggcgacactcgccgctgacgggggt

SEQ ID NO: 34343 - DNA, 768 bp, Sphingomonas aromaticivorans
atgctggaagacaaggtcgtcatcgtcaccgggatcggtcctggtcttggtcgcacgatagcgaccgaggcggcgaaaatgggcgccgacgttgcgatggtgtcgcgctcgggcgggatcatggacgaggtggcggcggacatcgccgctgcggggcggcgagcgctcaccatccgcgccgacattacatctgacgcggactgtgcccgggtggcgcaggaaaccgtggccgcgttcggacgcatcgacgggctcgtcaacagtgcctacttccccggtcgcctcgccccggtactcgatctcgacctcgatgcgctcggccgtgcgttcgaggtgaccgtcatgggcactatccgcatgatccgtgcagtcgtgccgcagatggagaagcagggaggcggctccgtcgtcaacgtgggcagccaggtggcgcgcaaggtcgtcccgcagcagggcgggtacgccgcgaccaaggcggcacaggcttcgctcacccgctatcttgcggctgaactgggttcgaagggcatccgtttcaacacaccggccatcggctggacgatgagcgcgccggcccgcgcctggttggagagcgaggcggaaaagggcgggccaagcttcgaggaagccgaagcggcgatctcggcgacgatggcgcttggccgggtgccgagcgatgaggagtgtgcgcgaggcatcctcgttttcctctcggatgcgctgtcctcggtgaccggcgcgacgctcgatatcaacgcgggggactac

SEQ ID NO: 34344 - DNA, 759 bp, Sphingomonas aromaticivorans
atgatccaccgtttcgccggaaagcgcgttctcctcaccggtggcgcatcgggcattggccgcgccaccgcagaacgctttgccgccgaaggcgcgagaatcgtgatcggcgacgtggacctcgaaggcgcgagtaccgttgctcagtcgctcggcggcaaagcgttttcctatgacgcgcgcgatcctgcggcagctggtggtctggtgacggaggccgttgaggtactaggcgggatcgacatcctgctcaacgtcgcgggcataatgacctggggccggttcgaggaaacctcgccgcaggcatggcaacgcacgatggacatcaacctctccggaccgttctttctgatccaggcctcgatcccgcacctcaaggcatccaagggcaacgtggtcagcgtcgcgtcggccggcggtctccatcctgtatatggcacttcggcctatggcgtgagcaaggcaggcgtgatcgcgatcacgcaatcggcggcgctggaatttgcgcgcttcggcgtccgcgcaaacgcggtggcgccaggcggcgtggcaacgccgatgcacgaaaaatcctctgcgggaggcggcgtcgatccggccatcttcgcggaagccgccggacgcaacatgcccaagcttaccgaccgccccgcctgcacgcccgaggaagtcgcggcggcaatcgcctacctcgccagcgacgaggcgcgctacgccacgggcaccgtgctcgtgctcgatggcgggcagatcaccggc

SEQ ID NO: 34345 - DNA, 795 bp, Sphingomonas aromaticivorans
atgtttcacaagttggccgtctcgcgtgcggtcgagacgttgatgttgcgccacacgcgggaagagcgcttctccggttggtggcatccgggtgaggggcaggaagccgcgccgatcggcgccacggctgcgctcgaagctgacgattacgtctggtatcagggccgcggctgcgcctgggcaatcggaaagggcatggacccgctaccaatccttggcgacctccttggcaagacgaatggcgcaacgggcggcaagggtggtggagtcccgcactgggcagactacagccttggcatcatgggcgagggcgcgacgcttggttccgtctatccgcttgcggccggttctgcccttgcctcgaagatccgcaaggacggccgtgtcagtctcgccaacttcggtgacggcactgcctcgcgcgggacgttccatgaaaccatgatgcacgcggccgcttggaagttgccactgatctacttctgcgagaacaacggcctccttgtcggcacgcggaccgagcaggtctcggcgaccgccgacatcgcgaaccttgccaagggctatggcattcccggggtgatcgtcgacgggcaggacgcggtcgccgtctgggaagcaacgcgcgaagcggcggcccgcgcccgggccgggaaggggccgaccctcatcgaggcaaaggttacccgcaagcacggccactacgccggcgatcctcagcactatcgcgacccggactatctcagggattatcgcgatccgctggaccttctcgccgcaaggctggccggaaac

SEQ ID NO: 34346 - DNA, 1055 bp, Sphingomonas aromaticivorans
cgatgcggaagtggctgccgcttatgaagcggccagagctgcgcccgaacccgatgtctcggtgatcgagagggacctttaccatgtcgtctgaaaccatgggttacaacgccgcgatggggcttggccttgtcgaggagatgcggcgcgacgacagcatcttcatcatgggccagggcgtcgtcaccggcggctggttcggcatggagaagggcctggtcgcggagttcggcaacgaccgggtgcttgactgcggcattgcggaagcattcgaggcgggcctggccgcaggtgctgccatcgccgggatgaaacccgtcatcaacatgggctttggcgactttgcgttgatcgcaggcgacgagatctatcacaagctcgccaagtggcgttacatgcacggcctcgacgtgccgatgacggcggtcatcatattccccatcggcgcgatgggcggggcagggccggagcattcgtcgtgcacggaagtcctcggcatgcatttcccagggctcaaggtggtggtgccgtccaccgcggaagacgcaaaggggctgatgaaggccgcacttcgcgagccgaacccggtccttttccactcggtccaggggcttggctggagccgaggcgacgtaccgctcgacccggatttcgtggttcccatcggcaaggccgtcacgcgccgccggggggctgacctttccatcgtcacctatggctcgatggcgccgcgctcgctcaaggctgcagaacgcctcgccagcgagggcatagacgccgaagtcatcgacttgcgcagcctcgtgccgctcgactgggaacacgtcctcgagtccgtgtcccgcacccatcgcgcaatggtcgtccacgaggccttccgcaccgccggaccgggcgcagagattgccgcgcagatccaggagcgcgccttcttcgatctggatgcgccggtgctgcggctgggagcacgggacttccccctctgccagaacgccgatctcgaacaggcggccattccatccgtcgatgccatcgccgccgaagctcggcgtcta

SEQ ID NO: 34347 - DNA, 1209 bp, Sphingomonas aromaticivorans
gaactgcgcatcccccgcatgggctctgtcgagaacgcgcgcctgttgaactggcgggtccaggaaggcgaggcttacgaacccggccaggtgctttacgagatcgaaaccgacaagacttcggtggaagtcgaggccgaaggtcccggtgttctggcgcgccaccttgccgccgtgggcgacgagttcaaggttggcgatcgcatcgggctctgggcgctgcccggcacggcccccgctactctgcgcgccgctctgtccccgcagccgatgcctgcatcggagcctgcgccgtctccgtcatcaacgttgcccgctgcggtcagcgcccccggcctgcatgctctccggccagtctccagggatgccgctggcggccgccgcgtatcgcccttggcccgtcggctcgcggcgcagaatggcgtcgacctggcgaccgtgacgggcacggggatgggcggcaagatcagcggcaaggatgttctggctgccagcgccaagccccggcccgcgcctgttcccgtttccccgccccggcccggaagcgatggcgagatcgtcccccattcgctccgtcgccgcacgatcgcccagcggatggtcgaagccgcggccatccccacgctgactgccgatatggaggtcgatcttacggcgctcttcgcgcgcaggaggtccgtcgaggggaacggtgcttctgtcctgggaatgatcgccgaagccgccatcgcggcgcttctccagcatcggcgtctgaatgcgcattggcgggaggacgcgatggtccagtttggggcggtccacctcggcattgccgtcgatacgcccgaaggcctggtcgtccccgtcgtccgcaatgccgaaagcctcaacgcgcgcggcctcacggatgccatcgcggcgttggccgacaaggcacgcgccggtacccttcgcccgcaggatatggagggcggcacgttcaccatctcgaacccgggatcgatgggcccggtcgtgcgcgccgaggcgctgctcaatccgcctcaggtcgcgcttctgggcctgcccgggatcgtgcgcgcgccggttgccatcaaggatggcgatgcatgggccatggccgtccgcccacttctgcgtctttccctttcgtttgatcaccgcgcactcgacggaggcccggtgattgcgttcctcaatacgctgaaggcaacgctggaacggccg

SEQ ID NO: 34348 - DNA, 756 bp, Sphingomonas aromaticivorans
atcctcaaggacaaggtcatcatcgttaccggcgcagggccgggcatggggcaagccgcgtgcaagggcgcagcgcgcgaaggcgcaaaggttgtcgtgaccgcgaggtcgaagcaggcgatcgaggaagtggcgcaggaaatcgttgcggcggggggcgaggccatagcggtgccgctcgacgtgaccgacatggaccagtgccgggcggcggcaaaggcggcggtagacaagtggggccggatcgacggcctcgtcaattcggcctactatcaccctgactgggcgcccttgatcgaacacgacgtggatcaggtgcttcgtgcatttgacgtgggtgcggccggcgcgctgcgcatgtgcatggcggtttacccgacgatgaaggcgcagggcgccggctcgatcgtcaacatctccacgctctgcacccgcaagccgatgcccggcgaaggcggctatggcatggccaagggcgcactgaaccacatgacccgccatctcgcggtcgaattcggcggcagcggcatccgcgtcaacacggcactgatgggctggatgatgggagccccgctagaaggcttcatggaaacgctgggcaaaggagccgaggccttccgcaagcagcgggcgagcgagattccggtcggccacatcccgcccgacgcagactgcgccaaggccgtctacttcctgctgtcggactacagctcggaagtgacgggcgcgatgctcgacgtgaacggtggcgactgg

SEQ ID NO: 34349 - DNA, 975 bp, Sphingomonas aromaticivorans
aaggatgtggggctggcgccggagagggcggcagcgctgttccggtcgcaagcgctgtcgcgccagcttgaccggctcagccgcaaattgcaggcgcggggcgaggggttctatacgatcggatcgtcgggccacgagggcaatgcagtgctggccgaagtgctgcgcatggatgacatggcgttccttcactatcgcgacgccgcgttccagatccaccgcgcccaccgcgtgccgggcgagaatccggcgtgggacatgctgctgagcttcacggccagcatggaggacccgatttcgggcgggcgccacaaggtgctgggatccaagcggctgttcattccgccgcagacgtcgaccatcgccagccacttgcccaaggcggtgggcgcggccttttccatcggcatcgcgcgcaggatgggattcgacgacaccgtgctgtcgaaggacggggtcgtgctgtgcagcttcggcgatgctagcgcgaaccattcgaccgcgctgggcgcgatcaacactgcgtgctgggcggcgtttcagggcacgccaatgccgatcatcttcctgtgcgaggacaacggcatcggcatctccacacgcacgccgccgggatggatcgaggcgaacttctcgggcagggcggggctgaactacattccctgcgacggatcggaccttgtcgatacctgcgcggccgcaagacaggcactggagatcgcgaggcggcagcgaaagccggtgttcctgcacatgaagacggtgcggctctacggccacgcgggcaatgacgtgcagcttgcctatcgcagcaaggaggagatccgagccgaggaagagcgcgatccgctgctggcgagcgcggccttgctgatcgaggaaggcgtcatgtcggcggcgcaggtgcgcggcgtctatgacgagatcgaggccacgctggaacggcaggtggagcttgccatcaagcgccccaag

SEQ ID NO: 34350 - DNA, 990 bp, Sphingomonas aromaticivorans
catatggcgaagctcatcagttgggccatggcggacctgctgttgcagtaccccaacgcgatcgtctgcggcgaggacgtggggccgaagggcggggtctatgccgcgacgcaaaagctgcacgcgcggttcggatcggcgcgggtgatcaataccctcctcgacgagcaggcaattctcgggcttgccatcggggctgcgcacaacgggctgctgccgatgcccgagatccagttccttgcctatgtccacaacgccgaggaccagatccggggcgaggcggcgacactctcgttcttttcgaacgggcaatacaccaacccgatggtcgtgcggatcgcgggcctgccctaccagaaggggtttggcgggcacttccacaacgacaactcgctggccgtcttccgcgacattccgggcgtggtgctggcggtgccgtcgaacgggcgcgatgccgtggcgatgctgcgcgaatgcgtgaggctggcgcacgatgaagggcgcgtggtcgtgttcgtggagccgatcgcgctctacatgacgcgcgacctgcatgagccgggcgatggcatgtggtcgagcgtctaccaaccgccgggcgagggagagatcgcgtttggcgagatcggcgttttcgactctgggcgaggcgaaggcaccgacctggccgtggtgacctatggcaatggcttttacctttcgctccaggcgcagaagttgctgtcagagcgcggcgttaacgtgcgggtgatcgatctgcgctggctggggccggtgaacgaggcggcggtgctcgatgcggtcgcgccgtgttcgcgcgtgctggtggtggacgaatgccggatcaccggggggcagaacgaggcgctgatggccctgctggccgagcgagcgccgggcaaggccatcgcgcggatggcggcgaccgacagcttcatcccgctcgcgcgcgcggcaacgcatacgctgccgagccgggacgggatcgtg

SEQ ID NO: 34351 - DNA, 1170 bp, Sphingomonas aromaticivorans
atggctacagcctatatcgtcgatgcggttcgcacggcaggcggtcggcgcgggggcaggcttgcgggcgtccatccggtggacctcgccgctcgcagcctcgatgcgatcgtcgcgcgcaccggcatcgacccgaccgcggtcgacgacgtcatcatgggctgcgtcacccaggccggtcagcaggcaatgcaggtgggccgcaacgcggtgctcgcctcgaagctgctgccgcagtcgacgccggccgtcaccatcgaccgccagtgcggttcttcgcagcaggcgatccagttcgcggcgcaggctgtcatgtctggcgtgcaggatatggtcatcgcggcgggcgtcgagagcatgagccgcgtgccgatgggctccaacgccacgttccacatgaaggaggggctcggtcactacaagtcgccggggctggaagaaaagtatcccggggtcatgttctcccagttcatgggcgcggaaatgatcgtgaagaagcatggcttcaccaaggacgatctcgaccgcttctcgctggacagccatcgcaaggcgattgcggcaaccaatgcccaggccttcgcgaacgaaatcgtgccggtagagatcgagacgcccgaaggccccgcaatgcacaccgtggacgaaggtatccgcttcgacgctacgctcgagggcatcgccggcgtcaagctgctcagccccgaaggctcgctcaccgctgccagctccagccagatctgcgatggttcgagtgccgtgctggtcgtgtcggaagctgcgctcaaggcgcatggacttaccccgctggcgcgcatccacaatctgacagtgaccgcgggcgatccggtgatcatgctcgaagagccgctcttcgccaccgatcgtgcattgcagcgcgcgggcatgaagatttccgacatcgacctatacgaagtgaacgaggcgttcgcctccgttccgatggcttggctgaagcacaccggcgccgatccggaaaagctcaacgtcaacggcggcgcgatcgcgcttggccatccgctgggcgcttcgggcagcaagctcatggcgacgctcgtccacgccctgcgcgcgcggggcggaaagtacggtttgcagacgatgtgcgaaggcggcggcgtggccaacgtcacgatcatcgaggcactt

SEQ ID NO: 34352 - DNA, 783 bp, Sphingomonas aromaticivorans
ttaccccagatgaagctcgacaataccgttgccgccgtcgtcaccggcggcgcatccggcctcggcgccgcgaccgcccgcgcgcttgccgccaagggcgtgaaggtcgccatcttcgacctccagaaggaaaagggcgaggccgtggctgccgaaatcggcggcgtgttctgcgaagtgaacgtgaccagcgacgaaagcgtcgatgccggcttcgccaaggcccgcgccgcgcacgggcaggagcgcatcctcgtcaactgcgcgggcaccggcaatgccatcaagaccgccagccgttccaaggaaaccggcgagatcaagcacttcccgatggatgccttcaactggatcatccagatcaacctggtcggcacgttccgctgcatcgccaagtcggcggccggcatgatgacgctcgacccctgcgacgagtttggcgagcgtggcgcgatcgtgaacaccgcttcggttgcggcggaagatggccagatgggccaggccgcctactcggcgtcgaagggtggcgtcgttggcatgaccctgccgatcgcgcgcgacctgatgagcgagggcatccgcgtcaacaccatcctgcccggcatcttcaacaccccgctgcttcagggcgcgcccgacaacgtcaaggccgcgcttgccgcctcggtcccgtttcccaagcgcctcggccagccggaagagtatgccaatctcgccttgtgcatgatcgagaccggctatttcaacggcgaggacgtccgtctcgacggcgccatccgcatg

SEQ ID NO: 34353 - DNA, 876 bp, Sphingomonas aromaticivorans
ttttccggctcgattccggcccttgtgactccttttcgcgatggagcgttcgatgagaaggcgttccgccgccttgtcgactggcagatcgagaacggctcttcggcgctcgttccctgcggcaccaccggcgaggcttcgacgctttcgaacgccgagcatcaccgcgtcatcgaagtctgcgtggaacaggcggccggccgcgttcccgtgatcgccggctgcggcagcaatgacacgatgaatgccttgctgcacatgaacttttccaagaagtgcggtgcgcaggccgcgctctgcgttgcgccctactataaccggccgagccaggctggcatcattgcgcacttcagctacctggcggagcacaacgacctgccgatcgtgctctacaacgtacctggccgcaccgtgaccgacatcctgccggagactgtgtgcgaactcgccaagcgctatccggacaagatcatcggcatcaaggatgccagcggcgatctgtcgcgcgtgaccgaccaccgcatggggatcggcaagcatttctgccagctttccggcgacgacgagctggcgctgcccgccaatgccgccggggcggtcggttgcatctccgtcacggctaacgtggcgcccaggctctgcgccgatttccaggctgcctgcgccgcgaacgatctggagaaggcgcgagaactgaacgacaagctctatccgctgcattacgccatgttcgaggacgcttcgccggggccggtgaagtacgcgctgagccgggtgttcgcggacatcaacgaagacctgcgccttccgatggtcccgtgcaacgaggctgcccgcaaggctgtcgacgctgcgctggtccacgccggactgctc

SEQ ID NO: 34354 - DNA, 747 bp, Sphingomonas aromaticivorans
ctcttcgaccttaccggcatgaccgccctcgtgacgggcgcggccggcggcatcggctcgtcgatctgccatgcgctggcccggcagggtgcgcggatcgcgctttctggcacaaatccggccaagctccgcgcgttccgcgaggaactgaacgacacttacggcaacgaccatgtcgagatcacctgcgacctctcgaacaccgagcaggtcgagcatctcgtcccggcggcgctcgacacgctgggcaagctcgacatcctcgtgaacaacgccggcatcacccgcgacaacctggcgatgcggatgaaggacgaggaatgggacgcggtgatccgcgtgaacctcgaggcggccttccgccttatgcgggccgcgaccaagccgatgatgaaggcgcgtttcggacgcatcgtgaccatcaccagcgtggtcggcgccaccggcaaccccggccaggtcaactacgccgccgccaaggctgggcttgtcggcatgtcgaagtcgctgggccaagaactggcaagccggggcgtcacggtaaactgcgtcgcgcccggtttcatccggacggcgatgaccgacgtgctgcccgacgggcagaaggacgctctcaacgcccgcattccgatggggcgcatgggcgagggaagcgacatcggcgcggcggttgcatacctcgcgtcgaaggaagcaggttacgttaccgggcagacgctgcacgtgaacggcggcatggcgatgatt

SEQ ID NO: 34355 - DNA, 927 bp, Sphingomonas aromaticivorans
gcattcgtttttccggggcagggcagccagaaggtcggcatgggtcttgaactcgccgaagccagcgcggcagcccgcgaggtcttcgaggaggttgacgacgcgctgggccagaagttgttccagatcatgaaggacggcccggaagacgctttgacgcttaccgaaaatgcacagcctgcaatcatggccaacgccatcgcggtgcttcgtgtgctcgagcgggagggcggcatcaccctggccgacaaggcggacttcgtcgccgggcacagccttggcgaatataccgcgctttgtgcggcaggggcattcagcctttccgacacggcccgacttctgaagttgcgcgggcagtccatgcaggcggcggtgcctgtgggcgagggcgcaatgtgcgcgcttcttggcgcggacatcgagaaggcaacggcgctggccgaggccgccgccgaaggcgaagtctgcaccgtcgccaacgacaacgatccgacgcaggtcgtgctgtccggccacaagggcgcgatcgagcgtgcggtcggcctcgtcaaggagcacggcatcaagcggggcgtgctgctgccggtatcggcaccgttccactgccctctcatgcagcccgcagccgacgcgatggcagaggcgttcgagaagacgccgcctggacccctgcgcgtcgcgctgttcgccaatgtcacggcatcgatcgtgaccgatccggcagaggtgcagcgcctgctggtcgaacaggtaacgggccgcgtgcgctggcgcgaaagcgcgatcgcgatgcgcgaggccggcgtcgatcagttcatcgaacttggcggcaaggtccttggcccgatgatcaaccgcaccgttgcggacgtctccatcaccagcgtcgtcggcatggccgacatcgaagccatcctgaaggagctc

SEQ ID NO: 34356 - DNA, 1008 bp, Sphingomonas aromaticivorans
taccgggttgtagtggtcggtgcgactgggaatgtgggccgcgagatgctcaacattctggccgagcgcgagtttccctgcgacgagatcgcagcggttgcttcgtcgcggtcgcagggcaccgagatcgagtttggcgagaccggccgcaagctgaaggtccagaacgtcgagaacttcgatttcaccggatgggacatcgcactgttcgcggccggatccggcccgacgcagatccacgccccgcgtgccgcttcgcagggctgcgtggtgatcgacaactcgtcgctctaccgcatggacccggacgtgccgctgatcgtgcccgaggtgaacccggacgcgatcgacggctacaccaagaagaacatcatcgccaacccgaactgctcgaccgcgcaaatggtcgtggcgctgaagccgctgcatgatgccgccaagatcaagcgcgtcgtcgtctccacctaccagtcggtttccggcgcgggcaaggaaggcatggacgagctgttcgaacagagccgcgcgatcttcgtcggcgacccggtggagccgaagaagttcaccaagcagatcgccttcaacgtgatcccgcacatcgacgtcttcctcgacgatggatcgaccaaggaagagtggaagatggtcgccgagaccaagaagatcctcgaccccaaggtcaaggtaacggcaacctgcgtgcgtgtgccggtgttcatcggccactcggaagcgctgaacatcgagttcgagaacgagatttcggccgaggaagcgcagaacatcctgcgcgaggccccgggcgtgatgctcgtcgacaagcgcgagaacggcggatacgtgacgccggtcgaatgcgttggcgactttgccaccttcgtttcgcgcgtgcgtgaggattcgaccgtggacaacggcctgaacatctggtgcgtctcggacaacctgcgcaagggtgcggccctgaacgccgtccagatcgccgaactgctcggccgtcgccacctc

SEQ ID NO: 34357 - DNA, 2157 bp, Sphingomonas aromaticivorans
atgaccgccactgccgcgcccgccgaagccggagccctgactttcgaacgcgtgttcgccagcccgagcctcaacggtctggccccgcgcgcggtcaagctgtcgcccgatggccgttacctgacgctgctgcgcaaccgcgccgacgaccgcgagcgttatgacctgtggggctttgaccgccagaccggcgagtggaagatgctggtggattcgctcaagctctcgtcgggccgccagttgaccgaagccgagaagatgcagcgtgagcgccagcgcatcggcgatctcaagggcatcgtgtcctacgagtggtcggcggacagcaagtcggtgctggtgccggtggacggagacctgctgctggccggtctcgacggttcggtccgcaaggtggaaggcaccaagggcggcgagcttacgcccaagcttgggcccaagggcgaacacatcgcattcgtgcgcgacaggcggctgtgggccgggccggtgaccggcaccgccgccgtggcgatcacgcccgaagaggccaatgcggacgttcactggggtgaggccgagttcgtcgcgcaggaggaaatgaaccgcttcaacggcttctggtggtcgcccgacgaaagccgcatcgcggtcgagcgcttcgacgagagcatggtgggcgtggtcacccgcgcggccatcggcgcggaagggacgaagaccttcgaccagcgctatccggcggcgggcacgcccaatgcggaagtctcgctttacgtgattgggccggacggttccaaccgggtgcaggtcgatctcggcgccaacaaggacatctatctcgcccgcgtggactgggcacctgacggcaagacgctctacgtccagcgcatgaaccgcgagcagaccgtgctcgacatgctcaaggtcgatcccgtgacggggaagtcgagcgtgctgttcagcgagaaggccgcggcgaagcactggatcgacctttcggacagctatcggtttctggccgacggcagcctgatctggtggtcgcagcgcgacgggttcgggcacctctaccgcttcaagaacgggaagtggagccagcttaccaagggtgagtgggtcgtgaccgggcttgtcggcgtcgacgagaagggcggcaagctctaccttgccgggaccaaggacgacgtactggcgccgcaggtctatgcgatggacctcaaggcgccgggcaagctcacgcggctgaccgagcttggctgggtcaacggggctagcatggacaagagcgggcagacgctgatgatcacgcgttcgtcggatgcgcagccggcccagtcctacatcgccgacactgccggcaagaacctcgcctggatcgaggagaacaaggtcgcgggctcgcacccctatgcgccctatctggccagccatcgcccggcgcagttcggcaccatcccggctgccgatggcacaccgctgcactacatgatgatcactccgccgctggagccgggcaagaagtatccggtgttcacctaccattacggcgggccgaccgcgcaggtggtgaccaagggcttccagggggcgctggcgcaggcaatcgtcgacaaaggctatatctatttcgccatcgacaatcgcggctctgaaaaccgcggcgtcaagttcgcttccgcgttgcatcacgcgatgggatcggtcgaggtcgaggatcagctcgcgggggcgaactggctcaagaagcaggcgttcgtcgatgccgacaagatcagcacgttcggctggtcctatggcggatacatgtcgatcaagatgctcgaggcaaatccgggggcctatgcagctggcatcgccgtcgcgcccgtgaccaagtggcagatgtacgacaccacttataccgagcgctaccttggcgaccccggcaagctgccggaggtctacgagaaggcgaacgccctggccgatacgggcaagatcagcgatccgctgctgatcatccacggcatggccgacgacaacgtggtgttcgagaacgccagcgccatcatcgccaaaatgcaggccgaggcggtgccgttcgagatgatgctttatcccggctacacccaccgcatcagcggaccgaaggtgagccagcatttgtacgagacgattttccgctttctcgaccgt

SEQ ID NO: 34358 - DNA, 1377 bp, Sphingomonas aromaticivorans
gattatgttgtcgccgacatcggccttgccgacttcggccgcgctgaaatccgcattgcggaaacggaaatgccgggcctgatggccctgcgcgaggagttcggcgcttcgcagccgctcaagggcgcgcgcatcaccggctcgctgcacatgaccatccagaccgccgtgctgatcgagaccctggtcgcgctgggcgccgaagtgcgctgggccacgtgcaacatcttctccacgcaggaccacgccgctgccgcgatcgccgccgccggcattccggtcttcgcggtgaagggcgaaagccttgccgaatactgggactacgtcggctcgatcttcgactggggcgaccagaccgccaacatgatcctcgacgatggcggcgacgccacgatgttcgccctgtggggcgcgcgcgtcgaagccggcgagccgctgttcgaaccctcgaacgccgaggaaatcgaattcgtccgcgcgctcaaggaattcctcaagcgcaagccgggctacctcaccatgtccgtcgcccacatcaagggcgtttcggaagagaccaccaccggcgttcaccgcctctaccagatcgccaaggacggcaagctgccgttcccagcgatcaacgtgaacgacagcgttaccaagtcgaagttcgacaacctctatggctgcaaggaatcactggtcgacgcgatccgccgcgccactgacgtgatgctggccggcaaggtcgcatgcgttgccggcttcggtgacgtgggcaagggttcggccgcatcgctgcgccagggcggcgcgcgcgtgatggtgaccgagatcgatccgatctgcgcgctccaggccgcgatggaaggctatgaagtcgtcacgatggaagaagccgtccagcgctgcgacatcttcgtcaccgccaccggcaacgaagacgtcatcaccgccgagcacatgaaggcgatgaagccgatgagcatcgtctgcaacatcggccacttcgacagcgagatccagatctcggcgctgaacaactacaagtggaccgagatcaagccgggcactgacctggtcgagttccccgacggcaagcagatcatcatccttgccaagggacgtctggtgaacctgggctgcgccaccggccacccgagcttcgtgatgtcctcgtcgttcaccaaccaggtgctggctcagatcgagctgttcaccaagaacgccgaatacaagaacgaagtctacgtcctgcccaagcacctcgacgaaaaggtcgcggcgctgcatctcgagaagcttggcgtcaagttgaccaagctgagcaagaagcaggcggactatatcggcgtttcgcaggaaggtccgttcaagccggatcactaccgctac

SEQ ID NO: 34359 - DNA, 543 bp, Sphingomonas aromaticivorans
caggacgtgcaggacgcgatccgcacgctgatccgctggtccggcgacgatccggagcgtgaaggcctgctcgacacgcccaagcgcgtggcgcgggcgtggaaggaatactgccagggctatggcgaggacccggcggtccatctttcgcgccagttcgaggaagtgggcggctacgacgagatcgtgctgctgaaggacattccgttccagtcgcactgcgaacaccacatggcgccgatcatcggcaaggcggcgattgcctatctgccgcgcgacaaggtggtcggcatctcgaagctggcgcgggtgctgcatggctttgcgcgtcgcctgcagattcaggaacggcttacggcagaggtcgcccagtgcatctgggacaacctgcggccgcatggcgttgcggtggtaatcgaggcacagcacgcgtgcatgaccgcgcgcggtgtgcggacgcccggcgtcggcatggtgacgagccgcctgatgggcacgttcctcgacgacaaccgcagccgcaaggaagtgctgagcttgatg

SEQ ID NO: 34360 - DNA, 447 bp, Sphingomonas aromaticivorans
ttcgacttcaccccctatcgtcgcaccaccgtgggcttcgaccgcctgttcgacctgctcgaacgccaggcgcgcgccaattcgggcgacaactacccgcccttcaacatcgagcgcagcggcgacgatgcctatcgcatcacgctcgccgtcgccgggttcaaggcggaggatatcgacatcaccgcccagcagaacctgctcgtggtcaagggccagaagccggaaccgcaggatcgcgaataccttcacgtcggcatcgcgaaccgcgggttcgagcgccgcttcgaactggccgacttcgtccgcgtcgaagccgccgacctcgccgacggcctgctgaccatcgacctcgtgcgcgaagtgcccgaggcaatgaagcccaagaaggtgctgatcggcgcccataacccgctcaaggtgatcgagggcgacaacaccgccgcc

SEQ ID NO: 34361 - DNA, 747 bp, Sphingomonas aromaticivorans
cgtccttacattgtcggaaactggaagatgaacgggagccgcgccatgctggccgaagcccgcgcgatcgaccgggcggcggggcgctatcccgacgtgcaggtggccatcgcccctccgttcaccctgatcggcgcgctgcgcgaagcggtgagcgccatgggcgtgggcgggcaggactgccacaccgaggtcaagggcgcgcataccggcgacgtctcggcagcgatgctggtcgacaccggggccgacttcgcgattctaggccacagcgagcgccgcaaggatcacggcgagaacgacgcgctggtcaaggccaaggccgaagcggcgctgacggcgggcctcgacatcatcgtatgtgtcggcgaaacgctggaccagcgcgacgcgggcaaggcggaggcggttgtctcatcgcaggtcgacggttcgcttccttcaccggaaacggccgccgaggcagttgcagcgggtaaggtcgcggttgcctatgagccggtctgggccatcggcaccggccgcgtggccgctgtcgaggacgtggtgacgatgcacgccgcaatccgcgcccgcctcgtcgcgctttatggtgaatccggcagcaaggtccgcattctctacggcggttcggtgaattccggaaacgccgcggaactgctggcggcggacggcgtcggcggcgcgctggtcggcggcgcgagcctgacggccgaggcgttcctgcccatcgtcgcggcggcgggt

SEQ ID NO: 34362 - DNA, 1410 bp, Sphingomonas aromaticivorans
gtcgtcacccgtttcgccccctcgcccacgggtttcctgcacattggcggcgcgcgcacggcgctgttcaactggctctatgcgcgccaccatggcggcacctacctcctgcgcatcgaggataccgaccgtgcgcgttcgacggacgccgcgatcgacgcgatcttcgacggactcgaatggctgggccttggcggcgacgagccggcggtgttccagttcgcgcggtcggaccggcacgccgaagtggcgcacaagctgctcgaggccggccatgcctatcgctgctatctgacccaggaagaactggcggcacggcgcgaactggcgcaggcggaacggcgcccgttccgcatcgacagcgaatggcgcgatgccacgcccgaccagtggcccgccgatcagtcctatgtcgtgcggatgaaggccccgcgcgaaggcgagacgacgatcgtcgacaaggtgcagggttcgatcaccgtccagaacagcgaactggacgacttcatcatcctgcgttccgacggcacgccgacctacatgctggcggtggtggtggacgaccacgacatgggcgtgacgcacgtcatccgcggcgacgaccacatcaacaacgcgttccgccagctcgtcatcatccgcggcatgcatgccatcgaaggcggttggccggaccccgtctatgctcacattccgctgatccacggcgcggacggggcgaagctttcaaagcgccacggagcgctgggcgtcgacgcctatcgcgacgagatggggctcctgcccgaggcggtgttcaactatctgctgcgtcttggctggggccacggcgacgaggaaatcatcagccgcgaacaggcagtggcgtggttcgatattggcgacgtcaacaagggcgcatcacggttcgacctgaagaagctgctcaacctcaacgggcactatatccgcgaggcggacgatgcacgcctggcagccctggtcgcgccccgcctggcgacgctggctcccgggttcgcgcccgacaaggggctggacctgctgacccgggcgatgccggtgctgaaggtgcgcgcggcggatatcaacgaactggcagccggttcggtgttccttttcgcccagcgtccgctggccatggccgagaaggcagcaagcctgttgaccgacgacgcacgtgcgatcctgaccaaggttgcaggggtcctggaggctgaaaacgtctggacaaccggagtgctcgaggccacggtaaagcaaatggccgaggagcttgggataggcttgggcaagattgcccaaccgttgcgcgcaagtttgacgggacagactacctcgccgggaattttcgacgtattggcgctgctcggcaaggacgagtcgctgtcgcgcattcgcgatcaggcggcc

SEQ ID NO: 34363 - DNA, 2205 bp, Sphingomonas aromaticivorans
gtgcgcctgcaggtggcgggcgcccgccaggaagaaagcggccacggcatcgctcgcatcagccggcatgtcatgtcgcagctcggcgtgaccgaaggcgacgtgatcgagatcgtcggcaagcgcgccaccgccgcgcgggtcatccagccctatcccgaggacgagggcctcgaactcattcgcctcgacgggctccagcgcgccaacgccgatgtcggctcgggcgagcatgtcgaagtgcgcaagatcgattcgcgccccgcccagcgcgtcgtcttcgcgccggcgcagaaggacctgcgcctccagggcccggcggttgcgctcaagcgcaatttcgcggggcgcccgctggtcaccggcgacctcgtcgcgacggcggggcagcagcaggtcaaccgcaccgacatgccgccgcaactgcgccagatgctcaatgcgccggcgtttgcgctcacccagatccgcctcaccgtcgtctcgaccagccccaagggcgtggtccacatcgacgagaacaccgaggtcgagttgcgccccgaatacgaggagccgcgcagctcgcgcgccgacgtcaactacgacgacgttggcggcatgggcgataccatccgccagctccgcgagatggtcgagctgccgctgcgctatcccgaactcttcacccgcctcggcgtcgatccgcccaagggggtgcttctccatggcccgccgggcaccggcaagacccgcctcgcccgcgccgtcgcgaacgagagcgacgcctcgttcttcaccatcaacgggcccgagatcatgggctcggcctatggcgagagcgagaagcgcctgcgcgaggtgttcgaggaggcaaccgccaactcgccgtcgatcatcttcatcgacgagatcgattcgatcgcgcccaagcgcagcgaagttcacggcgaggccgagaagcgcctcgtcgcgcagctcctcacgctgatggacggcctgcacagccgctcgaacctggtcgtcatcgccgccaccaaccggcccgacgcgatcgacgaggccttgcgccgtcccggtcgcttcgaccgcgagatcgtcgtcggcgttccggacgaaagcggccggcgcgagatcctcggcatccacacccgcgggatgccgctggccgaggatgtcgacctccaggagcttgcccgcaccacgcacggcttcgtcggcgcggatcttgcggctcttgcccgcgaagccgcgatcgaggctgtccgccgcatcatgccgcggctcgatttcgaacagcagaccattcctcaggacgtcctcgacagcctgcgggtggaacgcgacgatttcctcgaggcactgaagcgcgttcagccctcggccatgcgcgaagtcatggtccaggctccgaccatcggctgggccgacatcggcggtctggacgaagcgcaggaaaagctgcgcgaaggcgtcgagctgccgctgaagaaccccgaggccttccaccgcctcggcatccggccggccaagggcttcctgctctatggtccgcccggcaccggcaagaccctgctggccaaggccgtggcgaaggaggcggaagccaacttcatcgcgatcaagtcgtccgacctcctgtccaagtggtacggggagagcgaacagcagatcgcgcgcctcttcgcccgcgcccgccaggtcgcgccttgcgtggtattcatcgacgagatcgacagcctcgtccccgcgcgcggcagcgggcagggcgaacccaacgtcacagcgcgggtggtcaacaccatccttgccgagatggacgggctggaggaactgcaatccgtcgtcctgatcggcgcgaccaaccgacccaacctcgtcgatcctgcgctgctccgtccgggtcgtttcgacgaactggtctatgtcggcacgccgagcatgtccgggcgcgagcacatcctgggcatccacacccgcaacatgccgctcgcccccgacgtggacctcgccctggtcgcccgcgcgaccgaccgcttcaccggcgccgatctcgaggacgtggtgcgccgggcgggcctgaacgccatccgtcgcggcggcggcaacgtcgatcaggtcaaagcttccgacttcgacgaagccctcgaagactcgcgcgccacggtgaccgagcagatggaggaagagtacggccggatgaagggcgaactgaagaagcgcgcg

SEQ ID NO: 34364 - DNA, 870 bp, Sphingomonas aromaticivorans
atgatcaagacggtagctgtcatcggcgcgggccagatgggttcgggcattgcgcaggtttcggcgcaggcgggcatgaaggtcctgctcggcgacgtctcgatcgagctggcggacaaggccagggacaagatcgccaagggtctttccaagctggtcgagaagggcaaggtcgatgccacgctcgccgcgtcgacggtcgccaaccttcacaccttctccgatcatgccgcgctggccgaggccgacctcgtcatcgaggccgcgaccgagcgcgaggacatcaagcacaagatcttcgaatcggcaggcaggcacttggccgcccatgcgatcatggcgtcgaacacgtcttcgatcccgatcacccgcatggccgtctcctcgcccgatccggagcgcttcatcggcatccacttcttcaacccggttccgctgatgaagctggtcgaggtgatccctggtcttgcgacgtcggtcccgacgatcgaagcggtgcgtgattacgtggcgaacatcggcaaggaaatcgtgctttcgcaggacgagcccggcttcatcgtcaaccgcatcttcgtgccgttcatcaacgaggcggccttcgtgctgggcagcggcaccgggtcgatcgtggatatcgacaaaggcgtcaagctgggcctcaaccatccgatgggcccgctcgaactggcggacttcatcgggctcgataccctgctcgagatcatgaagatctacctcgcctcgaccggcgacccgaagtaccgcccggccccgctgctgcagaagtacgtcgaggcgggctggctcggccgcaagaccggccgtggcttttacgattactcgggcgaggtgcctgttcccactcgt

SEQ ID NO: 34365 - DNA, 865 bp, Sphingomonas aromaticivorans
atgaccgtcacccgcttcgctcccagccccaacggcccgctccatctggggcatgcatattccgcaatcgtcgcccatgaccgtgcgaagcgtgacaatggcgaatttctgctgcgcatcgaggacatagacggggcgcgctcccgccccgacctggcagacgaatttcgtgccgacctgcaatggctccgcctcgactaccgcgaggttgccccccagtcccagcgcatcgcctcctaccgcaccgccgcgaacgagctgcgggcgatgggcatcctctacccttgcacctgcacccgtgccgagattgccgccgccgccgtcgcgcagggcccggatggcccgctctatcccggcacctgcctgcgccgcgggcccgttccgggtcccgacgtcgcctggcggctcgacatggaacaggccacgttgatcgccggaccgctggaatggacggacgagcgccacggcgtgcagcaggcccggcctgaaatgttcggcgacgtcgtgctctggcgcaaggacgcaccggccagctatcatcttgcggcaacgctcgacgacgcgaccgatggcatcacccacgtgacgcgcggggtggacctgtttcgtgcgacccacgtccaccgcctgctccagcaccttctgggcctgccggtcccggtctggtaccaccacccggtgctggtggaagccgacgggcgcaagctcgccaagcgccgcgatgcgccggcccttgccgaccggcgccgtgccggagaggacgggcgcgcggtcgccgccgaggtgcgcgctaccctatttgacactggtatttcgttgtccgacaccatagatcagagcgcatgaactacgtcctgatcccgct

SEQ ID NO: 34366 - DNA, 1452 bp, Sphingomonas aromaticivorans
ccttctacgaatccgcgctcaacgagaaaaagtagggagtaaagcgcggtggccgacgcaacgcggttctacatcggcggcgaatgggtcgccccttcgacgagcgtgacgacagacatcgtcaatccggcgaaccggtcggttgtaggccaggtcgcgcttggcggaccggccgatgccgaggcggccattgccgctgcaagggctgcgtttccggcctggtcggccacgacccgcgagcatcggcttgcggtcctcgaacggatcaatgccgcgctcatcgcccgcgccgacgagatcggcgatgcgatcatggcggaaatgggggcgcccctgggccttgcgcgcggcgcgcaggcgggatcggggccgcagcatttcgaagagacgatccgcgtcctgaaggactacgccttcgaaacgccgctcggcacgaccctgctccagcgcgaggccattggcgtgtgcgtgctcataacgccgtggaactggcccatgaaccagatcgcgaccaaggttgcgccagcgcttgccgccggatgcaccatgatcctgaagccaagcgaagtcgcaccgctcgacgccgcgattctggccgagatcatcgacgaggccggcctgccggacggcgtgttcaaccttgtgcatggcacggggcccggaatcggcgatgcgctgaccgggcatcccgatgtcgacatggtcagcttcaccggatcgacccgcgcggggatcgccatagcagccaatgccgcaccgacgatcaagcgcgtggcgctggaactgggcggcaagagcgcgaacatcctgctgccggacgccgatctggcaaaggccgtcccggccagcgtgcgcggctgcatgctgaacaccgggcagagctgcaatgctccgacgcgcctgctcgtaccgcgcaccaccctctcgcgcgtcgagcatctggcaagggaagcggcggaggcaatcgtcgtgggcatgccgacagacaatccccacatgggcccggtagccaacgaggcccagtatcgccgtgtcatcgcactgatcgagcaggcgtgccacgaaggcacgcagctgctgtgcggcggcgtggagccgcccaagagccttgagcatggcctgttcgtcgcgccgaccattttcacggacgtcgcccccgacgccaccattgcacgcgaggaagtgttcgggccggtactcgccatcatcccctacgaaaccgtcgacgaggccatcgagatcgccaacgacagcccctatggcctgtccggatatgtctggggcgaccccgacgccgcgcgcaacgtggcgcggcggatgcggacggggatggtccacgtcaacggcgcgtcgctcgacagcgcagcgcctttcggtggctaccggatgtcgggcaacggccgcgaatggggcgtctggggcctggaggagttcctcgaggtgaagtccatc

SEQ ID NO: 34367 - DNA, 1275 bp, Sphingomonas aromaticivorans
acgaacgccgaactctggacccgtcgcgaagccgccgtgccgcgcggtgtctcctcgatgcaccagcgcttcttcgcgcggggtgaaaatgccgaggccttcgatgctgaaggcaaccgctacatcgatttcgccaccggcatcgcggtgtgcaacaccggccacgggcatccgcgcgtgcttgcggcggtgcagcgccagcttgacgcgttttcgcactgctcgttccaggtgacgccttacgaaaactacatcgagctggccgaacggctgaatgcgattgctcccatcgacggaccggtgaagtcgatcttcttcaccaccggtgccgaggcgctggagaacgctgtgaagatcgcgcgtgcgcataccgggcgccgcggcatcatcactttccagggcggctatcacggtcgcacgctgctgacgctggcgatgaccggcaaggtcctgccctacaaggcgcggttcgggccgatgccgggcgatgtgttccatgcgcgctttcccatcccctaccacggcttttccgaggaagaggcgattgccgggatcgaggcgctgtttgcctcggccatcgaaccttcggcggttgcggcgatcgtgctggaaccggtcctgggcgagggcgggttctacaccgcgtcctatgccttcttccgtgccttgcgggagatctgcgaccgtcacggcattctgctgatcgcggacgaggtccaggccggttttgcccgcactggccgcatgttcgcgatggactgggtgcgcgaggccaccggcgtgacgccggacctgatgaccgttgccaaggcgatggcggggggtttccccatttcgggggtgatgggccgggccgagatcatggacgcgcccgatccgggcgggcttggcggcacctatggcggatcgccactgggctgcgcggcggggctggcggtgctcgacgtgattgccgacgaggacttgtgcgcacgtgccgtcgccatcgggaaccggatcaaggcccgcctgcgccggatgcgcgacaatggcatgaccgccatcggcgacgtgcgcgggccgggcgcgatgattgcgatggaactggtccacgatggcgatccgtcgcggccgaacccggatgcgacccgtgcgctggtgcaggaaggcgcgcgcgagggcctgttgctgctgtcgtgcgggctgcgcgggaacgtcgtgcgcttcctgccggcgctgaccatgccggacgccctgctcgacgaagcgctcgacaggctggagattgcgctgaac

SEQ ID NO: 34368 - DNA, 1432 bp, Sphingomonas aromaticivorans
gcggctgtcctttcaaacgccatctgaacaatcggaaaatcaatgctttttgccacgcttgccgcgggggagggcctcgacgtgctcaaccccgccacccagcagaggatcgccaccgtcaaggcgtactctaccgaggagattgcccggctgatcgaagctgccgatgccgcgcgcggcgcctgggccgcgcgaaccgccaaggagcggtcggtcgtcctgcggcgctggtacgacctggtcatgtcgcaccaggaagaccttgctgcgctggtgaccgcagaaagcggcaagccgctggccgaagcgcgtggcgaggtggcctatggcgcggccttcatcgagtggttcgccgaggagggcaagcgcgcctatggcgacaccatcccgacattcgccaatggcaagcgcgtgctgacgatccgtcagggcgtgggcacgtgcgcggcgatcacgccgtggaacttccctgtcgccatgataacccgcaaggtggcgcccgcgctggcggccggatgcgcgatggtggtcaagcctgccgaagccaccccgctttcggcgctggcgctggaaacgctggcgcacgaggcgggcgttccggcagaagtgttcagggtcgtgccgacggatgacccggccggcgtcggcacgctgttctgcacgcatccgcaggtacgcaagctgagcttcaccggatcgacccgcgtgggccagttgctgatggaacaggcggcggcgaacgtgacgcgtctcagcctggaactcggcggcaatgcgcctttcatcgtgttcgacgatgccgatctcgatgcggctgtggatggcctgatggcctcgaagttccgcaacgcaggccagacatgcgtctgcgccaaccgcattctcgtgcaggacagcgtacacgatgccttcctcgccaaggtgcaggagcgggttgcggcgctggtcgtcggcgatggcgcgcagccgggtacgaccattggcccgctcatcaacgaggctgcggtgaaaaaggtcggggcgctggtggcggatgcctgcgaggccggggcaagggtgctggccggaggcggaaagtccccggtgggcaccggatttttcgaaccgacgatccttgccgacgtaacgcccgacatggcccgtggcttcggcggagattttcggcccggtggtgccggtcatccgctttgccgacgaaccgcaagcgatccgcatcgccaacgacacgccctatggcctcgccgcctatttctatgctcgcgacgtgggccggatctggcgggtgatggaagcgctcgaatacgggatggtcggcgtcaacgacggcatcatttccaccgaagtcgcgccgttcggcgggatcaagcattcgggcctgggccgcgagggatcgcgccatggcctcgatgaatacctcgaactcaaatactgc

SEQ ID NO: 34369 - DNA, 1395 bp, Sphingomonas aromaticivorans
catttcatcggcggcaagcgggtgtcatcgccctataccttcgaaacgcgctgcccgttcgactggtcctggaagctggcggacatttcgcgcggaacggtgaccaccgcagctcaggccgcgcaggccgcgaccgacgcctttccggcttgggcggcgctttccgccgcagagcggggcgcctacctccacaggctggcggatctgatcgaggccaatgtcgagaagctggccatgatcgagtgcctggacatgggcatgctgctggaaagcctgcgtctgcgcgtgatcctgcggggcgccgccaacttccgcaactacgccgatcttgccaccgggcatgaagagcgggtgtggtcgtcgcgcggaacgctgaaccgcgtcatccggatgccagccgggccggctctgatcatcacgccgtggaacgcgccgttcatgctttccacctggaaatgcgcgcccgcgctggcggcagggaacacggtgatcctgaagccggccgactggtcgccgctttcggcctcgatcctggcggacctgatcgaggaagcaggcttcccggccggtgtcttcaacatcgtgcagggcctgggcgcggaactgggcaatgccctgacctcggatccgcgcatcaagcgcatcagctttaccgggtcggtcccgaccgcccgcgtaatcggcaaggccgcagccgagaacattgtgccgttaaccgccgagcttggcggcaagtcgccgctgctggtctttgccgacgcggacatcgatgcggcggcgaagaaggcggcgggccagtacgacgacagcggacaggtgtgcatggccggcacccggatcatcgtggaagaaagcgtgaaggacgaattcctcgcgaaattccacgcctatgccgacgcccacgtgatgggcgacagccgcgatgccgcgacgaccatgtcggccctgatccatcccgttcatgtcgagcgcgtactcggcttcatcgagcgggcgcgggcggcgggtgacgccatcgttcgtggcggaaggctgtggaaggaagggtcgaactggatcgaacccacgctgatcgagccgaagaacaaccagagcgaagtcgtccagagcgaggtgttcggccccgtcctgaccttccagacctttcgcgacgaagcggaaggcgtggcgctggcaaattccaccgcctacgggctctcgggcatcgtctacaccggcagcgccgagcgggcggagcgggtcggacgccaggtccgcggcggcacggtgtgggtcaacaccttcctcgtgcgcgatcttaccgccccattcggcggcatcggcatttccggcatcggccgcgagggcggcgactatgccctggacttccactccgacctcaagaccttgcaaatc

SEQ ID NO: 34370 - DNA, 1356 bp, Sphingomonas aromaticivorans
agcatcaccgatccgcaggctttctggggtgaagctgccagggcgcttgactggacctcgcccccgtccgccactttcacgcaagacgacggctggttccccggcggaacgctcaacaccgcatacaactgcctggaccgccacgttgaagcggggtggggcgatgccatcgcgctggtctacgacagccccgtcacggacacgatccgccgctattcctattccgaacttctcgccgaatccggccgcgtcgccgccatgctagccgcgctcggagtggagaagggcgaccgcgttatcatctacatgccgatgatccccgagacggtattcgccatgcttgcctgcgcgcgtctcggcgcgatccactcggtcgtgttcggcggtttcgcaccactcgaactggccaagcgcattgacgacgcggcgccgaaggttctgctgactgcgtcctgcggcattgagggcgctcgcaccattgcctacaagccgatggtcgacgaagcgctcgaactcgcccaccatgcggttgagcgcgtcgtcctgttccagcgcgagcgccaccgcgccgacgtgatcgaaccgcgcgacatcgactgggatgtcctgcgtgccgatactgcgagcgatcccgttccggcacccgtgcctgtcgcttcggcggacccgctctacattctctacacttccggcacgaccggcacgcccaagggcgttgtccgcgagaacggagggcatgccgtcgcgctcgcctggtcgatgcgcaacatctacggcattggcgcgggcgataccttctgggcggcctcggatgtcggctgggtcgtcggtcacagctacatcgtctatgctcccctgctggtcggcgcgacgaccgtgctgttcgagggcaagcccgtcggtacgcccgatcccggcacgttctggcgggtcatcgttcgacatggcgtgaagaccttcttcaccgcgcccaccgccatccgcgcaatccgcaaggaagaccccgacgcgactttcctggcccggatcggcaccggcaagtgcgaggccattttcctcgcgggcgagcgcgccgatcccgatacgatcggctggctcgaggacaagtccggcctcccggtcatcgaccactggtggcagaccgaactcggctggccagccattgcctcgtgcttcgcgctgggcgacgtgcgccgcaaacgcggcagcgccgggctcccggtgcccggctatgccttcgcgatcctcgatgaatccggccacccggttcccgtcgggcacagcggtgcggtcgtgatcaaggctccgctcgctcccggcgcattccgcacgctctggaacaaccacgcaggctac

SEQ ID NO: 34371 - DNA, 1944 bp, Sphingomonas aromaticivorans
aaaggagagcctgaaatgggcgaggcagtctatcctgtaccggctgagtgggcgcagaacgcgctggtcgacgaggcgcgctaccaggatatgtatcgccagtcggtcgacgatcccgaaggcttctgggccgaacacggcaagcggatcgattggatcaggcctttcaccaaggtcaagaacacctcgtttcacgaagccgacttcggcatccgctggttcgaggacggcacgctcaacctcgccgcgaactgcctcgaccgtcacctcgccgaacgcggcgacgagatcgcgatcctgtgggagcccgacagccccgacgaggcacaccgcgagatcacctaccgccagctccacgccgatgtctgccgctttgccaacctgctgaaggccaagggcgtccagaagggcgagcgcgtcaccatctacctgccgatggtgccggaagccgccgtggcgatgctggcctgcgcccgcatcggcgcgatccattccatcgtctttgcaggcttcagcccggatgcgctggccggccgcatcaccgactgcgacagccgcatcgtcctcacctcggacgaaggcctgcgcggcggacgcaaggttccgctgaaggccaatgtggacgaggcgctgaagcaatgccccggcgtcgacaccgtgatcatgctgcgccgcacgggcgccgacgtggactttgtcgaaggccgcgacatcgactgggcaacggcagtcgccgagcagagcgccgattgccagcccgaggaaatgaacgcggaagacccgctgttcatcctctacacctccggctctaccggaaagcccaagggcgtgctgcacacgacgggcggctattcggtctgggcgtcgatgacgcaccagtacgtgttcgattaccgtcccgggcagatctactggtgcgcggccgacatcggctgggtcaccggccactcctatgtcgtctacggaccgctcatgaacggcgccactacggtcatgtttgaaggcgtgccgaacttcccggacgcaagccgcttctggcaggtggtcgacaagttcaaggtcgaaatcttctacggcgcccctaccgcgctgcgcgccctgatgcgcgagggcgacgaatgggtgaagaagacgagccgcgcctcgctgcgcctgcttggttcggtgggcgaaccgatcaatcccgaagcctgggaatggtatcacaaggtcgtaggcgacagtcgctgcccgatcgtcgacacctggtggcagaccgaaaccggcggggcgatgatcaccccgctaccgggcgcgaccgcgctcaagcccggctcggcctcgcgcccgttcttcggcgtaaagcccgcgcttgtcgataacgacggcacgttccttgaaggcgcgactgacgggtgcctcgtagtgaccgatagctggcccggccagatgcgcaccgtgtggggcgatcacgagcggttcttccagacctatttcaccactttcaagggcctgtacttcaccggcgacggatgccgccgcgacgaggacggctactactggatcaccggccgcatcgacgacgtgatcaacgtgtcgggccaccgcatgggaacggcggaaatcgaaagcgcgctggtcgcccacccgaaggtggccgaagctgcggtcgtcggcatgccgcacgacatcaagggccagggcatctacgccttcgtcacctgcaatgccgaaatcgagcccgacgacctgctgcgcaaggagttgatccagtgggtccgccacgaaatcggccccatcgccacgccggacgtgatccagttcgctcccggtctgcccaaaacccgttcgggcaagatcatgcgccgcatcctgcgcaagatcggcgagaacgacgtctccaaccttggcgacacgtcgacccttgccgatccgtcggttgtcgataatctgctggccaacaga

SEQ ID NO: 34372 - DNA, 810 bp, Sphingomonas aromaticivorans
ggcctcgtaggacgttcgatcctcgcctcccgctctcccgacctgcaccagggggaagggcgcgcgctggggctggaggtgagctacgagctgttcgactttaccgcccgcgacctgcccgacagtgcattggccgaagtgatcggcacgctgcgcgacgacggctttgcgggcttcaacgtgacctacccgttcaagcaggcgattgtgccgctgctggacgaactcgacgagagcgcattggccgtaggcgccgtcaataccgtggcgatccgtgaggggcgcctgatcggctacaacaccgacatgatcggttttcgcctgtcgatggagcagggcctgccgggcgcgaggctggagcgcgtggtgcagctcggcgcgggcggagcgggcgcggcggtggccaatgcgcttctctcgctcggcgtgcgcaggctggtgctggtcgacgtcgacccggcccgcgcggagcaactgcgcagcgaacttgccgcgcgctttcccggccaggatgtggagtgcggcgcgcctggcacgctggacaccacaggcgccgacggcatcgtcaatgcaacgcccataggcatgaacgggaagccaggcatgccgctgccaccggaaaagattgctgcgaggcagtgggtggccgacatcatctatttcccgagagagaccgagctacttcgggtcgcgaagagcaagggatgcgccactatcaatggcgtgggcatggtcgtgggccaggcggcacgggctttcgagatcatcaccggccatgccgccgacgcccgacgcatgcgcgcaatgctc

SEQ ID NO: 34373 - DNA, 1179 bp, Sphingomonas aromaticivorans
atggactttgaactcgatcccgccgatgtcgcctttcgcgaggaagtgcgcgaattcttcaccaccggcatcccccaggagtggcgcacccgcgtccgtgcaggattgcgcctccatcccgaagagctgatcgcataccagaagcgcctcgccgcaaagggctggggcgcgcccacgtggcctgcccagtacggtggcaccggctggagcccgatccgtcagtacatcttctggaccgaggctgccgaggccgatgcccccgcccagttccaccaagggctcgagctgatcggcccgatcatcttcacgtacggcagcgccgcccagaaggcgcgctttctgccgggcatcgtcaatgccgacgactggtggtgccagggctattccgaacccaacgccggatcggatcttgcatcgctccgcacccgcgcggtgcgcgatggcgaccactacgtgctcaacgggcagaaggcgtggaccagctacgggcacgtcgccagccactgcttcgtgctggcccggacttctgacgaggccaagcggcagcagggcatctcgctgttcctgctcgacatgaagacgccgggcatcaccatccgcccggtcgcgactatggacgagaagcaccacaccaacgagatgttcctcgatgacgttcgcgtaccggtcgaaaacctggttggggaagaagggcgcggctgggaatacggcaaggtcctgctcgaccgcgaacgcatggtcactgcatcggtggcggtcttcctgatccagacggtcaaggcgatccgagatgcggcctctcggcacacgatcgggggcgtgtcgctgctcgacaagccggacttcaaggacaagctggcgcagtacgagatcgaggtgatcgcgctccagacgatggtccttcgcgtaatggcggatgccagcgcaggggttgattcgggaccgctcgggtcgatgatcaagcttcgctggtcgcagctcctgcaggccggcaccgctctgtggatcgccgctctcgggccaaaggccgcccactttgccgcgctcgaccacgcttcggtcctgcccaccgacatgccctatgccatgcagggcgtgctccattcccgcgtgacctcgatctatggcggatcgagcgagatccagcacaacatcatcgcccagcgtgcgctgggcctg

SEQ ID NO: 34374 - DNA, 735 bp, Sphingomonas aromaticivorans
gaccaccgttgcctgctgggcgaaagcccggtgtgggatgcacgggggcgaaggctgtggtgggtggatgccgttggaaactcgatccacgcggccacgccagaaggcgtgcctctggtatcgtggcgttacgaagcgatggtcggcagcattggtcttgcggaaaccggcttggtcgctgcgttctccgatcatttcgcgctgatcgacggggctaccggtcgggcaacgccatttgctgcggttcccggaaacgatggcgccatgcgcctcaatgatggcaaggtggatcgcggcggaaaccactacatttgcggggagacccgcatggccgaaggggcgaccgggacgctgttccagcttgcggcaaacggtgcgcttgccccggtggcccgcgggatgcgcatctccaatgccacctgcttttcgcccgaggggtcacggctttactttgccgacagcctcgacggcgcgatccgctgccatgcctacgatcctgctacgggcaccgtcggtgcccgcgtcggcacgatcgatctcaagtccatcggtcaggctcctgatggcgccacgatcgatgcggagggcaatctctggattgcacttgtactcgatcaggccgtcgcctgcgtcagtcctgcgggcgaactgatccgtcggatcgacatgccgatgccctatccctcgtgcccggcattcggagggccgcagctcgataccctgtacgttacctcc

SEQ ID NO: 34375 - DNA, 1611 bp, Sphingomonas aromaticivorans
aacttcggcgacctgcttgatatcgccgccgccaatgtcccgacggaccgtcccgcgctcgtgcggggcgaccggacgatcgcgtggggcgaattcgattgccgcaccaaccggctcgcccgcgcgatgctggcaagtggcctgaagaccggagaccgcgtggccatcctcgcgcgcaacattcccgaatttatcgagatcgcctgcgccgcgttcaaggcgcgcctgacccacgtcaacatcaactaccgctacaccaccgccgaaatcgaatatgtccttgccgattgcggcgcggcagcgctgttccatcaggacgaatttgcaggcgtcgtcgagcccctccctgccgcgctcgatcatctgaggctcgtcgtgcagatcggcggggagggcagctacgaccggatggtcgaagagggcgacggcacgccgctcggcatcgcccggtcccccgaggacggctatctcctctataccggcggcaccaccgggcgccccaagggcgtcatgtgggcggcaggcgatgcacgcgcggtacagcttgaggcgccaacggtgcgcaatccggtgctgaccctggaggaccacgcgaagcaggttgcggccaacatcaccccgggccgcgtgcttccggcctgtccgctgatgcacggggcggggctcaacagttcgatggcggaactcctgatgggcggcactgcggtgttgctggaaaaggacagctttcgcgccgacgatctatgggatcaggtcgaggggcaccaggtcacgcgcatcctgatcgtcggcgacgttttcgcccggccgatgcttcaggcgctcgaggctgaaccgggtcgctgggacctgtcatgtctcaaggtcatttcctcggccggcctgatgtggagcgaggaagtgaagcgtggccttgtccgccaacttccgcagctgacgctggtggatatcctcggtgcgtccgaggcctcgggtttcggctatgccgtgacgaccgccacgcgtgagacacctaccggctatttcgagccaggtcgccagaccgtcatcatcgacgtcgacaccgaccgcgtgctggccgacgacgaacccggcacaggctggctcgcccgccgcccacctttcgcgcaaggctatttcggcgatccggaaaagaccgcgcagacctatcgcaccattggcggcatcacttatgccatccccggcgacatggccgaacgtactgtcgagggtctcattcgattgatcggtcgcggcaatctgtgcatcaataccggcggcgaaaaggtcttcgtcgaggaagtcgaggaagcactcaagcgagccccgggcatcgaggacgccatcgttgtcggtgtgccggacgagacttggggcaaggccgtcgtcgccctggtccgcactggcgcgacctacgacgaggacgccgcacgcacggcgcttgcagcagaccttgcgcgctacaagctgccgcgccggatcatcgtcctcgacgatcttccgcgccatgccagcggcaagtccgactaccgccgcgcgaccgaactcgccgtggcccacctcgccctcgcggcctgaccggtgcggccccacgcccttgttaccggcggc

SEQ ID NO: 34376 - DNA, 1574 bp, Sphingomonas aromaticivorans
cgcctcgttctggtgaccggcgcggcccgcggcatcggtctggcgtgtgcccaccgctttgccagggccggtgatcgcgtggtcatggccgaccgcgacttggcggcgtgcactttcgaggctgaaaggctcggctcgcggcatgtcgcgctgcaactggacgtttcggacgaagcggcggtcgagcacgcgatggacggtcttctgcagcagttcggcgcgttcgatgtcgtgatcaacaacgccggggtggtggatcgctttgcccggccgcttcttgacgtaccgccggaggatatcgaccggctgataggcgtcaatctcgaaggtccctatctggttgtgcgcgctgcgctgcggacgatccttgccggacggcgtggcgcggcaatcgtcaacgtcgcatcgggcgcggcactgcgcgcgctgccgggccgtgccgcctacagcatgacaaaggcgggcgtcatcggcatgacccgcgcgatggcgatagagcttggcccccagggtatcgccgtcaacgccgtgctgccgggatacatcgacaccgaaattctccttgctctggagcgggagggcaagttcgaccgcgccgccgctgccggcgcaataccgatgggaaggctcggccggacagatgagattgccgaggcggtccattacctcgcgcgcgggggttatcattgcggcagcctgctttcggtcgatggtggggtcgatgcgtatggcggttcgggcaaggcctccaccgccgtcatgccgcaccgcccggtgcgcgcgggcgacgtcgcttgcgtgaccggcggggcgagcggcatcggcgccgttgtggcagaccggcttgccgggctcggctggctcgtggcgataatcgacagccgggaaatcgcggacggaccacaccctgcgtggcaggccgacatcgccagcgaagcctcggtcgagagcgcgatggcaggcatcgctggccagctcggcccggtgacgctgctggtcaacaatgccggtatcgtcgaacccatggcgaagtctgccgaccaggcgcttgccgacttccgccgcacgatcgacgtgaacgtgaagggcactatccatgcatcgcgcgcggctgcgcggcagatgatcggcgcgggcggtggggccattgtcaatctttcctccatcacggcatcgctcggtttgccggggcgcaatgcctattgcgcgtcgaaatctgccgtcaccatgctcacccgcagtctcgcctgcgaatgggccgcgcatggcatccgggtgaatgcggtcgcgccaggatacatcctgacccccgcagtgcaggccttgctggcttcgggagagcgcgacatgaactccgtcgtccggcgcataccggtggcgcgccttggtcagcctgacgaagtggcggacgccatcgcgtttctggcctcggatgcggcatcctatgttaccggcgccacgcttcaggtggatggcggctatcttgccagcgggcatccgcccgatggaccgatgccctgaagcgtcttggggccaatcgcatatgcaatagttgccccggggtccggtggtat

SEQ ID NO: 34377 - DNA, 1053 bp, Sphingomonas aromaticivorans
tcctctaccggcaagatcagccaggtcatcggcgccgtcgtcgacgtgaccttcgacggcgaactgcccgcgattctctcggcgctcgaaaccgacaacaacggcaaccgcctcgttctcgaagtcgcacagcacctcggcgagaacaccgttcgcaccatcgcgatggactcgaccgacggcctgacccgcggccagccggtgaccaacaccggcgcgcagatctcggtgccggtcggccccaagaccctcggccgcatcatgaacgtcatcggcgagccgatcgacgagcgtggcccggtcggcgcggaacagaccgccccgattcacgccaaggctccggaattcatcgagcagtcgaccgaagccgcgatcctcgtgaccggcatcaaggtcatcgaccttctcgctccctatgcgcgcggcggcaagatcggcctgttcggcggcgccggcgtgggcaagaccgtgctcatccaggagctgatcaacaacatcgccaagggccacggcggcgtgtcggtcttcgcgggcgtcggcgaacgcacccgtgaaggcaacgacctctatcacgagttcctcgacgccggcgttatcgccaaggacgccgacggcaacccgaccccggacggctcgaaggtcgccctcgtgttcggccagatgaacgaaccgccgggcgcccgtgctcgcgtcgcgctctcgggcctgaccatggcagaatacttccgcgaccaggaaggccaggacgttctgttcttcgtcgacaacatcttccgcttcacccaggcgggttcggaagtgtcggctctgctcggccgtattccttcggcggtgggctaccagccgacgctggccaccgacatgggccagctgcaggaacgcatcacctcgaccaccaagggctcgatcacctcggtgcaggcgatctacgtccccgcggacgaccttaccgacccggcgccggccacctcgttcgcccacttggacgcaacgaccacgctgaaccgcgcaatctcggactcgcattacccggcggtaccagctatatagtcc

SEQ ID NO: 34378 - DNA, 870 bp, Sphingomonas aromaticivorans
atggctagtcttaaagaactcaagggccggatcaactcggtcaagtcgacccagaagatcaccaaggccaagcagatggtcgcagcggcaaagctgcgcaaggcgcaggcggctgccgaagccgcacgtccctatgccagccgcctcgcggaagtcatgggcagcctcgctgccaaggtcgctggccaggacaacggtccgctgctgatgcgcggcaccggttcgaaccagcgccacctcctcgtcgtggtcaacacggacaagggcctgtgcggcggtctgaactcgaacatcatcaaggaagccaagctgcaggcacgtgcgcttgaagcggctggcaagaccgtgacgttctatctcgtcggcaagaagggtcgcgcgccgatccgtcgtgactatccgaacggcatcgccgccggatacgacaccagcctcgttcgcacccccggtttcgacgaggccgccgccatcgcgcaggagcttctggccctgttcgaggccggcaagttcgacgtcgcccatctggtcgcgccggaattcaagaacgcgctgacccagttgccggtgaccacgcagatcatccccgtccctgccccgaccaacacggtcgcaatcgacgcagtggtcgaatacgagccgggcgaggaggaaatcctcgaggaactgctgccgcgctacgtcaccacgcagatcttcggtgccctgctcgagcgcgaagcttcggaacagggtgcgtcgatgaccgcgatggacaacgcgacgcgcaatgcgggcgagctgatcaacaagctcaccatccagtacaaccgcagccgccaggccgcgatcaccaccgaactcatcgaaatcattgctggtgctgaagcactg

SEQ ID NO: 34379 - DNA, 1527 bp, Sphingomonas aromaticivorans
atggaaatccgcgccgctgaaatctcgaaggtcatcaaggaccagatcgccagcttcggcaccgaggcccaggtctcggaagtcgggtcggttctctcggtcggtgacggcatcgcccgcatccacggcctcgacaaggtccaggccggtgaaatggtcgaattctcgaacggtgtgaagggcatggccctgaacctcgaagccgacaacgtcggcgtcgtgatcttcggctcggactccgagatcaaggaaggcgacgtcgtcaagcgcaccggcaccatcgtcgacgttcccgtcggcaagggcctgctcggccgcgtggtcgacgcgctcggcaacccgatcgacggcaagggcccgattgtcgacgccacccgccagcgcgtcgaagtcaaggctcccggcatcatcccgcgcaagtcggtgcacgaacccgtgcagaccggcctcaaggcgatcgacgccctcgtccccgtcggccgtggccagcgcgagctgatcatcggtgaccgtcagaccggcaaaaccgccgtcgcgatcgacaccttcatcaaccagaaggccgtcaacgccggcaccgacgaaggcaagaagctctactgcatctacgtcgccgtcggccagaagcgctcgaccgtcgcgcagatcgtccgccagctcgaagagaacggcgcgatggaatactccatcgtcgtggccgcgaccgcttcggaaccggctccgctccagtacctcgcgccctacaccggtgcgaccatgggtgaattcttccgcgacaacggcatgcacgccgtgatcgtgtacgacgacctttccaagcaggccgtcgcctaccgtcagatgtcgctgctgctccgccgtcctccgggccgcgaagcctaccccggtgacgtgttctatctccacagccgcctgctcgagcgcgccgcgaagatgaacgacgaaaacggcgctggctcgctcaccgctctgccgatcatcgaaacccaggcgggcgacgtgtcggcctacatcccgaccaacgtgatctcgatcaccgacggccagatcttccttgaaaccggcctgttctatcaaggcatccgtccggccatcaacgtcggtctgtcggtgtcgcgcgtcggctcctcggcccagaccaaggcgatgaagaaggttgccggctcaatcaagctggaactcgcgcagtaccgcgaaatggcggccttcgcgcagttcggttcggacctcgacgcctcgacccagaagctcctcaaccgcggtgcgcgcctgactgaactgctcaagcagccccagttctcgccgctcggcttcgaagagcagacctgcgtgatcttcgccggcacccagggctacctggatgccgttccggtgaaccgcgtcaccgaatacgaagccgaactgctcagcttcctgcgctcgcagcatgccgacctgctcggcctgatccgcgacaccaaggaccttggcgacgaagccaagggcaagctggtcgcggctctcgacgctttcgccaagcagttcgca

SEQ ID NO: 34380 - DNA, 537 bp, Sphingomonas aromaticivorans
agcggcattacggccagcctgtcagggcgctacgcctcggcattgttcgatctggcgaatgatcagggcttcgtttcggccgtggaaggcgatctcgagaagctcgacgccgcgctgcgcgaatcggccgacctgaagggcctcatcaacaacccccagcttggccgcgacgaagccggccgcgcgatggatgcggttgcgggcctgcttggccttggtgagcttacgaagaagttcgtcggcgtcctcgccgccaaccgccgcctttcggccctccccgacgtgatccgcgccttcggccagatcgccgccgcccagcgtggcgaagtcagcgccgaagtgaccagcgcccatgcgctcgacgatgcccaggttgccgccctcaccgaaaagctgaaggcccgtaccggcaagtcgatcaagctcaagaccagtgtcgatcccgaaatcctcggtggcctcgtcgtgaaaatcggcagccagatgatcgacagctcgatccgcacccgtctcaattccctcgcccaggcgatgaag

SEQ ID NO: 34381 - DNA, 1395 bp, Sphingomonas aromaticivorans
ctctacctcaacaacaaggcggtgcagcccaacgccgacctcgaggtgacgaacaagttcaatgggaaggtcgccttccggacggcgcttgcgacgcccgacgtgatcgacgaggccatcgcgggagcggtccgcgcggcagcgccgatggcccggctggcgagctacgagaagcgtgacgtgcttgaccattgcgtcagccgcttcatcgagcggaaggacgaactggcttatgcgctttgcatcgaggcgggaaagccgatcgcggattcggaaggcgaggtaggtcgcctcatcgacacgttccgtatcgccgccgaagaagcgacccgcaactacggcgagatccagccgctcgacatctctccccgcgccaagggctacatggggatgtggaagcgggtgccgatcggaccatgtagcttcatctcgccattcaactttccgctgaaccttgccgcgcacaagattgcgcccgcgatcgcagtcggctgtcccttcgtgatgaagcccgcctcgatgaccccgctcggcgcgatcatcatgggcgaagttctggccgagtgcgatgtccttccagaaggcgcgttctcgatcctgccggccagtcgtgacggcgcggagctgttcaccaccgacgaacgcctcaagctcctgtccttcaccggctcccccggcgtgggctgggacctcaaggcgaaggccgggaagaagaaggtcgtgctggaactgggcggcaatgcggcggtgatcgtcgatagggacgccgatctggaacacgcgctcgcccggatcatcttcggcggctactaccagtccgggcagtcgtgcatccacgtccagcgggtaatcatccacgccgacatctacgataccttccgcgacatgctggccgcgaaagtgaagacgctgaaggcaggcgatccgatgagccgcgataccttcatcggtccgatgatctccgcgaaggaggcgcagcggctcaagaagtggatcgatgcggcggtcgcgggcggagcgaggcttcttgcgggcggaagctgcgagggcaacatgctcgaggcgacgctgctcgaaggctgcagccgcgacatggaggtctataccgaagaggctttcggtcccgttgtgatcctgtcgaagttcactgactgggatgccgcgctcgatgaggtgaacgacagcaagttcggccttcaggccggtgtgttcacatccgatctgcacaaggtgctggaggcctgggacaggctcgaggtcggcgggatcgtcgtcaacgacgtttcctcctaccgcgtggacaacatgccctatggtggcgtgaaggactcggggctcggtcgcgagggcattcgtttcgccatggaggacatgacggagattcggaacatggtc

SEQ ID NO: 34382 - DNA, 714 bp, Sphingomonas aromaticivorans
ttcgaaggcaaggtcgcactggtgaccggagcggcatcgggcatcggccgggccgccgcgatccgctttgcagaggaaggcgccagggttttctgcgcggacctcaaccttgccggcgccgaagcagtcgcggcaggcatcggcaagggcgcgagcgcggtgcaggtcgatgtcgcgagctatgccagcaaccaggcgatggtcgacgcggtcatggccaacgcaggccagcttgacgtggcattcctcaacgccggcttctacggcgccgcggaagggctcgacacggtggacgaagcgctgttcgaccgcctcgtcgcgatcaacctcaagggcgcgttcaacggcatcaaggcggtgcaggccgtgattgcgacaggtggcgccgtggtggtcaccgcttcggcggcgggcatcgtggggcatccggcaaacccggcttacagcgcggccaagcacggcgtggtcggcctggtgaaatcctgcgtcgatgcatttgctgcgcgcggcgcgcggatcaacgcgctctgccccggcggcgtggaaacgccgctgatcggcgcgcccgacgttgccatcgtcccggccgcggatctgccgcgcgtgcctgcgcgcggaatgggccgggcgcagcatgtggccgaagtggcgctgtggctgtcgagccccgctgccggcttcatcaccggccaggcgcaggttctcgacgcgggc

SEQ ID NO: 34383 - DNA, 1530 bp, Sphingomonas aromaticivorans
atgctcgatccgctgcccgccaccataccccatgccgcgcaggcggcggcggccacctggcccgatgcaccttccgtgctcgaaaacggcgaagtctggagctttgccgagctgtggcagcgcagccgcgcggcggcttcggcgctgatcgcgcggggcataaaggccggagatcgcgtggcgatctgggcgccgaactcgcgcgagtggatcgttgcggcgatcgcgaccatggcgtgcggggcggcggtggtgacgctcaacacgcggctcaagggccgcgaggcgggcgacatcttgcggcgcaccaatgcgcggcttctgttcacggtcgagggctttctcggcatcgactatcgcgcgctgatcgtggacgaggatctgccggcgcttgaaggaacagtcctgcttgaccgggaattcgacgctttcatgcgtgacggcaggggggcgggcgatccggcggtcgatgcggcgatggcgcagatcgatgccgataccgtgtcggacatcctgttcaccagcggcacgacaggcagccccaagggcgtgttgatgacttatggccgcgtcctgcctcaggcggcggtgtggtgcgcgaacacccgcctgaccgagggcgaccgttacctgattgccaaccctttcttccattccttcgggatgaaggtgggctgggtcgcgtgcatcctcgccggtgccgtggcagtgcccatgctgcaattcgacgtgggtcaggcgattgatctgatcgagcgcgagcgcatcacgttcatgcccggtccgccgacgatcttccagatgctgctggccgaactcgacaagcgcaagtgggactgttcctcgctgcggggaggaacgaccggcgcggcgacagtgccgcccgcactggtggagcgcatccgcaacgacctgggcatggtggacctcatcaccgcctatggcatgaccgaatgcgtcaacatcacgacgtgcgtgcccggtgacgatgccgagaccattgcacggacctgtggcaaggcgtttccgggcaacgaggtgcgcatcgccgacgagaacgggaacgaactgccaaggggcgaggcgggagaggttctggtgcgggggcagggcgtcatgctcggttatctcgacaacccggaagccactgccgaggcgatcgacgcagcaggctggttgcacacgggcgacgtcggcacgatggacgagcgcggttatgtgcgcatcaccgaccggatgaaggatctctacatctcgggcgggttcaatgtgtacccggcggaagtcgaaaagctgctggccgagcatccggccatcggaatggctgcggtcgtcggcgttccggacgagcgactgggcgaggtggggcgcgccttcgtggtcctgcggcccggcgcgagtgcgaccgaggccgaacttgtcgcctggtcgcgcgagaacatggcgaactacaaggtgccgcgcagctttgtgctggtcgatgacctgccccgcaacgcgtcgggcaaggtgctgaagaccgaactgcgg

SEQ ID NO: 34384 - DNA, 1197 bp, Sphingomonas aromaticivorans
atgcgtgaagccgccatcgtttcgaccgcccgcactggcgtgggcaaggcctaccgcggtgccttcaatgacaccgaggcccctgtcctttcctcgcacgtggtcaatgccgcgatcgagcgtgcgggcattgacccggcgcgggtcgacgacgtttacctcggcgtcggcaaccactggaacacgcagagctacaacctcggtcggttgaccgtgcacggttcggtcctgcccgacacgaccgccggcttcactctggaccgcaagtgctcatccgggctcaacgccatcgcgctggccgcgcgggggatcatgtgcaacgagatcgacgttgcggtggccgggggcatggaaagcatctcgctgaccatcaacaagcacgcgcccgccttccgcaaccggtccgaattcatcaaggcggcggacccgcacgcctacatggtgatgatcgagaccgccgagatcgtggccgagcgctatggcgtgagccgcgaggatcaggaccgattcgctgcactgtcgcagcagcgcgcggcggccgcgcaggaggcgggccggttcgacgacgaaatcgtgcctatcacggtgacgaaggcgctgttcgacaaggaaggcaacgagaccggcaaggaacaggtcacactggaccgcgacgagggcgtgcgcgcgggcacgacctatgaggctcttgctggcctgaagccggtgttcaagggtggtcaggtcattgcagagggccgccatgtcactgccgggaacgcctcgcagctttccgatggcgcttcggcgcaggtactgatggatctcgacactgcgcgtgccgaaggacgtccagtgctgggcatctatcgcgggttccaggtcgctggttgcggcgccgaggaaatgggcattggcccggtcttcgccatccccaagctgctcgaccgcgcggggcttaaggtcgaggacatcggtctgttcgaaatcaacgaggctttcgcttcgcaggcggtctattgccagcagaagctggatatcgaccccgaaaggctcaacgtgaatggcggcggaatcgccattggccatccgttcgggatgaccggttcgcgccttgtcggccatgcgctgatcgagggcaggcgccgcggcgtgaagtacgccgtcgtgtcgatgtgcgtggcgggtggcatgggcgccgccggcctgttcgaagtg

SEQ ID NO: 34385 - DNA, 909 bp, Sphingomonas aromaticivorans
ggcaagaccgtggtggttaccgcagcggcgggcactggcatcggctttgccgttgccaagcgcgccgccgaagaaggcgcgcgcctgctcatcagcgacttccatgaacgccggctcggtgaagcggcggaccgcatcgcggctgaagtgggttgcgagcgcccggcgaccgttgtctgcgacgtgaccaacgaagcacaggtgcaggacctgcgcgacgcggcgctggagaagctcggcaaggtcgacgtcctcatcaacaatgcggggctgggcggcgaggtcgatgtcgtggacatgaccgacgaccagtggagccgcgtgatcgacgtgacgctgacaagcctgttccggatgacgcgggcgttcctgcccgcgatgtatgccaacaagtccggcgtcatggtcaacaacgcttcggtgctgggttggcgggcacagaaggggcaagcccactatgctgcggcaaaggccggcgtgatggccttcacccgctgcgccgcgctggaagcggcggaccatggcgtgcggatcaatgctgtcgcgcccagccttgccatgcatcccttcctggcaaaggtgacgacggaggagcgcctggccgaactggtcaagaccgaagcctatgggcgtccggctgaagtgtgggaagtcgcgaacgtcatgctgttcctggccagcgacctgtcttcctacatgaccggcgagatcgtttccgtctctagccagagggcctgagggatgacggcgatcttcgagcgtccggcggacctgatcggcaaggaaggcacccgacttggcccgaccgagtggcttgccatcgagcaggaccgcgtcgacggctttgccgaggtgaccggcgatcaccagtggatccatgtcgatgtcgagcgcgccaaggcagggccc

SEQ ID NO: 34386 - DNA, 2219 bp, Sphingomonas aromaticivorans
atggaattcgcatttaccgaagaacaggcgatgatcgcggaaaccgcccgcgccttctttgccgagaacgcgacgagcgaacgcacccgcaaggcgatggcctcggacggtgtcgatcgcgagctgtggtcgagcttctgcaccgaactgggacttgccgggatcggcgttcccgaggaaatgggcggggttggccttggcatggtggaattcgcgctgatcgcggaagccgccggggcccaggttgccgcgcttcccttgctgggcaacgcccgcgtttcgcacgctctcgttgcgggcgggacggacgaacagcgagtccgctggcttccggcgctggtggcgggtgaggcaatcgcgaccgccacgtggtccgatgacttcactgtcggcgaaggcaagctgagcggaaccttccgcttcgctccgcacggcggggccgcagacctcctcgtccttgccgcgggcgaccgttgctggctggtagaagccgatgcgccgggggtcagcgtggtacagcacgtgacgatggaccagacccgtccgctcgccacgatcacgctggacaatgccgctgccgagccgttcgcggatcacgccgccgccctgcacgcgcttcacgtgacgggctggctgtgccttgccgcagaagcacttggcggtgcgcaggccgctctcgaccgcactgtcgcctattcgaaggaacgcgtgcagttcgggcggcagatcggttcgttccaggcctacaagcaccgcctggccgacatgatgatcgagatcgagcaggcacgctctgccgtctactgggcagcctgcgcggtggacgaaggcagcgatgaagcgcagctcgcgctccattccgccaaggcgttctgcgccgatacgttccacatgtgcgcgggcaacatgatccagcttcacggcggcatcggttttacctgggaacacgacgcgcacctgttcttcaagcgcgcccgttcgatcggttcgatgctgggcgacagccagtggcatcgagagcagattgccggcatggtcctgggagtggccgcatgaagcttggcttttcggcagaggacgaggcgttccgcgccgagtgcgcgggctggctgcaggcgcagatggccggcccctttgccgatatccggggtatccccaacctgtgcgacgagatcccgcgccggaaggaatgggagcagcagcttgccgcgcaccgctggtcgtgcatcggctggcccgaggaatggggcggtcgcaatgcgactctcgcgcagcaggtaatcttcgccgaggagtatgcgcgggcaggcgctcctaaccgcatcaaccacatcggcgtggaacttgccgggccgacgatccttgcctttggcaccgacgagcagaaggcgcgctatctgccgggcattgccgggggcacgcagatctggtgccagggctattccgaaccgaacgccggttccgaccttgccaacgtcaagaccaaggcgcggctcgatggtggcgaatgggtggtgaacggccagaaggtctggaccagccttgcccactattccgacatgatcttcgtcgtggcgcgcaccgaggacggctcggtcgggccaaagggcctgtcgttcctgctgatggacatggaccagcccggcatcgaggtgcgtcccatccgccagatgaacggtgaggccgagttcaacgagaccttcctgaccgacgcacgttgtgcgagcgatgccatgcttggcgccccgggcgaggggtggaaggtggcgatggctctgctcgcgttcgagcgcggcgtttccacgctgggccagcagatgcagttccgcaacgagctggacgcggtgattgcggcggcccgcgcaaatggcaaggccgccgacccggtgatccgccaacgcgtggccgaggccgagatcggccttcgcctgatgcgttatggcgcgctgcggatgctttcgaacaccgacctgtcggccatcgatggcgcagcgctgacctacaagatccagtgggcaacgtggcggcgcgaccttggcgagctggcgatggacgtcatcggccaggccgccgaactggccgaaggcgatgactatgcatggggggcgctgcccaacatgtacctcttcagccgctccgacacgatctatggcggcaccaatcagatccagcgcaacctgatcgccgaacgcggacttggcatgccgcgcgagccgagg

SEQ ID NO: 34387 - DNA, 897 bp, Sphingomonas aromaticivorans
ttgggcatctgtgacaaccgcaccgtcatcatcactggcgccgcccgcggcctcggccgcgcctatgcactggcgttcggggcggaaggggcgaacgtcgtcgtcaacgacatcggcacatcgcttggcggcgagggacgcgataccagcgcggcggacgctgtggtcgaggaaatccgcgccgccggcggcaaggcgatcgccaactacgaggacatcaccgactgggatgccgccaagcggatcgtcgatgccgcgctggaggcgttcggtgacctgcacgtggtggtcaacaatgccggtatcgtgcgtgaccgcatgttcgtgtcggcaacggtcgaggaatgggacgcgacgatgcacgtgcatctgcgcggccacttctgcgtttcgcgccatgccgtgaactactggcgccagaagcagaaggatggccgggaccccgacgcaaggatcatcaacacgtcgagcggcgcgggccttcagggttcgatcgctcaggcggcctacgccaccgccaagggcggaattgcatcgctgacgctggtccaggcggctgaactgggacgctatggaattaccgccaatgcgctcgccccatctgcgcgcacgcgcatgaccgaacagacctttgccgacaagatggcgaccgaaggacaggctttcgacgtgatggatcctgcgaatgtcgcgccgacggtggtgtggctcggcagcagcgccagcgcacacgtctcgggctgcgtgttcgaactcgagggcggcaagatcatgctggaggacggatggcgcgaaggcccgttcgtggatcgccaggcgcgctgggagccgtcggacgttggagcggctgtcgacaagctgctctccgagcgggtgccgccgcgcaaggtctggggc

SEQ ID NO: 34388 - DNA, 1521 bp, Sphingomonas aromaticivorans
tcggcaagcccatcggctcctaccaggcggtcaagcaccaccttgccagcgcgcaggtcgcggtcgagttcgcgcggccggtcgtactcgctgccgcggccgagatcggccatgccgacgtgcaatcccgcgcccgcgtgtccgaggcgaagatcgtcgcgctcgaggctgccgaaaaggccgcgcgcgcctcgatccaggttcatggcgcaatgggctattcctgggaggtcgacgtccacctcttcctcaagcgcgcgctggcgctgacccattcgtggggcacgcccgctttccaccgcaatcgcatcgccacccgcgtcttcagccagcccgtcggggccgaccagacctttgcccgcgagaccgaacatgcctgaagcctacattatcgacgccgtgcgcacgcccgtcgggcgcaaaaagggcggcctcgcccatctccatccggcagaccttgctgcacacccgatccgcgaactgatggcgcggcacgacttcgatcctgcgttggtcgaggatgtggtgtggggatgcaccgaaacgatcggcgggcaagcgggcgatatcgggcgcacggcatggctcgtcgcaggacttgccgaggacgtgccgggcgtgaccgtcgatcgccagtgcgggtcggcacagcaggcggtgcattttgccgcacagggcgtgatgagcgggacgcaggatattgtcgttgccggtggcagccaggcgatgaaccgaattccgatcatggccgcgatgacagccggtgccgcatatggattcgaaagcccgttcatcggcgccaagggctgggacgcgcgttatggcgaccaggaggtcaaccagatccgctcggccgagatgatcgccgaaaagtggaacctcagccgcgaggaaatggacgctttcgcctacgagagccaccgccgcgcgcagtacgcgaccgagcagggctggttcagaaacgagatcgtgccgctcgaaggactagatcgtgacgagacgatccgtcccggcacgacactggaagggctggcttcgttgagcgccgtgcgtgaaggcgggcgagtcacggcgggcaacgcaagccagaattcggactgtgcggcggccctgctgatcgtcagcgagcgtgcggtgaaggaacacaacctgaagccacgcgcgcgcatccatcacatgtcggtgcgtgccgacaatccggtgtggatgctgaccgggccgatcccggcaacgcgctatgccatgcagaaatcgggcatgaagctgtcggacatcgacctgttcgaatgcaacgaagcgttcgcttccgtaccgatggcgtggatgaaggagctcgatatcccgcacgagaaggtcaacgtgtccggcggcgcgattgcgctgggccatccgatcggatcgaccggtgccaagctgatgacgactttgctgaacgcccttgaacgcaccggtggccgctatggcctccagacgatgtgcgagggtggcggccaggcgaacgtcacgatcatcgagaggctt

SEQ ID NO: 34389 - DNA, 1143 bp, Sphingomonas aromaticivorans
atggacctgacctacacccccgaacagcaggcgttccgtaccgaagtgcgcgcctggcttgaagcgcatgttccgaaggagccgctcgaacactacgacgctacgcgtgagggcttcgaggcccaccgccgttgggaagcgacgctcaagtccggcgactggggcatggttacctggcccaaggaatacggcgggcgcggggtcgacctcatccagtggctgatcttcgaggaagaatattaccgttcgggcgcaccgggccgcgtcaaccagaacggtatcttcctgctcggcccgacgctgatggagttcggcacgcacgaacagaagtctcgcttccttccgccgatggcgagcggcgaggaaatctgggcgcaagcctggtccgagcctcaggcaggatcggatcttgcaggcgttcgcgccactgcggttcgtgatggtgacgaatatgtcctgaatggtcacaagatctggtcaagccgtgcggcctttgccgactgggctttcggcctgttccgcgaacccgggagcgagcgccacaagggcatgagcctgatcttcttccggctcgaccagcctggcgtcacccgcaatccgatccgcaagatcaacggtcacgtcggctttgccgagatattcctcgaggatgtgcgtgtgcctgccttcaaccggctcggccaggaaggtgaaggctggcacatctgcatggcgactgctggcttcgagcgcggcctgatgcttcgcagcccggctcgcttccaggaagctgccgccgcgctttcgcatctgtggcaagcccgcaagcacgactgcgatccctgcctggaggccgaggtcgtgcgcgcgcacatgaatgccgatgcctatgcgctgtcgatctatcagaccgcatcgcgcctgatggcgggcgcgaagatcgggccggaagcttcgaccaacaagattttctggtcggaaatggacatccacctgcacgagaccgcgctcgcgatcctcgggccggaagccgagctggtcccgccgacaggcgatcacgaatggcttgacgactacatcttctcgctggcggggccgatctacgccggctcgaacgagatccagcgcaacatcattgccgagcgcatgctcggcctgccgcgc

SEQ ID NO: 34390 - DNA, 759 bp, Sphingomonas aromaticivorans
cagggcgcagaccatatcgaccttgtcggacaggtggcgatcgtcaccggcggaacgcgcggactggggcgccagatcgccgaggcgctggtgcgtgccggtgctgccgtgacggtgtgcgggcggaccgaaccggacgatcttcccgagggtctccacttccatgcggccgatatccgcgagcccgatcaggccacggcgctggtcgatgcggtcgttgcccgctacggccggatcgacatcctcgtcaacaatgccggcggatcgccgcaggcccccgctaccgcatcgccccgcttcttcgatgcgatcgtgcgacttaaccttcacgccgccatgtacatgtcgcaggcggccttcgcgcacatgcaacccgcgcgcagaggcagcatcgtcaacatcgccagcgtctccggcatccggccttcgccaatgacggcagcttacggcgccgccaaggccggtcttctcaacctcacccagagtctcgctcaggagtgggggccggacggcgtacgggtcaacgcgatcatcgtcggtctgatgcagaccgaaaccgcgggcgaaacctacggcgacgacgaggcccaggctgccgtcggccgttcactcccgctccagcgcatgggcacgggcgtggatattgcaggtgcggtgctctggctctgctccggtcttgcctcgtgggtgagcggcgcgcgcatcaatgtcgatgggggcggcgaacggccatacttcctcgacctcgtgaaaggaaac

SEQ ID NO: 34391 - DNA, 1575 bp, Sphingomonas aromaticivorans
ttcgatttcgtcatcatcggcggcggcgtcgcggggtgcatcctcgccaatcgcctgtccgccgatcccgccacccgcgtcctgctgctcgaggcgggcggctccgacaggagcccgctgatcgccgctcccggcgggctgcttccgatcatgatgtcgggcgcccacgcatggcgctacgtgtccgcgccccaacgccatctcgacgaccgcgtgctctatctcccgcgcggcaaggtgcttggtggaggctcctccatcaacggcatgacctatgaccggggcttccattcggactacgatcgctgggcacaggcgggcaatcggggctggtcattcgaggatgtcctcccctatttccgcaagctcgagaactacctgcccagcgaggacgaatggcacggtaggggtggcccgatccaggttacccgcgccgcgcaggaccatccctttgcgaaggccttcctcaaggcgggcgccgaagccggctaccccctgacgcaagatctcaacggcgcctcgcgcgacggcttcggcgcggtggaccttaccgtcggccggggtcgccgttccagcgcctcgtccgcctacctgcgccctgccaagggcaggcccaacctcaccgtcctgacccaggcgcatacccgccgcatcgtgatcgagaacggccgcgccaccggcgtgatcttccgccgcaagggcgcggaccggctggcactggccgcgcgcgaggtgatcctttcggcaggcgcgatcaacagcccgcaaatcctcatgctctcgggactgggcccggccgcgcaccttgccgaacacggcattcaggtcctgcacgatcttcccggcgtcgggcagggcctgcaagaccatctcgccgcccacgtaaagtaccgctcgaccaagccctggtcgatgctgcgctatctcaatcccctgcgcggcgcgctcgccatggcccagtatgccctcctgcgccgaggtccactcgccgatcccggcatgtccgtcgcctgcatggtccgctccgatccctcgctggatgaacccgacatcaagatgctgctggtgagcgcgctcttcgcgcagaacgggcgcgagatggtgccgatgcacggcttctacgcccatatcaacgtcgcccgcccgcaatcgcggggttcggtcacgctcgccagcgccgatccggaagtgccgccggtcatcgaccagaactacaacgccgctcaggaagaccgccgcgccatgcgcgaaggcgtgcgcatcgcccgccgcatcttcgcccagcccgctttcgacatcatgcgcggagaggaactggcgcccggcagcggggtcgaatccgatgcgcagatcgacgcctatatccgcgccaccgccgaggccgactatcactccaccagcaccgcccgcatgggtcgcgatccgatggccgtggtcgatgaccgactgcgcgtccacggcgttgcagccctgcgggtggtcgatgcttcggtcatgccgcaccttccgggcggcaacaccgccatccccgtcgcgatgatcgccgaaaaggccgccgacctcattctttcgaag

SEQ ID NO: 34392 - DNA, 1086 bp, Sphingomonas aromaticivorans
atgaagactcgcgcgatggtctgccacgcccccggagccccgctggtcgaggaagaactggaccttgccccgcccggccccggcgaagtcctgatcgagatcatggcaagcggcctgtgccacaccgacctgagccagctcgagggcgtggccgcgccttatcccttccccatcgtcgtcggccacgaaggcgccggcgtggtgcgcgaagtcggcccgggcgtcacttcgctccgcgtcggagaccatgtcgtcccgctcggcatcggggaatgcggcgaatgcggcaattgccgttcgggcctgaccaacttgtgcgaggccttccttgccgacatggcaagccagcccacgcccttctcgctgggcggcaagcgcgtctcggcctattccggcgtcggctcgctcgcccagttcatcgtcacggccgaacgcaacgtggcgctgatccgcaaagacgttccgttcgagctagcctgcactgtcgggtgctgcgtcgccaccggcgtcggcgccgtgctccataccgccgatgtcggcgaaggcgcgacggttgcggttttcggcctcggcggaatcggcctcaatgtggtgcaaggcgcgcgccttgccggagcctcgcggatcatcggggtcgacatcaatccattgcgcgatgcgcaaggccgccgcttcgggatgaccgatttcatcgacgcgcgcaacgccgacccggtggatgccatccgggcgctcaccggcggcggatgcgatttcgccttcgaatgcgcgggcaacatcaagctaatgcagcaggccttcgaatccacccggatcggctggggctgcaccgtcgtcctgggcgtgccgcccgatggcgcagcgctcagcctggtgcccttccagctccagctcggccgccgcgtccagggatcattcatgggcaacatgaagggccgcagccagctacccggcctgctcgaccactatgccgaagggcggctgaaccttgacgacctcgtcacccaccgcctgccgatgcgcgaagtcaacaacggcttcgcgctgatgaagcgcggcgaagccctgcgcacggtcgtctccttc

SEQ ID NO: 34393 - DNA, 1482 bp, Sphingomonas aromaticivorans
atcgaaagccgcccccatggcaccgccgaagggtggaagcgggtggtcgacaatggcgcgctggtggccgaaggccccgccgcgcttccgcccgggacgcgggtgagggtcgaacatctgttcgagaagatcccggcgcgccgcaagttcctgcgcagcccgcgctcggaatgggccgctgcatcggatgtcgtccgccgcctcgccatggcccgccccgacgtcggcttcacgctcgaacacgacggtcgccgcgcgctccacgtccaggccggggaaacgctcgaggcccgcgtggcgcaactcgtcgcgcgcgaactggcgggcaattcggtcgaggtcgacctcgtccggggcgatttccacctcaccggcatcgccggcttgccgaccttcaaccgcggcgtggccgatcaccagtacctgttcgtcaatggccgtccggtgaaagaccgcctgcttatcggcgcggtgcgcggcgcctatgccgacatgctcgcgcgcgaccgtcatgccgtgctggcgctgttcctgcaggttccggccagcgaggtcgacgtcaacgtccatcccgccaagtccgaagtccgcttccgcgacccggcgctggtgcgcggcatggtcgtctcggggttgcgccatgcgctttccaccggcgaccagcgatccgcccaggctccctcggcaagcgcgatggctgcctggcaggccgaacccatcgcgccgccaccaccttcgtctccgtcaagcgactggcagggcagcatcttttcgcaacagtggaaacctgaaccgcgcgtcagcgaagccgggcaggcgtggcggggctacgagcaggcgatcatggcgcccccgtccgcaagggccgagcctgcggcccagccggtggtcgatgccgcgcaacatccgctcggcgtggcgcgcgggcagatctcgaacacctatatcgtcgccgaggcggaggacggtctcgtcatcgtcgatcagcacgctgcccacgaacgcctcgtgctcgagaggctgcgcgccgccggggcggggcagggcgtggcgccttcgcaggcgttgctcatccctgaggtggtcgagcttgatgaaacggcgtgcgaccgtctggaagaagcttcggaaaagcttgccgaattcggtctggcgctggagcgtttcggtcccaatgcggttctcgtgcgcgccattccggcggctctcgccaagggcgatccggcaaggctggtggcagatgtcgcggacgatcttgcccaccacggcgatgcgctgctgctcggcgaaaagctcgacctcgtcctcgccacgatggcctgccacggctcggtccgcgcagggcgcacgctctcggtggcggaaatgaacgcactgttgcgcgaaatggaagtgacgccccgctcgggccagtgcaaccacggccgcccgacctgggtgaaactcgcgcacggagacatagaaaagctgttcgggaggaag

SEQ ID NO: 34394 - DNA, 1122 bp, Sphingomonas aromaticivorans
cgccgcttcaccgacgcggaaatcctgcccaacgcgcacgagtggcatctcgccaatgcgctgatcccggacgggacggtgcgcgccatggccgagcttggcactttcggcgtatgcattccggaagaacacggcgggtttggcctcggcaagctggtgatgtgcgtcgtgaccgaggagctttcacgcgggtggatcggcgccggatcgctgggcacgcgctccgagatcgcaggcgaactgatcgtcctgggcgggaccgagacgcagaaggcgcgctggctacctgccatcgccagcggagaagtgctgccgaccgcagttttcaccgaacccgatacggggtcggaccttggctcattgcagtcgcgcgcgcggcggggcgaagacggcggttggatcatcgacggggcaaagacctggatcacccatgccagccgttcggacctgatgacgatgctcgtgcgtaccgtgcccgacgccaggggctatgccggactttctatgctgctggtgcccaagccacgcgggacgcaagacgatccctttccagcggaggggatgagcgggagcgagatcgaggtgctcggctatcgcgggatgcgggaatatgcgctccagttcgatggaatgcgggcgccgggcgatgcgctgctgggcggcgaggaggggcagggcttcaagcaactcatgcgcacattcgagggcgcacgcatccagactgctgctcgtgcggttggcgtggcgcgccgggcgctcgagctcggactggattatgcgttgtcgcgcaagcagttcggcaaggccatcgtcgggttcccgcgcgttgcggacaagctggcgatgggcgcggttgacatcgtcatggcgcgagaactgacttatgccgccgccagggccaaggattcgggcaagcgctgcgatatcgaggccggcatggccaagctgctcgctgcacgggcggcgtggtccaacgccgatgccgcgctccagattcatggcggcaacggctatgcgctcgaatacgagataagccgggtgctgtgcgacgcccgcatcctcaatatcttcgaaggcgcggccgagatccaggcgcaggtgattgcgcgcggcctgatggaa

SEQ ID NO: 34395 - DNA, 846 bp, Sphingomonas aromaticivorans
gaaataatcgacggcaaggcgcttgcgacacaggttcttgcgcgcacggccgaggacgtggcgcagatgatcgcggcgggcgccggcgcgccgggactggcggtaatccttgtcggcaacgacccggcaagcgaggtctatgttggtcgcaagatcgcgcagtgccgcaaggcgggcatccgctcgatcgaacatcgactgccggccgataccccgcaggaacaggtactggcgctgatcgacgcgctcaacgccgatgaagaggtgcacgggatactggtgcagttgccgctgccgcggcacatcgacgcggcgctggtcctcgaccggatcgatccgggcaaggacgtcgacgggttccatccggtcaacgtcgggcgcctttcgacagggacgggcgggctggtgccctgcacgccgctgggcgtgatgatgctgctcgacagcgtgatcgacgactatcgcgggctgaaggtggtggtgatcggcaagtccaacatcgtcggcaagccggtctcgatgctattgctggagcgcgaggcgacggtcaccgtcacgcatatcgaaacgcgcgacctgcccgacgtggctcgcaaggcggacatcatcgtcgcggcggcgggcgcgccccatctcgtgcgcggatactgggtgaagcccggcgcggtggtgatcgatgtgggcatcagccgcgtgacagaccacgacggcgtgacccgcatcgtcggggactgcgcgacgcacgaactcgatcacgcaaaggcagttaccccggtgccgggcggggtagggccgatgaccatcgcctgcctgctcagcaacacggtgctggccgcgaagatgcgc

SEQ ID NO: 34396 - DNA, 726 bp, Sphingomonas aromaticivorans
atgttgtttgaaggcaagaatgtcatcgttaccggcgcggcttccgggatcggccgcgccaccgcgatccgcttcgccgctgaaggcgcgcgggtcaccatcggtgacaagaatgtcgcggggcttgaggaaacggcggcgatgatggcatcggcgccggtgatccagcccttcgacgccgtggacaacgcttcctgtcgcaagcttgtcgaagtgggcgcacgcaatggcctcgatgttctctgcaacatttcgggtgtgctcaagtgggggcggagcgaggacttttcgctcgaggatttcgacctggtgatgcgggtcaatacccatagcgtgttcacgctgtgccaggcggcgctgccgcaccttgtggaaagcaagggcaacatcgtgaacaccgcttcggcggcggcgctccagggcattgcctatacggtggcctatgttgcgtcgaagcacgcagtggccggcatgaccaagagcctggccgtcgagttcgcgtcgcgcggtgtgcgagtgaacgccatctgtccgggtgacgtcaagacgccgatgacccaacagaccgccgtgcccgaaaatgtcgactgggcgctggtcatgcgcaacgcgcccaagctgctcgatggctcgtgcgagcctgaggacatcgccgaactcttcgcgttcctggcgagcgagcgggcgcgcaagatcaccggcgcgctgttttccatcgatggcggg

SEQ ID NO: 34397 - DNA, 1482 bp, Sphingomonas aromaticivorans
atgacctcaacttcctcctctccggtcaccgaaactatcctgaacttcattgacggttcctatcgcaaaggtagcgagggtaagtcgtttcccaacgtcaatccggccaccggcaccgcgatcggggttgtgcacgaagcaagccaggccgacgtcgcagacgccgtggctgcggccaaggcagcgcttaccgggccatggggcaagatgaccacggccgagcgggtcaagctgatcgccgccgtggcgaccgagatcgaacgccgagcggatgatttcctggctgccgaagtggccgacaccggcaagccgcgccatgtcgcgtcccatatcgacattccgcgcggggccgccaacttccgcatgttcgcggatgtcgtctcgacaatgccgggcgaaagcttcaacacatcgacccccgatggcggccaggcgctcaactataccgtgcgcaagcccaagggtgtggtcgcggtggtctgcccatggaacttcccgctgctgctgatgacctggaaggttggcccggcgctggcctgcggcaataccgtggtggtcaagccgtccgaggaaacgcctcggactgctgccctgctgggtgaagtaatgaacgcggtgggcatgcccaagggtgtctacaacgtcgtccacggattcggtccgggttcggccggcgaattcctcacgtccaaccccgatgtcgatgccatcaccttcaccggcgagaccggcaccggacaggcgatcatgcagaaggccgcgatcggcgttcgcgacatttcgttcgaactcggtggcaagaacccggcgattgtgttcgccgatgccgacctcgacaaggcggtcgagggtctgtcgcgctcggtcttcctgaacaccgggcaggtctgcctcggaaccgagcgggtctatgtcgaacgaccgatcttcgacgccttcgtggcgcggatggcggcggcggcgcagggcttcaagccgggcgtgaccggtgatcgcgcctatctcggcccgctgatcagcgccgagcaccgcgagaaagtgctgggttactatcgccgtgcggtcgaggacggggccaccgtggtcaccggcggcggcgttcccgaaatctcgggtgcggaagccggtggcttcttcgtggaaccgacgctgtggatcgacgtcgcccacggcgataccgtgatgcgcgaggaaatcttcggaccgtgctgcggtatcgtgccgttcgacagcgaggacgaggtgatcgcacttgcaaacgatacggtttacggcctgtgcgcctcgatctggaccgaaaacatgtcccgcggacaccgcgtggcggcggcgatggacgtgggggtgtgctgggtcaattcctggttcctgcgcgatctgcgcacggctttcggcgggtccggccattccggcatcggccgggaaggcggggtgcacagcctcgaattctacaccgagatcaccaacatttgcgtgaagctg

SEQ ID NO: 34398 - DNA, 1503 bp, Sphingomonas aromaticivorans
atggctacgcagttgagaagtgcagaaaacgaatacgggatcaagtccgagtacggccactatatcggcggcgagtggatcgccggggacagcggcaagaccatcgatctgctcaatccctcgaccggcaaggtgctgaccaagattcaggccggcaacgccaaggatatcgaacgcgcgattgccgccgccaaggcggcgtttcccaagtggtcgcagagcctgcccggcgagcgccaagaaatcctgatcgaggttgcgcgtcgtctgaaggcacgccattcgcactatgccaccctcgaaacgctcaacaacggcaagccgatgcgcgaatcgatgtatttcgatatgccgcagacgatcgggcagtttgagctgttcgccggtgccgcctatggcctgcacggccagacgctcgattatcccgacgcgatcggcatcgtccaccgcgaaccgctcggcgtctgcgcgcagattatcccatggaacgtgccgatgttgatgatggcgtgcaagatcgcgcccgcgctggcctcgggcaacactgtcgttctgaagccggccgaaacggtctgcctttcggtgattgaattcttcgtggaaatggctgatctgttgccgccgggtgtgatcaacgtcgtcaccggctatggcgcggacgtgggcgaggcgctggtcaccagccccgatgtcgccaaggtggccttcaccggttcgatcgccaccgcgcgccggatcatccagtatgcctcggccaacatcatcccccagacgctcgagttgggcggcaagtcggcgcacatcgtgtgtggcgatgccgacatcgacgcggcggtggaaagcgcgactatgtcgaccgtgctcaacaagggcgaagtctgtctggccggttcgcgcctgttcctgcaccagtcgatccaggacgagttcctggccaagttcaagaccgcgcttgaaggcatccgccagggcgacccgctcgacatggcgacccagcttggcgcccaggcatcgaagatgcagtttgacaaggtgcaaagctacctgcgcctggccaccgaggaaggggccgaggtcctgaccggcggcagccgctcggatgccgcagatctggccgatggcaattttatcaagccgaccgtgttcaccaacgtcaacaactccatgcggatcgcgcaggaagagatcttcggaccggttaccagcgtcatcacctggagcgacgaagacgacatgatgaagcaggccaacaatacaacttacggcctcgctggcggcgtctggaccaaggacatcgcccgagcccaccggattgcgcgcaagctcgaaactggcacggtctggatcaatcgctactacaacctgaaggccaacatgccgctgggcggttacaagcaaagcggcttcgggcgtgaattcagccatgaagtgctgaatcactacacccagaccaagtcggtggtggtcaacctccaggaaggtcgcaccggaatgttcgatcag

SEQ ID NO: 34399 - DNA, 798 bp, Sphingomonas aromaticivorans
gtgactgcaagactcgaaggacaggtggcgctgctgaccggcggcgccaccgggatcggcgcggcggtcgtcgcccgctatctcgaagaaggtgcaaaggtaggcgtcctggtcagggacgccgaccaagctgacatggtgcgcatgcggcatggcaaaggaatagtcgtggttgagggcgatgtccgcaactattccgacaaccagaacgcggttgcggcgaccgtggctaccttcggcaagctcgacgtgtttgtcggcaatgtcggcatctgggattacatgaccccgctggcggacatggatccggacaagctctccgaaacgttggacgagatttttggggtcaacgtcaagggctacttcttcggtgcccgcgccgcaatcccggaactcaggaagaccaagggcagcatcatcttcacggcctcgacctcgagcttctataccggcggcggtggcacgccctatgtggcatcgaagcacgcggtccttggtctgatccgccagctggcatgggaacttacccccgatgtcagggtcaacggcgtggctccgggcggcacccggacacccctcggcggcaccaaggcgggcggaacggccgatgtccacatggaggacatggaaggcctcgacgcgatgattgccgggatgacgccgctcgcgcggatcgctgaaccggatgatcacacagggctctatgccttgctagcctcgcgtcgggactcggcctacatgacaggagcggttttgctcagcgatggtggcatcggcattggcaagcgtcccgaaggc

SEQ ID NO: 34400 - DNA, 708 bp, Sphingomonas aromaticivorans
atgcctgatcgcctgtccggcaaggtcgcggtcgtcaccggcgctgcggcgggcatcggcaagggctgcgcccgcattttccgcgaggagggagccgccgtcatcggcgtcgatcttgcaggggcggaccgcgcctgcgacctgaccgacgagacgcaggtttcagcgctgttcgccgcgatcgtggccgagcacggcaggatcgacgtgcttgtgaacgccgccgcctttgcggtcttcgcgtggatcgaggaaatgacccttgcggagtggcggcgcacgctgaccggcgaactcgacaccgttttcctgccgacgcgcgcggcctgggcgggcctcaaggccagcggcgctgccagcgtgatcaacttcgccagcgccaacgcgcgccacgcgctcgacggttcggccgcgctcgcgcattgcgcgggcaagggcggcgtccttgcgatgacgcggcagctcgcgatggaaggtgcccctcacggcatccgcgccaactcgatctctccgggcttcatccgcaccgaggcgacgggacgccaccttgccgaagtcccggacctgcgcgaccgggtccttgccaagaacatggtcaaacgccttggcgagcctgaagacatcgcgtggtgcgccacatggctcgccagcgacgaggcccgctatgtcaccggggccgacattgccgtggatgggggcgcgacggcc

SEQ ID NO: 34401 - DNA, 765 bp, Sphingomonas aromaticivorans
atggatatccagggactggccgcgattgtcaccggcggcgcatccggacttggcgcggcaaccgcggaactgctggccgcgcgcggcgcgaaagtcacgctgttcgatctcaacgcggatctcggcaatgccaaggccgccgaaatcggcgggcgcttcgctgcggtgaacgtgaccgacgaggatgccgtcgccaatgccatcgccgaagccgaagcggtcaacggcaaggcacgcatcctggtgaactgcgcgggcatcggccctccggccaaggttctcaatcgcgacggcagcccgctgccgctggcggacttcgcccggatcatcaacatcaacctgctcggcacgttcaacgtcctgtccaagtttgcctcgcgcatccacgatgcggaaccgcttaacgaggacggcgaacgcggcgtgatcgtcaacactgccagcgtcgcggcgttcgaaggccagatcggccagcccgcctatgccgcgtcgaagggcggcgtggtcggcatggcgctccccatcgcgcgcgaatttgcccgctatggcatccgcgtgaacactattgcgcccggtatcttctggacccggctgctcggttcgctgccgcaggaagcgcaggattcgctcggtcggcaggtgccgttccccagccgcctcggcaagcctgccgaatatgccaagatggtcgaggcgattgtcaccaacccgatgctcaacgcggaagtgatccgcctcgacggcgcgatccgcatggcgccaaag

SEQ ID NO: 34402 - DNA, 2559 bp, Sphingomonas aromaticivorans
cccgccgccccgatagtgaacgccatgcccgacgccgagaccctgcccggcctttcctctcaagaagccgcagcgcgtctcgcctcggaggggcccaacgcccttgcatcaggcgaggcgaggaccttcggacgaatcgtgctcgatgtggtgcgcgagccgatgcttgccctgctgctggtcgcgggtgccatctaccttgccctgggcgatctccacgaagcgctgcttctcgtggcgttcgcctgtctctcgatcctgataacggcggtccaggagacccgcaccgagcgcgcggtcgccgccttgcgcgacctgaccagcccgcgtgcgctggtcatccgtgacggcgaacgcatccgcattgcgggcagcgaggtcgtgcggggagacgttgtggtcctgcaggagggcgaccgcgtgccggccgacggctggatcgcccggtccagtgcgctgctggtcgatgaatcgctgctgacgggggaatccgtgccggttcgcaagaccgcgaccgatatcgagccgacagcagccgagtgccgcccgggcggcgaagacctaccctttgcctggtcgggatcgctcgtcgtgcgcggaaccgggctttgcatcgtcaccgccacagggagcaaaagcgcaatcggcgcaatcggcaatgccctggcgactatcgagacagaagcgccccgcctgcggcaggagacacggaggctcgtgtacctcttcgccgccatcggcatcggggtgagcgcgctggcggtcatgctttatgggctgttgcgcggaagctggctcgaagccgcgctggccgggattgcccttggcatgtcgatgctgcccgaggagttcccggttgtcctcaccatcttcctcgcgatgggtgccatgcgcatgtcgcggatcaaggtccttgcccggcgcgcggcggccatcgaaacgctcggttcggcaagcgtgttgtgcaccgacaagaccggcacgctgacccagaaccgcatgcgcatcgaacggctgtggcttcccgatggcaggacggtggcacgcgacgaacttgcggagcgcggtctcgagggcgagttccacctgcttgccgaactcggcatccttgccagcgcggaacgaccggtcgatccgatggagcttgcgtttcatgaactgggccgcgaactgggcgacgcccgcgggcgcgaggacatccgcgggcgacagcggaatggctggacgctgcgacaccactatccgctcgacccggcgctgctggccatgtctcaagtctggggcggcgcaccggatggggagcagatcgtcgccaccaagggcgcgccggaagcgattgcggaactctgcgcgctcgccccggaagaccgcgcggcgatgaagcaagcggtggacgcgatggccgaaggcggcctgcgcgttctgggcgtggcagaagcgcgatggaaggcaaccgacctgccggaatcgcaccgcgccttcgcatttgcctttcgcgggctggtgggactggccgatccccttcgcccgtccgtccccgatgccgtgcggcagtgccgcgaggccgggatccgcgtggtgatgatcaccggcgactacccgcagacggcgcgcgccattgcccgacatgccggaatcgacgcgacggaagtgctgaccggcgcggacatggagccgctcggcgacgaagccctggccaagcggctggcaagcgtcggggtctgcgcccggatcatgcccgaacagaagctgcgcctggtcgaggcgttcaaggcccagggcgctattgtcgcgatgaccggcgacggggtgaacgacgcgccctcgctcaaggccgcgcatatcggcatcgccatgggggggcgtggcaccgatgtcgcgcgggaggccgcgtcgatcgttcttctggacgatgacttcggctcgatcgttgccggggtgcgcatggggcggcgcatctacgacaacctgcgcaaggccatggcattcatcgttgcggtccacgtgccgattgcgggggtcgccctgcttccgcttctgacggggctcccgctgctgctggggccggtccacatcgccttcatcgagatgatcatcgatcccgtttgctcgcttgccttcgaggccgagaccgacgaacgcgacgtgatgaagcgcccgccgcgctcgccagatgcggcgctgttctcgcgcagcctgatcgggtggtcgctggtgcagggactgatggtgcttgcggtcaccgcgctgtggatcgtgatcgcggcgcggggcggggccggcgacggcacgatccgggcgacggcgttctttgcgctggtgttcgggattgccgcgctgatcctcgtcaaccgccgcttcagcccatcgttcgcccacgcgatgcgcaggcccaatccggcgcttgccctggtgctgggcgcggtcgcggcgatccttggcgcggcgcaactggtgccggcggtgacgcggttgttccagttcggcgcggtggggccggaaaggctgacgatgatcgccaccggtgcggtggccatgctgatcgtgctggaacggctg

SEQ ID NO: 34403 - DNA, 690 bp, Sphingomonas aromaticivorans
ggcggcgcgtcgggcctcggagaggccatcgcgcgggcctttgcggcagagggcgcatcggttgtcgtcgccgatatcgatgtggccggcggcgagacgctggcggcgcaaatcggcgcacagttcgttccgctcgacgtgacgcaggagggatcgtgggccgaagccgtcgctccgttcgaacggatcgacgtgctggtcaacaacgccgggatcaccacgctcggctcggtcgaggaaatcacgctcgaccagttccggcacgagctggacatagacgtgctgggcgtgttcatgggcatccaggccaccctgccccggatgaagacgcacggcgggtcgatcatcaacatgtcctcgctctcgggcgtgaaggcatcggccaacctcgtcgcctacaatgcggcgaaggcggcggtgacgctgatgacgaagtcctgcgcgctgcactttgccgacaagggctatggcatccgttgcaactcgatccaccccggcgcgatccacacgccgatcatcgacaaggtgctggcccagtccgacgatcctgacgcgctctaccgcagcttcgtcgatgtccatccggtgaagcggctgggcaagccggaggagatcgcggcgatcgcggtctatctcgccagcgatgccagcgcctttgcaacgggcgcggagttccgcgtggacgggggc

SEQ ID NO: 34404 - DNA, 897 bp, Sphingomonas aromaticivorans
ggcgaagtgcgggtcaaggtgcacgcctgcggtgtctgccgcacggacctgcacgttgccgacggcgacatccacggtctgctacccatcgtgcccgggcacgaagtgatcggcgttgtcgacgcactggggccgggggtgacggatgtcgagcccggtgcgcgggtcggcgtcccctggctcggccatgcctgtggcacctgcccatattgcgacagcgggcgggaaaacctctgcgacgcgccgctgttcaccggcttcacccgcgatggcggctacgctacccacgtgatcgccgacgcgcgcttctgctttcccattccagagggtttcgacgatctccacgcggcgccgctcctgtgcgcgggccttatcggctatcgcgcgcttcggcttgccggcgatgcccctgtcctcggcttctacggcttcggagcggcggcgcacatcctcgcgcaagtggccctgtggcaggggcgcacggtttacgcgttcactcgcgatggcgacgcgaaggcccaggcctttgctcgtgacatcggttgccaatgggccggaccctctggcgccgcgccgccgcaagcgctcgacgcagcgatcatcttcgcctctgcgggagaattggtgcccaccgccctgcgtgccgtgcgcaagggcgggcgcgtggtctgtgccgggatccacatgagcgacatcccggccttcccctacgccgatctctgggaggaacggcagatcctctcggtcgccaatcttacccggcgcgatggcgtcgaattcctgccccttgcagcgcgggcaggcgtgcgcacacatgtcgaggccatgccgctaatgaaggcgaacgaggccctcgaccgcctgcgccgtggcgacgtcagcggcgcgctggtgctc

SEQ ID NO: 34405 - DNA, 750 bp, Sphingomonas aromaticivorans
cgtctttccggcaagattgctctcgtgacgggcggcgcgtcggtgccgggcctcggcagcgcgacggcgcaacgctttgcggaggaaggcgcgaaagtgtggctcactgaccgcgacctcgccggcgccgaaaaagtcgccgaaggcattcgtgcggccggcggccaggcgcgggcgctgctgcacgatgtgaccaacgaggcgcaatgggacgaagtcttcgccgcgatcgaggccgaggacggcaagctcgacgttcttgtaaacaatgccggcatcgcggtcctgcgcccgatcgccgaaatgaccactgccgactggaacctccagaattcggtcaatctcgatagcgtgttccaggggaccaagcgtgcggtcgtgctgatgcgcaagaccggcaccaagggctcgatcatcaacatttcgtcggtcgccggcctgatcggcgtgccggcatgtggtgcttatgccgcggcgaagggcggcgtccgtctgttctcgaagaccatcgcggtcgagacggccaaggatggcatccgcgtgaactcggtccaccctggcatgatcctgaccaatatccagggcgtcgcgcaggaagacaacgcggcgaactacgacgccacgcttgcgctcgtgccgatgggctacatgggcgatccgctcgacatcgcgaacatgaacctgttccttgcgtccgatgaatcccgctatgtcaccggcaccgaactggtggtcgacggcggcatgacc

SEQ ID NO: 34406 - DNA, 693 bp, Sphingomonas aromaticivorans
tctgaccgtctactggggcgcaaggccatcgtcaccggcgccggatcgggcatcggcgcggccacggcggcgcggctacgggccgatggcgcgcaggtcttcaccgccgatgtgcagggcgatgtagacctcgtcgcggacctgacggcagagggcgcgaatgcccggctggtcgaacaggccgtggcggcgatgggcggactggacacgctggtgccctgcgcggggatcagcgcgttccaccctctcgaggggcacgacgacgcctatttcctgaaggtcctggacgtgaacctcgttgcggtgtttcgcctcgtgcgcgacgcggcaccctggcttaaggccgctggcaacgggcggatcgtgacgatcggctcgaccacgtcgagccacggcgacgaagggctctgcgcctattccgcatcgaagcacgcggtactgggctttaccaagtcggtcgcggcggaactgggcccgttcggcgttaccgcgaactgcgtgcaaccgggcgcgatcgccacgccgatgaccgcgccggcctttacccggatgcccgagttccggacgttctgggaaaacaaggccgccttgcgccgcctgggtcaacccgaagacattgccgatgtgatcgcgttcctgtgcagcgacgatgcgcgcttcatgtcggggcatggggtatgggtcgacggcggc

SEQ ID NO: 34407 - DNA, 1407 bp, Sphingomonas aromaticivorans
gtggctgaacagtatgacgtcatcgtcctcggatcgggccccggcggctatgtcgcggcgatccgctgcgcccagcttggcctgaagacggccatcgtcgagcgcgagaacctcggcggcatctgccttaactggggttgtatcccgaccaaggcgctcctgcgctcggccgaagtgctgaaccatatgaagcatgccgccgcctacggtcttgcggccgacaacatccgtgcggacctcgacgcggtggtcaagcggtcccgcggagttgccaagcagctcaaccagggcgtcacgcacctgatgaagaagaacaagattaccgtgcacatgggcaacggtattctgaagtcggccacgtcggtggaagtcactggcgacaagggttccgaaaccatctcggccaagcatgtgatcgtcgccaccggagcccgcgcccgcgacttgccgttcgccaaggccgacggcgagcgcgtgtggacctatcgccacgcgatgacgcccaaggagatgccaaccaagcttctggtcatcggatcgggtgcgatcggcatagaatttgccagcttctacaatgatatgggggcagaagttactgtcgtcgagatgatggaccgggtggtgcccgtggaagatgccgacgtttcggccttcctcgaaaaggcgctaaccaagcagggcatgaagatcatgaccggcgcaggcgtcgaaagcctggccgtttcggcctcgggcgtgaaggcgaagatcaagggcaaggatggcaaggtcgcggaaggcgattacagccatgtcatcgttgcggtcggcatcgtgccgaataccgagcacatcggcctcgaagcgctgggggtgaaggctgagcgcgggatcatcgccatcgacggttatggccgcacgaacgtcaagggcctgtgggccatcggcgacgttacgccggggccatggctggcgcacaaggccagccatgaaggcgtgatcgctgctgaggccatcgccgcggaactgggcaacaaggaggttcacccgcacccgatggaccgggggaacatcccgggatgcacctactgtcacccgcagatcgcaagcgtcggcctgaccgaggccaaggccaaggaagcaggctacgcggtgaaggtcgggaccttccccttcatcggcaatggcaaggctatcgcgctgggcgagcccgagggcttcgtgaagaccgtgttcgatgccaagaccggcgaattgctcggtgcgcacatgatcggcgctgaagtgaccgagatgattcaaggctatgtggtcggcaagacgctggagacgacagaggccgaactgatgcacacggtgttcccgcatccgaccatcagcgaatcgatgcacgaaagcgttctggctgcttacggacgcgccatccac

SEQ ID NO: 34408 - DNA, 1281 bp, Sphingomonas aromaticivorans
atgcccatcgccatcaagatgcccgccctctccccgacgatggaggagggaactctcgccaagtggctggtgaaggtgggcgataaggtctcttccggcgacatcatggccgagatcgagaccgacaaggcgaccatggaattcgaagcggtcgatgaaggcacgattgtttccattgacgtggccgaaggatctgaaggcgtgaaggtcgggaccgtcatcgcaaccttggcgggcgaggatgaagatgccagtgctcccgctcctaaggccgtcgctcccgctgcggcgcctgtgccggttcctgcgcccaaggcagagcccgcgccggcggcggtttccacccccgctcctgcagcggcgtccgctagcaagggtgaccgcgtaatcgccaccccgctggccaagcgcatcgcggcggacaagggtattgatctcaagggtgtggcaggctctggtcctaatgggcgcattattcgcgccgacgtcgagggtgcgaagcccgccgctgccgcgccagtttctaccgtggcgcccgcggtcgcgtcggcagccgcccctgctcgtgccccggcggccgtgccagacttcggcatcccctacgaggcgcagaagctcaacaatgtgcgcaagaccatcgcgcgccgcctgaccgaggcgaagcagacgatcccgcacatctatctcaccgtcgacattcgcctcgacgcgctgctcaagctgcgcggtgatctgaacaaggcgctcgaggcacagggcgtcaagttgtcggtcaacgacctcatcatcaaggcgctggccaaggcgctgatgcaggtgcccaagtgcaacgtcagctttgccggcgacgaactgcgcagcttcaagcgcgcggatatttcggtggccgttgccgcgccgtcgggcctgattacgccgatcattgtcgatgccggctcgaagtctgtctccgccatcgccaccgagatgaaggcgctggccaacaaggctcgtgagggcaagctgcagccgcacgagtaccagggcgggaccgcatcgctttcgaacctcggcatgttcggcatcaagaacttcgatgcggtaatcaacccgccgcaggcgatgatcatggctgtcggcgcgggcgaacagcgcccctacgtcatcgacggtgcgcttggcatcgccacggtcatgtcggcgacgggcagcttcgatcaccgcgcgatcgacggagcggatggcgctgaactcatgcaggcgttcaagaacctgatcgagaacccgctcggcctggtcgcc

SEQ ID NO: 34409 - DNA, 1182 bp, Sphingomonas aromaticivorans
atgagcttcaagacccttgacgacatcggcgacctgaccggcaagaccgtgctggtgcgcgaggacctcaacgtgccgatgcaggacggcgcggtcaccgacgacacgcgtctgcgcgccaccatcgcgacgctgaacgagctgtccgacaagggcgcgaaggtgctcgtgctggcgcactttggccgccccaagggccagccgtcggaagaattttctttgaagaagctcgctgccccgctcgcgcacgtactgggccgtccggtcagctacatcgactgggaaagcgacaaggccgctgtggctgctctgacgcccggtgcgattgccgtgcttgagaacacccgcttcttcgacggcgaggaaaagaacgacccagccgtgatcgagcgtttcgccagcctcggcgacatttacgtcaatgatgccttttccgccgcccaccgcgcccacgcttcgaccgaaggcctggcacacgtgctgccggcctatgcaggccgcgccatggaggccgagctcaaggcattgcagaaggcgttgggggaacccgaacgtccggtggcagccgttgttggcggggccaaggtgtcgaccaagctcgacgtgctcaagcaccttgtcagcaaggtcgatcacctgatcatcggtggtggcatggccaacacgttccttgcggcgcgcggcgtgaacgtgggcaagtcgctgtgcgaacacgaccttaccggcaccgccgaggaaattctcgacaatgccgacaagtcgggctgcaccgttcacctgccgtacgacgtggtcgtttcgaaggagttcaccgcaaacccgccgagcctgcggacctgcaatgttcatgaggtcgctgcagacgagatgatcctcgacgtgggcccggccgcggtcgaggcgcttgctgatgtgctcaagacctgcaagacgctggtgtggaacggtccgatgggggcgttcgagaccgagccgttcgacgccgccaccgtggcgttggcgcgcacggctgcagctctgaccaaggaaggttcactcgtgtcggtggcgggcgggggcgataccgtggctgccctgaaccatgcgggcgtggttggtgatttctcttacatctcgactgcaggcggcgccttccttgagtggatggaaggaaaggaattgcccggcgtcgcggcgctggaa

SEQ ID NO: 34410 - DNA, 1005 bp, Sphingomonas aromaticivorans
atggcgatcaaggttgcgatcaacggtttcggacgcatcgggcgcaatgtggcccgcgccattctcgaacgtcccgattgcgggctcgaactggtttcgatcaacgacctggccgacgccaaggctaacgccctgctgttcaagcgcgacagcgtccatggcgcgttctcgggcgaagtctcggtcgatggcaacgacctgatcgtcaacggcaagcgcatccaggtgactgccgagcgcgacccggccaacctgccgcacggagccaacggcattgacatcgcgctggaatgcaccggctttttcaccaatcgcgatggcggccagaagcacctcgacgccggcgccaagcgcgttctgatttccgctccggcaaagaacgtcgacctgacggtcgtctatggcgtgaaccacgacaagctgaccggcgatcacaagatcgtctccaacgcgtcgtgcaccaccaactgcctcgcgccgatggccaaggtcctgcatgaatcgatcgggatcgagcgtggtctgatgaccacgatccattcgtacaccaacgaccagaagatcctcgaccagatccacagcgatccgcgccgcgcccgcgcagccgcgatgaacatgatccccaccagcaccggcgccgccgttgcagtgggtgaagttctgcccgacctcaagggcaagcttgacggttcgtcgatccgcgtcccgaccccgaacgtctcggtcgtggaccttaccttcacgccgaagcgcgacacctcggtcgaggaagtcaacggtctcctcaaggcggctgccgaaggcgcactcaagggcgtgcttggctacaccgacgaaccgctggtttcgatcgactttaaccacgatccgcattcgtcgaccatcgacagccttgagactgccgtgctcgaaggcaagctggtccgcgtcctgtcgtggtacgacaacgagtggggcttctccaaccgcatgctcgacacggcgggcgcaatggcgaagttcctc

SEQ ID NO: 34411 - DNA, 1920 bp, Sphingomonas aromaticivorans
atggccaacgcgatccgtgcgcttgccatggacgcggtccaggcagcgaattcgggacaccctggcatgccgatgggcatggccgatgtcgcgacggtgctgtggacgcagtttctgaagcacgatcccgccgcgccgaagtggtcggatcgggaccgcttcattctgtcggccggccacggctccatgctgatctacgcgctgcttcacctgtcgggctacgaaagcccgacgatggacgacatccgcaagttccgccagctcgacagcgtctgcgccggtcaccccgagaacttccttattcccggcgttgaatgcaccaccggtccgctcgggcaggggcttgccatggcagtcggcttcgcaatggccgaacgccatcttaatgcccagttcggcagcgacctggtcgaccacaagacgtgggtcattgctggcgacggctgcctcatggaaggcatcaaccacgaagcggtcggccttgcaggcacactcaagcttggtcgcctcaacgtgctgtgggacgacaacaagattaccattgacggtgacacatcgctttcgacaagcgaggacattcttggccggtatgccgcgtcgggttggcacgtcacctcgtgcgacggccatgattttgcagacatcgcacgcgcgctggcagaagcacaggccgatccgcgcccgtcgcttgttgcctgccgcaccgtgatcggaaagggtgcgcccaacaagcagggcgggcacaacgtccatggcgcaccgctcggtgcggacgagatcgctgccgcgcgtgagtatcttggctggaccgcggctccgttcgaagtcccggccgacatcctcgccaactggcgctcctcggcagaagccggaaagaccgcgcgagccgaatgggaaaagcgggctgcagccaatcccaatgccgccgaactggcccgccgcatggccggggaactccccgcccagaccggtttcgacgcctatatccagtcgctgatcgccagcccgcccaaggtcgccacccgcaagtcgagcgagatggctctcgaggccttcaccgcgaacgtgcccgagatggtgggtggttcggctgacctcaccggctcgaacaacacgaagacaaagtcgaccgcgccgttcacgccggaaagctatgacggacgctacgtctactacggcatccgcgaattcggcatggctgccgcgatgaacggcatggcgctgcatggcgggatcatcccgtatggcggcacgttcctcgtgttctccgactactgtcgcaacgccgtgcgcatgtctgcgctccagcacgtgcgagcgatctatgtgttcactcacgattcgatcggccttggcgaagacggcccgacccatcagccggtcgagcatgtcatgtcgctgcgcatgatcccgaacctgctggtattccgtcctgcggatgccatcgagaccgctgaagcgtgggctatcgcgcttgcaaacaaggaccgtccgtcggtcctcgcgctgacccgccaaaatctgccgccggtccgcttcgacgccgagatgaagagcgcaaagggcgcctatcgccttgttgccgcgcaggccgaccgcaaggttgtgctgctggctaccggttcggaagtggaagtcgcgatcaaggtcgcggccgaactggaagccaagggtctgggcgccgacgtcgtttcggttccatgctgggaactgttcgacgaacaggacgcggcctacaaggctgacctgctgcccgccgacgcactcaaggtctcggtggaggcaggcgtgactctggggtggcagaagtacatcggcgatggcctggccatcggcatcgacacgttcggcgcgtcggccccggccgaagtgctgttcgaccactttggcctcacggctgaaaagattgtcccgcagatt

SEQ ID NO: 34412 - DNA, 1338 bp, Sphingomonas aromaticivorans
atgggaacctacacattccgcctgcccgatattggcgagggtatcgccgaggcagaaatcgtcgcctggcatgtcaaggtcggcgacactgtcgaggaagacggtcgcctggctgacatgatgaccgacaaggccacggtcgagatggaaagcccggtcgcgggcaaggtcgtctcggttgcgggggaagttggcgatgtcgtggcgatcggctcggcgctggttgtgatcgagaccgagggggaggacgaggcaccggcgcctgctgcggcgcccgcgcccaaggcggcgatcgtcgaagagcgcatcgaggtcgaaacgcccgagccaccgcaaccgccatcaccgccccagccgctgttcgtttcgcgcgaagtcgaggcaccgcccgcagtgccggctacaggttctggcgtggcgcctggcccgcgtgcctcgaccgcgcctgacacgatcggtggggcgggggcaaaggtcctcgccagtccggccgtgcggcagcgtgcccgcgatcttggcatagacctgtcggaagtccgtccgtctgaggaaggccgcattcgccacgccgacctcgatcagttcctctcctacaatgcctctggcggttaccgtgcagccggtgccgagcgcggcgacgaagtgatcagggtcatcggtatgcggcgacgcatcgccgagaacatggccgcgtcgaaacgacacatcccgcacttctcctacgtcgaggaatgcgatgtgaccgcgcttgaaatcatgcgggaacaactcaacgcgggccggggcgacaagcccaagctgacgatgttgcccctgcttatcaccgcgatctgccgtgctctgccgcagtacccgatgatcaacgcccgctatgacgacgaggccggcgtggttacccgctatggtgcggtgcatctcggcatggcggcgcaaacgcctgcgggccttatggtgcctgtcatccgcaacgcccagaccctgaatctctggcaactcgcccgcgagattgtccgcctggcagaggccgcgcgcagcggcagcgcaaaatcggacgagctttccggttcgacgttgacggtgacgtcccttggcccacttggcggcgtggcgaccacgccggtcatcaaccgcccggaagttgccatcatcgggcccaatcgcatcgtcgagcggccgatgttcgtgtccgatggcatggggggcgagcggatcgaaaagcgcaagctgatgaacatctcgatcagttgcgaccatcgcgtggtcgatggccacgatgcggcaagtttcatccaggcggtgaagaagctgatcgaaacgccggtgctgctgctggcggac

SEQ ID NO: 34413 - DNA, 1008 bp, Sphingomonas aromaticivorans
acccgtcgtctgaacatgatcgaagcgatcaatgacgctctcgacatcatgatggagcgtgatcccaacgtcgtggtcatgggcgaggacgtcggttatttcggcggcgtgttccgtgcgacggcgggactccagaagaaatacggcaagacccgcgtgtttgacacgccgatcagcgagtgcggtatcatcggcgtggctgtcggcatgggcgcttatggcctgcgcccggtgcccgagatccagttcgccgactacatctatccaggcctcgatcagctcgtttcggaggctgcgaggttgcgttaccgttcggccggcgaattcattgcgccgatgacggtgcgttcgccatttggcggcggcatcttcggcgggcagacccacagccaaagccccgaggcgctgtttacccacgtcgccgggctgaagacggtggttcctagcactccgcacgatgcgaagggtctcttgatcgcagcgatcgaggataacgatccggtgatcttcttcgagcccaagcgcatctataacgggcctttcaacggctactacgacaagcctgtcgagccctggagcaagcatgcggacagcgccgttccggagggctattattcgataccgctaggaaaggcccgcgtcgtgcgcccggggcaggcgttcactgtattggcctatggcaccatggtccacgtcgctgcagcggtctgcgcggagaagggcgtcgatgccgaaatcatcgacctcaggacacttgtcccgctggatatcgagacggtggaaaagtcggtggaaaagaccggcaaatgcctgatcgtccatgaagccacgcgcacttcgggctttggcgcggagttgtccgccctggttcaggagcgttgcttctaccacctcgaagcaccgatagagcgcgtgaccggcttcgacacaccctatccacacagcctcgaatgggcctacttccctggcccggtccgcatcggcgaggccgtcgaccgactgatgaag

SEQ ID NO: 34414 - DNA, 1203 bp, Sphingomonas aromaticivorans
ctatcgctccacgtgccggaaccgaagttccggccgggtgacaaggtcgattattccgaccttgccatttcgcgcgcgggggaacagccgcgacccgacgagcagtgcgaggcttccgaaacccacccgttgtgcctcgatctggtgcgcgtgcttggcgatgacgaccgtgcgatcggcccttgggacccccggttggacgccgacacgctgcgccgcatgctgcgcacgatggcgctgacccgtgctttcgacgaccgcatgtatcgcggccagcgacagggcaagaccagcttctacatgaagtgcacgggcgaagaggcgacatcggtcgccccggccatggccttggcggatgacgacatggtcttccccagctaccgccagcagggcatcctgatcgcgcgtggctatccgttggtcgagatgatcaaccagatctattccaatcgtgccgacaagctgaagggacgccagttgccgatcatgtattcggcgcgcgagcagtcgttcttcacgatctcgggcaacctcgccacgcagtacccgcaggccgtgggttgggccatggcaagcgcgatcaagggcgacagccgcatcgccgcgacctggatcggcgaagggtccacggctgagggcgacttccattcggccatgactttcgcagcagtctacaatgcgcccgtcatcttcaatgtggtgaacaaccagtgggccatttccagtttttcgggttttgccggcgcggagaggacgacttttgccgcccgcgcgatcggctatggcatcgccggcttgcgggtggacggtaacgatccgcttgctgtcttcgcggcaacccagtgggccgcgaaccgcgcccgcgccaatgccggccctacgctgatcgagcacttcacctaccgtgccgaggggcactcgacttccgatgatcccacccagtaccgttccgcgcaggagcgggaggagtggccgctgggcgacccggtcaaccggctgaagaagcacctcgtggccctgggcgagtggtcggacgagcagcacgaggcgatggaccgtgaactcgtcgacctggtcaaggcggccacgaaggaggccgaaaagaacggcatcctggggcacgggctgcatcacccgttccatacaatgttcgaggacgtcttcgaggaactgccctggcatctccgcgaacagagcgagcag

SEQ ID NO: 34415 - DNA, 948 bp, Sphingomonas aromaticivorans
tcgattcagcgccgcccgatcaacggacgcgagaccaaccccattggtctgggatgcatgtcgctgagctgggcctatggcggccggccgagcgacgaggacggcatccgcctgctccagcacgccgtcgacatcggctacgatcatttcgacaccgcgcggctctatggtctcggccacaacgagacccaggtcgggatcgcgctcaagggccgacgcgacaaggttttcctggcctcgaagatgggcatcttcgccagcggcgacaagcgcggcatcgattgccacccggacacgatccgcagcgaactcgaagtctcgctcaggctgctccagaccgaccacatcgacctctactacatgcaccgccgcgatttcaccgtgccgatcgaggattcggtcggcgcgatggccgacctcgtgaaggagggcaagatcggcggcatcggcctgtccgaaatgtcggctgacacgctgcgcaaggcttcggcggtccaccccatcgccgcgatgcagaccgaatattcaccctggacccgccaggccgaaatcgccgtcctcgaggcctgccgcgagcttggcaccacgttcgtcgccttttcgccggtcgcgcgcggggttctggccgatggcgtgcacgatcccgccgcgctcgaggaaaaggacatccggcgcgccatgccgcgcttcatgggcgacaactggcccaggaactacgcgctcgtccgccagttcaatgccatcgccgctcgcgaaggcgtgaccccggcgcagctttcgctcgcctgggtcctgtcgcggggcgaacacgtcgttgccattcccggcaccggcaagatcgctcacctcgaagagaacatcgcacgctgggactgggaaatcccggttgcggtcgctgccgaagtcgatgccctgatcaaccagcagaccgtcgccggtcaccgctat

SEQ ID NO: 34416 - DNA, 1188 bp, Sphingomonas aromaticivorans
atgaacgtccatgaataccaggccaaggaactgctcgcgaagtatggtgtgggcatcccggcaggcatcgccgcgctgacggtcgaggaagccgtcgccgctgccaagcagcttcccggaccgctttacgtcgtcaaggcgcagatccacgccggcggccgcggcaagggcaagttcaaggaactccccgccgacgccaagggcggcgtgcgcctcgccaagagcatcgaggaagtcgaggctttcgccaaggaaatgctcggcaacaccctcgtcaccgtgcagaccggtgaagccggcaagcaggtcaaccgcctctacgtgaccgacggcgtcgacatcgacaaggaatactacctctcgatggtcgtcgatcgcgccaccggccgcgtcgcgatcatcgtgtcgaccgaaggcggcatggacatcgaggaagtcgcccactcgaccccggaaaagatcgccaccatcgtgatcgatcccgccgaaggcttcatgccgcaccacggccgcgccgtcggtttcgcgctcaagctttcgggtgacctgctcaagcaggccgccaagatcgccgagcagctctacaccgccttcgtcgcgctcgactgctcgatgctcgaaatcaacccgctggtgcagaccaaggatggcaacctcctcgtgctcgacaccaagatgagcttcgattcgaacgcgctctatcgtcaccccgatgtcgtcgccctgcgcgacgaaaccgaggaagacccggccgagatcgaggccagcaagtacgacctcgcctacatcaagctcgacggcaacatcggctgcatggtcaacggcgcgggccttgccatggcgacgatggacatcatcaagctgaacggcgaattcccggcgaacttcctcgacgtgggcggcggcgccaacaaggaaaaggtcaccgcagccttcaagatcatcctcaaggacccggccgtgaagggcattctcgtcaacatcttcggcgggatcatgaagtgcgacatcatcgccgagggcatcgttgccgcggcgaaggaagtgaacctctcggttccgctggtcgttcgcctcgaaggcaccaacgtccagcagggcaaggacatcctcgccaactcgggcctgccgatcgttcccgccaacgacctcggcgatgccgccaagaagatcgttgccgaagtgcgc

SEQ ID NO: 34417 - DNA, 1143 bp, Sphingomonas aromaticivorans
atggttctcggcgccgcgccagcgattgccagcaagcgcgcaaggcggccgaacattctctacatcatggctgacgacctcggttacgcagacctgtcctgctatggccggcgcgatttcgagacgccggtgctcgacaaactggcagcgcagggacttcgcttcaccaatgcttatgccaacagcgcggtctgcacggctacccgtgtaggtctcatcaccgggcgctatcagtatcgcctgcctgtgggcctggaagaaccactcgcgttccgacccaacatcggcctgccgccctcgcacccgacactgccctcgctgctcgccaaggcgggctatcgcacttcgctcatcggcaagtggcaccttggaagccttcccgacttcgacccgctcaagagcggttaccagaccttctggggcatccgcagcggcggcgtcgactattacacccacgccaccagcaacggccagccagacctgtgggacggaccgacgccggtggaaagggcgggctacctgaccgacctcctcgccgaccgtgccgtaagcgagatccgcgaagcctcgtctggcgaggccccatggttcatgagcctgcacttcaccgcaccgcactggccatgggaaggccctgacgacgccagtgagtccgcccgcattgccaagctgaaggaccccagcgccctgttccacttcgatggcggcagcgcggcgatctatgccgccatggttcgccgtctcgactatcagattggccgtgtcctcgaagcgctgaaggcgaaccgggccgaacaggacacaatcgtcgtattcaccagcgacaacggcggcgagcgcttctccgacacctggccgttcagcggtcgcaagaccgaactgctcgaaggcggcctgcgcatccccgccatcgtgcgctggcccggcgtcacgagagccggcacgaccagcgacgcacagatcatctcgatggactggttgcccacgttccttgccgctgccggctccgcccccgatcccggccaccccagcgacggcgtcgacgttacgccggctctcggtggtggatcgctcgccgaacgcgccttgttctggcgctacaagaaccgcgcccagcgtgccgtgcggcggggcaacctgaaa

SEQ ID NO: 34418 - DNA, 984 bp, Sphingomonas aromaticivorans
cttcccgcaatgcagacccgcactctcggccagtccggcctcgccgtttccgcgctcggctatggctgcatgggcatcgatttcggctaccgcaacaagctgagccgcgaggatggcatctccatcatccgcgccgccgcagagcgcggcgtcaccttcttcgacaccgccgaagtctacgggccctggaccaacgaggacatggtcggtgaagcactggaacccttcaaggacaaggtcgtcatcgccaccaagttcggcttcgacatcgatcccgacaccggcgccatcagcggaaccgacagtcgtcccgaacgcatccgcaaggtctgcgaagcatcgctgaagcgcctgcgggtcgacgccatcgacctgttctaccagcaccgcgtcgatcccaaggtgccgatcgaggacgtcgccggaaccgtgcgcgacctcatcgccgagggcaaggtcaagcacttcggcctgtccgaaccgggagcccccacggtgcgccgggcccatgcagtccagcccgtggcagccctgcaaaacgagtactcgctgtggacgcgccaggtcgaaagcaacggcattctcgacacctgccgcgaactcgggatcggcctcgtgccctattctccgctcggcaagggcttccttgccgggggcgtgaccagcgccgaacaggtcgccaatggcgacttccgcggcaccctgccccgcttccaggcagccgccttcgcgcacaatctccagttgctcgacctcgtgaagaggatcgccgcagaacgcgatgccacgcccgcgcagattgcgctggcctggctactcgccaaggccccgttcatcgtgccgatccccggcacgacgaaactgcaccgcctcgacgaaaatctgggcgcggccgacgtcgtcctgaccggcaccgacctgaccgagatcgaggccctcctcgccaccgtcaccgtcgtcggcacgcgctaccctcccgaacgc

SEQ ID NO: 34419 - DNA, 1320 bp, Sphingomonas aromaticivorans
cgcaagttcttcggcaccgatggcatccggggtcggaccaattccggtgtgatgactgccgaaatcgcgatgaaggtcggccaggctgccgggacctatttccagcgcggcacgcaccgccaccgcgtggtcatcggcaaggacacccgcctgtccggctacatgatggaaagcgcgatgaccgccggcttcacctcggtcggcatggacgtggtgctgctcggccccatgcccacgcccgctgtcgccatgctcacccgttcgatgcgcgcggacctcggcgtgatgatctcggccagccacaatccgttcgaggacaacggcatcaagctgttcggccccgatggctacaagctttccgacgaagccgaactgacgatcgaatccatgctcctgcaggagctgccgctggccgacgccgcgcaagtcggtcgggcacgccgcatcgaggacgcgcgtggccgctatatccatgcggtcaaggccagcctgcccgacaatgtccgcctcgacggcctgcgcatcgtcgtcgattgcgccaatggcgccgcataccacgtcacgccctccgcgctctgggaactcggcgccgaagtcatcgccatcggggtcgagcccaacggcaagaacatcaatgccggcgtcggctccacccatcttgacgcgatcaaggcaaaagtgcgcgaaacccgcgccgacatcggcatcgcgctcgatggcgacgccgaccgcctgattgtcgtcgacgagaaatgccagaccgtggacggcgaccagatcatggcgctgatcggaacccagcttgccgcccgcggcgaactgcgcggcggcggcgtggtcgcgaccgtcatgtccaacctcggacttgaacgacacctaaacgcacacggcctcaccctggaacgcaccgccgtcggcgatcgctacgttctggagcgcatgaggtcgggaggcttcaacgtcggcggcgaacagtcgggccacatgatcctgaccgaccacgccaccaccggggacggcaccgtcgccgcgctgcaagtcctcgccgcgctcgtctcctcgggcaagccggcaagcgaactgctccacctgttcgatccggtcccccagctgctcaagaacgtgcgctttaccgggggcaagccgctcgaggccaagtcggtgaaagaggcgattgccgaggccgaggcccgccttgccggcaagggccgcctcgtcatccgcccctccggcaccgaaccgctcatccgcgtcatggccgagggtgacgatgcggacgaagtcgaagcggtcgtcgaccagatctgcgacgccgtgcga

SEQ ID NO: 34420 - DNA, 858 bp, Sphingomonas aromaticivorans
aggaaaggcatcatcctggcgggcggttccggcacgcggctttacccgcttacccgcggcgtctcgaagcaactcatgccggtcttcgacaagccgatgatctattatccgcttagtaccctgatgttggcgggaattcgcgatgtactgatcatcacgacgcccgaggatgcggtgcagttccagcgtgttctgggcgatgggtcggcgttcggcatcgcgatcagctatgcggtccagccaagccccgacgggttggcacaggcctttcatatcggcgcggacttcgtgaagggcagccccagcgcgctcgtgctgggtgacaacatcttctacgggcacggcctgccgcaattgctgcagaacgccaataaccgaccgaccggtgcaagtgtctttgcctatcgcgtaaacaatccagaggcttacggcgtggttgccttcgacgccgaggggcgcgccagctcgatcgaggaaaagcccgagagccccaagtcgaactacgcggtcactggtctctacttctatgacgagaccgtcgtcgagcgtgcccgcgacctcaagccgtcgccgcgcggagagctggaaatcaccgatctcaaccgtctctacatggacgagggccaactttcggtcgagatcatggggcgtggctatgcctggctcgataccggaacgcacggttcgctgctcgatgccgcgacctatgtccgcattaccgaggagcggcagggtctgaagatctgctgccccgaagagatcgcctggcggcagggcttcatcgacgatgcgggcctggaaaggatcgcccagccgctgcgcaagtccggctacggtgaatatctgctgcaactgttg

SEQ ID NO: 34421 - DNA, 1339 bp, Sphingomonas aromaticivorans
tatactgcggttctgggtgcggaatggcgatggttgagcggccagagcagcgcatcccatgcagcgcggatcgtgggcgaggcggaccgcgtcggctcgcttggcgaagatgcgctgtcggtggctacctgggcaattacgggagtggtcctgatcgcgacggcgttcgcgatctcgtggcagctcaccgcagtgtcgctttttgccgctggcgtggtcgcgatcgcagtggtccttctcagggcccgaaagctgcgcgagggcgagcgctatggcgaggcctaccaggccatgcaggagcaggtcaccaacggcctgttccatctgcgcgctgcgcgcatcggcggcgcggaggtttcgctggccagccgctttgcccgaacggctcgagcggtcgaggaatcggagctgcgcttccatcgctcggtctcgctggcgcacgtcgcgttccaggcgattgccgccgccatgctcggcgcgctcatctatgtggcgcttctgcgctttcacaccccactaaccgtcctggtgcccgtcctggtgatcatggcgcggctggttccgatcgcttcgggcatccagcattcggtccggcgatggacgttcaaccgccccgcgctcgacgcattgcacggcctcgtcgcgcaggcccgtgcacaccaggaacatgccgacgacggttcgccgccgcccgtcctgcgcgagcgcctcgaactacgcggagtgtcgctgcgctatccggggcggcagcgcccggttttcgatgacttcgacctgtcgatcgcggctgggtgcgtcgtggcgatctgcggcccgtccggtgtcggcaagagcagcctggcggacatgctgggcgggctcatctctcccgacgcaggcgaagtggccatcgacggcgaggtcctgcgcgatggcgcgcgcgtgcgctggcggcggcgggtcgcctatgtcgagcaggtgccctatctgtttgacgggacgattgccgagaacctgtgctggggcctgccgggacacgatgacgcggcgctggagagggcgctcgaccgggcggccgcgctgtcgttcgtgcaggctctgccgctgggcctgcagacccgcgtgggcgaggcggggcggcagttttcgggcggcgagaggcaacggctggcgctggcgcgggcgcttttgcgcgaaccggacctgctgattctcgacgaagtgactgccgcactcgacggggccaacgagaacgcggtgcggggtacgatcaggggccctcaagggctcctgcacgatactcatcctcggtcatcgagcggggctgcttgaacttgcggaccagatcgtcgatctgggg

SEQ ID NO: 34422 - DNA, 1863 bp, Sphingomonas aromaticivorans
gaggacatcgaccagtacctcaaggtgcatgagcacaagacgatgctgcgcttcatcacctgcgggtcggtggacgatggcaagtcgaccctgatcgggcgcctgctctacgattcgaagatgatcttcgaggaccagcttgccgcgctggaaaacgattcgaagaaggtcggtacgcaaggccaggacatcgacttcgcgctgctggtcgacggtcttgcagccgagcgtgagcagggcatcaccatcgacgtcgcctaccgcttcttcaataccgagaaacgcaagttcatcgtcgccgactgcccgggccacgaacagtacacccgcaacatggtgaccggcgcctcgaccgccgacctcgcggtgatcctgatcgacgcgcgcaagggcgtgctcgtgcagacccgccgccactcgtacctgtgccacctgatcggcatccgcaacatcgtgcttgcggtgaacaaaatggatcttgtcgattacgatccggtcgtgttcgacgccatcgtcaaggattataccgagttcgcacgctcgatcggcatcgagagcttcaccgccatgccgatctccggcttcaagggcgacaacatcaccacccgttcggccaatacgccctggtacaacgggccgaccctggtcgatcacctcgagacggtcgaggtcctctcctcgctcgacgcggacaagccgttccgcatgccggtgcagtgggtcaaccgccccaatctcgacttccgcggcttctcgggcctcgtggccaccggcagcgtcaagccgggcgacgagattcgcgtcctgccttccggcaagaccagcaaggtcacccgcgtcgtcacgctcgacggcgatctcgaccaggccgtcgccggccagtcggtgaccctgtgtctggccgacgaggtcgactgttcgcgcggcgacgtgatcgcgctggccgacaatccgccgcaggctgccgaccagttcgaggcaacactcgtctggctcaacgacgaggccatgctgccgggccgcgcctactggctgaagctcgcgacgcaaaccgtctctgccacggtccagcagcccaagtacgtcgtcaacgtcaacacgatggaacatctggcggccaagacgctggaactgaacgccatcggcgtggccgaacttgccaccgacaagccgctggtgttcgaaccctatgccgacagccgcacgctcggcggcttcgtgctgatcgacaagatcaccaacgcgaccgttgccgccggcatgctgcacttcagcctgcgccgcgcgcagaacgtgcactggcaggcgcttgacgtcagccgtgaggcccatgccgcgctcaagcaccagaagccggcagtgctgtggttcaccggcctgtccggctcgggcaagtcgaccatcgccaaccttgtcgagaagcgcctccacgcggtgggcaagcacaccttcctgctcgatggcgacaacgtgcgccatggcctgaacaaggacctgggcttcaccgaggccgaccgcatcgagaacatccgccgcgtcggcgaagtggcgaagctgatgaccgatgccgggctcatcgtgctcaccgccttcatcagcccgttccgcgcggaacgcgaaatggtgcgctcgctcatggccgatggcgaattcatcgaggtgttcatcgacaccccgcttgaagtggccgaatcgcgcgacgtgaaggggctctacaagaaggcccgttccggccagctcaagaacttcaccgggatcgacagcccctacgaagcgccgcagaatcccgagatccgggtcgacacgaccgaggaaacacccgaaaacgcggccgagcggatcgtgaatcaattgctcggctgg

SEQ ID NO: 34423 - DNA, 1302 bp, Sphingomonas aromaticivorans
atgaagatcgcgatggtgggttcgggctacgtcggcctcgtgtcgggcgcctgctttgccgacttcggccacgacgtggtctgcatcgacaaggacgagggcaagatcgagagcctgcgccagggcgtgatgccgatctacgagccgggtcttgccgaactggtcgccgccaacgtcaaggctggtcgtctctcgttctcgaccgaccttgccgcttcgatcgaggatgcgcaggcgatcttcatcgcggtgggcacgccttcgcgtcgcggcgacggccacgccgacttgagctatgtctacgccgtcgcgcaggaactggcagagaacctgaagaccccggccgtcatcgtcaccaagtcgaccgtgccggtcggcaccggcgacgaggtggagcggatcatccgcgagagcgggactgcggtgcgtttcgaggtcgtctccaatcccgaattcctgcgcgaaggcgccgccatcggtgacttcaagcgccccgaccgcattgtcatcggcgcggaggacgaatgggcgcagggggtgatgaaggaagtctaccgtccgctcttcctgaaccgcgcgccaatcctgttcacgtcgcgccgcagcagcgagctgatcaagtacgccgccaacgcgttcctcgcgaccaagatcactttcatcaacgaaatggcggacctgtgcgagaaggtgggcgcggacgtgcaggacgtgtcgcgcgggatcgggctcgacaaccgcatcggcgcgaagttcctgcatgcggggccaggatatggcggttcgtgcttccccaaggacacgctggccctgctgaagaccgccgaggactacaacagcccggtccggctggtggaggccgtggtcaaggtcaacgacagccgcaagcgtgccatgggccgcaaggccatcgaggcgctgggaggcgaggcgcggggcaagcgcgtcgcgctgctcggcctgaccttcaagcccaacaccgatgacatgcgcgatgcgccctcgatcgccatcgtgcagaccttgcttgatgccggggcggaagtcgtcgcctatgaccccgaaggcatggaagcagccgccgcgattatgccggaagtgacgatggcgccaaacgcctatgccgcgatcgaaggcgccgatgcgatcgtgctggtgaccgaatgggacgccttccgcgcgctagacttcgcgcggatcaggcgcctggccaatgctccggtcatggtcgacctgcgcaatgtctatgatccggccgaagtgcgcgcggccggcttcgaatataccagcgtcggccggccc

SEQ ID NO: 34424 - DNA, 659 bp, Sphingomonas aromaticivorans
gactggcgcgccagcctcgaacccctgcttgcctcgccccccttgcgcgcactgggcgacttcctcgacgcggaggagcgggccggcaagacgatctaccctcccgcgacgcagcgcctcgccgctctggagatgaccccgctggacaacgtgcgcatcgtgatcctggggcaggacccctaccacggccccggccaggcgcacggctcgccttctcggtccaggacggggtcaaggtcccgccgagccttgccaacatctacaaggaactggaggccgacctcggcctgccccgcccgccccacggcaacctcgcacggtgggcgcggcagggagtgctgctgctcaacagcgcactgacggtcgaggcggcaagcgccggctcgcaccagggcaagggctgggaggccctgaccgacgccgccatcgccgccgtcgccgcgcgcgacgtaccgacggtgttcatgctctggggcagccacgcgcagaagaaggcggcgcgcgtcgcccgcctggccagcggcccccacctcgtgctcgaagccccgcaccccagcccgctctcggcgcacaaggggttcctcggatgccgccatttcagcaaggccaacgccttcctcgaggcgcacgggcggcgcgcggtggactggcggatctga

SEQ ID NO: 34425 - DNA, 684 bp, Sphingomonas aromaticivorans
atgccccgcctgatcctgattcgtcacggccagtcgcagtggaacctcgaaaaccgcttcaccggctggtgggatgtggacgtgaccgagaagggcgccgccgaagcctttgccgccggcaagctgctcaaggacaagggcgtcctgccgacgctcgccttcacctcgttgcagacgcgtgcgatcaagacgctgcacctcgcactcgaggcagctggtcggctgtgggtgcaggaagacaaggactggcgcctgaacgagcgtcattacggcggccttaccggtctcgacaaggccgagaccgctgccaagcacggcgacgagcaggtcaaggtgtggcgccgcagcttcgacgtgccgccgccgccgctggaggccggcagcgagttcgatctggcgtcggacccgcgctatgacgggatcgcggtgcccgccaccgaaagcctcaaggacacgatcgcccgcgtcctgccctgctgggaagaaaagatcgcgcccgcgcttcgtgccggcgagacggtgatcgtatcggcgcacggcaattcgctgcgcgcgctggtcaagcacctgtcgggcatttccgatgaagacatcaccgggctcgaaatccccaccggtcagccgatcgtctacgaactcgacaacgatctcgcccaagtggaacgctattacctgtcggagcgc

SEQ ID NO: 34426 - DNA, 729 bp, Sphingomonas aromaticivorans
gaggcggtcctgatcaccggcggggcgcgcggcctgggcgaggtgcttgtgcgcgcgtttcacggggcgggctggcgtgtcgcggtttctgacatcgatggcgacgccgcgcacggactcgccatctcgctcgatgcctccggcaagaccgcgctcgggctggcgctcgacgtgcgcatgcagaccgatttcgaagccgcgcgcgatgtcatgctcgatcgctggggcgtggtccacgcgctggtcaacaatgcggtggtcacccgcgcgcagccggtgctggacatagcgccggacgatttctcggccgtggtcgaggtcaacctgcgcggcactttcgtcggcagtcaggttttcgggcgcctgttcaagacttgcggctatggccgcatcgtcaacattgcctcgcttgccgggcagaacgggggcaccgcgaccggggcccactatgcggcgtccaaaggcgggatcatcacgctgaccaaggtcttcgcgcgcgatctcgcgccgttcggagtggcggtcagtgccatcgctcccggcccgctcgatctgcccagcgtgcgtgaacttgtccctgccgaagcgctgacggcgctgacggagacaattccggtccgccagcttggcgatcctggtttcatcgcccgcaccgccgtgcatctcgcagggcgggacgcggcattcgcaaatggagcaacatgggatgcaaacggcggtctcttcatg

SEQ ID NO: 34427 - DNA, 1398 bp, Sphingomonas aromaticivorans
gccgccagcggcgcgcggcgcgacgtgctcgatccatcgaccgggcttgtggtcaccgacgtggccgaaggcggagcggcggacgtcgacgcggcggtggcagctgcccgcgcgaccttccagagcgccgagtggcgcgacatgcgtcccctggcgcgcgaacgcctgcttcaccgcctggccgacctgatcgaacgcgacgccgatatccttgcggaactcgaagtgatcgacaccggcaagatcctgccgatggcgcgtcatggcgatctcgtcatcgctctggattccctgcgctacatggcaggctggaccaccaagatcgaagggacgacgatcgatccctcgttctcctacattcccccgatccgcttttctgcccgcaccgtgcgccagccggtcggcgttgtcgggcagatcatcccgtggaacttcccgctggtcatggccatctggaaaatcgcgccggcgcttgccgcaggctgcaccgtcgtgctgaagcccgccgaggacaccccgctcaccgcgctctaccttggccgcctgatcgcggaagccgggttcccggcgggagccgtcaacatcgtgaccggcgggcgcgaggtcggcatggcgatcgtcgagcatcccggcatcgacaagattgcctttaccggatcgaccgccgccggccaggacatccagcgtagggccgccgccacgatgaagcgcctcagcctggaactcggtggcaagagcccggtcgttatcctcgaggattgcccggtgccgatggcggtggaaggcgcggcgggcgcgatcttcttcaaccacggccaggtctgcaccgccggttcacgcctgctggtccaccgcagcatctacgaggacgtcgtgcaggggctagcccatgcggcgaatggcatggtgctgggcgaagggatggacccggccggccagatggggcccttgatctccgcccgccagcgggaccgtgttgccggttacgtgcagggtgcgctcgatcagggcgcgcggctgctggcgggcggtgaagcgccggaccgcgacgggttcttctaccggccgacagtgcttgccgatggcacgccttccatgaccatcttccaggaggaagtgttcggtccggtggtcattgccatgcccttcgatacggaagaggaagcgctcgcgcttgccaacgattcctgcttcgcgctgggcgccagcgtctggacgcagaaccttgcggcggccaaccgcttcgccggcgcgctgcgctcgggcaacgtctggatcaacgcgcacaacatcctcgacccggcggtgccgttcggtgggtggaagatgtcgggatatggccgcgaactgggacacagcgcggtcgaactctataccgaggccaagtccatcacgatg

SEQ ID NO: 34428 - DNA, 1179 bp, Sphingomonas aromaticivorans
gacgcggtgcgcaccccgatcgggcgcctcaacggcagtctctcggggatccgggccgacgatctggccgcactgcccctgcgcgcgctcatggaacgcaatccgcaggtcgattgggctgcgctcgacgatgtcgtgctcggctgcgccaaccaggcgggcgaggacaaccgcaatctcgcacgaatggccctgctgctggcgggaatgcccgaggccgtgcctggtgcgacgatcaaccgcctctgcggatcgggcatgaacgccgtcggcattgccgcgcaggcaatccgcagcggcgatgccgacctcatgatcgcgggcggcgcagaaagcatgacgcgtgcgccctatgtcctgggcaaggccggcagcgcattcggacgcgatcagaagatcgaggacaccacgcttggctggcgcttcgtcaacccggcgatgaagcgcgccttcggcgtcgataccatgccgcagacggcggagaacgtcgccgcgcaatggaacgtcggtcgcgaagagcaggaccgctttgcccttgccagccaggacaagaccgctgccgcgcaggcaaggggccgcctcgcgcttgagatcgttggcgtcagcgtaccttccgggaagggccagacccgcgaattcacgcaggacgaacaccctcgctccaccacgctggacgtgctctccggcctgcgcccggttgtccataaagaaggcaccgtcactgccggcaacgcttccggcctcaacgatggcgctgccgcgatgatcgtcgcgagcgaacaggccgccgccgccaacggccttgtgccccgcgcgcgcattgtcgccatggcttcggccggcgtcgcaccgcgcgtgatgggtatcggtccggtcgacgccgcgcgtcgccttttcgcccgcacaggcctctcgatggaacggatggacgttatcgaactgaacgaggctttcgccgctcaggcgatcccggtcctgcgagatctcggcgtcgatcccctcgatccgcgggtaaaccccaacggcggcgcgatcgcgctgggtcatcctcttggcatgtcgggggcaaggctggtgcagaccgcagtgcaggaactgcaagagaccggagggcgccacgcccttgccatgatgtgcgttggcgttggccagggcatcgccatgatcctggagcgcgtg

SEQ ID NO: 34429 - DNA, 1065 bp, Sphingomonas aromaticivorans
atgaggcgttattccatcgccagcattccgggagatggaataggccgcgaggtggtgcctgccgcaatcgaggtgctgacggcggcagcggccaagtgcggtttcgtgctcgaattccggcacttcgactggagctgccagacctacctcgaaaccggcaagatgatgcccgatgatgggctagaccggttgcgcgatcatgatgcggtgttcctcggcgcggtcggctttcccggggtacccgatcatatctcgctgtgggggctgctgctgccgatccggcgcgagttcgagcagtacgtcaatctgcgtccggtgcggctgctgccgggcatcgcttcgcccctgcgcgacaaggctcccggcgacatcgatttctgggtggtgcgcgaaaactcggaaggcgaatattcccagatcggcggtcggaccgggaccggcgagaacgaaatcgtcgtccagcaggcgatcttcagccgccggggcaccgaccgcatcttgcgctatgccttcgacttcgctcggcggagcgggcgcaggcatgtgaccagcgcgacgaagtccaatggactctatcattcgatgccgttctgggacgagcgctttgccgcgatcggcgccgaataccccgatgttgccgccgatcagtatcatgtcgatattctcgccgcacgctttgtgatgtcgcccgaacggttcaatgttgtggttggttcgaacctgtttggtgatatcctttccgatctggggccgggaatcactggcaccatcgctgtggcgccttctgctaacctcaaccccgaacggcggttcccttcgatgttcgagccggtccacgggtctgccccggacatcgccgggcagggcatcgccaatccgatcggccagatttggtcgggtgcaatgatgctggaacatctcggcgaagccgagcccgccgcgctggtgatgcgcgcactcgaaacggcgctcattgcgcccgatattgcgaggacccccgatcttggcggaaacgggacaaccgcgggatttgcgcaagctgttcgcagcaccttgctggggctc

SEQ ID NO: 34430 - DNA, 964 bp, Sphingomonas aromaticivorans
atggaatatgatcgtaaggacgccaaggcctgggcaacgaagaccgtcaggggcttctatcagtgtccgatcaccccgatgaccgccgattacaagttcgatgtggacggtatccgctacaacatcgataaatatgtcgaaatgggcgtagatggcttggccgtcggcgggttcatcgccgaatgctggaacgtctcagcgtcagactggtttcgctatcacgagatcgttgccgaggcgaatgccgggcggctcgatctgtggaccatcgtgctcgatcccagcgtctataccgcgatcgagaagatgcagttcgtcgagaagctcgggtataacggggctgaggtgatcaacccggttgtgcagctcaagcgcgacgacgaaatctattcctggttcaagttcctgaccgaccacaccgatctggccgtctgcctctaccggaccccggtttcgggcaccgtgctgagctgggacctgatgcgccgcctggccgatatcgataccgtgatcggcgtcaaacaaggtgccatgagccgtgccgagacaatcaagatccgccagctaatgcccgaaggcttcaacacgatggagccatttgaatacttcttcctcgacgatctgcgtcttggcggcaccgtttgctggggtgaattgtcctacatgctgtacggcaagaagcgccatttcgccaaggaatacatccgcctggcgcatgaaggaaaatgggaggaagcgcgggccgcttccgatcagctcagcgaagtccgcgaattctatcacgacaacttcctgtgggatatcgcccgcaccgcgacctatgccagcgcacttgccaatgtgaaggcctggtacgaagcgattggcctcaagggctggcccgatcctgccgccggtggctgatgtgacgccggaaaagaaagagcagatcagggccaagctggtcgaactgggcattgcctga

SEQ ID NO: 34431 - DNA, 2650 bp, Sphingomonas aromaticivorans
gtgttttccttcggttccggcgttctggtcgcaggtcagattggtctcgacaagcgcgtcttgggcgggaaaggggccaacctcgccgagatggcgcggatcgggctgcccgtcccgcctggattcacgatttccgccggcgaatgcctcgcttatcttgaccacggcagagcttcacttgatcgcatccgcgatgaggtttcggctgctttggggctggtcgaacgggcgacgggcaagacgttcggcaatcctcgcgatcccctgctggtctcggtgcgttcgggcgcgcgggtatccatgccggggatgatggacacgatcctcaaccttggcatcaatgatgctaccgtcaccggcctgggccagtcctccggggatgagcggttcgcgctcgacagttatcgccgcttcatccagatgtattccagtgtcgtgctcgaaatcgagcatggcgtattcgaggcagcccttgaccgcatcaaggaagatcgcggcgtcgatgaggatatcgatcttcgagtggaggatctgcgcggcgtgatcgcgaccttcaaggatctcgtgcttgcccatcacggcgcggcctttcctcaggatgtacaggaacaactctggacggcaatcgaggcggtgttccgctcatgggactcaccgcgagccaaggtctaccggcgcctgaacgatatccccggagattggggcacggcggttaacgtccaagccatggtgttcggaaatcttggcgagaccagcgctaccggcgtcgcctttacccgcaaccctgcaaccggcgagaaggcctactacggcgaatggctggccaacgcccagggtgaggatgttgtcgccggcatccgcacgccccagtatctgaccaggggctgcccgcgaagccgcaggtgcgcggcttccctcaatgcaggaagcgatgccgaaggcctatgcccaacttgctgaggtgttcgaactgctggagcgccactatcgcgacatgcaggacatcgaattcacagtcgaacgcggcaggctctacctccttcagacccgttcgggcaagcgcaccgccaaggccgcgctcaagattgccgtcgacatggtcgaagagagcctggtcgacgaagtgaccgcgctgctccgcctcgacccggcctcgctcgaccagttgcttcacccctcgctcgatccgaatgccccacgggtgctgctcggaaagggtttgcctgcctcgcccggggcagcctcgggaggtgtggtattcgatgcggaaacagcggcacggtgggccgaattgggagagaaggtcatcctcgtcaggcatgagacgtcgcctgacgacatccatggcatgcacgtcgcaaccggcatcctgacggcgcgcggcggcatgaccagccacgcggccgtggtcgcgcggggtatgggccggccatgcgtggcgggcaccgcgagtctcaagatcgacccggtcgcgcgggtcgccgagatcggcggccagcggctcgaagagggcgcattcatcacgatcgacggttcgaccggcgaagtgttcctgggcgaactgccgacgatcctgcccaaactttcgggcgatttcgcaacggtgatggcatgggctgacaagcatcgccgcctgaagattcggaccaacgcggaaaccccgctcgattgcgaaatggcccgccggttcggggccgaaggggtcgggctttgccgaaccgagcacatgttcttcgatgaaagccggatcctcgccatgcggcagatgatcctggccgacagcgaaaaggaacgacgctccgcgctcgaccagctattgcccgaacagcgcaccgacttccgccggatcttcgaaatcatggaaggcttgccagtcaccatccgcctcctcgatccgccgctgcacgagtttctgccgcatacggatagcgagttcaccgagctttcgcgggcgatgggtattgacgtggagcaggttcggcatcgcgcaatcgaattggcggaaaccaaccccatgctggggcatcgaggctgccgactgggcgtggtctatcccgaaatatacgaaatgcaggctcgcgcgattttcgaggcggcgctcgaagtcgcgggcgaggcgggcatggcggtctgtcccgaaatcatgattccgctggtcggattgccgcgtgaactggaatcactgaaggataccctgtacagggtcgctgaagtcgtgttcgccgaaaaaggcgagcggatcgcctttagcgttggcaccatgatcgagctgccgcgggcagccctggttgccgacgaaatcgctgcaagcggggaattcttctcgttcggaaccaatgatctgacccagactacgctggggatcagccgcgacgatgcggcgcgtttcctgggtgcttatgtggaaaaaggcattatcgccaaggacccgttcgtcaccctcgatatcgaaggggtcggcaagctgatcgaaatggcatcgcgcaaagggcgcgaaacccggcccgacctaaaactggggatctgcggcgagcacggcggcgatccggccacgatcgccttctgtgaggagatcgggttggactatgtcagcgcatcgcctttccgggtgccgattgcccgactggctgcggcccaggcggcgctggcg

SEQ ID NO: 34432 - DNA, 970 bp, Sphingomonas aromaticivorans
gacatcgcctctggcggcgaacttgccatcgtgcgcgacgccgggatcgatccggccatggtcagcttcgcggggcccggcaagcgagacgccgaactcgaggcggcgattgcggcggccgttacgctcaaccttgaatccgaaggcgaggcgacgcgtgcgctggccattgccgggcggctggggatcgtcccccgtctcgcgatcagggtgaaccccgatttcgatctcaagggatcgggcatgaaaatgggcggcggggcgaagccgttcggcatcgatgcggagcgcgtgcctgctctcgcccgcaagctgatttccgccggggcggagtggcggggcttccacatcttcgccggaagccaggctctgtcggccgacgcgatcattgaaacgcaggcgcagacgatcgggctggccgcgcggctggccgaggagacgggcgcgcccttgccgaagtgcaatctcggcggcggcttcggcattccatatttcccgggtgacgagccggtcgacgtggttgcggtcggcgccgcgcttggcgaccagttcgcggcgctgcccgatgtcctccgggacacggcattctgcattgaactaggccgctatctcgttggcgaggcggggatttacctggcgaccgtgatcgaccgcaaggaaagtcacggcgaggtctatctcgttaccgacggcggcctgcatcaccagctcgccgcctcgggcaacttcggcaccgtggtgcgccgcaactatcccagcgccatcgccacgcgcttcggcgcggcggtggaggaggaggcgagcatcgttggctgcctgtgcactccgcttgaccggctggccgacaagggcggctttccccggacagataccggcgatctggtggtaatcttctgtgccggtgcctatggggcgagcgccagtcccgcagcgttcctcgggcagggtccggcccgggaaatgcttgtct

SEQ ID NO: 34433 - DNA, 1866 bp, Sphingomonas aromaticivorans
atgtgcggaattgccggaatcgtccataccgagggcccgaagcccgtcgacccagaccgtgtccgccgcatgtgcgatgccatcgcgcatcgcgggcccgacggggaaggcgtgtggaccgcgcccggcatcggcctggggcaccgccgtctctccatcatcgacctggcgggatcgccccagccgatgaaggccgccgaaggcgacgcggtcatcgtcttcaacggcgaaatctacaacttcagggacttgcgcaaggaactccaggccctgggcgcacagttccgcaccgatggcgataccgaggtgatcctgcaggcctggcgccaatggggtacggcgtgcctgccgcgcctccacggcatgttcgcctttgccctttacgacctccgccaacgcacgaccctgctcgcgcgggaccgcttgggcgtgaagccgctgttcacggcgcgcctagccgatggcgcggttatcttcggctccgaactcaaggcgctgctcgcgcacccgtcgctgcggcgcgaaatcgatccgctggcggtcgaggattatctcgcctggggctatgtcccggaccaccgatcgatgctcaagggggtggagaagctgcccgccgggcactaccagctcctgcgccatgatgccccgccggccgcgccggtgcagtggtgggacgtctccttcgccgaccgcgccaatggtagcgccgaagaccttggcgcgcacctcctgcaccacatgcgcgacgcggtgacctcgcgcatggtcgccgacgtgccgcttggcgccttcctctccggcggggtcgacagctccagtgtggtcgcgctcatggccgaggcgagcgccacgccggtcaagacctgttcgatcggtttcgacgtcgccgcgctcgacgagacggcctatgccgaccggattgccgcgcgcttcgccaccgaacaccgcaagcgcctggtttctccagatgatttctcgctggtggacaggctggcgggcatgttcgacgaacccttcgccgatgcttccgcgctacccaccttccgcgtgtgcgagctagcgcgcgaacatgtgaccgtcgcactctcgggcgacggcgcggacgaggcctttgccggttaccgccgccagaccttccagcaccgcgaggaacaggcgcgggcgctgctgccttccgccttgcgcaagccgctgttcggcacgcttggccggttatggcccaaggcggactgggcgccgcgccccttgcgcgcgaagacgacgctgctcagcctcgcggcttccggggaggagggctatgcccgcgcgctttcggtcacgtcgcccgagctgcgagagacgctttacacgccggacttcaagcgactgcgcggcgactaccgcgccgaacagccactcatcgagttgatgcggaaggcgccggcccgctcgggactggatcgcgcgcagtatgccgatctcaagttctacctgccaggcgacatcctgaccaaggtcgatcgcaccagcatggccgtcggccttgaagcgcgcgagccgttgctggatcatcgcctggtggaattcggcgcaagcctgccggaacggctgcgggtgcgcggtgcgaccggcaaatggctgataaagcagacaatgcgccgctatctgccggaagatgtgctgttcaggccgaagatgggtttcgtcacgccgctggcccagtggctgcgcggtccgcttgcgcacgaggcacgggcgctggcgtcggacggcctgctcgcccgcaccggctggctggacgcagcccgtatcgacgccctggccgatgcgcacgtgtcggggagggcggatcacagccggctcatctggcagttgctgatgctccgg

SEQ ID NO: 34434 - DNA, 774 bp, Sphingomonas aromaticivorans
atggcgaccttctcgcttccgaagaactccaagatcaccggcaaggcccgccatcacgcggcggccaccaacggcaaggtccgcaagttcaaggtctatcgttacgatcccgacagcggcgaaaatccgcgctacgacacgttcgagatcgatctcgaccagtgcggcccgatggtgctcgatgcgctcatcaagatgaagggcgagcaggacccgaccctcaccttccgccgttcctgccgcgaaggcatctgcggttcctgcgcgatgaacatgaatggccgcaacggcctcgcctgcaccaccgcaatcgaggatctgtcgggcgatatccgcatcaccccgctgccgcacatggaagtgatcaaggacctcgtccccgatttcacgcacttctacgcgcagtacgcctcgatccgcccctggctgcaaaccgtcagccccacgccttcgggcaaggagcgcctgcagtcgcccgaacagcgcgaaaagctcgacggcctgtacgagtgcatcctgtgcgcatgctgctccacctcgtgcccgagctactggtggaattccgacaagttccttggccccgcgatcctgctccaggcctaccgctggctggccgacagccgcgacgagatgaccggcgagcggctggacgagctggaagatcccttccgcctctatcgctgccacaccatcatgaactgcgccaacgtctgcccgaagggcctgtcgccggcgcgcgcgattgccgaaatcaagaagatgcaggccgagcgt

SEQ ID NO: 34435 - DNA, 1170 bp, Sphingomonas aromaticivorans
tccgatcccgtcgtcattctgtcctacgcacgcacgccgatgggcgcgatgcagggtgccctggcagaggtcgccgccaccgacctcggcgccaccgcggtcaaggccgccgttgagcgcgcgggcgtcgcgcccgacaaggtcgagcgcatctacatgggctgcgtgcttcccgccggcctcggccaggcacccgcacgtcaggccgcgatcaaggccggcctgcccaagtcggttcaagcgacaaccgtcaacaaggtctgcggttcgggcatgcagacgatcatcatgggcgccgaggctctggccgcgggcagcgccgacctgatcgtcgcgggcggcatggaatcgatgaccaacgccccctacctgctcaagaagcatcgctcgggcgcgcgcatcggtcacgacatggcctatgaccacatgttcctcgacgggctcgaggatgcctacgacgccggccgcgccatgggcacgttcgcgcaggacaccgccaacgcctatcaactcacccgcgaacagcaggacgcctactcgatcgaatcgctccgccgcgcgcaggccgccgtcgccgacggctcgttcaaggacgaagtcgtcgcggtcaccgtcaagacccgcgccggtgaagtgacggtcgatacggacgaggcacccggcaagggccgtcccgacaagatcccctcgctcaagccagccttcgccaaggacggcacgatcaccgccgccacctcgtcgtcgatttccgacggcgcggccgccgtggtcctcgcccgccaaagcgttgccgccgccgccggtcttgcgccggtcgcgcggatcgtcgcccttgccgcccacgcgcaggaaccgaaggacttcaccaccgctccggtcggcgcgatccagaaggttctcgacaaggccggctggtccattgccgacgtcgacctgttcgaggtgaacgaggcgttcgcctgcgtcgcgatgttcgcgatgcacgacctcggcatcccgcacgagaagatcaacgtccatggcggcgccaccgcgctcggtcacccgatcggcgcttcgggcacccgcatcgtcaccacgctgatcgccgcgctcaggaagcatggcaagacgaagggcgtcgccagcctctgcatcggcggcggcgaggcgacggccctcgcgatcgag

SEQ ID NO: 34436 - DNA, 1350 bp, Sphingomonas aromaticivorans
caagcaatgaaggacacgacgcggggcgagatgctggcgcagctcgagcggcagaaggcggcattcacccaggcgcgccccgaacccctgtccacgcgcaacgacaggctggagcgatgcgcacggctgttgctccagcacggcgaagacttcgcccgggcgatgagcaccgatttcggccaccgtagccacgagcagtcgatgctgaccgacatcatgccggcgttgagcctggtgcgctattcgcagaagcggatgaaggcctggtcgaagccggagaagcgccacgtcaacttcccgctgggcctgctgggggcaagggccgaggtgcggtacgaacccaagggcgtgataggaatcgtggcgccctggaactttccggtcggcctgacgctggcgccactggcgcaggccttcgcggccggcaaccgcgccatgctgaagcccagcgagttcaccgagcggacttcggaactgatggctgaacttttcccgaagtatttcggggaggacgaggttgccgtcgtgctgggcgggccgcaggcggggcaggatttctgctcgttgccgttcgaccatctgctgttcaccggcgccacctcgatcggcaagcacgtgcttcatgccgcggcggacaacctcgtgccggtgacccttgaacttgggggcaagtcgccgaccatcctcgggcggagcgccaatgtagaacaggcggcccagcgcatcgcactgggcaagatgatgaacgccgggcagatctgccttgcgcccgactacatgctggtgcccgaggacatggaagagcgggcgattggcgcggtcagcgcgagcgtcgcgcagatgtacccgaccttgctcgcgaacgacgactatacttccgttatcaaccggcggcaccgcgaccggctggtcgggcttgtcgacgatgccgtggcgaagggcgcggaggccatcgtcgtcaatccgggcggggaaaacttcgagggatcgaacggcaacaagctgccgctcacgatactgcgcaacgtcgacgacggcatgaaggtgatgcaggacgaaatcttcgggccggtgctgccggtgaagacctatcgcgggatcgacgaggcgatcgactacatcaatgcccatgaccgtccgctggggctctactatttcggcgaggacgcgggcgagcgggagcggttgctgacgcggacgatatcgggcggggttaccgtgaacgacgtgatcttccacgtatccgccgacgatctgccgtttggcggggtcgggccttcgggcatgggcagctaccacggcatcgaaggattccgcagcttcagccacgcgcgcgcggtctatcggcaa

SEQ ID NO: 34437 - DNA, 1452 bp, Sphingomonas aromaticivorans
atgcctaaggttaaggtagacggcgtagaactcgaagttccggcaggcgccaccgtcctgcaggcgtgcgagctggccggcaaggaaatcccgcgcttctgctatcacgaacggctgagcattgccggcaattgccgcatgtgcctggtcgaagtgaagcccggaccgccgaagccgcaggcttcctgcgcgctcccggcgaccgagggccaggaaatccgcacggactccgagatggtcaagaaggcgcgcgaaggggtgatggagttcctcctcatcaaccacccgctcgactgcccgatctgcgaccagggcggtgaatgcgatctgcaagaccagtcggtcgcctatggccgcggtgcctcgcgctatcacgaaaacaagcgcgcggtgaccgagaagtacatgggcccgctcatcaagacgacgatgacgcgctgcattcattgcacccgctgcgtgcgtttctcggaagaggtcgcgggcgtggacgagatcggtgcgctttatcgcggcgagacgatgcagatttcgacctatctcgagaaggctgcggcgcacgaactttcggccaacgtgatcgacctctgcccggtcggtgcgctgacttcgcgcccctatgcgttcgaagcgcgtccgtgggagctgaagaagacgctgtcgatcgacgtttcggatgctctgggttcgaacatccggctcgacagccgtggccgcgaggtgctgcgcatcctgccgcgcgtgaacgacgacgtgaacgaggaatggctgtccgaccgtggccgctacatggtcgacgggctgacccgccgccgcctcgacaagccttggctgcgccgtgacggcaagctggtcgcagcgacctgggccgaagcgttcgaagccgttgcgaaggtcaacccgggttcgtctgtcgcggtcatcgctggcgatctggtcgattgcgagacgatgttcgcggcaaagaagctggccggcgcactgggatcgtccctgctcgaaggccgccagaccggtttggcttacgacacgtcgaacctcaccgctgtgaacttcaactcgacgctggctggcatcgaggacgcggacgccgttctgatcgtcggttcgatgattcgtgacgaggctcctctgctcaacacccgcctgcgcaaggcggcgaagaagggcgcgaaggtgttcatcgtcggcccgcactgggacccgacctatccggcgacgtttctgggcgacgatctggcagtgcttggaaacctgccggccgaagtcagcgatgcgttcggtgcggcacagaagccggcgatcattgtcggcggcgcggcgctgggcaagggtgcgctggccgcgggcttggccttcgccgaaaagttcaacctcgtccgtgagggctggaacggcttcaacgtcgtccacatggcggcgagccgcatgggtggcctgatgctcggctat

SEQ ID NO: 34438 - DNA, 1398 bp, Sphingomonas aromaticivorans
atggccaatatccgcccgttctgcatgcccaagtggggcatcgaaatgaccgagggcaccatcgccgaatggatggtcaaggaaggcgaggccttcaacaagggtcaggtcctctgcctgatcgagaccgccaagatcaccaacgaggtggaagcggaatacgacgcggtcctgaagcgcctgctgacgcctgcgagcgacgaggcccaccccgtgggcgcgctgctggcggtctttgccgatgccgacacgaccgacgccgaggtcgatgagttcatcgccggcttcaagcccgccgagacctcggttgcggccaagagcggcggcggttcggccccggcccccgccccggctgcggcggcgcctgctccggcggctcccgcgcgcacgccgacgaagatcgtcaccaaccgcgcaatcagccccgaggcattgaagctggccgaggccgaaggcgtcgacatcgaacccatcgaaggttcgggccgcaatggccggatcacctaccaggatgtggttcaggccctgcgcccggagcgcgccttgtcatacaagggcagcgcgcagctggtggaggacagccccgaggccttcgcgtcgccgctggcccgccgcatcgcggcccagcacggcatagcgctggccgggatcaagggcaccggcgcgcgcggccgtatctcgaaagcggacgtgatggcgctggtcaagccgaccacggccgcggcaccggtcttcggcgcgccgttcgaactggttgccaaccagccgcaggtccagccgttcgacaaggtacgcaaggtcgtcgcgcgccgcctgaccgaggcgaagcagacgatcccgcacttctacctgcgcgtctcggcctcggtcgacgcgctgatggacttgcgcaagacggccaacctcgtgctcggcaccaaggcttcgatcaacgactacctggtcaaggccgtggcgctggcgctggtgcggcatcccgacgtcaacgtgcaggtccatggcgacagcgtccacagcttcccccacgccgatgtcgccatcgcggttgccagccccaagggcctggtcaccccgatcgtgcgacaggcggatcgcatgcacatcgcgcagatcgcggccactacccgcgcactgatcgacaaggcacaggcgggccggctcggctatgaggacatggacggcgggaccttctcggtgtcgaacctcggcatgttcgggatcgagcagttcgatgcgatcatcaacccgccgcagggcgcgatccttgcggtcggcggggtgaaccgcgtggcggtggaagcggcgaacggcgacatcgctttcgaaaaccgcatccagctgaccatgtcggtcgatcatcgcgcaatcgatggcgctgcgggcgcgaagttcctgcag

SEQ ID NO: 34439 - DNA, 1002 bp, Sphingomonas aromaticivorans
atggcaaaaatgatgtaccgcgacgccgtcgtctcgacgatcgcagaggaaatggagcgcgacgagaacgtcgtcatgctcggtgaagacattgtcggcggcatgggcacgccgggtgggcccgaggccatcggcggcatctggtcgacctccaccggcctgttcggcaagttcggcgcggaccgcgtgatcgacacgccgatctcggaaagcgcgatcatgggcgcggcggcaggccttgcgctttcgggcaagcgcccgatcgccgagctgatgttcgccgacttcatcggcgtttccctcgaccagatctggaaccagctcgccaagttccgctacatgttcggcggcaagaccaagtgcccggcagtgatccgcatggcctatggcgcgggctacaacgccgccgcgcagcatagccaggcggtccaccagatcctgaccggcatgccgggcctcaaggtggtcatgccgaccacgcctgccgacgtgaagggcctgctgcgcaccgcgatccgcgacgacgatccggtgatcttcctcgagcacaaggcgctctacggcgtttccggcgaagtgcccgacgatccggacttcatgatcccgttcggccacgcccgcctttcgcgcgccggccaggacgtgacgatcgtctcgaccggcctgctgctgggattctgcgaggcggtggccgacaagcttgccgccgagggcatcggctgcgacgtgatcgacctgcgcaccaccagcccgatcgacgaggaaacgatcctcgattcggtcgaggtgaccggccgcctcgtcgtcgtcgacgaagcgccgccccggtgcagccttgcgtccgacatctgtgcgacagttgccgaaaagggcttcgccgcgctcaaggctccgccgcaggcggtcaacccgccacacaccccgatcccgttcgcgcgtgagctggaatctgcctaccttccttcggtcgacaagatcgaagcggcggtgcgcaaggttctg

SEQ ID NO: 34440 - DNA, 966 bp, Sphingomonas aromaticivorans
ctgagccgtgaggcgctattgcgcgcctatcgccagatgaaggtgatccgcgaattcgaggaacgcctacacgtcgatatccagaccggcgagatcgccggcttcacccacctctactgcgggcaggaagccgtcgcggtcggggtgtgcgaacatctgtcggtcgaggacaagatcgtctccacccatcgcggccacggccactgccttgccaagggttgcgacgtgaacgggatgatgaaggagatctggggcagccgcgaaggcctgtgcaagggcaagggcggctcgatgcacatcgccgacgtcgacaagggcatgctcggcgccaacggcatcgtcggtgcgggcgctcccatcgcggtgggcgcggggatcgccgccaagatcgacggcaagggcaaggtcgcgatcaccttctcgggcgacggcgcatgcaatcagggcaccacgttcgaggccatgaacatggccgtggtgaccaaggccgcgacgatcttcgtgttcgagaacaaccactattccgaacacaccggcttcgaatacgcggtcggcacgaccaaggatatcgccagccgcgccgaggccttcggcatgaaggtgtggcgcggtgacggcaccgacttcttctcggtgttcgagacgatgcgcgaagtgctcgactacgtgcgcgtccccggcaacggcccggccgctgtcgaattcgacaccgaacgcttcttcggccacttcgaaggcgacccgcagcgctatcgcggccccggcgagatcgaccgcatccgcgagacccgcgactgcctcaagaagttccgcgaaagcgtgaccgccgccaagctgctcacccacgaagacctcgacgcgctcgatgccgaagtgatggaagcgatcgaggaatcggtccggcaggccaaggccgcagaccggcccacggcagaagacgtcctcaccgacgtctatatcagctac

SEQ ID NO: 34441 - DNA, 1227 bp, Sphingomonas aromaticivorans
atggacatcgaactttcccccgaagaccaggccttccgcgacgaggttcgcgcgttcctggccgcgaacctcccccgcgaggtgatcgacggcgcggcctcgtcgccgacggtcttcgtcgagccggacatcggccagcgctggaacgcgatcctcgcggccaaaggctggctggcctaccagtggccgaaggaagcgggcggcacgggctggagcccggtgcagcgctacatcttcgagaaggaatgcgcgctggccggcgcgcccaacctgacggtgctcgggctcaagctggtggcgccggtgatctacaccttcggcacgccggagcagaaggccaagtacctgccgcgcatcctttcgggcgaggactactggtgccagggcttttccgagccgggcagcggatctgaccttgccagcctgcagtgccgcgccacgctgtccgaggacggcacgcactacaagctcaacggatcgaagatctggacaacccatgcgcactgggcgaaccgcatgttcgcactggtccgcaccgacgcgacggtcaagaagcaggcgggcatctcgttcgtgctggtcgacatgaaccagccgggcgtctcggtgcgaccattgctgacgctggcgggcgaccatgaggtgaaccaggtcttcctcgaggacgccatcgttccggtcgaggaccgcatcggcgaggaaggcgacgggtggaagctcgccaagttcctgctcgagaacgagcgcggcggctcctgccattcgcccaagctggaatacgacctgggccagatcgagaaggacgccgccgccgagccagacgggcgcggcggacgcctggccgacgatgccgactggaagcgccgtgtggccaaggtgcgcctcggcatccagagcctcgagatgatcgagctgaagatcctgtcggaagtggccaagggccgtccgccggggccgcagacctcgctgtgcaagctgctggcatcgaacctgcgccaggacgtcgacctgctggcggtggatctctatggcacggcgggcctccagctcgacttcgcgcggccgttctatggcgacaacgccccggccgcgatccattccaggggtgcgcaagtcgcatcggcacggtacctcaacagccgtgcgtggaccattttcggcggaaccaacgaagtgcaggcgggcatcatcgcgcgcactgtgctgggactataaggaagcaagagg

SEQ ID NO: 34442 - DNA, 1137 bp, Sphingomonas aromaticivorans
gtctgcatcgtcggcatcggcatccacccgttcgggcgcaccgacgggctatcggggctggagcagggcgtctttgccgtgcgccaggcactgggagatgccggaatcgagtggggcgacgtccagttcgcctatggcagctcggattccgccggcaaccccgacacgatggtcgaccggctgggccttacgggcatgcagttcatcaacgtgcgcaacgggtgcgctgcgggcggatcggcgctgttctcggcgcagatggcgatcaagagcggcgagttcgacatcggccttgccgtcggcttcgacaaacatccgcgcggcgcgttcaatgccatgccgagcgagtacaacctgcccgactggtacggcgaggcgggctacatgatcaccacgcagttcttcgcgaacaagatcatgcgctacatgcacgatcacggcatcagccagcagacgctgggccgggtggcggaaaaggctttccgcaacgcggtgcatgccgatcacgcctggcggcgcgagccggtggacctcgagacgatcctcgaggcgccgctggtttccgacccctataccaagtacatgttctgctcgcccgccgaaggcggcgtcgcgctgatcctggcgagcgaaaagaaggcgcgcgaactgggcaagccgctggtccgcctgaaggccgcgacgatgcgcacccggccgcccaagtcgttcgaggtcttcgcaccctcgatcgatatcggcggcggcaaggcgaccgcgacccagatcgccagcgccgacgcgttccgcatggccggcatcgggcccggcgacatcgcagtcgcccagctccaggataccgaggccggcgccgagatcatgcacatggccgagaacggcttctgcaaggacggcgagcaggagcgctggctggccgaagggctgaccgaggtgggcggcaagctgccggtcaacaccgacggcggctgccttgcctgcggcgaacccatcggcgcttcgggcctgcgacaggtctacgagaacgtcgtgcaacttcgcggggacggcggcgggcgccaggtgcccggcaatcccaagaccgcatacagccacgtctatggcgccccgggcgtctctgccgtgaccattctggaacgc

SEQ ID NO: 34443 - DNA, 1596 bp, Sphingomonas aromaticivorans
ggctgggattacatcgtcgtcggcgcgggctccgccggatgcgtcgtggccgaaaggctgagcgccgatggccgccaccgcgtgctcgtgctcgaggcgggcggcgagaacgacggtttctgggtgaccctgcccaagggtgtggccaggctcgtcaccaatcccgaccacatctgggcctatccggtcgctcagccccgcgcggcggggatgcccgcgaacgaggtctggatcaggggcaagggtcttggcggttcgtccgccgtcaacggcatgatctggagccggggcgagccggccgactatgatgcgtgggagcaggccggcgccaccggctggaatggcgctgccatgaccgaggccttcctcgcgctcgaggatcacgccgccggtcccggcccgatgcgcggcagcggcggcctcgtccacgtcgatccggcaatctacacctatccgctggccgatcgcatgatcgcggcgggcgagtcctgtggcatggcccgcgtggccgatctcaacgaacgcggcggtccgcgtgtcggcctctacagccacaatatccggaagggccgccgccaaagctcgggccgcaccttcctcgccgcggcgcgccgccgcgccaacgtcagggtcgtgaccggcgcgattgccgaacgcgtcgtgacacgcgatggccgcgcggtcgcggtggaggcgcgcgtcaacggcgtcctcacccggttcgattgcgcgggcgaggtaatcgtcagcggcggcgcgatggaaagcccgctcctgctccagcgctcgggcatcggcgatggcgcccgccttcgcgccgtcgggatcgaacctctggtccagtcgcccgacgtgggcgaacgcctggtcgagcatctcggtttttccatgccccaccgcctcgtcggcgagcgcggtaccggcggcttgctgcgggggccgggcctggtcgcggcagtcctgcgctatgccctgacgcgcggcggcatcatggcgaccggtccgttcgaggtcggcgccttctgcaacgtcgcccatcccgatggccgcgtcgatgcccagctctatcttggcggctataccttcgaagtctcggacgatggcaacccggtgccgctcgacaagatctcctcgcgccccggcatgacgatctacggccagctcctgcgcctgaccagcgaggcgtcggttcgcgccgccggcccggatgccgcaaccgcgcccgtgatcctgcccaactggctctcgaccgaacacgaccgcaagtccgccgtcgccatggttcgcgccatgcgccgtttcgtgcgcaccgcgccgcttgccgaggtggtgggagaggaaatgataccgggcgccgcggtcgaaagcgacgaggccattctcgacgctttccgccacctcgccagttgcggcctccatgccataggctcctgccgcatgggctcggaccagcgcgcggtggtcgatccgcgcctcagggtgcgcggggtcgatggcttgcgcgtcgtcgattgttcggtcatgcccggacacatcaccggcaacaccaacgcgccggccatggccctcggttatcgtgccgggaacctgatcctc

SEQ ID NO: 34444 - DNA, 997 bp, Sphingomonas aromaticivorans
gtgaatttcgacctgaacgaagacgaggaaatgctgaaggccctggccgagcgcttcgtcgacgaccattacgatcttgatcgccgccgcggctacctggccgatcccaacgggttttcgcccgcgatgtggtcgctgctggccgaacttggcctcgtcgccgcgccgctttcgatggagagtggcggcctttcgcttgatgcgacggcaatcgcgacggtatttgaagcgctgggtcgcggcctcgtggtcgaacccctgaccgagaacatcctcgtcgccgcgcgcctgctggaacgcgtcgcgccggccgatcttgccgaagggtggatggaatccctcgcgatgggcacgcgccgggtcgcgctggcccacgccgaacacggcgcgcgtggcggcctcactttcgtcgaatgcgcggttcgcaccgacggttcgctctgcggcgtgaagtcgtgtgtgccggcgggggcgggggtcgatgccttcatcgttaccgcccgtgaaagcggcagcgcgaccgacgaggccggcatcgcccttttcctggtcgaagcgaacgcgcccggcgtcgcggtcaatccctggcgcatggccgacgggtcgatcgcggtcacgctcacgctcgatgcggcgcccgccacccgcctcgtcggctcgctggcggacgtgcgggagaacgaccttctcgcctcgctggcccgctcggccgaagcgatcgggatcatgcagctcctgttcgacgccacgctcgattacctgcgcacgcgccggcagttcggcgtgtcgctgggcagcttccaggcgatccagcaccgcatgtcggcccagtatgctgccatcgaacaggcgcgggccctgactcaatcttgccatggtctcgcaagggtcggacgcattcgcctccgccgtccacggcctgcgcgccttcgtcgccccggcctcggtcgaactcggtcacgagatgatccagttccacggcggaatgggcgtgacg

SEQ ID NO: 34445 - DNA, 771 bp, Sphingomonas aromaticivorans
ttgtccaagaggcttgaaggcaaggtcgccctcatcaccggcggcaccaccggcatcggcgcggctaccgtcgcgcggttgacccaggaaggcgcgaaggtctggtttaccggatctaaggaagaggcagccgccgcgctttgcgcagaaaccggcgccgtgttccgcaagctgcgcgtgcaggatgccgcgggctggcccggcctcatcgacgagatcatcgccgccgaaggccgccttgacatcgtcttcgccaatgccggcaccgaaagcggcgatggcagcatcgaggacgtttccatcgagggctgggacaatgtcgtcgcggtcaaccagaccggcgtcatgctcaccgtgcagaacgcgataaagggcatgaagcgcaatcccgaaggtccgcgcggctcgatcgtcatcaactcctcgatgaacgccacgcgccctctcggcaactacgtgacttattcggtgaccaaggccgcggtctgcgcgctggcgaagtctgccgctgtccattgcggccagcagggctatgccatccgcgtcaacgcgatcctgcccggcgtggtggaaaccccgctgatccagcagatcatgaacgcccagcccgatccggcagcggcccgcgccatgtacgaaggcatggccccgatgaagcgcatggcgcagctcaacgaagtggccggtctcgtggcctacctttccagcgacgaggccgggttcatctccggtgccgaatacgcgatcgacggcgcgaccaccgccggcatg

SEQ ID NO: 34446 - DNA, 795 bp, Sphingomonas aromaticivorans
gcacagcgcctgaagggccgcgtcgctttcgtctcgggcggccttcgcggcatcggcctcgcctgcgccgagcgcttcctggccgaaggcgccgaagtcgtcctgtcggacctcgacgccgaagccagcgataccgcgcgcgacgtcatggcccgcctcggccaggctgccagctacatcagcgccaacgtcgcaagggaagaggattgggagcgcgcggtcgccctcgtcaaggagcgccatggcaagtgccatgtcctcgtcaacaatgccggcatcgatctcaccggccctgtcgagacgctcagcatggaaggctggcggcggatcatgtcgatcaacgtcgacggcgtgttcctcggtacgaagcacttcgttccgctcatggcggaaagcggcaaggatttccggggcggttcctcgatcatcaacgtcagctcgatcatgggccttgtcggcatgaacgaggtctcggcctacaacgccagcaagggcgcggtccgcctgttcaccaagggcatcgcgatcgagttcgcccagaagaagacgccgatccgcgccaactcgctgcaccccggtttcgtcgaaacgccgctgctaaaggccggtttccagcgctgggtcgaccagggctttgccgacaagcccgatgatctcgtcgcgggcgtcgtcggcgccacgcccatcggccgcctcgcgcagccgagcgaactggcgtcggccgcatttttcctcgccagcgaggattccagctacatgaccggcgcggagctggtcatcgacggcggctggacc

SEQ ID NO: 34447 - DNA, 750 bp, Sphingomonas aromaticivorans
gccgtcgtcaccggcgcggcgggaggcatcggccgcgaactggtcaaggcgatgaaggccgccaacgccatcgtcatcgccaccgacatggccccctcggccgatgtcgaaggcgcggaccattatctccagcacgacgtgacgagcgaggccggctggaaggccgtcgcggcgctggcccaggaaaagtacgggcgcgtcgatgcgctggtgcacaacgcgggcatctcgatcgtcacgaagttcgaagacactccgctgtccgatttccaccgcgtgaacacggtcaacgtcgattccatcatcatcggtacgcaggtcctgctgccgctgctcaaggaaggcggcaaggcgcgcgcagggggcgcctcggtggtcaacttctccagcgtcgggggcctgcgcggcgcggcgttcaatgcggcctattgcaccagcaaggcggcggtgaagatgctctcgaagtgcctcggcgcggaattcgcggcgctcggctacaacatccgcgtcaactccgtgcatccgggcggcatcgataccccgatgctcggctcgatcatggacaagtacgtcgaactcggcgctgccccctcgcgcgaggtggcccaggccgcgatggaaatgcgccacccgatcggtcgcatgggtcgccctgccgaaatgggcggcggcgtggtctatctctgctccgacgcagcaagcttcgtcacctgcacggaattcgtgatggacggcggcttcagccaggtc

SEQ ID NO: 34448 - DNA, 738 bp, Sphingomonas aromaticivorans
gggaaagtcgccatcgtcaccggcgcaggcgtcggcatgggcgctgcaactgcccgcctgctcgccgcgcggggggccagggtcgtcgtttcggacatcaaccccgacaccgccgccgcgaccgtcgagacgatccgcgccgatggcggcaccgcccacgccgtgcgtaccgacgtgtcggacgaagctcaggtcgaagcgctggtcgccgagaccgtcgccacgttcggcaggctggactgcgcggtcaacaatgccgcgataacgcccgacgtgctgcccatccacgaagcggacatggccgtgttcgacagggtgctgaacgtcgacctgcggtcggtcatgctgtgcatgaagtacgagattcgccagatgctggcgcaggagggaccagggtcgatcgtcaacatcggatcggtcagctcgttccgcccgcagccgaacaacgcggcctatgtcgcggccaagcacggcgtgatcggcctgaccaagaccgggagcctcgaatatgcggggcgcggcatccgggtgaacgccgtgctgcccggcgccatcgacacgccgatgctgcgcggggcgctggagacgacgggctttaccgaagcggacttcgccccggcgctgagcctgttcgggcgcttcggcaagccggaggaagtggccgaggccagcgcctggctctgttccgatgcagcaagctacgtgaccgggcacagcctcgcggtcgaaggtggctac

SEQ ID NO: 34449 - DNA, 728 bp, Sphingomonas aromaticivorans
caaatggacggcaaggtggcactggtcaccggcggcgcgtcgggcctgggtgcagaggacgctcgcgtcctcgcccgcgaaggcgcgcgggtcgtcatcaccgacatgcaggaagacctcggccagaaggtcgcttccgaaattccgaactgcgtgttcctgaagcaggacgtgcgcgatgaagcccgctggggcgaggtcgtggccgaaaccctgcgccttttcggccgcctcgacacgctggtcaacaacgccggcctcgtccgcttcggcacggtcgaagacctctcgtgggacgactacaagctccagaccgatgtcatggcaggcgggaccttcctcggctgcaaggcggcaatcccgcacatgagcaaggacggctcgggttcgatcatcaacatggcgtcggtcggcggcatcaagggcatcagcgcgatccccgcctacgccgcggccaaggccgggatcatcggcatgacccgctccatcgcggtccactgccgcgaacagggctaccgcatccgctgcaactcgatcgcgccgggcggcatcgttaccccgatgaccgcacaggcgctcgccgaattgcccgccgacaacgccgggctcgaccaggctcacaaccacggcatgggccagccgatcgacatcgcgaacatggtcctctacctcgcctgcgacgatgccgccacatcaccggcaccaacatcgtcatcgacaacggcgag

SEQ ID NO: 34450 - DNA, 1419 bp, Sphingomonas aromaticivorans
agggtcgggcggttcaccgggatgcgtgaggacggcgttctcgccttcaagggcatacgctatggccgtgccgcccgtttcgagcgagcgctgcccgagccgtggaacggaaacccggccaaggcgcagaccttcgcaccgatcgccccccagcgcggcaatccggacctgccgcagtccgaggactgcctgttcctgaatgtctggacgcccgacgcgaacccccgggcaggccgcgcggtcatggtctatttccatggcggcgcctattccaacggcacggtgacggacccgctcacccacggcggcaagcttgccgcgcagggcgatgtcgtggtcgtgaccgtcaaccaccggctcaatgcgctgggccatgcctggctcaagcccttcggcgcacggtttgccgacagcggcaacctcggccagctcgaccttgtcctcgcgctggaatgggtgcgcgaccatgtgcgcgatttcggcggcgatccggcgcgggtcatggtgttcggccagtccggtggcggcgcgaagatcgcgacgctcatggcaatgcccgccgccaggggcctgttccattgcgccgcgacgatgagcgggcaacaggtcgtcgccagcgggcccaacaatgcgtggaagcgcacgcaggcgctgttcgccgcgctcggtctccagccccgcgacgtcgaactgctgcgcaccctgccggtcgagcggatcgtcgatgcgctgggcgcgaccgatcccgtcatgggcggcggtctctacatgggccccgtgctcgacatgaccaacctgccgcgccaccccttctggccggacgccgcgccgcagtccctcgaaattccgatgatcctgggcaacgtgcgcgaagagacgcgcgccttcatcgacccgcgcgggcccaggttgcgcggtcttgactgggacaatctcgccgcccgcatcgcgccggagatcaagatcgatctcgacgtcgactgggtcgtcgcgcaatatcgccggcagcatccgcagtggacgcccgagcaggtgttctatgccgccacgaccgcaggccgctcgtggccggggcaggtgatcgaagccgatgaacgggcaagggcaggcgcgacgaaaacctgggtctaccagttcgaccggccttcgccgctcgatcccctgcgcggcgcggcgcacaccgatgacattccctatgtgttcggcacgctggatgcgccgggcagcatgagtggaaccgacttgggcgcacggatgacccgggacctgatgatgggcgcctttgcgggccttgcaaggacaggcaggccgggtctcgccgactggaccgcctacacgcttccggaccgtgccacgctggtcgtaggcgatggcacggcctccatcgccagcgacccgcggaagtgggagcgcgagctt

SEQ ID NO: 34451 - DNA, 774 bp, Sphingomonas aromaticivorans
ggacattcgatgagcattttcgacctttcgggccgcgtcgcggtcgttaccggcgcgaacaccgggatcggacagggcatcgcggtggcgctggccgaggcgggcgccgacatcgccgccgtgggtcgcaccccggccgaagaaaccgccgccaaggtgcgtgcgctcggccgcaagtgcgaactggtgagcgccgacctttcgaccatcgccccggtacaggacgtggtcgacgaggtgctgtcgtcgctgggcgggctcgacatcctcgtcaacaatgccgggatcatccgccgggcggacgcggtcgacttcaccgaagaggactgggacgcggtcgtcgacaccaacctcaaatcggtgttcttcctctcgcaggctgcggggcgccacatgatcgcgaaccgcgaagccaccgggcggcgcggcaagatcatcaacattgcatcgatgctgagcttccagggcggcatccgcgtacccagctataccgctagcaagagcggcgttgccgggctgaccaggctgctcgcctgcgaatgggccgccaggggcgtgaacgtcaacgccatcgcgccgggctacatcgccacgaacaacacgtccgccctccaggccgacgagacccgcaaccgccagatcatggaacgcattcccgaaggccgctggggcgatcccgccgacatcggcggtgcggcggtgttccttgccagcggcgccgccgactatgtccagggtcacgtcctggccgtggacggcgggtggctggcgcga

SEQ ID NO: 34452 - DNA, 1251 bp, Sphingomonas aromaticivorans
ttgaagatcgcaattctcggccttggctatgttggttgcaccgcagcagggtgcattgccagccagggccatcacgtggtcgggatcgacgtgaacctgggcaaggtcgaaacgctgaacacgggcaaatcgccagtctatgaaccgggtctcgacgacctgatcgccaaagctcgcgcggaaggccgattgcatgcggttaccgagatcggctcggcgctcgacgattgcgacatcgcgatcgtctgcgtcggcacgccaagcggcgtcgatggcgcgcacaacatgagcttcatcgtacaggtatcgcgggcaatcgcggcatccgtgcgacccgaccgcaagacgccccttacggtcgtgtaccgatcgaccatgcgccccggcacgaccgagcaaatgatccttccgatcttccgttcggtgatcggcgaggactgcgaaaagcttatcgagctggtctacaacccggagttcctgcgcgaggccactgcgatcgaggactatttccacccgcccaagatcgtcctcggaacgatcgatggcgccccgtccgagaagatggtggcgcttcatgaaggcatcgaagcgccgatcttccacgtgggcattcgcgaagcagaaatcacgaagttcgtggacaacacctggcacgccgtgaaggtcgctttcgccaacgaggtcggccgggtgtgccagaacctgggcatttcggcaaagcaggtgcacgagatcttcgtctcggacacaaagctcaacatctcggcctactacacgcgtcccggcggccccttcggaggatcttgcctgcccaaggacgtccgcgcgctgcagcatatcgcggccgataccggtgcgcagacccatctcgtcgattccttgctgcgcagcaatgatgcgcacaagcaccaccagttcctgcaggtgaccaaggatctccagccgggcgcaagggtcctgctggtcggccttgcgttcaaggcggacaccgacgacctgcgcgagagccctgcggtggacatggcccgcaagctgctcgacgcgggctacgcgctcgacatctacgatccgcaactgcggcccgagagcctggtcggccagaacctcggctatgcctatgcgatccttccgtccatcgacgggctgctggtggacaagacgaccgcggaagcgcgcgactacggcgtggtgattgcgaccaatcgcctcattcgcgacctcgcgcttccgggccgccgtatcgtcgacgtg

SEQ ID NO: 34453 - DNA, 714 bp, Sphingomonas aromaticivorans
atgtcgcgagttgcagtcgttactggtggtacgcgcggaattggccaggcaatctgccttgccctgcaggcgcaagggcggaccgtcgtcgcgaactatgccgggaacgaggaaaaggcgcgaacctttacggcggagacgggcattccggcctatcgctgggacgtgggcgatcacgaagcgacgctggaaggttgcgctcgcgttgccgccgaggtcggtccgatcgacatcgtcgtcaacaacgccggtatcacgcgggacggcgtgcttcacaagatgagcttcgatgactggaacgaggtgatgcgcatcaacctcggcggatgcttcaacatggcaaaggcgaccttctccggcatgcgcgagcgcggatggggccgtattgtcaacatcggctcgatcaacggccaggccggtcaatacggccaggtcaactatgccgccgccaagtcgggcatccacggcttcaccaaggcattggcgcaggaaggtgcgaagtacggtgtcaccgtcaacgcgatcgcgccgggctacatcgataccgacatggttgccgccgtgccgccgcaggtcctcgaaaagatcgtcgccaagatccccgtcggccggctagggcatgcggacgagatcgcgcggggagttgccttcctcacggccgaccagggcggtttcgtgaccggatcgaccatgtcgctcaacggcggccagcat

SEQ ID NO: 34454 - DNA, 786 bp, Sphingomonas aromaticivorans
atctcggttgccacatggaacatcaattcggtccgcttgcgcgccgatcaggtagaacgcttcctgttgcaggaggcacccgacgtgctctgcctgcaggagatcaagtgcgcggagagcgtgtttccgcacgaggtgttcgagaagctcggctatacccaccgcgcgattcacgggcagaagggctaccacggcgtcgccacggtcagccgcatccccttccgcgatttcagcaggcatgactggcaggacaatggcgaggcccggcacatcggggtcgaactgctggggccgggcaacggactgattctcgagaacgtctacatcccggcaggcggcgacgtggccgaccgcgaggtgaaccccaagttcgggcagaagctcgacttcctcgagcgcatgacccgctgggccgagaagatcgagcgcccgacgctgatcgtcggcgacttcaacatcgcgccgctggaatgcgacgtctacgaccacaaggccctgctcaaggtcgtcagccacacgccgcttgaagtcgagacgcttcagcgctttgccgatgcccacggctgggtcgaccttggccgcaagcatatccccgcgccggagcgcaactattcctggtggtcttaccgctcctactggcgcgccaaggaccagggccggcgcctcgaccacatgtgggcctcgcccgaagcagccgcacagacccgcgggcaccgcttcgtcgaggagacgcgcaagtgggaccagccttcggaccacataccgctgatcaccgagctggatctg

SEQ ID NO: 34455 - DNA, 759 bp, Sphingomonas aromaticivorans
cgctacaccgcgcaggagcacgcgatctgggatgagctttacgcccgccagatggaacttctgcccggcagggcctgcagcgccttcctgcagggcctggagcggctcgacctcgggcgcggaggcgtgcccgacttcgcacggctttcgtccgagcttggcgcgctgactggctggagcgtcgtgcccgtgccgatgctgatccccgatcacgtgttcttctggcacctggcgaaccgccgctttcccgcaggcaacttcatccgcacgcgcgagacgttcgattacatccaggagcccgacgtcttccacgatgtcttcggccacgtaccgatgctgaccgacccgacttatgccgactacatgcaggagtatggccgcgccgggtggaaggcgatgcgttacaaccggctcaaggcgctgggcgcgctctactggtacacggtggagttcgggctggtgatcgaggacggcgcgcccaaggtctatggtgcggggatcctctccggcccgcgcgaggcggtgttcgcgctggaggggcagtcgcccaaccgcatcatgctcaacgtcgaccgggtcatgcgcacggattacgtgatcgacgatctccagccgacctatttcgtgatcgagagcttcgcggacctctatcaccagacggtcgagcgcgatttcgaccggctctaccgcgcgctcggcgccgggttcacttatgccaacactgcggtgatcgacgtggacgacgtgctgcaccggggc

SEQ ID NO: 34456 - DNA, 1476 bp, Sphingomonas aromaticivorans
cgatggttccagtacctgctgctgatcgtgctggtccttgccatcggcacggcctgccgcttctacttcgtgtcctggctgggcgagcgcgtggttgccgacatccggctcaaggtccaggcgaacctgctgcgcctgcccccgtcgttcttcgagaccaacagtcccaaggaaatctcctcgcggatgacgtcggacactgcggtcatcgaacaggtcgtaggcacgaccgtgtcggtggcgctgcgcaacacgatcaccgcgatcgggggcctgggctacctgttctaccttgcgccgaagctgaccgcgatcctgatgatcggcatcccgctggtggtgggccccatcgtgttcttcggccgccgcgtgcgcaacgtctcgcgctccagccaggaccgggtggcagtgatcggcgtgatcgtttccgaagtgcttggtgcgatgaagatcgtccaggcattcgggcaggagaagcgcgagcttgaacgcttcggcgaaaaggtcgaggcgaccttccagaccgcgctgcgccgcatcagcctgcgcgcggtgatgaccgcgatcgtcatcctgctggtcttcggcggcatcaccatgctggtctggcagggcgccgtcggcgtggcggaaggcaggatcagcggcggcacgatctttgccatcgtcatcacggcaggccttgtcgcgggcgcgctcggggcgctctccgaggtctacggtgacctgctgcgcggggccggcgccgcaggacggctcaacgaactgctgcgcgaacagcccgagatcgcgccgcccgcccgccccacggcgctgccgatcccgccgcgcgggcagatcgcgttccagaacgtctcgttccgttatccctcgcgcccggaagttcttgcgctcgacgatttctcgctgacggtcgagccgggcgagaccgtcgccatcgtcggcccttcgggcgcgggcaagtcgacgctcttcctgctggcacagcggttctacgatccgcacggcggcacgatccgcatcgacggcgttcccctcaccagcgccgaccctgccgagattcgccagcgcagcgcgctcgtaccgcaggacgccacgctgttcgccgcctcggcgcgcgacaacctgcgctatggcaactggggcgcgagcgacgaggccatctgggaagcggcacgggccgccaatgccgaacagttcctgcgcgacctgccgcagggcctcgacaccttcctcggcgaggatggcgcgcgcctttccggcggccagcgccagcgcatcgccattgcccgcgccgtgctgcgcgaggcaccgatcctgctcctcgacgaggcgaccagcgccctggacgccgaaagcgagcgccttgtccaggaagctctggaccggctgatgaaggaacgcaccacgctggtcatcgcgcaccgccttgccaccatccgcgcggcggaccgcatcgtcgtgatggacgcgggc

SEQ ID NO: 34457 - DNA, 2085 bp, Sphingomonas aromaticivorans
cgacagggagagttggacatgacgctgcgcagcaggtccgccggtgtttcgctgatggtgctcgcgttcgtcgcctgtccggcgtttgcgcaggaagtgcgcacagtctcggcgctcgagtcgggttggcgctttctggacggcgatgtggccggagcggtggcacctgatttcgccgacgccgcgtgggagcaggtcgaggtgccgcatacctggaaccgcgtcggcttctaccgccacgacatgggcggggccaataccgaagcaaacgtgcgcaagcggcagggggtgggctggtatcgtctgcgtttcagccctgccccggtccgcccgggcgatcggagctggctggagttcgatgcagcgagccggacggcgcaagtctggctgaacggcacgtatctgggtgagcatcgcggcggcttctcgcgcttccgcctcgatgcgacggcggttttgcgtgccggggcggagaacgtgctggtcgtgcgcgtcgacaacacccagcctgccgccggtgcgccgaccgccgacgtgctgccgctgaccggcgacttctttgtccacggcgggctctatcggccggtgcggttggtgacgacggcgccgctgcatatcgacatgaccgaccacggtggcgcgggcattcgcgcggcgacggtgtctgcctcgaccgggagcgcgcgcgtgaaggtggcggtgcgcgtggccaacgacggtcggggtagcacgcgggccattgcgcgcgtggcgctcttcgaccgcgacgggcgcgaggttgccgcagccagggttccggcgaccgtcgcttcgggcaaggtcgccgaagtcgaggcggagctttctgtcgccgcaccgcacctgtggcagggaacgaaagatccctatctccatgacctggtgaccgaggtcctcgacaaggatggcaaggtcgtcgaccggatcagccagcccttcggcatccggacgatgacgttcgatcccgagcgcggctttgtcctcaacgggcagccctatcgcctcaagggggtgggctaccatcaggatcgagatggcaagggatgggcgatttcgcgcgccgacgtggccgaggacgtcgcgaccatccgcgagatgggcgccaataccatccgcctgacccactaccagcacgggcaggacatccatgacctggccgaccgcgcgggcatcgtcgtctgggacgagatcccgctggtctcggcctggacgctggggggaaagctcgatcccgatccggcgctggtggccaatgcccggcagcagctgaccgagctggtcaggcagaaccagaaccacgccgcgaccgcgatatggagcatcgccaacgaggtggacttcggcaattcgatgccgatcttcctgaccgccgatgcgcaggggcgcgtggccgatccgatggcgctgctcaaggaactggacgggctggcaaaggcgctcgacccgtcgcgcccgaccgcgcttgccacgtgttgcgagggcaatcggcaggcaccggggacacagatcccgatcaccgcgacggcggccgatctcggcggagcgaaccgctacttcgggtggtattacggcaagccttccgaacttggcgcccatctcgacaagttgcgcgcggggcggccggaccagcccctgtcgctgacggaatacggcgcgggtggcgggctgacgatccacaccgacaacgtgctgggcggtcccgccgattcacgcgggtttgcgcagcccgaggagtacgagagctgggtgcacgagcagaccctgccacaactcgacgcgcggccatggctttacgctacatggctatggaactcgttcgactttgccacgcgcatccgcaccgagggcgatgcgcaggacatcaataccaagggccttgtcgcctatgaccacaagacccgcaaggacgcgtggtacttctacaaggcgaactggaacgtggagccgatggtccacatcacggccaagcgctacaaggagcgcgcctatccggtgaccgaagtgaaggtctacagcaacacggccagcaccgaactgctgctgaacggccgttcgctgggcacgaag

SEQ ID NO: 34458 - DNA, 786 bp, Sphingomonas aromaticivorans
ggcaggctatcgggcaaggtggcgatcgtcaccggtggcgcgcgcggcatgggtgcggcgacaagccggcttttcgtggccgagggcgcgaaagtggcgattgccgacgttctggacgaggccggggaggcgctggcggcagagcttggcgatgcggcgcgcttcttcaagcttgacgtgaccagcgaggacaactgggcttcggtcgtcagcgaagtcgaggcggcgctggggccggtcgacgtgctggtgaacaacgccggcatcctcatgttcaagagcctgctcgagacgaccaaggcggactacgagaaggtgctgggcgtcaacctggttggcgagttcctgggcatcaaggcagtggcgccgggaatgatcgcgcgcggcaagggttcgatcgtcaacatctcttcggtagacggaatgaagggcgcgaacagccttgtcgcctacgcctcgtccaagtggggcgtgcgcgggctgaccaaggtcgctgcaatggagcttggtcacaagggcatccgcgtcaactcagtccatcccggcggggtcgacacggtcatgtccaaccattccggcgcagcgcgcgaggacgtggacaagggctatgccaacgtgccgctgcagcgcatcggcgggcccgaggaagtggcggcggcgagcctgttcctggcgagcgacgacgcatcctacctccacggcgcggagatcgtggtggatggcgggatgaccgtcggcacctactacatgggctttccgggttcgccgggcatgtgatccggcccg

SEQ ID NO: 34459 - DNA, 738 bp, Sphingomonas aromaticivorans
gacttttcgggcaagaccgtgctggtcacgggcggaggcgtcggcatcggccgcgccattgccgaagcctttgccggagccggcgcgcgcgtcgtgatcgcggaaatcgacccggccaatgccgaggcggtcgaacaggccattcccggcgcccgcgtgatccgctgcgacgtgcgccagcgcggcgtgggccagatgctggccgaacgcatcgccgccgaaaccggcaagctcgacgtgctggtcaacaacgtcggccacttcgtccacgcccgtcccttcgcgatgctttcggaggaggaggtcgaggaaatcctcgacaccaacctaggccagctgctccgcgtgacccgcgcgatgatcccgctgctgcgcaaggccgggccgggggcgaacatcatcaacgtcacctcgatcgaggcccatcggggcatcccctattgcagcgtctatgccgccgcgaagtgggcggtgaccggcttcaccaagagcctcgcgctggagcttggccccgagggcatccgcgtgaacgacatcgcgcccgagacgacggacaccccgcaagtcgcgctcgactacatgatcccgcccgaaaaccgggtgcacgaggaacgctggattccgctcggccgctttggccggcccgccgactgcgcgggcgcggcgctctatctcgccagtccgctggccgcatgggtgacgggcaccgcgcttcacgtcgatggcggggcgctggcg

SEQ ID NO: 34460 - DNA, 1617 bp, Sphingomonas aromaticivorans
ttcgacttcatcgtaatcggcggcggcagcgcgggggcggtgctcgccgcccgcctgtcggaagacgcgcaaagcagggtccttctgctcgaggcgggcggtgccaacacctcgctgctggtgcgcatgcccgctggcgtcggcacgctgatcaagaagaaaagccgccacaactggggcttctggtccgaccccgaaccccacatggacgggcgccgcatgtggcatccaagggggcgcgggctgggcggctcctcggcgatcaacgggatggtctatattcgcggccacgcgcgcgattacgaccagtggcggcagatgggcctcgaaggctggtccttcgccgaggtcctgccctatttccgccgcgccgaggacttctgcgacggtgcggatgccttccacggcgcgggcggccccttgcgggtaagctggggcgagcgctcggaccacccgctctatcgcggcgtgatcgaggcaggccgccaggccgggcacaaggtcacccccgatttcaatggcgctgaccaggaaggctttggtcgctaccagctcaccatccacgatggcgagcggtggagcgccgcgcgcggctatctcgcgccggtcgcggggcagcgggcgaacctcacgatcgtcaccggggcgcgcgtccaccgtgtcgtggtcgagggcggacgcgccaccggcgtcgagtacagccttggcaagggcaagccggtgcgccgcgcccatgccgcgcgcgaagtgctggtctgtgcgggtgccctgcaatcgccgcagatcctgcagctttcggggatcggcgatccggaggaactggcaaggcatggtatcgcgccggtccatcccctgcccggcgtgggggccaatctccaggaccacctcgacgtaacgctcaactgggcctgcacgcagccgatcacgatctacaacgagatcaaggggttgggccagctcaaggtcggcctgcaatacctgctgaccggcaagggcgcgggacggcagaacgggcttgaggcgggagccttcctcaagtcgcggcccgatctcgaccgtccggacctccagatccacttcgtgctggccatcatgcaggaacacggcaagcgttcggtcaagcgcgacgggttcacgctccacgtctgccagctccggccagaaagccgggggcgggtatcgctcgcctcggcggacccatatgccgatccctcgatcctggcgaatttcatggccgccgaggaagaccgccgcgctgtccgcgcgggcatccgcatcgcgcgcgaggtggcggcgcagcctgcgcttgcaccctatcgcggcgaggagatctggccgggcaacgacgtgcagaccgacgaagagatcgacgcctgggtgcgccgcaccggcgagacgatctatcaccctgtcggcacttgccgcatgggcacgcaaggcgatgcgatggcggtggtcgacagccagtgccgcgtcatcggccttgaagggctgcgcgtggtcgatgcatcggtcatgccgaacctgatcggcggaaacaccaacgcgcccacgatcatgatcgccgaaaagatctccgacgcgatccggggcagggcaccgcttgcgccggtcgag

SEQ ID NO: 34461 - DNA, 735 bp, Sphingomonas aromaticivorans
ctcgatggcaaggtggcgctggtcacgggtgcgggcggcggcatcggccgcgctgcggcgcaggtcttcgcccgctcgggcgccagcgtcatggtcagcgacgtgaacgaggccggcggcgccgagaccgtcgccctgatcgaggcggcgggcggcaaggccgcattcgtgcgctgtgacgtcagcaacgcggacgaggtcaaggccatggtcaaggccacggtcgacacgttcggcggcctcgattgcgcattcaacaacgccggcatcaaccgcgtgaccgacgaccagtacgacgacgcgatctgggaacgcgacatcgcgatcaacctttcgggcgtgatgcgctgcatgcgcgaggaatcggctgtcatgcttgagcgcggcggcggggcgatcgtcaacaccgcctcgatcaacggcctcgtcggcaacggctcgcagccggcctataccgccgccaagcacggcgtcgtcggccttgcccgccatggcgcgctgcgctgggccaagaacggcatccgcgtcaacgcggtgtgcccgggcgtgatcgagaccccgatgaccgcccccctggtccagaacccggagatcaaggcgctgatggattcgatgacgccgatgggccgcatgggctctgccatggaaatcgccgaggcggttgtctggctctgctcgcccgccgccagcttcgtcaccggccacgcgatggtcgtggacggcggagccacggca

SEQ ID NO: 34462 - DNA, 714 bp, Sphingomonas aromaticivorans
tttgcgggcgcgcacgtcctcgtcaccggcggcacgagcggcatcggcgcggcaagcgccgccctgttccgcgatgccggcgcgcaggtgacgattaccggcacccggggcagcgcggcagagtatgacgccgacctgtcgggctaccgctatctccagctcgacatcgaggacaaggaccggatcgatgcggtggcggcggcgctcccccggcttgacgttctggtcaacaacgcgggcttcgcgctgccttcgatcggattggacgaatgggagccggacgtgttcgaccgcgcggtgaacatgcttctcaacgccgccttccgcatggcgcggcgcaccgtcgacctcctggcgcaaagcgcggtgccgggcggcggatcggtgatcggggtagcatcgatgtcgagctatttcggcataccggtcgtgcccggctatggcgccgcgaagacgggccttgtcggcctgacgcgcacgatggcagccaactggggaccgcgcggggtgcgggccaatgcggttgcggccggtctgacccgcagcaagatgacggcgggcaccttcgaacaggaagcgtggaccgcgccgacgctttcgcgcacgccgctaggccggctgggcgaagcggacgacatcgcgcaggcgatcctgttcctggcaagccccgccgcgtcgtggatcacgggccagacgctggccgtggacggcggc

SEQ ID NO: 34463 - DNA, 540 bp, Sphingomonas aromaticivorans
gaggtggaagaggcgatagccacgctcatccgctgggcgggcgacgatcccacacgcgaggggctgctcgacacgccaaggcgcgtggcgcgggcctggcgggagtgttgcagcggctatgcggaagatccggcgcaccatctttcgcgccagttcgaggaagtgggtggctacgacgagattgtgctgctgaaggatattccgttccagtcgcattgcgaacaccacatggcgccgatcatcggcaaggcggccatcgcctacctcccgcgcgagaaggtcgtcggcatttcaaagctcgcacgcgtcctccacgcctatgcgcgccgtcttcagatccaggagcggctgaccagcgaagtcgcgcagtgcatctgggacaacctgcgcccgcatggcgtggcggtggtgatcgaggcgcagcacggctgcatgaccgggcgcggcgtgcggacgcccggcgtcggcatggtgacgagccggatgatgggcacgttcctcgacgacaatcgcacccgcaaggaagtgctggggttgatg

SEQ ID NO: 34464 - DNA, 754 bp, Sphingomonas aromaticivorans
gaattttccggccggcgcgacgatcgtcttcggcggcagcggtggcatcggcaggggcgtctcgctcgaatttgcacgcgaaggcagcgacgtggccgtggtctatcgttcgaagcaggacgttgccgaagccgtggccgaggaaatgcgcgcgctcggccgccgcgtctcgatccacaaggccgatgtacgcaaccgcgccgaagtgcaggccgcgttcgcggcagccgtggcggaacatggccgggtgcacacggtcgtatggggtgccgggcctgtcgtgccgcaggttcccatcgccgaatggaccgagcagatgttccgcgattcgatggagatcgaggctttcggcttcaacaacgccgtgcacaccgcgctgccgcacatgcgggacagcggcggcggcagcttcgtgcacctgggttcggccgggcatgactggtggccgcagctcgatggcctgtcggtagcgcccaaggcctgcaacgaggcactgatcaagggcatcgccaaggaagagggccgtcacgagatccgagcgaactcgatcctcgtcggcgtgatcgatgcgggccagttcaagatcgggcaggaagcgggcaccttcacccccgaatgggaagcggcggtcaaggcgatgctgccgctcaagcgctggggcagcccgcgtgacatcggacaggctgcggtgttcttcgcgtcggaccggggcaactacgtgaccgggcagaccatctcggtcggcggcgggttc

SEQ ID NO: 34465 - DNA, 3432 bp, Sphingomonas aromaticivorans
atgcagttcaggcgcttgaagctctccggcttcaagagctttgtcgagcctgcggaactgcgcatcgaacccggccttaccggcgtcgtcggccccaacggctgcggcaagtccaacctcctcgaagcgatccgctgggtcatgggcgaaagttcgcccaaatccatgcgcgggggcggcatggaggacgtgatcttcgcgggcaccgccacccgccccgcgcgcgccttcgccgaagtcatgctgacggcagagacggacccgtccggtccgttcggcggcgaactcgaagtggtccgccggatcgagcggggggcgggatcggcctaccgggtcaacggcaaggacgtgcgggccaaggacgtcgcgctcgtctttgccgatgccgccaccggcgcgcacagccccgcgctcgtcagccagggccgcattgccgcggtcattgccgccaagcccgccgaacgccggatgatgctggaagaggcggcgggcatcgccggtctccacgtccgccgccgcgacgccgaacagaagctgcgcgcgaccgaggccaatctgggccggctcgtcgatctcctctccggcctcgaaagccagatcgccacgttgcgtcggcaggcgcgggcggccgaacgctatcgcgcggtcagcgagaagatccggctggccgaagcgcggctcgtcttcgcccgctggcgcgatgccgccgctgcggcggaagccgcgcgaaaacaagctgttgcggctgaagacgcggtaaaggccgcggcgctcctcgccaaccaggcgcaggccgcgcagcacaagtccgccgcgacgctcgccgaagcgcgcgacgatctcttcgaccgccgccaggacgccgccgcccatggccagcgcatggcctcgctcaccgcgcagctcgaagccgcagagcagcgcctcagggacatcgaccgccagctttcccggatcgaggaggaccgcgccagcgccgaccgcctgaccgaggacgccgccgccgccatggcccgcctcgaacaggacctggccgccgccgaaactgcccttgcgggcgacgaggcgcgcaggccgacccttgcggcagcggtcgacgacgccgaccgcgctgcccgcgcggccgaagtcgcgcttgcgcagcgtgttgcggaacaagccggcatcgatgccgaatggcgcgttgccgaagccgccgtatccgccgcccgccagcgtctggcgcggctcgatgccgacgcgacgcggcttgcccagcaggccgaagcgctttcgcgagaggccgatccggaagcgcaaatcgctgaagcggaagcgaaacgtgccgaagccgcagccacgctcgccgatgcagaagctcaacgtgccgacctcctgcgccagcgagaggacctgaccacgcggcgcgatgcggcaagcaatgccctggcgcaggcccgtgccgacctcgccggcgtggagcgcgaagccgatgctctcgcccgcgacaaggccgcgcgcgaaaaggcggccgccgccaagggcctgggcaaggccgccatcgccggaacccgcgccgcagcaggctacgaacgcgccctcgccgccgtcctcggtcgcgatgcggccgccccggtcggcgcggcgcccgccgatgccgaagggcgcttctggacaggggccgaggcgccggaaccgctcgcggattcgctggtccgccatattcccacctgcccgcccgaactcgccgcccgccttgccctggtgcgcgtcgccgaagcggatgaggggcaagtcctacgtccgggagaatggctggtcacccggtcgggcaggctgcgtcggtgggacgggttcgtcgcgcggggcgaaggcgcggcagaagctgcggcgctcgaggcggagaaccgcctggccgaattgcaggcacttctaccggcccgacgcgaggcacttgcggccgccgaggccgggttcgaggacgttcgtgtcactttaggtgccgttcaggtcacgctgtcgcagacggaaaaaacgctctccgccgccgccgatgccgaacgtgcggcgttgcgcgcgctcgacgcggcagaggcggcgcgcgcccggctcgaccagagaaaagctgaaatttcaagaactcagacagacctggcggagcaacgccagtccgcgcaggcagagctttcggcagccgaggacaagcgaagcagcctccccgacccggccgccggccgcgccgcgctcgacgccgcccgcgcccgcaacgacgcggcccgcacctcgctccagtccgcgtcggctgcggcggcatccatcgaacaacagattgccgttggaaaagaacggcttgcaggcatcaaaggcgacatccgcgcctggcaggcccgcgcgggcgacgccgccaagcgcctggcggaaatgaccggccgccgcgaggagcttgaagccgagcgcgctgtgtcggcggtcaaacccgctggattcattgcggaaatcgagcagggcgaaacgatccgccagcgccttgccaccgaccttgccgctgccgaaaccgcactcgcagaagcagaaagcgcgtcgaaacaagcagatagcgccctttccgccgcgaatgaagccctcgccaccgcgcgcgaggcccgcgccggcgccactgcccgcgccgagaacgaggatgcgcggcggcaggaaatggctggaatttcaggggaaaggttccaatgcccgcccccgctcctgcccgaacgcttcggattcgcctcggcagaggtcgctgcggccggggacgagtccgccgccatggaccgcctcgtcgcggagcgcgagcggatcggtccggtgaaccttgtcgctgccgacgaactggccgaggcggaggagcggcatggcacctcgattgccgagcaggccgaacttaccgaggccgttcatagacttaggggatcgatcggcaacctcaaccgcgagggccgcgaacgcctgcgcgccgcgttcgaagccgtcgacggccacttccgccgcctgttcgcgcgcctgttcggcggcggcgaggcgcatctcgcgctggtcgacagcgacgacccgctcgacgcaggcctcgagatcttcgcccagccgcccggcaaacgcctgcaatcgctgactcttctttccggtggcgaacaggcgctgaccgcagtcgcactgatcttcgcgctgttcctgacgaacccggcgccgatctgcgtcctcgacgaagtcgacgcgccgctcgacgacgccaacatcgagcgcttctgcgacctgctcgacgcgatggtgcaggaaaccagcacgcgctacctgatcgtcacgcacaacgcggtgacgatgagccggatgcaccgcctgttcggggtgaccatggtcgaacgcggcgtttcgcggctggtcagcgtcgacctgggcggcgcggtggagcttctggaaagc

SEQ ID NO: 34466 - DNA, 1323 bp, Sphingomonas aromaticivorans
atggccaccgtaacccgcttcgcgccttcgcccaccggcaagctccatgtcggcaacgtccgcaccgccctccacaactggctgctggcgaagaagaccggcggccgcttcctcctgcgcatcgacgataccgacgccgagcgcagccgcgaggaatacgtcgaatccatccgcgcggatctccagtggctgggcctcatccccgatggcgaggaacgccagtcgctgcgcaccgaactctacgagcgcgaatttcagcgtctggtcgaggcgggacgcatctaccgggcctacgaaaccgcgcaggaactcgatctcaagcgcaagatcctgctcggtcgcggcctgcccccgatctatgaccgcgccgcgctgaagctgaccgaggcggaccacgccgcaaaggctgcggcaggcgaaaggccgcactggcgcttcctcctcgaccacgaccagccgatcacctgggacgacggcattcgcgggccccagagcttcgacccccggcagatgtccgaccccgtcatccgccgcgcggacggctcgtggctctacatgctgccctcggccatcgacgacatcgccatgggcatcaccgacgtcctgcgcggcgaggaccacgtctcgaacaccgcaacgcagatccagatgttcacggcgctgggtgcagaaccgccgcgtttcgcccacgaagccctgctgacgggcagcgaaggcaagctctccaagcgcctcggtgcgctcggcatggccgactttcgcgaacagggcatcgaacccgaggccatcgtcgcgcttctcgcccgcctcggcacttcggacccggtggacgcggcgctcgatgccgcggcccttgcaaccagcttcgacctgtcccgcttcggccgcgcacctgcccgtttcgacgaggccgatctccaccgcgtcaacgcgcagatcgtccatcgcctgccttatgcccgcgtcgcacacctcctgccacagggcatgggcgaggccgcatgggaagcgatccgccccaacctcgcccacatcgacgaggcgcgcgactggtggaacgtggtgacggggcccgtcaccgccccgaccttcgacgatgaaacgcgcgccttcctcgcgcaggccgccaaaaccgccgcctcgctggattggtccgccgatccgtggcgcgccctcaccgcgaccctcaaggacggcaccggccgcaagggcaaggccctgttcctccccctgcgtcaggcccttaccggccacgaccacggcccggaaatggccgccctcctgcctttgatcgcgcaggacgaggctgtacgccgcctgtcc

SEQ ID NO: 34467 - DNA, 933 bp, Sphingomonas aromaticivorans
atgaagatcatggccggcaactccaatctgccgctcgcccgcgccatttcggcctatctcgaaatgccgctgaccgacgccagcgtgcgccgcttcgcggacgaggaggttttcgtcgaaatccacgagaacgtgcgtggcgaagacgtgttcgtggtccagtcgaccagctatccggcgaacgacaacctgatggaactactgatctgcatcgacgcgctgcgccgtgcatcggcaaagcgcatcacggcggtggttccgtatttcggctatgcccgccaggaccgcaagccggggccgcgcacgccgatctcggcaaagctggtggcgaacctcatcacccaagccggcgccgaccgcgtcctgtcggtcgaccttcacgccgggcagatccagggcttcttcgacatcccgaccgacaacctgttcgcggcgcccgtcatggccgcggacatccagacgcgctatggcgcgcaggaactgatggtcgtctcgccggacgtcggcggcgtggtccgcgcccgcgcgctggccaagcggctcaacaacgccccgctggcgatcgtcgacaagcgccgcgaccggccgggccagtccgaagtgatgaacatcatcggcgaagtgaaggggcgcatgtgcatcctgatcgacgacatcatcgattcgggcggtacgctctgcaacgcggcgcaggcgttgatggatgcgggcgcggtcggcgtttccgcctacatcacgcacggcgtcctttcgggcggcgcggttgcgcgcgtggctgggtcggcgctcaaggaactggtcatcaccgacacgatcatgccgacggaagccaccgcatcgtgcgaccgcatccgcgtgttgacgatcgcgccgctgattggcgaggcggtccgccgcatcgccgatgaaagctcggtgtcgagccttttcgac

SEQ ID NO: 34468 - DNA, 1356 bp, Sphingomonas aromaticivorans
gaaggaacagtggcaaagaactggactgcggattcgtggcgcgggcatgaggggcggcatctgccgacctatccggacgccgaaaagctgaacgaggtcgagacgaccctgacgagctttccgccgctggtttttgccggcgaggcgcgcgcgctcaaggccgatctcgcgcaagtggctgcgggcaagggtttcctgctccagggcggggactgcgccgaaagcttcgccgagttccatccgaacaacattcgcgacacgttccgcgtgctgctgcagatggcggtcgtgctgacgttcgccagcaagcagccggtggtgaaggttggccgcatggccggccagttcgccaagccgcgttcgtcgccggtggaaaagatcggtgacgtcgaactgccgagctaccttggcgacaatatcaacggcatcgatttcacccccgagtcgcggattcccgatcccgagcgcatgctgcgcgcctacagccaggcggcggcgacgctgaacctgctgcgcgctttcgcgggtggcggctatgcgaacctgcgccaggtccaccagtggacgctcgaccacatcggcaagagcccctgggcggcgaagttcagcgagatggccgacaagatcggcgagtctctcgacttcatggaagcctgtggcgtcgatcccagcaccgtcccgcagcttcagggcacgagcttctacactagccacgaagcgctgctgctgcagtacgaagaagcgatgacgcgccaggattcgctgaccggcgaatggtacgacaccagcgcgcacatgctctggatcggcgaccgtactcgcttcgaaggatcggcccacgtcgaatacctgcgcggcgtcggcaatcccatcggcatgaagtgcggtccttcgctgacgcctgacgccctgctgcgcatgctggatacgctgaaccccggtcgcgaggccggtcgcatcacgcttatcagccgcttcgggcacgacaaggtcgaagccggcctgccgcctctggtgcgtgccgtaacgcgcgaggggcacccggtagtgtggtcgtgcgatccgatgcacggcaacgtgatcaaggccgacaatggctacaagacgcgtccgttcgaccgcatcctgaccgaggtgaagggcttcttcgcggtgcatcgcgccgagggaacccacgctggtggcatccacatcgagatgaccggccgcgacgtgaccgagtgcaccggcggtgcggtggcgatcacccaggaaggcctggcggaccgttaccacacccattgcgacccgcgcctcaacgcggcgcagtcgatcgagctcgctttcctgatggccgaagcgctcaaccaggaacgc

SEQ ID NO: 34469 - DNA, 1077 bp, Sphingomonas aromaticivorans
aaagccgccgtactcgtcgaaccgggcaagccgctggatattcagcatctcagcgtgtccaagcccggcccgcatgaagtccttatccgcaccgcagcctgcgggctgtgccattcggacttgcacttcatcgaaggtgcctatccccatccgctgcccgcggtgccggggcacgaggcggcggggatcgtcgaggcggtcggctcggaagtgcgcacggtcaaggtgggtgacgcggtcgtcacctgcctgtccgcgttctgcggtcattgcgagttctgcgtgaccggccggatgtcgctgtgccttggcggcgacacccggcgcggcgcgggcgaggcacctcgccttacccgcaccgacgacggcagcgccgtgaaccagatgctcaacctctcggcctttgccgaacagatgctggtgcacgaacatgcctgcgtggcgatcaatcccgagatgccgctcgaccgcgcggcggtgatcggctgcgcggtcaccactggcgcgggtgcggtgttcaacgcggcgaagctgaccccgggcgagacggtctgcgtggtcggctgtggcggcgtcggccttgccacggtcaacgccgcgaagatcgccggcgcaggccggatcatcgcggtggacccgatgccggaaaagcgcgaactggccatgaagctgggcgcgaccgatgtgatggacgcgggacccgatgcggcggcacagatcgtcgagatgacgaaaggcggcgtccaccatgcgatcgaggccgtggggcgtccggcatcgggcgaccttgcggtcgcgacgctgcgccgcggcggcaccgccacgatccttggcatgatgccgctggcacacaaggtcggactttccgcgatggacctgctgtcggacaagaagctgcagggcgccatcatgggccgcaaccacttcccggtggacctgccgcgcctggtcgacttctacatgcgcggcttgctcgatctcgacacgatcattgccgaacgcatcccgctcgaagggatcaacgatggcttcgagaagatgaagcagggccattccgcccgctctgtcatcgtgttc

SEQ ID NO: 34470 - DNA, 1227 bp, Sphingomonas aromaticivorans
ttcgaaccgaccgagcgccagaagtactggcgggaccgcgtccgccagttcgtcgaggacaacatccgcccgcgccatggcgactacaaggcggaagccggcacggccgatcgctggaaggtcatccagaccatcgaacaggaaaaggccagggccaaggcggccggcatctggaacctgttcatgcctccgcgcaacagcggccaccatcacgtcgacgaaacgttcgcgttcgaaggtccgggcctgaccaacctcgaatacgcgctctgcgccgaggagatgggccgcatcggctgggccagcgaagtgttcaactgctccgcgcccgatacgggcaacatggaagtgctgcaccgctacggcacgctggaacagaaggagcgctggctgcgcccgctgatgaacggcgagatccgctctgccttcctcatgaccgagccgcaggtcgcatcgtccgacgcgacgaacatcgagacctcgatccgccgcgaaggcgacgaatacgtgatcaacggccgcaagtggtggtcgtcgggcgcgggcgatccgcgctgcgagatcgccatcgtcatgggcaagaccgatttcgaggcaaagcgtcaccagcagcagtcgatggtcctgatgccgctggacgcgccgggcgtgaacatcatccgtcacctgcccgtgttcggctacgacgacgcgccgcacggccacatggagatcgaactcaaggacgtgcgcgtcccggtcaccaacatgctgctgggcgaaggccgcggattcgaaatcgcgcagggccgcctcgggccgggccgcatccaccactgcatgcgcaccatcggcgtggccgaggaagcgatcgccaagatggcacggcgcctccagtcgcgcgtcgccttcggcaagcgcgtgtccgaacagtcggtctgggaacagcgcatcgcgcaggcccgcatcgacatcgacatgacccgcctgctttgtctcaaggcagccgacatgatggacaaggtcggcaacaaggccgccgcgctcgaaatcgcgatgatcaaggtccaggcgccgaacatggcccttcgcattatcgacgacgcgatccaggcccatggcggcggcggcgtctcggcggacttcggccttgccgaaagctatgcccacatgcgcacgctgcgcctggccgacggaccggacgaagtccacgcccgcgcaatcgcccgcatcgagtttgcccgccat

SEQ ID NO: 34471 - DNA, 756 bp, Sphingomonas aromaticivorans
ttcgacggaaagaccgtggtggtaacgggcgccgcgtcgggcatcgggcgggcggcggcgctggccttcgctgcggaaggcgcgaaagtctatgcggcggacatcgacgaggcggggctggcagagacggctgcgcaatcgaacggcgcgatccggaccgcgcgctgcgacgttacccgctgcgaggacatcaaggccctgatggatcgcgcaggcaccgagacgggcggcatcgacaccgtgttcaacaatgccggcgcaggcggtgaccgcgcgcccatcgacgagatcgagcccgaaggctgggaccggacgatggacctgctgctgcggtcggtcgctttcggcattcgctatgccgtgccgcacatgaagggccgccatggcgcatcgttcgtgaacacgtccagcgtagcggcggtcggccccggttattcgcccacggcctatgcagttgcaaaggcgggcgtgcttcacctgacgaaggtcgctgcggcggaccttgcgaagcaccagatccgcgtgaacgcggtgcagcccggcttcatcaacaccaacatcttcaccagctcgctcgaaatgccggaggaactggaagcacaggccaagggcgcgatcgcggcgatgtcgcaacaggcccagccggtagcgcggggcggacagccagaggatatcgcgcaagccgtgcttttcctcgcgagcgaggcggcgggcttcgtgacggggacttcgctcatcgtcgatggcggcatcacc

SEQ ID NO: 34472 - DNA, 963 bp, Sphingomonas aromaticivorans
tggcccaagccttatggcggtgccggcatgtctccggccgaggccaaggtgtggcgcgaggagtgcgcccgcatcggcgcgcgtccgccgctgtccagcttcggcatctggatgctcggcccggcgctgctcaagttcggcaccgaggaacagaaggtccactatctcaaccagatcgcgcgcggcgagatccgctggtgccagggctattccgaacccggttccggctcggacctcgtcagcctgcagaccttcggcgaggacaagggcgatcactgggtcgttaatggccagaagatctggacatcctatgccgacaaggccgactggatcttctgtcttgtccgcaccgacaagtcgaacaagtaccagggcatcagcttcctcctgttcgacatgacgacgcctggcgtcacgaccaagccgatcaagctgatcagcggcaactcgccgttctgcgaaaccttcttcgacaatgtcgtggtgcccaagagccagatcgtcggcgagttgaaccgcggctgggacgttgccaagtacctgctcggccacgagcgcgagatgatctcgggcgcaggcggcggcgaccgtctcaacgcgatcggcgcggtcgttgcgcgcaacggtcttgaagacccgatcctgcgcgcggaactcgcgcagttcgacgtcgatgcgctggcctatgcctgcatgggcgagaagttcctcgacgaggccaaggtcggccgcgcccatcctgcccagccgaacatgatgaagtatgccggcaccgagctgaacaagcggcgccacgaactgctcatggcggcaggcggcgccacggcgcttgaatgggaaagcgatcgcaccagcggcggaacgcccgcgcgctcgtggttgcgcaccaaggcgaactccatcgagggtgggaccagcgaggtcatgctcaacgtcatttccaagcgcattctcgacctgccg

SEQ ID NO: 34473 - DNA, 1137 bp, Sphingomonas aromaticivorans
ggagcctgatcgatgcctctttaccacaccgaagaccaggccatgctggccgaaaccgtcaccggcttcatggccgatgaaggtgcgatcaagaagcagttgcggcactatcgcgacatgaattgccaggacggcttcggccatgccctgtggaagcagtttgccgaaatgggcctgaccgggatgctggcgtccgaggccgacggcgggctggccatgggccatgtcgaggcgggtatcgttctgcgcgagattggccgcaacctcacgccttcgcccttcctgaccacttcggtcatgggcgtcacggccctctcgggcgggtcggacgagctgcgcgggcgctggcttcccggcgtgatcgccggcgacagcgtgcttgccgtcgccatcgacgaaagccccaagcaccgacccgaacgcatcgcctgccgcgccgagaaggcgggcaacggcttccgcctccagggccgcaaggccttcgtggtccacggcgcatctgcggacgcgatcatcgttgctgcgcgcacctcgggcagcgacaccgatgttgacggcatcacgctgttcgccgttccgaaggatgcggccggcattgcccacgagaacctccgtctcgtcgacagtacgatggccagcaacgtgaccttcgacaatgtcgagctggacggcgactgcgtgatcggcgaggtcgatggcgggcgcgaactgctgaacagggtgctcaacgtcggtcgcatcggctcagccgctgaaatgaccggggtcgggcagggcgcgttcgacatcaccaccgcctatctcaagacgcgcaagcagttcggcaagctgatcggggaattccaggcgctccagcaccgggccgcgcacctctactccgagctggagattgccgaggccgccgtcatcaaggcgcagcagcttctcgacggcaattccgaaaaggcggacctgatgatctcggtcgccaaggccaaggctggcaaggcttgcaacctggcagtgcgcgagggtgtgcagatgcacggcggcgtgggcatgaccgacgaattcgacatcggtctctacatgaagcgcgaccgctcgctgtccgagttcatgggggaccagtactaccacgccgaacgggtcgcgcag

SEQ ID NO: 34474 - DNA, 735 bp, Sphingomonas aromaticivorans
ttcagccttgaaggccgcgtagcggtcgtcaccggtggttcgcgagggatcggcgagatgattgccgagggtttcatcgccgccggttgctcgcgcgtctacatcaccgcgcgcaaagccgccgtggtcgaggaaaccgctgcccgccttggcgagaagtgcatcgccctgccaggtgacatctccaacgtcgccgggatcgaacagctcgccgccgacctcgccgcgcgcgaggacaagctcgacattctcgtcaacaacgccggcgcggcgtggggcgcggatttcgaggattttcctgaactgggctgggacaaggtcatggacctcaacgtcaagaccccgttcttcctcacccagaagctgcatggcctgctcaaggccgctgccagcaaggaacagcccgccaaggtcatcaacatcgcctcggtggatggcctgcgcctcaacccctgggaaacctacagctaccaggcttcgaaggcggcggtcgttcatctgacgaagcgaatggcggcacgcctggtcaaggaccagatcattgcgagctgcatctgccccggcgccttcccctcggaaatgaacaaggcggcagcgaagaatccggaagcctcgtcgcgtggcattccgctgaagcgtatcggcacgatcgaggacatggccggcggcgcgatcttccttgccagtcgcgcgggcgactatgtcgtcggcacgccgcttcccatcgacggcggc

SEQ ID NO: 34475 - DNA, 579 bp, Sphingomonas aromaticivorans
tcgatcacgcggaagaccgaggaaaccgacatcgccgtgtcggtgaacctcgatggcaccggcacctacaaggtggacacgggcatcggctttctcgaccacatgatcgagcagttcagccgtcactcgctgatcgacatcgaatgccgcgtgaagggcgatctccacgtcgaccagcaccacacgaccgaggacagcgccatcgcgctgggccaggcgatctcgcaggcgctcggcgacaagaagggcatcacccgttacggccacacctactcgccgatggacgaggcgctgtgccgcgtcgcgctcgatatttcgggccgtccggtgctggtgtggaaggccgccttcacccagccgcgccttggcgagatggacaccgagctgttcgagcactggttccagtcgatcagccaggctgcgggcatcacgctccacatcgaaagcctctacggctcgaacaaccaccacatcatcgagggcatctacaagggcttcgcccgtgcgatgcgcgccgccatcgcgatcgatccgcgcaaggccgacgccgtcccttcgaccaagggcatcctcggtggc

SEQ ID NO: 34476 - DNA, 792 bp, Sphingomonas aromaticivorans
gtccgcgtccgcgtcattccctgtctcgacgttgccgatggccgcgtggtcaagggcgtcaatttcgtcgacctgcgcgatgcgggagatccggtcgagcaggcgcgcgcctatgacaaggctggcgccgacgagctttgcttcctcgacatttccgcaagccacgaaggccgcggcaccctgctcgatgtcgtcgcccgcaccgcagaagtctgcttcatgccgctgaccgtcggcggcggggtgagggcggtggaagatgcccgcgcgctcctgctggcgggagctgacaaggtcgcggtcaattccgccgccgtcgcccggcccgaactggtgcgcgacattgccgagaagttcggcgctcagtgcgttgtcggttcggtcgacgcgcgccgcgtcagcgaacccggcgctccgggcagatgggaaatcttcacccatggcggacgcaaggcgacgggaatcgacgctctggcgcacgccgtgaaccttgccacgctgggtgcgggcgaactcctcgtgacctcgatggacggcgacggtacgcagaagggctatgatctcgaactgacccgcgcgattgccgatgccgtgccggttccggtgatcgccagcggcggcgtcggctcgctggaacatctggtggaaggggtgaccaagggtcacgccagcgcggttctcgcagcctccatcttccacttcgggacctacaccatcgccgaggcgcacgcggcgctgcgtgcggcgggcctgccagcgcgcggctgaaatgcgccgtgtcccgcaatgggg

SEQ ID NO: 34477 - DNA, 300 bp, Sphingomonas aromaticivorans
atcctcgcccggctcgaagccacgatcgcagaacgtcgcctcggcgatccgtcggccagctacgtcgccaagctgaacgccaaggggctggccaagatcgcgcagaaggtcggggaagagggcaccgagaccgtcattgccgcgctggccggggaccgcaaggaactggtcggcgaagcggcggacctcatcttccacctgatggtgctgttgtcggccaaggacgtgccgttcgccgaagtcctggccgaactcgcgcgccgcgaaggcacctcgggcatcgccgagaaagccagccgg

SEQ ID NO: 34478 - DNA, 834 bp, Sphingomonas aromaticivorans
accgaccacaccgcccgcgcccgcacctggttcgaaagcctgcgtgaccgcatctgcgcggagttcgaagcgatcgagcgcgaggcgggctcggacgcgcgcttcgcctacactccgtggaaccgcgagcacgaaggcgagaccgtggagaacgggggcggcggggtccagggcctgatgaagggccgggtcttcgagaaggtcggcgtcaacgtatcgaccgtgcagggggaattctcgaaggagttcgctggcacgatcaacggggcgagcgcggacgcgccgggcttcaccgcaaccggcatcagccttgtcgcccacatggccaatccgcacgtgcccgccgtccacatgaacacccgcttcctcaccaccagcaaggcatggttcggcggcggcggcgatctcaatccgccgatcccctatgaagaggatacggtagagttccatgccgagtacaaggcggcctgcgacaggcacgatccggaatactatccccggttcaagaagtgggcggacgactacttctggattccccaccgcaaggtccatcgcggcgttggcggcatcttctacgaccaccttgaatgtgccgacgatgcggcgttcgaggcgaacttcgccttcacccgcgacgtgggcgaggctttcatcaacgtgttcccgcgcctcgtgcggcggcggatgggcatggatttcacgcccgccgaaaagctgacccagctcgagtatcgcgggcgctatgccgagttcaaccttgtctgggaccggggcacgctgttcgggctcaagaccggcggcaacatcgacgcgatcctgatgagtctgccgccg

SEQ ID NO: 34479 - DNA, 1629 bp, Sphingomonas aromaticivorans
atgtatcagtacgacagctatgaccaggcaatggtcgatgcccgcgtcgccgaattccgcgaccaggtgcagcggcgccttgccggcgacatcaccgaggaccagttcaagccgctgcgcctgaagaacggcctctatctccagcttcatgcctacatgctgcgcgtggctgtgccctatggcacgctgaacagccggcagatgcgcatgctgggcgacatcgcggacaagtacgaccgcggatacggccacttcaccacgcgccagaacatccagtacaactggatcaagctggaagacgcgcccgacatcctggcggacctcgcctcggtcgagatgcacgcgatccagaccagcggcaactgcatccgcaacaccaccgccgaccagttcgccggtgccgcggccgacgagctggtcgatccgcgcccctatgccgaactgctgcgccagtggtcgacgttccatccggagttcgactacctgccgcgcaagttcaagatcgcgatcatcggcagcgaaaccgaccgcgcggcgatgaagctgcacgacatcggcatccagctcgtgaagaacgacgcgggcgagatcggctgccggttctacgtcggtggcggcatgggccgcacgccgatgatcgccccggtgatcggcgacttcgtgccgccgctgcagatgatctcctatgccgaggcctgcctgcgcgtgtacaaccgctatggccgccgcgacaacaagtacaaggcgcgcatcaagatcctcgtccacgagatcggcgccgatgaatatcgccgccaggtcgaggaagagttcaagcacatcctgacgctgggcctcgagccgcctgccgccgaactggagcgcatcaagggcttcttcgagcagccgggcttcgatgccaacgcatcggacgagctggacctgtccgatcccgacttcgcactgtgggtggaccagaacgtccatgcccacaaggccaagggctatgccatcgtcaacatcagcctgaagccggtcggcggcattccgggcgatgcgacggccgaccagatccgccttatggcggacctcgcgctcgagcattcgttcgacgagctgcgcgttacccatgcgcagaacatcgtcctgccgcacgtgaagaaggcggacctccatgcgatctggcagaagctggacgcggcgggcctggcgaatgcgaacctcgacctgatcggcgacatcatcgcttgcccgggcctcgactattgcagccttgccaatgcccgttcgatcccggtggcgcagaagatttcggagcgcttcgcagacctcggccgccagcgcgagctgggcgagctgaagctgaagatctcgggctgcatcaacgcctgcggacatcaccacgccggccacatcggcatcctcggcgtcgaccgcaagggcgtggagaactaccagctcctgctcggcgggtgcgagggcgcggatacctcgctcggcacgatcaccggccccggcttcaacgaggacgggatcgtggatgcggtcgaaaaggccactgacgtctatctcgcccagcgcgccgaaggggaacgcttcgtcgacacctatcgccgcatcggcatggccccgttcaaggaggcaatctat

SEQ ID NO: 34480 - DNA, 608 bp, Sphingomonas aromaticivorans
ggctggcgggcgacctcgcggtcgtgtcgagcttcggcgcggaaagcgcggtgctgctccacctgatcgccgaagtcgacccttcggtgccggtcctgtttctcgaaacgggcaagcatttccgcgagaccgttgcctatcgcgacgagttgatcggcttcctgggcatgaccaacctgcagatcatcgaacccgacgcggcggtcatcgccaagaaggacgagaacgggctgcgctggtcctgggacccggatggctgctgcgagatccgcaaggtcgagccgctggccagggccctgctccacttcgatgcatcgatcaccggccgcaagggcttccagtcgaagacccgcgcagggcttccacggttcgagatcgaccgttcggacgcgcaaggacggttgaagatcaacccgctcgcgtcatgggacaagaccatgctcgaggcctatttcgcagagcatggcttgccgccgcatccgctggtcgcgcagggctatccctcgatcggctgcgcgccctgcaccagcaaggttgcccccggtgaagacccgcgctcgggccgctggaagggctgggacaagaccgaatgcggcatccattcgccc

SEQ ID NO: 34481 - DNA, 2067 bp, Sphingomonas aromaticivorans
ctggctgtcccgggcatgcattgcgcgggttgcatgggcaaggtcgagcgcgcgctcggcgcggtcgagggcgttgccagcgcgcgcacaaacctgaccgcgcgcacggtcgaggtcatccatgcacccgcgatcgaaacgcccgcgctcgttgccgcacttgccgcaaccggcttcgaggcccagccgcgcgagatcgaggccgagccggtatctgcggtgaagccgctgctcgcgccgcttggcgtggccgccttcgcctgcatgaacgtcatgctcatgtcggtcagcgtctggtcgggggcggatggcacgacgcggtcgctgttccactgggtctcggcgctgatcggcgttcccgccatcgtctatgccgggcggccattcttcgcctcggcgtggaaggtgctgcgccatggcaggaccaacatggacgtgccgatctccatcggcgtcaccatcgccaccggcctctcgttctatgaaacgctgaccggcggggcagaggcgtggttcgacggcgttctcatgctcctgatgttcctcctggcaggccgcgtgctcgatgcgatgatgcgcgaccgcgcccgctcgggcgtcgatgcgctgctgcgccaggttgccaccggcacgatggtggtcgatgccgacggttcgacccgctgggtggaggcaaagtcgctcgagcctggcatgatcatgcgggttgcctcgggcgagcgccttgcggccgatggtgcgatcgttcgcggcaccagccggttcgaccagtcgttgcttaccggtgagagcgaacccgtcaacgccgggccgggaagcattgtccacgcgggcacgctcaacgtcgaactgccggtcgatgtgcgcgtgaccgccatcggccgcgataccgccttgtcagagatcgcccgcctgatggaagcggccggccagtcgcggtcgaagtacgtgcgcattgccgaccgtgcctcgcggctttacgcaccagccgtccatacgctcgcggcgctgacgttcgtcggctggatgatcgcgggcgcaggcgtctacaagtcgctggtcatcgcgatcgcagtgctcatcattacctgcccttgtgcgcttggccttgcggtgccggtggcgcaggtcgttgccgcgggtgcgctgatgaagcgcggcgtgttggtgaaggacggctccgcgctcgaacgcatggccgaagtcgaccgcctcctgctcgacaagaccggtacgctgacgctcggtcgcccggttcccgacgaagcggccctcgacgccctgtccggcgccgaagcctctgtcgccctcgcgctcgccagtcacagtcgccaccccctgtcgctgggtctcgtgcaggccctcggcgcgcgcggtgtcctcgcggcggccctggaagatgtggtggaagagccggggaagggcgtgagcggcaaatggaatggccttgcggtgtcgctcggtcgcccgcaatcggcccagggcatggccacggcgcttcatgttgagggcgggccggtccgtgtcatcgcctttgccgaccggcttcgtcccgacgccgaagccgcgctcgggcagttgtcgagcatgggtgttccagcctccatcctctccggcgattccatccctgcggtcgccgccgtctcgcgcgcgacgggtctcaccgcgcaggccgccgccagcccgatggagaagcaggaagccatcgagcgtctccaggcagcggggcgcaccgtgcttatggcgggcgacgggttgaacgatggtccggcgcttgccgccgccaacgcctcgatcgcccccggttctgccagcgacgtcggtcggcaggctgcggacatggtgttcaccggcgattccctgctcgccatccctcgcgcggtgcgggtggcccgcgccaccatgcgggtcgtgcgccagaacttcgtcctcgccatcggctacaacgcgctggcggtgccgctggcgatccttggccacgttaccccgctcatcgctgccatcgccatgtcgaccagctcgcttgtcgtcgtggccaattcgctgcgtcttgccggagaagcgaaa

SEQ ID NO: 34482 - DNA, 1563 bp, Sphingomonas aromaticivorans
ttggcgatcttgacgatgacatttgcaaacctcccccaaccgctcgccgccgcgctcgaaggccacggttacactgccctgaccccggtccagtccgccgtgaccgaagccgaagcccatggccgcgaccttgtcgtctcagcgcagaccggctcgggcaagacggtggccttcggcctggccatggccggcgaactgctgggtgacgaagccacgctgcccttcgccactgcccccctcgctctcgtcgtcgcgcccacgcgcgaactggcgctgcaggtgagccgcgaactgacctggctctacgcccccacccaggcccgcatcgccacgtgcgtcggcggcatggacccctcgcgcgaacgccgcgcgctgtcgcacggcgcgcatatcgtcgtcggcacgccgggccgcctgcgcgaccatctcgaacgcggcgcgctcgacctgtcggcgctgcgctgcgtcgtgctcgacgaagccgacgaaatgctcgacatgggcttccgcgaagatctggaagaactgctcgacgccacgcccgagggccgccgcacgctgctgttctcggccaccatgccgaagccgatcgaggcgctggcccgccgctatcagcgcgatgccctgcgcatctcgaccgtcggcgaagcgcgcggccatggcgacatcgcctaccgcgccgtcgccgtcgccccggccgagatcgaggccgccgtcgtcaacctgctgcgcttccacgaggcggaaacggcgatgctgttctgcgccacgcgcgacaacgtgcgccgcctccacgccaccctggtcgagcgcggattcaccgcggttgccctttcgggcgagcacagccagtccgaacgcaacaacgcgctccaggccctgcgcgaccgccgcgcccgcgtctgcgtcgccaccgacgtcgccgcgcgcggcatcgacctgccctcgctcagcctcgtcgtccacgtcgagatcccgcgcgatgccgaaacgctccagcaccggtcgggccgcaccggccgcgcaggcaagaagggcaccgccgtgctgatcgtgcccttcccgcgccgccgccgcgtggaaatgatgctgcgcggcgcgcgcatcaacgccgattgggtcgacgtccccacccccgaggcgatccgcgcccaggaccgcgagcgcctgctcgagacgatcctcgccccggtggaaaccgacgaggcggacatggagatcgcccgcaccctgcttgaacagcgcacggccgaggaacttgcagcggcgctggttcgcgcccaccgcgccgccctgccccagccggaggagctgctttccggcaccgacgaaggacgcaagcaggcgacccatcgcgccgggttcgaggacgtggtctggttccgcatggacgtcggccgtcgccagaacgcggacccgcgctggatcctgcccacgctctgccgtcgcggccacgcgtcccgccaggaaatcggcgcgatccgcattgcgcccaacgacacctggttccaggttccccgcgccattgccgaccgctttgccgacgcggtccgtcgcacagcc

SEQ ID NO: 34483 - DNA, 789 bp, Sphingomonas aromaticivorans
gtgatcggggacccgatcgcgcagtccaaatcgccggtgatccacgggttctggctggaagcgcttggcctcgaaggcgattatcgccgtgcccacgtcagggccggggaactggcagattaccttgctgcccggcgtgcggacacagactggcgtggttgcaacgtgacgatgccgcacaagcaggcggtgatcccgcttctcgaccggctcgacccgctcgccgcccggatcggcgcggtcaataccatcgtgcccgaggacggcgcattggtcggatacaataccgatgcgcctggcttcctcgaacccctgcggccattgctcgatcaggtgcattacttccgcatggcgcgcgtcctcgggaccggcggcgcggcgcgcgcaatcattgccgcactggcggacgagcacatggtgatcgtgctggcgggccgaaacgtcgagaaggcccgtgcgcttctcgatgaactccatcctgaaggggagcaccacgtcgccccgctcgaacacttctctgacgagaccgatttcgtcttcgatgaccgcgaaggatgcctcgacctcgtcgtcaacgcttcgtcgctgggcatgacagggcagccaccgcttgcctttgacatgacacatgcgccgccgggctcggtcttctacgacatcgtcaccagcccgctcgaaaccgatttcctcaagacagcgaaggcagcaggcttccgcacggtcgatgggctttcgatgctcatcggacaggccgaccatgcctttcgccgcttcttcggcgcggtgcct

SEQ ID NO: 34484 - DNA, 1428 bp, Sphingomonas aromaticivorans
atggagaccccatacgatctcgcggtgatcggcggcggcgtgaacggcgcggcgatcgcgcgcgatgcatgcggcaggggattgtcggtcctcctgctggaacggggcgacctcgcgcagggcacttcctcggcctcgaccaagctgatccacggcggactgcgctatctggaacatcgcgagttcgcgctcgtcgccgaagccctgcacgagcgggaaaccctctggcggcaggcgccgcatatcatctggcccatgcgtttcgtccttccgatcgtgcccgaagggcgaccgtggtggatgttgcgcgcggggctgtggctctacgatcgcatcggcgggcgcaaggcgctgccgcccgcgtcgcgggtgcgacttgacgggcgcatgggcctccagcctgaaattcggcggggctacgaatactccgattgctgggtggacgatgcgcggctggtggtcctgctcgcgcgggatgcggcggaccgcggggccgaagtgcggacgcgctgcccggttacggcgctgcggcgcgagggccatctctggcggatcgaggcgggcggcgatgtgttccatgccgccatgacggtgaatgccgccggaccgcaggtcggcgagatcatggaccgagcccatgcgccgcggcccgcattgctgcggcgggtgcgcggctcgcacattgtggtgccgcgcctgcacgacgatccgcgcgcgctgttcctgcaactggcggatgggcgcatctactttgccattccctggcaatatgccttcaccctgatcggaacgaccgacagcgaggagggcgcggatgccgacccgccgcacgccacggaggaggagatcgcctacctgctggacgccgccaaccactacttccgccgaagcctcaggcgcgaggacgtggtctggacctatgccggcgtgcgcctgcttgcggatgacggttcgggcaggccggaagcggcgacgcgcggctatcgcctcgaggtggaccggggccgcgaccgccattccgcgcccatgctctcggtgctgggcggcaagatcaccacgcatcgcacccttgccgaagcggcgctcgagcggctcggcgtgactgacaatgccggctggaccgccagcgcgccgctccccgggggcgatttcacacctgacgggctggacgaggccgacaacctcgcgccggtggaacaggaaattgcggcacaggcgcagcagctttcgcggcccaccatccaccggctcgcgcgggcttatggcaccgaagcgctgggcttcgtgcgcggcgacatggggcggcacatcgggcagggcttcaccgaggctgaactcgatcacctgaccggtcgtgaatgggcgcagacggccgaggacgtgctgtggcgccggtcgaagctcggcatgtggttcagcgccgaggag

SEQ ID NO: 34485 - DNA, 1449 bp, Sphingomonas aromaticivorans
gtactggtgatcgatgcgggcacgacctcgacgcgggctctcctgttcgggcgggacgggcgctgccatggcgttatgcaaagcgaatttgcgcagcattatccccgcccgggccaggtcgaacacgatgcggacgagatctggcgcgcgacgcttggctgcatgcgcgaggtggtcggggtcgtcggtatcgagcgcatcgcggcgattggggtaaccaaccagcgcgagaccgtcgtcgcctgggatcgcacgaccgggcaacccctggcgcgggccatcgtctggcaggatcgccgcaccgcgcccatgtgcgaccggttgcgatcggaaggggcggagccgctggtccagtcccgaaccgggctgctgcttgatccctatttctcgggcaccaagatgcgctggatgctcgacaacgagccagcggtcgccggagccgcgcgcgacgggcggctggctctgggcacggttgaatcatggctggtgtggaagctcacgggtggagcgcgccacgtaaccgatgccagcaacgccagtcgcacgctgcttctcgctctcgatggcgcggactgggatgaggagttgctcgacctgttcggcgtgccgcgcgcggtgctgcccgaggttaccgacagtctgggagaatttggcgcggcgctgcctgaatggctggacgcgtccgtgccggtcagaggtctggccggggaccagcaggccgcaaccatcgggcagggctgtcttgcgcccggcgaagtcaaggcaacctacgggaccggtgccttcgtgttggcggcaatgggtgacgcggtgccgcgttcgggccatcgcctgctcggcacggtgctggttcaggacaagggcgttcgcagttttgcgctggaaggttcggtctttgtcgcagggagcctgatcaagtggctgcgcgatgcgatgggcctggtcggctccgccgcagaaacggccgcgcttgcggcttcggtgccggacagtggcggggtcgtgctggtgccggcgctctccggcctcggagcgccgcactggcggcccgatgcgtccgcggcgcttacaggaatgacgttttcgaccacgcgcgcccatgtcgtgcgcgccgcgctggaggcgatggcgcaccagacgctcgacctcatggacgccttcgccgccgaccgcgcaccctggacctcgcttcgcatcgatggcggcatgagtgcgaacgattgggtggcgcaggatcttgccgatatcctcgacctgcctgtggagcggccggtcatggtcgagactacggccctgggcgcggggatgctggcggcggtcgcgtccggctggttcggatcgctgggcgaagcggaggccatgcgcgggtccgtcacgcggttcgaaccgcgcatggcgccaggtgtccgggccgcgcggatcgcgcggtggcgcgaggcgctcgcgaaa

SEQ ID NO: 34486 - DNA, 2205 bp, Sphingomonas aromaticivorans
atcctcacctcgcttcacgaggtcatggcctcgcgcagcggcgcgcaggccaagttgaaccagatcgtcgaagtcatcggcgaaaacctcgatagcgaggtctgctcgatctatctcctgcgcgaggggatgcttgaactcttcgctacgcgcggcctcaaccaggcggcggtccatgtcacccggctggccgtgggcgaaggtctggtcggcaccatcgccggtaatgtcgagacgctgaaccttgccgaggcggccgcccatccggacttcgcgttccgccccgaaacgggcgaggaaaagttccactccttcgctggcgtgcctatcgtgcggcgcgagagggcggtcggtgtcgtcgcggtccagcacgtggaaccgcgtcgctacgaggaagtggagatcgaggcgctgcagaccgtggcgatggtcctgtcggaactcatcgccaatgccgaactgatcgacgacgaggaaacgctcggcgtgcccgcgcacctgacggggccggaccgcctcaagggcctcacgctggtcaagggcctcgccagcggcgtggccgtctaccaccagccccgcgtcaccatcgaacacgtcgttgccgaggacaccgaggcggagcgtcagcgcgtctacctcgccttcgacaagatgcgcgagcagatcgaccgcatggccagccaggccgaattcggcgtaggcggagagcatgaggaggtgctcgagacctaccgcatgttcgcctacgacgaaggctggtcgcgccggatcaacgaggcgatcgattcgggccttaccgccgaagccgcgatcgagcgcgtccagcagcgcacccgcatgcgcatgcgccagatcgacgacccgctgctcgccgatcgcatgcacgatctggaagacctgtcgaaccgcctgctgcgcatcgtctcgggccagctcggcacggcggcaagcatgggtctgaagggcgatgcgatcctcatcgcgcgcaatctcggtccggccgaactgctggaatacgaccgccgccgcctgaaaggcgtgatcctcgaggaaggctcgctcacggcccacgtcgtcatcgtcgcacgcgcgatgggcattccggtggtcgggcgcatgcgcgcgctgcgcggcaaggtgcgcgagggcgaccagctcctgctcgacggcgaccagggcgtggtcgacgtccgccccgcgcccagcctggtcgaggccttcgaggcccgcttcgccaagaatcgcgaacgtcaggcccactatgcggcgatgcgcgaggtcgagcccgtcacccgcgatggcaggcgcattactgtgctgatgaatgccggccttcgcgacgacacgcccatgctcaacctgaccggcgcggacgggatcggcctgttccgcaccgagttccagttcctcgtctcggccacgctgccctcgcgcgagcggcagacccggctctaccgcgacgtgatcgatgccgccggcgatcgtccagtggtgttccgcaccgtcgatatcggcggcgacaaggttcttccctacctgcgccacaacgatggcgagaccgaggagaacccggcgatgggatggcgcgcgctgcgcgtcgcactcgaacgcgacggcctgctcaaggtccaggcgcgcgcgctgctcgaagcggcgggcgggcgcacgctcaacgtcatgttcccgatggtcaccgaaccgtgggaattcgatgcggccaaggccgtgttcgaaggccagctcgccttcctgcgccgtcagaagaaactcctgcccgaagcgatccgctatggcgcgatgctcgaggtgccagccttggctgaatgcctcgacctgctggcgcccaagctctcgttcctgtcgatcggcaccaacgacctcacccagttccttttcgccgccgaccgggccaacccgaagctggcggagcgctacgactggctctcgcccgcgatcctgcgcttcctgcgccgcgtggtgcgcacgctcgagcccttcggcaccgatgttaccgtctgcggcgagatgggcggcaggcggctggaggcgctggcattgctcggcctcggcatcaatcgcctgtcgatcacgcctgcggcagtggggccggtcaaggagcttgtgcgcaaggtggacctcggcgagattcgcgccgcgatggacggatggctggcagatccgccccatgacttgcgctccgccatt

SEQ ID NO: 34487 - DNA, 1875 bp, Sphingomonas aromaticivorans
aatccttggatcaagagcctcctcgtctggggcggcatcttccttgcactcctgctggtcgtctcgatgttcggctcgcgggttgaccagaccgctgcgaccatcccctattcggccttccgctcgcaggtcagcgacggcctcgtccgctcggtggagatcgcgcctgagcgcattaccggtacgctcaagaacggtggccagttcgcgaccattccggtccccggcgactccgacctgcccaagctgctgcaggacaacggcgtgcagtatgccggcaaggcggccgagcagccgaacatgctgatgtacatactcgtcaattcgctgccgttcctgctgatcctgggcgtcgcgttcttcgcgctgcggcaggtgcagaagggcggcgggtcgggcgcaatgggcttcggcaagtcgaaggccaagatgctgaccgagcgttcgggccgtgtcaccttcgacgacgttgccggcatcgacgaagcgcgcgaggaacttcaggaaatcgtcgagttcctgcgcgatccctcgcgcttttcgaagctcggcggccagattcccaagggcgcgctgctggtcggctcgcccggtaccggcaagaccttgctcgcccgcgccatcgcgggtgaggcgggcgtccccttcttcacgatctccggttctgatttcgtcgagatgttcgtcggcgtcggtgcaagccgcgtgcgcgacatgttcgagcaggccaagaagaacgcaccgtgcatcgtcttcatcgacgaaatcgacgcggtcggccgccatcgcggccacggcctcggcaattcgaacgacgagcgcgagcagacgttgaaccagctcctcgtcgagatggacgggttcgaggccaacgaaggcatcatcatcatcgcggcgaccaaccgccccgacgtgctcgaccccgcgctgctgcgcccgggccgcttcgaccggcaggtcgtcgtgccgatcccggacatcgaagggcgcgagaagatcctttcggtccacatgaagaaggtgccgctggcgcccgacgtcaatccgcgcaccatcgcgcgcggcacgcccggtttttcgggcgcggacctcgccaacctcgtcaacgaagccgccctgctcgccgcgcgccgcaacaagcgtctcgtcgcgatgcaggagttcgaggacgccaaggacaaggtcatgatgggcgcggaacgccgctcgatggtcatgaccgacgacgagaagaagatgaccgcctatcacgaggccgggcacgccatcgtctctgtccacgagcctgcgtccgacccaatccacaaggcaacgatcatcccgcgcggccgcgcgctgggcatggtcatgcgcctgcccgagcgggacagctattcctaccaccgcgacaagatgcacgcgaacctctcggtctcgatgggcggtcgcgtggccgaagagatcatcttcgggcacgacaaggtctcgtcgggtgcctcctcggacatccagtacgccacgtcgctggcgcgctcgatggtcaccaagtggggtatgtcggacaagctcggcccgctgcagtacgaggaccagcaggaaggctacctcggcatgggcggttcgcagcgcctgttcgtctcggacgagaccaacaagctgatcgacatggaaatccgtggtctggtcgacggcgcacacgagcgcgcgcgcgatatcctcaagaccaacgaggacaagctgcatctcctcgctcaggcgctgctcgaatacgagacgctgaccggcgacgagatcaaggaactgctcgagacaggtcacatcgaccggccgcaaagcccgagcggcccctcgcgtccggtcaccgcgcagggttcagctgtgccgcgcgccggcaag

SEQ ID NO: 34488 - DNA, 1020 bp, Sphingomonas aromaticivorans
cttcggtgattgcgggggcggcggcgagggtctagtcaccccgccatgaccagctacccgatgactcgcctgcgccgcacccgtgctaccgcatggagccgcgcgatgcaccgcgaagtgctcgtgaccccggccgacctgatctggccgctgttcgtgactgaaggggagggcgtggaagatccgatctcctcgctccccggcgtctcgcgctggtcggtcgacggcattgttgcccgggcgagggaagcggtcgcgctcggcattccctgccttgccctgttccccaacacccaacccgaccgtcgcagcgaggacggcagggaagcactcaatcccgacaacctgatgtgccgtgccatccgcgcgatcaaggatgcctgcggcaacgacatcggcgtgctgaccgacgtcgcgctcgatccttacaccagccacgggcaggatggcctgatcgacggcgagggctatgtcctgaatgaccggacggtcgaggtcctcgtgggccagagcctcaaccaggcggcggcgggcgccgacatcatcgctccgtcagacatgatggacggccggatcggcgcgatccgcgaggcgctggaagacgcagggcacgtcaacgtccagatcatgtcctacgccgctaagtacgcctcggcgttctacggcccgttccgcgatgcggtgggttcgcgcggattgctgaagggcgacaagaagacctaccagatggacccgggcaatgccgaggaggcgctgcgtgaggtcgagatggacctggccgaaggcgccgacagcgtgatggtgaaacccggcctgccgtacctcgacatcgcctgccgcgtgaagcaggccttcggcgtccccgtcttcgcctaccaggtgagcggcgaatacgcgatgatcgaggcggcggttgccgcaggggcggccgaccgcgatgcgatggtgctcgaaacgctagtggcgttcaagcgcgctggatgctctggcgtgctgacctaccacgcagcccacgctgca

SEQ ID NO: 34489 - DNA, 2244 bp, Sphingomonas aromaticivorans
cagagcctcgagaagacgctgcacaccgcgctcgccaacgcgtccgagcgcagccacgagtacgcgactctcgagcacctcctgctggccctgatcgacgatccggatgcggcgcaggtcatgcaggcctgcggcgtcgacctcggcgatctcggcgatgtcgtgcgccagtacctcgaccaggaataccagtcgctcaagacgcaggagaaggccgacccgcagccgacagccggcttccagcgggtgatccagcgcgccatcctgcacgtccagtccagcggcaaggacaccgtcaccggcgccaacgtgctggtcgcgctgttctccgaacgcgacagctatgcggtctatttcctgcagcagcaggacatgagccgcctcgacgcggtcagcttcatcagccacggcatcggcaagggtggacgccaggtcgatggccgcacgcccaagggcgccgaggaggatgtacccaagcagcaggaagaaaaggccgacgccaaggggcagaagaaggaaaccgctctcgaccagttctgcgtcaacctcaacgagaaggcgctggcgggcaaggtcgatccgctgatcgggcgcgggccggaagtggatcgcacgatccagatcctgtgccgccgcagcaagaacaacccgctctacgtgggcgatcccggcgtgggcaagaccgccatcgccgagggcctcgcgcgcaagatcgtcgagggcgaagtgcccgaggtcctctccgaggcggtgatctattcgctcgacatgggcagcctgctcgccggcacccgctatcgcggcgacttcgaggaacgcctcaagcaggtcgtctccgagctcgagaagatgccgcacgcgatcctgttcatcgacgagatccataccgtgatcggcgccggcgcgaccagcggcggggcgatggacgcttcgaacctgctcaagcccgcgctttcgggcgggaccatccgctgcatcggctcgaccacctacaaggagttccgcaaccacttcgaaaaggaccgcgccctgctgcgccggttccagaagatcgacgtgaacgaacccacagtcgaggacacgatcaagatcctcaagggcctgcgcacggcgttcgaggaacaccacaaggtcaagtacacgcccgacgcgatcaagaccgcggtcgagctttccgcgcgctacatcaacgaccgcaagctgcccgacaaggcgatcgacgtgatcgacgaagtgggcgcgatgcagatgctggtgccgccctcgaagcgcaagaagaccatcaccgcgcgcgagatcgagcaggtcatcgcgaccatggcccgcatcccgcccaagtcggtgtcgagcgacgacaagaaggtcctcgaacacctcgaacgcgacctgaagcgcctcgtgttcgggcaggacaaggcgatcgaggtgctgtcctcggcgatgaagctcagccgcgcgggcctgcgcgatccggacaagccgatcggctcgttccttttctcgggcccgaccggcgtcggcaagaccgaggttgcccgcagccttgcccagatcatgggcattccgctgcagcgcttcgacatgtccgaatacatggagcgccactcggtctcgcgcctgatcggcgcacctccgggctatgtcggcttcgaccagggcggtcttctcactgatgccatcgaccagcagccgcactgcgtcctgctgctcgacgagatcgagaaggcgcaccccgacctgttcaacatcctgctccaggtgatggacaacggccgcctgaccgaccaccacggcaagaccgtcgacttccgcaacgtggtcctgatcatgaccaccaatgcgggcgcttcggacatggcgcgccagggcatcggcttcggcgacgtgtcgaaggcggacgcgggcgacgaggcggtgaagaagatgttcacccccgagttccgcaaccgcctcgatgccatcgtgcccttcgcgtacctgccgcccgaagtcgtcagccgcgtcgtcgacaagttcgtgctccagctcgaactccagcttgccgaccagaacgtgcacatccagttcgatgccgatgcgcgcgcctggctggcgaagaagggctatgaccgcctctatggcgcgcggccgatggcccgcgtgatccaggaaaaggtcaagaagccgctggccgaggaattgctgttcggcaagctcgccaatggcggcgaggtccatgtcagcctcaagcaggaggagggccag

SEQ ID NO: 34490 - DNA, 969 bp, Sphingomonas aromaticivorans
atgacggcaatgggatgggatgcgccgggtggaccggaggttcttcggcccgaaaacgtgcgcgtgccgcagccagggccggggcaggtcctcgtcaaggtcgcttttgccggggtcaaccgcccggacgtgatccagcgccagggcttctatccgccgccgcccgatgcctcgccgctccccgggctggaaattgcgggacaggtggtggccatgggccagggcgtgacctggccgttcatcggcactgcggtctgtgcgctggtcgcgggcggtggctatgccgaatactgcatcgccgaggccgaccagtgccttcaggtgcctaccgggctgccgatggcgcaagctgcggcaatgcccgagacgctgtttaccgtgtggcacaacgtgttcgagcgcggcatggtggccgagggcgaaacgatcctcgttcacggcggaaccagcggcatcggctctatggcgatcctcctcggcaagctgttcggggtgaaggtgatcgccacttgtggcgggccggaaaagtgcgagcaggcgcttgccatcggcgctgcccacgcgatcgactacaaggctgccgacttcgtcgaggaaaccctgcgcctgaccgaaggtcggggcgtgcacatggtgctggacatggtcgcgggcgattatgtcgcgcgcaacctcaagtgcctcgccgacgacggacgccacgtgaccatcgcggtgcagggcggcgtgcgggcggaaatcaacatggccgaagtcatgcgccgccgcctgacgctgaccggatcgaccctgcggccgcgttccagggcgttcaagggcgcgcttgcctcggaaattcgcgataccgtctggccgctggtggtcgagggggcgctgcgtccgatcatggaccagactttcccgcttgccgaagccgccgcagcgcacgtgcgcatggaacagggcgcgcatatcggcaagatcgtgctg

SEQ ID NO: 34491 - DNA, 2043 bp, Sphingomonas aromaticivorans
atgccacaggtccatcatcgcacgtgccatatctgcgaggccaattgcggcgttctggtggaagtggacgggcgccggattctgtccatccgtggcgatcccgacaacccgctgtcgcgcggacacatctgccccaagggcacggccctgcaagaccttcaggaggatcccgaccggctgcgccgcccgctcaagcgggtgggagacacctggcacgagatcagcttcgagcaggccttcgccgaaatcggagagcggacacgcgcaatcctggcgaaggaccccgacagcgccgccgtctatatcggcaatcccaacgcgcacagctatgggaacgcgctcaatgcggactttctgggcaaggccctgcggacgcgaaacaagttctcggccagcacggtcgaccagatgcctcatcaggtggcgaacctgcggctgtggggccatgccagcatgttcccgattcccgacatcgaccggacgcgcacgcttgtcatcctcgggggcaaccccatggcatcgaacggctcgctctggaccgtgccggatttccgcgcgcgcgttcgcgacctcaaggcgcgcggcggcgaactgatcgtgatcgacccgcgtcggacggagaccgcaaaaattgcggaccgccatctcttcatccggccggcgggcgatgtgtacttcctgatcgcactcctcaaggccgtgcgggcgcgatcgcccgcccgcgttgtgcaggacttcgtgaccggtctcgaccgggtggacgaggcgctgcaacgtttcgacgccgaggcttgcgcagcgtcctgcggggttcccttgcccgagatcgaggctctggccgaaaggttcctggcgggtcccgccgcgctctatggccgaatgggcgtggcgacccaagcgcacggaacgctcaacgcttggctgatctcgctggtcaacatcgcgtcagggcaactcgaccgcgaaggaggctgggtgttcggccttcccgccgtcgacacggtcaacgtccttccgcccggatcgatcggcaagttcgcatcgcgcgtttccgggcatcgctcggtgcttggcgagttgcccgctgccgcgatggccgaagagatcgaaactcccggcgaagggcggatcagggcgctgttcgtcgtcgccgggaatccggtgctgtccacacccaacggcgcgcggctcgacaaggcgctcgagtgcctcgacctgctggtttcgatcgacatctatcgcaatgccaccagtcggcgcgcgcactacatcctgccaccggccggaccgctcgagcgcgaccattacggcctgttcctcctgccgatggccgcgcggacgatcgcagtctattcccggcccacgctggagcaggaagagggatcgctgcacgactgggaaatcctgcgcggccttgcccacgcgatcagcggcgaacccgtacaggcgccaaccccgcgcgaggcgctggacggattgctgcggtccgggccttacggattgacgctcgaacaggtggaagcatcgccatcgggtatcgacctcggccctccgccgaccggtcagttgcccggtcgcctgcgtacgccggacaagcgcgtcacctgcgacgtggaggaattggtcgaagctctcggcgcgctcgacctgcccggacaggaggacccgcaagggggactgcgcctcatcggaaggcggcacttgcgcacgaacaactcctggctcgccaacagccgccgcctgatcaaggggccggaccgctgcacggtgatgatccacccggacgacgcgaccccgcgcggcatcgccgatggcgcgacggtgacggtgcgctccgtcgcgggcagcatcgcgctcgccgccgaggtgaccgacgacatgatgccggggaccgtttccataccgcacggctggggccacggcctgccgggcgtatcgatggagaacgccctgggtcggcccggcgtcagcgtcaacgacatcacgctggaaaccgcgatggatccgctttccggcaacgccgcgttttcgggcgtggaggtc

SEQ ID NO: 34492 - DNA, 612 bp, Sphingomonas aromaticivorans
atgaagctgtaccatcacccgctttccggccatgcgcaccgcgcccgtctgttcgtatcgctcctcggcctcgatgccgaactggtcgaggtcgacctccttgcgggcgagcacaagcagcctgcgttcctcgctctcaatccgctgggccaggttccggtgctggtcgatgacgatggcactgtggtctcggactccaacgccattctcgtctatcttgcccgcaagcacgatcgcacggactggttgcccgaagatcccgccagcctcgccgctgttcagcgttggctatcggtagcggctggcgaactcgcttttggccctgcggcggcacgtctcgtcacggtattcggttcgcgtcacaatccgcaggaagtgatcacgcgggcccacggcctgctcgccaatctcgaacgccacctcgagcaccgcgattggcttgtcggcgccgcccccaccatcgccgacgtatcgctgtacagctacctgtcgagtgcgcctgaaggcaatgtcgaccttgccgcctatcccaatgtccgcgctctgctggcgcgcatcgagcatctgactggcttcgttcccttcgtccggacggcggcaggcctgcgcgcc

SEQ ID NO: 34493 - DNA, 1119 bp, Sphingomonas aromaticivorans
ctgcgccaggagcttgacgctgccgaatgcgccagcgctgcgaagagccggtatcttgccagcgtcagccacgagatccgctcgccgctcaatgcgatctatggctatgcgcagctcgtcgagcgcgaaggcacggtcgatccgcgcgatgcggccagggtcatccgtcgcagcgccgaacatctcactaacctcgtggaaggcctgctcgacatcgcctcgatcgaacagggcgtagtgcgcatcgacagcacggttgcacgcctcgatgcgctggtcgagcaggtggcggaaatgttccggccgctcgcggtgcagaagggcctcgcgttccgctgcgatcttcccgcgcgtctgcccgagttcgtgcggatggacgaacgtcgggtgcggcaggtgttgatcaaccttgtctccaacgcggtgaagttcacccaggcgggcgaagtggtcctggcggtgcgctggagcggcgaaatagcgacattcgaagtgcgcgataccggcccgggcatttccccggcccatcaggagacggtattctcgccctaccagactggtggggtcgaatgtggcggcggtgccggactgggactggcgatcacgcgtgcgatagtcgacatgctgggcggcgacctgcggctggaaagccggctgggcgagggatcgctgttccgcgtcgtgctgatgatgccgcatgtctccggcatggtggactgtgccgcgccgcgccctcgaccggtggggtatcggggggcaaggcggtcgctgttgctcgtcgatgacgatgccgaccatcttgccgtgctgcgctgcacgctcgaatcctgtgggttcgacgtttcgctggcgcccgacggcgcggcggcgcttgctctggctcacgcgcgcgccttcgatgctgtcgtcctggacattgcgatgccgggattgtcgggttgggaggtcgcggaaaggctgcgtgccgcgcacgggcagtcattcaggctggtcatgctttccgccaatgccgaagagcggcacgggccacggggcaaggagcctgaccacgacctgttcctgatgaagccggttgaactgtccgcgctggtcgactcgctgggcaagctgctggggctg

SEQ ID NO: 34494 - DNA, 1392 bp, Sphingomonas aromaticivorans
tttgaacgcatcaatccgatgaccggcgccgtcgcctcgcaggcagaggccatgaaagcgtcggacattccttccattgctgcccgcgcaggacaggcctttccggcgtgggccgcgatgggccccaacgcacgtcgcggcgtactgatgaaggcggctgcggcgctcgaagcgcgggccgacgctttcgtcgaggccatgatgggcgagatcggcgcgaccaggggctgggcgctgttcaacctcggccttgccgccagcatggtgcgcgaagccgccgcgctgaccacgcagatctcgggagaggtcattccctcggacaagccgggctgcatttcgatggctctgcgcgaaccggttggcgtgattctgggcatcgcgccgtggaatgcgccgatcatccttggcgtgcgcgccattgccgtgccgctcgcctgcggcaacgcggtgatactcaaggccagcgaaacctgtccgcgcacccacgcgctcatcatcgaggccttcgccgaagccggcttccccgaaggcgtggtcaatgtcgtgacgaacgcgcctgccgacgcagcggaagtggtcggcgcgctgatcgatgcgccggaagtgcgccgcatcaacttcaccggctcgaccaatgtcggcaggatcatcgcaaagcgcgcggccgagcatctcaagccctgcctgctcgaactgggcggcaaggcaccgctgatcgtcctggacgatgcggacctcgacgaagcggtcaaggccgcggctttcggcgccttcatgaaccagggccagatctgcatgtcgacggagcggatcatcgtggtcgatgccgttgccgatgccttcgccgataagttcaaggccaaggtcgcctcgatggctgtcggcgacccgcgcgagggcacgaccccgctcggcgccgtcgtcgacgcgaagaccgtcgctcactgccgcagcctgatcgacgatgccctggccaagggcgcccgtctgctgaccggcggcgaaaccacgcacaacgtgctcatgcccgcccatgtcgtcgatggcgtgacgcaggacatgaagctgttccgcgacgagagcttcggccccgtggtcggcgtgatccgcgcgcgcgacgaagcccatgccatcgaactggcgaacgacagtgaatacggcctgtcggcggccgttttcacccgcgacaccgcgcgcggcctgcgcgtcgcccgccagatccgttcgggcatctgccatgtcaacggcccgaccgtccacgacgaggcgcagatgcctttcggtggagtgggcgcgtccggctacggccgctttggcggcaaggccggcatcgacagtttcaccgagctgcgctggatcacgatggaaacccagcccggccactatcccatt

SEQ ID NO: 34495 - DNA, 792 bp, Sphingomonas aromaticivorans
accgtcgctttcaccgtcgaggacggcatcgcttgggtgaagttcaaccgccccgagaagcgcaactgcatgagccccaagctcaaccgccgcatgaaggcggtgcttgaggaactggaattccgcgacgacgtgaaggtcctcgtgctgaccggtgagggcgatgcctggaccgccggcatggacctcaaggaatacttccgggagaccgaggcccagggccttggcgccgtgcgcaagtcgcagcgcgaaagctatggctggttcgaacgcctgcgctggtacgagaagccgaccgttgcgatgatcaacggctggtgcttcggcggcggctatggcccgctgttcggctgcgacatcgcgatcgcttcggaagacgcgcagttcggcctgtcggaaatcaattggggaatcctgcccggcggcggcgcgtcgaaggtcgcgcaggaacttatgccgttccgcaaggccatgtaccatgcgatgatgggcgagaacctgacaggcaagcaggccgaagagcagggcctcgtcaccgaagccgtgcccgccgacaagctcaaggcgcgtgtgctggaaatctgcgaagcgctgaagaagaaggatagccacgcgcttcgcgccaccaagtggacgatgcgtcgcatggtcgacatgacctacgacaacggccttgaataccagattcgcgcgcaggaagcgctgcacagcttcggcggtgcggcagcccgcaaggaagcgacgcgccagttccttgacgagaagagcttcaagcccggtctcggcacgttc

SEQ ID NO: 34496 - DNA, 1563 bp, Sphingomonas aromaticivorans
tatgacgcactgatcatcggcggcggccacaatggccttgtctgcgccttctaccttgccaaggcagggatgaaggtccgcgtgctggagcgccgcgacgtggtcggcggtgctgccgtgaccgaggagttccaccccggtttccgcaattcgaccgccagctataccgtcagcctgctgcggcccaaggtgatcgcggacatgaagttgcacgattacggctatcgcgtgatcgagcggacgatcagcaatttcttcccgttccccgacacctacctcaagttgggcggcggaccgggccgtaccgaggcagagttcgcgcgcttctcgaagaaggacgcggaaagctatcccaggtatgacgccgcgctggaaaaggtcgcgaacgtcctgcgcgacatttccctgcagacgccgcccaacgtcgggggcggcattgccgcgctgaagtccgccgcgacgcagggctggccgattgcgaagctggatatcgccacccagcgcgacttgctcgacatcttcaccaagtccgcgcgcgatttcctcgatggctggttcgaggatgaccacgtcaagtccgccttcgggttcgacgcggtggtcggcaacttcgccggcgtatccacgcccggctctgcctacgtcctgctgcaccacgtgtttggcgaagtgaacggcaagctgggcgcatggggccactccgtcggcggcatgggggcgatcacccaggccatggcgaaggcctgtgtcgatgctggcgtggagatcagcctcgaagcgcccgtttcgcgcgtgctcgtgaacaacggcaaggccgctggcgtgaagctggagggcggcgaagagctttacgccccgatcgttgctgccaacgtcggccctgccatgctctatcgccagatggtcgatgccagcgaccttgacgaggatttccgccggcggatgaagaactacaagaccggctcaggcacgttccgcatgaacgtggcgctttccgaactgccggatttcaaggtgcttcccggcaagcagcttgcagaacaccacactgccggcatcatcatcgcgcccggcatggattacatggaccaggccttcatcgatgcgcagcagttcggctggtcgaagaagcccatcgtcgagatcaagatccccagcaccgtcgacgacagccttgcccctccggggcagcacgtggcgagcctgttctgccagcagttcgcgccccaattgcccgatggccggtcatgggacgattgccgcgaggaagtggcggatctcatcatcgacaccgtcaacgaccatgcacccaacttcaaggccagcgtgatcgcccgtcagatccactcgccgctcgatctggagcgcaagttcggcctgatcggcggagacatcttccacggtaccatgggcctcgatcagctctgggccgcgcggccggtgctgggcaacggcgactatcgctcgccgatcaaggggctctacatgtgcggctcgggcacgcatcccggcggcggcgtgaccggcgcgccggggcacaatgcggcgcatgagatcatccgg

SEQ ID NO: 34497 - DNA, 1302 bp, Sphingomonas aromaticivorans
gtgatcaacccggccacgggggagccgttctgcacggttccccgcgcctccgctgcccaggccgacgccgccattgcggcggcgaaggcggcagtgcccggctggtctgccgtgccgtgggccggacggcaggccaagctcatcgaacttgccgacgcaattgccgcccgcaaggacgagatcgcgcgcgtgctgacgatggagcagggcaagccgctggccgaagccttgggcgaactcgcctggacggacggatacctgcgccactacgccaccctggaattgccggaccgggtgatccaggatgacgaaagtggctacatagcggtcaggcatcggccgctcggggttgtcgtgggcatcatcgcctggaacttccccttgctcgtcgcctgctggaagatcgggcctgcggtgctcgccggcaacgccatcgtcctcaagcccgcgccgaccacgccggtttgcgcactgatcctgggcgagatctgccgcgacgtgttcccggcgggcgtcgtcaacatcatcaccgacgccaacgatctcggcccgcacctgacggctcatccggatgtcgcgaaggtgggcttcaccggttcgaccgccacgggcaagcgcattgccgcaagcggcgccgacacgctgaagcgcgtgacgctggagctcggcggcaacgatcccgccatcgtgctcgaagacgtcgacgtgcgcgaaaccgcgcaggcgatcttcggcaatgccttcctcaacaacggtcaggtctgcctcgcggtcaagcgggcctatgtccactccgacatctacgacgcgatgtgcggcgaactggcgcggctggcgcaagcggccgtcgtcgacgacggcttgcagcagggcacccagatcggcccgatccagaacgccatgcagttcgagaaggtcaagggcttcctcgatgccgcgcgcgaggaagggaccatcgtggcaggtggcgaggtcatggaacgcgccggctacttcattcgcccgaccatcgtgcgcgacgtgaccgacggcgaccgcatcgtcgacgaggaacagttcggaccgatcctgccgctgatccgtttcgacgatgtcgaggacgtcatcgcccgcgccaacgcctcggactacgggcttggcggttcggtctggtcgaaggacgtcgcccgcgcggccgatatcgcctcgcgcatcgaaagcggtcaggtctgggtcaaccagcacatcgccatcggcccgcacatcccgatggccggcttcaagagcagcggtctgggcgtcgagcagtcggtcgagggcctt

SEQ ID NO: 34498 - DNA, 1557 bp, Sphingomonas aromaticivorans
cttcttgaaaagaccatcggccaggcactgcgcgatgcggcggcgctctggggcgacgagcttgccctggtatcgcgccaccagcagatccgctggacctgggcccagctcgacgcagaggtcgatcgtatcgccacgggcctgctcgacaggggcgtggccaagggcgaccgtgtcggcatatgggcgccgaactgcgcggaatggaccgtcctccagttcgcgaccgcgcggatcggtgcgatcctcgttaccatcaatcccgcctatcgcaccagcgaggtcgagtacgcgctgaacaaggtcggctgcaccttccttgtcaccgccgcgcgcttcaagaccagcgactatgtggcgatgctgcgcgaactggggccggacaagctgccgggcgtaagctgcatggtcgtgctcggcgcggatcgccacgacggcttcgagccatgggaggccctgcgtgccgaaccggacgccgcacgccttgccgccgccgaggctgcgctgaaccagaacgatgcgatcaacatccagttcaccagcggcaccaccggctttcccaagggcgccacgctcacccatcgcaacatcctcaacaacggccatttcaccgcccgcacgatcaagctgacccagcgcgaccgcatctgcatcccggtgccgctctaccactgcttcggcatggtcctgggcaatcttgccgcgctcgccagcggggcggcgatggtctaccccggcgaggcctacgatccgcagcttgcgctcgcggcggtggccgaggagggctgcaccgcgctctatggcgtgccgacgatgttcatcaccatcctcgcgcagccggaccttgaccgctacgacgtatcgaccttgcgcaccggcatcatggccggctcgccttgcccggtcagcacgatgcgccaggtcatggaccgcctcaacatgaccgaggtgaccatcggctatggcatgaccgagaccagtccgctcaccacccagacagcgaccgacgatccgctggaagagcgcgtcggcactgtcggccgtgtccatccccatgccgaggcgaagatcgtcgggctcgatggcgaaacgctgcccatcggccagcagggcgaatactgctcgcgcggatatgccgtcatgctgggttactgggacgatccggaaaagacagcagaagccatcgacggcgagggctggatgcattccggcgatctcgcgacgatggacgaacatggctatgtccgtatcaccggccgcatcaaggacatgatcatccgcggcggtgagaatatctacccgcgtgaaattgaggagtttctcctcacccatcccgccgttcaggatgcgcaggtcttcggcgtttcggacgagaagttcggcgaggaagtctgcgcctgggtcatcgcgcggtccggccacgcgctctcgcacgacgatatcctcgcccactgcaagggccgcatcgcacactacaaggtgccgcgccatgtccgcgtggtcgaagccttcgccatgacagtcaccggcaaggcgcagaagttcgagatgcgcaag

SEQ ID NO: 34499 - DNA, 1392 bp, Sphingomonas aromaticivorans
gcgcggagagcatcgagaatgcaccggatcgaaaccgacagcctgggcgaagtgcgcgtgcccgcagatgcctattggggcgcccagacgcagcgaagcatcgagaactttccgttcggcgagatggagcggatgccgattggcatcattcgcgcactggcgctggtaaaacgggcagcggcgggggtgaaccgggcacacgggctagacccgacgctggccgacgccatcgaacgggccgccgccgaagtggtcgacggcaagctggacgaccagttcccgctggtcatctggcagaccggcagcggcacccagtccaacatgaacgccaacgaagtcatcgcagggcgcgccaacgagatccttaccggcaagcgcggaggcaagagcccggtccatcccaatgaccacgtaaacatgggccagtcctcgaacgacaccttccctaccgcgctgcacgtcgcggccgtcgaggcgctgaaccgagacctgctgcccgcgctgggacggctgcggggcgcgctggcgggcgcggcgctcgcgtggaaggatatcgtcaagatcgggcgaacccacttgcaggatgcgaccccgctgacactggggcaggagttttccggctatgccgagcagttgcgcggcatcgaagcgcacctgaaggccgccgagacgcaccttctgcgactggcgcaaggcgggactgcggtggggaccgggctcaatgcgccggaaggctttggcgacgccatggcggcagaaatcgccgcattgaccggcaggcccttcgtttccgcgccgaacaagttcgaagcgctcgccagcaacgacgctcttgtccagttttcggggacgctttcgacgctggcggtggcgctgaccaagattgccaacgacatccgcctgctgggttccggcccgcgctcaggccttggcgagctggaattgccggccaacgaaccgggcagttcgatcatgcccggcaaggtcaacccgacgcaggccgaaatgctcacgatggtggcggcgcaggtgatcggcaatcatcaggccgtgaccgtgggagggatgcaggggcatctggaactcaacgtgttcaagccgatgatcggcgccgccgtgctgcgatcggtccacctgctgtcgaccggcatgacaagctttgccacccgctgcgtcgaagggatcgagccgaaccggcggcggatcgcggaccttgtcgaacgctcgctcatgcttgtgaccgcgctggcgccggagatcgggtacgacaacgcggcgaagatcgccaagcacgcgcacgagcatgacctgagcctgcgacaggcggcgctggcgctgggactggttgacgaggcgacgttcgaccggcttatccgaccgggggacatggtc

SEQ ID NO: 34500 - DNA, 1134 bp, Sphingomonas aromaticivorans
gcgctggaaatcgcggatcgggtagagcgtttcgttcgcgaggaagtgatcccctatgaaagcgatccgcgccgcgacgaccatggcgcgccgctggacgaaatggtcatggaaatgcgcgggaaggctcgcgcggccggggtcctgacgccgcatatcctttccgatggccgtcacctcaaccagcgcgagacggcggtcgtcctcatccgctcgggcctttcgccgctgggcatgctggcctgcaacacccaggcgcctgacgaagggaacatgtaccttctgggcaaggtcggcagccccgagctgaaggagcgcttcctcaagccgctggtttcgggcgaagcgcgttcggctttcttcatgaccgagcctgccgaggatggcggcgcgggctccgatccgtcgatgatgcagaccacttgccgccgtgacggcaaccactgggtcatcaacgggcgcaaggccttcatcaccggcgccaagggcgcgaaggtgggcatcgtcatggccaaggacgaggacggcggcgcctgcatgttcctggtcgacctgcccgatccggcaatcgagatcgtgcgggtgcccaacaccatcgacagcagcatgccgggcggccacgccgtgatcgacatcaagaacctgcgcgtgtcctccgaccagatgctgggcgagccgggcgaggggttcaagtatgcgcaggtccgtctgtcgccggcgcgcctttcgcactgcatgcgctggctgggcggctgcatgcgcgctcaggagatcgcgaccgactatgcctgcaagcgcatggcctttggcaagcacctgatcgaccacgagggcgtgggcttcatgctggcggagaaccgtatcgacctgaagcaggccgaactgatgatcgattggtgtgcgggcgtgctcgacaccggatcgctgggcaccgtggaaagctcgatggcgaaggtcgcggtttcggaagcgctgatgcgcgtggccgacaagtgcgtgcaggtcatgggcggaacgggcgtcacgaccgataccatcgtcgagcagatgttccgcgaagtgcgtgcgttccgcatctatgacggcccgaccgaggtccacaagtggagccttgcaaagaagatccgtcgcgaa

SEQ ID NO: 34501 - DNA, 1419 bp, Sphingomonas aromaticivorans
gtcgccacgggatcgggggctgtaaagggcgtgaccgccggaaccgtcagcgcattcaagggcatcccctatgccgcgccgccggtgggcgagaaccgctggcgcgcgccgcagccggtcgccacatggatcggtgagcgggacgcttcccgctatggctccgactgcgcccaggccccgttcccgccagacgccgccccgatcaccacgacgccctcggaggattgcctctatctcaacgtatggaagcccgcgtccgccaaggcgggagcgaagctgccggtcatggtctggatccacggcggcggtttcgtgaacggaggttcctcgcccgcatcctattcgggcgagaacttcgcgcgcgacggcgtcgttctcgtcagcctgaactaccgcctcggccgcttcggcttctttgcccacccgggcctggcggcagaaggcttcggcggcaacttcggcttcctcgaccagatcgcggcgctgaaatgggtccaggccaacgtcgccgcgttcggcggcgatccggccaacgtcaccgtcttcggcgaaagcgcgggcggcatgtcgatgcacatgctgctccagtccccgattgcccgcgggctgttccacaaggcgatcgtcgaaagcggtggtggccgcgaccgcgcgctgcccatgccgaccatcgccgtcgctgccaaggctggcgaagcattcgcccccggactcgacgccgctggcctgcgcgcccttccggcggaaaaggtcactggcgacctgtcgatgatgaccatgggcaagcccgactattccggtccgatggtcgatggccgcaccatccttggctccagcgtcgatggcatcgcgggcggcctctatgcccgggtcccggtcatggtcggcgccaattccgccgacggcttccccttcgtcaccgacaaggacaagatcttcgcgacctatggcgacaaggccgacgaggcgcgcaagctctatgatcccgagggcaagctcacgggcctcgtcgtcggcaccatgaccagcgcagaccgcacattcatcgagcctgcgcgcgccgtcgcccgtgcactcgccgcacgcggccagcccgcctacctctatcgcttcgcctatgcccatccggatatgcaggcggcgatgggcggtgccccgcatgcgagcgagataccttacgtcttcgacacggtcgccacgcgcacgcagtggaagatggtgcccgccgaacctgccgtcgccacggtcacgcacaagctctggatcgagttcgcccgcaccggcaagcccggagcaagctggcctgcggcaacagtcgacgacactcgcgtcatgctcatcgacgcgaagggcgcggcccatgtcgaagacccgtatcgcgcgcggctcgatttcgtcgaggcgctcgtcacccagggc

SEQ ID NO: 34502 - DNA, 771 bp, Sphingomonas aromaticivorans
agggttcagggcaagaaggcactcgtcaccggggcggcgcaaggcctcggcgcggcacacgcatggatgctggcgcgcgaaggcgccagggtgctgctcaccgacatcaacggcgaaggcgcaacggcaacggctgcggcaatcaacgccgaactgggggcaggcacggctttcgccatgcgccatgacgtgaccagcgcggacgattgggacgcggcaatcgcgttcgccgccgagaagctcggcgggctttcggtcctggtcaacaacgcgggcgtcggcgtgcgcggcaatatcgagacctgcacgctggaagaatggcaccggggctttgccatcaacgtcgacagcgtgttcctgggttgccagaaggcgctgccgctgctgcgcgacagccagcccgcctcgatcgtcaacatcagctcgatcgcgggtctcatcgcctcggacacgatgcccggctacaacgccagcaaggcggcggtgtggatgctgaccaagtcggtcgcgctgtactgcgccaagcgcggctgggacatccgctgcaactcggtccacccgacgttcgtcgacaccccgatcctcgacggcatcagcgcgaacgccaatctggaaaagtcggtggtcatgggcaagctcgcccgccagatcccgctgggccgcgtgggcgaacccgacgacattgcggcgggcgtgctctacctcgccagcgacgaaagccgcttcatgaccggcgcggagctgaagctggatggcggcatctcggcgatg

SEQ ID NO: 34503 - DNA, 1104 bp, Sphingomonas aromaticivorans
atgaagacccgcgccgcagttgcgttcgcgcccaagcagccgctcgagatcgtcgaactggacctcgaaggccccaaggctggcgaagtgctggtcgagatcatggcgaccggcgtgtgccacaccgatgcctacacgctcgacgggttcgacagcgaaggcatcttccccagcgtgctgggccacgaaggcgccggtatcgtgcgcgaggtgggccctggggtcacttcggtgaagcccggcgatcacgtgatcccgctctacacgccggaatgccgccagtgcaaatcgtgcctctcgggcaagaccaacctgtgcaccgcgatccgcgccacgcaagggcagggcctgatgcccgacggcaccagccgcttttcgtacaagggccagaccgtgttccactacatgggctgctcgaccttctctaacttcaccgtcctgcccgagatcgcggttgccaagatccgcgaggacgcgccgttcaagacctcgtgctatatcggctgcggcgtgacgacgggcgtcggcgcggtgatcaacaccgccaaggtccaggtcggtgacaacgtcgtggtcttcggcctcggcggcatcggcctcaacgtgatccagggcgcgcggcttgccggtgccggcaagatcatcggcgtcgacatcaaccccgaccgcgaggaatggggccgcaagttcggcatgaccgacttcctcaacagcaagggcatgagccgcgaggacgtcgtcgccaaggtcgtcgccatgaccgacggcggcgcggactacaccttcgacgccaccggcaacaccgaagtgatgcgcacggcgcttgaagcctgccatcgcggctggggcacctccatcatcatcggcgtggccgaggcgggcaaggaaatcagcacgcgtccgttccagctcgtcaccggccgcaactggcgcggcacggccttcggcggcgccaagggccgcaccgacgtgcccaagatcgtcgacatgtacatgaccggcaagatcgagatcgacccgatgatcacccatgtcatgggcctggaagagatcaacaccgccttcgacctgatgcacgccggcaagtcgatccgttcagtcgtg

SEQ ID NO: 34504 - DNA, 1128 bp, Sphingomonas aromaticivorans
ccgatcaatcgcgtcggcgtgatcggcgccggcacgatgggcggcggcatcaccatgaacttcctgaccgcagggattccggtgacgatcgtggaaatgacgcaggaagcgctcgaccgcggcgtcgccacgatggcccggaactacgagaacaccgtcaagcgcgggaagatggacgccgccgacgcacaggccgcgatggcgcgcctgacgccgacgctcgacttcggtgccctggccgaagcggacctcgtgatcgaggcggtctatgaaagcatggacgtgaagaaggacgtgttcggacgcctcgacaaggtggccaagccgggtgcgatcctcgcgtcgaacaccagctatctcgacatcgacgagatcgcgagcgtgacgagccggcccgaagcggtgatgggcatgcacttcttctcgcccgccaacgtgatgaagctgctggaagtggtgcgcggcaaggcaaccgggaaggcgcaactggccacggtgatggcgctgtcggtgaagatcggcaaggtgccggtcgtgtcgggcgtctgccacggcttcatcggcaaccgcatgctttcgccccgtcaggcgcaggcgcaggcgctgatcatggaaggcgcgaattactgggacgtggacgaggcgctgctggaattcggtttcccgatgggaccgtggcagatggccgacctcgccggcgtggacatcggctggcaccgcgatcccagccgcatcgaaaccctgcgcgatgcactgtgcgcggtcggtcgctgggggcagaagaccaagaagggcttctacgactatgacgacaaccgccagcgcacgccttcggacgaggtgaaggcgatcatcgccgacttcgcgaagaaggccggcaagccgcagcgcgagatcggcaaggacgagatccgcgagcgcctgctctatccgatgatcagcgaaggcgcgctgatcctggaggaaggcatttcgcagcgggcaagcgacatcgatacggtctggctcaacggctatggctggccggcgtggaccggcgggccgatgttctgggccgatcatatcggactggataccgtggttgcgggcctgaagaagcacgggctgccggtggcacctctgctggag

SEQ ID NO: 34505 - DNA, 1464 bp, Sphingomonas aromaticivorans
gccgcaaggcggggcgcggcagtggcgctggcggacgagaaccgcactgtcggctgggcggaaatggatgccctgctcgaccgcatcgccgtggccctccagcgcgagggcgtggaaaaggatgagccggtcgccatagcggcaatgaactcggtgacgacggggctggccttccttggggcgatccgtgccggggcggttgcggcacccctcacctccactgcggcgcccgacaccatcgtggccatgctggaggacagcggcagccgggtgctgctgctcgacaaggacattgccgagcggcttgaagggctggacctgccggccggcgtgaagcgcatcgcgctggatgacagcgacgcgggcgagccgttcagctcgtggatggcggaagaaggtgcgaagcccgaggagcgcgccgtggcgccgggcgatccgttcaacatcatctattcgtcgggcaccaccggcgcgcccaagggcatcgtgcagagccacaagatgcgccacgaatacgcgcggcgcacgatcgtggcgggttacgacgacgatacggcggcgatctgttcgacgccgctctattccaacaccacgctggtcagcttccttccggcgctcaccgccggcggcaaggtggtgctgatgcgcaagttcgacgcgcgcacgttcctggaactgtccgagcgcgagcgggtgaccaacgccatgctggtgccggtgcagtaccgccgcatcatggaactgcccgacttcgacagcttcgacctttcgtcctaccggctgaagtcctgcacgtccgcgcccttcccggcttggctgaaggccgatgtgctgaagcgctggccgggcgggctgaccgatggctatggcatgaccgaaggcggggcgacgacgatcctgctggcgcacaagttcccggacaagctgcacaccgtgggccaggtcgcacccgggcacgtgatgaagatcatcgacgaggacgggaacgagttgccgcagggcgaagtcggcgagatcgtcggccattcgccgatcatgatgaacggctaccacggcaagcccgacaagacccgcgagatcgagtggcatgacagcgaaggccgtcgctacatccgccacggcgacatcggcaagttcgacgaggacggcttcctgatcctcatggaccgcgccaaggacatgatcatctcgggcgggttcaacatctacccgagcgatctggaagccgaactcacccggcaaggcgcggtgaaggaagcggccgtggtcggcgtgcccagcgatgcctggggcgaaaccccgcttgcggtggtggtgctggccgatccggccgccgatccggcggcgatccttgccgaggcgaacagccggctgggcaagacgcagcgcatctcggccatcgaagtgatcgacgaactgccccgcagccccatcggcaaggtgctcaagcgcgaactgcgcgac

SEQ ID NO: 34506 - DNA, 1170 bp, Sphingomonas aromaticivorans
atgcgtgacgccgtaatcgtatccgccgctcgcacgcctatcgggcgcgcctacaagggcgccttcaatgccactcccggcgcgacgctgggcgcgctttcgctggaagccgccgtggcgcgggcggggatcgaccctgccgaggtcgacgacgtgctgtggggcgcggcgctccagcagggcgcccaggccggcaacatcgcgcgccaggtggcgctgcgcgcaggcctgccgatcaccacttcgggcatgagcatggatcgccagtgctcgtcgggtctgatgaccatcgccaccgcttcgaagcaggtgatcatcgaccgcatggacgtggttgccgccggcggccaggaatcgatcagcctcgtccagaccaaggacatgcgcgtcgccccggacaagagcctgatggcgatgcacaaggcgatctacatgccgatgctgcagaccgcagagatcgtcggccagcgctatggcatcagccgcgaggcctgcgacgaatatgccctgcaatcgcagcagcgcaccgccgccgcgcaggccgcgggcaagttcgatgacgagatcgtcgccgtggacacgacgatgggcgtccagaacaaggaaaccggcgaagtcaccttccaggacgttcacctgaccaaggacgaaggtaatcgtccctcgaccacgatcgagaacctccaggcgctgaagccggtgatcgagggcggcatcgtgacggcgggcaacgccagccagctatcggacggttccgcggcggtcgtcgtgatggaagcggcgctggcggcaaagaagggcctggccccgctcggacgctatgtcggcatggccgttgccgggaccgagcccgacgagatgggcatcggcccggtcttcgcgatccccaagctgctccagcgcttcgggctgaagatggacgacatcggcctgtgggagctgaacgaagccttcgcggtgcaggtgctttactgccgcgacaagctgggcatccccaatgacctgctcaacgtcaacggcggctcgatctcgatcggccacccttatggcatgaccggcgcgcgctgcaccggccacgcgctgatcgaaggcaagcgtcgcggcgcgaagtacgtggtggtcaccatgtgcgtcggcggcggcatgggcgcggcgggacttttcgaagtc

SEQ ID NO: 34507 - DNA, 1121 bp, Sphingomonas aromaticivorans
ttcgcgctgaccgaagaccagatcgccatccaggacatggcgcggcgcttcaccgccgacgccatcacgcctttcgcggcacagtgggacgaggaccacaccttcccgcgcgacacgatcaaggcggcggcggaactgggcttcgcggcgatctatgtcagcgaggaatccggcgggatcggccttggccgtctcgaggccgcgctcatcatggaagccatggcctatggctgcccggcgaccagtgccttcatctcgatccacaacatggccgcttggatgatcgacaagttcggcggcgacgagatcaagagccgttacctgcccagtctcgtcaccatggaccagatcgcaagctattgcctgaccgagccgggttcgggctccgacgcggcggcgctcaagaccaccggcttcggctggaaggtgaccactacgtcgtcaacggcaccaagcagttcatttcgggcggcggggtcaacgatctctacgtcaccatggtccgcaccggcgataatggtgcgaaaggcatttcctgcctggtgatcgagaaggacatgccgggcgtcagcttcggcgcgccggagcgcaagctgggctggaatgcctcgcccaccgcgcaggtcatctttgacaacgtcaaggtgcctgtcgccaaccgcgtcggcgccgagggcgacggcttcaagttcgcgatggccggtctcgacggcggccgcctcaacatcggcgcctgctcgctcggcggtgcgcagcgctgccttgacgaggccgtggcctacgtcaaggaccgcagccagttcggcaaggccatcgccgagttccagaacacccagttccagctcgccgacatggcgaccgatctcgaagcctcgcgcgcgctgctctacctcgcggcggccaaggtcaccgcaaacgcaccggacaagacccgcttctcggccatggccaagaagctcgccaccgacaacggctcctcgatcgtcgatcgcgcactgcagatgttcggcggctacggctacctgcgcgattacccgatcgagcgcttctggcgcgaccttcgcgtccaccgcatcctcgaaggcacgaacgaagtcatgcgcatgatcgtgggaagggac

SEQ ID NO: 34508 - DNA, 1486 bp, Sphingomonas aromaticivorans
attgaccatttcatcgtcggcggccccggtggcgcgcctgcccgcaagagcccgatcttcgatcccaacaatggcggcgtgcaggccgaagtcgcgctcggcaccgcagagacgctcgagcgcgcggtgcaggccgcgctgaaggcgcagccggcatgggccgcgaccaatccgcagcgccgcgcccgcgtgatgttccgcttcaaggaactggtcgaggccaacatggacagcctcgcccacatgctctcgtccgagcacggcaaggtcatcgcagactccaggggggacatccagcgcggcctcgaggtcgtcgagttcgcctgcggcatcccgcacgtcctcaagggcgaatatactcacggcgcggggccgggcatcgacgtctattcgacccgccagcccatcggcatcggagccggcatcacgccgttcaacttccccggcatgatcccgctgtggatgagcgcgattgccatcgccaccggcaacgccttcatcatcaagccgtccgagcgcgatccttcggtgccggtgcgcctcgctgagctgttcatcgaagcaggtcttcccgaaggcatctgccaggtcgtccacggcgacaaggaaatggtcgacgcgatcctcgatcacccggcgatcggcgccatcagcttcgttggatcgtcggacatcgcgcactacgtgtacaatcgcggcgttgccgccggaaagcgcgtgcaggcgatgggcggggccaagaaccacggcgtggtcatgcccgatgccgatctcgaccaggtcgtgaacgacctgtgcggcgccgctttcggctctgccggcgaacgctgcatggcactgccagtggtcgtgcccgtcggccatgacaccgccgagcgcctgcgcgccaagctgatcccggcgatccacgcgctcaaggtcggcatctcgaccgatcccgaggcgcactacggtccggtggtgacccaggcgcacaaggaaaaggtcgaaggctggatcgacaagtgcatcgaggaaggcggcgaactcgtcgtcgacggtcgcggcttcaccctgcagggggcacgagaacggcttcttcgtcggcccgacgctgatcgaccatgtcacgcccgacatggacagctaccacaacgagatcttcggcccggtgctgcagatcgtgcgcgccgagaacttcgagcaggcgctcgaactgccgagcaagcaccagtacggaaacggcgtcgccatcttcacccgcaacggccacgccgcgcgtgaatttgccgcccgcgtcaacgtcggcatggttggcatcaacgtgccgatcccggtgcctgtggcctaccacaccttcggcgggtggaagcgttcggcgttcggtgacaccaaccagcacggcatggaaggcgtgaagttctggaccaaggtcaagaccgtcacgcagcgctggccggatggctcgcccgacggcggcaacgccttcgtcatcccgacgatgggc

SEQ ID NO: 34509 - DNA, 1473 bp, Sphingomonas aromaticivorans
ggagaccgggtcgcgctcgtggcagagacgggccccgatttcgcggccatcttctgcggtgcgatgtatgccggcgcatggccggtcccgctcccgctgccgaccagcttcggcggcaaggagagctacatcgaccagctcgcggtccagctttccagttcagacccgaagatgctcgtctaccccggcgaaatcgccgagatggccagtgccgcagccgcacgccagggttgcgcgggcctgtcgtgggatgaattccacgccggcgcagccgccgatggcccgctgcccacgcccgatccggacgcgatcagctatctccagtattcgagcgggtcgacccgcttcccgcatggcgtcgccgtcactcaccgcgcgctcatggcgaacctcgccggccattcgcatggcatgaagatcgcggaccccgatcgcgcgatctcgtggctgccctggtatcacgacatggggctcgtcggctgcttcctctcgccgatcgccaatggcgtgtcggtcgattacctcaagaccgaggacttcgcccgccgcccgctcgcctggctcgacctgatcagccgcaacaccggcacgacactctcctattcgcccaccttcggctacgacatctgcgcccgccgcatctcgagccagagccacgtttccgaccgcttcgacctttcgcgctggcgcgtcgccggcaacggggccgacatgatccgccccgacgtgatgcagaacttcgtcaacgcctttgccgaggccgggttcaaggccgaagccttcctgcccagctacggacttgccgaagcgacgcttgccgtcaccatcatgcccccgggcgaaggcatccgcgtcgaactggtcgaggaagaacgcctctcgggcaccccgcgcgacctttcgcgcccggcccgctaccgcgccatggtcaactgcggcgttcccgtgcgcggcatggaagtcgccattcgtggcgagaacggcaacgagatcggccaccaccacatcggcaaggtgtggtgccgcggctcatcggtcatgcactcctacttccgcgatcccgaagcgaccgacgcctgcatggtcgacggctggctcgacaccggcgacatgggctacgtcgacgagaacggctacctgttcatcgtcggccgcgccaaggacatgatcatcatcaacggcaagaaccactggccccaggacatcgaatgggcggtggagcagcttcccggcttccaccagggcgatatcgccgccttctcggtcgagaccgagaacggcgaggaggcgcctgccgtcctcgtccattgccgcgtctccgacccggtcgaacgggtcaagctgcgcgaccagatccgcgacaaggttcgctcgatcaccggcatgaactgcgtcgtggaactcgtgccgccgcgcaccctgccgcgcaccagctcgggcaagctgagccgggccaaggccaagaagctctac

SEQ ID NO: 34510 - DNA, 1311 bp, Sphingomonas aromaticivorans
cagaccgcagaggccatccgcgcccagcacggcggcagcgaatcgcacttccccaccgtccttcccgatgccgtcgtcttcgtccgtgacacgaaggatgtggtcgactgcgtggacctctgccgcgagggcggcgtcgcgctcgtgcccttcggagccggcacttcgctcgaaggccacacactcccgctggccggcgggatcagcctcgacctgtcgcgcatggacacggtccttgccgtgaacgaggcggacttcgactgcaccgtccagcccggcatccgccgcgaagcgctcaatgcgcacttgcgcgacacgggcctgttctttcccatcgacccgggcgcgaacgccaccatcggcggcatggcggcgacccgcgcctcgggcaccaacgccgtgcgctatggcacgatgcgcgaggcggttctcgggctcgaggtcgtgacgccgcagggcaaggtggtcaccaccggccgccgcgcccgcaagtccgccgccgggtacgatctgacccgtctctacatcggctcggaaggcacgctcgggatcatcaccgccatcaccctgcgcctccaccccgtccccgaagcggtcatggccgccacgtgcccgttcgccacactggaaggcgcggtcgacacggtcgtgcaggcctttcatgccggggtgccgatggcgcggatcgaactgctcgacgcgatgcaggtccacgccgtgaaccttcgcgcagggctgggcctgcccgaagcgcccacactgttcttcgaatttcacggcagcgagacaggcgttgccgaacaggtggaaatggtccgcacgcttgcgggggccaatggcggcggcgacttccactgggcgacccggaccgaggaccgcacccgcctctggcgcgcacggcacgaggcctactacgccgccgtcggactgcgccccaacgccataggctggaccagcgacgtctgcgtcccgatgagccgccttgcgcagtgcatcctcgaaacgcgcgaggacctcgaccgggcgagcgttccggcaaccatcgtcggccatgtcggcgacggcaatttccacgcgatcttctcgatcgatcccgctgctccgcacgaactcgacgaagtggcagagatcaaccgccgcatggttgcgcgcgcactggccatgggcggcacctgcaccggcgaacacggcatcggcatcggcaagcaggacatgctcgtcgacgaactcggcgaggacgcggtcgacgttatgcgcgccctgaagcgtgccctcgatccgcagaacctgttcaacccgggcaagatcttc

SEQ ID NO: 34511 - DNA, 2016 bp, Sphingomonas aromaticivorans
ttcaagaaaatcctcatcgccaaccgtggtgaaattgcctgccgtgtgatcaagacggcgcgtcggatgggtattcagacggtggcggtctattccgatgccgatgcgcgggcgccgttcgtgcagatggcggacgaggcggtgcatatcgggcctgcgcctgccgcgcagtcgtacctgatcgccgacaagatcatcgctgcgtgcaagcagaccggcgccgaagcggtgcatccgggctatggcttcctgtcggagcgcacctcgtttgccgaggcgctggcggcagagggtatcgagttcatcggcccacctgtcggcgcgattgccgcgatgggcgacaagatcgaatccaagaagctggccaaggaagcgggcgtcaacgtcgtccccggcttcgtcggcgagatcgaggataccgagcatgcggtgcgcatctcggacgagatcggctatccggtgatgatgaaggcttcggccggcggtggcggcaagggcatgcgcctggcctacaacgagaaggacgtgcgcgaaggcttcgaggcggtgaagcgcgaggggctgaattcgttcggcgacgaccgcgtgttcatcgagaagttcattctcaacccgcgccacatcgagatccagatcctcggcgacaagcacggcaacatcctatacctcaacgaacgcgaatgttcgatccagcgccgccaccagaaggtggtggaagaagcgccttcgcctttcgtcaccccgaagatgcgcaaggccatgggcgagcagtgcgtcgcgctggcacgcgcggtgggctactattcggcaggcacggtcgaactgatcgtgtcgggcgcggacccgagcggcgagagcttctacttccttgaaatgaacacccgcctccaggtggagcaccccgtcaccgaggcgattaccggcgtcgacctggtcgagcagatgatccgcgtggcggccggcgagaagcttgccctgacgcaggacgaggtgaagatcgatggctgggccatcgagaaccgcgtctatgccgaggacccctatcgcgggttcctgccctcgacgggccgcctgatccgctacaacccgccggtcgcgggctggaccgacgacggcgccgagaacggacgccgcgggatcgacggcgtgcgcgtggacgacggcgtctatgagggcggcgaagtctcgatgttctacgacccgatgatcgccaagctgatcacctggggcaagacgcgcgacgaggcggcggacaagcagatcgaggcgctcgatgccttcgagatcgaggggctgggccacaacatcgatttcgtcaacgcgatcatgcagcacccgcgcttccgttcgggcgaactgaccaccgggttcatcgctgaggaatatccggaaggctttaccggcgcggcgacttcggacgagctgaagcagacgcttgccgcgctggccgcgttccttgccacggcccgcgcggaccgggcgcggcaggtggacaaccagcttggccacgacctcgatccgccttcggaatggtcggtgaaggtcgggggcagcacctttgccgtggagctgaccgaggaggaaatctccgtcgacggcacgcccgtggacatcgcactggaatacacgccgggcgaccggatggtacattgcgaggtcgacgacaagccgctgtcggtgaaggtcgagaccacgcgcgcaggcttcaggctgacgacgcgcggcgcgatccatgacgtgcaggtcctgccggcgcgcatcgcgcacctgaccaggcacatgatcgagaaggtgccgccggatctttcgaagttcctgatctgcccgatgcccggcctgctcgtctcgctgaacgtgggcgagggtgacacggtcgaggccggtcaaccgctcgccgtggtcgaggcgatgaagatggagaacatcctgcgcgccgagaaggcgggcaaggtgaagtcggtcaatgccaaggcgggcgacagcctggcagtggacgccatcattctcgagatggag

SEQ ID NO: 34512 - DNA, 1278 bp, Sphingomonas aromaticivorans
gatgttatgacgcagaagcttgagacgctgacggtccacgccgggtgcgagcccgatccgaccaccaaggcgcggatcacgccgatctaccagacggcaagctacgtgttcgacagtgccgagcacgccgcgaacctctttgcgctggccgagttcggcaacatctactcccgcatcatgaaccccaccaacgccgcgctggaagcaaagatcgcggcgctggaaggcggtgtggcggcgttgggcgtggcatctggccatgccgcgcagttcatcgtgttccacaccctgatggagccgggctgcgagatcgtggcggccaagaagctctatggcggcacgctcaaccagttcgcgcatggctttgccaagttcggctggaaggctgtcttcgtcgatgccgacgatccggccgcggttgccgcagcgatcaccgacaagacgcgcggcgtgttcatcgaaagcctcgccaaccccggcggcgtggtgcaggacatcgccgcgattgccgaggttgcgcatgccgccggtgtgccgctgatcgtcgacaacacgatggccagcccggcgctgtgccgcccgatcgaacatggcgcggacatcgtcgtccattcgtgcaccaagttcctcaatgggcatggcaattccatcggtggcctgatcgtggacgcgggcaggttcgactgggcggcgagtgacaagttcccctcgctgtcgcagcccaacccgagctatcacggcgcggtgctgaccgaggcgctgaagcctgtcgggccgatcgcgttcatcatcggctgccgcgtgctggggctgcgcgatcttggccccgcgatggcgccaatgaacgcattcctgacgctgacaggcatggaaacgctggcgctgcggatcgagcgccactgcgccaacgcgctgcacctggcgcagtggttgcagaaccatccgaaggttgcctgggtaagctatgcgggcctgcccgaagatccgtatcaccagttggcgaagcagtacctcggcggcaagggcggcgcggtgttcaccttcggcgtgaagggcggttacgaggcgggcgtgaagcttgtccagtcggtcaagctgttcagccacctcgccaacatcggtgacacccgctcgctgatcatccaccctgcctcgaccacccacagccagctcggcgaggaagaactggtagcggcaggcgccgggccggacacggtgcgcgtctcggtcggcatcgagcacatcgacgacatcgtcgccgacctcgcgcaggcgctg

SEQ ID NO: 34513 - DNA, 1170 bp, Sphingomonas aromaticivorans
gacatctacatcgtctcgggcgcgcgtaccgccatcggctcgttcggcggcgggctcgcttcgctgcgtccggcagagagcggcgccatcgtgatcaaggaagccatcgcccgcgccgggatcgcgccggacaaggtgcagaacgtggtgatcggcacggtggtgccgacccagcccaaggacgcctacgtcagccgcgtggccgcggtgaatgccggcattccgatcgaagcccccgcgatgaacgtgaaccgcctgtgcggttcgggcctgcaggcgatcgtctcggccgcacagggcattgcccttggcgagcaggacatcgccatcggcggcggcgcggaaagcatgtcgaacgcgccgcacatggtgctgaccgcgcgcaacggccagaagatgggcgaccaggtgctgatggacgccatgctcggcgcgctgcacgatccgttcgaaggtatccacatgggcgtgaccgcggagaacgtggccgagcgctgccagatcacgcgcgaggagcaggactcgctggcggttgagagccacaagcgcgcggcagcggccatcgcggctggctacttcaaggagcagatcgtcccggtcgagatcaagacgcgcaagggcgttgtcgtgttcgacaccgacgagcacgtccgcgccgatgcctcggtcgaggcgatggcggggctgaagccggtgttcaagaaggacggcacggtcacggccggcaacgccagcggcatcaacgacggcgcggccgccgtggtgctggcgagcggcaaggcggttgaagagcacggcctgaagccgatggccaggatcctcggctggggtcacgcgggcgtcgagccgaacgtgatgggtctcggcccggtcaaggccgtgccggtggcgctgcagcgcgcagggcttgacctcgaccagatcgacgtgatcgaggccaacgaggccttcgccgcgcaggcttgcggcgtcgccaaggaactgggcttcgaccccgccaagaccaaccccaacggctcgggcatttcgctgggtcatcccatcggtgcgaccggcgcgatcctgacgatcaagacgatgtacgagctgcaccgcaccggcgggcgctatggcctgatcaccatgtgcatcggcggtggccagggcatcgccatggtcatcgagagggtc

SEQ ID NO: 34514 - DNA, 1209 bp, Sphingomonas aromaticivorans
gtcgctgccgccacgccccgcagcccagaggcggttgccgccgccgccctgaaaagcgcaccggtgttcgacgggcacaacgacgtgccggagcagttgcgcgaccggcgcaaggacgtgcttgaaggcttcgatttccgcgacacccgcgcgacgggcgatgcggcaacggggacgccgccgatgatgaccgacatagcccggatgcgtgcgggacgggtcggggcgcagttctggtcggtctacgtctcggccaacttgcccgaggcgcaggcagtgcaggcgacgctcgagcagatcgacgttacccggcggctgatcgcgcagtatccggcggacatgcagttctgcactgacagccggtgcgtggacgaggcgtggaagcgcggccggatcgcgtcgttgatcggcatggaaggggggcattcgattggcggatcgctgggcgtgctgcggcagatgcacgcgcttggcgcgcgctacatgacgctgacgcatttccggaacacggcctgggccgacagcgccaccgacgcgccccaacatgacgggctgaccccgttcggcgagaaggtggtgcgagagatgcagcggctgggcatcctggtggaccttgcccacgtgagcgaggcgacaatgcgcgacgtactggcgctgggtggtcccccgcccatcgtcagtcattccaacgcgcgggccatcaaccaccacgcccgcaacgtctcggacgagacgctgaaggccatcggcgcggcgggcgggatcgtgatggtgaatttctacccgccgtatgtgctcgaagcggcccgccagtggagcgccgcgcgcgatgcggaggtcgcgcggaccaagtcgctcaaccggggcgatccctcggctgagaaggccgcgctggatgcctgggacaaggccaaccccatgccgcgcggcagcgtgcaggatgtggccgatcatgtcgatcatattgcccgactgaccggcacggaccacgtggggctgggcggcgacctcgacggggtggaagccaccattgccggtctcgacgatgccgcgagctatcccgcgctgttcgtggaattggcaaggcggggctggtcgcagggcgatctcgagaagctggccaacggcaacatgatgagggtcctgcgggtggccgaagcctatgccagccagcaccgggccgacgggccgctggaaagtccggtcggc

SEQ ID NO: 34515 - DNA, 1398 bp, Sphingomonas aromaticivorans
atgatcatcgacggcgcccgcgtcagcggcggcggacgtcgcacccacgcggtcgtcaatcccgctaccggagagaccatcggcgaactgccgctggccgaagtcgccgatctcgaccgcgcgctcgaagtcgcggcgaagggcttccgcatctggcgcgacagcacgccgcagcagcgcgcagccgtgctccagggcgcggcccgcctgatgctggaacggcaggaggacctcgcccgcatcgccacgatggaagaaggcaagaccctgcccgaggcgcgcatcgaagtcctgatgaacgtgggcctgttcaacttctacgccggcgaggtattccggctctatggccgcaccctcgtgcgccctgcgggtcagcgcagcacgatcacgcatgaaccggtcgggcccgtggccgcctttgcgccgtggaactttccgctcggcaaccccggccgcaagctcggcgcgcccattgccgccggttgctcggtgatcctcaaggcggcggaagaaacgccggcctccgcgctcggggtgctgcaatgcctgctcgatgcgggcctgcccaaggaagtggcccaggccgtgttcggtgtgcctgacgaggtgagtcgccacctgctcggctcgtccgtcatccgcaagctctcgttcaccggctcgaccgtcatcggcaagcacctcatgcgccttgccgccgacaacatgttgcgcacaacgatggagcttggcggccacggccctgtcctcgtcttcggcgatgccgatatcgacaaggcgctcgataccatggccgcgtccaagtatcgcaacgcgggccaggtctgcgtctcgccaacccgcttcatcgtggaagagagcgtgttcgaacgcttccgcgacggttttgccgagcgcgtcggccggatcaaggtcggcaacggcctcgatcaggatgcgcagatgggccccatggccaacgcccgccgccccgaggcgatggatcgcctgatcggggacgccgtgacccgcggcgcaaggctccacaccgggggcgagcgcgtcggcaacgccggctatttctacgcccccacggtcctgtccgaagtcccgctcgacgcggcgatcatgaacgaggagccgttcggcccggtcgcgctgatcaatcccttcggcggcgaggaagcgatgatcgccgaggccaaccgcctgccctacggcctcgccgcctacgcctggaccgacagcgcggcgcgggccaagcgcctcgcccgcgagatcgagacggggatgctcgggcttaactcgaccatgatcggcggcgcggattcgcccttcggcggggtcaagtggtccggccacggctccgaggacggtcccgaaggcgtcatggcctgccttgtcaccaaggcggtccac

SEQ ID NO: 34516 - DNA, 1407 bp, Sphingomonas aromaticivorans
ttcatcggcggcgaagcagtcgtcgggcgcggtcgcagcttcgaggtcctgcggccctctgacggccagttgcttggcgaattgcgcgcggcggacgagcagcagctttgcgcagcggtggagaatgccgcgatggcgcagaaggccagcgggtggggcgccatggaaccgcgcgggcgaatgaagctgctgcgccgctgggcggacctgatcgaggccgacgccgaaacgctggtgccgctcgaggcggtcggatcgagccgcacgcttgccgaagtccgcgcctgggacctgccctataccgcggaatgcatccgcttcttcgccgagttcgccgacaagcacggcggcgagatcgccgcgaccacgccggacaagctgggcttcacgctgaccgagccatatggcgtgatcggcgccatcgcgccgtggaacctgcctttggtgatggcggcatggaaactggggccggccctggcagcaggaaatgccgtcgtcctcaagccttccgagctgaccccgttctcggtcgtgcgccttgccgaactggcggtcgccgccggcattccggccggggtattcaacgtcgtgcagggcggcgggggcgacatcggcgacgcgctggtgcggcacgaacgcatcgcgaaggtaagcttcaccggctcgacccgtaccgggcaggcgatcatggccgcctgcgccatgaccgggcccaagccctccacgctggaactgggcggaaagagcccgcagatcgtctttgccgacgccgaccttgccaaggcgagcgcgctggtcgcccgcgcgatcacgctcaactccgggcaggtctgcgtggcgggatcgcgcctcctggtccacgagaaggcgcgcgacgaagtggtcgaacgcctgaccaccgcgttcgaagcccatcgtctgggaacaacgtgggacgccgccacgacgatggggcccatcatttcggaaggccagctggcgacgatcgacggcatcgtccagcgcgcccgcgcggccggtgccgaggcggtgaccggcggcgcgcgggccgtgtcgccgcagtcgggcagctattaccagcccactttgcttgccggcatgagcgacgacaacgaggccgtacagggcgagatcttcggaccggtgctgacagtgcaatccttcgccgacgaagacgaggccttcgcgctcgccaatggcacgcgctatggccttgccgccggcgtccacacaacggacatctcccgcgcgctgcgggcggtgcgcgcccttgaggcggggacggtctgggtcaaccgatatggccgctcggatgacttcatcctgccgaccggcggcttcaagcagtccggcgtgggcaaggatcttggccgcgaagcctatctcggatcgtgcaaggtgaagacg

SEQ ID NO: 34517 - DNA, 1392 bp, Sphingomonas aromaticivorans
ctgatcgacggcgcatggatttccggcgatctgcccaaggtcgaagtcctcgatccggcaagcggcgaggtcgtcggcgtggtcccggattgcggcgtagcggagaccgaggccgccattgccgcggccgaggcatcctgggccggctggcgccgccgcacggcgaacgagcgcgccgccctgcttgaagcgtggcacgcgctggtccttgccaacctcgacgatctcgcccgcatcatgacggccgagcaaggcaagcccctggccgaatcccaaggcgaaatccggtacgccgcgaccttcatcaagtggtttgccgaagaggggcgccgcgtcggcggacgcaacattccctcgcccgagcgagatcgccgcatcatcgtgatgaccgagccggtcggtgtgtccgctgcgattaccccgtggaacttcccggcggccatgatcacgcgcaagtgcgcgccggcgctcgctgccggctgcccggttgtcatcaagccctcggaaatgaccccgttcaccgcgcttgcgctggtcgaactggctttgcgcgcgggctttcccaaggggacgatcaacctggtcaccggcatgccgcaggcgattggcgcggccatcaccgccagcccggtcgtgcgcaagctgtccttcaccggttccacccgcgtcggtgcgctgctgatgcggcagagcgcggacacgatcaagcggctcagcctcgaactgggcggcaatgccccgctgatcgtgttcgacgatgccgatctcgacctcgcggtgaaggccgcgatggcctccaagttccgcaacgccggccagacctgcgtctgcgcgaaccgtatcctcgtccatgctcccgtctacgaggagttcgcctcgcgtctcggcgcggccgtctcggcgctcaactcagcaccgggcatggaagcggcttccaccgtgggcccgctgatcaatgcagcggcggtcgagaaggtctcggcccacgtcgaggatgcactggcgaaaggtggcaaggtgctgttctcgggcaagggacgggagggcggcaacttcctgcgcccgctcgtcatcggcaacgccagctcggacatgcgcctcgccagcgaggaaaccttcggcccggtcgccccgctcttccggttcgagaccgaggatgaggcgatcgctctcgccaacgacacgccctacggtctcgccagctatttctacacctcgggcctcgaccgcgccttccgcgtcgccgaagcgctcgaggcgggcatgatcgcgctcaataccggctcgatcgcgatggaaatggccccgttcggcggcatcaagcagtccggcctcggccgcgagggtggccttgccggcatcgaggaataccttgaaaccaaggccttccac

SEQ ID NO: 34518 - DNA, 1056 bp, Sphingomonas aromaticivorans
agctattcgatcgcggtcatccccggggacggcatcggcaaggaagtcatgcccgaaggcatgcgcgtgctggaaaaggccgcatcgatcttcggtttcgagatcgaacagaagtggcacgactttgcgtgctgcgattactacgcgcgccacggcaagatgatgcccgacaactggaaggaagagatcggccgccccgacgcgatcttcttcggcgcggtcggctggccggataccgtgccggatcacgtgtcgctgtggggttcgcttctccagtttcgccgcgagtatgaccagtacgtcaacctgcgccccgtccgcctgatgcccggcgtgccgtgccccctggccgggcgcgagcccggcgacatcgacttctgggtggtgcgcgaaaacaccgagggcgaatattcctcggtcggcggcatcatgtttcccaataccgaccgcgaagtcgtgatccaggaaacggtgatgacccgcatcggcgtcgaccgcgtgctgcgttatgccttcgacctcgcgcagaagcgcgagcgcaagcacctgaccagcgcgaccaagtccaacggcatcgctatcaccatgccctattgggaccagcgcgtcgaagccatcggcgccgagtatcccgacgtcagccacgacaagtaccacatcgacatcctgaccgcgcagttcgtgctgaaccccgaccgcttcgacgtggtcgtcggctccaacctgttcggcgatatcctctccgacctcggcccggcctgcaccgggacgatcggcgttgcaccttcgggcaacatcaatcccgaaggcatccacccctcgctgttcgagccggtccacggttctgcccccgacatcgcgggccagggcatcgccaatcccgtcggccagatctggtcggcggcgatgatgctggaacacctgggcgaggcagaggccgccgctgccatcatgcgcgcggtcgagcaggtcctcgctacgccatcggcccgcactcgcgatctcaagggcgctgcaagcaccgatgcctgcggcaaggccatcgccgaagcgctc

SEQ ID NO: 34519 - DNA, 1356 bp, Sphingomonas aromaticivorans
acgctgaccaaccgctccctcgtggacatcgaccgggatcacctgatccattcggtcacctcgttccgcggccatgaacagcacggcgccatcgtgctcgaatcgggcgatggcatgtggctcaccgacgccgagggcaaccgcatcctcgatgccttcgccgggctctggtgcgtcaacgtcggctacggccaggaatccatcgtcgaggccgccgccgcgcagatgcgcaagctgccctacgccaccggctacttccatttcgccagcgagcccgccatccgcctggccggcgaactcaccgccgccgcgccttcgggtctcgaccacgtgttcttcacccagggtggctccgacgcggtcgacagcgcgatccgctacatcgtccactactggaatgcagccgggaagccttcgaagaagcacttcatcgcgcttgaatggggctaccacggctcgagcagcctcggcgcggggctgaccgcgctcggcaacttccaccgcaacttcgacctgccgcgcccctggcagcaccacatcgcctcgccctatccctatcgccacccgcagggcgatgacgacgcggcggtgatcgcctcgaccgtcgccgcgctcgaggccaaggtcgccgaactcggtgccgacaacgtcgccgccttctgctgcgagccgatccagggttcgggcggcgtgatcgtgcccccacgcggctggctcaaggcgctgcgcgaggcctgcacccgcctcggcatcctgatgctggtggacgaggtcatcaccggcttcggccgcaccggaccgctcttcgcctgcgaggaagaaggcgtgtcgcccgatttcatgaccacggccaagggcctgaccgccgggtacatcccgatgggcgcgatgttcatggcggaccatgtctaccagaccatcgccgatgccgcgcccgccgcacttcccatcggtcacggccagacctattcgggccaccccgtcgccgccgccgtcggccttgaagtcctgcggctttaccgcgagggcgggctgctcgagaacggccgcaagacgggcgagcgctttgcctggcacatggagcggatcagggcgcatcccctggtcggcgacgtgcgctatcgcggcctgcttggcgccatcgaactcacgccggacaaggcgaccaaggcgatcttcgacgcttcgcttgacatcggtggacgcctctcgaagctgacttacgccaacggcgtgatcgtccgctgcttcggcaatgcggtgctcggcttcgcgccggcgttgtgctgcacgctggaagagatggacatgatcttcgagcgcgtcgagcgctcgctcgaccagctgctcgaccag

SEQ ID NO: 34520 - DNA, 1245 bp, Sphingomonas aromaticivorans
cgcgccttcgcacgcctcgtcaaggagcgtcgtgaaagcgatgacaacgtcgcgcgcgatgtccagaccatcgtcgaggacgtccgcctgcgcggggacgaggcccttgccgaatatactgcaaggttcgatggccacgcccccgccgacgatgactggcgcatctcgcccgaggcgtgccgcgaagccttcgacgcgctcaagcccgaccttcgcgccgcgctcgaactcgcggcggaacgcatccgcgaatatcacaaggcccagcttcccggggaccgcgactacaccgacgccaccggcatgcgtctcggcgcgcgctggcggcccgtcgatggcgccggtctctatgtgcccggaggccgcgccgcctatccctcgtcgctgctgatgaacgccatccccgccaaggtcgcgggggtcgagcgtctggtcgtcgtcacccccacgccgaagggcgaggcgaaccccctggtccttgccgccgcgcaccttgccggcgcggacgaagtctggcgcgtcggcggggcgcaggcggttgccgcgctcgcctatggcacgaagcggatcaggccggtcgacgtcatcaccggtccgggcaacgcctgggtggccgaggccaagcgccagctcttcggcgtcgtgggcatcgacatggtcgccgggccttcggaaatcctcgtcatcgccgatgcgaagaacgatccgcaatggattgccgccgacctcctcagccaggccgagcacgatcccgtcgcgcagtcgatcctcatcacggacgacgccgcattcgccgatcaggtggccgacatggtcggagtcgagatcgccatgctgcccacggcaaaggtcgccaaggcaagctgggacgcgcatggcgtgatcatcgtggtggactcgctcgacgaagcgcccgcgctcgccaatgcgctcgccgccgaacacgtcgagatcgccaccgacgatccccaggccctgttcgaccgcatccgccacgccggatcggtcttcctcggtcgcatgacccccgaagccgttggcgattacgttgcgggaccgaaccacgtcctgccgaccggtcgccgcgcgcgcttttcttcgggcctctccgttctggatttcatgaaacgcaccagcttcatcgcggccactgacgccgcgctcgccgccgtcggccccgcagccgtggcccttgccgaggcagaaggccttgccgcccacgcccgctccatcgaactgaggctc

SEQ ID NO: 34521 - DNA, 648 bp, Sphingomonas aromaticivorans
ctcgttttcgccctgccgaagggccgcatcctcgacgaggccctgcctctgctcgagaaggccgggatcgtgcccgaggccgagttcttcgacaagtcctcgcgcgcgctgtcctttgccaccaaccggcccgacgtgaagatcatccgcgtccgcgccttcgacgtggcgaccttcgtggcgcacggcgcggcccatgcgggcatcgtcggctccgacgtgatcgacgagttcgattacgccgacctctacgcccccgtcgatctcgacatcggccactgccgtctctcggtggcggaacccgtcagcatggtcgaaagcggcgccaatgcgcgcgaaagccacgcccgcgtcgccaccaagtatcccaacctcacccgccgccacttcgaaaagctgggcgtgcaggcagaggtggtgaagctgaacggcgcgatggagctggctccttcgctcggcctcgccagccgcatcgtcgatctcgtctccaccggccgcacgctcaaggagaacggccttgtcgagacgagccgcatcctgcccgtctcggcgcgcctgatcgtcaaccgcgccgccctgaagaccgacagcgcccgcctcggcgcgctggtcgatgccttccgcgcgatggtcgctgcaaaggacgcc

SEQ ID NO: 34522 - DNA, 2139 bp, Sphingomonas aromaticivorans
cccgccgcaaccgcgcctgccacccccatgtcgaacagggactggtggcccaatcgcctcgacctttcgccgcttcgccagcacggcgttgaatcgaacccgatgggcggcaagttcaactatgccgaggaattcaagactctcgacctcgccgcggtgaagaaggacatcgaggcgctgatgacgacctcgcaggactggtggccggccgactacggccactacggtccgttcttcatccggatggcatggcacagcgccggcacctatcgcaccgccgacgggcgcggcggtgccggcggcggccagcagcgcttcgaaccgctcaactcctggcccgacaacgtcaacctcgacaaggcccgccgtctgctctggccgatcaagcagaagtacggtcgcaagatctcgtgggcggacctcatggtgttgactggcaacgtcgcgctcgaatcgatgggcttcaagaccttcgggttcgcgggtggccgcgccgacgactgggaggccgatcaggtcttctgggggccagagaacaagtggctggccgaccagcgctaccacggcgaccggaagctccagaacccgctcgcagcggtgcaaatgggcctcatctacgtcaatccggaaggcccgaacggcaatcccgacccgctgctcgcggcaaaggacatccgcgagacgttcggccgcatggccatgaacgacgaagagaccgtcgccctgatcgccgggggccacaccttcggcaaggcgcacggcgcgcgcaagccggaaggctgcgtgggcgtcgatccggcggccggagccgtcgaggaccagggtctgggctggaacaacaagtgcggcaagggcaatgccgaagataccgtgagcagcggcctcgaaggcgcgtggaccgccaacccgatcgcctggaccacgcagtacctcgacaacctctatgcgttcgaatgggtccagacccgcagcccggctggcgcgatccagtgggtgcccaaggaggacgcgaccttcgtccccgacgcacacgtcaaggacaagttgcacaagccgatcatgttcaccaccgatctcgcgctgaagacggacccggcctatcgcaagatcaccacgaagttccgccagaaccccgacgccttcgccgatgccttcgcccgcgcatggttcaagctgacccaccgcgacatgggcccgcgctggcgctatctcggcgcgatggtgcctgccgaggaactgatctggcaggaccccgtccccaaggccacctacgccatgatcgacgcggccgacgtctcggcgctcaaggggcgcatcctcgccaccgggctcaccgggcctgaactggtgcgcgcggcctgggcctcggcggcaagcttccgcggcaccgacatgcgcggcggcaccgatggcggacgcatccgcctcgctccgcagaaggactgggcggccaacaatccggcggaactcgcaagggtcctgaaggcgctcgaaggcgtcgcgaccgagttcaaccgcgccgcaaaggacggcaagaaggtctccgtggccaatctcgtcgtgctgggcggcaatgccgcaatagaacaggccgcggcaaaggccggcgtcacggtcgaggtgccgttcacgcccggccgcaccgacgcgagccaagcccagaccgatgtcgcgtcgttcgagttcctgaagcctgccgccgatggcttccgcaactattacgatgcgtccgccaaccgcctttcgccttcggaaatgctggtcgaacgcgcaaatctgctgacgctttcggtgccggaaatgaccgtgctggtcggcggcttgcgcgcgctcgatgccaatgccggcggggccaggcacggggtcttcaccgatcgtccgggcacgctcagcaacgacttcttcgtcaacctgctgggcatggagacgaagtggcagaaggcggcgaccgacggcgtctatgaagggcttgatcgcaagaccggcaagaccaggtggacggccacccccgtcgacctcgtgttcggttccaactccgaactgcgggcggtctctgaagtctacgggtcggccgatgccaacgcgaagttcgtcaacgacttcgtcgcggcctggaccaaggtcatgaacctcggtcgc

SEQ ID NO: 34523 - DNA, 1533 bp, Sphingomonas aromaticivorans
ctgttcgccaacctcggcaccgcgcccctggtggaacacgccgtccgcaacggcgaaggcctgctctgcgtcgatggcccgctggtggtcgagaccggcaagcacaccggccgctcggccaaggacaagttcatcgtccgcgatgccgaaaccgaaaacaccgtctggtggggcaagaccaacgtcgcgatgtcgcccgagcacttcgccgcgctcaaggccgacttcatcaaggcgctgggcgagaaggatcgcctctacgttgccgacctgttcggcggcagccagccggagcaccgcgtcaaggtgcgcgtgatcaacgaactcgcgtggcacaacctgttcatccgcaccctgctggtgcgcccgaccaccgacgagctggcctcgttcgtgccggaatacacgatcatcgacctgcctagcttccgcgccgacccggctcgccacggcagccgcagcgagaccgtgatcgcggtgaacttcaccgaaaagctgattctgatcggcggcacggcctatgccggcgagatgaagaaatcggtcttcggcatcctcaactacctgctgccggtaaagggcgtgatgccgatgcactgctcggccaacgtcggccccgacggcaagaccgccgtattcttcggcctttccggcaccggcaagaccacgctttcggccgatgcttcgcgcacgctcatcggtgacgacgagcatggctggtccgacaccgccgtgttcaacttcgaaggcggctgctacgccaagatgatccgcctctcggccgaagccgaaccggaaatcttcgcgacgaccaagcgcttcggcaccgtgctcgagaacgtcgtgatcgatccggtcacccgcacgatcgacctcgacgacaacagcctcgccgagaacagccgcggttcctacccgatcgacttcatcccgaacgcgagcgaggaaaacctcggcccggttccggccaacctgatcttcctcaccgccgatgcctatggcgtcctgcccccgatcgcgcgcctcacgcctgaccaggcaatgtaccacttcctctcgggctacaccgcccgcgtcgccggtaccgagatcggcgtgaccgaaccggaagccaccttctcgacctgcttcggcgcgccgttcatgccgcgtcacccgtcggtctacggcaacctcctcaaggagcgcatcgccaagggcggcgtgaagtgctggctggtcaacaccggctggtccggcggcaaggccacgcaggaaggcatcaagcgcatgccgatcaaggccacccgcgccctgctcaacgccgctctcgacggcagcctcaacagcgcgaccttcaccaaggacccgaacttcggctttgaagttccggtcgaggttccgggcgtcgacaccaagctgctcgacccgcgcggcgcatgggccgacggcgaggagtacgacaagacggcgcaggaactcgtgcgcaagttcgtcgacaacttccagcagttcgccgaccacgtcgaccagtcggtccgcgatgcggcaccc

SEQ ID NO: 34524 - DNA, 717 bp, Sphingomonas aromaticivorans
tttcgcgacaggtgcgtggcgatcctcggcgggaatgcggggatcggcctggcggcggcgcgcctgttcgccgccgagggtgcgaaactggcaataaccggtcggaatgccgagacattgcgggcggtcgcagaggagctggacgccctttgcatccgttccgacatgggtgacctgaacgacaccgaacgtgcccttgaagagatcgaggacgctctgggcggcatcgacgtgctgttcgtgaacgccggcgtcggggggttcgcgatggtcccggacgtcacgcccgaattctgggaccagatccactcggtcaacctgcgcggggccttctttgcgatccagcgggccctgccgctgatgcgcgacggaggctcaatcgtcataaccgggtccatcggatcgatggccgctgtgccgggcaacgtcgcctatgcggcggccaaggcggggctgcgggccatggcaaggatcgtcggcaaggaactcctgccgcgccgcatccgcgtcaacatggtgagcccaggcccgaccgacacggaaatcttcaagcgcgatgcgagcgccgaggaaatccagggcatgaaggacatgctgtcctcggtggtgccgatcgggcggatggggacttcggaggaagtggcccgcgccgtgctgttcctggccagcgcggaagcgagcttcatcaacggcgtcgacctgtgcgtcgatggcgga

SEQ ID NO: 34525 - DNA, 2120 bp, Sphingomonas aromaticivorans
ccctatcgcatgccgagcccctgggatttgctatgatgcgccagcttctcgccaccctgttccttggcctcgccgcctgctccctcggcggcgcgactgtcctgaccgagggcgccggacgcgagtggcccggcccgggcggtgacgccggcaagacgcatcactcgcgcctgaccgccatcaacgcggagaacgtcggtcggctcggccttgcgtggcaagtcgaacttggcaccctgcgcgggcaggaggcgaccccggtcgtggtggacggcgtgctctacacctcgggcaccacgggccgcgcctatgcgttcgatgcggcgaccggcaaggagctgtggcggttcgagcccgaggtcgacatgcaggtcaaccgcacggtctgctgcgacatggtcaaccgtggcgtcgcggtggggcgcggcaaggtcttcgtcgccagtctcgatgggtggatgtacgcactcgatgcccgcaccggcgcggtcgtctggaagagcgacttcatcgagaaccgagccaagggcgacaattccaccggcgctcccgaaatcgcgggcgatgtcgtcgtcatcggcatgggcggcgcggagtacgacgtgcgcggctatgtcacggcgctcgatctcgataccggaaagctgcgctggcgttggcacgtggtgccccgcgatcccaagctggggccgcaggaaacgcccgaactcgaagccgcgctgaagacttgggacccgaacagccgctgggacatcggcggcggtggcagcccgtgggatgcgatcaactacgaccccgaaaccggcctggtccttgtcggcaccggcaatggcgggccttacgccacgtccaagcgctcgcctgcggggggcgacaacctctacctcgccagcctcgtcgcgctcgatccgaagaccgggcggatgaagtggcactaccaggaaacgccgggcgacaactgggacttcaccgccacccagccgatgatcttcacccgcatgaagatcgacggcgaggaccggccagtcgtgctccacgcgccgaagaacggctatctctacattctcgaccggcgcgacggaaaactgctgcgcgccaatcccatcgtccgcaccaactgggccaagggcatcgatcccgggaccggccgcccgatcctcgatcccgcggccgccgactataccaccggtcccaagatcgtgttcccggccacgaccggcgcacgcaactggcaccccgccagctacgatccagcgaccgggctctacatcggcgcggtgctcgacatgggcaatctcatcttcatgacgccgggggccaagccgctcaaggcgcgcgggctcaacaacgatgccgcgctcatcttcacgccggacgtcaaggaagcgcttgccgccttcccgcctgaattcggcgatgccgtgcgcaagttgcctgcctatcaggaggcgctgaagcagcctgccaccgcgcagatccgcgccatcgatccgctaaccgggaagaccgtctgggcggccgataccgccggctggcaggatcgcggcggcgtgctgaccacgtcttcgggccttaccatccatggcggcgtcaccggcaagctcttcgtgcgcgatacgaaaaccggcaagctcctgaaggaaatagacaccggcactccgatcatggccgcgccgatgacttacgaggttggcggcgtgcagtacatcgccgtcatggccgggtggggcgggggcggctatcccttcgtcccgcgctattccgcagcctatacgcgcggcaacatgaaccggctgctggtgttcaaggtggggggcggcaaggtgccgttgccggacctgctcccgccgctggaagtggcgccggaaccgccggcacaggccgcgggcgtgacggcggcgaccatcgcgcgcgggcagggcctgttcttcggcaattgcgcgatctgtcacgccaaccagccccgctcgatcacgccggacttgcgccggatgcagcctgccacgcacgagatgttccgcgagatcgtgctcgaaggcctgctcacgcccaatggcatgccgcgctggaacgacatcctctcgaccgacgatgccgacgcgatccacgcctacctgatc

SEQ ID NO: 34526 - DNA, 1548 bp, Sphingomonas aromaticivorans
tactttgaccgcggacatgaccgcgacccgcagcgtctcgccatcgtcgacaccgagacgggcctcaagctgacgttcgccgaaaccaaagcactgtccgaacgcattgctgcggcattgcagaagggcggcttcgagaaccaggacctgctcggcctctatggcccgaacgacggcatgctgctcgtcgtgctgcttgcgatgtggcgcgccaacggcaagtggatcccggtcaacacccgcaacgccatcgacgccaacgccgcctacatcaactacgtccgcctgaagtggctggtctatcattcgtccaaggccgacgaggtcgcggagctcaaggcgctgtgccccacgctccagcatttcgtctgcctcgacaagcgcatgggcgatgaccccagcctcgaggagttcatggctggtgtcagcgaagccgatttcgtcgagcccgagatcgatgccttcggcaacctcatggacatggtcggcatcttcccgaccggcggcaccaccggcccgtcgaagggcgccaacgtcaccaacctcggctggggcacgatgatcgagaccgcagccgacggaatgggcggccgcacggattcgcccgtcgcacttgtttccgcgccgatcacccacgctgccggcccgatcgcgctttcgacgctcagccttggcgccacgcaggtcatcctgcccggcttcgatgccgagcgcgtgctgcgcaccatcgcggagtacaaggtcacgcacatgtacctgccgccgacggcgctctaccagttgctggcgtcgccggaattgggcgatcacgattactccagcctgcgcatcttcatcctcgtgggctcgccgtgcagcccggagaagttgcgtcaggcggtcgaagtcttcggcccggccatgtgccagtcctatggccaggtcgaatgcccgatgatcgtggcatggttcccgcccgaggacgtcgcccggttcgcgacgtccgcgccggaaaagctcgccgcctgcggcaagccgacccgctcgatcaaggtcaagctgctcgacgacgatggcaacgaggtgccgctgggcgaggcgggcgagatttgcgtgcgcggcgcgctggtcacgcattcctacttcgaaaagcccgaggaaaccgccgagatccgcaagttcggctggcaccacaccggtgacgtcggcaaattcgacaaggacggctatctctacatcgtcgaccgcaagaaggacatggtcgtctcgggcggcttcaacgtcttcaccgccgaagtcgaggcggcggtgacggaactcgccgccgtcaaggaagcctgcgtgttcggcatcccgcacgagaagtggggcgagcaggttcatgccgtggtggttgccgacggcattaccgaggcagagatcatcgcctatgccaaggagcgcctgggcggagtcaaggcgccgaaatctgtcacgtttatcgactcgattccgcgcaccgcagcgggcaagatggacaagaaggcgctgcgcaagccctggtggggcaacgcagaccgcatggtgaac

SEQ ID NO: 34527 - DNA, 2151 bp, Sphingomonas aromaticivorans
agagagctggatatgcgattgaaggtcctgggacttatggccgcactgctgccgctggcggcgtgcaacatcaagagcgagggcggcggggatgccgtcgccaacgccggcgtcaccgacgccctcatcgcccaggcgcccgaaggcgaatggctgagctatggccgcgattatggcgagcagcgcttctccccgctcacccagatcaatgacggcaacgtcggccagctcggtcttgcctggttccatgacctcgagaccgcgcgcgggcaggaagccacgccgctgatgcatgacggcacgctctacatctcgaccgcgtggtcgatggtgaaggcgttcgatgccaagaccggcgcgctcaagtggtcctacgatcccgaagtcccgcgcgagacgctggtccgcgcctgctgcgacgcggtcaatcgcggcgtcgcgctctatggcgacaaggtcttcgtcggcacgctcgacggtcgcctcgtcgcgctcgaccagaagaccggaaaggtcgtctggtccaaggtcgtcgtgcccaaccaggaggactacaccatcaccggcgccccgcgcgtggtgaagggcaaggttctgatcggtagcggcggctcggagtacaaggcgcgcggctatatcgccgcctacgacgtcaacaccggcaacgaagtgtggaagttccacaccgtccccggcaatccagcggacgggttcgagaacaaggcgatggaaaacgccgcccgcacgtgggctggcgaatggtggaagctcggcgggggcggcacggtgtgggattccatcacctatgatcccgccaccaacctcgtcctgttcggcaccggcaatgccgagccatggaacccggccgcagccgggcgcgagggcgacagcctctacacgtcctcgatcgtcgcggtgaatgccgataccggcgactatgtctggcatttccaggaaaccccggaagaccgctgggacttcgactccgcgcagcagatcacgctggccgacctgaccatcgatgggcagcggcgccacgtgatccttcatgcgcccaagaacggtcacgtctatgtgctcgacgccaggaccgggcagttcctgtcggcaacgcccttcgtgatggtcaactgggcgaccggtatcgatcccaagaccggcaaggccaccgtcaatcccgaagcccgctatgaaaagaccggcaagcccttcgtcagcctgcccggtgcggtcggcgcacactcctggcagccgcagagcttcagcccgaagaccggcctgctctaccttccggtgaacaacgcggcattcccctatgccgccgccaaggactggaaggccaccgacatcggcttccagaccggcctcgacggctatgtcacctcgatgcccgccgacgccaaggtccagggcgccgcgatgaaggcgaccaccggtacgctcgtggcgtgggacccggttgcgaagaaggccgcgtggaaggtcgaactgccgagcccgtcgaacggcggcattctctcgaccgctggcaatctcgtgttccagggcaccgcgggcggcgatttcgttgcctacaacgccgacaagggcaagcagctctggtcgttcccggcgcagagcggcatccttgccgcgccgatgacctatgcgatcgacggcgaacagtacgtcgcggtcatggtcggctggggcggcgtgtgggacgtcgccaccggcgtcctcgcgcacaaggccaagaagcagcgcaacatcagccgcctggtcgtgttcaagctcggcggcaaggccacgctgcccgctgctcccccgatggccaagatggtcctcgatccgccgccgttcaccggcacgcccgaacaggccaaggccggcggcgaactctacggacgctactgcaacgtctgccacggcgatgcggcggttgcgggcggcgtgaaccccgatctgcgtcactccgcggcgctcaatgcccccgaggcgatccgctcggtggtgatcgagggcgcgctgcagcacaacggcatggtctcgttcaagtcggcgctgaagcccgaggatgcggacaacatccgccactacctcatcaagcgcgccaacgaggacaaggctctcgaagccaagggcggctgagcgatctcgctatgtccggaa

SEQ ID NO: 34528 - DNA, 1416 bp, Sphingomonas aromaticivorans
ttcatcaacaacgagtgggtcgacagcagccacgacgccgtgatcgaggtggaagacccctcgaacggcaggatcgtcggtcatgtcgtcgatgcctcggacaaggacgtcgaccgggcggttgccgcggcgcgcgccgcgttcgacgatggccgctggtccaacctgccgccaatggtccgcgatcgcaccatgaatcgcctggccgacctgcttgaagccaacgccgatctctttgccgagctcgaagcgatcgacaacggcaagcccaagggcatggccggcgccgtcgacatccccggcgcgatcagccagctccgcttcatggccggctgggccagcaaggtcgcgggcgagacgacgcagccctacacgatgcccaacggcaccgtgttcagctacaccgtcaaggaacccgtcggcgtctgcgcgcagatcgtgccgtggaacttcccgctgctgatggcctcgctcaagatcgccccggcgctggcggctggctgcaccctggtgctgaagcccgccgaacagacctcgcttaccgcgctcaagcttgccgatctcgtggtcgaggccggcttccctgcgggcgtgatcaacatcatcaccggcaacggccacaccgccggtgaccgcatggtcaagcatcccgacgtcgacaaggtcgccttcaccggctcgaccgagatcggcaagctgatcaatcgcaacgccaccaccacgctcaagcgggtcacgctcgaactgggcgggaagagccccgtcgtggtcatgcccgacgtcgacgtggcgcagaccgcgcctggcgttgccggcgcgatcttcttcaacgcgggccaggtctgcgttgccggttcgcgtctctatgcgcaccgttcggtgttcgattccgtgctcgaaggcatgacccagaccgcgccgttctgggcgccgcgcccctcgctggatcccgaagcccacatgggcccgttggtcagcaaggagcagcacgaccgcgtgatgggctacatcgaggcgggcaagcgcgatggcgccagcgtcgtcatgggcggcgattgccccagcgccgatggcgggtactacgtcaacccgacgatccttgcagacgtgaacccgcagatgtcggtcgtgcgcgaggaaatcttcggccccgtcgtcgtcgcccagcgcttcgacgatctcgatgaagtggcgaagatggccaacgacacctgcttcggcctcggcgcgggcgtgtggacgcgcgatgtcgcggtgatgcacaagcttgcctcgaagatcaaatcgggcaccgtgtggggcaactgccacgccctgatcgataccgcgctgccctttggcggctacaaggaatcgggcctgggccgcgaacaggggcgcgccggcatcgacgcctacctcgagaccaagaccgtc

SEQ ID NO: 34529 - DNA, 726 bp, Sphingomonas aromaticivorans
gtgacagatctttccggcaagcacgtcgtcatcactggcgcctccacgggcatcggccgcgccacggcgacgcgttgcgtggccgctggcgctcgcgttaccctgatcgcccgccgtgccgacctgctcgaacaggccgcccgtgaacttggcggatcgaccgcgttcgccgctgccgacgttgccgacaaggctgcgctcaaagccgcgctggaccatgccgttgccgcaaatggcccgatcgacggcctgttcctcaacgccgggatcggcggcatgttcgcccctgtggaggactatggcgacgaagcgttcgatgcggttctcgccgtcaacctcaagtcggtcttctgggcgatccagcatgcactcccggcgatgaaggagcgcgggcagggggcgatcctggttaccggcagtctcgccagcgagcgtggcctgccgatgaacgcgggctatgtcgccagcaagcacgcggtactcggcctgtcgcgcgcggtggcgaacgaggcggcggaagcaggcgtgcgctgcaactgcatcctgcccggcctgatcgagacgccgatgctcgatggcctcccgcccgaagccgcctcgcagatggcccgcgccgtgccgcagggccgcaccggttcgtccgacgaagtggcgcaggtcgctgccttccttctttccgacgccgccagccacgtcaccgcgcaagctctcgcggtcgatggcggc

SEQ ID NO: 34530 - DNA, 1131 bp, Sphingomonas aromaticivorans
cgcactgcctacaacgaagatcacgaagccttccgccagaccgtacgccgctttcttcaggaggaaatcgcgccgaacgctgagaagtggggcgatgacggcatcgttcccaagtccatctggcccaaggcgggcgagctgggcatgctctgcccgaccgtccccgaggaatacggcgggctcggtctcgacttcggctacaacgcaatcgtcgacgaggagagcagctactacggccgcgtcgcgaccggcttctcgctgcagtcggacatcgtcgccaactacctcgtctcctacggctcggaagagcagaagaagaagtggctgcccaagatggtctcgggcgaggtgatcactgcgatcgccatgaccgagcccggtaccggttccgatcttcagggcatgcgcacgacggccaagaaggacggcaaccactatgtgatcaatgggtcaaagacctacatcaccaatggccagaatgccgacctgattctcgtctgctgcaagaccgacaccgaaatccagcccgcttggaagggcgtgtcgatcgttctcgtcgaagccgatcgcgaaggcttcaagcgtggtcgcaatctcgacaagatcggacaggatgaagccgacacctcggaactgttcttcgaagacgtccgcgtgccgatcaccaactgcctcggcgaagagggcaagggcttcatctacctgatgagcgaactgccgcaggagcgcctgtccatcgccgtcggtgcacaggcttcggcgcagaaggcctttgacgatacggtggaattcacgcgcgaacgcaaggcattcggcaagccgatcctcgatttccagaacacgcgcttcacccttgccgacatcaaggccaagctgcaggtaggctgggcgcacctcgactgggccctttcacgccacttgcgcaaggagctgaccccggaagaaggcgccgcagccaagctctggcacaccgaacttcagtgggaagtaatggacaagtgcctccagctccacggcggcgccggctacatgaacgagtatgcgatcgcccgtgcctggcgcggcgcccgcgtgacccgcatcttcggcggcaccaacgaaatcatgaaggaactgatcgggcgcaagctt

SEQ ID NO: 34531 - DNA, 969 bp, Sphingomonas aromaticivorans
tacgacgtcatcgccatcggtaacgccatcgtcgacgtgatggccccgtgcgaggatgccgacatcgcgcggctcggtctggccaagggcgggatgacgctggtcgacacggctcgggccaaggaactttacgacgccatgggccctgcccgcgagatttcgggcggatcggcggcgaacacgctggccgggctcgccgcgctcggcgcgaactgcgccttcatcggacaagtggcggacgatcagctcggcgaagtctttgcgcacgacatccgcgcgggaggaatcgcctttgacacgccgacccgcgcggacgaaccgccgacggcgcggtgccttatcttcgtgacgcccgacgggcagcgcacgatgaacaccttcctcggggcgtcgcagttcctcccggcggaggctcttgacgacgccaccatcgcggccgcgcaggtgctctacctcgaaggctacctgtgggatccggaagagccgcgcaaggcgatgcgccgcgcgatcgcggcagcccgcaacgccggtcgcaaggtcgccttcaccttgtccgacgcattcgtcatctcgcgtcatggcgacgatttccgcgcgctcatcgatgccggccagatcgacatccttttcgccaacgagcatgaactggctgcgctgaccggcatcgaggatttccacgtcgggatcgagcaactggcggccaaggtgcccaccgtcgtggtaacccgcagcgagaatggtgcccacgcgatcagccagggcgaacgcgctcatgtcccggcggaacccatcgccaaggtcgtcgacaccaccggcgccggcgacctttttgccgccggcttcctctatggctacgttcgcggccgtcctctcgccgaaagccttaccctcggtgcgatctgcgccgcggaaatcatctcgcactacggcgcaaggcccgaggcggacctcaaggacctggtcgcacag

SEQ ID NO: 34532 - DNA, 1179 bp, Sphingomonas aromaticivorans
taccgcgaacgacgcgcgcgcctgatgagcgtcctgaaggatggcgtcgccgtgatccacggcgccccgcgcgaccagacgggcggcccggtcagcccgcccttccatcagtccggcgactttgcctggcttacgggcatcgccgacgaacccggcgcagtcctcgtcctcgcgcctgacgaacgcactttccgcgaattcctgctgctgccgtcccgcgacatcgagaccgagcgctgggatgtcgagcgcctccccctcggttcgctgatcgaggcgcgcaccggaatgcagcgcgtgcgccgcacaggcagcctcgacgcgcttgtcacccagattgcagcgcgaagtcgtacactgcatttcatgggtcccatcgtcagcgcctcggcgccggtcccgcccgcgatggacctctacggccgcatcatggcccgggtgcccggctgcacgctgaaggaccagagcgcgctccttccgtcgctacgaacggtaaaggaaccgcgcgagctggacttgatgcgcaaggctcttgccgcgactcaggccgggcacctcgccgcaatgaaggcggtgcgccccggcatgaccgagcgccagcttaccgccgtgctcgaggatgggtttcgccagggcgggggcgaaggcctgtcctacgattccatcgtcgcgacggggcgcaacgccgcctcgctccattacgcccatggcaatgcgacaataggctcgcaggacctcgtcctgatcgacgccgccgcatccgtgggcggctatgcctgcgacattacgcgaactttcccggcatcgggcaggttcacagcggcgcagcgcgccgactacgaacttgtcctcgccgcacaggatgccgccgcccggttgctgaagccgggcgtcatccacgaggacatgaccgaggccgccaatgccgtgttccgcaaggccggccgcatcgacgaattcacccatggccttggccatttcgtcggcctggacgttcacgatgcgggcgattacgcaaagccgatcccggcgggcgcagtcctcaccatcgaacccggcctgtacaatcagcagatgaaccagggcatccgcatcgaggacctttacctcgtgaccgccaacggctgcgaacgcctgagtaccggcatcccgcgcacagtgcaggagatcgaagcgttc

SEQ ID NO: 34533 - DNA, 753 bp, Sphingomonas aromaticivorans
ctcaaggtcgcaagtttcaacatcaacgggatcaaggcccgtctgccacgcctgctcgaatggttggaagagacgcggccgtcggtcgcatgcttgcaggaaatcaagactcaggacgaaggctttccggccgaggagttcgagaagatcggctatcgcgcgatctggcatgggcagaagggcttcaacggcgtggcgatcctcgccgatggggagcagcccgtcgaggtgcagcgcggcctggctggcgatcccgaggacgagcattcgcgctatctggaagccgacgtgttcggtcttcgggtggtgtgcatctacctgccgaatggtaatccgcagccgggccccaagttcgactacaagcttcgctggatggaacgcctccgcgcccgcatggccgatattgcgtccgaggaagtgccggcgcttgtcattggcgactacaacgtgatccccgaggacaaggataccttttcggtcaaggcaatggcgagcgatgcattgatgcagcccgaatcgcgcgatgcctatcgccggctgctcaacgacgggtggaccgatgccatcgacctgttcaatccgcagggcggcgtgtggacgttctgggactaccaagccggtgcatggcagcgcgaccacggcttccggatcgaccatgccctgctatcgccggagcttgccgacaggctggtcgcagcgggcgtcgacaaggattaccgcggccgcgagaaggccagtgatcatgcgccggtc

SEQ ID NO: 34534 - DNA, 537 bp, Sphingomonas aromaticivorans
gcgccaggccgcaaggttgcgatcttcgcaggcggttgcttctggggcgtcgagggggtgttcagccacgtcaagggcgtgaccagcgtggtctcgggctaccatgggggcgaaaagaagaccgcgagctacgatgtcgtcggcaccggccggaccggccatgccgaggctgttcgggtcacctacgatccggccaaggtgcgctacgaccagcttctccggatattcttcgctgtcgtgaccgatccgacgcagttgaactaccaggggccggacgacggcacccagtatcgcaacgctctggtgccgatggacaaggaacaggcacgcgtggcggccggatacctggcccagttgaagcggctcgatctctggaagcggcccatcgtgacagcagtcgagccttacaagacgttctatccggccgagggctatcatcaggacttcatggccaacaatcccgaccacggttatatccgccgctgggatgcgcccaaggtccaggcgctcaagcgcatgttccccgatctctacaag

SEQ ID NO: 34535 - DNA, 1887 bp, Sphingomonas aromaticivorans
atgagccaagaaccggcaacgccgttgctagacacggtcaagaccccagacgaccttcgcaagcttgcgccaacgcagctccgccaactggcggacgaactgcgtgtcgagatgatatccgccgtcggccagacgggcgggcacctcggttccggcctgggcgtggtcgagctgaccgtggcaatccactatgtgttcaacacgcccgaggacaggcttgtgtgggacgtgggccaccaggcctatcctcacaagatcctgaccgggcggcgcgaccggatccgcaccctgcgtcaggcaggcggcctttccggcttcaccaagcgcagcgagagcgagtacgaccctttcgggacggcgcactcgtccacctcgatttcagcggcgctcggctttgccatcgctaacaagctttcgggcagactgggcaagggcatcgcggtgatcggcgatggcgccatgagcgcgggcatggcctacgaagcgatgaacaacgccgaggccgcaggcaatcggctgatcgtcattctcaacgacaacgacatgtccatcgcgccgcccgtcggcgggctttcggcctatctggcgcggctggtttcgtccggtccgtttttggggctccgcgacattgcccgcaggctttcgcgcaagctgccccgcccgctgcacgaagccgcgcgcaagaccgacgagttcgctcgcggcatggcgatgggcggtaccctgttcgaggagcttggcttctattacgtcggcccgattgacggccacaacatcgaccagctcatcccggttctcgaaaacgtgcgcgatgcggccgaagggccgtgtctgatccatgtggtgacgcagaagggcaaggggtatgcccctgccgaagccgcggccgacaagtatcacggcgtgcagaagttcgacgtcatcactggtgagcaggtgaaggccaaggctgccgcgcccgcctatcagaacgtgttcggcgagacgctggccaagctggcggacgccgacccgacgatctgcgcgatcaccgccgcaatgcccagcggcaccggcgtcgacaagtttgccaaggctcatcccgaccgcaccttcgatgtcggcattgccgaacagcatgcggtgacctttgctgcgggcctcgccgcagaagggatgcggccgttctgcgcgatctattcgaccttcctgcagcgcgctttcgaccaggtcgtccacgacgtggcgatccagaacctgccggtgcgcttcgccatcgaccgcgcaggcctggtgggcgcggatggtgcaacccacgccggttcgttcgacgtgacctatctggcaacgttgccgaacctggtcgtcatggctgctgccgacgaggcggaactggtccacatgacctataccgcggcactgcatgacagcggcccgatcgctttccgctatccgcgcggaaacggtgtgggcgtgccactgcccgaggttcccgagcggctcgagattggcaagggccggatcatcaggcagggtagcaaggtcgcgctgctgtcgttgggtacgcggctggcagaggcgctcaaggctgccgatcagctcgacgccaggggattgtcgacgactgtcgccgacctgcgctttgccaagccgctggacgtggcgctgatccgtcagctgatgaccacgcatgacgtgatcgtgacggtggaggaaggctcgatcggcggcctgggcgcgcacgtcctgaccatggcgagcgacgagggactggtggacgggggcctcaagatcaggaccatgcgcttgcccgatctgttccaggaccacgacgcgcctgaaaagcagtatgacgaggcggggctcaacgcgccgcatatcgtcgataccgtactgaaggcgctgcgg

SEQ ID NO: 34536 - DNA, 1803 bp, Sphingomonas aromaticivorans
ctttcggatttcgcagcctatccaaatctcgtcgcgatgttcctcgaccgtgccggcacgcgcggcgacagcccgttcctctgggccaagcacgatgggcaatggcggccgataagttgggcggaaacggtgcggcaggtgtgcctactggcggaagcgctgcgcggcctgggcctgaatcccggggaccgcgtggcgctggtttccgaaaatcggccggaatggtgcgtagccgacctcgcgatcatggccgccggtctcgtcaccgtgcccacctacatcaccaataccgaacgcgaccacctgcacatcctggaaaactccggcgcacgggcggtgatagtctcgaccgcgaaactctcgcagccgctgcttccggcggcgctttcggccccttgcgtcgagcacgtcatcggcatggagccactccgccagatgcaggcgggcaagctgtcgttccacgactgggacacgatgatgaccggcgatgccgccgctgctcgccgcgcggtcgacgaacgcctgcgcaccgtggatcgcgcggatctagcctgcatcatctacaccagcggcaccggcggaagcccgcgcggggtacgtctgcaccacggatcgatcctgcagaacgtcgagggcgcggcgcacatcctggccgaagacttcggctgggacgaggaagtgttcctttccttcctgccgctgtcccatgcctacgaacacaccggtggccagttcctgccgatcggcatgggcgcccagatcttctattccgaaggactggagaagctcgcttcgaacatcgaggaagtgcgcccgacgatcatggttgtcgtgccgcgcctgttcgaggtcctgcgcaccaggatcatgaagcaggtggaaaagcaggggcgcgtcgccaactacctgatggaccgcgcgctttccatcggcgggcgcaaggccgctggcaagggtcggctgatcgacgcgccgatgaacctcgttctcgatcgcaccttgcggccaaagatccgcgcgcgcttcggcgggcggatgaaggcgatggtctcgggcggggcgccgctcaatcccgacgtcggggtgttcttccagtcgatggggctgaccatgctgcagggctatggccagaccgaggcgggacctgtgatttcatgcaaccggcccagggtcggcctgaagatggacacggtcggcccgccgatgaagggcgtggaagtgaagatcgccgaagatggcgaaatcctcgtgcggggcgagctggtcatgcacggctattggcagaacgaggcggaaaccgcccgcgccgttccccagaacggccccaacgcaggctggctgcacaccggcgacataggccatctcgacaagaagggccgcatcgtcatcaccgaccgcaagaaggacatgatcgtcaacgacaagggcgacaatgtctctccgcagaagatcgagggcatgctcacgcttcagcctgagattgcgcaggcaatggtgtcgggcgacaagcggccctacatcgtcggactgatcgtgcccgatccggaatgggcgctcgattggtcgcgcgcgcaaggcgaacacttcgatttcaagaagctgcaggacctgcccgccttccgcaacgccatccgcgcggcggtggaccgggtgaacaaggacctgtcggtgatcgagaaggtccgccagttcaccttcacggacgaagccttcagcatcgacaacggcgagatgactcccagcctaaagatccgccgccacaagatccgcgaacgctacggcgcaaggatcgacggactgtac

SEQ ID NO: 34537 - DNA, 1005 bp, Sphingomonas aromaticivorans
gaacccgcgcaccgcctgacgataaaggccctgggccttgcgcaaggcgggaccacgctggcgcccacgccttcgctcgcccagcgcatagcgggactggcctttcccaacccggtcggcatggcccccggtttcgacaagaacgcggaagtgcccgatgccatgctcggcctcggcttcggattcgtcgaagtgggcacggtcacgccccgcccgcaggagggcaaccccaagccgcgcctgttccgcctggtcgaggaccgcgcggtcatcaaccgcatgggcttcaacaacgaaggcgcgcaggccgtcaccaaccgcctcgtgcggcgacgcgagactggcaagcacggcttgccgggcatcgtcggcgtgaacatcggcgcgaacaaggattcggcggaccgaatcgccgactatgcgctgatgacgcggctgatggcgccgctggcctcgtacctcaccgtcaacatctcatcgccgaatacgccgggcctgcgcgccctgcaggacgaaggcgcccttgccgcactgctcgatgcagtgatcgaggcgcgtggcaacatgaccacgccggtgttcctcaagctcgcgcccgatctcgagccggccgatatcgacagcatctgccgcatcgccatcgaaaagcagcttgcggccctgatcatctcgaacacgacgatcacccggccagtgctccgctctgcccacgccggggaggcgggcggactttccggcgcaccgctgcgggaactggcgctgcagcgcctgcgcgatttccgcaaggccagcggcggggcgatcccgctggtcggcgtaggcggcattgccacggtcgacgatgcgtgggagcggatccgggcaggcgccagcctgatccagatctacagcgccatggtctacgaagggcccggcctggcccgccgcctcgttgcgggtctcgagcgcaaagtccgcgaagccggcctcacttccattgccgaggccgtcggcagcgaatagcgt

SEQ ID NO: 34538 - DNA, 792 bp, Sphingomonas aromaticivorans
atgaacgacaccgaacagcacctgaaggcacgcgagcggtggccgagcgtcctctggctgatccgccacggacagagcgccggcaatgttgcgcgcgacatggcaatggccgcaggcgacctgcgtatcgctctcgaccaccgcgacgtcgacgtgcccctctccggtcttggccgcgagcaggcccgcgcgctgggtcactggttcgccagcggcgaggaaggcgggcggcccgaaatcgtgctagccagcccctatgcccgcgcggtccagacggccgagctgttccgcgaggcaggcggttgcagccctgccttgcgcatctgcgtcgacgagcgcctgcgcgagaaggagttcggcatcctcgacggactgaccacgctgggtatccgcgagttccagcccgaacaggccgattttcgcaaggttctcggcaagttctaccatcgcccgccgggcggggagagctgggtcgacgtgatcttccgcctccgcgcgctgctcgacaccgtatcgctccactacgccggcaagcgggtgatgatcgtggcgcaccaggtggttgttctgtgcttgcgctacatcatcgagcacatgaccgaggcagacatcctggccattgaccgggagggcgacatcgccaactgcgcgatcacgcaatatcggctggagcgcggtgggccgggcgacggggaactcgtgctggaacgcttcaacgtggttgcgccgatgatccgcgagggcactcccgcaacacgcgagccggaccagatggtggccgcccgtggctga

SEQ ID NO: 34539 - DNA, 843 bp, Sphingomonas aromaticivorans
aagcccatccgcaaggcggtctttccggtcgcggggctgggaacccgcttcctgcctgcgacaaaggcgatcccgaaggaaatgctgccgatcatcgaccgcccgctgatccagtacgcggtcgacgaggcgcgcgaggccggcatcgagcagctcatcttcgtgaccggtcgcggcaagaccgcgatcgtcgagcatttcgacacggcctacgaactcgaacacacgatgcgcgatcgcggcaaggtactcgatattctcgcgccgacgcggatccagccaggcaatctcgtgaccgtgcggcagcaggtgccgatgggtcttggccacgccatctggtgcgcgcgcgcggtcgtgggggatgaacctttcgcgatcttccttccggacgaaatgatgatcggcacgcccggctgcatgaagcagatggtcgatgcctacgaagacgtcggcggcaatctcatttccgtgctcgaagtgcccgcggcagaagtgtcgagctacggcgtcatcgctcccggcgcccgggtttccgacacgctgaccgaagtgaagggcctggtcgagaagccgaagcgcgaggacgcaccttcaaacctcatcatttccggccgctacatcctccagccggaagtcatgcgcactctcgaatgccaggaaagcggcgcgggcggcgaagtgcagttgaccgatgcgatggcgcggatgatcggccgccagccgttccacgccgtgaccttcgccgggcgacgctacgactgcggcagcaaggccggcttcgtcgaggcgacgctcgccctggcgctcgagcgcgaggatatggccgaagacgtgcgcgcgatc

SEQ ID NO: 34540 - DNA, 1281 bp, Sphingomonas aromaticivorans
atggacaagatcatcattcgcggcggaaagcgtctttcgggcgccgtgccggtctcgggcgccaagaactcggcgcttaccctgctgccctgcgcgctgctgaccgacgagccggtgacgctgcgcaacctgccgcgtcttgccgacatcgacgggttccagcacctgatgaaccagtttggcgtatccacgtcgattgcgggcgcaaggccggaggatttcggccgcgtgatgaccttgcaggcgacgcgcctgacgtcgaccgtcgcgccctatgacctggtgcgcaagatgcgcgcctcgatcctcgtgctgggcccgatgctggcacgcgcgggcgaggccacggtttcgctgcccggcggctgcgccatcggcaaccgcccgatcgacctgcatctcaaggcgctggaagccctaggtgcgcagatcgaactggcggcaggctatgtccgcgcgatcgctcccgacggcggcctgccgggcgggcgctattccttcccggtggtctccgtcggcgcgaccgagaacgcgctgatggccgccgtgctggccaagggcaagtccaccctgcacaatgcggcgcgcgagccggagatcgtcgacctgtgcaacctgctggttgcgatgggcgcgcagatcgagggcatcggcacgtcggacctcacgatccacggcgtggaccgcctccacggcgcgacctacatggtcatgccggaccgcatcgaggccggctcctatgcctgcgcagccgcgatcaccggcggcgaagtgatgctgaacggcgcgcgcatcgaggacatggaagcgaccgtacaggcactgcgcgacgcgggcgtccatgtcgaaccgcgcaagggcgggatctacgtggcggccgacggtccgctcaagccggtcacgatctcgaccgcgccctatccgggtttcgcgaccgacatgcaggcgcagctcatggcgatgctgtgccttgcccatggttcctcggtgctgaccgagaccatcttcgagaaccgctacatgcacgtgccggaactgaaccgcatgggcgcccggatcgagaccaagggccgcaccgcagtagtccacggggtggagaagctgaccggcgccgaagtcatggcgaccgaccttcgcgcatcgatgagcctggtcatcgccgggcttgcggccgaaggcgagacgcaggtccaccgcctctatcacctcgaccgcggctatgaacggcttgaagagaagctctcgctgcttggcgccgaaatcgagcgcgtcggcggggac

SEQ ID NO: 34541 - DNA, 2541 bp, Sphingomonas aromaticivorans
cttcctcgcgtggcgcatccgtcgcactatgcaatctcgatcacgcccgacgccacgaacctcactttcaccgggacctcttcggtcgaccttgaagtcaccgaggcgagcccggtgctgacgctccacgccctcgacctcaagatcgcctcggccacgctcacgccggccggcggcgcggccatgccggtcacggtcacgatggacgcggccagccagactgcacgcttcgccgccgcccagccgctcgcgcccggcaagtaccggctcgacacgacctattcgggcgtaatcaacacccaggccaacggcctcttcgcgctcgactatcccgacaaggtcaccggcaaggacgtgcgcggcctgttcacccagttcgaggcgccggacgcccgccgtttcgcgcccatgttcgacgagccgatctacaaggcgaccttcgatctctccgccgtcgtcccgtcgaaccgcatggcgatcagcaacatgccgacgatcaaggaagaggatctcggcaaggggctcaagcgcgtcacgttcggcaccagtccgaagatgtcatcgtacctgctgttcttcgcgctcggcgatttcgaacgcatggccaaggaagccgcgcccggcgtacaggccgggatcgtcgcgccccggggcagcggcgagcagccgcgtttcgcgctcgatgagctggcgccgctgatcccctactactccgaatacttcggccagccctatcccctgcccaagctcgacaacgtggccgcccccggccagtcgcagttcttctcggcgatggaaaactggggtgcgatcctgacgttcgagcgcatcctgctcaacgatccggcgatcacctcggcctctgcgcgccagaacatcgtcaccacccaggcgcacgaagtggcgcaccagtggttcggcaatctcgtcacgatggcctggtgggaagacctctggctgaacgagggctttgccagctggatggaaaccaaggcgaccgcccatttccaccccgactggttcccgctgctcggccgcgtcgaagggcgcgaggccgcgatgggcctcgacgggttcaagaccacgcacccgatcgtgcaggagatcaagaccgtcgacgagaccaaccaggccttcgacgcgatcacctaccagaagggcgaagcggtcatctcgatgctcgaatccttcgcgggcgagaccgtgtggcgcgatggcctgcgggcctacatgcgcgaccacaagttcgccaacacgcgttccagggacctgtggcaggcggtcgaaaaggccggtgcccccgggctgacttccgttgccaccgacttcaccaccaagcccggcatcccgctggtcaaggtgaccgggctgacctgccgcaagggcgtctccacggtgatgctcgaacagggcgaattcagcatcgaccgcaaggaccaggtcgcgggtcagccgcagcagtggaaggtgccgctgctcgtctccgccggcggcgaggcgacgcgcacgatcctcgacggcggcaagggcacggtcaccgtcaacggttgcggcccggtcgtcatcaatgcgggccagctcggctattaccgctcgctctacacgcccaagatgctggcctcgctcaagacggcgatgccgtcgctgcagcccgtcgaccagatgggcctgattgccgacaaccttgcgctctcgaccagcggctaccagccctatgccccggcactggacctcctcgccgcggttccgggcaatgccaatccggtcgtcgcgagcagcgcattcgggcgctacgttggcgcgtggcgtacgctcgaaaaggacccggctacccagaagcggctcgccgcgaaggtcgccgccacctggaagccgcgcctcatgacgctcggcttcgaccccaaggcgaacgagagcctgccggatgccgatctgcgctccacgctgatttcgggcttcggcacgatgggcgatcccgatgtcgtggccgaggcgcgccgccgcttcgccatgctcgcctcgaaccccaaggctctcgacggtccgcagaagacgacctggctcaacatcgtcgcgcgcaatgcgacgaaggctgattgggatgcgatccgccagatggcggccgcttcgaacagcgcggtcgaacgccagttcctctacacgctgctcggtcgtcccgccgatcccgcgcttgctgccgccgcgcgcgatctcgcgctgaccgacgttccggggaagaccacgagcgctgcaatgatcgtcgcggcggcggggctacacccggacgccacctacgatttcgccgtggccaaccgtgcgaagatcgaggggctggtcgatgcgcagagccgcgtgaccttcattgccagccttgccaacgcgtcgaacgatccggcgatgctggccaagctggaggccttcaaggcaaccgtccccgccgaagcctcgcgcccggtcgatcgggtgatcggtggcttaaccgaacgggcaaaggcgcgtccgctcttcgtcaagggcctgaccgactggctcaacgcccgc

SEQ ID NO: 34542 - DNA, 1405 bp, Sphingomonas aromaticivorans
cctcgcggacgcaaggtaaagatcctcgccacggtcggccctgccagccgcgatccggaaatgctcgaaaagctgttccgcgccggcgccgacgccttccgcgtcaacatgagccacggcgaacacgcgattcacgccgagaccatcgccaacatccgcgcgctggaaaagaaggtgaaccggccgatcacgatcctgtgcgacctgcaggggcccaagcttcgcgtcggcaagttcaaggacggccgcgcggtcatccgccattcgggccacttcacgctcgatcgcaatcccgagccgggcgatgaaacccgcgtctgcctgccgcatcccgaactgttcggcgttcttcacaagggccagcgcctgctgatcgacgacggcaagctgcggctgcgggtgatccgcgccgacgagaacgagatcctctgttcggccgaagtcggcggcgtcatttccgatcgcaagggcgtcaacgttcccgatgcggtggtgcccgttcccgcgctgaccgacaaggatcggcgcgacctgtcgttcgcggttgagcagggggcggactggatcgcgctgtcgttcgtccagcggcccgaggacgtggccgaggcgcggcgcctgctgggcggccacggctcgctcatggccaagatcgaaaagccggcggcgatttcccggcttgaagagatcgtcgagctttcggacggcatcatggtcgcccgcggcgaccttggcgtcgagctgaaccctgaagaggtgccgccgctccagaagcgcatcgtcgaaaccgcgcgccgccaggggcaagccggtggtcgtcgccacgcagatgctcgaatcgatgatcgaagcgccgacgccgacccgcgccgaagtttcggacgtcgccaatgcggtctatgacggcgccgacgcggtgatgctctcggccgaaaccgccgccggtgcctggccggaagaggcggtcaccatcatgcaccgcatcgccgcgcaggtcgaagccgatccgggctatggcgcgcgcgtccacttcttagagacgcttcccgatccgaccaccgccgacgcccttgcgcaggctgcggcgagcatcaccgagaccttgccgatttccgggatcatcgtgtttaccggatcgggttccaccgctcgccgcgtggcgcgcgaacgtcccggcgtgccgatgctcgtgctcacgccttcgcacaagacggcgcgcaaggtcgggctgctgtggggcgcccatgccgtcagcaccaaggacatcggcagcttcgaggagatgatcgccaagggcaagcgcatggcgctgcgccacggcttcggctcggccggatccaagctcgtcgcgctggcgggtgttccgttcggcacgccgggggcgaccaacctgctccacgtggtgacg

SEQ ID NO: 34543 - DNA, 447 bp, Sphingomonas aromaticivorans
atccgcgccgcaacgcctgacgacctgcctcttgtggctcgcctcgtccgcgctctcgcggaatacgagaagctggcccacgaagtgcgcttcgacgaagccgtgctgggcgagaagctgttcggcccgcgcccctacgccgaagtggcgatcggcgagatcgatggcgaggcgcagggcttcgccctgttcttccacaatttctcgaccttcgagggcaagccgggaatctatctcgaggacctcttcgtccagcccgccgcacgcggctcgggcctgggcaaggcgctgctctcccacctcgcggcccttgcgaccgaacgcgattgcgcgcgcctcgaatggtcggtgctggactggaacgaaccggcgatcggcttctacaagtcgctcggcgcgcgcctgatggacgaatggaccgtgatgcgggtggatggcgacgcgctg

SEQ ID NO: 34544 - DNA, 2652 bp, Sphingomonas aromaticivorans
gatacgctcggcacccgcagcacgatgaacgtgggcggcaaggagttcgcctactactcgctcaagaaggcctccgagaagttcggcgacatctcgcgcctgcccttctcgatgaaggtccttctcgaaaacctcctgcgcttcgaggacggtggcttcaccgtctcgaccgacgacgtgaaggcggtggtcgactggcagaagaaccccgccgaatcgaacaacgagatccagtaccgcccggcgcgcgtgctgctccaggacttcaccggcgttccctgcgtggtcgatcttgccgcgatgcgcgatgccatcgccacgcttggcggtgacaccagcaagatcaatccgctggtccccgtgaacctcgtcatcgaccactcggtcatggttgacgagttcggccatcccaaggccttcgaagagaacatggaaatcgaataccagcgcaacatggagcgctacgatttcctcaagtggggttcgaagagcctcaacaacttctacgcagtgcccccgggcaccggcatctgccaccaggtcaatcttgaaaacatcgcgcagacggtgtggaccagcaccgaccagaacggcgcgacggttgcctaccccgacacctgcgtcggcaccgacagccacaccaccatggtcaatggccttggtgtgctgggctggggcgtcggcgggatcgaggccgaggccgcgatgctcggccagcccgtctcgatgctcatccccgaagtggtgggcttcaagttcaccggcgaactgaaggaaggcgtcaccgccaccgacctcgtgctgacctgcaccaacctgctgcgcaagcacggcgtggtcggccgtttcgtcgaatactacggccccggccttgccgccctgtcgctggccgaccgtgcgacgctggccaacatggcacccgaatacggcgcgacctgcggcttcttcggaatcgacgagaagaccctcgactacatgcgcctcaccggccgcgaagaggctcagatcgcgctcgtcgaagcctatgccaaggagcagggcttctggatcgacccgtcggtcgagccgatcttctcctcgacgctggaactcgacctcggcactgtcgtgccctcgctcgccggtcccaagcgcccgcaggaccgcgtctcgcttcccgaagtcgacgacgtgttcaacgccgacatggcgaacacctacaagaagacccccacccgcgttccggtcgaaggcaaggacttcgacatcggtgacggcgacgtcacaatcgcggcgatcacctcgtgcaccaacacctcgaacccgggcgtgctggttgccgcaggcctcgtcgccaagaaggccaacgagctgggcctgaagcccaagccctgggtcaagacctcgctggcgcccggctcgcaggtcgtcaccgactacctgaacaaggcaggcctgcaggaacacctggacgccgtcggcttcaacctcgtcggttatggctgcaccacctgcatcggcaactcgggcccgctcgccgaaccgatcagcaaggcgatcaacgacaacggcctcgtggccgccgccgtgatctcgggcaaccgcaacttcgaaggccgcgtctcgcccgacgtgcgcgcgaacttcctcgcgtcgccgccgctggtcgtcgcctatgcactcaagggcacggtgatcgaggacttcaccaccaccccgatcggcaagagcaaggacggcgctgacgtctatctcaaggacatctggccctcgaacagcgaagtcgcgaccaccatggccggctgcatggaccgcgccatgttccaggcccgctatgccgacgtctacaagggcgatgcgcactggcaggcgatcaacgtcacgggttcggaaacctactcctggcgcgccggctcgacttatgtcgccaacccgccctacttcgaaggcatgtcgatgacgccggctccggtcagcgacatcatcgatgccaagccgctgctcatcctgggcgattcgatcaccaccgaccacatctcgccggccggctcgatcaaggctgacagcccggcgggcaagtggctgatggagcaccaggtcgcgaaggcggacttcaactcctacggcgcgcgccgtggccaccatgaagtgatgatgcgcggcaccttcgccaacatccgcatcaagaacgaaatggtccccggcgtcgaaggcggcttctcgcgctacggcgacgaggtcggctcggtctatgacgttgccatgaagcacaaggccgacggcacgccgacggtcgtgatcgcgggcaaggaatacggcacgggctcttcgcgcgactgggcggccaagggcaccaacctgctcggcgttcgcgccgtgatcgtcgagagcttcgagcgcatccaccgctcgaacctcgtcggcatgggcgtgctgccgctccagttcaaggaaggccagaaccgcacctcgctcgcgctctcgggcgacgacaccttcacgatcaagggcgtcgcgaacctccagccgcgccaggacgtggaagtcgaagtgacgcgcaaggacggcaccaagctgaccttcaccgcactgtgccgcatcgataccgccaacgaagtcgagtacttcatgaacggcggcatcctgcactacgtgctgcgcaagctcgcttcg

SEQ ID NO: 34545 - DNA, 876 bp, Sphingomonas aromaticivorans
ggcggcaaactggcgctcgacggcgtgagcttcgacgtgccgcaggggcagatcttcggcctgcttgggcccaacggcgcgggcaagtccacgctcatcaacacgctggcgggcctggtgatgaagacttcgggcactgtcgagatctggggccacgacatcgaccgcgacgtgcgcaacgccaaggcctcgatcgggatcgtgccgcaggagatcgtgttcgacccgttcttcacgcccgccgaagtgctggaaaaccaggcgggtctctatggcgtgccgaaggccatgcgccgcacgatggaactgctgcgggcggtgcacctggcggacaaggccgatgcctatgcccgctcgctttcgggcggcatgaagcggcgcctgctgatcgccaaggcgatggtccaccagccgccggtcctggttctcgacgagccgacggcgggcgtcgacgtcgaactgcggcggcagttgtgggaactggtcggcgaactcaaccgcgacggggtgactgtcgtcctgacgacgcactacctcgaggaagcggaagaactgtgcgaccgcatcgcgatcatcaaccacggaagactgatcgcgaacaagccgactcgcgaacttgtcgacatggcgcgggaaaaaatcgtggtgctgacactcgaccgcgatgtcgatgttgcaccgcaacatccggtcttcctgaagagcgtgatttcgggcgagcggcagattgagatcggctacgacaaggaccgcatgaatgccggcgaagtcatgtcgctggtccaaggccagggatatgcgatcgtcgatgtttcaacgcgcgaagcggaccttgaggacgtgttcgtgacgctgaccagccaaccgcgcgaggac

SEQ ID NO: 34546 - DNA, 1542 bp, Sphingomonas aromaticivorans
gatgtcctgatcatcggttcgggcgcggcgggcctgaccgcagcgctggtgcttgctgaaacctgccgcgtgcttgtcctggccaagggcgggctcgacggcggctcgaccaactgggcgcaaggcgggatcgcggcggtgctcgacgccggcgacactttcgaagaccacatccgcgacacgatgatcgccggcgcgggcctgaaccgccgcgagacggtggagttcgtggtcgaacatgcgcccgccgcgatccgccggctggtcgaccttggcgtgcccttcaacgccgaggcgggttcgctccatctgacgcgggaaggcgggcattcgcatcgccggatcgtccatgtcgacgatgccacgggcgcggcagtgcagaaggcgctgctcaaggccgcgcgcgaacatcccaacgtgacgctcctgcccggccgcacctgcatcgacctgatcacgggccgccacgaggccgcgcgctattccggttctggccgggtctggggggtctatgccctcgacgaagcgagcggcaccgtggaagcgcataccgcccgggcgacgatcctggccaccggcggcgcgggccgcgtctatcagttcagcaccgccccgcgcggcgcaacgggcgacggcatcgccatggcatggcgggcaggcgcgcgcgtctccaacatggaaatgatgcagttccacccgacctgcctctacaacctcgaggtcaagaacttcctcatcaccgaggcagtgcgcggcgaaggcgggcgcctcatcaatccgcgcactggcgcgcggttcatggaattctacgatccccagcgcctcgaactcgcgcctcgcgacgtcgtggcgcgggcaatcgacgccgagatcaagaagttcgggctcgacttcgtgcatctcgacatcagccacatgccggcggatttcgtgcgggggcatttccccaacatccacgagaagctgctggggctgggcatcgacatgacgacccagccgatcccggtggtgcccgcgcagcattatacctgcggcggcgtgctgatcgatctcgacgggcggacggacctgccagggctctatgctgccggcgaatgcaccgaaagcgggcttcatggcgcgaaccggctggcgtccaattccctgctggaatgcttcgtcttcggcgatgcggccgcgcgcgacatcctgcgccgctgggacagcttcgaggcaccgcccgaagtgcgcgcctgggacgagagccgggtgacggactcggacgaggaagtggtcatcaagcagaactggaccgaaatccgccggttcatgtggaactacgtcggcatcgtgcggaccaacaagcggctcgagcgcgcggcgcaccgcatccagatgctgtctgacgaggtcaacgactactacggccacttccgcgtgaccacggatctcatcgaactgcgcaacctgctgcagagcgcggaactgatcgtgcgttccgcccgcgcccggcacgagagccggggtctgcactatacgctcgactatccgcagaccaacgaa

SEQ ID NO: 34547 - DNA, 2646 bp, Sphingomonas aromaticivorans
catgcccaaccggtggacgccgtcctgcgcagcctgcaagccgtgccaaacgggctgagttctgaagaggcgagccgccgactggagaagtatggcacgaaccgcctgccggaacaggcagcgcgcagtcccttcctgcgtttccttcggcactttcacaacattctcatctacgtgttgctggcatctgccgtaatcacggcgctgatggggcacctggtggataccggcgtgatcctcgccgtcgtgatggccaacgcgatcatcggcttcatccaggagggccgcgccgaaggggcgatggcggcgatccggcagatgctggccccccgttcggcggtcctgcggaacggtgtgcgagcaacaatcgatgcgtcggagcttgttcccggtgacatcgtgctactcgagccaggtgaccggattccggcagacctgcgcctgatcgaggcacggggcatgaaggtggaggaggcgatccttaccggcgaatctgttccggtcgacaaggattgctcccccgtgcccgagaatgcttcgcttggagaccgcgcctcgatggccttcagtggcacgctggtggtgtccggaacagcgcgcggtgtggtcgcggccacagggggcggcacggaaatcggccagatcagcgggatgctctcccgggtcgaaacgctgaccaccccgctagttcaccagatggacatcttcgcccggtggctgaccgcgttcattcttcttgtcggcgccgcaatccttgcattcgggacattcgtccgacagctgcccttcgacgaaatgttcatgatcgtcgtgggcctggccgtcgccgcaattcccgaagggctccctgccgttctcaccatcacgcttgccgtgggggtgcaggccatggcgaaacgcaacgccattgtccgccgcttgccggctattgagaccctggggtcggtttcggtcatttgcaccgacaagaccggaacgctgacgcgaaacgaaatgatggccgcagcactggtgtcttcgggccgtgagtataccatcgagggtgccggctacgccccggcggggatgctgcaggcgggcggagaaccagtcgaagcgagcggcgatcccgtgctggtggaattcgcccgcgcagccgccttgtgcaacgatgcctcgctggtgcgatccggggacgactggcgggtcgaaggcgatccgatggaaggcgcattgctcgcacttgccggaaagatcagcgatggttcgctgcgcgcgttcgagcacctgacgcgcactgatgtcatcccgtttgatgcggcctggcgctacatggcggtcttgtgccacgaccatcaggggcaagccttcgcctatgtcaaaggcgctcccgaggcgatcctcacgatgtgcggcgaccagcaggactgcaacggcgaaaccgaacccctggacgaagcctactggtcaaggtcggtcgagactctcgcaggggacgggcagcgggttctcgcccttgcagtgcggaccatgcggcaggacgatacggttctgaacaccagcgaccttgagggcaagcttaccctgattggccttgtcggcctcatggatccgccgcgtgctgaagcgatcgaagcggtttcggaatgccatgccgccggcatccgggtgaaaatgataaccggcgatcacgccgcaactgcccgggcgatcgccgcccagataggacttcgcaataccggccgcgtgctcaccggtgccgacatttcggatctggcggacgaccaactggccgaagcggttatggaaaccgatatttttgcgcgcacctcacctgccgacaagctgcgtctggtgaccgcgctgcagtcccaagggctgatcgtcgccatgaccggagacggcgtcaacgatgcgcctgctctcaagcgggcggatgccggaaccgcgatgggcatcaagggcagcgaagcggccaaggaagcgtccgagctcgtcctggccgatgacaatttcgcctcgatcgcggccgccgtgcggcagggccggacggtctacgacaatatcaagaaggtcatcagctggaccctgccgaccagcgctggcgaagcgatgaccatcgtggttgccgtgctcgccggcttgtccctgcctgtaacggctgtccagatcctgtgggtcaatctcatcacggccacgacgctcggcatcgcgctggccttcgagccgagcgagagaaagaccatgctccgtccaccccgggctcgcgatgcaccgctactcaccggcgaactgatctggcatattgtgctggtttcgggcctgttcgtcgtcgccgtcttcggcatcttcgcttatgcgctggataagggatattcactcgcgctggcccagaccatggctgtgaacacgctggtcgtgctggaaatcttccacctcttcttcatccgcaacatctacggcagctcgctgaactggagggcggtcaagggcacgccgatcgtgtggttggcagtcatcgtcgtgacagccgcgcagttcgcgataaccttcctggaaccgctgcaacgcgtcttcggcacacagtcggtcccgatccgcgatggactgctcattattggtgtcggggctgcattctttggtctgatcgagatcgagaagcagttg

SEQ ID NO: 34548 - DNA, 783 bp, Sphingomonas aromaticivorans
ggactgatgcaagggaagcgtggcctgatcatgggccttgccaacgacaagtcgttggcctgggggatcgcgaagaagctgcacgagcagggcgcggaactcgccttctcctatcagggcgaagcgctcgagaagcgcgtgcgcccgctggcggaaagcctcggcagcgatttcctgatcgaatgcgacgtgtccgacatggccgcgctcgaccagacgttcgagacgctcaaggcgcgctggccgacgatcgacttcatcgtccatgccatcggctattcggacaagaaccagcttcgcggcaagttctatgacaccacgctcgacaacttcctgatgacgatgaacatttcggcgtacagcctcgtcgcggtgacgaagcgcgcggccgagatgatgcctgcgggcggctcgatcctgacgctgacctactatggcgcggaaaaggtcgtgccgcactacaacgtcatgggcgttgccaaggcggcgctcgaagcgagcgtgaagtacctggcgaacgactgcggcccggcgggcatccgcgtcaatgcgatctcggccggtccgatcaagaccctggccgccagcggcatcggcgacttccgctacatcctcaagtggaacgaactgaacagcccgctgcgtcgcaacgtgaccatcgaggacgtgggcggcgcggggctttatttcctgtccgacctgtcttcgggcgtgacgggcgagacccaccatgtcgatgccggctatcacaccgtcggcatgaagcaggaagacgcgcccgac

SEQ ID NO: 34549 - DNA, 1647 bp, Sphingomonas aromaticivorans
atggctgccaaggacgtaaagttcggccgcgacgctcgtgaacgcattctgcgcggcgtcgacatcctcgctgatgccgtgaaggtcacgctgggccccaagggccgcaacgtcgtgatcgacaagagcttcggcgccccccgcatcaccaaggacggtgtttcggtcgccaaggaaatcgagctcaaggacaagttcgagaacatgggcgcccagatgctgcgcgaagtggcctcgaaggccaacgacgcggccggtgacggcaccaccaccgcgaccgttcttgcacaggcgatcgttcgcgaaggcatgaccgcggttgccgccggcatgaacccgatggacctcaagcgcggcatcgacatcgccgtcggcaaggtcgtcgagaacctcaaggcccgttcgaccccggtcgccggttcgtcggaaatcgcccaggtcggcatcatctcggccaacggcgacaccgaagtcggccagaagatcgccgaggcgatggagaaggtcggcaaggaaggcgtgatcaccgttgaagaggccaagggcctcgaattcgaactcgatgtcgtcgaaggcatgcagttcgaccgcggctacctctcgccctacttcatcaccaacccggaaaagatgacggtcgaactcgagaacccgtacatcctgatccacgagaagaagctgtcgtcgctccaggcgatgctgccgatcctcgaagccgtggtgcagtcgggccgtccgctcctcatcatcgccgaggacatcgaaggcgaagcgctggccaccctcgtggtcaacaagctgcgcggtggcctcaagattgccgccgtcaaggctccgggcttcggtgaccgccgcaaggccatgctgggcgacatcgccacgctgaccgccggcgaaatgatctccgaagacctcggcatcaagctggagagcgtcacgctcgccatgctcggccaggccaagaaggtcaccatcgacaaggacaacaccacgatcgtcgacggcgccggttcggccgaagagatcaaggcccgcgtcgagcagatccgtgcgcagatcgaagtcaccacttcggactacgaccgcgagaagctgcaggaacgccttgccaagcttgctggcggcgttgccgtgatcaaggtcggcggcgcgaccgaagtcgaggtcaaggagcgcaaggaccgcgtcgacgacgctctccacgccacccgcgccgcagtcgaggaaggtatcgtcccgggcggcggtacggctctgctctatgccaccaaggctctcgaaggcctcaagggcgccaacgacgaccagaccaagggcatcgacatcgtgcgccgcgcgatccaggccccgatccgtcagatcgccgcgaacgcgggtcatgacggtgcggtcgtctcgggcaacctgctgcgcgagaacgacgagaaccagggcttcaacgccgcgaccgacacctacgagaacctgaaggccgccggcgtcatcgacccgaccaaggtcgtgcgcaccgcgcttcaggacgctgcctcggtctcgggcctgctgatcaccacggaagcggcgatcagcgagaagccggacgacaagcccgcgatgccgccgatgggcggtggaatgggcggcatgggcggcatggacttctaagtc

SEQ ID NO: 34550 - DNA, 282 bp, Sphingomonas aromaticivorans
atgactttccgtccgctgcacgatcgcgtgctcgtacgccgcgtcgaagccgaggaaaagaccgccggcggcatcatcatccccgacagcgccaaggaaaagcctgccgagggcatcgtcgtcgccgttggttcgggcgcccgcgccgagaacggcacgatcaccccgctcgacgtgaaggccaatgatcgcgtgctgttcggcaagtggtccggcaccgaagtcaaggtcgacggtgaagacctgctcatcatgaaggaatcggacatcctcggcgtgatc

SEQ ID NO: 34551 - DNA, 1284 bp, Sphingomonas aromaticivorans
ttgcgcatcgcgctggccggacttggcacggtaggcggcggagtgatccggctgatcgaggcgaacgccgatctgatcgcgcgccgcgcgggccggccgatagtcattaccaccgtcagcgcacgcaatcgcgacaaggaccgcggcttcgacgtgtcgcgctatgcctgggaagacgacatggtcatcctcggcgagcgtcctgacgtggacgtcgtggtcgaactcgtcggcggcgccgatggccccgccttggcgctcgcccggaccacgttcgaggccggcaaggctcttgtcacggccaacaaggcaatgatcgcgcaccacggcgtggaacttgccacaaaggcagaagccgccaaggtggcgctgaaattcgaggctgcggtcgctggcggcatccccgttatcaagggactcaaggaaggcgtcgccgccaacgagatcgcacgggtctatggcattctcaacggcacctgcaactacatcctctcgacgatggaagacaccggccgcgatttcgccgacgttctcgccgaggcgcaggccaagggctatgccgaagccgacccgaccttcgacatcgacggcatcgacgccgcgcacaagctttcgatcctttcgtcgatcgccttcggcacggcggtggacttcaagcccgtggccgcgaccggcatccgccgcgtccttgccgccgacatcgcgcaggcagatgtgctcggctactatatccgcctgatcggcatggccgagacggaaatggacgctgcgggcaaccgccgcctgttccagcgggtccacccgcacctcgtccatcgcgaccatccgctcgcccatgtcgacggcgcgaccaatgcggtcgtcgccgagggcaatttcgtgggcaggctgctgttccagggcgcgggggccggcgatggtccgaccgccagcgccgtggtcgccgatctcatcgacatcgcgcgcggcgacatcggcgcgcccttctcgatcccggtcgcggaactggaaagggcagctccggccgaaaccggccaccgcaggggcaaggcctatatccggttcaacgtggccgatcgtccgggcgtgctggccgaaatcaccgccgccatgcgcgacgccggggtatcgatcgagagcttcatccagaagggtgggcaggacgatgcaccggtcatggtgtcgatggtcacgcacgaaggcccggaaagcgccatcgccgaagcactgcgccttctcgatggctcgcccgtcctggccgagccgccgctggtcatgcacatc

SEQ ID NO: 34552 - DNA, 1059 bp, Sphingomonas aromaticivorans
atgagcctcaacagcttcggtcacatcttccgtttcacaacctggggcgagagccacgggccggcgcttggcgccgtggtcgacggttgccctcccggccttgcgctgaccgaagcgcagatccagccttttctcgacgcccggcgccctggccagtcgcgcttcaccacgcagcggcaggagccggatcaggtgcgcatcctgtccggcgtgttcgaaggccgcaccaccggcactccgatcagcctgatgatcgagaacgtcgaccagcgttcgaaggactatggcgatgtcgccaaggcctatcgccccggccatgccgactatgcctatgacgccaagtacggctttcgcgactatcgcggcggcgggcgttcctcggcgcgggaaacggctgcgcgcgtagccgcgggcgccgttgcccgcctcgtgatcccggaagtctcgatcctggcctgggtcagcgagatcggcggtgaccgcatcgacatggaccatttcgatgcggcagagatcgcccgcaacccgttcttctgcccggattcctgggccgcggcccgttgggagaagctggtcgacgatgcccgcaagtctggctcctcgctcggcgcggtggtcgaatgcgtcgcaaccggcgtaccggccggctggggcgcgccgctctacgccaagctcgatgccgaactggcccatgcgatgatgggcatcaacgcggtcaagggcgttgagatcggcgatggctttgccgccgcgcgcaataccggcgaaggcaatgccgatccgatgcggccgggcgctggcgttccggaattccttgccaaccatgccggcggcatcgcgggcggcatatccaccggccagccggtgacggttcgcgtggcgttcaagccgacttcgtcgattctcacgccgatgcccacgatcacgcgcgagggcgaggcgaccgagttgctgaccaaaggccgccacgatccctgcgtgggcattcgcggcgtgcccgtggtcgaggcgatgatggcgctcgtcctggcggaccagaaactgcttcaccgcggccag

SEQ ID NO: 34553 - DNA, 1197 bp, Sphingomonas aromaticivorans
cttaccctctacatcctgatcggcatgctgcttggcatcgtcgtgggctatgccctgaacaccgcctatcccaagggtgacgagacgctcgcctacaccgccgacacgctcaagctcctgcccgacgtgttcttgcgcctgatcaagatgattgttgccccgctggtcctggcgaccatcgtcaccggcatcgccagcatgggagacagtgcggcgctgggccgcatcggcgggcgctcgctggcgtggttcatcaccttcagcttcgtctcgatcagtctcggcctcttgctggtgaacctgctgcgcccgggggtggggctggaactcacgccgaccggtgagcttggcgaactcgccaccggcgacttcacctttcgccatttcgtcctctcggtgttcccggccagcccgatcgaggcgatggccaagaacgacatcctgcaggtcctcgtcttctcgctcttcgccggcatcgcgctgtccgccgtgggcgagaagggcgcgccgctggtgcgcggggccgaggcgctggcgcaagtcatgctgaccgtcaccggctatgtcatgcgctttgccccctttgcggttttcggcgcgatctcctcggtcatcgcggtgcgagggcttggcatcatcgtcacttacggcaagctcgtcggttcgttctatcttgcaatgctgatcctgtgggtcgtgctgctgagcgcgggcgcgatcttcctgcgcggacgcatcttcacgctgattcgctacatccgcgaaccgctgctgctggcctattcgaccgcgagctcggaagccgcgctgcccaagctgttcgagcagctcgaccggttcggcatcccgcgccgcatctcgggcttcgtcctgccgctgggctacagcttcaatctcgacggctcgatgatctacaccagcttcgccgcgatcttcatcgcccaggcctatggcatcgagcttccggtcacgagccagattgtcatgctgctgaccttgatggtcacgtccaagggcattgccggcgtcccgcgcgccagcctcgtcgtgatcgcggcgacgctgaaccagttcggcctgccggtcgaaggcatcgccctggtgctgggcgtggaccatttcctcgacatgggccgctctgccaccaacgtcgtgggcaatgccgtggcgacgtcggtcgtgaccaagtgggaaggc

SEQ ID NO: 34554 - DNA, 726 bp, Sphingomonas aromaticivorans
atggccagaatcggaatcatcggcagcgcggggcgcatgggcaatgcattgcaggcggcagtggctgcggcagggcacgactttgccggcggcatcgacaagggcggagatccgcttgaactggcaaaggccagcgacgtgctggtcgacttctccgcacccggcgcgctcgagttcaatctcgacgccgcaatccatgcaggcgtgccgatcgtggtcggaacgacgggtctcgaggaacgccatcactggctgatcgatgcagccgcagtcagcgtgcccgtgctgcagaccggcaatacctcgcttggcgtcacgctgctggcccatctcgtgcgcgaggccgccgcgcgccttggcgaggactgggacatcgagatcgtcgagacccatcaccgcatgaaggtggatgccccgtcgggcaccgcgctgctgctgggcgaagcggccgcaaaggggcgcggcgtcagcctggccgaggaggccgttcgcgggcgcgacggcatcaccggtgcgcgcaaggctggcacgatcggctttgccgccctgcgcggcggatcggtcgcgggcgaccattcggtccacttccttgccgacaacgagcgtttgaccttctcgcatcttgccgagaaccgcgcgattttcgccaagggcgcgatccgggcagcgcagtggctgctcgatcaggagccgggtcgctacacgatgcccgaagtcctcggcctc

SEQ ID NO: 34555 - DNA, 1002 bp, Sphingomonas aromaticivorans
cccgcagaccaccccactgttctcaccggcaaggtcggggtgcttctggtcaacctcggcacgcccgatgcgcccgatgcgggcgcggtgaagcgctatctcaaggagttcctgtccgaccgccgtgtggtggaaattcccgcgctcgtctggcagccgatcctgcgtggcatcatcctgaacacgcgcccccggaaatcagcgcacgcctacgcccaggtatggacggatgagggatcgccgctggccgcgatcacggccgcgcaggcacgcgcgcttcaggcacggctgggcgaaagcgcgatcgtgcggcacgcaatgcgctaccaatcgcccgccatggcgaaagagctggacgcgctgctgcaggccgggtgcgagcgcattctcgtcgcgccgctctacccgcactattcgggggcgacgacggcttccgcgctcgatgcggtggcagactggatcaaggcgcgtcgccgccttcccgcactgcgcaccctgccgccttatcacgacgatccggcctatatcggcgcgcttcacgccgacctctcgcgccagatcgacgctctcgacttcgcgcccgaactgctgctgctgagttatcacggcatgcccgaacggacgctgcacttgggcgacccctaccactgccactgccgcaagacctcgcgcctgctgggcgagcgttttgcgcagagcaatccggcgctgcggctggagaccacgttccagtcgcgtttcggcaaggcaaagtggctcgagcctgcaaccgatgccgtgctggtcgacgaagctcgcaagggcacgcgccgcatcgccatcgccgcgcccgggttttccgccgattgcctggaaacgctcgaggaactggcgatccgcggcaaggaagatttcgtcgcggcgggtggtacgcacttcgcctcgctcgcctgtctcaatgcgggcgacgacggcatggacatgatcgaggcgctggtccggcgcgagctttcgggctggatc

SEQ ID NO: 34556 - DNA, 1338 bp, Sphingomonas aromaticivorans
atcctgcgcgaatacgacattcgcggcgtcttcggagagacgttggaggtggaggatgcgcgcgccgtggggcgcagtttcggaaccatggttgcgcggcgcggcgggcatcgggtggtggtcggccgcgacgggcgaaccagttcgccgctgctggaacatgcgttggtcgaaggcctcgtcgccagcgggatcgacgtcgtccggatcggcgtggggcctacgccgatgctctattacgccgaagcctcaatgccagaggtacaaggcggcgttcaggtaaccggcagccacaatcccgccgatcacaacggcttcaagcttgtatttgaagggagtgcgctgttcgggaccgatatattcgatctcgggcggttggccggtgaaggcgactggatttcggggagcggccgcgtcgaggaggccgacgtcctgcccggctatgtcgagcggctgttgcagggactggacggcgtcgatcgggcggctctctccgtcctgcggatcgcgtgggatgccgggaacggtgccgccggtcccgccatcgaggcgctggtcgcccggctgcccggcgagcatgtccttcttcacacgattgtggacggccattttcccaaccatcatcccgatcctacggtcgaggcgaacctctccgatctgcgcgaagctgtcgcgcgcggaagcctcgacttcggactggcattcgacggtgacggagacaggatcggcgcgatcgattccaccggacgagttgtctggggagatcaactgcttgccatctttgccgaggacttgctgcgaaaccgcccgggcgcgacggttatcgccgacgtcaaggcaagcagcgccttgtttcacaggattgccgaactgggcggcaggcccgaaatgtggaagaccgggcactcgctgataaagtccagaatgaagcagactggcagtccgctggccggcgagatgaccggacacatctgttttggtgatccctactatggctttgacgacgcgatctatgcggccgtgcagctcatggcggccacggtcagactcgggcggtcgctgaccgaattgcgcgacgccatgccggagatgaagaatacgccggaactgcgcttcgccgcgccgccggggcgaaggctggccgtggtagaggaagtgctcggtcgcttgcgtgccgccggggcaagggtgaccgacatcgacggtgcgcgggtcgatacgcccgatggctggtggttgctgcgcgcctcgaacacgcaggacatgctggtcgtccgtgcggaaagccgcagcgaggagggtctcgcgcggcttctggcacaagtcgatgcgcaactc

SEQ ID NO: 34557 - DNA, 1428 bp, Sphingomonas aromaticivorans
ggaatgctcatcgggatcgacctgggaaccaccaacagcgcggtggccttgtggcatgagggcgaggcacggctcgtgcccaattcactgggagcgctgctgaccccgtcggcggtttcggtgctgcaggacgggacgacgcttgtcggcgcggcggcattcgaacgcatggccgcgaaggatggcgcggcggctaccagcttcaagcgcctgctgggcaccgaccgcaaggtgcgccttggccgcaaggagttctcggcggaagatctctcggcgctggtcctgcagtcactgtgcgccgacgtcgaggcgcataccggcgagcggccgaccgaggcggtgatcacggtccccgcctatttcaacgaccgccagcgcaaggcgacgcgccgcgcaggcgaactggcgggcctctccgtgcggcgcctgatcaacgaaccaaccgcagccgcgctggcattcggcctgaaggacaaggcggagcgtgaaccctttctggtcttcgatctcggtggcgggacgttcgatgtctccatcgtcgagatgttcgaaggcatcgtcgaggtccgcgcctcggcgggcgacaaccggcttggcggcgatgatttcaacggtgcgctggcgatggcggtcaaggggcggctcgatcccgacgaaagacttgcgaccctgggcgaggcccgcgcgcaggcgctgctgctgcaggcggccgaacggaccaggcgtgccctgaccgatgcaccggaggccgagttcgccgtgaccgccggcgacgaacggctttcgaccaccgtcaccgccagcgagttcgaggcgcaggccgagggcctgctgcgccggttgcgcgacccggtcgtgcgggccctgcgcgacagccagatcgatgcggcgtccctcagcgagatcgtgcttgtcggcggggcgacgcgcatgccgctggtgcgcaaagcgataacccggttattcggccgcttccccaatgcgtccgtccacccggaccacgcggtcgcccttggcgccgcgatccagggcgggctgatcgcgcgcgatggcgggctggaggaaatccggatcaccgatgtctgccccttcacgctcggcatcgagacggcggaacactctgtgcggggcacgatccagcagggcctgttctcgccgatcatcgagcgcaataccccggtgccggtcagccgctcgggcgtctacagcaccatgggcgacgggcagaagcagatcgcggtgcacatctaccagggcgaggcgcgcgaggtttcgggcaatgtcaaactcgggacgctgtccgtcccggtgccgtcccggcccgctggcgaggtgtcgatagacgtgcgcttttcctatgatagctccggcctgctcgaagtggacgttgaggtgccgctgaccgggacgaggcacaacctcgtcatc

SEQ ID NO: 34558 - DNA, 1230 bp, Sphingomonas aromaticivorans
atcgtgatgaaattcggcggcacttcgatggccggcaccgagcgcatccgccgcgtggcgcgcatcgtgcagcgccagcaggcggcagggcacgaggtggcggtggtcgtctctgccatggcgggcgagaccgaccgcctcgtcaacttctgccgcgaggcgaacccgctctacgatccggccgaatacgacgtggtcgtggccagcggcgagcaagtgacgtcgggtctcctggcgatgcatctccaggcgctgggctgcaaggcgcgctcgtggctgggatggcagctgccgatccacaccgacgacgcgcattcgaaggcgcgcatcgaaggcatcgattcggaagcgctgcttgccagcatgggcgcgggcgagatcgcggtgatcccgggattccagggccttaccgccgacaaccgcgtgaccaccctgggccgtggcggttccgacacttcggccgtggcagtggcggcggcggtcaaggccgaccgttgcgacatctacaccgacgtggacggggtctacaccaccgatccgcgcatcgtggccaaggcccgcaagctcaagaacgtgacctacgaggaaatgctcgaactggcctcggtcggctcgaaggtcctgcagacccgctcggtcagccttgccatgaaggaaggcgtgcgcgtgcaggtgctttcctcattcatcgacgacgacgccccggcggcggacacgatccccggcacgatgatcgtttccgacgaggaacttgaaggattggatatggaacgccagctgatcaccggcatcgccgccgacaagaacgaggcgaaagttaccctgacccgcatcgcggaccgccccggcgcggtcgcggcgatcttcggcccgctggccgcggcgaacatcaacgtcgacatgatcatccagaacatcgccaaggacaagggcgagaccgacgtcaccttcacggttccgatctcggacctcgcccgtacccaggcgctgcttgaagagcgcaaggacacgatcggctactaccgcatgctggccaacagcaaggtcgccaagatcagcgtcgtcggcgtcggcatgcgcagccacgccggcgtcgccagcaccatgttccgcgccctggccgaccgcggcatcaatatccaggcgatcaccaccagcgagatcaaggtctcggtgctgatcgacgaggacgagaccgaactcgcggtgcgcgtgctgcacaccgcctac

SEQ ID NO: 34559 - DNA, 852 bp, Sphingomonas aromaticivorans
atgactgctgccgttattgacggaaaggcctttgccgccacgctgcgcgggcgcgtcggcgaccttgccactgcattcgaggccagggccggtcgcaaggcggggcttgccgtggtgctggtgggcgaggacccggcgagccaagtctatgttcgctcgaagggcaagagcacgctcgaagcgggcatggcaagcttcgagcacaagcttcccgccgacaccgccgaggccgacctccttgccgtagtggagcagctcaacgccgatccggcggttgacggcattctcgtccagcttcccctgccccggcacatggacgagcagaaggtcatcgccgcgatcaatcccgacaaggacgtcgatggcttccacgtgatcaacgcgggccgcctcgccgtcggccagccgggcttcgtgccctgcaccccgcttggctgcctgatgttgctaaaggaccgactgggcgacctttccggcctcgatgccgtggtaatcggccgctcaaacatcgtcggcaagccgatggcgcagttgctcatcgccgaaagctgcaccgtcacggtcgcgcacagccgcacgaagaacctcccggaagtcgtgcgccgcgcggacatcgtcgtggcagccgtaggccgccccgagatggtcaagggcgactggatcaagccgggcgcaaccgtgatcgacgtcggcatcaaccgcgtcccgggcaaggaagaaggcaagacccggctggtcggcgacgtcgactatgcgtccgccgccgaagtcgcgtcggccatcaccccggttccgggcggcgtcggcccgatgaccatcgccgtgcttctgcgcaacgcgctggtcgcggcc

SEQ ID NO: 34560 - DNA, 861 bp, Sphingomonas aromaticivorans
ctgaccgaggcgctgccctatctccagcgctatgcgggcaagaccttcgtggtgaagtacggcggccacgcgatgggcgatcccgaactcgcgcaggacttcgccgaagatatcgtgctgctcaaggccgtgggcatcaaccctgtcgtggtccacggcggcgggccccagatcggtcgcatgctcaaggcgctcggcatcgaatcgcggttcgtcgacggcctgcgcgtcaccgacaagcaaacggccgaagtcgcagaaatggtcctcgccggcgcgatcaacaaggaactggtaagctggatcgcccgcgcgggcggcaaggccatcggcatttccggcaaggacgggggcatggtcatcgcccgcaaggtcgaggccaagaaggcgcccaaggccgtggccgatgctgaaagcggcgatcccatcgtcgtcgacctcggcttcgtgggcgagcccgaccggatcgacacgaccgtcatcgacacgatctgcaaggccggcatgatcccggtcatcgcccccatcggcgttggcgaggacggcgagacgtacaacatcaacgccgacacgatggccggctccatcgccgccgcgctgggcgccgcgcgcctgttcctgctgaccgacgttcccggcgtgctcgacaaggacaagaacctgctcaccgaccttcgccccgccgacatcgcgcggctggccgaggacggcacgatcagcggcggcatgatcccgaagctggaaacctgcgtccacgcggtcgaggcgggctgcgaggcaaccgtcgtgctcgacggccgcgtgccccacgcgatgctcctcgaaatcttcacggcgcgcggcgcgggcaccctgatccgc

SEQ ID NO: 34561 - DNA, 2571 bp, Sphingomonas aromaticivorans
actccgatgatggcgcaatatcttgcgctaaaggaccaggctggcgactgcctgctgttctatcgcatgggcgacttcttcgagcttttcttcgacgacgcgaaggtcgccgcacaggttctcgacatagccctcaccagccggggcgagcatggcggcgcgcccattccgatgtgcggcgtgccggtccattcggccgagggataccttgcccggctgatcaaggcggggtgccgcgtcgccatcgcggaacaggtggaaacccccgaggaagcgaagaaacgcgggggttccaaggctctcgtcgcgcgcgacatcgtccgcttcgtcacggccgggacgctgaccgaggaggcgctgctcgaaccgcgccgggccaacgtgcttgcggcggtgtgcgaagtacgcggcctcatcggcatcgccgcctgcgacatctcgaccggccggatggagctggaggaatgcgccgccgaccagattggcgcggctcttgcccggcttggtgcgagcgagatcgtcgcacccgattcctgggatgaccggcccttcgattgcgttccgcgtccgaatcggaccttcgccagcgaagagggcgaagcgcgactcaaggccgtgcacggcgtgtcgaccctcgacggcttcggccagttcacccgggcgatgctctcggcggccggcgggctggtcacctacctcgaccatgtcgggcgcggcgcgctgccgctcctgctgcccccggtggcgcgggaagcgggcacccacatggcaatggacgaggccacgcgggcaagcctcgagatcctgaacagttccaccgggacgcggcggggcagccttgtcgaggcgatcgaccgctgcgtcacgggcgccggcgcgcgcctcctggcggaagacctctccgcgccgctgaccgacgcacgcgcgatcaaccgccgcctcgaaatggtcagctggctccacgacgatccgctgctgaggggcgacatccgcgccatcctgcgctcgctgcccgacgtcgggcgtgcgcttggccgcgtcgtcgcggggcgtggaagccctcgcgatctcgggcaattgcgcgacggcctgtccgaagcgcggcggctgcacggtctgctgcacgctcgcgctgaccggcccgaaccggtccacgcgctgctcccctcgctcgccggccacggcgcactttgcgacctctatgcccgtgcgctggtccctgcccctccgaccgaaaggtcacaggggggctacatcgccgagggctacgacgcggcgctcgatgaactgcgccgcatatcgggcaacgcccgccgcgcgattgccgcgctggaggccaagtaccgcgacgacaccgggatcactgccctcaagatccgccacaacggtgtgctcggctatttcatcgaggttcccgcaaagcacgccgaccggttgatggcgcccgattccggtttcacccatcgccagaccatggctggagccgtgcgtttcaacgcactggcgctgcatgaggaggcgagccgcatcgccgagagcggcggacacgcgctggcagcggaagaagcacacttcgaggacctcgtcggccacgcggtgcgcgcgaaggaggcgatcgcggccaccgccgccgcgcttgcgcgcatcgacgtcgccgccggtcaggccgaacgcgctgccgaaggcggctgggccctgccgcgcgtggtagacgagccttgtctcgaaataagtggcgggcgccatccggtcgtggaagcggcgcttgccgccaagggcgagcgctttgtcgccaacgactgcgcgctcgggccgcaggaccggctgtggctggtcggagggcctaacatgggcggcaagtccacgttcctgaggcagaacgcgctgatcgtactgctcgcccaggcaggcggcttcgttccggcacggtcggcgacagtgggcctcgtcgaccgcctgttcagccgcgtcggcgcatcggacaatctcgcgcgcggccgctcgaccttcatggtcgagatggtcgagacggcagcgatcctcagccaggcaacggaccgcagcttcgtcattctcgacgaagtcgggcgcggcacttcgacctacgacggactcgcgctcgcctgggcggtagccgaggcggtccacaccatcaaccgctgccgctgccttttcgccacgcactaccacgaactcgcccgcctcgccgaaagctgcgacgccctctcgctccatcacgtccgcgcgcgcgagtggaagggcgacctcgtcctgctgcacgaactggccgatggtccggccgacaagtcctacggccttgccgtggcccgcctcgccggcgttcccgcgcccgtgatcaagcgcgccaagtcggtgctggagaagctggagaaaggccgcgccgccaccggcgggctggcggccgggctcgacgacctgcccctcttcgccgccgccatcgaggccgccgaggaaaaggtcgatgcccttcgcgaacgcctcaacggcctcgacatcgacgcactgtcccctcgcgaggctctggacctgctctacgaactgaaagcccag

SEQ ID NO: 34562 - DNA, 1383 bp, Sphingomonas aromaticivorans
ttttccgacctcggccttgccgaacccatcctgcgcgccctcgaaacgaagggctacaacgacccgacgccgatccagcgccaggccattcccgccctgctcgaaggccgcgaccttcttggcatcgcgcagaccggcaccggcaagaccgccgcgttcgcgctgccgtcgctccatcgccttgccgcgaacccgcagccacgcaagccggcctcgtgccgcatgctcgtcctctcgcccacgcgtgagctggccgcccagatcgcggacaacatgaagggctatgcccggaacctgaacctgatcgtcgattgcgtgttcggcggcgtgcccatcggcaagcaggcccgtcgcctggtgcccggcgtcgacattctcgtcgccacccccggccgcctgcttgacctgatcgacaaccgggcgctgacgcttggccgcaccgagatcttcgtgctcgacgaagccgaccagatgatggacctcggcttcatccatgcgctcaagcgcgtggcgaacctgctgcccaagacccgccagagcctgttcttctcggcgaccatgcccaaggccatcgaggacctcggcaagcagttcatcgtcaatcccgtgcgcgtcgaggtcgccccgaactcgaccaccgcagaacgcgtcgaacagtacgtcaccttcatcaaccaggccgagaagcaggcgctgctgaccctgcgcatccgcgatctgctcaagaccaaggaactcgaccgcgcgctggtgttcacccgcaccaagcacggcgcggaccgcgtcgtgcgccacctctcgtcggccggcatcgatgcccgcgcgatccacggcaacaagagccaggcgcagcgtaccgccgcgctcgaggccttccgccagggatcgtgcccggtcctcgtcgcgaccgacatcgcggcgcgcggcatcgacgtctcgggcgtgagccacgtgttcaacttcgaactgcccaacgtgcccgaacagtacgtccaccgcatcggtcgcaccgcgcgcgccggcgccgatggcatcgccatcagcttctgtgcgccggatgagaagccctatctcaaggacatcgagcgcctgaccagggtcaaggtcgacgccctccccctgcccgagaacttcaccgccgaagcggccaagctccccgcgccgagccgcaagccggccgagcaggagcaggacgcccgccgcgatgcgcgtgacgcgcgcggcaacggcggtcgcggcggacagggtcgcggccaggcccacggtggccgtgcccagggtcgcgacggccgcccgcgcgacgccagcccgcgccaggaccgccgcgaaggcgatcgcggtccggtgcgcaacccgctccacaccgaccgcaccgaccgcccc

SEQ ID NO: 34563 - DNA, 1704 bp, Sphingomonas aromaticivorans
cgttcgtcgctagtgctggtgattgccgccagcgtcctgctcaaccttctcgttttcgccggcacgatatacatgatgctggtctatgactcggtactgccgagccgcagcatcccgacccttgtcggcctgttcgcgatgatcgtgctggtctacctgttccaggccctgttcgaggccattcgcggcgaggcgatgctctcggtcgccaatggcgtgcatgacgatctctttgctgccgtccaccacgccacggtttcgcgccccctgcgcgccgccgccgacaagggcgacggtcttcagccgatccgcgatctcgatgcgatccacacgttccttgcggggccggggccgacggcgctgatcgacctgccgtgggtaatcgtgttcctcttcgtgctgactgcgttgcactggtggctggggctgacggcgctggtcggggtgatcgtgctgtccgcgatcgcgttgtggtccaaccggcggacggcgagtgcgacccggcaattgcagtcggtcatcggccagcggtccgcctcggcccaggccgagatccgcaatgccgagacggccgtcgccatgggcatgcaggagcgcctgctgacccggacgcgtggctgggaagcggattttctcgaatcgcaatcgcgcctgtcgcggcttgtctcgcggttcggcggggcggggcgcacgttccgcgtcttcctgcaatcgctgatcctgaccgtgggcgcgctgctggtgatcgacgacaaggccagcggcggcgtgattctcgcgtcctcggtgttgtccggacgcgcgctggcgccggtcgattcggcaatcgccaactggcgcggcctggtcgcggcaagcaccggctgggagcggatcgtccagctcatcaatgccttccagaaggcaccgccccgctcgatcgagcttggcgcgcccagcgccgaactctcgatccgcgacctgtgggtggccccgccgggcgtccagcgcatgaccgtgcagggcgcggccctttcgctcacccccggccaggcgcttgcgatcatcgggcctagcgcggccggcaagacctcgctgatgaaggccatgctcggcatctggcgcccgcagcggggcgaagtccgcctcgatggcgcgacgctcgaccagtgggctgccgaaagcctgggccgccacatcggctacgtgccgcagaccgtggaactcgtcgacggcaccatcggcgagaacatcgcgcgcttcgatcccgatgccacgtcggacggcgtgatcgcggccgcgcgcgcggcgggaatgcacgagacgatcctggccatgcccgacggctatgacacgcggctgacggggggcgggctggaactctccgccggccagcgccagcgcgtgggccttgccagggcgctttacggcgaaccgttccttgtcgcgctggacgaggccaattccaatctcgactcggcgggcgacgcagccctggccaaggcggtcgaggacgtccgcaagcgcggcggcatagttgtcatgattacccaccgccccgctacgctcgggccgatcagccatgtcgcggtcatggcgggtggccgcatcatcgaccttggcgagcgcgacgaggtgatgaagcggctcagcaccgccaaccccggcgagccgaaggacggccagaccgttgccgcccggacaggcccggccaaggtcggtgcc

SEQ ID NO: 34564 - DNA, 1185 bp, Sphingomonas aromaticivorans
gaccttcgcgaacgggccgcgaaggtcatccccaacggcatgttcggccatgaggccacgcatctcctgcctgcatcgttcccgcagttcttcagccgcgcgaagggcgcctacatctgggatgtcgacggcaaccgctatctcgatttcatgtgcgcctacggccccaaccttctcggctatggcgacgagctgatcgacgcggcggcgacccgccagcttgcccttggcgacacgatgaccggacccgggccggtcctggtggatctttgcgaaactctggtcgacatgatcagccatgccgactgggtcatggtgtgcaagaacggcaccgacgccaccacgatggccctgaccgcagcccgcgcgcagaccggcaagcgccgcgtcctcgtcgccgagggggcctatcacggtgcggcaccgtggtgcacgccgatgccgggcgggatcgtgcccgaagagcgggccttcatctcgaagtacaagtacaacgatgtcgccagcctcgaggccgccgtggccgcggccggcgacgatctcgccgcaatctttgcctcgccattcaagcacgatgctttcgaggaccaggccctgcccgacccggcctatgcccgccgcgcacgcgagctgtgcgaccagaccggcgccatgctgatcgtcgacgacgttcgcgcgggcttccgcctcgtgcgcgattgcagttgggaactggtcggcgtccgcccggatctcagcagttggggcaagtccttcgccaatggtcacccgatctcggcgctgcttggctcgaactcatgccgcgccggagccgaggcgatctatgccaccggttcgttctggttctccgccgtgccgatggccgccgcgatcgagacgctgcgcatcctgcgcgaaagcgattacctcgagcgtacgatccgtctgggcgagaggctgcgcgaaggtcttgcggcggcggcggcacgccatggcttctcgctgcgccagactggcccggtccagatgccgcagatcctgttcaacgacgatcccgatttccgcatcggctttgcctgggcagaggccatgctcgagcgcggcgtctacgttcatccctggcacaacatgttcctcaacggcgcaatgtccgagacggacatcgactttgccatcgaggcggcagatggcgccttcgcacaggtg

SEQ ID NO: 34565 - DNA, 590 bp, Sphingomonas aromaticivorans
agaaccagtcaatcccatcccctcctgatcgcgtccgtcgagccgtttcccggtttcggcagtatcggtatcaccttctgccctggcaaattccaaccggacgcaatgagcggctcgtgggcgcgcgatttagcctccgatctcgatgccgtccgtgactggggggccactgcgatcgtaacgctcgtcactcagcgcgaattgcagcgtctcagcgtgccaatgcttggtgctgaagtagtagcgcgccacatcgactggcaccacctgccaatcaaggattgcggcacgcccgatccctcgttcgaagctgagtgggaaaccgttggcgaagagcttcgcaaccgcctgcggaacggcttcaacgtgctgctgcattgcaaaggcggtttgggtcgagctggtacggttgccgcacgccttcttgtcgaacttgggtgggacgcaaacaaggccgtgagctccattcgcgaggttcgcccaaacgccatcgagacgctagatcagttcaaccacgttctcagtgcgcgccacgtgccagaatgccaacccgacaccagccttgatgccatgcgcgaccgggcggtggg

SEQ ID NO: 34566 - DNA, 969 bp, Sphingomonas aromaticivorans
atgcctcttcttgaagcccgcaacacctacaagccctttgaatatccctgggcctacgagttctggaagcgccagcagcagatccactggatgccggaagaggtgccgctgggcgaagactgccgcgactgggcgcagaagatttccgaacatgagcgcaacctgctgacgcagatcttccgcttcttcacccaggccgacgtggaagtgcagaactgctaccacgagcagtacggccgcgtgttcaagccgaccgaggtcaagatgatgctcgccgccttctccaacatggagacggtgcacatcgccgcctattcgcacctgctcgacacgatcggcatgcccgagagcgaatacggcatgttcctcgagtacgaggagctgaaggccaagcacgattacctgcagaccttcggcgtcgagacggacgaggacatcgcccgcacgctcgccatgttcggcggcttcaccgaagggctgcagctcttcgcctctttcgccatgctgatgaacttcccccgcttcaacaagatgaagggcatggggcagatcgtctcgtggtcggtgcgtgacgaatcgctgcactgcgaaggcatcacccgcctgttccacgcgttcgtcaaggaacgcggctgcctgaccaaggcagtgaaggaagacatcatcgactgctgccagaagacggtgcgcctcgaggacgcctttatcgatctcgccttcgaacagggcccggtcccggggatgagcgccaaggaaatcaagcgctacatccgctacatcgccgactggcgcctgtcgcagctcggccttcccgcgatctacatgatcgaagaccaccccctgccctggctcgccccgctgctcaacggcgtggagcatgcgaatttcttcgaaacccgcgccaccgaatactcgaaggccgccaccaagggcgactggaacaccgtgtggtcgagcttcgacaagcgc

SEQ ID NO: 34567 - DNA, 1791 bp, Sphingomonas aromaticivorans
cgcttcaccatcgtcaccgatgacagccgcgacgtgaacctcaccgatttcggcaaggatacgctggacgaccgctacctgcttcccggcgagaagtaccaggacctgttcgcccgcgtggccgatgcctatgccgacgaccaggaacacgcccagcgcctctacgactacatctcgaagctgtggttcatgccggcgacgccggtcctgtcgaacggcggcaccggacgcggcctgccgatctcgtgctacctgaactcggtcgacgacagcctcgaaggcatcgtcgccacctggaacgagaacgtctggctcgcctcgcgcggcggcggcatcggcacctactggggcaaggtgcgcggcattggcgaaagcgtcggcctcaacggcaagaccagcggcatcatccccttcgtccgcgtgatggacagcctgaccctcgcgatctcgcagggctcgctgcgccgtggctcggccgcctgctaccttgacgtctcgcaccccgagatcgaggagttcctcgagatccgcaagccgtcgggcgacttcaatcgcaaggcgctcaacctgcaccacggcgtgctgctgaccgacgagttcatggaagccgtgcgcgatggcgccgaattccacctgcgctcgccgaaggacggctcggtgcgcagcactgtcgatgcgcgctcgctgttccagaagctcgttgaaacccgccttgccacgggcgagccctacatcgtcttcaacgacaccgtgaaccgcatgatgcccaagcatcaccgcgacctgggccttaaggtctcgacctcgaacctgtgctcggaaatcacgctgcccacgggccgcgaccatctcggcaacgaccgtaccgccgtctgctgcctgtcgtcgctcaacctggaaacctgggacgagtggaacggcgacaagcgcttcgtcgaggacgtgctgcgcttcctcgacaacgtgctgcaggactacatcgaccgcgcgcccgacgagatggcccgcgccaagtattccgcggcgcgcgaacgctcggtcggcatgggcgtgatgggcttccactccttcctccagaagaagggcatcgcctttgaatcggcgatggcgaaggcgtggaacctcaagatgttcaagcacgtcgccgccaaggccgacgaggcatcgatcctcctcgcgcaggaacgcggggcttgcccggatgccgccgaaatgggcgtgatgcagcgcttctcgtgcaagatggcgatcgcgccgaccgcgtcgatctcgatcatctgcggcggcacctcggcctgcatcgaaccgatcccggcgaacatctacacgcacaagacgctgtcgggctcgttcgtggtcaagaatccgtacctgcagaagcttctcgccgacaagagcaaggattccaccaacgtgtggaactcgatcctcgagcacggcggctcggtccagcatctcgatttcctctcggtggaggaaaaggcggtctacaagaccagcttcgagatcgaccagcgctggcttctcgaattcgctgcggaccgcacgccatacatcgaccaggcccagtcgctgaacctctacatcccggccgacgtcgacaagtgggacctgatgatgctgcacttccaggcgtgggagaagggcatcaagagcctctactacctccgctcgaagtcggtccagcgcgcgggcttcgccggcggcgtcgaggcggacaacacggccgaagccccgaagatcgaactcgccacggcagagaccgactacgaggaatgcctggcctgccag

SEQ ID NO: 34568 - DNA, 1185 bp, Sphingomonas aromaticivorans
gaggcggacgacaacatccgcttcttcgatcaccgccgcgaatgggcgcggaccgatttcgagaacggcgggttgccgcgccacgaatgggaggccctgctggtcgaggcgacgcgccgcgcggatgccgccggccactggcgcttttccgcgcccaagaagtacggcggcaaggacggcaccaacctgtggatggcggtgatccgcgatcacttcgccgccagggggcttgggctgcacaacgatctccagaacgaacactcgatcgtcggcaacttccccttcgtgaacatgttcgagcatttcggcacgcccgagcagcaggacgaattcatcaacggcggctttgccagaacccgccgcaccgccttcggcctgaccgagccgcgccacgggtcggatgccacccacatggaaacgcgggccgtgcccgaaacgcgcgacggggttcccggctggcgcatcgatggcgagaagatgtggacgacgggaatgcacgtcgccacccactgcgccacgttcgcgcgcaccagcggcgcggacggcgatgcgcggggcatcacctgcttcctcgtgcccaacccgaccgaagggctggtgatcgaggaatacctgtggacgttcaacatgcccaccgaccacccgcgcgtctcgttcaccaatgtctgggtgccggacagcgcgatcctcgggccggtcggtggcgggctcgccatcgcgcaaagcttcgtccaccagaaccgcatccgccaggccgcttcgtcgctgggagcggccacgttctgcgtcgaggaatcggtgcgctatgcgcgcgagcgcaagcccttcggcgaggagctggcacgcaaccaggcgatccagttcccgctcgtcgaactggccacccagtgcgagatgctgcgcctgctgatccgcaagaccgcctgggacatggaccgcctcgaagccgaggaaggcgggcacaagcggatcgagcgcgagctgtcggacaaggtgtcgatgtgcaactactgggcgaaccggctggtctgcgaggcggcggaccgggcgatgcaggtccacggcggcatcggctattcgcggcacaagccgttcgaacacatctaccgccaccaccgccgctaccgcatcaccgaaggcgcggaggaaatccagatgcgcaaggtcggcgccttcctgttcggt

SEQ ID NO: 34569 - DNA, 1191 bp, Sphingomonas aromaticivorans
actgattatctctttacttccgaaagcgtttccgaaggacaccccgacaaggtctccgaccagatcagcgacgcgatcgtcgacctcttcctgtcgaaggaccccgaagcccgcatcgcctgcgaaaccctgaccacgacgcagctcgtcgtccttgccggcgagatccgctgcaagggcgtctacgagaacggcgagtgggctcccggcgcccaggacgagatcgagaagaccgtgcgcgatacggtcaagcgcatcggttacgagcaggacggcttccactgggaacgcctcgagttcatcaaccgcctgcacggccagtccgcccacatcgcgcagggcgtcgatgccgccgacaacaaggacgaaggcgccggcgaccagggcatcatgttcggctatgccaccgacgagacgcccgacctgatgccggcgacgctctactacagccacaagatcctcgaacgcatggccgccgatcgccactcgggcgcggccccgttcctcgagcccgacgccaagagccaggtcaccctgcgctacgaaggctcgctgcccgtcgccgccaccgcggtcgtcgtctcgacccagcacgcccccggctatgacgaaggcggcaaggaagccgagcttcacgaatacgtgaagcgcgtggtcgccgaggtgatcccaccggtcctgctgcgcgagacgaagtactacatcaacccgactggctcgttcgagatcggcggccccgacggcgacgccggcctcaccggccgcaagatcatcgtcgacacctatggcggcgcagcgccccacggcggcggcgcgttctccggcaaggacccgaccaaggtcgatcgctcggccgcctacatcacccgctacctcgccaagaacgtcgtcgcggccggtctcgcaacgcgctgcacgatccagatcgcctatgccatcggcgtgtccgaaccgctctcgctctatgtcgacacgcacgagaccggcacggttggcgacgacaagatcgagcaggcgatcctcggcattgccaagctcggcggcctcaccccgcgcgcgatccgcacgcatcttggcctcaacaagccgatctaccgcccgaccgcggcctacggccacttcggccgcaaggcggacggcgacttcttcccttgggaacggctcgacctggtggacgatctgaaggccgct

SEQ ID NO: 34570 - DNA, 657 bp, Sphingomonas aromaticivorans
gaagcgcgcgcctatcgcaagggcgacgtggtgttcgagaagaacgatcccggctcctcgctcttcgccattgcctcgggttccgtccacgtgcggctcgacccgaaggacccgtcgaaggtcattccgatccccgcaggcacgatcttcggcgaggtcggcctcatctccgggcgccggcgcggcgccacgatcgtcgcggccgaggatgccgtctgcgtcgagatcagccgcaacgccgcgctgaaactgcaaagccaggtgcctacggccaagcgcacgatcgagcgcatctcgaccgagcgccagatcctgcagatgttcggctcgggcctgaccagcgccgacattgccgaagtggtggagacgtcaaagatcgtccaggtccgcgcaggcgacgcgatcatcaaggaaggcgacgaggacaaggacatctacgtcatccgcgtcggctcgatgatcgtggaaaaggaagtcggcggaaagccggtgttcctgtcctacctgccggccgggtcctatgtcggcgaaatggcactgatcgatggcggacggcgcaccgcgacggtgcgggccgcgatcaagagcgaggtcatccgcattgatggcgacgcgttcggcagggtgctggcggcaaagccagcgctgctcgaccgc

SEQ ID NO: 34571 - DNA, 975 bp, Sphingomonas aromaticivorans
atgaacagcttcagttttcacggcggcaggttggccgatgccatggcgcagttcggcatgggcaaggcgccgtggatcgacctgtccaccggcatcaatccgcatggctggcccggcgcggacaatctggcagtggactggcaggcgctgcccgacaccggcgcgctgaacgatctggaggccgctgccgccgcctgtttcggcactgacccagcccatgtctgtgccgtaccaggcacggagatcggcctgcggatgctgggtgacatcctgcccggcgctgccatccacgcccagcccagctatcgcacccatggcgaaatgattccccgcagccgccccgtagccctgaccgagctgaccggaacggaggaggcgaccatcatccttgccaatcccaacaaccccgatggccggatcatgtcgcctgccaccctgcttggctggctggcggcgcggcgcgacagcgcagcgtggctggtcgtggacgaagcctttgccgatgccgccccgcacagcagccttgccgcccatgtgcaggacggacagcggctgattatcttccgctcgttcggcaaattcttcgggctggccggggtgcggctcggctttgtgctgggaccgcgcgcgctgatcgcgcaatatcggcagcggctgggcagttggccgctatcggcagcggcgctggccatcggcacagcggcatatcaggatgtggactggacagccgccatgcggatggccttgcgtgaacaggcggatgcgctggacgcggtgctggcgcggcggggctacagcgcgataggtgcttgcccgctgttccggctgatcgaaacggacgatgccgccgcgctgttcgaacgccttgcgcgccattccatcctgacgcggccgttcgattacgatccgcgctggctgcgcctgggcctgcccgccgaccgacaggcgctggatcgccttgatgcggcgctggct

SEQ ID NO: 34572 - DNA, 3279 bp, Sphingomonas aromaticivorans
atgcacgtcattttccgcgaaacgcacgggatggaggaaaccgccgtcccgcaggatctggggcaagagcccgcggatcttgtggtcctgtccttttcggacagcgatctgggggcgttcgcggcggcatggcatcaggcccgtgcagacgatgcgacatttccttcgctgcggctcgccaatctggcggcgctgatgcatccgctgtcggtcgacacgtatgccgagcggacgctgtcgggcgcaaaggcgatcctgatccggctgatcggcggcacgccctattggagctacgggctgcaacaggtcgaggcgctggcccggtcgcgcgggatcgtgctggccgtgctgcccggcgacggctttgaggatgcgcggctggatgcggcctcgaccgtgccggtgaccgcgttgcgcgaacttgcgcagtggtgcgatgctggcggtgcaagggcggcgcaggcggcgcttgccgcgctgtcgcagctggcggggctgattgatgcccccgcccggacattcgatccgctgctgatggcgggaggctggcatcccggccggggcgtgatcgatcttgaagcctttgcgcgcgatcccgcaaggccgctggtcctgatcgtgttctatcgttcttacctgaccgcccacgatctggacccgtttgccgccctgcataccgcgttcgagcagcgcggtttcgatgcattgtcgatcttcgtcccctcgctgaaagccccgcaggtgcgcgaacaggtggaccgctgggtgcgcgggcttggcccggcagcgatcatcaacgctaccgctttttccgcgcggggcgatgacggcgccaccccgcttgatggcgcgggcgttcccgtgtttcagctggcgctggccacgtccgggcgcgcgggatgggcagcggcttcgcgcgggctttccccggcagaccttgccatgcacgtggtcttgcccgaaattgacgggcgggtgtttgcaggcgtcgccagcttcaaggaggcggggacgcgcgatcccgcgcttggctttgcccgcaccatccatcgcgccgatgcaggccgggttggggcgatcaccgcgcgggtggcgggctggatcgcacttgcccaaacgccggttgcagaacggcgggttgcgctggtcctgtctacttatcccggcaagacataccagatggcccacgccgtggggctggatgcgctggcttctgccgaggcgatcctggccgatctggccgaggcgggatatgccactgacgcgcaggccggactggcagcgctccttcaatgcacacatcagcactggccgatggcagagtaccgcaaggctttggcagcactgcccgataccctgcgcgctgaacttttcgccgcatggggcgagccggaagccgatgctgccgccgccgatggcgcgttccgttttgccgcgctgcccatcggcaacgcgctggtagccttgcagcccgaacgcggcgaacgcgcccatcgcgacggcgactatcacgacctgtcccgctgcccgcgccatggctatgtggcgttctacctgtggctgcgccagcgaagcgtggacgcgctggtgcatatcggcgcacatggcacactggaatggctgccgggcaaatcagtcgcgctgtccgatgcttgctggcccgaggcgctgaccggcgcgatgccggtgatctatccgttcatcgtcaacgatcccggcgaagcggcgcaggccaagcgccggatcagcgcggttacgatcgggcacgttcccccgccactggtgcaaacgcaaagcggtgcggggctggcccggatcgaggcgctgctggatgaattctccaacgctggcgggctggacccggcccgccgcgaccgtctgcaagtgaacatccgcgacgaagcgcgcgtgctgggacttgaggcggaactgggccttgatgacgcggccacgctggtcgaggcgatcacccggatcgaccgcttcgtttgcgatgtaaaggacagccagttcggtgacgggctgcatgtgttcgggcggggagatcagggcgcagccgagcgggccggattgctggcggcactcgacggacgccgcgttccgcccggtccctccggctccccctttcgcgggcgcagcgatgtgctgccaaccgggcgaaacctttatgcgatagacccgcgcgccgtgccttcacgcgcggcccatgcccaaggggtgacactggcagaggagctgatccggcggcatctgcaggatcacggcgattatccgcgcgggctggtggtcgatctgtggggatcggccacgatgcgcacggcgggcgaggaattcgccatggcgctgcacctgctgggcgcaaagccgctgtgggacaccgcgtccgaacgggtaacaggcatcgaaatcctgccgctggcgctgctggaccggccgcgtatcgatgtgacgttgcggatttccggcctgttccgcgatgcctttcctgcgctgccgatactgtttggccaagcggtgcgcgcgctgtgtttgcgcgatgaaccggcggactggaacccgtttgcagggcaggctgcggcaccgcgcgtctatggcccggcccccggcagctatggactgggtcttggcgatgcagccgaggtctatactgaagcggcccggcgcgctgctggtgaggcatggctggcggcatcggaccatgcgtttgacgcagcctccgatgcgatcggaacctttgccgatcctgccggcctgcgccagcgtgttgaaggagcggacgcctttgtccatcttcaggacttgcccgaaaccgatctgctgctggccgccgattatgccgcgcacgaggcgggctttgccgctgccaaggcgctgatcggtggttcggcggcgctctaccacctcgacaatcgcgatccggggcgcaccgttgcgcgcaccctgaccgaagagatcgcccgcgtggtccgcgcccgcgcggcgcacccaggctgggtggcgggcatgatgcggcacggctttcgcgggggggcagaactggccgcgacgctggaccatatgggtgcctttgcgcacctttcaggcagcgtaccgccgcatctgttcgacctttatcacgacgcgacactgggccagaccgatgttcgcgcatttcttgaacgcgagaatccggctgcgctggcggcgatggaagcccgctttgccgcgctccatgccgccgggctgtggcagacccggcgcaattccatcctcgccagcctgccaaggcttgaggacagg

SEQ ID NO: 34573 - DNA, 606 bp, Ferroplasma acidarmanus
gttataagatattctggttacacttctaatagtgatgatatggagaatttatttcaatatatatacagtaaagagagtcgggtagattttcttgtcaacaatgcaggaatctatttttataaagatatagaaaattcatctttacaagattttaataatatagtatctgcaaatattttaggggagtttaacatgacgaaatattgcactaaattattgaaaaattcaacacacccatcaattgttaatatagcttcggtctcaggtcagagaacagaagaagggcatacgctttattctactactaaaggagcaactctagcttttactaaggcacttgccgctgattttggaaaatataaaattcgcgtgaacagtgtaagtccaggcaatataaaaactccgatgaacgaccttgatattgaagcccaatccaaaatcaaaggtagaagttttgcagaaacagaaaaggaatactcttcagagagcatattacggaggagaggaactgctgatgaagtggcatcagtagttttatttcttttatcttctgcatctaattacattaacggagaagatataattattgatggggggctttaccta

SEQ ID NO: 34574 - DNA, 795 bp, Ferroplasma acidarmanus
ttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaag

SEQ ID NO: 34575 - DNA, 1053 bp, Ferroplasma acidarmanus
atgaaagggattatattgcatggcggtgccggcacgagattgaggccattgacacatacaggccccaaacagttgatacccatagcaaacaagccgatgtcccagtatgtactggagtatttaacagatgctggaataaatgatatttgtatgatacttggcgatatatcgcctgaaaaggtaaaggattactatggggatggatctgaatttgactgcaatattcaatacatagatcagggtgcgcccctcggtatcgccaacgcagtatctctaaccagtaattttgttgggaacgataagtttgtagttattttaggggataatttaatagagggcaaaattaaaacatttatggataaatttgagaaatctaattatgatgcttttattgttctgacaaagtcaatgcacccgaaagattttggtgttgctgagtttcgcgataataagcttataaatcttatagagaagcccgaaaaccctccatctaattatgtacttacaggcatatacttttttactccactaatatttgattatataaaaaagttgaaaccatcctggaggaatgaatacgaaattacagaagcgatccagctgctcttaaaggataataagaatattggatatgatataatagatggatggtggaaagatacaggcacagttgatgatatacttgctgcaaatatgctcatactggatagaggcaaaaacattgaggaaagagctaatgtaaaaggaaaagtagcaatcgggaaaaacgttgttttatcagatgattcacttatcaggggcccggctatcattggagataatactgttatacaggataaaacgtttatagggccatatacaagtataggcgataactgcaccataaaaaaggcgtcaattgagaactctataataatggataattcaaatatagatacggaaaatacaatagtcgattccataattggagaaaattctgttatcatgaatgcaaatttattaaaacccgctggaaaacgcttattgctgggcgagaattcaagaatatatatt

SEQ ID NO: 34576 - DNA, 1074 bp, Ferroplasma acidarmanus
atggaagcaataattgtgaagccacctgaagcaggaataacttttcaaaatttagattataaaaataatggaattaaaataaaaattctggaaaatggcatatgtggcactgatagggaaatagtaaaagggcaattaaattctgcagcgattccggctggatctaattatcttattctgggtcatgaagccataggcactgtgatggaagatggaactatctttaaaaaaggggatatagtaatgcctgtaaacagaagggggtgcgggaaatgcctgaactgcctggttgggaggcctgatttctgtgaaacgggaaattttgttgaggctggaataaaaggcatgcaggggtttatgggcgaatatatatacgatgatgagaaatatttagtgagggtccctgccgggataaaaaacatggccatactggcacagccactggctgatttagaaaaatcaatggatgagattatcaatatacagaaaaggatgatatggagatgcagcgataataccttccactgccgcaatgcactggtaataggaacaggaacaataggcgtattgttttcactgcttttaaaaacatatgggtttagtgtaacaatagcaaacagaagatatgcacatgacaaggaatcaaaaatatgtaatatagcagatattaaatattataattcagctactggatataaatttgatgataattcattcgatttaataatagaagcatcaggttcctctgcagatgtaatatcccaaacaatgggttttctaaaaaataatggaatatttggattgttcggatttataaggtcaggtgagctcagtataaatagccatatgcttcaggatttcgtttataaatcaattgcaatggtgggactgatcaacggccagaagccacattttgaaatggcaatggatcatttaatgcaatggaaatatatgtatcctggaatagagaaactattgataacagatgaaattaaaatatcagatagggagaaaataaccactgtattgacagaaaagtctaaagatgaaataaaaaccaggatattatgggat

SEQ ID NO: 34577 - DNA, 1714 bp, Ferroplasma acidarmanus
ggtgataaaatgattgaagtaaaggttaacagccttgatgaagctttacagaaaagttaccctccttgggtaaggagaactattgaaatacggatataagcatatacagagcattctctgactcagttgaaaaaaataaagataatattgcaatagatttcatgggcaaaaaaataacatacagtagcctgaaagaaaacaatcgattctatttctgtgaggttgggggagttaggtatcaccaaaggtgacagaattgcagttatgctgcctaacataccgcagtacataacatatttctttgcgattgttaaacttggtgctattattgtacaggtaaatccattgtatacaatgcgagaactggaatttgaaataaaggattcaggggcaaatacacttatagtaatggatgattttatagacaaggcattgccattatatccggctaaattgaaaagaattcttgtcgtgaaggttcaatattacctgccaccggttgtatcacagttatatacattgattaaaaaagaacataagaagatacctgtagcagacaatatatatttatgcaaggtgcctaaaaaatctaaattaccatcaaaggaagctgatatagacccggaaaatgaccctgccctgcttcagtatacaggaggcactaccggattgccaaaggctgcaatacttacacataaaaatttaatttcaaacgcatatcagataattgaatacatgcctgacaaatataagaaaaacatttcctatctatcatcaataccctttttccatgtatacggcatgatgacggcaatgttgacaccattgctgcagggttctaaaattatccttataccggatcccaggggatattaagactgcattaaaaataatagataagaaaaagcctgtagcatttccgggaatacccacactttaccatggaataattacatataaggatgttaagaaataccatattgacaatgtaaaaatatgtatttcaggggcatctccattgccggtagaactgcaaaagaattttgaatcaatgaccggtgcaattctcgttgaaggatacgggttaagtgaatgttcgcctgttgccaatgttacaccgctggttgaggatgatagggaaaaatacaggagatttggttctgtaggcttgcctgtatccaatacatatgaaaaaatagtttcaacagaggatggagtaactgaaatgcctcttaatgaacctggagaactagtaatcaaaggtccgcaggttatgaaagggtactggaacaggcctgatgaaaatgcaaaaacaatggtagatgggtggctgcataccggtgatattgcaaagatggatgaagatggttacgtatatatcgtcgaccgtgaaaaggatttaattatagcaggcggctataacatatatccaagggaagttgaagaagttatatatgaaaatccgaaagtttctgagtgtgctgttataggggtgaaagatgcacatcgcggtgaaactgtaaaggcatttattgtaaaaaaggatagttcactgactgatgctgagataataaatttctgcaaagaaaggctggcagtttataaagtaccgaaaataatagaattcagggacgaacttccgctaacccttgttggaaaagttgataagaaggctctgcgcggtggagataatggtaaataaaaaatatctaat

SEQ ID NO: 34578 - DNA, 1062 bp, Ferroplasma acidarmanus
gacccatctgcaatgatattaacctccggtacaaccgggcggtcaaaagtcgttgttgaaagcaattcgcagtttatagctacagcgctggatatgattgatgcaggtggtgttgcttctgacagcagaatatatgtgtatcttccattgtttcatataatggcactggacctggctatcatatcctcaattctttcaaactctaccgtatatctcgttgaaaaatttaatccatccactttctggaaagatattgttggttatcaaataactcatttccatgctgtaggccccatctttgaaatgttgattaaacaaaatccgtctgctgaggagaagcaacacggaaccattatcgctattgcttattcatcaagggaggtctggactactgcagagaataggtttggaataaaaattaccggtggatatggaggcacagaggcaggaattcctgtaacttccccatatagtgaggtcgttaacggtatcaatcctccgggtagttgtggtaaagcaacaccgccatacgaagtcgctataatagatgaatctgggtttcctgtagtaacaggtgcaatcggtgaaatagtgatccggccgaagttaccatgggttacttttctggaatattataaaatgcaaaaggaatcactacaggcatttaccggattatggtttcatacaggcgatcttggaaaatatgataataacggatatatctattttgttgaccgatctaaggattcgatacgcaggaggggtgagaatatatcgtcattcgaagttgaacaaactattctaaaaatggatggagtgttagaagttgctgtttatcccgttccatcaaaccttggagaagatgaggttatggtagcactatcgagaaacaatagtgagttaaaaccagaaaatataattgaatattgcttgaataatatgccaccttactggatccccaattatattcgctttcttgactcccttccaaaaactcctaccggaaggattgaaaaatataaattaaaaaatgaggcggtaacaacagacgcataccatatg

SEQ ID NO: 34579 - DNA, 924 bp, Ferroplasma acidarmanus
ggcatagaaaacgtaaagatcgtggataaagatctctcaggagaaggcataaaggtaaaaatagtaaaggcagggttaaatccactggattacaatcttatagctggaaacattgtatataatgtaaaccctatgccccatattccgggttcagaggtaatgggaattgccatggaagatggaaaacgtatacgcaaaggggatcgtgtaatagtatataaccggatttttgacaatggctgtgatatgtgctactctggaaatgaacatttatgctacaatggtgggatatggggtgttattaccaacggtggctatgctgattatataaaaataggtgagcaaaatcttttcagggttccagagtctattgatgacaacacggctgtcagcatcggcatcggggcattgacatcctacagatcgctgaaacgtgccagggcagggataaacgataagatactggtatatggtgcgggaaatacaggcatatttactgtgcagatagcacgccagatgggtatggatgtttatgtatactccagaaacagggaacttgaaagccttggcattaaggtgctggattctgtccctgacgacttcaaagctgatattattgttaacccgcttggaggaaaacttttcggagattcaataaagcatttgaagagaagagggaaaatagtaacttacggggttttaaccggaagaaacgcagaccttgacatagcaaacgtttacaccaatgaactggaaataatagggtcaaccggcgggacaagaaaagatttaacagaacttctgcagatactggaaaaaagcaattttcgcctgcccgtatataaggaatacagtttatgggatataaaagacgcactgcatgcatttaaggatagggtaaatgggagaatagtttttaattta

SEQ ID NO: 34580 - DNA, 507 bp, Ferroplasma acidarmanus
gatgatgaagctgatgactataatgagcggggaatatcgtactttaatgttacgcagtatcccgatgcagttaaggaatttacaaaggcaattaacctgattaaaaccgatcctgattattatataaacagggcacttgcttactattccatgcacatgtataatgaagctataaaagattgcaagagtgcaatagcacttagtgctgacaggggagattaccacaacaccctcgggtctatttatgatgatatgaacaggttcgatgatgcactgggagaatttgatgctgcaataaaaatagaagatgatgtgcctgattactattataacaggggcaatgtttactggagaaagggggataaagacctggcacttgaggattataacaaggctgtttatttaaacagcgcagacccggtgtttctgtataaaaggtcccagatatacacggaaatggagaaatacgaagacgcgcttggggacctggaggattgcattaaactg

SEQ ID NO: 34581 - DNA, 948 bp, Ferroplasma acidarmanus
aaattaaatgagtgtgatgataccagaataaaagatataataatcaaattgcgcgatttcacattgaatggcgggaagcgtttgaggccaatattaatgatcatgggatataatatgttctccgggcaggatgaaagaataatcaaggcttcaatttccatagaactggcccaatccttccttcttatacatgatgacataatggatcagagcgatatgcgcaggggaaagccaagcttccataaggcagtagaaggaagcctggatggaaatgatgctacaagaattgcggaaaaccttgctatcagcgccggcgaccttattgacacattttcccatgaagcacttttacgttccggtttcgaacttgaaaatttgctggatgccgattttgaattttccaggataatagaggatactggaaaggggcagatactggatatatattcttcaatagagaatttatatagcgaggagaggcttacaaagttgcatttccttaaaactgcacggtatacggtgcaggggccactgctaatgggtgcttatctttcagggaataaaaaatatatccaggaaataaaggattttggaaaatatgcgggaatagccttccagctttacgatgatatgctgggcatatttggggtagaagagaaaacaggaaagccggttaaaggtgatgttaacgaaggcaaaaaaaccctgttaattataaaagcttatgagaactcagggaaagaggacagagagttcatagaaagctgccttaaatgcggggatgtaagcgattctgattttaacaggctccgggaactcataaaatcaacaggttcatatgattacacaaaacagaaaatagatgaatacaataatatagcaagatctgcacttgaaaaaattgatggggataaggaagtaataaaaatgcttgatttccttctggaa

SEQ ID NO: 34582 - DNA, 1140 bp, Ferroplasma acidarmanus
ctcacatcagtgggatgggccgaggaaaatggagtgaataggcttgcacttaatgaatatgatatacaggccaggaaaaaccttgagggtgaaatgagagcagtaaaagcagatataaaacatgatgatgccggtttaatattcggaacactgggttccgggaaagacaatacagctataggttcacacatggattccgtacccaatgggggaagatttgatggtttctatggcgtaatgtccggcatgcagcttttaaaagacctgggaagcacattaaaaaataggaaaattacagctatagattttaccaacgaagagggtgccaggttccagccatcacttcttggctcagggatttcaacaggtgtattcacaaaggaattcgcctattcacggaaagacagcgatggaattacatttgaggatgcgctggagaaatcaggctatatgggagaggaacagaacagggttaaaaaccaggacatatcacggtacatagaattgcacattgaacagggtcctgttctggaactggaaaattaccagataggaataccaaaaggcatagtaacaatggttgtggacaatatatcctttaccggtgaatcaaaccaggcgggaccaacacccatgaaggtaaggaaagatgcacttgtagctgcatcaaggtttactgtagctgtaagggatatagctaagtcatcagggaaggaattaaccatgacgatagggaaaattaataatttccccaatgcgtacaatgttattccgggaaaagtaacaatgaaccttgataccagaagcccggataaaaaaactgcagaagagtattcaaaaatggcaaaggaaatatcagaaagaatagcttcagaagaaggcgtaccggtagatttcaaaaaccagtggactacagaaactacactatttgatgaggatatgagaaaggagataataaaatcctgcagagcgctcaacctgaaatataaagaattgtacagctggccagggcatgatgcacagtacatgaatagggtggtacccacagctatgatatttattccatcacataatggaaggagccatacaaaggaggagtactcatctgaccgggatttaattaacggatattctgtattg

SEQ ID NO: 34583 - DNA, 1230 bp, Ferroplasma acidarmanus
ctacagaaacaaagggaaatggagtccagcacagtaatctacccggatagtttccccattgcaattaagagggctgaaaactcattaatagaagacctggatggaaatattttcattgactgggtatcaggaatcagtgttcttaatttaggatttaatgataacataagaaaagcagtaaaaaaccaggtggatgacatatggcatgccctggaaatacctacagaagttagaattaattttcttgaagcattgagaaacagcttccccccggagatgaggaattataaaacaatatttggaatcagcggggccgatgcatgtgaaactgcaatcaatatagcacatgcaataaggaaaaagaatgccccaacaattgcattcgaaggtgcataccatggagtatcaggcggaattattgctgctactgccgggagaaaatacagggaagcagtatacagcgatgggtttaaggtaataagggtgccatatccatataaattatggtatgactatgatgtttctgatataatttctataatgaaaaagataatggatgatggagaagcaggatatgatcggcctgattctgttatagttgaacctgtacagggagaaggcggttatatagtaccaccagatggatttttaaaggccataagggaattctgtactgaatacgaccttacaatgattgttgatgaggttcagagtggggtaggcaggacaggcaagatgtgggcatttgaatatgaaaatattactcccgatatagtatgtgtcagcaagagcataggcggggggttgccagtatcattagtttattacagggatgactatgacaaaaaattgccgaagccattccatcttggaacatacagggctaatccccttgcaatggctgctggaataactgttatcaatgaggttccaaaatatttcgacaaagtgaagtccagcgggaaggaaatgttaaacaaattcaataaaatagattccaaccttataggggaagtgcgcggaaagggctatatgataggcatagaacttgtagataacggaaagccagtgaattcaaagcacatgatggaattaaagcatgaactcctcaagaatggattgttaatgcatacatgcgggcactatggtaatgtattcagattcatgggtgcattgaatatagaggaggaattgcttaacaggggcgttgaaatattttcgaaggcggtg

SEQ ID NO: 34584 - DNA, 1155 bp, Ferroplasma acidarmanus
gttggggcagtgatcgcgggttatatgggtgataatttaggcaggcgttttttatattcttttaatcttggaatatatgcaataggtgcccttatatcggctctttcagtcaattattctatgttcctttttggcagaatagttgtcggccttggacttggcggtgaagtggctattggtttaacattaatatccgagattatgcccacaagagttagaagtcaacttactggagctgtaaatgttggtccgggattcggcatattcgcagttgcaattcttgcattaatttttatagggccctatgaacaaatatttgggggttcaaagctagcgtggagatggtttttaggaatattgattttaccagcattgctaatattgctttacagaaggtacatacctgaaacgccaagatttctcatatctaaggggaggcaggatgaagctttcgctgtgattaaaatgctttccgagaacaaactaattccactaaagaagttaaaaaactattataaggtggacgacctgagacaacaatataactatattggtcttaagcctataaacgaaaagcccaaaaccagggaactttttgctggcaaatatgcaagaagatctttacttttatttatactgtcctttattacctttggaacatccgcatcatttactataatatatcctgaaatatttacgtcagtagcaacggcactgcatcttagcagcacattcacacttacaacgatagttaattttggaactctcctgggaacattcacagcggtattcctagctactaaaaatagaaaaatattgatatctactttagggatattagctataatcggggccgggcttacagtaacatttcactcatatgcgtatatagtggtaatatcactgtttatattcgcaattttttcgtatgcatcaaatacaactatatggctatattctcctgaaatgtatcctactaggataagaaatataggcacaggtttcattctggcaacaagtcttggaggtgtggctattatggaagttctgacgtcttatgtatacgcattgtacaatttaactggtataggtctggtagccataggggcctttgtagtatatgttatacttgcgttttttatggcagatgatacg

SEQ ID NO: 34585 - DNA, 1716 bp, Ferroplasma acidarmanus
ttgaatggaagactggaaacatttgtgagaatgcttgaaccagcgaatattgttgttattactgacccagatttttatgaaaaaaaactggtaggggaaatggcaacagaccatgaacttatagaattgaataggaaatattacagtaattcttacctgtacaggagcaatccagatgatgttgcaaggactgagaaggatacatacatatccagtttagatgagaagaatgctggtgcaacaaataactggatggaaccagaacacttaaaatcccgcattttcaatttaattaaaggttcaatgaagaataaaaccatgtatatcgtaccatttattctgggccccgcaggttcgaaatacagtgaagcgggcatacagattacagataatccatatgttgtaattaacttaataaaaatatcgcttgttggaaaagaagccataaaccgtattgaaaatacaggcaaatatgtggtagcaatccatgtaaccggtaccctggataaaaataacagatacattgcacatttcacagatgaagacctgataattagtgtaaataccgcatatggcggaaatgccctcctgaccaaaaaaggctacgcgctgagaatagcaagtgtacacgcaagggacaactcaaggatggcagaacatatgatggcacttgaagttacatcacccagcgggagaaaatacggcatctcaggagcttttccaagcgccagtggcaaaacgaacctatctatgatacggactcctactgatatggctggctgggatgcgcaactattgagtgatgatattatatggatgcatatcaataatgactcgctatacgcaattaaccctgaatatggatttttcggtgttgcacctggcaccaatgcaacaacaaatcccaatgcaatgaaagcattcaatagggatacaatttttacaaacactgcactaacaacggatggcaaaccctggtggtattcacttgacccttctgtaagtgaggtatatgactggcatggcaatttaactacggatttaaagaatgcggcccatccaaactcacgttttactacaccaataaagaattacccgtatctttctagtaaattctatgataatgaaggcttgaaaattgacgctatgttattcggaggcaggcgcagtgatctcataccgcttgtgaggcaggcaaagagctgggcgcagggcgtgcttttcggcgcaatgataagagctgaaacaacggctgctacaactggaaaagttggaatattgagaaacgaccctatggccatgattccgttctgcgggtataacataggcgattacttccagcactggcttgatatgggaaaactagtacagcacaggcctgagattttttatgtgaactggttcagaaaagattcagatggaaatttcatctggcctggcttcagtgagaatttcagggttattgaatggattgccagcaggctggatgcaaaagcaaatgccattgaaacccctgttggattaattcccgacatagctaatttcgcctctggaaatttaggcaaaaacaaattagagcagctctttgagatagattatccgggatggttaaaggaacttaacgaaatagaaccatttttcaaaaagataggcgatagtttccccgaagaactgtggagagaatttcataacatgaaagatggagtggaaaaacaa

SEQ ID NO: 34586 - DNA, 1827 bp, Ferroplasma acidarmanus
ataaattatgtagataaatcatatgaccctatggaagatttttcaatatattcatatggaaagtgggtaaaatcacatcctgtacctgaagacaaatacgtgtatgacgcatccactgaacttatggaatggaataactttatacttgggaaaattttagaatcatgtgcacgaaatagccagaaccctgcggaaagagccctgggtgatttctacatatctattatggatgtagatggaattgaaaagaatggttttaagccagttagcagatttatggaaataattgataggatagatagcaaaaacaatattattgaaacttttggagaattcaatactatgggcatttcaggattgttctcatttgactccatgcccgatgagaagaacagttctgtttacgcatgttatctaaatcaggatggcttatcattgccaaatcgtgattactattttgatgactcatttaaggaaataagggcgcaatacataaatcatataaaaaatatgttcattctatacggatttgacgataaaacatcagagaatatgggaaatacagtattaaaaattgaaacaagccttgcattaaaaagcaggtctcctgttgaactcagggacccggataaaaattataaccggttccagtttaatgatatagagaaggaattcccggggttgcgccatagagaatacttttcaaaaataggtttaaccggtttagattacatcataataggccaaccagaattcttccgtgacctggactctattattcaacaatatacactggatgactggaaaatttacatgaaatggaatgtacttaactctgcagccccgttcctgttcggggatgttgaaatggagcattttgatttcttccagagaaaattgctggggcagcaattgcctgctaaaagatggaaaaaggcggtttcaattatcgatagttttatgggcgaggcactgggcaaaatttatgtggaaaagcaattcggagaggattcaaagagaaggatggatgatatgattgaagatctgaaggaggtttttattgaaagaatcaataatttatcatggatgggcagggaaactaaggaaaaggcactggaaaaatttagcaaattcagggctaaggttggatatccatctaaatacatagattattcatctataaaaataagtcaggatagactcttcgaaaatattataaattgcaataaattcgagctggaaagagagactaaaagaatagggaagcctgtggataaggaactctgggaaatgactccaccaactgtaaatgcatatttttctcctacagacaatgaaattgtttttcctgccggaattctccagcccccgttttttgaccctgaaatggatgatgctgtaaactatggggctaccggcgctacaatagcacatgaaatatcccatggtttcgatgacgagggaagaaaatatgatttgaacggaaatctgaatgactggtggacaccggaagatgataaagcctttacagagaaggcgaagagtgttgttgagctgtataattccattgaagccttgcccggtatccatgtaaatggtccattaacacttggggaaaatatagcggatatcggcggggtgagcatagcatttgaggcacttgaacacaggttaaagaaaaacccggaattaaggaaagtaatagacggatatacaccggagcaaagatttttcatgggttgggcacagagctggagaactactgtaaaggatgaggcactaaaatggcagattcttaacgatgtccattccccggaaaaaatcagg

SEQ ID NO: 34587 - DNA, 993 bp, Ferroplasma acidarmanus
atgaaatatgttaatgttggaaaatccggattaaaagtttctacagtggccataggtacatggcatctgccagggtctgggcaatttgttaataaggttgaatctgtaaatgaggaagaatttaagaaaattttcaagaaagcatatgattttggaataaatttctatgatacagcagatatttaccatggaagggtggaaaataatgaggattgcatagaatgcacaggcaactcagaaagggttcttggtaatattataaaagattatgatagggaatcactggttatatctacaaaggtagctggacctatgaattattatgttaattcatccggcctatccagaaaacatataatgcacggtattaagagttcactggaaaggctaaaaacagattatgtggatttataccagttccactggtcagataatgatactccattaatcgagacattaaaggcaatgagccatatagttgaccttgacctctccaggtatataggcatgagcaatgttaatgcctgtgatatcccggagtttatgaatttgtcagaaaaatataatttaaataattttataacaatgcaggaggcttataatatactcgacaggaaaattgagaatgataaaattttatatgcacagagatacaacttaggcttgcttgcatatataccacttgaccagggaatacttgcagggaagtacttaaacaattacggaaaaggttccagaataacatactattctgggttacaaaatgaaatagatagaacattgaatacggtaaaaaaattaaaggaatttgcggatgaaaatgatattaccctatcccagcttgctatagcatggctattaaaaagaggtgcagaattgaatattaagattataccgctcctgggaataacaaatataaaatatctggacgacaatataaatgcactgaatgtgaacttaaaggatgaggatatgaaatatataaacgaaata

SEQ ID NO: 34588 - DNA, 1866 bp, Ferroplasma acidarmanus
atgagcaaatactttgaagaatacgaaaggtctttaaaagatgttaacggattctggaatgaaaatggacggataatagactggtttaagccgtttgataaagtacttgatgactctaaaaaaccattttaccgctggtttatcaacggaaaaactaatctgtcatataattgccttgacaggcacatacagaacgaaaagcggaacaaagtagcgtttatatgggttccggagaaaggagaggaaaaggttgtaacatattttggattatacaggagggtcaatgcatttgccagaggattattaaacctcggtgtaaaaaaaggagataaaattacaatatacatgccaatgatccttgaagcaccaatagcaatgctggcgtgtgcgagaataggtgcggtatttaatgttgtattctccggtttcggtgaacaggccctggctgagagaataaataattcaaattctaaaacaattataactgctgacgggggatatagaaaaggcaatattatacagctaaaaaatattgttgataaggctatagaccttagcaatggcgtggacaatgtaattgtagtgaaaaacacacatacagaaatagacatggagccggaccgtgattattactatgatgacattatagaagatggatatgtagagcccgagcaaatggattcaaatgacccattatttattctgtatacctcaggaactacaggaaagcccaaaggtattttacatgccaacggaggatatcctgtctggattgccaataccttaaaatgggcatttaatccgaaagacgaggatagatggtggtgtgctgctgatattggatggatcaccgggcatagctatatagtgtttgcacctttattgcttggcttaacgtctgtaatgtatgaaggggctatagattatccaaagccagacaggatgtgggagattattgaaagatatggcgttaaccttttatatacttcaccgacggctataaggctgttaatgaaatatggggaaaaatatccactatcacatgatttatcttccttaaagaccctgggcacagttggcgaacctataaatcctgcagcatggcactggtactatgaagtaattggaaagagcagatgtcccataattgatacctactggcagactgaaacgggcggtttcacaatatcaccttcagccaggctaggattgcccgatctaaaaccaggttcggccacgttccctatgcccggtatagatgcagaaatcctggatgaaaatggaaagaatgtgaagccaggggaaaaggggtatatagtaattaaaaagccatggcccggattgatgctcacagtgaataatgatgataaaaggtacatcgacacatatttctcaaaattcaaaggcaaatatttcatgggtgactatgccattcaggatgatgatgggtattactggcttctgggaagatcggatgaggttttgaaggtatccgggcacaggattggtaccattgaagtagaagacggtttagtatccatgaaggaaatagctgaagcagctgtatttggcaaaccggatacggtaaaaggagataccatcgttgcatttgcaacattaaaagatggatatgaaaaatcccctgaattaatagagaatattaaaaaaaggataaggaataatctcggcccaattatggttccggaggaaattcacatagtgagtacagtgccgaaaaccagaagtggaaaaataatgaggagggtaattaaggcagtttacctggatcaattgccaggagatatcagcacactggaaaatgaagcatctgttgaagaaataaaaagggcagtggacattataaag

SEQ ID NO: 34589 - DNA, 744 bp, Ferroplasma acidarmanus
atgtataatgatttaaaaggtaaaaatgtccttgttacaggtggaactaaaggtattggcaaggccatatcattgggatttgcagttgaaggtgcacgggttatctcaatatcaaggcacactccagaagatactgatgatcgaattacctactataattgcgatgtttccagtagcaacgatgtaaaaagtaccattgaaaatattctttctaaatttaatactatagatattcttgttaataacgcagggatagaagagtatgcaagtcttgataaaacagatgaaggcatgtgggatcgaattatggacataaatgttaaaggagtttataatgtatcaaagtactgcattcaggaaatgataaaaaaccatggtggcaatataataaatatctcatcagtccaggcaaatattataacaaaaaacgcagctgcatatgtaacatcaaagcatgcgataataggtttaacaaagagcatagctctggattatgctcctgaaataagatgcaatgctgtattgccagccacaatagatacacctctggtcaggaaagcagctattctggaagtcggcaacaatgaagaaaaaattaaagaaaaaataagggaatggggtttgcagcatcctttaggaagaataggaaagcctgaagaagttgcaaatacagtattatttctggcatcaaaccagtcgtcatttataaccggagcatcaataatggtggatgggggtttaagc

SEQ ID NO: 34590 - DNA, 927 bp, Ferroplasma acidarmanus
gaagaaatataccttgacaagaacgaaaatccattcaatgtaccggaaaaggtaaaaaaagaattcataaactatgcaaaggatgcagattttaacagataccctgaaaaggggttaccttcccttattaaaaaactggcagggctcaccgggtttagcagtgaaaacattattgcagccaatggcagcgacgaattgcttgatattttaatcaggcgtgcagaaggcgatatagttgtcagttcaccaacctttgaaatgtattcattctatgccagaaattatggccataaggcaattgatgtcccgctccgcagcgatttttcccttgatgttaatggtatactggcgcagaaggatgcaaaacttgtggtaatatgttcgccaaataatccaacagggaatcttatagatagagagagcataaaaaaaattcttgattccggtgtaacaaccatacttgacaatgcctattatgaattttcgggtgaagattatactgaccttattgcaaaatatagcaatctcataatattaaggacattttccaaggcttttagccttgcaggaatgagaattggatatggcatagcagagagcaaatttatatctgaaatcaaaaaattgcaggcaccgttttatatgaatatactttcagctaaaatggcagagatcatgattgataactacagccttattgtagaaaaaataaaatatattgtagaggagagggaacgtgtttacaatgaaataaaggatatagcataccctagcagtgcaaactttcttctccttaaaaaagatctatatggctatatggaagaaaacgggatacatataagaaaactcccgcttgtaaaggataggtcaagattaaccataggaacaaaggatgaaaataaaagggcaattgaagcaattaaaaaa

SEQ ID NO: 34591 - DNA, 1050 bp, Ferroplasma acidarmanus
gttataggtgccgggataacagggctgttctccgcacttaaccttgcacttgatggttatgacgtgacactttttgatagggaatatattctttccggtacttcagggaaatttcatggaatgctacacagcggttccagatattctgtgaatgatgcggaatctgcaaaggaatgcatacatgaaaatgcgctgctttctaacactgcctcatcctttattaaaaatacaggagggtattatcttgctttgaatgatgcggatgcagaatacggcgataagcttctacagaaaaataaagaaaacggcataccaacagaagaactgggcattgatgaaatgcttgacctggaaccgaatattaataaaaatattttaagggcttttcgtgttcctgataaagttatatctgcacaccccttcgcagcggctgtggcagttgaagcacagttaatgggtgctaaactgagatttaaatcagaagtcctgaaagctgaagttgatggaaaaactgttgaatctataaaatacaggtcacatagtagaattgtgaatgagaaatttgattatataataaacacgaccgggccatggtcaggacaacttttaaaatccttcggcatcggcgattttgaggtcatgcccacactgggttacatggcatcctatgactatttattttcacatggtatcttaaacagaatgagggaaccttcagatggggatatattgctcccatatggaagtatgtcggttgcaggcactgtggctattatatctgataatgtagataacaatgacattgacccggaagaccttgataccatgctatctgaagtttcagagatggttccatcactttccaggcacaggtataaaaaactatacagttccatgcgcccgctgatcagagaaggttattcaagggctacaagagatttcaggatatacgaaaatatgaacaatttattcagcataataggcggaaaattcacaacttcaaggcttatggggcaggccgtatcacagaaactttctaaaattacagga

SEQ ID NO: 34592 - DNA, 1182 bp, Ferroplasma acidarmanus
aaaatagtaattttatcagcatttgggatgcttcttgatggctaccagttaacggtaatcgcattcgccgtccttttgataccggattatatacacctcagtgattattcccttgattatgggctactgatagcatccgtaataataggtgcaattatagggacaatacttgttggatacctgagtgacctggtaggcaggcgcagggtatacctttcaacgcttatgttctttatactatttgacatgatttcagtattttcggttaatttttatatgctctttatctcgagagtacttcttggggttgtcctcggagcagaatatcctgttgccaattcatatatagctgaggtaactccatcggataaaaggggattctatcttgcctttgcaactgtattcttcagtgtagggtctatcagcagtgcaatagttgctgtttttatgtttccattgggaaatatcggatggcgcctgatgctcggtgtcgcagtcatacctgcaattattgtagaatttatgagattttccctgccagagtccaaactatgggaagagaaaaaagagaaaacaggctttcttgagatgttttcgaaaaaatattctaagaatataattttagcagcacttatctggtttctttatgatattgttgcctatgggctgtcgcttacacttccaacaatcttgaaactggggcatttcgtaaccaatgttgataatgcccttttgaccacatttttccttgtaataggaatagtttcaggggtatttgtaatgatcaaggtggataagtttggaagaaaaggaatccagattacaggatttcttttaatggctgtattattccttatcctgcctcacttttattatctggcaggaataataacaatagtatcttttcttgaactgttcaatgcttttggaggtgcgactgtagggataattccagcagaggtaacaattacccgattcagggggacatcatatggattttcatcaatgatgggaaagataggtgccgttataggcgtaattgccatgtctctccttattacctcaaaaaattattttaatgcctacatatttttagctgtaatcatgattattgcaatacttcttacgctattgctcccagaaacaaaaaatataaaactggaataaaaataaaaaaatatt

SEQ ID NO: 34593 - DNA, 852 bp, Ferroplasma acidarmanus
tatcattccatcatatattcatcaatgtttaaagagaatttactgaaagataagaatatcctgattacaggcggaggaacaggcctcggaaaacagatgacggaaactttcctgaaattaggtgctacagtatcaataattagcaggaaagaagagcatcttactgctgcaaaggaatattttaataatatgggatacaaaattgaagctgtgaaatgcgacataaggaatcctgatgagattaaaaatgcagtggatttaatagaaagtaaaacagggaaaattaatgttttaataaataatgcagcaggaaatttcatcagcaggacagaggacctaacgccgaaggcatttgatactgtaatggggattgttttacatgggacagcatatgcttcactggaaatggggaaaaggtggctctctaattccatgaagggtacaatactaagcattgtggcaacatatgcctggacaggttccggatatgtggtcccatctgcaatatccaaggctggagttttagcccttacaaggtctcttgcagccgaatgggggcataaggggataaggacagttgcaatagctccgggggcgtttaagactgaaggtgcgtggtcaagacttctccccggtgatgattatgaaaagcagataatatccggaaaccctgaaagaaggcttgcaacaaaggaagaaatagccaacatagctgcttttcttatctcggacatggcagcctatatcaatggggaagttgttaccgccgatggtgggcaggcattatatggctccagcatgttcaacatgatggaaagccttcctgatgatatatggaaaatgatgaggcaa

SEQ ID NO: 34594 - DNA, 1128 bp, Ferroplasma acidarmanus
tatatgcttaatgaaaatgaaacaaatgttttgaaatatgtccgggaacttgcagaaacaaaaatcaagccaagagcccgggaaatagacgaaaaaatggaagttcccgaagatattatacaggccatgagggatatgggactgtttgcatcatatatacctgaaaaatacggtggatacggccttagctttccattccttgtcaatgttattgaaacaatatctgaagcatgccccagtactgcccttgtccttgacggagccctgaccctatttgcagaaccactgataatgtttggaagcgaggagctgaataaaaaatatttaacagagatagcaaagggtgcagttggcggccttgcaataacagaacccgggtctggaagcgatgcagcatccatatctacaagggctgaaaaatgtgaaggcgggtataaaattaccggaaccaagacctttatttccaatggcaggatagcaaaattctttgtgatggatgcttctacagataaatcaaaggggtacaaaggaattaccacatttgttgttgacggcaatgcccctggattagaaattagcagggatatacataagatgggcatcaggggttccagtaccgttgagttgaatttccatgaagtttttgttcctgaatcaaatattgtcggtgaatataacaagggtttttcagtaataatggacacgctggatgccggaaggattggaatagcagcccaggcactgggaatagccagatctgcgttccatgaagcacttgaatatataaacacaagaaaacagttcaacaaaaaaatcattgatttccagggcatccagtttatgatagcagaaatggaaagcaggataaaggcttctgatctgcttatcagggaagctgcagagaaatggcagaaccatgaggataccgtggagctctcatccattgcaaagatgtatgcctctgataccgcagtatatgtggcagaaaggtcactgcagctattcggtggatatggttatactacagatttcaatgctgaaaggcatatgcgtgatgcaaaaattacacagatatatgaaggaaccaacgaaattcagaaaataattatatcccgggaaataatgaaa

SEQ ID NO: 34595 - DNA, 1589 bp, Ferroplasma acidarmanus
aaaacaattgaactgagggtatatggtatgacatgcgacgattgtccgaagcatgtttccacggtttgaagaatctcacggtgtaaaggaagtctccgtttcgcttacagatggcatgcacatatcagagctactgatacagctaattccatgatctcataaactggacgtcttaaggccagtacagggcacagtaaggagtgttaaaaatgactgaatatgatctagccattataggctggggtgcagcgggttttgcagcggctataaaagcaagcgaattaacatctaaccagatgaaaatagctttgatcgggacaggcgaattaggtggtacctgtgtaaacgttggttgcgttccatcaaagtttttaatagaggcatcaaagaattataaggaggctaaaagtccggcatacgccgggataacgtcttctgcgacccttgatttttcagaatttatggaatccttgaatcaatttgtttccggagaaagggagactaaatataccagcgtaatgaaaaattttgagaatattgacctgatagaaggtcttgcaaagttcattgataatgatactatatcggtaaacaacacagaactcaaggccactaattttattatagcaacgggctcaaggacatttataccggaggtcagggggctgacagattattataccagtgatacagtgtggaaaatgagaaaactacctggaaagttagctgtcatcggttccggagaagtggcacttgaactggcatacgccttttcaaatttcggatcagaagttcatatatttaacaggtctaacaggatactgaaagggtttgatgatgatgtcaacagccagctgatggctgctctaaaatctaatggtatagtgttccaccttggagttaatttctatgaaattaagaatgaggagggaaaaaaggatatagttacatggacagggacatttggcgatttcgatgaaatcattgtagctaccggaaggatgcccaacatcgatggattggacctcagggcaggagggattacagcagacaatggtattgttgttaaccccgattttagaacaacaaatccgaaaatatatgcagcaggggactgtgtaaggcaatcccttaagcttgaaacacttgcaggaaaagaaggcgtaatagcagtagagaatatacttggagggaataggaagataaatatgcaggaggtaccatgggtagttttcactgaaccaaatgttgcatcagttggttacacggaagcagaactgaaaaagaaacacatagaatacgatgtacgcacagtagaattgaaaaatgtggtaaaagcaaatattctcaacagttatactggaattgccaaaataatatccggaaaggacaaaaaaattcttggtatccatgtgatagcccccatggcagctgaattcataacagaaggtgtataccttattaaaaatggtttaacctacgacgatcttatagacactatacacgtattccctactgtggcagagtcaattaaaatcacagggcaggcatttataagggatatatcaaagatgagctgctgtatggat

SEQ ID NO: 34596 - DNA, 2905 bp, Ferroplasma acidarmanus
atttttattgatggcattcctttgaatattaagggcgaggaaacaatattgcaggcaatgatggataacaatatcgatataccgcatgtctgctacaatcctgcactgggagccatagaatcctgtgatacgtgcatagtcaatgccgatggaaaatatgtccgtgcatgcaccactcaagctaaaaacaacatgaaggttctgtttaactctccagatgtaaaagcaagggaaaccgaggctgtgaacagaatattgcacaaccatgacctttactgcactgtatgcgaaaataacaacggtgactgtgcattgcatagcgctgttgataccttgcaggtaacaaggcagaaatatccctttaccagcaagggatacgaaccagattattccaatcctttttacaggtatgacccggaccagtgtattctctgcggcaggtgcgtggaggcatgccaggatgtggaagtcaatgaaacgttgcatattgactggtctctggaaaggccaagggttgtctgggatgacaataaggcaattaatgattcttcgtgtgtatcatgcgggcactgtgttacagtatgccctgtaaatgcacttatggaaaaatccatgcttgaggaagccgggtatttcacttcacttaccaggaaagcaaagtataacctcatagagtttggaaaagaccttgaaaagcctgttggaaatggcatgataatgaaaattagcaacatagaggctaaaatgagggaggaacagataaagaagacaaaaacagtatgtacctactgtggtgttggctgttctttcaccatgtggaccaaggggagaaaaatattaaaagtacagccagaggttgaatcacctgcaaacggaatatccacctgtattaaaggcaaattcggatggggctttgttaacagcgaagagaggcttaagtatccattaatcaggaaaaatggaaaatttgtccaggcatcatgggatgaagccattgactttgctgctaaaggcctgaaaaaggtaggtgaaaagtatggcaatgagtcattgatgttcatagcgtcatccaagggaaccaacgaagaatcataccttctccagaaaatggcgaggcagatattccacaataacaatgtggacaactcatccagattctgccaggctccagcaacaaccggtctgtggagaactgtgggatacggcggcgatgcagggtcaatacaggatatatacaaatccgaactggttatgatagtgggtgcaaatacagcagaatcacatccggtacttgcaacaagggtaaagagggcacataaattaaaccaccagaaacttatagtatccgatttaagaaaaaatgaaatggctgagcgtgctgacatataccttcacccctccccgggaactgatatagtactcctatctgcactatcaaaatatataatagaccagggatggcatgacagagaatttattgagaagagggtaaatggctttgatgagtattataagagtttagagccattcacactggaaaatgcatccagcataacaggaattcctgagaagcaaattatcgaaactgccgaaatgatacacagcgtaaagagcatgtgcatactgtgggcaatgggaataacccagcattctgcaggatcagatgaatcaacagcaatatcaaaccttcttgttctaacaggaaattacggaaggcctggcaccggtgcgtatccattaagaggacacaacaacgtccagggagcaagtgattttggagcaatgcccacataccttccgggataccagccaataaaggacaaagaagtaataaagaagtttgaaaaggcatggcatactgagttgccaactaaacccggaatagacaacgtatcatgcattgagaatatagataacgataaaatcaaggcaatgtacgtggtaggtcaggaaattgcatcaacagggcccgattccaatatgatcagggattcccttgaaaaacttgatttccttatagtagaggatgtattcttctcagaaaccgcaaaatatgctgatgtcgtattgcctgcaactgtaagtctggaaaaggaaggaacattcaccaacacggaaaggcgtatacagaggatatatcaggttatggaaccatatgaacaaacaaagccagattgggaaattatacagggaattgcaaaatcccctgggttatgactggaactataagcacccatccgaaataatggatgaggcagcatcattatctcctatgttccatggagtatcatatgagaggcttgagggattcaagagcctgcagtggccaatgaaagaaaacggcgaaggatcagagtacctctatgaagacagattcaacttccctgatggaaaggcaaggctttatccattatcatacaggccaccacttacagtctccgaagaatacccgctgcatcttaacaatggcaggatgctggagcatttccatgagggtaatgaaacattcaaaacagaagggataaaggagaaggttcctgacacattcctggaaatatctgaaaaacttgccgctgagtataaaatacaaaccggagatttcgtaagggtcacatcaaagtggggcagcataaaggccagagcattgattacagaaagggtgagtggcaatgagctttacatgccaatgaatgctgcatctgatgacgcaacggtaaatctgctcacatcatacacaagggatccagattcagatacacctgcctacaaggaactgcctgtgaaaattgaaaaactgaagaaaaatggcgggagcccgcttcctgcaaacaattccaggtacggaaagccggaaccacagattggaatacttgtcagtgagaaatggaagaggaaagattactca

SEQ ID NO: 34597 - DNA, 1029 bp, Ferroplasma acidarmanus
atgaaaacggcattgataacagggattacaggccaggatggggcatacctggcaaagttgcttcttaaaaaaaattataaggtatatggtttgtacaggagagtaagtacaccaaatttctggaggttgcaggctcttgatatatatgacagggttaatttaatatctggagacttaagtgacttatcatctatccttaatgcgttcaaggcatcacagccagatgaggtttaccatttagcagcccagagctttgttgaagcttcctttgaatcgccattgtcaactgctgatgttacaggtttatcggtcacaagaatacttgaagccgttaagctattctcaaattccacaaaggtatattttgcaggaacaagcgaaatgttcggctcatcatataccggagaaccattaaatgaaaaccatccatttaaccccatgagcccatatgctgcagcaaaactatatggatactggatatcaaaaatctacagggaaggatacggcatatatgttgcttctggaattttattcaatcatgaatctccattgcggggaatggaatttgtcacaaggaaaatagcaaatgaagttgcaaagataaatctcgggcttgaaaagaaaatacatttagggaatatcaatgccagaagggattggggatatgcgcctgaatatgtagaagccatgcattccatgctgcagcttgataaagctgatgattttgtaatagcaacaaacgagacgcattccgtggaagaatttgtaaaatatgcatttgattatattaaagaagattacagagattatctggaaatagataagagattcatcaggccgctggatgtccccgcacttcagggcgattattccaaggcagaaaagacatttaaatggaagcctgaaactaaattcagggaactggtaaatatgatggttaaagctgaaatagacaggtggaagagatataccgaaggtgagaaatttgcatgggatgttccaaactatcctaatgagaataatctgtta

SEQ ID NO: 34598 - DNA, 2550 bp, Ferroplasma acidarmanus
cacgagatcgaagatgtggaaagcattctcaaatctctcggggttgatgttgaaaatgggttgactgaatcagaagcaacacgcagaattcaaagttacggtttaaatgctatccctgaagccaaaaaacatggcattctccagatttttctggaccagttaaaagaaccactaatacttgttcttgtggttattggaatcatatattttctaataggaaccccatttgaatcctttactgtaatcattatagttttcgccgtgatagtaattgaagtttataatgtaaaaaaggcccagatatctatacaggcacttcacagcatggttactcccaaaacatgggttttaaggaacggttcactgctggaaaaatccaccagcgtgttagttccaggtgatattgtataccttcgaacaggagacatggtcccggcagatggcattgttgtaagttcctcaggcttatatattgacgaatcactcgttacgggagaatcatatcctgtgaacaaggtcagttttgatgaacctgaaaccaagccgggtgcaaatatgcacagggtagtttcaggaacactagtggtgcagggaaacggtaaatttgccgttacgtccaccgggttgaaaacagaaattgggaaaatttctgaatcagtcaagaatcataaagacattccaacacctttagaaaagtcattgaataaaactgcccggctcctgatagtaatagcagttttcttcagcgccctaattccactgataggctatgtgcacggtgaccccttggatcagatgatattaatgggtctttctatggcattcgctacagttcccgaagagataccaattttgataacaataaccctagcaataggggcatattccctatcgaagaagaaagccattgttaaaggccttactgcagcacaaactctgggtagcgttacagttattgccacagataagactggaactatcacagaaaatgctatgaaagttaatcatattcttgttggcgaaaaactatatgaagctgctcaaaagggcaacaccagtttccttaaatcagcggtacttgctacaggaaatttggaaattgaacagaaattttctgagggatacaaagacccgatggaggtagcaatactcaaatatgcaattaattccggacttgatattcatgaattggaaagtgaatacctgataactggtcgattcggttttgacagtaacataaaacgtgcgagttatgtgtattccggtcatgatggttatgttgcatatacaagtggggcccccgaagttgttttatcaagatgcacgagtataatgatggatgaatcttcaaataaagtcaaatccgaaagtgatttaaaaattataagggatgctataaatgaggtggcaaaagttggtgagaggaccatagctttcgcctataaaagaataaatggtcaggctgaagagagagattttgtcgatagtgatatgatattcataggcatgattagcttcatagaccctccagggaaaggagtaaagaacgccgtaaagctctgccagaatgcgggaattagggtaataatgctcacgggagactatccggtaacagcagaaactattggaaaaatggttggcataaaaaacgcggaatcaacccttaccggagatcaaatcagggctatgccagatgatgagctttctaaagccattgagaaaacatctatctttgcaagaataacccatgatcagaagctgcggattgtaaaggcacttcaaaagaatggtgaaattgttgctgtgactggcgatggtgcaaatgatgcttctgcattgagagctgccgaaattggcatatcaatggggaaaagaggaactgaagttgccaaggaagcttcagacatagtactggaagacgataatttccatactatagcagaggcagtattcgaaggcagaaagatgcaatacactctaaaaaaaggcatcaggtactatattgcagttaagatctcactgatcttgattctccttgtcccgatactattgatcattcctttccccttcatgccgatacagattataataatggagatgttcatggatgttggtgcactctggggatttttgaaagagcgggatgaacctggcattctgcatgctgcaccacagaaacggggtgcagatttcatggacaggcctatgataatttctattctgacaagtgcccttggagtatttcttgcggttactttcatatatttatatatatactatagtgaaggggatatcatccaggcacagacggcagcttttgcaacatggatactttcccaggtgatccttgcccagaacctcaggacagagcgcgagccagtttcacagaggccatttttttctaattgggtaattctatcgtggggattaatcgttgtaggggccctcatagttataactgttttcccgccgctacacgctatcatagatacatcaaccattgaatacagaaattgggttttgatcataatagtttcagtgctatcaagt

SEQ ID NO: 34599 - DNA, 1137 bp, Ferroplasma acidarmanus
atgaaagtgcttattctgggcattgacggatacatcggttttcctcttgcactgaggcttcttgatagaggatatgaagtatatggtgccgacaatttttatacacgcagaagggtaaaaaatgtaggttctaaatctgcggtaaagattaattcttttgccacacggaacaaaaaactgaataatgccattaagttttacatgggcgatgttagcaatccgaaatttgtatacgatataataagggattcaggggcagatgccatagtccacctggccgaacagcgttctgcaccctattcaatgatatcacttaaaacggcgacggaaacactggacaaaaatatagaaagcacaatgaatataatatatgcggtaaaagacctgaacagggatatacatatagttaaactaggttccatgggtgaatatggaacaccgaatattgatatacctgaaggattcctggatgtccagttccatggaagaagcgataaattgcctttcccacggatggggcaatcctggtaccacctgtcaaaaatttttgacacttacaacctgatgcttgcaaaccggatctgggggctaaacgtcagtgatgttatgcagggtgttgtttacggcacaagaactcctgagattacaaaatacaaactctttactaggttcgacattgaccagatatacggaacagtgctgaacagattcatttcacaggcggtaataggatacccgctgacagtgtatggaaaaggagaccagaagcgtgcgtttttgtccctggaagatagtgtagaatgccttaacctgatacttgaccacccggctgaaaaagaatacaaggtatacaaccagtttgatgaatattatccattaaattatcttgcagaaacggttaaaaacaggtatgaatcgatatatggaaagaaggtaagcataaaccatgtgcctaatcccagggtggaaatggaagaccactattataatccggcaaaccagaatttaaaggatatcggatacaggaggcagaggtcactggaagatgaagtccctgttatgataaaggatgtgaggaacaacataaatacagtttatagcctgaagaatgttataaagccctcaactaactggaga

SEQ ID NO: 34600 - DNA, 1209 bp, Ferroplasma acidarmanus
ttttacactatggacgattttgatttcaatggcaagagagtgtatcttagaatagatataaattccccaattaaccctataaccggagaagtagtggatgatacaagattcattcattatttgaggacaattaacgaacttaaaaactcaaaggttgttattattgcccaccagggaaggccgggcgacagtgattttgtaagtttgcggcaacatgcagggcatcttggcaggctgttaggcagagatgttttattcgttgattcattgatagggtctgcagtggaaacagctataaggaacatgaaaaatggagatattatcatgctggagaactccagattctatagcgaagaaatacttataaaagatgatggggctgcccagaaaaacacatttattgtcaggaatttatcaaaattatttgattactttataatcgatgcttttcctgcgatacacagggaccagacaacacttaccggattcaaggatataaaacccaatatagctggcaggcttatggaaactgaaattaatagcatagacaggttcatgaattctaaatcacatccgaaactggctataatgggtggagccaaaataagggatgctataaaggtaacaggcccattcctggagaaagggatagtggacaatataatttttggtggtgtggcagcaaacatattcctgtgggcttccgggatagacatagggaaaaggaacatggaattcatcgaaaaacaggataaaaattataagaaattgctggaggaatgcaaatcgttgttatcccgattctccgatcgcatatacctccctgaagatttcatgcttaatcccttacagacagaaataaaaacaggtgagaaggttccagatgggcagttgctggcggatattggatttgagtccattaaaacttttagcagtattatagaaaaagcaaaaaatatatttctcaatggcccgatgggaatgtatgaaataaatgaatactcacttggaaccagggaaatatttaatgcagtttcccagagccctgcatcaaaaatagtcgggggagggcacacaataaatgcaattaatgaattcgggctttcagattccatgggatatatatcaaccgggggtggcgccctgataaattatttatccggtgagcctatacctgtaatagactcacttgtttataacaggaaaaaa

SEQ ID NO: 34601 - DNA, 1200 bp, Ferroplasma acidarmanus
cagccatctgttaatataggtatggttggtcatgttgaccatggaaaaagcaccctgacttttgctttaaccggcaaaaaaacagatgtgcattctgaggaagttaagcgtgggatatcaattaaacttggatacgctgatacacccatatacaggtgcacagatgaaacaggaaaagaattttacagcaataagaaaaattctgataattgccagctttcccgcgtaatatcgattgtggatgcacctggccatgaaacattaatggctacaatgctcgcaggttctgccatcatgaacggtgctatccttgtaatagcagcaaatgaagaatgcccacaaccacagacaagggaacatttaactgccctggaaataatgggaataaaggaaatcatagttgtacagaataaaattgaccttgtaaccagagaaagggctatggaaagctacaaagaaataaaggattttcttaagggcagcattgcagaaaatgcaccggttatccctgtaagtgcatatcataacacaaatattgacgtagtttttgaagccatagagaaaataattaaaactccaccattcaatgataatgatgcacctatgatgtatatagcccgctcatttgatattaacaaaccgggaaccaaaccctcaaaattgaaagggggcgtactcggcggtgctttaattagaggcaaacttacagtaggagatgaaattgaaattgctccgggagttcagattactaaaggaaataaaactacatgggataatgtcacaacaaaaattacgtccttgatggcaggttcgtcttcatatgaatctattttgccaggtggattggcagcagttggaactgaacttgacccattccttacaaaaggagattcatttacaggcagaataatcggattaaagggcaatgttccgaaaaccgtatttaacatggagatggatatacatctgcttaaccgtgttgtcggctttgacgaagaagttaatgttgaaccattaaaatcaaatgaaatgatcatgttaactgtagggactgcaaatacaataggaactgtgacttcaattaaagacaaacgtgtcggtgtctcattgaaatatcccgtagctgccagtataaatgaccgaatggcgataggaaggcgtatatccaacagatggagacttattggatacggctctata

SEQ ID NO: 34602 - DNA, 1329 bp, Ferroplasma acidarmanus
gatgtggtaacaataggggcaggtggagcatcttaccctgcagctttcaggctcaaaaaggcgggattctctgtcattatgatagatgataagggaataatgtctggaaattgcctagctgaaggatgtgtgccttcaaaagcaatcatagaaacagtccacacttataagcgtataagcgattttggcgacttcaggataaattacagggatattttaaaaagaaaggacaaagttcaaattttaagaaacgggctccacagaaaagaactggaggaagcaggaatagaaatcttaaagggtgttgcaaaaattatagattccagcacagtagaggtaaaaactgaggctggcaatataaaactcaattataagcacttaatcattggaagtggggcatacacatatatgccgcaaataaaagggattgaatacgcaataacaagtgcagaccttttcaggattgaccctaaaatcaaggaccttccagagtctatagctattataggcggaggctacataggtgtagaaacagcttcatacatgtctatcatgggttcccgggtagagcttattgaacgttctgatagaatcctgatggacatggatccggagatagttggaaaattagagccattattgcctgatatgagggtacattttaacaacagtgtaatttcaatagaaccagatggggatggctacaaaactactataattgataataacggaaaaagtgacagtgttattactgcctgtgtaatgatggcaactggccgtgaaccacttattccggaaggaactgaagaagcgggcattaaatttaacagaaagggaattatagtaaactcatcaatgcagacgaatataccgaatatatatgcaacaggctatgtgaatggcattgcaccattatttcatgccgcaaaaaggcagtcactgatagccgcaaactgcatcatgtcaggagatatgcctgttgatcgcttccaggacaattgtgtaccatttaccgtatacactattccaaatatgtcttttaccggaattacaccggagaaggcaaaagaactgggcataaaatacataaagtcaaaatataaaatggcggatgattcccttgcagagatatacaatgagccaggaggggagctagatttaatttttgatgaagatatgaaaataataggtgggtatgttatcggaaatgatgcggggaatataatcaatgaaatatcgatgggactttcaaagggattaacagccagggatttcgcagaactgccacaccagcaccctatgaccttcgaagggctggacagcgccgca

SEQ ID NO: 34603 - DNA, 1326 bp, Ferroplasma acidarmanus
ctggataatgcaaggataaattctctgcataagaaaatcacagcactttcggttggaggaacattcctggatggttacgatatttcaataatatctgtagcccttatagttatgtccaaaactgcatttgggctggatactgattttggcaaagctatgatagcggcatctacaacaataggaatgctcgtcggcgcaattctgttcgggtacataactgatctgtacggcaggcggacaatgtatatgtatgacatggctttatttattgtactgacagcagctgaagcattttcatggagctttgcctcattgtttattatgagatttatcctcggacttggattaggtgccgattacgctataggtacaacaataatcggggaattttctccggtgaaatacagggggaaactgctggtaaccaacgtgctttcatggtttttaggtgcagcagtagcagcagtaacaggatatcttctgctcccgctgggaaatgagtcatggagatatatgtttctacttgggataatcccggccgccataattctggtactgaggagggatgttccagagtcgcccaggtggctaagcaataagggcaatgccagtgaagctgaggatatagaacggaggttgaccggcacttctgataatttaactgcaattaaacgtgataataagaaccctttgaaagagctgctaagcagaaaatacataaagagccttctttttgtgggaatattctggtttacatttgatgcggcattctatggaataagtatattcagccccacaatactggaattgctgggtttaaaagcaaggttagcggtgcttgggtctgctgtttttgatacatttgcaataattggaagcttaatagcaattctcctgatcgatagaataggcaggaaagggataacaataattggattctccggtatggtaatatcactcctaagccttggaattataacattttacgttcctgataggtcagcatttataacagatggaatcctcatatttgcactgtttctaatattttatataactgaagcaataggaccaggttctactgattttgtttacccggtagaacttttccccacggaagacagggcaagtgcacagggattcgggacatcagttagccgtatcggggctattcttggcattacaacgttcccgtttattgtttcaatctatggcttcagcaccagccttttcttcttcaccggtttatctgtaattggcttgcttgctaccatattccttgctactgaaacaaagggaaaaacacttgagcaggttaatgaaata

SEQ ID NO: 34604 - DNA, 1077 bp, Ferroplasma acidarmanus
acaatacaggaaaggataaaggaaatagaagacgaaattaagaaaacccagaagaataaagctacagaaaaacatatagggttgctcaaagcaagaatgtcaaaacttgaactggaagaagaatcacataaaaaatcaggtggatatggtttctccgtttctaaaagcggggatgccacgatggcactggttggatatccaaatgtaggaaaaagttctcttctgaatgcccttacaaataagaaaagcactgtagggaattttgaattcacaacactcacagttattccaggaacactaaattataatggtgcccagatacagatacttgaccttccaggaatcatagacaatgctgcactgggtgcaggcaggggaagggaaatcatcagcaccatcaggaatgtggatcttatagtgcttgtaactgatatccagttaaaaggacttgacaggataattgctgaactttacaaagcagggattgtactgaacaggaaaaagaaaaacatagcatttaagcgtaccaattatggcggattaaggatacataagcccagaaatgtggatattgacaacggagatataagggacatagcaaaagagttcaagatagtcaatggcgatatatacataagggaaaacattgatatggacgatctaatagatttttttaagggaaacatagtttacataaaatctttcatggttgttaataaaatagatatgccacacgatgaggaacaattgaagcgaaagctgaaagactttggcaattatattgaagtatccgcagagaccgggcataatctggaaagcatgaagaatatgatttataaaacacttgacatggtcagggtttatatgagaaataaatccggggaagtggactatgaacggcctctgatattaagcgagggtgccaccatacgggatgtaagcagaaagataagcagggaaatgatttctaccttccgttatgcaataataaccgggcctaccagaaagatagaagcaagggttggccttgactataaagtaaatgatgaagatgttgtaaccttaataagcaaatat

SEQ ID NO: 34605 - DNA, 2673 bp, Ferroplasma acidarmanus
atgattatagaatccataaaaattataaattttctatcacacgagaatactgaaataacctttgaacagggcattaatataatcacaggaaagaacggtgccggaaaaaccagcatacttgacgcaataaaattcgcattatttgctgagtcaaggaataatgaaaaaaacaatgaattgataaaaaagggaaagaattatttcgaaattacattgaatttcaatgtaaatggtgaacattacgaagtataccggcacttcggccttaagaaggcaaaaaatgcagaaaggcttgcatctgttaaaaagaacggtgtaatagtagctgaaacatatgaaggtgtaaacgttgagataacaaaaattttgaatgtttcaagggaagtattcaaaaattcagtatttgtagagcaggggcagatggattcattaatctccggcaccccgaaggaacggaaaacaattttttccgatataatagggctcacatcactttcaaggagcgctgaccggctcagggaaatcattggtgcattcagggaagaaatgatcctgcttcaaaactccagtgagaggcttgatcaggcaaaaaaagatattgaaaagtttaaggaagagaaaaaaacagcatttgaatccatgtcccgggctaaaattgaatccgaaaaatattacggggaactggaagaattaaaggcaaaacagaaagaaagagatcggtatataactgttatagaaaatataaaagccaatatttcaaaatatctggatgagataaaagagagggagggccaatcagtggaattatctgcaaaaatttctgaaatcacttcaatcgagaaaagggtaacagaacttcaggagaatccatattataaaaaaatggattttattaaccggtattttctggagaaatcgggaatggacagtgcagcaaaggacatggaaaaagctaataaaagactatcagaatattctgattacgccggaaaacttgaaaagctttcggaataccataaaaagtattcggatatgcacgataaatatacactgaacagtgaaaaaataaaggaaagcaggaaaatgcacgaggaatacctgagtgcatccagcaacattcaatcaatggtagatagattgaataaaatgaaaaattatgttgacaattatttaaaatcctccggcttgagcctggaagatatacaaaatttcaggccaatcagggaaaaaatcaacagggaaatttcagaaaaaacatccagaatctcggaaataaaatcaaacgtggcatcatacagcaaaacccttactgaggtcagggagaatatggaaacactgaaaggcaaaagcacatgccccctgtgtggcacaaacctgactccggatcatatggaatcaatatctaaagaatatgacgaaaaagcaggacaaattattggtgacatagaaaaattgaaactggagaaaaactcagttgaatctgatcaggagaagcttaaggacaggtataaaatttttggaagccaggaaattgaaactgcagcatcctacattaacgaaatcaaatctttagaaactgagaagaaagagctggaaaataccattgaaaacgcatctaaagggcatgaattattcaatgtactttcggcggaaaacgagaatctggaaaaagccataaaagaactgcagcaatatgaaaatgaatatatcagatacagcagcataatctccggtatggaccccggggcaatcaaaaaagaaattgaagcagcaggagaatcatttaccacatttaaaaacaggataaatgaactgctatctcaaattggctttgtgccggaatataatgaatatcagaatacaggcaaaatctcttctgaaatcaatcgccttaaaactgaagtagaacggtccagggaaatgaaatcaaaactggaatcgattaaggatgaaatcgagaataggaagaaatctattgaaggattgcgtattgaaatggaaaataaacaatcggcaatgcatcagtatgatggcatagatgaacaggccggtaatatagaatcccggtataagtctgcataccaggaaaacataaaaatgaagacactggtggactcatatacagaacggatagaggaaacagaggaaaatgctaaaaatcttgaacaggatgcagaaaaatataaaaagaccagggaagctatatcaacactggggaaaataagggaagcctttgattacaatggcatacagtccataatcagaaaagacgcatccgcttccatgaccaacctcacaagaaagtatctacaatcattcaacctggattttgatgacatttccatagatgaaaattttgacattaaagtcacccagaactctatggaacagacccttgaatcactcagcgggggagaaaaaacagcactggcaatagcaatacgattgtccgtaacagaatacgtcctggaaataataagcatcataattatggatgagccaacaaattttctggatgaggacaggaggaacaatttgaaagatattatattatattcattgaaaggcgaaaacatagtgccacagatgataatgatcacgcaccacagcgaattgatatccgttgcagatgcatcctatgaaataataaaaactgcaggaacgtcgagggtt

SEQ ID NO: 34606 - DNA, 1455 bp, Ferroplasma acidarmanus
aatttgagtatagaggatgtcaatgctgttgcaagtggcagcgaaaaagtaggcatagctgagtctgcaataaagcagatacagtattcaaaaaaatcattgatgaaaatactggattccggcaagcctgtatatggtgttaataccggattcggatcactccttaatgtaaatgtggacaggaaaaatatagtacagcttcagacaaaccttatacgtagccattcttcagggataggggaaccactggatattgaaactgtaagggctattatgctggtaagggcaaacacactggtgaagggttattccggtgtatcggagaatatgattgattttctgctattcatgttgaacaataatataattcccgctgttcccaggtacggttctgtgggggcaagtggggacctcgcaccactggcccatattggccttgcacttatgggtgaaggtgacgtattctacaaaggaaaaatccagaatgcaggtacggtattcaaatcacttggaaaagaaccatacagttatggtgaaaaagaaggcgttgcactgataaatggcacatctgtgatatgcggcatactggctctggaaataaaaagatcagagaaacttgtttctgaagcccttggatcatttgcactggcatttgaaggtttatccggaactgataaggctttcacagaatgggcactggcatcccgtccacatgaaggccagcaaatgataggaaaagccttcaggaaactattcaatggcagcatgattatagaaaatgcaaataaaagcaaggtacaggatgcatactctctgaggtgtactccccaggtttacggtgccgtgtgggatacactccagtacgccagaaaggttttaacaacagaaataaattccgcaacagataacccattattgctggggaatgaatacatttccacgggaaatttccacggggagcctgtagctatggtttccgattttgtagcaatcgccatgacggattttggtaatatggtagaaaggcgcctggcaaggattgtggatacaaatttgagcgggctgcctccatttcttgtaaaggattatggactgaattccggctatatgatcccgcagtacacagcagcagccctgtgcaatgtaaacaaaacgcttgtacacccgaattccgctgatacaattcctacctcagccaaccaggaagaccatgtaagcatgggaaccaatgcagcattgaaacttattgaaattaacaaaaatgtgaagtctataatagcaatagaataccttcttggagcccaatcactggaattcagaaagcatgagccttccccggcaactctctcaatatataagaaaatcagggaaatagtcagacctcttgattctgaccgtccctccacaggtgatataggagcaattaccagcatgatggatacagaagagtttctc

SEQ ID NO: 34607 - DNA, 1302 bp, Ferroplasma acidarmanus
atatcaacatttaacccttttacagaaaaagaacttggcaggtataaggtagctagccttgaagatgttaaggaaactatcagaaatttaaaggaaaaccagctcaaatggagggaaaatattgataaaagaattgacatgctgaaagaatcaaagaaaaattttgaaaaaaatgttgaaagccttgcaaccctgatgtcatctgagatgggaaaacctataagccagagcattgcagaagtacagaaaacactcaggctctttgattattacattgaaaacggtgaaaagttcctggaaaatgaatatatacatacagaggcaaaaaaatcctatataagatttgacccccttggggttataatcataataatgccatggaacttcccattatggcaggtggcaagagctgcaattcccgcactgctggcagggaacgctgttcttctcaagcacgcttccatagtaagcgggtcttctttgaaaatccaggagttgtttaatcttgatacatttaggtctacaataacaacaggcaaaataatagatgatgccattaaattctcagacggtgtttcatttacagggtctacagctgcaggatctataatagctgctgaagcaggaaaaaacataaagaaatttgtaatggaactgggtggttcagatccctatattgtcctggattcttcaaatatagacgaagcagtaaaaaactccgtttacgcgagactgcagaataatggccagagttgcattgcctctaaaagattccttataaatgattctatatacgatgaattttccagaagaatgctggaggaatatagcagggtaaaagtgggagaccagctggataaagacacatatattggcccactatcctctgtatcacagaaagatataataacaaagcaacttaaggaattgaaatctatgggaactgtaatctctaccggggataactttggaaatgtaataaggccagcactggtaaaaatggataaagattatggggaagaggttttcgggcctattgcaatgttgagcaggttcaaaaccattgatgaagcaataaaacttgcaaacgacactccatacgggctcggatgctcaatatggggagacccggataatgcagaaaaacttgttccatacatagaatcaggtacagtatcaatcaataaaattgttgcttccgacccgaggttgccatttggcgggacgaagaaaagcggaatcggacgtgaactatccagatatggaatacttgagtttacaaatataaaaaccgtatgggtg

SEQ ID NO: 34608 - DNA, 738 bp, Ferroplasma acidarmanus
aataaaaatgctatagttacaggtggttcaagaggcatagggaatggcattgcaaaagctctggcagacaacggcgcaaatgttataattacatatggcaacaacgacaatgctgcggatgaaactgtgaaatatataagaagtaagggagtttcaggcgaaaaatacaagatagaccagtcggatataggagaaatagatggattgatgaaatttattaaagataagttcaaaacagtggatgtgctggtcaacaatgccggaatttgcccgttcatggatttttttaatatagaccagaatttatttgaaaaagtatggaaagtcaatgtggaaagccattttttcatcacacagcgtgtctcacagatgatgatagagaacaatactaagggaaaaatattatttataagctcaataagcgcaatagttggcgggaaatttcaggcacattacaccacaacaaagtctgctatgaatggattaatgcattcactggccataatactcggtgagcacgggataatggttaattcgctggaacctggtactatacttactgatatcaacacagaagacctttcaaataaaaagaaaagggagtatatggaaaacagaatacccctaagaagattgggaaatccttccgatatagcttctccggctttattccttgtttccgatgaaaatacatatataaatggtgctgaacttttagttgacggcggcatgcttgtt

SEQ ID NO: 34609 - DNA, 2373 bp, Ferroplasma acidarmanus
atttataattatattttggatcttgacataaacagcaaaaattatacgtatacgtgccatgaaaccataaagttcaatggaaatgaggaaaaattaattctgagctctgtaaatctgaaaattaaaaggattaaggtaaataatagcattaaaaattttaaagaatttataaaaaaccaggagatagttgttgacggtataatcacaaaagattcaattgccgaaatcgatttttccggagaaatacctgaggagctccagggattctacagggcacacacagaggaaggcgatatgttcaccacccagttcgaatcaacaggcgcaaggcgtttcttcccgtgcatagacaacccatcatacaaagctgcctttgatattacagtaagggtagatgagggtctggaagccatttcaaatatgcctgtggagacaaaggaaaatgtggatggaaagactgttataaaatttatgcagactccggtgatgtcaacatatcttctttatctgggcattggaaaatttgatgagcgttctctggaatttaacggaaacaaaaaattaattcttgctgcacagaaaggccatttaacagaatctaattaccctctggaaattggaaagaaagctatagaattctaccaggattattttgggatagattatccgttgccaaaggaacacctcatatcagtaccggaatttgccgcaggtgcgatggaaaactggggtgccataacattcagggaaatataccttaatatttcttcatccacaggatcttctgtcaaaaaagctgtgggagaagtaatagcacatgaacttgcacaccagtggttcggcgaccttgttactatgaactggtgggatgatctctggctaaatgaaagttttgctacctttatgtcatataaagcaatgaataagcttgaagtggattatgacatgtttgctgatttccttgtgagcgaaactgcaggagccctggaaggggattcactggttaattcccatcctattgaggttgaggtaaaacatccggacgatatttcacagatttttgatgagatcagctatggcaaaggcggtagcatattaagaatgataaatgcctttgttaccgacgatgtgtttaaaaaggggcttcatctttatcttgaaaattttaagtataaaaatgcatcagggtcagacctgtgggaatttatagccaaggtttctgaccgccctgtcaggaaggtaatggaatctttcatacagaatgtgggatatcctatcattgaggcaaaggaagagggtggaaagataaagcttacacaatacaggttcctgttaaatggcaaaaagcaaaatgtccagtggaagataccgctaacggccaaatatgcaggagaggtaaagagcatacttttcgattcggagtctatggaaattgatttgcagggattcataaaactcaatgacagtgaaactgggttctaccgtgtcctttattctgattcactgtatgaaaatataatcaaaaatatagccatactggataataaagacatattcgggctgttaaatgattcgcatgcattcctgatggcgggaaaattgactttacaggagtacctttccagaataaataagtttatggaattgaatgattcattaataatcagggagatatccaatgagctgttctcattatatcttattgaccccaaaaattcagaaatactcgggacaaatatggaatatcttgctgataaacttaaaattcttggagataagcaaaaatcagaaaatatcaacatttcccttgcaaggggcatagttgcaaacagatttgctacaataaacaggggatatgcggaagagctctcaaaatttgccggatcactggaacaggtagatccggatatgcgccttgctgttctcacatcatatgccatagtgcacaacgattcagaaaaaatgcttgatatgctttcaaagtttaaacaggatgaagataaggttaaaacaatacaggcaatggctatgcttaccggagacaataatttcaatgccgtggagaaggctatatctgagaggaaaataaaggcacaggactcgttgaggtattatatgctggcagctgcaaatcccggtgcaaaggaatatatttacaataacctggaaaatatcatggagaaaatccaggcaatatttgccggttccggttactcttcaagggttatagaaatggtagttccatttatcggattaaaccacatggaagagatagagggaaaactagcaaaaataaatatacaggaaataagcaggggcataaagaaggggatggaataccttaacataaaccatgacctggttgaaagattg

SEQ ID NO: 34610 - DNA, 1015 bp, Ferroplasma acidarmanus
aaaataaaagtctcacttctcggggcaactggcatggttggccaaaaaatgattaaacttctggcagatcatccatatatagaactggtaaagctaagcgcttctgattcccgtattggaaaaaaatattcagaaactgtaaaatggatagagaacggaagcatacccgaaaaatttcgcgacatgaagcttgtatccacatcaccggaggataataaagatgttgattatgttctttcagcgcttcctccagaggctgctgaacctgtagaattaaaacttgttaaaaacgggataaatgtcatttcaaatgcatctccatacaggctttctaaggatataccactcataaatcctgaaataaattttgaacatttgaggatactggagggaaaagatacaaaattcgtaaaaaatccaaactgcacatctgcaataatggcaatgccactggtcaaacttttaggatttgattacgatagaatttcacttgtttcaatgcaggccataagtggtgcgggattttccggattgccatatatgtccatagatgacaatataataccttatatccatggagaagaagagaagataccagcagaaatttcaaaaatgtatggaacagtgcaggatggaaaaatcaacggaaagaatatcagaatgtctgtaacctctgtgagggttccggtaaaggtaggacatatgggtgtccttaacatggaaataaaaaagggtgttgatgtagaagaacttattaaaaacctgaataatttttcacccctgaaaggtttcaacgggctttacaatgcacctgcacaccccatagttgtacataatgaggcagataggccacagaacgcaatagatacatataatggcatggaagtccatgttggcagaatttcatacactgatagaatctgaaatggtaatacttggcaataaccttgtaaggggcgcggctggaattacaatactcacacttgaactcatggaacaataaattataattatt

SEQ ID NO: 34611 - DNA, 774 bp, Ferroplasma acidarmanus
gttgtaaagatcggtggatcaatattgaaaaataaggaagatttaaaccttataaaacaaaaattgatagactgccataattgcattattgttacatccgccctgaagaatgtaacgaatatgttgatagaagcctacgaaacaaaaaatacaggtattattgacagtatttaccacatgcatacagatatgatacaacttgacaatagtataatatcaacccttgcagggataagggaagaattgaaaaaattggttgttcgggaaaattctccttctttgcgtgaccatataatatcatacggagagcgtatgtcaacactggttctttataatttcttcaaggacaacggatttaatgtttcatatataatagagcctttgctggtaactgataacaattatggagattccagttgccttatggatgaaacagccagaaaaataaagaactgtgtttttggagatttcaccatagtgcctggattttatggtgctaccattgagggaaaaataacaactgtggggcgcgggggcagcgattatacagctatggtattagcttccatacttaattgcgatgttagaataattacagacgtgcccggaataatgacatcagacccgaaattattcaaaaattccaggacgcttgcggaagtttcacttagtgaagtccttaaaatgtcatattttggagttaagaactttaattacaaaacctttatgccagttcttggaacagatataaacattactgtggaatcactttat

SEQ ID NO: 34612 - DNA, 1368 bp, Ferroplasma acidarmanus
caggaattgatagataaacttggcaaagatattattttaacgaccaaggaagaattaataccttatatgaaggatgcttcatatattaagggaaaaatgccactggctgtttgccttccagaaaatgcagaccagatttccagcatactcaaaatatgcaataaatttaaaatcaatgttactgcaagaagcggcggcacttcactcaccggttcatcggtagaaagctttgacggaataattataagcaccatgaatttaaacaggctccttgaactggatttatcctcaaggtatgtggtatgtgaaccgggagtgaggatagatatattgaatgcggagcttaaaaagcataattttttttacccgcctgaccctgccagttcaagggcatcaacaataggtggctcattgtccaccaatgcaggaggattgcgggcagtaaggtatggagccacaaaggaatgggtgcttggcatggaagtagttctgccaacaggggaaattataaggaccggcgaatacacattgaaacgtagtgcaggctatgaccttactgcattgatgataggaagcgaaggaacactggggataataacaaaagcaatattaaaaattgagccattgcctgaaaccactgcaaaaattatggggttttaccgtgacatattatctgtcgggaaatccatggatacaataaaaagccagggaattacacccataatagcggaattcatggaccttccaacaataaattcaatcaaaaaagctatgggaattgaggtacctgcatacacacagtaccttctgatggttgatattgacagcgctcctgaggctttagaaagaaaacttgcttcggcaaaagatataatgggcaaattttcagaggatgtaatagtgataagggaccagaaaaggatggatgagatatacgcagcaagaaaaggcgcatattctgcccttctggaacagagggataacagcaaccagctaattgttataggggacgtaattgtaccatcaagccagctggcagatgcactcggtcaaatagagggctatgccagaactgatgggttaaaaaccacccttttcgggcatataggggatggaaacattcacgcgaatatatttatggacaatacagaagagggcagaaaaaagatggcaaaactccagatggatatagccagggtagctataaggcataggggatcggtttctgctgagcatggaatcggaacagaaaaaaatgagctgctttacgaggagtataaggaacgaaattccctatacacgcttgaagtaatgagattaataaagaaagcatttgacccgaacaatatactgaacagaggtaagata

SEQ ID NO: 34613 - DNA, 1107 bp, Ferroplasma acidarmanus
atgtggttttttaggtcgccgcagataatatttggtgatgaatcattaggatttctggaatcattgtcaataaaaagagctgttatagtttcagataaaaatatcagaaaagcaggcattgtagacctagtaataaagaacctgcatggaacagaattattaataattgatgatatcccggaagagccggaatacagagctattgcaaaacacctggatgagataaatcaattcaaaccggattattttatatctgtaggaggcggttctgttatagatagttcaaaaatattattctttaagtatgaacgcccggatctcgaattttatgatgttacaccacttgttaaactgaatttgaggcagaaaagcaaattaatttcgattcccacaaccagtggcaccggttcggaatgtacctgggctgcagtaatttcagatgaaatggaaaataggaaagatgagctggcatcaccggaaataatgcctgactatgcaatacttgacccgcagatggttaaatcactgccaaaaacccagacaataaatactgcaaccgatgctatcacacacgccatagaaggttacacaagcagatggaacaatccatattccgatgccatggctgagaaggccattgaactaattattccgtcaatagttaaactggtgaaagatccggagaatctggagttgagaaataatgttcatataggggcatctatggcaggattatcattttcaaattcccagatagggctagcgcatgctctgggccattctctaggtgcaatgtttcatgtggcgcatggaaaatctgttggcatatttcttccaggagtaattaaatttaattatgcggcagccggggagaagtatcagaggcttaacctcttaattcctgaaatgtatagagggaaaacactgtacgaatccatagttattatactcaaagctctggggcaaactatcaggatatctgaaacagggatagacgaaaaagcattccggaataatctcgataagcttgtgagcctggcatcggaatccacgggaattgtaacaaatccagcggatgccagcagggatgacataacgcggctgttt

SEQ ID NO: 34614 - DNA, 720 bp, Ferroplasma acidarmanus
ataaaagataaagtatgtatagtaacagggtcaggaaggggaataggaaaagctattgcgattaaacttgcacaggcaggcgggaagattgtggttaacgttagaacccatgaggatgaaggcatgcagacgctggaggaggtaaataaggcatcgtccggaattctttcaatggcggatgtttcaacagaagaaggcaggaaaaaattattcagggatgctatagaaaaacttggaaaacctgacatacttatcaacaacgcaggagttggtattctcgagccattcgaaaacatagatgaaaaacacatgcaattgatgtttaacactaacctctattctccagtatggctttccagagagttcgttagcaagtacgacaatggcgttattataaatatggcctcactggcaggcatatcccctttccccgggctatctgtatatggaatgaccaaggcagcgcttattagcatgactaaatatctttccctggaagctgccggccaccatatccgtgtaaatgctgttgcaccgggagtagttaaaaccaggatgggcgacagcctcctgaaaattatgaatctagacgagaaaaatttttctaagaaatttacgcttacgggcaaactcatagaccctgatgaagttgcagatacggttctttatttgatcaggaacgaatctatgactggccaggttataacaatagactctggc

SEQ ID NO: 34615 - DNA, 1452 bp, Ferroplasma acidarmanus
gaatacatattatctatagatgcaggaactacaaattgcaaagccgttatttttgatagaagtggtgaaataactggcaaatcatccatacgcatggtatcatattatcccagggaaggttgggtagaacagaatccatattttattatttctgcagtgaaaaaagttatctcacaggcaataaaaatagctggcattgatcctggagatattgaatcggcaggaattacaaaccagagggaaactactgttatctggaacaggaaaactggtgttccgatttacaatgcaattgtatggcaggacaggcgtactgaaaatgttatgagaaaaatggaaaattatataaccgttatagaggaaaaaacaggcctcaggccagatccatatttcagcgctggaaaaatacaatggctcctggataatgtggaaggtgcgagggaaaaagcatcgaagggagaattagcattcggcaccgtagattcatggctcttattcaatatggcggggtcagggccccacgctaccgattataccaatgcatcaaggacaatgctatacaatatccgtaaactggagtgggatagtgaaatgctggaattattcaatattccagattccttgctccctgacgttgagccatcgctcaatgattttggatcaatttctatttctccaggaaaggaaatacctgtatacgcaattataggagaccagcagtctgccctgttcggtcatgctgccatatcaaaaggcatggcaaaaaacacatacggtacaggttcatttatgctggctaacacaggaaataacatcccggcaaccggttccctgatcgggactatagcatacgggttagaatataaaaaagtgagttacgctgttgaaggaagcattttcagtgcgggttcttctattgactggatgaagaatattcttaatgtgaaatcttacgataaactggaagaaatggcattgaaggcgcacagttccaatgcataccttgtccctgcctttacagggcttggctctccatactgggatcctacggccaggggaactattgttggattgacccattccaccggcaggaatgagatggcacggatggcatacgaatcagtagcttaccagacagaggacgttttgcaggaagttaaaaaagtaacaccggtgaaggaattaaaggtggatgggggattgacccgcagccaatttcttatgcaactccagtcaaatctttccggcttaaatattataaaaactaataccactgaaattacagctacaggttctgcatatatagcagggcttgcatcaggtttctggaagctggaccagctgggtgccatgtcatcgactgaaagaaagttttctcctgataatagttctggaggtgcacactcaggatattttggctggaaacaggcagtagctatatcctttggatgg

SEQ ID NO: 34616 - DNA, 1866 bp, Ferroplasma acidarmanus
atagataggtctaaaaatcctgcaaaagatttttatggatattgcaacgggaaatggcttgaagagacaactatacccgaagatagatcaagatatggggctttcgacatgctttacgaaaaaaatatgtatatattgaaaagcatacttgaagatcttaaaaagagttcccataacagcatggaaaaacagcttggcgatttttacacatccgctatggatacagagaggatagaaaaattaaaattcggccccattaagggtgagatggataatattaataatgttacaaaggaaaaacttcccgaactcttcgcagaattaaccatgaaaagcgtccagattcccttcgatataggaagtgcagaggatgcaaaaaatgcagaaatatattcactatatattggccagggtgggctatctcttcccgatcgggattattatttaaacgaacagatgaaaccaatcctggatgcatataaaaagcatatagccaggatgtttaccttatatggctatactcagaatgatgcagaaaatacggcagagagagttgtttcactggaaacagaactggctaagtttagcaggagcaaaactgatttaagggatgtagaaagggcatacaacaaatatagtatggaggaacttttccagaaattcccagaactaggctttgaccggtattttaaaataatcggttcaggcaatatgaattatgccataatggatgcaccggagttctttgaacaagcaggtgcattgttgaaaaatacagcaattgaaaatattgtttcctatctaaagtggaaggtattagccggcagcgcaatgtttctgcataaggaagcagttgatgagaacttcaactttttcaagaaaacactgctagggcaggaaaagatagctccaaggtggagaacggtagtcaatgtagtagatgcctctattggtgactctctggggcaggtttatgttgataagcatttcggaaaggaagctgttgaaaaaataaccgtactggtcaatgatataaaagccatttttaaagaaaggctggaaaacaatccctggatgagtaaggaaacaagggaaaaagctttgctaaaattctccaaattcaatgccaaaataggatatactgaaaaattcaaggattattcttccattgaaattaatccagatgactatataggcaatgttgaacgtgcagcatcattcgaactgaacaggcagctcaaaagaattggaaccaaggtagataaaacagagtggtacatgacccctcccacggttaacgcatatttcaatcccatgggcaatgaaatagtattccctgcaggaataatgcagccgccattttttgaccctgaaatggatgatgcggtaaactatggtggaatcggtggcgtaatatcacatgaaataacacatggatacgatgaccagggaagccatttcgatgaaaatggaaatatggtgaactggtggacagacgaggataagaagcgtttcgatgagatggctgaaaaagtagtcaaactttattcctccgtggaaatcctcccgggcctgaacgtgaatgggaaattaaccctgggtgaaaacattgctgaccttggggccgttttgatagcctatgaggcactgcagaaaaggcttaaggctgaaccggctaagaacataaaaatagatggtttaacacctgagcagagatttttcatatcatgggggcaggtctggaggactaaaattagggataacgaagcaagaaggcttgcgaccatagacccgcattcaccaggctctgtaaggtctgaacttccaccatggaaccatccggatttctgcaaaactttcgggtta

SEQ ID NO: 34617 - DNA, 1317 bp, Ferroplasma acidarmanus
cttgatcgattgccggtgagcaagttccatacgaagtttcttctgtacgttacaggaggcgaatttataattacgttccttgtcttgctagtcggaagtttgctggccattatttctgaagtttttcacctgtcaacagatgtgtcaacttatatcatgccaacagcgttctatagcgggatggttgtcggaacatttgcattcgggaggcttgccgatatatatggcaggaagaaaatttattttgttaatctactggtttttgcaatcggtgcgataattgcaggattaatgtcaaattacatacttataggagtgtttatgttcattgcggggattggcaccggtgcagaaataccgctaggagatacatacataagcgaaactatgacgaagcgcaataggggtagaaggttagcattagtatacacgataggtgtgattagtgctccattaggtgcgttctggctgttagagatgtctaacatcaaccttgcggatagctggagaattttcctaatagttctaggtgtagccgccttggtatttcaggtaatacgattcagaatgaaagagtctcccaggtggctggaatctgttggtagatataaagacgcaaacaatcttatgaatagcattgaagaagaggttatgaaagaaaaagatataagttcactcccgccggttgagaaccatacagaggtacttaaggagaaaccgaaatggatagacctttttgataaaaaattacggaaaaataccattatggtaattatattccaatatgcgcaaagtggtgtgtttttcgggtttacagctcttgtgcccactcttcttattgcaaagggatattctttagcctcaacctttttatttagcataattatctatatgggatttctagtaggcagtctagtcaatttactgtatatagacaaattagagagaaaaattggtgtttgtttgtttgtaggcctggcaggaatttttggcattatattctctattgctaataattcagcagagatagtgctatttggattcattgtagcttttatgctatggaatatgtctaactttttccatcagtatcaggctgagatattcccaacaaaacttagaggttctggaactggcatggggcagggcataaatgccatagcgtcagcgtcggtaccaacccttattgtagtatttgttctatcgcatggatcgcttgcggtattttctgttctggggatacttgttgtgattacaatagttgatataatgttatttgggccaaaaacaagccagagagaattggagtctatatct

SEQ ID NO: 34618 - DNA, 1332 bp, Ferroplasma acidarmanus
gatgaactgccagtaagcccgattctgctcaaaataacactgctttcctcaatgggtattttcatggatggctatgtgctttcaatttactcaattgccatactttatatgcgtgattacttccacctggtttctggaacgccattttacgtttattacattgcattcatgggttcttccctgtttataggaatgttctttggaagcataatccttgggaacctctccgataagtatggcaggaaaaaaatatacgaatacgatttgataataactatggtattcctcattatgagtggaatttctaccaatatccttgaatttatcatattcgaaattctggcaggtgtaggaattggtgcagattatccaataagctcatcaatccaggcagaattttcaccgaaaaacaagcgtggaaaattcctcgtgtttaacatattttcatggacaataggcggaatagtgctgcttctggttgcaattcctgttatcctttacattcctgcagctataaactggagaatattataccttacaggtgcaattataccctttttcgttatactatcgcggagaaacctgccagagagcccattctggctcacaggaaaaggaagagacagtgaagcattaaaatcatctaattacctgggcaaatcagcaggcatggaagtggacgaacttcctgttgtggaaagtggaaattcaaaaatcagggatttattctccaaaaaatatctttattatactatattcgtctcagttgcatggttttcatacgatgtttccagttatggcgtctgggaatataccccatctgcttttgcttatagcaattcgaacattgttatggttgttcttgccaccctccttgaggaattgccagtctttataggttttcttatatgcatgtactatgttgaaaaaaccgggaggaagagcctggagctaataggttttggcggtgccgctgtttctcttattatctttgctgcagtatcaaattttattgcccttggaatcctcctgactttcttctccttcgcaacaatgcaccttttccacaatatggggccaacaaaccttacctatgattatcctgtggagatattcccaacaaggattcgtggaacagcaatgggttttgccacatcagtatccagaataggtgctattgttggcaccatagcatttccaattatactatttacactgccatttacatttgtcctgattttccttgtggtgtttgaagtaataggtttttccattactttcctgcttgcaccggagacgaagggcaaaagccttaattgaccttttcctggc

SEQ ID NO: 34619 - DNA, 1374 bp, Ferroplasma acidarmanus
aatacgttaaacaagtacaacccgagcactggagaagttcttgatacatttcccgctgccactaaagatgatattgatgcagctatggattccgctgaatccgcatttccctcatggtcagatatgggaacacaggaaagggcaaaaatcctgtataaggcagtagaattaatatcgcagaaaagaggggagcttgaaaacctgctaactttagaagttggaaaaataaaacgtgaggctatagatgaagttgatggtgttattgaccagattcaatactacgctgaatttgaaaggaagctaacaggagatatagtggaagggtccagttcaaaaaggaaaatattccagtataaagttccatatggcatagtggttgcaataacgccatggaattttccggcagctatggttgtgagaaagcttgcaccggcattgttgacaggaaataccgttatactgaagccaagttcagatacaccgcttactgccaactggatcgtcaataaatttatagaagcaggaatacccaagggagttttgaactttgtaacaggccgtggatctgaaataggtgattatatagtaaaccataaaaaggtcggcctggtaactatgacaggttcaacttcaaccgggcaaaaaatcatgcaaaatgcatcctcaaatatggcaaaattaattctggaacttggtggaaaagccccatttatcgtatggaaagatgccgatatgataagggcattgaaaagcctaatatgggcaaagtacctcaatgttggacaatcgtgtatagctgcagagagattgtacatacatgaagatatatatgacaaatttatgtcaaagtttgtcgcaatcacaaagaaattgacaacaggggatccggatacatccgatgttgggccactgataaataaaaacgcgctggctgggatggtacagacagtaaacaatgcaaaggattccgggtataaaatactcacaggcggcaatactccggaccttcagggaaagtataaaaacgggtatttctttgcaccaaccataatagaaaacgttccacaggattccggattattccaggatgagatatttggccctattataggcactgaaaagatttccggggtagatgagatgtatagaaaagcaaacgattcgaagtttggattggcatcttacctgttcactgaagaccctgaactcatgctggaggcatccgagaaaatcagattcggggaactctatataaacatgccagggcctgaagcgtcacagggctaccatacaggatttagaatgacaggtcaggcaggagaaggcagcaaatatggaataaacgaatatctgaagttaaaaaatgtatatgtt

SEQ ID NO: 34620 - DNA, 1386 bp, Ferroplasma acidarmanus
aaaaccaaaatagtggccaccttaggcccggcaagttttgatgaatctattatcacaaaaatggctgataaaggattggccaccataaggattaacactgcacatatttcagaaggttatattacagatgtcagccgccttgtttataaaataaatgagaaatataataagaaacttggaataatggtggacctcaaggggcctgagctcagaacaggggaatttcccggtggaattttaaacataacagccgggaatacatatggaatttcagataacccgggagttaaatctgatatatccattaactacaaaatctctgattatgttgataaggatacactgatagcgataaatgatggcagggtaagattcaatgtggaatccatcagcaatggagtaataacaactagagccatggataccggaacaatacacgataggtcaagggtaaatattccgggcaaatacattgaccttggagtccttacagatagggacaaaatgttcctggaggaaggcctgaaaaataatataaatttctatgcactttcatttgtccagtcacgtgaaaatgtttatgagcttcaggactacatatatgaccgaaaagggcagggcgatattataagcaaaatcgaaacaaaaagcggttacgataatttagaatcaattgtgaaagcttctgattttatcatggtcgccaggggagaccttggtgttgagctgccattgaaagaagttgcaatggcccagaaaaggattatagacatatcacataaatatgcagtgccaaccatagtagcaacacagatgcttgaatctatggtaaattcagattcacccacccgggctgaggtatcggatgtaacaaatgccatacttgatgatactgatgctgttatgctgtctgaggaaactgctatcggaaaatatccggtagaggctgtaacatacctctacgagatttccaaatatgtagaatcacaatccacatctttccctgaaccggagaattttatggtggatcccatagctttctctgttgccaagggtgtgaaaattatgtcaaataccattgatgtaagttccattattgcaatgacaagaacaggccatacagcgaaaatattgtcggcaatcaggcctgtcaatgatatctatgctatcgtgcaaactgaatggcttgcaaggtctataaatctcatgaggggcgtaataccagttgtactgccggaagcacaggcgaaggaggaaaatatatacgatataataaataaaatagccccgcttggattgctgaatccaggggaaaaggccatcgttgtatcaggttctccatccctataccttggaggtacaaataacatcagggttatttctata

SEQ ID NO: 34621 - DNA, 957 bp, Ferroplasma acidarmanus
atgtacataggttccgggcttgaaaacaaaatcaacagtttcatggaagattatggcaaaaatatttcctttgttagctatgcactgaagcagctatacaaaagcaagataaatgccatttcttcatacaaatcatttttgaaagatggagaatcatctaaatctcagaagtatgttaatattgttataaaaaaactgataaatatggaaattgaacgggacaattccgtgtcgtatataggcgggggaactataggagaccttataggatattcagcatctgtgtataagcgtggagtgcacctgataggaattccaacaaccttgcttgcccaggtagacagttccataggtggcaagaacgctataaattttgaaaatttaaaaaatgctatggggacattctataatcctgatgtaatctttgccgatgttgatttcctgctcgggtcggaccctgcacttttaagggatggcatagcagaagcaatgaagatggcccttgtaaaggacaggagattctttaattattttacctcaaaaaacttgaattctatatacaataggaaaagcctggaatatgtaatatcaaaaagcgcaaagataaaactggatgttgtttcggaagatttttttgattccaggaaaatacggtacctgctaaactttgggcattccatcgggcatgctatagaatcttatactgaaaacagggtgtcccatggaactgctgttgccaatggcatgatactggaaagttatctggcatataaggccggattttctgaaccattttacgaaacagtaagggatgcagtatcagcctatgggattccattgctggatttcaacactattgaaacagataagctggtatcctttataaaaaatgacaaaaaagtcgaaaatggaaagctgaatatggtaatgttaaaaggccccggacaggcagaaatt

SEQ ID NO: 34622 - DNA, 663 bp, Ferroplasma acidarmanus
atttacaacagcctgtttatggactacggtatagattccatgtatattgcaatagatctgcacaggaaaaatttgccacgattttttgatttgtccaggggcaatattgaaggcttcaacataactgcaccgtataaggaagagtcaatacaatttatagactatgcagataaaatagtttctgataccggatcggttaatctcgtaaaaaaccagggtggaaaattatacggatataacagcgattacgctggatttatgatgcttgccagaaaaaataatattgatttttcaggtaaaaatgtaataataatgggcacaggtggtgcagccaggacagttgcatattcaataatgcaaaattataattcaaatatcagcatagtttcaaggaatcctggggaaaaaaagatttacggaatagccacaacaggatataatgatataaaggaatatgatattattattaattgcacgccactgggcacatttccagatactggaatgcctatcccggaaaatatgatacataatggaataaccggcatagaccttgtgtataatccctccaggaccccatttctgaaaatagtcgaaaaaaatggtgggattccggtaaacggagaggacatgttcatcgggcagggaattgaaacgttaaaa

SEQ ID NO: 34623 - DNA, 1194 bp, Ferroplasma acidarmanus
atttcaggtacaatttacgcaccgtcttcaaaaagttatacccagaggtatgtgctctattcagccttttccaataagccggtaaaaattaaaaatgtctcattttcagaggatgagatggtatcgcttaaaattgccgaaagctgcaatgccaccattaattacaacagaaaagatatagaaataaaaccggattttaaatgcccggatagcatttatgttggagaatccggaacttcttacaggctttctataggattactggtcgcaagaaaatgcaaaacaacaataaaaggagaacagcaactggcagggcggcctgttgaacctttaataaaagccttatcagatgcaggtaccaatttcaaaaaacacaaagatggcttttatatggtagatggtagaaattctgcttctacaggagtatctattgatggtggaacaagttcacagttcgtaagtgctatgttatattattattccatacttggagaaggaaacttcactgtcagcaatatggtttctgcgaattatgtaaatattaccattaactgcctgaggaattttggtatcacggtgcacaataatggaaataattattccatagaaaatggtgattacgctgttaaagaaattggcattgaaggtgattactcctctgcgtcttattttatagtactgggcatatttaccgggaacataaaaataaaaaacctgggtattgattcactccagccggacaggcaaattatagaattgttaaacaatgcaacagaatgcataaaaattggtggcaatgaacttaccgttgataaggcaaattttataaaaggaattattgtagacgcttctgcgacccctgatatagctccagtaatatcggttatagggatattttcgactgaaggtgtaaaaatttataattaccagaggttaaaaacgaaggaatccgatagatggaaaggaataattgaaatgtgccgggcatttggagcgaccgtttcagtatgtgaaaactttatagaaattaagaagggcatccttaaagacccggaatctataaaattcacagaccatcgcatgataatgagtgctataatagctggggtaatagcaggatctcatacggaatttaaaaatgcggagaaaattaataaaagttatccagaatttctggttgacctgaaaaggctc

SEQ ID NO: 34624 - DNA, 432 bp, Ferroplasma acidarmanus
ttaaaaattggagaacaggctcctgattttgaaacaattgaccaggatggaaaaaatgtaaagctctcagattttaaagacagcgtggttgtattatatttttacccgaaggacaatacgccgggatgcaccatggaggctaaaaacttcagagataatatagatatgtttactgaaaaaggcgtgaaggttttcggggtaagcgtagactcaagtgaatcacataaaaaattccaggaaaaatataaccttaatttcacattgctcagtgacaaacagaaagatatagtaaaaaaatatggcgtactgggcctcgctactgccaagagagttacatatattataaaagatggaaagattgtttatgtatacccgaaagtgagcccgggagaacatgcaaaagaagtatatgaaaagcttcaggagttaaaa

SEQ ID NO: 34625 - DNA, 1143 bp, Ferroplasma acidarmanus
atcggcgccattagcattttcgttgcaagctacaatatagctataatatctgtagcactaaaacccatagaaaatgcatttcaaaccggcaccggtatagtatatcttctgggtgcattgatatttgttggcgccatgataggtgcgataataagtggggtattttctgacaggtttggcagggtcagcatacttacaatagatatagtaacgtttataggtgcaggcatcgggagtgcattatccaccaatatcgcaatgctgatgtttttccggacactggtaggagttggtgttggaattgattatgttgtaattttcacatatatttctgagattcttgccacaaaaaattctacaaggaatttagccctgataatgttctttgccaattttggaatattattttcttacctcataggaggaacgttgttgactcttggatctacaggctggagatatgcactgctctccggagccatattggcaatagtccccctgattatgagaagcaggctcaaggaatccaccctatggaaatttaagagaataaagtctataaaaaccatattaaaagatgtaacgtcaagggaaaacagaaaatatctttacagattttccattccatggttcctttaccagattggggaccagagccttacgatgtttctgccatttatacttatatctgcactgggtatttctgtagtcagcggggcgttttcggctgtgcttgtcaaagcatttaccatacctgcatcaatagtagcatttttaatcatacagaggcttggaacaagaaaactccaggctactggatttattataaggtcagtatttctcgggatacttgggttcggcctatatttcgcattaaggtttaccggaatagaaattataatacttctgggatttgcattcttcttcggttccatggggccggataagaccacagtaataatgccagttgaaaaatatgacgaatcgattcgtggttcagggcagggattcaatgaaatggccgggagatttggcgggcttataggtatccttgcatttgccctcttcgggatggcgggcatagacatagggcttatatttctatccatcacgtgtattctcggattcataataacggttata

SEQ ID NO: 34626 - DNA, 1167 bp, Ferroplasma acidarmanus
ttcaggcttaatgtcaaaaaatcttttgattacgcattaaaggatgcaggcatgagtgtaaaagacatagatggttcggtatctgcatacttctctgaccatctacaggggcagttaatagcaggtgccatgtcaaatgactttatcgggcttgcaggaaagccatccaagagaatcgaaggcggtggagccacaggggggcttgcatttcaaaccgcctatgaagaaatcgcttcggggaatatggacacatgccttgcatatggctttgaaaacatgtcacatgttggaacctggaggggaaacgatataatagctctgggaagcgatgcaaatttcgattatccactgggaggtttctataccgcatattacgctttaatggcaacaaggcatatgtatgaattcggtaccacagaggaacagatggcaatggtatcggtaaaaaaccaccgaaatgccatcaataacccatttgcacaggcacctatgaatattacagtagatgatgtattaaaatctcctgttgtttccaccccattgaggatgctggatatctgcctgatgtcggatggtgctgcctgcgctatactggcatcagaggaagttgcaaaatcattttccggaaaaccggtactcataagtgccataggatcatcaagcgatactatgaggctggcagacaggccattcggtgatgtccccctgctcccgaatgaaaacagcgcaatgtacagaggacttaaatatccaggcgtccattccttcagggccggcaggctagcagctaaaatggcatatgacagaattggcataaaaaatccagaaaaagaaatcgatttcgctgaactttacgatgcatacacatctgccgaaatacaggcatatgaggatatgggattctgcccctatggcaaaggaggcaaatttatagaggagggcaatcctgaactggatggcagcctgccagtgaatatggaaggagggctccaggcatccgggcatgccataggcgcaaccgggataatgcaggcagtatacgctttctggcagctccagggttctatgcaaaaacacatgggtaacggaaagcttcaggttaagcccccttcccgtgggctaatccatagccatgctggaacaggggcatatgaagcggttacaata

SEQ ID NO: 34627 - DNA, 1104 bp, Ferroplasma acidarmanus
ttgaaagatgaatatattatgattcagcagagcgcaaaggaatttgcagaaaaggagataattccagtagcagcaaaaatggatagggagaatttctttccgagggaactcttcaggaagatgggaaaggagggttatctgggtgtaaccattccggagcaatacggtggatcagggtcagattacgtatcccaggccatcatagaggaggaaataagctatgcatcaggttcattagggctctcatatggggcgcacagcaacctgtgcctggacaatctctacaggaacgggtcagaatacttgcgtgagaaatatttagagaagctatgttccggggaacacgtaggctcacttggaatgacagaaccctcatcgggatcggatgcactttcaatgaaaacatcagcaacaatggataaaggaaattttatattgaatggaagcaagacattcattacaaatgccccatatgcagatatttttcttgtctatgctagaaccggggaaaacataactccatttgtggttgaatcctctgacaggggattttccaggggccaggagttcgataaaactggcatgaggggttcacctacaggaacaatattcttcaatgatattattttgccggagaacagaatagtaggaaaactgaatgggggaagaaatgtattgttaagcggcttaaacctggagcgggctgtacttgcattcaattcaataggaatagcaaggagggcactggatcttgcaataggctatgcgtccgagagaaaacagttcggcaggcctataagtgattttgagctggtacaggagaaacttgcatacatgtatactaaatttgaatcctcccgtctttttgccatggaagctctaaaaagggtgcaggaagaccggatggattccctggatgctgcctccgcaatactttatgcatccgagtcatcggaatacatagcaagggaagccctgcaaatttttggcggttatggttacataaaagactttgaaatagaacgtgtgttcagggactccatactgctaacaataggcgcaggaaccaatgaaatcaggaaaaaggtaataagtgaggcctta

SEQ ID NO: 34628 - DNA, 1254 bp, Ferroplasma acidarmanus
gaattaccacatatgaatttagttataatagggcatgtcgatcatggaaagtctactttcgtaggaagattattgttcgaacacggagagatcccacagcacataatagacgagtacaagaaagagtctgaagaaaagggaaaggcaacattcgagtttgcctgggttatggaccggtttaaggaagaaagggaaagaggagttacaatcgaccttacacacagaaaattccagacagacaaatactactttactattattgatgcacccggacacagggactttgttaagaacatgattacaggaacaagccaggcagatgcagcagtgcttgttgtttcagcaagagagggtgacggtgtaatggcacagacaagagagcacgctttccttgccaggacccttggtgtatcacagctcatagttgcagtcaacaagatggatgcaacacagccagcttacagtgaaaaaaggtacaacgaagtaaaggaacaggttacaaaactgcttaccccgattggatttaaggatgttccaattatacccatgagcggttacaagggagacaacatcatgaaaaacagcgcaaatctgtcatggtggaaaggcccaacaattatggaagcacttaataaccttaaggtaccagcaaaaccaacagacaaaccgcttagaataccggttgaggatgtttactccataacaggtataggcacagttccagtagggagagtggaaactggagtcattaaaataaatgacaaggtaatattccttcctgcaaacaagtcaggggaagtgaagtcaatagaggagcatcatactgcaatgcaaagcgctgaacctggtgacaatataggattcaacgtaaggggaattgcaaagaacgacctgaagagaggagatgtctgcggcccagtatctgcaccgccaacagttgtaaaatcatttacagcccagatagttgtacttcagcacccgagtgtaatagcagctggatacaaacctgtattccacgtacatactgcccagatagcctgcagatttgaagaaatcataaaaacaataaacccgaaggatggaaccacacttaaggaaaaacccgatttcataaaagcaggggatatagctgtagttaaggttatacctgacaaaccccttgtaatagagaaagtatcggagttcccgcagctgggaagatttgcaataagggatatgggtatgaccgttgcagccggtcagtgcatagacctt

SEQ ID NO: 34629 - DNA, 2169 bp, Ferroplasma acidarmanus
gttaattataacataaaactggatgttgatttttccggaaagaagtatagtggtattgagaaaataaaaattacagatgcagagaaaaaaattacactggatttaaataaaatagatatacataaaataaaagttaatggcgcggatgttaaatttgaagcaggagaagatggagttacattccccaccaatggcggagatatagttgcagaagtgcagttttcatctgataatgacagaggtttgaaaggattttatgttgcaggcactgaaaaagagtatatactgtcaacccagttcgaagaatccgatgccagaagggcatttccatgcatagacaatccaaattataaggcaacctttgatatcacaatggcaatagacaaagacctccaggcaatatcaaatatgccggtaaagttcgaaacacttgaaaacaacaaaaaggttgtgcagttcgaacaaacaccggtaatggctacatatctcgtttatctgggcgtgggccacttcgatgagatggaggataaatacaggggaaaaagattggctttaacagcaatgaaaggacatttaacagagtcaaggtatcctattgagtgtgccaaaaagtcccttgagtatcttgaaaactacacaggaatagattacatgcttccaaagttgaaccttatatcggtaccggaatttgccgcaggtgcaatggaaaactggggagctataacattcagggaaattctattaaacatagataaatcaacaactagcagaagctacaaaaggactgcggaagttataacacatgaacttgtgcatatgtggttcggagaccttgtaacaatgaagtggtggaacgacctctggcttaatgagagctttgctacgttctttgctttcaagactgtagacagcacaaatcccgattggaaattcttcggagattttcttctggaccagacagatggggcttataccatggatgcgctgaaaaattcccatccaataaatgctgatgttaccgatccaaggagcatatcacaattatcctatgaaataagatatggcaaagggtcaaatgtcctgagaatgatagaagcatatgttggcaaagatgtgtttatgaaagctatgagaaactatttaaaagaattctcatacagcaatgcatcaggatctgacctgtggaatgccatagaaaaggaatcaggcatgggcatatcaaccattatggaacagtggatttcccagaaagggtatccgtaccttgaaactgcaaaggatggggattcactcaaaatatcccagaaacaattctatttccttgaaggcgataaaaattcaacatggaaaataccgttatttataaacaggttctccagcgaagaaaagttattgatggaaggaaatgaaatgaaggtagatggcgatatattatcccttaatttcaaccataatggattttacagggttttatacgacgattccatgtttgaaaacatatcgagaaatctttcccagattacagcagaggagaaatgggggcttgcaaatgacctttatgcctttttgctttcaggaaaaataaatatgacaacatatgtcagaaggctggaaaagctctatggaatcaatgagaacatagtaatagatgagatatcaaaggaacttttcaacctttatacaataacagacaataactatttcaaggacctggcgaatttctatataaaggacaaaatggagtacgtagaggcaaacaggaaggatgattttaatttcaaaattaccctttccgggctttacacaaagcttgcctatataaataatgatttctgcaaatctttattaaaaaaatacagcagctacgaaaatgttgaccctgatttcaggctggcatatctggttgctgaggcaaagataaaccaggatttcagctactttgcggatattataacaaacacgaaaaatgatgaggacaaaacaaaagctataactgcatctggtgcacttgagggcgataaaaatcacagtgcaatcatggaattcgtcaaatccggaaaagcaaagaagcaggatatggattcgttctttgttgcaatggcttcaaataccccatccaggcagtttataatagacaatctcaaggatatagtagacatgttgtacaaa

SEQ ID NO: 34630 - DNA, 828 bp, Ferroplasma acidarmanus
atggaaataacattcaataaagttacaaagaaataccataaatttatggcactcgatgatgtttcattcaattaccgtgaccatggggctattgggtatctcgggccaaacggcgctggaaagaccacaacccttaaggttatgacaaatctcctccgcccgtcggaagggcatgcagaattaaatggcatagacgtaaataaatatccaaagaaagcactggcaaatgttggctctatgatagaaacgccaactccatatccatttcttactgtgaaagaatcaatgcaatttgttggtgaattaagaggaatagataaaaaaacaatcaattcaaagatagatgaattctatgatgcattgaaattgccaccattgacatcgaaaatgggccagctatccaaaggtcagaggcaaagggcagtgtttgcatctgtattaatatctgatccagatgtagttatacttgatgaacccaccagcgggcttgatccatttgaaagaaagatattccgggattttatactggaattgaaaaaaaccaaactggtcttcttttcatcacatatactttcagaggtttcagaaacctgtgacgatgtgatttttattaatcatggcaagatactgaaacagggtaaaattgatgagatagcccaggagtttaacaccaatgccgtctctatagaattcctcaaacccttagataacaatatgataaaaaacattcagtcactgggaagcggtgtattaaagacagatgggaaatacgccgtaattaaattttcagggaaggaagatgaaagggcacagatactggagaatgca

SEQ ID NO: 34631 - DNA, 1350 bp, Ferroplasma acidarmanus
aaattcccggataatttcatgttcggtaccgcaacaagcccatttcaggtggaaatgggcagatcagataattctatatcttcagagagcgactggtataaatggtcacatgatagtaatataatacagaaaacctatgtaagcggagatttcccggacgatggcccggatttctggaataattataaaagattcatcgatgcttctattgatatgggaaataattccataagaattggcatagattgggccagaatattcaaaacatcaactgaaagtgtggatgcagttgcaagcaaaaacgaaaagggtgatgtttatgcaatgtcattccctgataacgttatccagagaatggattccattgcggataatgatgctgtaaagcattatgttgaaataatggaatacataaaggcaaaaaatttaaagcttattttaacagcataccactggcctttgccactatggctccatgatcctgtaaaatgtaaccaggactttgcaaattgcagggaaaaaggatggggagacaaagccacagtagaggaattcggcaaatacatttattatatttataataaatttcacagatatgtagatatatggaatacactgaatgaaccgaacataatagctattaatggctatgtttatggcaatctggagggatttcctcctggattgtctaacttttcaatagctgtatccgttatgaggaacctcgcctacgcacataatatagcatataaaattatcaaggcacttgatcattcctcacaggtcgggatcaatgtagctgtcccatatttccagcctgaaatggatacaccggaaaacaggttcattgtaaattatgttaaacacattttttatgacctgtacctcaattctgccctgtacggaaactttgacaattccctatctggaatttttaatgaatcacgcccctctgaatttgcaggtacagattttataggaatagattattacagcaggataagggtaagatatgtggacaacgacaatgttgacctgaggtatagatttgcctttttgccctgcagcaagtgctcggataattactgggatatatttcctgaaggcatacgcaatgtttcgaggtcagtattcaaccattacagaaaacctgttatgatactggaaaatggggttgcggatgcagaaggatcattgcgcaaagaattcatagaaaaacatcttatagagctacataaggccattaaggaagattatatacctgtaaaaggatatttccactggtctatagtggataactatgaatgggccaggggttataaggacaaattcgggctttataaaatcaat

SEQ ID NO: 34632 - DNA, 945 bp, Ferroplasma acidarmanus
tttccagttgaacgtatgagaaggtacaggttaaatagcaatctaagggatattttcagtgaaactacaataaattcagataagcttataatgccagtttttgtagatgagacagaaaaatcgaaaactgcaattaagtcaatgccaggaatttaccggtatgcattgaacgaatatgaaaaatatatagggcatcttgaggacatcggggtcaaaaatattataattttcggaataccaaaacataaggattcttcaggcaccgcatcctatgaccatgatggaatagtccagaaagccatcaggtctgcaaagtcaaatacaaaattgaatgtaattgcagatctctgcctctgtgaatatacggatacaggtcattgtggggtaatatccaatggctatgtggataacgataaaacccttgatatttatggaaaagaggcaataagctatgcagaggcaggcgttgacatagttgccccttcgggtatgatggacgggcaggtcggggccataaggaaggcaatggattccaatggctatgtcaacacacttattatggcatacagttcaaaatttgcatccaacctctatgggccattcagggatgccgcagattccacaccacaatttggcgacaggaaaagttatcagatggattaccggaatggtgacgaggcaatgcgtgaaatagaccttgacgtgaaggaaggcgccgacataattatggtaaagccagctttattctacctggatatgatttaccgggcaaagcaactttataaaatgccactggcaacatacatggtgagcggtgaatatagcatggtcaaaaatgcagtactctcaggggcactggctcccgatactgtaaatgaagcgcttatttccctgttcagggcaggctctgacctagcgataacttattttgcggaggattatata

SEQ ID NO: 34633 - DNA, 837 bp, Ferroplasma acidarmanus
gaacgcatagtaatagcacttggcgggaatgccctcgacaatggaaaatcaagtatagatgaacagatagaaaaagcctctgaaacatttctaaggctgtcagaaattataaataacaacgaagttgtaataacctatggaaatgggccacaggtaggtgaaatatacgataaaacaggatatcctttagatattagcggcagcatgtcccaggggctgcttttgcacattctggcaatggcatatggttccctgaagatttcaggcaagctcaaaaaaaatatagtccccattctgacaaatactgttatagacgaaaataaatacactctaaagcctataggcccatttttcgatcataagatagacgatacatatgccatggaaatgaacaaagggtacaggaaaatggtaaaatctcctgaacctgcaagtattctggagatagattctataatcaatctggtgtcaaatggctatttgccactggcagtcggaggaggtggggtgcctgtagaaatattgaataaaaaatatatggggtttcagggtgtcatagataaggatttgagttcgtccttgctcgcaacacttctaaacgcaaagaaatttattattattacagatgtgaataacgtatatctggatttcaagaataaaagtgatcccattaacaaaatatcctataaacaaatgctggaatattataacaaaattaagtttgaggagggcacaattaagcctaaaatacttgccgcactaagatttattgaacacggcggcgaaaaggtctatatcacttcaatttcaaatatagaaaatatggaaagtgggact

SEQ ID NO: 34634 - DNA, 945 bp, Ferroplasma acidarmanus
cggatatggtggggcacactgcatgacagctgcaatagagagaaagtgattgaaatggtaaggtcgttattaacattaaaggatatagaaccggaagaatttacagaaatggtaaacagggcagtgtattataaatcaatgattggaaacaagaaaatggtagttccagtattaaaaggaaaatatgcagggctattgtttgagaaaccatcaacaaggacaaggacatcatttgaggtagcttcggaaagaatgggtgggcatgcactttatttatcttcagaccagctccatctttccggaggagaacctgtaaaagatgtggctagaatgcttggtggatggctggatatcatggttgcaagggtattcgcacaatctacccttgaggagcttaagaaatattccggcatcccggtaattaatgcactgagcgattccgaacatccaacacagatggtctctgattttcttacaataatggaaaagaaaaagaaatttaaaggattaaaaatgacatttgtcggcgatggcaccaataatatggctaattcccttatgcttgcatgttccatgacaggaattgatcttacaatagcaactcctgatgcgtatcagccggatgcgtcttataaagcttttgctgaaaaactagggaaaaaagcagggtctgcaataacagtaacagataatgtccatgattcggctattggggccgatatactttatacagatgtgtgggtcagcatgggagaggaggcagaacggcagaaaagacttgaagatttcaaaggatttcagattaatagtggattattgaaacttgcaaggcctgatgccattgtaatgcattgcttacccgcagaaagagggcttgaaataacagatgaagtcatagaaggaaaacaatcagtagcatggcaacagggagttaataaaatatac

SEQ ID NO: 34635 - DNA, 2220 bp, Ferroplasma acidarmanus
ttaattatagcagaaaaaatggatgccggaaggcgtatatcgtacattctctcggataaaacatcgaagcagaaaaaaactaagaacatcagttatatagaatttgaaaggaacaatgagcagaatatcatggtctcattaagtgggcatatactaggagctgattttccagaagagttcaaagattgggttaaatctgaccttgataagcttatagactccaatattatctataaagttaccaaccagagggcatattctgcattgaaatcattttcaggcattgataatatcattatagctactgactatgaccgtgaaggagaacttataggagtcgaggcattaaaatttatagagccgggttatacaaacatcaggcgtgccaaattcagtgcattgacatcacaggaggtaaaggatgcctttgacaatcttcttgatgtaaattacgggcttgcagactcggccaaggcaagggaagagatagacctgctctggggtgctgtcctcacaaggttcttttctgtaacaagcaaccggctctggaaagattttatctctgtgggaagggtacagacgccaacactggcattgatagttgaaagggaagaagaaataaaaagctttgtgccggaaaaatattttgtcataaatgttacattcaataagggaatagatttccagggcgtatatgaaaaaaatataaaagacgaagatgaagcaaataaaatttttaatgcaataaatgggaatgatggaatagtaaaatcatataaaaatgagaaaaaagaggtatataagcccccaccattcagcacaacagatttcctgagggaagcatccagaataggggttacaccctcaaatgctatgaaaatagccgaaaagctctatatgagcgggcttataagctatccaagaactgacaatacagtttaccagcggtccataccacttaaaagcatagcccaaaaatttgaagggactgaatttgatactgaagcaaagatggtactggggcaggaaaagatttatccatccaggggcaaggttgagactacagaccacccaccaatataccctgtttcatatccgaaaaaggcccttacaggtgcatataaaaatatctatgaattgatagtaagaagatttttagccacattgtataaaaatgcagttatagaaaaatctgatgcggatattgacataaaaggttacaattttaaagtgtcgggcgaaaaaataatagacaacggatggtttgatatttacaaatacagaaaattaagagagtccaaactcccggaactggtaataggggaaacagtaaaaggaaaaaaatgggatatggaagaaaagtatacagagcctccaaagagatacgatgtggcatccctgcttaaactcatggaatcattgaatctcggaacaaaaagcacaaggcatgacattatacagaagctcaatgacaggaactttgcaacaggcaatcccttaaggccaacgccactgggtatagggttcataaaatctataacaactatcgattcagatattgcaaagcctgatatgactgccgagctggaaaaagagatggataaaatagcagaaaaccagaaaaaattagatgatgttgtcaatgactcaagaaatatgcttcacagtgcgttaaaaggtttcaggggaaataaggaagaaattaaagaaacaattacatcatatgctaacaagggcgattctatagggacatgcccgctggatggaggagaaatatcactggttaaattcaggaatttttcaaaaataaagtgctcaaccgaaggctgcaaaatcaattttaaccttaacgccaccgggctcgtacagatgacggataaaagatgtgatgtatgttccctgccaattataaagattatcaggaaagggcaatcccccgaatatagatgtgtcgatccgaattgcgaatataacagaaaaaagctttctgttggaaaatgcccctctgatgatggtgacctcataatcaggcaatccaggtatggaaagcggtttctgggatgctccaactatcctaaatgcaccgtaacatatccacttccccagaaaggtgtgataatgccaacaggagaaatatgccggtactgtggcgcaccattgcttataatggttaatggaaagagaaaatggaaattttgcccgaatatgaaatgtgaatac

SEQ ID NO: 34636 - DNA, 1170 bp, Ferroplasma acidarmanus
aaaataacatttgaaaatggaaagtggaaagtgcccgataatccgacaattctgtacacagacggtgatggcataggcccagaaatcatggatgtaacgaggaaagttgtggatgctgcagttaaaaaggcatacaaaaataaaaaaatagagtggaaagaaattcttgtaggggacaaagcactgaaagagaaaaatgatcgtttcccggaagaatcacaggaggcaataaaacaataccgtgtactgttaaaatcgccgcttggaacacctataggtactggttttaagtcaatcaatgtaaggataagagttatgctcgacctttattcaaatataaggcctgttagttttatgaaaggtttagaaagcccactcaaacacccggaaaatgtaaatttaaccatattcagggaaaatactgatgatctttacaccggaattgagtataagtatgacagcaaagaggctgccgaaattagaaaatttttcaaagacaaattacatgttgaaataagcgacgattctggaattggaataaagccaatgagcaaatataaaacccagagaatcacaagagcggctgcaaaatttgcaattgaaaacaacaaaaagaagatcactataatgcataagggaaatgtaatgaaatacacggaaggcgctttcagggaatgggcatatgaaacacttaaaaacgaattcggtaattatacatcaaccgatgattcaagtaaaatacttgtaaacgacatgatagccgataatatgttccagcagataataacaaggcctgaaaactatgaagtgatattagctccaaatatagatggggattatatttctgatgcagcaggtgcattaataggaaatatcgggactctaggcggcgcaaatgttggagacgatgcaggaatgtttgaagcagtgcatggaaccgcaccgaaatatgcagggcagaatgtagcagacccgctgggattgataagaggagcgcagcttatgattaaatacctgaactggcacgaagcatttgatgtgatagaaaaagctataggggaagctatagagacaaagaaagtcacaaaggaccttgctaaattctttgatgttccggcaatggggacaaaggaatttggtgactcgcttgtgaaaattatagatgggcta

SEQ ID NO: 34637 - DNA, 978 bp, Ferroplasma acidarmanus
aatgaagatttaataacgatatattctactatgataaagatcagaaaatatgaagaaaaattgcgcgatatctatctcagcgataaaaaaccactatttaacattgcagccgggaagattcccggtgaaatgcatctttcggctggccaggaaccgtcggctgcatggatgtcggttttgctaaggaatgatgattttgtttacagcacacacaggccacaccatactgccatagctaagggagtagacctgaacaggatgactgcggagataatgggaaagcatggtgggttaagcaaaggaaaaggtgggcatatgcatatttttgataaaaaggttaatttcgcctgtgccggaattgtaggttcatcttttccctctgcacttggagcagccctggcatcgaaactcgatggtaaagacagcattgcagtggcatttggaggtgatggttcattaaaccagggtatgttccttgaatcattaaatcttgcatcattatggaaacttcccgtaatttttgtaatagaaaacaatgattgggcaatatctgtggaaacaaaggattctacgccgcttaaaaatgatgctataagagccgatggttttggaatgcccggagtttacatagaaaataatgaccctgtaaaaatgtataaagcggcagaaaaagctgttaagagggcaaggagcggggaagggcctacccttattgctatcgatacgtacaggtactacgggcattttgaaggtgatcctgaagtatacaggcctaaagatcaggtaaaggaacttcttgcaaaagaccccataaagataatggaatccgacctgcttaagaagggcattatctcaaaggacgaagacgacaggataaataattcggctatggaagaaataagccaggcatttgcatttgcagaagacagccctcttccggtgggaagcgactccatggatgacgtgtatgctcctgta

SEQ ID NO: 34638 - DNA, 990 bp, Ferroplasma acidarmanus
aaacttccggtttacatggcaatttcagaggcaatatcccaggagatggagggaaataaagatgtactttatatgggtgaagatgtgggaaaatatggcggaatttttggggcaacaaccggcctgtttaaaaaatttggggctgaacgtataagggacactccaataagcgaatcagcatttattggctcggctgctggactcgctgctgccgggaagcgacctatagttgagctgatgttttcagattttgtcggcgtaacacttgaccccataatgaaccagatagcaaaaaaccattatatgtctggcggcactgtaaatatgcctgttgtcattaccaccgctgttggaggcggctatggtgatgcagcacagcattcgcaaacgttgtattcactcttcgggcatcttcccgggcttaaggtagtggtaccttcaaacagctatgatgcaaaagggttgatggtatctgcaataaaagataacaacccggttgtctatatgtttcataaggggcttctgggattgccatggatgccatatccacaatctacagtgaccgaagtacctgaggaagaatatactgtcccaataggaaaagccagaattgccagggaaggaaaagacataacaataatcggtataggcgctacggtgcatatggcaatggaagctgcaatggagcttgaagagaatggaattaacgctgaagtaattgacctgagaagcataaagccgcttgatactgatactgttataaggtctgtcgggaaaaccggatcactgcttgtggctgatgaagattatgctgcattcgggcttgcatcggaaattacatcggctgtaagccatgccctcttcgggaaacttgataaggctcctgaaagcattgtatcccctgatgtgcctgtgccctatagccagccaatggagaaatactggcttccggacacacagaaaattgtaaacagagttatggagatgttc

SEQ ID NO: 34639 - DNA, 1632 bp, Ferroplasma acidarmanus
atggaaaaaaagaaatggtttgatatctggccctactatctaccttttacaatagattatcctgaaatggacatatgggaaatgctggaaagcccatccggattatacgggaataaaaatgcattggtatattatggaaatagaataaaatacagggagctatggcagaacgtaaaaaatctttctacatatataaaaatgatggggtttggaaaaggagatagaatcggaataatgatgcagaattccccccagttcataatttcattttttgccatatcaagatccggagccacaattgttttgatgagcccggcactggatatggaaactgcagagtatattgcaagagatacgaatttaaaaatggtaattaccacggctgaacttttaaaggtgccatgggacctccatgaaaaattcaatattcctgtaatatgcggcctgctcaaggattacattaaagagcccgatatccctgttcctgaatttgtgctcgctgatctggatataaaaggcgtaccatggagcgaagcggtggaaaatcgccctgatgccgggcatattgagtcgggggctgacgccgaggcattgatagcatatacatcaggcacaacaggaattcctaagggatgtgtccatacaaacagatcggtgatatccaatgcaataggagcttccatatggaggaggcttacttcgtcggcaattgagctgggagcagcaccatttttccatgttacagggctctcattttcgatgctgtctccagtgtattccggcgcaacaattgcaatattaacaagatggaatagcgaggcggcaatagaagcaattgaaaaatacagggtaacccattttgtatctgtagccccgatgatagttgacctgctgaaccagaagaaccttgaaaatagagatttctcctccatgcgttttatcggtggcgggggtgcagcaatgccagaaatccttgcagagaatatggaagatttatttcatattccttttgtagaaggctatggaatgacagaaaccatgggacaaacacacataaatccgccggaacacaggaaattgcagtgcatcggaataccgcaatttggctatgatgcaaaaataatttccacagaaaccggaacccctgtagaagaaggcacgggcgagattgtggtcactgggccaagcctgttcaccggatatttaaataagccacttgataccatgcaggcttttgtagatatcgatgggcaaaaatatctcagaaccggagatattggatatatggacaatgaaggctcattttttgttgttgacaggctaaaaagaatgataaaccgtgcgggtttcaaggtctggccagcccaggtggatagtttaatgctaaaacattcggatatactggaagcctgtgtggtcggcacgcctgatccaagaaatggagaagaggtcaaggcttatgttgttcttagggagcctggaagaaacaagaaaatctctgaaatggaaatagttgaatgggctaaaaaggaaataggtggttataaatatccaagaatagttgaattcatagaatcgttgccgaaaactgcaacgggtaaagttgactggagaaaactccaggagagggaa

SEQ ID NO: 34640 - DNA, 1128 bp, Ferroplasma acidarmanus
ggctttaattctagatgtgtccattccggagacatggaaatagaaggtgttggaaacgttgtaacgcctatttttgaaaattcaaccttcgagttccctgagagtggcgtagccggcaaatatatctattcaagatggggcaaccctacagttgaatcctttgaaaaaaagtatgcagaccttgagaaaacagaacatgcttttgccttttcaacgggcatggcagctataacctcaagcatcatgccatacctgaagagtggcgactctgtacttgcgctcaatgaactctacgggcaaacatttggttttttctcaaaagttctgccacagtataaaatcaatgttgattttacatctgtcaatgacctgaatagactggattttaaaaataaaaattataaactgctttatctggaatcaattactaacccactgctggaagtacctgatattgtaaacctctccagaatctgtaaggaggagggaataaaactcatggtggatgcaacctttgccaccccatacaaccagaatcctgtttcactgggggcggatatggcgttgcatagcgggacaaagtacatatcagggcattcggaccttttgatagggcttgcgggcttcaatgataactatgataaccttgatttttacagaaaaacttttgggggaacgcctgatgcatttcaggcttttcttgcatacaggggattgaaaaccctgggattaaggatggaaaggcataataaaaatgcaatggaacttgcaaaagtattaaacgagtctagtagaatagaggaggtttattacccgggtctcaaaaatagtgaatatttcgatgttgctgagaaaaacctgaagggttatggtggaatggtgtcatttaaggtaaagggtggaatagaaaattcacataaattgataaaaaatcttaatattccgaaatatgcagtaagcctcgggggcgtagaaagcctgatatccattcctgttgaagggacacataaagcactatcacctgaagaaaggaaagcatcaggaatcacggacaaccttgtaaggctttcagttggaatagaggattcagaagatttattgcaggattttgaaaatgcccttgaaaaa

SEQ ID NO: 34641 - DNA, 2043 bp, Ferroplasma acidarmanus
gatttcttcgaccgttatgactataatgatcagattaacaaactcagaagcgactatccggatataaaatcactatacatttcatataacgatttatcaggctatagcaccgattttattgaagggctgatgaaggacccatattattatcttacaattggggaattttatataaaggaaacattgggaattacatacaataaggtcaggaggataaatatcagattggtaaatgtccctgaaattattggtataaaatatgatatacgcaatgtaaggagcagcaatgtaaattcatatatctcaatcaacggaataataaggaaaaatacagaggtattgccaaggctccagaatgcagcattcaaatgccccgcatgtggcgaacttaccatagtcccggaagacatacagaaactttttgagcctacagcgtgccaggcatgcggatggaacaagggaaagctaaaactaatccctgaggaatcagaatttgttgatacacagaaacttgagatacaggaaaatccggatacaatagatagcacttcacagccacagaggattacactgataatagaggatgacattactggaaagatataccccggtgacagggtaaccgtatatggaatactgaaggcagatgaaaaacatattggaaatacaatgctgactgaatataatatatatttaaatgtaaataatttcaagaaggaaaccagagatttcgaagaaattaaaataaacgacgaggatgaaaaaaagataaaggaactggcaagggagccaaacatcatagaccggctggcaaaatctatagcaccatcaatatacggtttagacgttattaaaaaatcacttgtattacagctttttggtggcgtcaggaaggtaatgaaagatggaactcatataaggggggatatacatatactcatgataggagacccgggtaccgccaaatcacagcttttaaggtatatgactttcatctcaccgaggagtgtatttgctttcgggaaaggttcaagtgctgcaggattaacagcagctgcagtaagggatgattttggtgagggcagatggacgcttgaggcaggtgcccttgttcttgcagataacggtttcgcggcaatagacgaacttgacaaaatggataaaaacgataccgcatccatgcatgaagctatggagcagcaatctgttaccatatcaaaggcaggcataatggccacccttaaatcaagatgctctatacttgcggctgccaatcctagattcggcaggtatgaccccatgaaaaccatagctgaacagacagaattcccaccacccttgctttccaggtttgatataatttttaaattaatcgatacgcctaacagggaaatagatgacaaactggcagaacatgtacttaaaactaaccggctcggagagatatacaggagtctggaaaacaacaatcttgagatcgatatacctgatgaggagaatttcatagcagaactggacaaagacctgataagaaaatatgtgtcatatgccaaaaatagagtgttcccaaggttgagtgatgaagccataagcatattgaaggaagagtatgtaaaaacccgtgcaagtggcatagactctgtgcccatcaccgcaaggcagcttgaatcaacaataaggcttgcagaggcagcggcaaaggcaaggctctcacctattatcaccgttgaagatgcactgcttgccaagggagttgttgattactaccttaaggaagtatcggctatgaacggtcaggtggatattgatatacttaacacaggaataagtacaaaacagaggaccgaacttgaagtaattctgtccgtgattaaggaagctaaagaaaacagtggggatcagaaaaaggcaccggaaattgaaacagtaatagagatgttaaagcaaaaaggaatcagcagggaacgggccgaaacagacctggcaaggctaaaaagtgatgggtttatctatgagccttcaaataaaagggtagatgtgatc

SEQ ID NO: 34642 - DNA, 1005 bp, Ferroplasma acidarmanus
atgatggaatccagatccattaaaaattatgttatccttgttacatgcaatagaattgaaatatatttccggcctgaagagattttaatgggtagcattgaaggatcattatatcttgaatatcccgagtccgtaaaacatctgtttatggtggcttcaggccttgaatctatggctattggcgaaaatgatattttaaggcagataaaatcatcctttgacattgcttccaaaagaggaaagctggacaaatttttatcctatacattccgtaaagccctttctgttggaaaggatgtgaggacactcactgatatttcacatggaaaaacgtccctatcatccataagcctggatattatagaaagccagtatggtttggcagggaaaaagttatgtataataggaacagggaaaatgtctactgcactcttaaattaccttgcaggttcaaaaactattgtaactgttgctggaagaactattgatcatgcgagggatctggcaataaagtatggagccaattattcagatatcggtaatattcagtcgctaataaaatctaacgagataataatcgctgcaacatcgtcaaagaattatataataagagcagaggattattccactattaatgaaaataaaatcatgattgacctttccaaccccccaaatatagaacaggcaatgaatgaatacattgcgttttatgacctggacagaatatatagtatttccaaggaaacaagggagcatagaaagcttgaaattaagaaagcggaagaaatcgttgagaatgaattgacactgtacacctccaaaatcaacgaaatgaagtccgatgatattattgcggcattttacaaatttgccaaccagataaaacaggatgagcttgaagagctggcaaggaaaacagacataaaagaagcccagatggaaatcatagacataatgatgaattcatttacaaaaaaacttcttgcaccctatacagattctata

SEQ ID NO: 34643 - DNA, 1350 bp, Ferroplasma acidarmanus
agaacagaaagagatgtaataggcgaagtacagattgacgattccatttattatggaattaatactctgagggcaaaaaataattttaatatttccggaataaaatcaaaagaccgtgaccatataaaagcaatggccattgtaaagaaaggggcagcatatgccaactatactgccgggaagctacagaaagagctatacgaaagcataagcaaggcatgtgacagattaatatcaggagattttgatgaacaattcgtagttgatgttttccaggcaggggcaggtacttcattcaacatgaatacaaatgaaatactggcgaacctggttctggaatcacttaaccataagaaaggcgaatataaatacgcacacccaaacgacgtaattaacatgagccaatcaacaaacgatatttaccccaccatgatgcgtgtgagcataatgctaaaatcaccaaaacttatcgaaaatgcggaagccctaataaaatcattaaaggcaaagcataaggaattcgagaaagtttacaaaaccgggagaacccaccttcaggatgccgtcagggttaccctgggggatgaattcaatgcctgggcatttgctattggcagagatttgaaggaattcaaatccgcactggactatatactggaattaaatatcggcggtaccgcagtgggaaatggggcaaatacaccggatggatacaaagaatacgccgtgaagaaaatatcagaggaaacaggcttcaatttcaggcccggagaaaatcttatgggcataatgcagtttatgaccgatttttcaagggtaatcaactcactgtcaaatatggcacttgacctgagcaaaatttcagatgatttgaggcttctctattccgggccgggagcaggattacatgaaattgtcctcccagcagtacagcagggttcatctataatgccaggaaagataaatccatcaatagcagaggctatgaatatgatatgccattccataaccggatcacagcaggctgtcaatctatctgtaaaagcagggcagctggaactgaatgttatgatgccccatattgactatgagatatccaagtcaatagaaaggctggcaaatggaatcaaaatgctggatgaagaagccatacagggcataaagccggatcttaataagataaaggaaaacatagaaagaagtttcgggtctgccgcattgctgaatccatacctgggctacgataccatggccaagattgttgaagaatcccttgaaactggaaaaagcataaaggaccttgttctggcaactggaaaaatagatgaaaagaaatataaagaaatattt

SEQ ID NO: 34644 - DNA, 1101 bp, Ferroplasma acidarmanus
atagagttcaccgattctggcatggtggttccggatatccttaccatcggttatatagatggcgatggcataggcccggaaatcaccggagctatgataggagttgttaacagtgcgattgaacttgcgtatcagggcagcagatccattgaatggcataaaatactcataggaacagaagcatatgagaagtttggaacttatgtgccggaggactccataaaggaaatccagaaaatgtatatagccatgaaatcaacactgaactttatgcctgacaagagagatttgaatacaatattgaggaagcgacttgggttatattcaaatatacggatattaaaatatattgagggaatggatataccggtaaatacattcaacaggctgaatctaacaattataagggattccacccctaacagccacatattttaccattcttctgaaagcaccgatgatttaatccggtttatatcggacaattatggattgaatattactcctgactcagggatatatatgatgccccagagcaaattcaggacaaggaagattgcaaaacaggctgtaaggtattccagaaggaatggaaaaaagaaaattacaatactggaaagccagcaaaaccatgaatttgcaaactggtgcatagaggaagcatcagcccaggaagatgttggttatgaggttctgaaaacacgggaattcatgaaacggctgatatcctcgccggaagattttgaggttatccttgttgacaatgtattaagccagacactggtagactaccttgcaggtacgattaatatagagtatggatcaagtatcggggatgaatgtgcggtttttgaagctgtccagtcctctttgccatctgaagcaggatatgatgctgcagaccctctttcattcattctttcaggatgtgagatgcttatgcacataggatgggttgaggccgcacaaattattgagaatgcaatatcagccgcttttagggataataaaattccaaaagatataaacacaaggccggatataagccctataaagtgctctgaattttcatcagaaattataaaaagaatgaatggtgtc

SEQ ID NO: 34645 - DNA, 1047 bp, Ferroplasma acidarmanus
tcactgggcaatgaaatcaagcttactgtttttggatcctcacatggcccttacataggcggcacggtggacgggcttcctgcaggattggcaattgatcaggaatttatacagaagtggcttgacaggagaaaacccgggcagagcctgattacaactccgagaaatgaggacgataaaatagaaataattggtggaagcaggaaaggattcacagatggttctccgcttgcctttatttttaaaaacaaagattatattgataagcattatgatgatttaagggacaatccacgccccgggcatgcagatttaacaatgttttacaaatatggcgaatacaggaattatgaagggggcggttttttttccggaaggatgacaatgccgctggttgctgcaggcgcttttgcaatgggcgttctgaagagatataatataaaaatagttacatatataaaatccgcagggggaataagcatagacaatgaaccacaggaagatgaggattatgtgtatggcttcagtacacggatgccggatcgggaaaaagattcgttgctgtataataagatattagagtcaataaagaatggagatagcatgggaagcgtgatcagcacgcatatatacaacgttccgccaggaatcggcgagccattcttcaattctgttgaaagcgaaatatcaagggcaatgttttccataccgggattaaaggctattgaatttggttcaggattcaagttaggcaatatgtatggttcagaagcaaacgatgaattttatgcagaaaatggaaaaattctctcaaggacgaataattccggtggcatactgggtggcatcacaaacggaatgccggtggtgttcaatatagccatgaagcccacatcctcaatcagaatctcccagaaaacagtaaacctgaaaagcatggagccctctgaggtgcaggtaaaaggcaggcatgacccgtttatatctttcagagcggtgccggtgatacaggcaatggctgcatttgttatgcttgaccttataatg

SEQ ID NO: 34646 - DNA, 1623 bp, Ferroplasma acidarmanus
atgatgtcaggtcaaacgccaatattaatattaaaggaaggtacagaaaggcaacagggtaagaatgcccagaaaaacaacattgaagccgcaaaggcaattgcagatgcagtaaggacaacactgggcccgaagggaatggacaaaatgatggttgattcaataggggatataataatctccaatgatggggcaaccatattgaaagaaatggatgtagaccatcctacagcaaaaatgattgttgaggcttcaaaatcccaggatacagcagttggagacggaaccacaactgttgttgtatttgctggcgaacttcttaaacaggcagaagccctgcttgaccagggagtgcattcaactattatagctgatgggtaccatctggctgcagaggaagcaaggaaacagcttctagcaatgtctgtaagtgcaaaggatgatgctatgctcagaaagatagctataacagcactttccgggaaaaacacaggagttgcaccggaatttcttgcagaccttgttgtaaatgcaataaactctgttactgaaacagatggagataaaatcatagttgataccgcaaatattaaagtagacaagaagagcggtggaagcgcagcagatacaaaattcataaacgggcttataattgacaaggaaaaggttcactcaaaaatgccttctgttgtaaaaaatgcaaaaatagcacttataaactctgcacttgaaataaagaaaaccgaaatagacgccaaggtacagataacagacccatcaaagatacaggaattccttgaccaggagagcgacacattaaaggaaatggccgagaagataaagaaatcaggagccaatgttgtcctttgccagaagggaatagacgacacagtacagtactatcttgccaaatatggaatatacggtgtcagaagggtaaagcagagcgatatggaaaagcttgcaaaagccacaggcgcaaaaatgatcaccgaccttgatgatataacagaagaaaccatgggaaaagccgaaaccgttgaggaaaggaaaataggggacgacaggatgacatttgtaacaggatgcaaaaaccccaaggctgtcaatatacttatcaggggcggaacagagcatgttgttgatgaaatcgacagatcccttaacgacgcaataagggttgttgcaataacaaaggaagatggaagataccttccaggtggaggagccacagaggccgagcttgcaatgaagctaaggtcatattccaacagcgtgggcggaagggagcagctttccatagaagcctttgcaaaggccctggagataattccaaggacacttgcagaaaatgccgggatggatcctattaacaccctgatatctcttaagtcagagcacgagaagggaaacaaaaacttcggtgttgacatggaagcaaacaaaataacagatatgataaaggcaggagtattcgacacattccgtgttaaaacccatgcaatatcaagcgctgtggaagttgccaccatgatactcaggatcgatgatgtaatagccagcaagaagtcatctgccccacagggcggagctggcggcatgggtggcggaatgcctccaggc

SEQ ID NO: 34647 - DNA, 903 bp, Ferroplasma acidarmanus
agagatattctatcagtagcagatatggaaaatgattttgaccagataatagatacatctataaaattgaaaaaggataagacaataaaattttcagataagaaattgcttggcatgatttttgagaaacccagtacaaggacaaggatatcccttgaggcagcaatggaacagctcaacgggcatgctatataccttagcccacatgaaatgcaccttggcgatggtgaaactattgcggatacagcaagggtcatgtccagattcctggatattatttcatacagggcatatgattacaggaatgtcagggaactggcaaaatatgccgatgttccggtactgaatgcactggacaatatggaacatcctctgcaaattgttgcagattttatgaccattatggaaaagaagcacaggcttgaaaatcttaaactggcatatgtgggtgatggaaacaatgtatccaattccctgcttctgggtgctgcattgacaggcatggacatttcagttgcctgcccggaacaccgtgaaccggacagagatatactgtacagggctaaggaccttgcattgaaaaccggcagcaggatagagatattaagggatgccagaacagcggtagattcggccgatattatatacacagatgtatgggtgtccatgggcgaagaaaaagaaaaggaccagaaagaaaaactattcaagggataccaggtaaatgaagaacttgccgattttgcagataaaaattatatatttatgcactgcctccccgcaagaagggggctggaagtaactgatgaaataatagaaggaatacatagtgtagtttttgatgaagcagaaaacagactctacagtgaaaagggggttatttatacagttctatcatgaatt

SEQ ID NO: 34648 - DNA, 933 bp, Ferroplasma acidarmanus
gacaaaataaatgaggttaactcaaggcttctacaggctattaaaactgaccaaccatatctttttgaaatgtccaagtataccatagacgcaggtggaaaacgtttcaggccactgcttaccatattatcctatgaaatttcatgcaacgaaccctatgacagtatacttgaccttgcttcaggctatgagcttatacatacagcaagcctcatacacgacgacattatagataaatcgaaatacaggagagggcgcgaaacactggcatccaggtatggcatagacaatgccattgtggttggcgattacctttttgccaaggcatatgaacttgggtcgagatacggaaaagttgtctcaaaggttatggccgatggttcatcgcatcttgcggaaggccagataattgaagcattgaatattggcaatctgtctctggatatagagacgtataacaaaattataatgaacaaaactgcttatttcttttcagcatgtgctgaaggtgccacaatagcggctatggcaccagacaatgtaagggacaagctcagcaaatttgcttacaatatggggatggcctttcagataacagatgatatacttgatattgttggaaatgaaaaggaaatggggaagcctacaatggttgatcttaaccatgatgtgataacacttcccataatacacgcattatctcatgttaccggtgagaataagcgtacactggttaacatactaacaggaaaatacacagacagtgattataaatccaagttccgtgatatactttttaaatccggttctctggagtacacatttaaaattgcaaaggactacatattaaaatccgttgaaaacctgaatggcatcgggagatcggatgacctgggccttctaatggatctggcgcttatagtagttgataga

SEQ ID NO: 34649 - DNA, 738 bp, Ferroplasma acidarmanus
aaacttgacaataaaatagtattaataaccgggtcttcccggggattgggaaaggcaatagccatgaaatttgcctctgaaggggcaagaatagcaatcaattataacagggaccagaaatcggctatggaattaaaaaacatgctcgctggatctgaaattttccaggctgacgtatctgaccatgcagcagttcgcaacatggtaaatgaaatacacaggaaaatgggaacaatagacattttagttaataatgcgggaattctcagcgcaatcacatgggatgagtttgatgatgccagagtgaaaaaaatatttgacgtaaatcttatggggccagtatacacaacccgggaatgcattgaagacctgaaaaaacagcatggaattattattaacctggcatccaatgcaggtgttggaactgctgctaagggaacaacattttattccatgacaaaagccgcaataacaatgctcactaaaagacttgcatttgacctgatggactggcacgtgagagtcaatgccattgcccccggctggatagagtccgatatgaccataggagggaaaagtgaggaagaggtgaacaatctcaggcaatcattcaaatcgaaaacggagcttggcatgactggaaaacctgaaaatattgcagatgccgcaatattcctcgcatcaaatgaatcggaatatatggatgggcaggtacttgtggtagatggtgggagaata

SEQ ID NO: 34650 - DNA, 597 bp, Ferroplasma acidarmanus
gggatagatgaagctggcagggggcctcttataggccctatggtaatggctattttatgcggagatagggaatcacttgaaatcattggtgtggccgattcaaagaaattgtcaccaggcaggcgtgaaagcctgtttgcccgcttgcaatcgtacaaatataattttgtaattataagcccttccgaaatcgacagatatgtggagcatcaaaaactgaacgtgctagaggaaacctatgcctcaaaactggcatcctgggctcctgcaagcagtactgtatatgttgatagtttcgacgttaacgagttgaggctgcagtctctcctcatggaaaatacaaaaaggcaaattgtatgcaggcataaggcagatgaaatatatccctgtgtttctgcagcatctataattgcaaaggtaataagggaccgtgaaatcgataagctccataaggactatggggattttggctcaggttacccttctgacccgagaacaataaattttgttaaaaatgcattgaaaaatggaataaatattgatagtatagtaaggcaccagtggaaaacctataaaagtatgttaaataaaaaatta

SEQ ID NO: 34651 - DNA, 1815 bp, Ferroplasma acidarmanus
agggaatggcaggatgccctgataagcaccgtatcaaaaaaccttgaggagaaaaacaaaattgccatagaggcacctaccggttccggaaagaccagcttcatactatatctggcttttattacagggaagaaattaatttaccttaccagaacacataatgaattcacgaggctttatgaggataaccagaaatatttcaacatacccgctttatatttatatggaaaaagcaaattatgcccgcttaaagagaggtggtacgactcagaagatgatgggcagaaaaatgtatgcaaagggtgccccttgaaggataaaaccataaagcttgatctgaaaaatataaggagcccggagagttttctggaagacatagaagctgattctacggaacttatcaggcaggatgtggaatcaaaggccctcggaagggatacaaaggggaatcttgttacaatcaagaaagaaaatgtaaaatcctattgcccatattattctgtgcggtccaacatggcagatgcacagataatagccatgacatataactatctgttaaatccatcaatacggttcaatgtttttcatggcaccgaaggggaagagatgattgaccttaatgaatgctatatagtttttgatgaagcacataacctggattctgtaatagaaaattttggccggacgctgcagataaaaacagtagagaaggcaattgatatgcttgtaaaggattttccaattgaaacttataattcatatgataggattgaagcaaatttgatgcttgaaaatcttctgtccaacatgagctcaacaaggggaaccgatagtctcaagctattcaaattttctaatgattttgcatcaaggattgcaaaccttgaatcactcaggacattcagtgatgaatttgaagaaaaaaacgaaaacaggccattgaataagagaagcaggaattacctggaaaacgtttacaattttctctatgattaccagaggatggaaaatggttcagtgtactccactatcaataatccggaaaaaaaagatttaaaacttaaattgatgtattatgatacatccggctatctttcatttttacgggataactctgttatttttatgtccgggacaatgccatctgtagaccatatctcaaaggtatggaatatggaaaatgtcctgtacctgaaagttgacagcatattcaaaaacgccggcgggctaaagcaataccatatagttaacggttatacaactctgggacgttaccgcgaaaacctggatgattgggctgaaatgctcagaaaatatatgcagtttgccattgatgtttactcaaaatcggataaaagtgtacttgttgctgtcccctcatatcgcatactttttggcgacacctatacaaaaacaccaggcataggcaattacctgccagaaagtatgagggcaaactgtgtattcgaaaacaagaaaatttcttattcctatatagaaaagaaagcgaaggagagaaaaataattattttttctgtacacggtggcaaacttcttgagggcatacagctggttaaccggggaaaaagcctgattagcgatgtaatcattgcagggcttcccctgataccccttgatgattacagaaaggataaaataaaatatcttgaaaaagtgctgaaaaaaaatgcatacaatctgctctattatgagtttgcgcttatcaaagtaaaacaggcagcaggcagatctacaaggtctccagaggatacttccagcatatggctctgtgatgacaggtttgatgagcctttc

SEQ ID NO: 34652 - DNA, 1761 bp, Ferroplasma acidarmanus
atgttattttcagaagccagcaaaaaattcatggagatggaatcgacaacgaagaggcttgaactcacatcaatactgggttcattgcttgaaaatgcaggggatgacctgaaggaactggtatatttaatacagggcaagctggcaccggattatgagggtatagaatttggagtttcggggaagcttatagtgaaatcccttgcagccatatccggaatggatgaggaagaagtcaacaaattgttttacaagaatggcgaccttggtataactgcctctgaaatcagggaaaaaatggaacagaagccacttttcagggaagaccttaccgtacactatgtgtatacaaggcttatggaacttgcaaaatcagcagggcatggaagtgtaaaggggaaaacagatatttatgcggacctcatggtaaattcatatcctgaagatataaagtatattacgagaataatcatggggaaacttagactaggcgtggcagattccacaatacttgattccctggtgcatgcattttcctctaaagataatgcagatatggtagaaacagcttacaattttcatccagacatagggcttatagcaacgctcctgcagaaaggcgatataaaggccataagcaacataggtcctgagccattgattccattcaaggtaatgcttgcagaaaggctgaggtccattgatgatataagggaaaaaatgaaccaccacgtatcatttgagtataaatatgacgggctcaggacagagttgcacaaaaaaggggataaaattaagattttttcaagagggcttgaggaaacaactgaaaatttcccggatattatagaaaatttcaaaaagagctattcatttgaatccataataattgatggagaatcggttccgtttaatcccgatacaggggaattgttcccattccagatggtttccaaaaggaggggaagaaaatatcagattacagaaaaatccactgaaatacctcttgtaatgtttatttttgatatactggagctcaatgggaggacacttgttaatctcccatacgaagaaaggcgtaaaattcttgaagaaaattttgtagataatgagcactttaggctggcaacaagattgtcctcggatgattctgaagagattaacaaattctttgaacagagcatagaggatgggtgtgaaggcattgttgcgaaggatacatctgatgaatctgtttaccgtgcaggggctcgtgggtggctttggataaaatttaaaagggattatcagaaagaacttgcggattccatggacctggtaattatcggtgcatttaatggccgtggaaggagggcaggggcatacggtgcactcctcatggcatcatataacgaagaaacacatgcattcgagtcagtcacaaaactgggaacaggattcagtgatgaggtattattttcattgccaaaaatgctctctgatcttgtaagagaccacaaacctgctatggttgaatcaaaaatggttcctgacatctggatatatccacagatagttatggaaatccagggagcagaaattactgtaagccctatacatacatgtgcttttggaaaaatagagaaagattccggccttgcgttaagatttcccagattaattaaaatacgtgacgataaaaacgctgaagacgctacaactaccaatgaaattatagaactttataaaatgcagaaaaaaacaaaataaataaagaagagt

SEQ ID NO: 34653 - DNA, 945 bp, Ferroplasma acidarmanus
atagaaaaaataggaataataggtgcaggagcaatgggttcttctattgccgaggtatttgcttttaatggttacagtgtatatttaaaagaccagaatatggaatatgtcaacagaggtatttcccatgtgagaaaggtactggatgactaccaatcatatatggattccatgcccgacaaggaaataaagagaatagaaagaaatgggatagaactgacggaaacccagaaaaatactattaaaaagaatctcggcaagcagctcgatatagatggaattatttccaatatacatccagttgaatcatacaaagaactgtcacagtgtgggcttgtaatagaggctgttttcgaaaaacaggaaatcaagaacgatctgttcagagaactatccagttattttggtgaaaatacgatacttgcttcaaatacatcatcactgagtataacagagatggcagccaattataaatatccggagaataatatcattatccacttcttcaatcctccatacacaatgccactggttgagattgtaccagctctccagacaggcagtaaaactgttgaaacagcatattcacttatttctggattgagaaaccatagggatgcaatggttcccgtaaaagcgaaggaaaggtcagggttcatagtgaacaggatactaatccaacttataaatgaagcaataaagatagttgaggaaggcatagcagatgagaaatctgttgatataggaatgaagaagggagcaggttttccaatgggcccattcgaacttggcgattatgtcgggctggatattgtctatgatgtattgaaatcatttaacaaagcatacggagatgcatacatacctccggaaaggctaaaaaatatggtcatagcaggatatcttggaaggaaaactggaaaagggttctatgagtacacaaaa

SEQ ID NO: 34654 - DNA, 915 bp, Ferroplasma acidarmanus
aagatttctattattggcgcaggagcagtaggtgcaagtgtagcacaggttctggctatcaagaatatcgcagatattagcatttttgatattgttgagggcgttgcagagggaaaagcactggatatacaggaaggagcaccacattttggctttgattgcaaattgcagggattttgcacccaggaccctaaggaatatgcaaatttaaaaggttcagatgtaatagtagttacagccgggcttgcaagaaggccaggaatgagcagggacgatcttctggtaaagaatataggaataatgaaggatgttggggaacagataaagaaatattcaccggattcaataatagttgctgtaacaaatccagcagatataatggcatacgcattgcagaaagcatccggaattagcccagagagaataataggattgggcgggtcgctggacagttccagattcaggactttcctggctgaagcacttaatgtatctgtaagggatgtaaatgctttcgtaataggtgggcatggtgacgatatggttccgtttatacattactccagtgtttcaggaatacccatatctgatcttcttagcgaagagaaaatacaggaaatcattaaaagaaccagatttggagggggagagatacttaacctttacaaaacaggaacagcattctatgcaccatcaatatccatttctgtaatggttgagtctgtagttaacgatcaacacagggtaattccatgtgcagcataccttacaggaaaacacgctgaaaattataaagtcagcaacgcctttatcggagtgccaataaaaattggaaagaatggcgttgaggaaatatatgatttaaaattcagtgaagccgatgcaaaggaatggatgaagagcgtagaatctgta

SEQ ID NO: 34655 - DNA, 1692 bp, Ferroplasma acidarmanus
atggaaaaaaaagaatatgatgcagttattttaggaggtgggctagccggattaatggctgccaatatggttgcggcaggcggttttactgttgctgtagtttcgaaggtttttccaacacgttcacattcttcagctgcagaaggaggcatagcagcctacattatgggtaattctgacccgaatgatgatcctgattttatgtcctatgacgaggtcaagggaggagattatctggtagatcaggatgctgctgaattgctgtccaaaaagtctggagaaatagttaatttgctggatgcatggggagctccttttaacaggcagcccgatggaaggatagcattaaggtattttggagggcaaacctatccaaggacaagatttattgcagataaaaccggaatggcattgctgcatacccttttcgagcattcaacgggatttaagaatattgatttttacaatgaatattatgttcttgacattgcaagagaaggcgatagtgtaaatgggctagtagcaatggaaatgaaaacgcttgaccccatatacctgaaatcaagggcattgcttatagcatccggcggaataggcatgatgtataaacattcaacaaacagttacatcaacaccggcgatgggcatggcatagcattgagatccggtgtggcacttaaagacccggaattcgtacagttccatccaaccggtctttatccatccgatatattaattagcgaagcagcaagggctgagggtgcaatattgaaaaataacaagggagaaagattcatggcacgctatgcgccccataaatttgaccttgcaccaagggacattgtttccaggtccatggcaattgaaatccgtgaggggagaggattcgaaggcggatatttaggccttgatctcaggcatctgggaaagaaatatatcctggaaagattaacactggcatacgatgcagcaaagaacttctccggcgtggatgctgctgaagagatgataccggtaaggccggcacagcattacttcatgggtggcatagatgttgacataacaggaacaaaccatgacctgaaaggtgtatttgccgcaggagaagctgcgtgtgtttctgtgcatggtgctaacaggctgggttcaaattcacttctggaaacccttgtatatggaagggaaactggaaatgccatggtagaataccttaaatcccataaaaaaatagagtcaaacagtgacgtggacaagctggtagataatgcctatgcctatataaagagagaaagcggtgaacatttcggcgtcctgacagaggaactcagggatatcatgtgggacaacgttggcatattcagggacaatgacaaacttgcacaggctatttcaaagataaaagatctgagaacaagatcaaggtctatgtatgttacggacaaatccacaaattacaacaccgaactattcaatgccctggaaacaaggaatatgattgatgttgcatatgctatggctactggagcattgaacaggacagaaacaaggggtgcacatttcagggatgatttccctgaaaggaatgataaggactggatgaagcataccataacatatcttgccggagatgaaataaaaatatcctacaagcctgttacgtatacaaggtggaaacctgaaccgagggtgtat

SEQ ID NO: 34656 - DNA, 927 bp, Ferroplasma acidarmanus
gaagaaaaagaaataaccgtgaatgttaaaaaatataatgagaaagacggtgcattctggaagtcctacaaacttagtgtggataaatacacacagatgacagaggttcttagaaggataaaatccgaacaggatccttccctggcttaccgtgcctcctgccatatggctgtttgtggaagctgttcaatgaaaataaatggcgtcccgtcactggcatgcaggacaatagcattgcaggctacagatgaaaaaaatgaaatcaatctggagagcatggactattatcccggagttagagaccttataacagatatagacgtattttacgacaagatgtacaaggtaatgcccaggttagtagccgataattccgtactttcaggtgaaaatgaacagaggatgactcccgaagaccagactgaggtatggaaatttgaggaatgcatttactgtggcctttgcgtgtctgcatgcccttctgtaaaggaggatgaaaagttccttggtcctgctgcccatgcaaaaggattcaggttcgtggacgatgaaagggacacaaagaggcaggaaaggttagacattttaatggacagtgcatacagatgtacatcatgttatatgtgctatgaggtgtgcccgcaggatgtacagccagtaatagcaataaagaaaacaaagaattatctggatgaatacaaaggaaatactgcgataacagttgcggcgagaaagcatgatgatgctatagaaaatcttatagcgtcaacaggaaaaataaaagaatcaacactatttttgaaaagtttcggatatggtgaagcaatgagagatgcggtggacatgctgaaagcaggcaaattcaaatacgcattcgaaaaagattccaaagttaaaaatatggatgaaataaaaaaattaatgggt

SEQ ID NO: 34657 - DNA, 864 bp, Ferroplasma acidarmanus
aataaaatggttataataagtaaggaaacaaaggtaatagtccagggaatgacaggacatcagggtgcattccattcaggcgaaatgataaagttcggaacaaatgttgtagccggcgtttctccgggaaaagccggaacaaaagtcaacggtgtagatgtttacaataatgttgcagacacactggatctgaagccagatgcttcgatgatatctgttccagctccatttgtaaaggatgctgccctggaagcaatagaaaatggcataaaattaatatacatacttacagaacatgtgccggtacacgatacaatggaactttaccatgaggcaaggagaaagggtgttttcatgatagggccaaatagcccaggaataacagttgccgggcaggctaaaataggaatcatgccaaataatatattccgcgtagggaatgtagctgtagcttcaagaagcgggacacttacatatgaaatagttaaggcggttacagatgcaggattcggtgaaagcacagtaataggtctcggaggagacccgataattggaacaactttctcagatataattaaaatattcaacgaagacccgcagacaaagcagattgtccttgttggtgaaatcggaggaagcgaggaggaaaaggcagcagaatatatcaaaaaatatgtaaagaaaccggtaacagggtatataacaggaatcagcgccccaccaggaaagaagatgggccatgcaggtgcaattatagagaaaggcacaggaactgcagattctaaaatcaaagcatttaaagatgccggaataaaggttgccaattatcctgatgacataccatcattgttgcagaaataattg

SEQ ID NO: 34658 - DNA, 1086 bp, Ferroplasma acidarmanus
atgaatctttatgaatacatgggtaaggaaatattcaaaaaatacggaataccggtacccgacggatatgtaatagaaaatgttggagagttaagaaagttcgaatatcctgtggctattaaatcacagattctttcaggaaaaagaggcaaagcaggcggtattaaattcgccaggaacagcaatgaattatcagagttttcggacaagctgttaaattctaccataaataatcttactgtaaagaaattgctcatagagcgtatgcttaacattaaaaaggaaatatacctcagcattacgcttgaccgtgcaacaaaagagcctgttataatactatctgcagacggtggaatggaaatagagagcgttccggaagaaaacatccataaaatacatatagatcccatggtggggtattctgattatatagcaagggaagccctttcctatattccagttgagaacaagaaacagttcagcaaccttctatcttcactatataaggcctttgtgggtgaagatgcactgcttaccgagataaatccgctggtaatagatgcagaaaataacataatagcaggagattcaaaagtaataatagatgacaatgccctatacaggcataaggattacatgataacagatccggacaaaactgctctggaaaatgaagcagcatcaaagagctttacctttatagaaatggatggcgacataggcgttatagcaaacggtgcaggattaacaatggcaaccatggactctttaacgctgcacaaacttaagccaagaaatttccttgacctagggggtacagacaatattgaaattgttgaagacgcattttcatttgtaatgcgtgcaaggccaaaattgatatttgtcaatatatttggcggtgtaacaaaggcagatacggtagcaaatggaatagtttcatcaaaaaagaaatttgatataaagcagcctatagttgtcaggctcagtggtgtgcatgaagaggaagggcagaaaatccttcttgaaagcggtataaaagctttcaccaacatgacagatgctgtaaaagaattatcccgtata

SEQ ID NO: 34659 - DNA, 777 bp, Ferroplasma acidarmanus
aaaacctcaacgatcggcatgggtacatactacgatatgagatggatattcaaaacatacctgggcatatattctggtagggatcagaagatagatgcatacagggcaggaatagacaacgggattaaccttattgatactgccgagttgtaccggacagagaaacttgtgggaacagcaataaaatcgtacaaaagggatgaattattcctggcatcaaaggtattccccacacacctatcaccgaaatcccttgaaaaggccctgaaccgtagccttaaaaatcttgatacagattatattgatttataccagatacattttccaaaccctacagtagacatcaaaaaaaccctccgtaccatggaaaagatggtagataaaggcaagataaggcatataggtgtcagcaatttcacactaaaccttttaaagcgtgcacagggaatactctcaaaatatgaaataacatcgatccagataaattataatgtcttccacagaaacagccagaaaggcatgatagattattgcaataaaaatcatatagctgtaatggcatattttcccctggggcatgggaaggtaacacagccacaatttaataagtattttgaccatgtaagaaaaactataggggacgttcccaatgccaatatagcgcttgcatacctcataagcaggaatcagaatgtattccccattccccgggcttcgaacagggcccacgttttgcagaacgcaaaaaattcagatattcttctaaacgaagatgat

SEQ ID NO: 34660 - DNA, 1092 bp, Ferroplasma acidarmanus
agttttgaaaatatggatatatcagaaaatttaaagaaatcattaggcttaatgaagtttacggaaccaacagaaatccaggaaaaagcaattcctgtagtattgacgggaaaggatgttattatacgttctaaaacaggttcaggtaaaacagcagcatatctactgcctgtattgaattcagtagaaaagttaaagggtaaaagtgtaaaggcaataataatattgccgacaagggaacttgcgcttcagacccacagggttgcctcaaggctcggaaaaatttcgggaatcaaatcaacaattgtgtatggtggagcatccataataaggcaggttgaagaacttcccggttcagatatcgtgatcgggacaccgggaagaatactggatttatacaatcagaaataccttaaacttgaccatgtcaagtatctggtacttgatgaagcagaccttatgcttgatatgggatttatagatgacataaagaaaattatctcatttacccctgaaggcaggcaaactatattgctatcggcaacattgcctgcagaggttaagacaatagcaaaccatttcatgaacaaccctgaatttgtagatgcaggtggggatgaagctataccatcatcaataaaacatctttatactgtgtctgagaagtttgacaagttctccactcttatgtcctatatacacagctataattccagaaaagctatagtgtttgtgaagactcagaggtccggtgaccttttaaatctaatactctcaagatcaggattcaataacgtactgatccatgggggaatgaagcagcatgcccgtgagaggtctatagcagatttcaggcatatagattcagggatactcgttgcaactaacgtggccgcaaggggattggacattccaaatattacagatataatcaactttgatgctcctgatagtaccgaaacatacgcacaccgtgttggcaggtcagggagaatgggcaaggatggaagggcaatgacaatattcgacccaagccagaaaagccttatacagagcatacagagaagaaacaggataaaaatggagaaaata

SEQ ID NO: 34661 - DNA, 2493 bp, Ferroplasma acidarmanus
aagaatatgaatattaatgggcggaacctgaaatattttccgcttgcacaacttgcaggtaaatatgatattgaaaatctgccatattcacttaaaattttgcttgaaaatgttttgaggaactatgacggtgttgatattgatgaacgttcaattgaaaacatagcaaatatgaaatcagggtcagagatggcattcaagccttcccgggttgtttttcaggattacacaggtgttccaatactggtggacctggcagctatgagggaatactacaaagaaaataaattaaatgccgatgacgtaaaccctgcaacaaaatcagatcttgtaatcgaccattccataattgtagattctttcaggggagaagagccaataatattaaacatgaaggatgaatttgaaaggaatgtagaacgctatgattttcttaaatggtcccagcagtcattcaaaaatgtgagaattgttcccccgggacatggaattgtgcaccagattaacttggagtatctatcatctgtagccgttatagaaaaggatgaaatattcccagaaagccttataggtgcagattcacatacaaccatgataggcggcattggagtcctgggatggggagtaggagggcttgaagctgaagcttccatgctcaatgaaccctatttcatgaatgtgcccgatgttgtaggcgttaatataaaaggaactatgcctacaggagttacacctacagatgttgtattgtatatcacaaaaacactgaggtcaaaaaacgttgttggaaagttcgttgaattctatggtaatatatcagaactcactgcacaggacagggcaaccatatcaaacatggctcctgaatatggcgcaaccataggttacttccctgttgactctgagacacttaagtatttaaaagggacaaaccgcagcacggaatctgttgaaaaatactttaaggagcagggattattctataatgggccaaaaaaatacacggaaactgttgaaattgacctttctaaaatcaaaagtgcagttgcagggccgaaaaacccggatgagcttatcaatatagaggatttaaagggaaaaatagaagacctgttaaaagagggcaacgacggaaaacttgttaaaaatggtgctgttgtgctttcagcaattaccagctgtaccaacacatcagacccattcgtgcttcttggtgccggcctgatcgcaaagaaggctattgaacacaaccttactgtggctaacacaataaaagtcagccttgcacctggatcaaaggttgtaacagaatatctcgaaaaagccggccttatgaaatacctgaacaggcttggatttgaacttgtaggatacggatgcacaacatgcataggaaatgcagggcctttaattcctgaagtacaggacgatatgctgaaaaacaatgtaaagacatttgcagtcctgagcggaaacagaaacttcgagggaagaataaatccatatatagccggagcttttcttgcatcacccatgctggtagtggcatttgccatagcagggaaaatgaatattgacctcataaacgaaccgataggcaatgataatggaaaaccggtatacctgaaagatttatggccaacaaatgatgaaataaaagaatatttccatcttgccatggaccctgaagtttataagaaagaatatggagatgttttcaagggggacaataactgggaatccatgaaatccagcaaggggcttctatttgatttcaaggaagattcctcatacattaaaatgccaccatggatgtatatggagccggttactgacattaagaatggaaggatacttgcagtattcggcgataaaataacaacagaccatatatctccagcagggccaatagcaaaggattctgttgcaggaaaataccttgcatcaatggggataactgaaatgaatacattcggcgcccgccgtgggaaccatgaggtaatgctacgtggcggtttttccaatacaaagataagaaaccttatggtcagccatgctggtggaagcaccatctattatccggatgggcaggaaatgagcatatacgacgcagcaatgaaatacatgaaaaataaaactcctctggtcatattcgcaggcaagcaatacggatcaggaagctccagggattgggctgccaaggtaaccgcacttcttggagtcaaggcagtggttgcagaaagcttcgaaagaatacacaggagcaatcttgtggatatgggcatagttccggttcaggttgataaactgcctgatctgaaaggggatgaggtagttaatatagatggaataaataatatttccataggaaaggaattgaatatttccattaatggaaaaacccttaaggggaaagccctgataaacacaaatgccgaattgaactacgttaaaaccggaaacatcctgaaatacattgccttatctgcaaaa

SEQ ID NO: 34662 - DNA, 819 bp, Ferroplasma acidarmanus
attacaccggttataactccatttacggataacaaggtagataaagataaagcggtaaagcatggagaggatgttattaagggcggcatgaaatatttatttccaggtgggaccacagggcttggcccatctatggcttcaggtgagaaactgcaactccttgatgcctatgcccatattcctgaacatgtcatactacaggttggttccctgaatctggaggagtcaataaatctggcaagggaagctaaaaaatacaaaatacatgcggttgcagcgcttcctccgtactatttcacaggaataaaaagggagtggctcataaaatattacacaaagatctcttcagaatatccaacaataatatataactatccggaaacaactggatataatattacttatgatatggttaacgacataaagaaagccgggggagatgtgataggaataaaagaaacaacgttcaatatgaatgatatactcaatacaaaaatgtacgtcccggatttcaaagtgtatacagggcctgaccagtacatactttctgcatacaggctcgggctcgacggctttgtgtccggtgcctcaaattatggatataaagtaataaataaaattatagaaaaccatgataataaggatggtgacagataccagttcttattgaatgagcttgcggacttatcaaggaaatatggaacaatttcttctatttatgatatggtagaaattatgacgggaatagatgctggaaacccccgtgagccattcttcaaattaagcaaagaggaaaggagttcactggaaaaggaaatg

SEQ ID NO: 34663 - DNA, 1497 bp, Ferroplasma acidarmanus
tcaaaaagaagcgatccatttatcacatattttaagaatattatgacctatggagaatttgaaggatattcaaatgccgttgctgtagagttttctatgtattgcgatccgggtgacattatagcaataatagcagaaaatatacctcagttccccatagtgcaatacgcgtcatggaaaaattcctgcatttttgtgccattgagccctctggattctgagaatgaaattacagggaaaattaagttcatagatgcaagggtggtagtaatcagcagtgaattcagggagaaattttccagcttgatggagatacagagcctccatgtcttatatacagacccacagactttcgggaaacttccggataatatggcagaaaagtacatcacaggaataatgaaagaagaattaaaccttcgactcaagaaagaattcaagggatattatccggaaccagggagtatagcaatgcttgtatttacctccggtacatcaggcaggcagaaggctgctgagataacccatagcaatatatattcagcttcgtatatataccgtgaatggtattcggtacaaccacatgacaaaaacctgtgtatcgcacccttcttccacataacagggctaatttttggcatatccctgacaatgctgtcgcattcatccatggcattgacgtaccggtttaacccggaaaatgcactagaaactgtagaatcagaaaatacaaccattaccatgtttgttgccacggcctaccgggccatgattaatgcatggtctaatgttgataaaatcaaaacccggctctcatcgatgagaatgtggtcggcaggcggaatgcccatgccctataaaactgaaatcgaatggaaagcaatgtcaggtaagtgggtatatatggcatatggattaactgaaagcacttctccggttgcactatgggaatatccatatacagacaatattccattatataatggcatagttacagctggaaaaccggcaaattatacacgcatagtcagggcaaggggcggtgaactggtagtttcagggccacaggttataagaagatactataagaatcctgaagacacagaaaaggcatttggaaaatatgggctgaaaacaggtgatatatgctatattgatcgcaagggatatatctatataattgaccggaagaaagaccttatagacgtatcggggtataaggtagttcctgccgaggttgaaaatgcaataagatcctgtgatcatgttgaagacgttgtagttgttggagaaaatgatgaatataaaggtgaagtcccggttgcatatgttaaactatcttcagtcccagacaactatgaggaaatgaagaaaagtatttacagcgtatgcaaaaaagaactggctagatataaagtgcctgcacggataatctttgtaagggacatgccattgaatgcatcaggaaagattaaacgttcaggaatacattctgta

SEQ ID NO: 34664 - DNA, 711 bp, Ferroplasma acidarmanus
atgtcaggcaaaattgtaataaccgggtctaacaggggaatagggcgatcaatagcagaaaaaatggcatcagaaaaatatggaattattatggttgactatgataatgccgtacttgattcggctaagtcgctgaattcccgatatggcaatgttgaagggataaaatgtgatgtatcaagttatgatgcctgcgttgaggctttttcaacaatagataaaaaagagatatacggcatagtaaacaatgctggcataaacagagatgccctattcaaaaatatgtcatttgatcagtgggacgccgtaataaaaactgatctttacagcatgttcaacgttacaaagcaatttgttgattcaatgattgaaaatctaagtggaagaatagtaaatatttcttctgcaagctggaacggaaatgtagggcaggccaattactcatctgcgaaggcaggggttatcgggtttactaaaacgctttcacgtgaactgggcaggtataatataacatcaaatgccattgttccgggattcataaaaactccgatgacagaccagatgcctgaaaaaataaaggaaaagtttattgaaaaaattccattaaaacgtatgggctccggtgatgatgtggcaaacgctgtttcattcttgatgaaagaggatagcaattatgtcaacggaattttacttgaagtaggtggaggaatg

SEQ ID NO: 34665 - DNA, 786 bp, Ferroplasma acidarmanus
cttcgattataaattatgaaagcagctattataggagcaggtacagtaggaaggtcaataggtgaaggcataaaaaatgattttgaagtttcattcagttccggttcatttgaaaagctggaaaaatggagtaagggggagttcaagattttcgataacaacgttgaaaatgcgaaatacggggatgtaatacttctagcaatcaaacccggaatatcagattccgttatggaggaaataagaagtgcagcaaagggcaaacttgtaatatcctttatggcagggattacattatcacacatgcaggagatgttaaaagattcaatggtcgcccgtggaatgcccagcatacccatgcttgtccagaaatcagtcacagcatatagttacaaaaatctggataaggaacataaggatgtactggagaaagttttgaaaggctttggttctgctgtgcatatagatgaatcatatatggatgctgtaacaggattaagtggcagcggacccgcattcgttgctataatggcagattcaatgattaatgcaggaatactggccggaataccaaaaatccaggcacgtgagctggtcattgatactttcatcaatactatgtcccttatgagagagaaagggttttcggcatccgatctgagggatgaagttatgactccaggaggcaccacagtagccggcatatatgaaatggaaaaggcaaatgccaggacagcaatagcgaatgcagttttaggttcatacaggagagcaaaggaaataagcaaa

SEQ ID NO: 34666 - DNA, 981 bp, Ferroplasma acidarmanus
attatggatgtttctcttgtggggttgggccatataggaaaggctgtagtgggtattttgaatgaaaatcatgagtattttaaaaccagatttggttccgatatccatgtcatttctgtatcagattcaaaaacaacagtttatgataaaaatggattgaatcttgacaaggttctcatgtacaaggaaaggggcgaactggatgaagttgcagatgtaatgaaaatggaagatatctattcccttaattcagatgtaatagtagatatgtcgccggcaacaaaggacgggcttgcaggcatgcgtatgtataaaaatgctttcgatagtgggaaacaggtagtaacctgcaataaggctccgctggctctgcactggaaggagatcatggaatcatccagaaagcagaaaaagaatatactctatgaatcagctgttggaggcggtgttcccttattcaatcttaacaggtattcactaaaatcatcaaaacttttggaattcaaggggcaggtaagttcaacaattaattttgttctgaaccacctgatgggaaatgtggatttccatgaagcaataaaaactgcccagagcatgggcatagctgaaactgattaccatgacgataccaatgggctggatggagccagaaagactgttattatagccaatgcacttctagggcttgattacacattaaaggatgtggaatatgatggcatagaaaatcttgataatattgaatacatgaggaattctggtgaagtataccgtgttctttcacatatcactgcgggaacaaatcctatcattgaatctaaaatattcagcataaagccaggtgattctatggccgctatggattcactatcaatgggataccttgagaaaacagataataatgacgacctcatggtatttgaaaagcatgatgggccactggaaactgctgcacaggttgtaaatgatattcttttatta

SEQ ID NO: 34667 - DNA, 1623 bp, Ferroplasma acidarmanus
atgcagcaagaaatcaggaaacaggttattaaaaacgcatatatgcatggtgggaaagcggatatttcctcagttgttggaaagttgatttccattaacccggatgcaaaaaaggatatgaaaacccttatgggaacaataaggaaatatgttgacgaggtaaatgcaatgggtgctgaccagctggaggagatcgttaacaccgagtacccggatatacttataaaggaaaagaaagaagaaaggcatgaactgcctgatcttcccggggtaaatgggagtgttgttatgaggatggctccgtccccctcaggacccctgcacataggccattcgagaatggctatcctcaacgatgagtatgtaaagcgttatggcgggaaactgatacttagaatagaagacacaaatccgggcaacattgatccggatgcatatacaatgattccggaggatctaaaatggctgggcgttgatgttacagaaactgtaatccaatcatcccggatggagttctattattctgaagcaaagcgcatgatttctgaagggtatatgtacgttattgaagaaaatcagcaggaattccatgatctcaaattgaagaaagtacctgtaaaagaaagggatgccgacccttcagttaaccttgaaaaattcgataagatgatttcaggccattactccgagggtgaagcagcactggtaatgaaaacggacataaatcacccgaatccctcgataagggactggattgcattcaggataaataccaccgagcacccgctaaccggatcaaaatattcagtatatcctactatgaatttttcagtgtctgttgacgaccattatctggggcttacacatgttataaggggaattgaccatcttgtcaataccgagaagcagaaatatgtttttatgtacaataactggaaaatacctgaatatttccattatggtttcataacaattcccgatacaattcttaaaacaacaataatcaaggaaggcataaaatccggaaagtacagtggatgggacgatatcaggcttggaactttaaaggcattgaagaagagaggatataatcctgaaacattcaggaagtactgggtccgttcaggaatgaataaaagcaatgcaaccttttcatgggaaatatttgattccatggatagggaaataatagattataatacagaaaggtattcctttgtaccacatccggaactcattagccttcagaatgcagaacccttaaaaagccatgccctgctacatccacagcgcccagattccggtttcagggaatatagcattccggcacaggcatctgtttatttccctggcgatgaaattgataaaataaatgaaggggaagtaataaggttaaaagacctctgtgtggcggtaaaaaagggcaataaacttgtttatagcaatattgaaccggaaggcagggtgaagataatccagtgggcacctgaaaattccggagacctccagatattttatccggacgggaacatagacaagggaaaactggaacctttagcaacagagaaacggggagttgtacagctggaacgttacggatatgtcaacctggatggcaaaaat

SEQ ID NO: 34668 - DNA, 858 bp, Ferroplasma acidarmanus
atgaaatttttggctttctttggccacttaaatatagatgtaaccctatccgtgccatctctaccgtctccaggccaggctactggtgtaaaggcccttagagagaaatttgcaggcactgcagggaattttgcatacgttgcaaatgcgctgggactgaaatttgatctgtattccgctgttggtgaaatatcccatgaaaaataccttgcaaatctaaaaaaagtaggaattaatacagaacatgttgacattatgaaagaagaaaatgggcctatttgttacctaccctctgatggaagggaacagattgcatatatgtttcagggcccgatgaataattgggaagcttcaaaacattttgaatatggaaattatacattcttaaatatcggtacaggaccggtgaaagagtatatgaaaattctggatagggagaagaaagctaaagtagtatttgacccgggacaggaaatatggtatacgtacaataaggaaagtgcagagtatatggttaatcacagcaatatgattattatgaacagaaaggagttttaccacctccttgaattgctgaatacagatagtgcagccgtatataaaacagtaaataatataattataacggaaggtgaaaaaggtgcaactttgattgaaaatggagaatctactctgatgcctggaataaaaccggatcgcattgcagacactattggtgcgggtgattcgttcagggccggcctatttacagcactttcaaatgggtatacattaaaagattctgtaagtattggaaatataacggcctcaaaagctattgaaaataatataaatgaatttaaccttaatttccaggat

SEQ ID NO: 34669 - DNA, 1200 bp, Ferroplasma acidarmanus
gtagagagtatagaaataacagattcaagaatcacaaaaatatttgattcaaggggaaacccggctattgaggcaacaattattttaaattatgcaaccggcacaagttcagcacctgcaggtgcgagcacgggaaaaacagaagtaattgcgtatcccaaaaataatattgacaacagtgtggatttctataataagcacgtaagaaatgcattaaaaggtttcaatgcactgaatcagagtggatttgacacattattgcacgaactggatggaacggataacttctctgaaatgggaggaaatcttgctactgccctttcgatagcaaatgcaaaggcagtatcaaactatcttgagatacctttatacagatatgttggaggcctgcatccacagataccgcgtcctatgggaaatataataggtggcggaaaacactcaaagaatggaactacaatacaggaatttcttgtctcttcgcagggaaaaacattttatgattccgtatattataatattctggtacacaggagagttggtgagaaattatcagagaagctaaagggccagagcgttggtctcggcgatgagaaagcatggacagcggatgtttctgatgaggaagcaatagaaataatgaaagaagctgcaggcgaaatatcatctgaaaacaaagttaaaatttatctcggagtagattttgccgcagattcattctataataatggcaaatatgattataaaacatcaaagaaaacacaggatgagcagatcgattatgcagtctcattaaataaagaacatggattttactttatagaagatccattatacgataatgattttgaaggttttgcagaaattacaaagaaaattggagaagatagtttgatagtaggagatgacctttacacaacaaattccgccagaatacagaaaggcatagatatgaaatctaccaatgcagtacttataaaagtaaaccagataggaacactttccgacactgtaaaatctgttaagctcgcgactaaaaattcaatggataccgttgtttcacatagaagtggagaaactaccgatgatttcatagcacacctggcagtggcttttaattcaaaatttataaagacaggaacaataggtggtgaaagattagcgaaactcaatgaagttatacgcctggaagaggatttg

SEQ ID NO: 34670 - DNA, 1724 bp, Ferroplasma acidarmanus
cttaacgcaactgcaagggaaatcagaaaggaaattataaaaatggtttacagtgcaaagagcgggcatccagggggttctttgagcattgcagatgttattactgcactttattttaaggaaatgaatatagaccctgaaaaaccagacaagccggatagggatattcttataatgagcaaagggcatgcatcccctgccgagtatgctgccctcgctctccgtggctatttccccgtggaattgctggaaggcttcagaaaagtaaattcaaagctcgaagggcatgtacacaggggaatacctggtgtagaatcctcaacaggttcacttggccaggggctcggtgttgcgataggatttgcactttcatccaagcttgattcaaagacaaataaaatttatgccatacttggcgatggtgaaatggaagagggaaatatatgggaatctttgatggcagcttccaaataccatctgggcaaccttaccgctattcttgaccggaacatgatacagctcgacggatttacagaggatataatgccactgggcaatgttgctgaaaaggtggccccatttggatgggaagttataacaataaacggaaataatatggatgaagttgtcaatgcgcttgaatatgcaaagaaaccaagggataggccattatttattgttgcaaacacaattaaaggcaaaggtgtaagttatatggagaataacccgaaataccatggctcacctccggccaatgaggaagaatatgtacaggcattaaaggaaattgaggggtcacaatgatggaaaagatggataggatggaaagcttgagggatgcctatggaaaggaactggcttcacttggtgaaaaaaataaggatattgtggtacttgacgcagacctttcatcgtcaacaaaaacaggggtattcgggaaaaagttccctgaaaggttcttcaacatgggtatatcggagcagtccatggtttctgcagcagcaggcctttcgcttgctggaaaaactgtatttgcctcaacctttgcagtatttctaagcaatacatacaatgtgatacgccagtcaatatgctataacgaagctccggttaattttgtggtaacacattcaggcatttcccttggtgaggatggcccaacacaccagatactggaggatgttggcattatgtccgggctgccaaatatgaaggttattgttcctgtagattcaattgaaactgtcagtgtgatagattacctcgcagccaggaaaacatcaccatattatgtcaggcttaccagggaaaaattccccgtactcaacgatgagaattatgaattcaaagaagggaaatctgttactttcagggatggctctgatgtgacaattatgggatatggcataatggtttcatttgcccttaaagctgcagaacagctaaaaaacaggggaatagacgcaagggtaatcaatatgtcatcaataaaacctttagaccgccccgcaataattaaggccgcacgggaaacagggaaaatagttaccgctgaggagcattccatatacaacggacttggctcacgtgtagcagaggtaacatctgaagagtacccggttccggttatgaggatcgggatgccggatatttttggaaagagtggcaagggaatggaactgttcgattattttcatataggggtaaacgatatagtagaaaag

SEQ ID NO: 34671 - DNA, 645 bp, Ferroplasma acidarmanus
atgaaaatatttatagatacagcaaacattgaagaaataaaggaagcaaatgaatttggattgattgatggtgttacaacaaatccatctttgatcatgaaagcctcaaagggcggaaaaagctttaaggcaatagcaacagaaatattgagggaggttaacggccctgttagcctggaagtagttgcagaaaaagctgaagatatggtggaacaggcactcaagctccatgcgctgggaagcaatgcagtcataaaaatacccatgacactgcagggattgaaagctatgaagattcttaaagaaaaagaaataaaggtcaatacaacactgatattcaatgcaatacaggctttgcttgctgcaaaaaatggggctgcatttgtttctccatttgttggaaggctggatgacattggggaagatggcatggctattatagaccagattaaaactgaatacacaaattatggatacaaaacagaggtgcttgttgcatcaattagaaatccagtgcacgtactaagggctgcccttatgggtgcagatgccgtaacaattccatatgatgtgataaagaaactagccatgcacccgaaaacagatgaagggttaaacagatttctggatgactggaaaaaagtt

SEQ ID NO: 34672 - DNA, 627 bp, Ferroplasma acidarmanus
gaagtattaaaaactggaacaacaacactcggtatcacagcaggcgattacgttattatgggaactgatagcagggctaccatgggcaatttcatttcaaataaaaatgcacagaaattgtacaaaatagatacttatgcaggcatgactattgctggcctggtaggagatgcacaggtcctggtaagatacatgagggctgaaatggaactttacagggtccagagaaagataaatatgcccatagaagcagcggcaacattgctttcaaacatgcttaaccagtccaaatattatccatacatggtgcagttgctggttgggggatttgacaaaaaaccgcatatattctctatagatgctgcgggaggatctgtagaagatgagtacgcaagtacaggatccggctccccattcgtttacggagttctggaagctgaataccagcctaacatgaaacttgacgatgctataaaccttgcaataaaggcaattagcgttgcaaaacagagggattctgcatccggaaatatgctgcaaataggagttatagacccggagaagggattcaactatctttcagaggacgacatactgtccagaatgaaaaaattaaaactaacttta

SEQ ID NO: 34673 - DNA, 1968 bp, Ferroplasma acidarmanus
atgaaatcaatatgccctttttgcggtgttggctgtggacttgaattaatggctgtaaataatattgttgttggcgtaaaacctgttccagaacatgtagtaagcagggggcatttatgtggcaaaggaagtgttgcacatgaggctttgacagcatgggatcgtttatactatccattaaagaaagtaaagggggaacttgaaaggacgtcatgggaagattcaataaaatatactatagaatctataaaaaacatacagaaaaaatatggcaaagactctgtggctttttacggaggatgccagaactcccttgaagaggtttatcttttgcagaagcttgcaagagcccttggaaccaataacgtagattcatgtgcaagggtttgtcatgacccatcagcgaaggcgcttaaggaaattgtaggagttggtgccggatctaattccgctacagaaatcccgaaggcaaaagttgttgtggtagcaggagaatctgtaacagatagccatcctgtattgatacagtattttctggaagcaaaggaaaaaggaacaaaaataatattaatagatccaaggaatacaaggtttgcaagctttgcagacctccatttaaagataaagcccagaagtgatatatttttattcaatgcggttgccaattaccttatccagaataatatgattaaaccggattttattgctgcaaggactgaagggtatgaaaaatataaggaaaatgtttcaaaatatacacttgaactcgcagtagaacaaacagggttagctgaaaaagatattatagaatttgcaaaatacatatctgaggataaggttattttttcatgggggctggggcttactgaatctactggcaccaagggaattaaatcttatttatctctcccattgttaactggaaatatggggaaagaaggcgcaggggtaattgtttacagaggacaaacaaatgtgcaggggtccggagacctcataaaaccggatgtgtttcctaatggtgaaatgaatgaggcaaatagtgaagcattatcccgcatatggggatttaagccaccagtaaacaagggttcttccattatagatactttttatggttccaaaaatataaaggcactgtttattatgggatacaacccggtaaggagcttgccgaacagaaaaaaagtaaaagaatttctcgggtcccttgaacttcttgtggtgcaggacatatttatgactgatacagcccgttacgccgatattgtgctacctgcagcggcatgggctgagaaggaaggttctgtagccagccttgacaggcttgtgaagtggagatttaaagcagttgatccgccaggaatggcaaggccagattatgaaatactttctgacctggcaaaggctgccgggtataactttaattcaaacccgaaagaactgtttgaagagcttaaaacagcggctcccctgtattcccatcttaatatagatgatgtgatggattattcaaaagattcaagataccctaacggtgaattgcacctttatggggagaaattttcaacaaaatccggaaaagcgcaatttattcctgtggattccgaaaaacataatgatgggctgatactggttacagggagaaccgtaacaagatacaacagtgatgaggttataaatagggtacccggtatgcaggaatacaatcccacattatgggtcaatccttcagatgcaaaaaatctcggaatagaaaacgaggatatggtaaaacttgcatcaaagagcggtgaactggacataatagcaaagattacagatgatgttataccaggagttgtatttacctatatgcacaatcccaaaataaatgatatcgtatctccagaatttgatgacgaaactaaaacacccaaatataagtatacgcccgtaacagttactaaataaaaaaattcctgatat

SEQ ID NO: 34674 - DNA, 1602 bp, Ferroplasma acidarmanus
ggtcaacccatatttatccttaaagaaggaactaaaagagaaagcggaaaagatgcaatgttcgagaatattgatgctgcaaaggcaattgccacatccatcaggtctacactgggcccgaggggaatggataaaatgctggtggactcattaggtgatatagttataacaaacgacggcgtcaccattctgaaagaaatggatgtagagcacccagcagcaaagatgatggtagaggtctcaaagacccaggacagttatgtaggcgatgggacaacaactgctgttataatagcaggtgcattgcttgaccaggcacagagccttgtaaagcaaaatgtccaccctacagtgattacagaggggtacaaaacagccgcagcacaggcgagcagggttctggaggaaatatccagaccagttacactgaaagacaaggaaatccttataaaaatggcaaagacttcacttaacagcaagagtgcatctgtggaaaaagaacttctgggaactatttcatacaatgcaataaaaacaatagcagaagagagggatggcaaatatcttgttgattttgacaatctccaggttgtaaagaaaaacggtggcgaaatcaatcagactgaacttatagatggtataatccttgacaaagaaaaggtacaccctaacatgccaaagcttgttaagaatgcgaaaatagcgctgcttgatcttgctcttgaaataaagaaaccagagtttgatacaaatcttcagataaatgacccttcaatgatacagaaattcctgggccaggaagaggatgtcctgaaggaaatggttgataagatcaaagcaacaggcgcaaatgtagtaattacccagaaaggcatagatgatatggcacagcactacctttcaaaagccggcatatatgctgtaaggagagttaagaaaagcgatgtagacaagatagcaaaagctaccggtgctacaatagtttcatcactggaagaaatcgtagcatccgaccttggagccgcagacgctgtagaagaaagaaaaattggcgacgactacatgacctttgttacaggcagcaagaatccaaaggcaataagcctgttaatcagagctggtacagaacatgtagcagatgagattgaaaggtcaattacagactctctacacgtagtagcagcagccgttgaagatggggcatatacaacaggcggtggatccgctgctgaagaaatagcatttaatcttagaagctacgctactaaagttggtggaagacaacagcttgcaatagaaaagttcgcagacgcacttgaggaaatacccagggctctggctgaaaatgcaggactcgacccaatagacatacttataaaaataaggagtgaacatgcaaatgggcacaaaacattcggagtgaatgtcttttctggaaatgtcgaggacatggaaaaagctggagtcatagagccgatcaggatagggaagcaggcagtagaagcatcaacagaagctgcggtgatgatactcagaattgatgacgtaatagcaacaaagtcatcaaagggtggttcacctggcggagcaggcggaatgcct

SEQ ID NO: 34675 - DNA, 1122 bp, Ferroplasma acidarmanus
atggaaatagaagagtatgtaaaaaatatattgaatgatattaaatcaggcggcattgatgcagtttcggaatattccaaaaaatttgatggctatgggatgccatttaaagttcctgaaagcgaatttgccgaagcgaacgaattaataccggaataccagaaagacataataaatagaacatataagagaatatacgaaaaccatgctatacagtataacaacgataaggtacgtttttccaggggttctatatatggaatcagatacacgccaatagaaaggataggaatgtatatacctggaaaaaagcctctgccatctaccgtaatgatgatagggattccggcaaaaatagcaggtgtcagggatattgtaattgtgtctgccccggaaagcaatggcagggtaaatccatatacactttatatagctgggcttctgggcattcatgaggtataccgtatcgggggtgtgcaggcaatagggtcaatggcatacggcattgggatgaaaaaggttgataaaatattcggccctggaaattcatacgtaaacgaggcaaagaggcaggtctatggatttaccgggatagatggcttatacggcccatcggaggttatggtaatatccgatggaacagcaaaggatgaatatatactggccgacctcaattcacagctggaacatggcataacatcaaaggcatggcttctcaccaccggcaaagccatttccactgccggaaatgaaagaataggggtaatggtttttgaaaatatggatgaactcatatcaaaggcaaatgaaatagctccggagcacatggaaatacaggcaaaagatccaatggaaatatttaccaggataaaaaatgccggtgcaatatacattggtgaatatgcccctgtgccagctggagattatttcctgggcgtaaaccacctgttgccaaccggggggacatccagattttcttcagcacttacagtggacgactttatgaaaaaaacatcatttgccagtgtgtccagggaagattttatggctgatcgtgaactgggtcttgaactggcaaaaatagaagggatgccacttcactataaatctatggaggcaagg

SEQ ID NO: 34676 - DNA, 522 bp, Ferroplasma acidarmanus
ataagggagacgaaggaaactgtgatagaggttgatattggttcagaaagtaccgtaatagaaacgggggataagatactggaccatatgatgcgcacattgttcttctacatgggcaggaatgcaaaaattaagtgttcctatgacctcaggcaccacctgtgggaagatctgggcataacaattgccatggagctcacagccttaaagggcgaaaaaccggtaaagaggtttggaagtgcaacaatgcctatggacgaatcactcataatggtttctttagatatttcaagggcatacataaatttccaggttgatttcagggatgcagagggtttcgagttgaacctcctctatgagttcctgtgggcacttgcaaggacaatgcccatgacactgcatgtaattaaattcagtggaataaattcgcaccacataacggaaaatgtctttaaggctttaggagcagccctgggaaatgcactggaaggaactgaatatacaaggagcacgaaggggata

SEQ ID NO: 34677 - DNA, 750 bp, Ferroplasma acidarmanus
atgcttgcaaaacgaataataggggcactggatattgccggtgatagggtagtaaaaggtgtaaactttgagaatgtaaaggattccggagatcctatccagcttgctaaacgctatgaatcggaaggaattgatgaacttgtattccttgatatccgggcaacccgtgagaaaaggaacattatgaatatgcttgttgaaagggttgcctcagagatatatatcccatttacagtaggaggcgggctaaccgatatagaaactatggtaaaaataataaggaatggggcagaccgcatatttattaatacatatgcagttgaacaccctgaaataatagggaaaatatcggataggattggatcagccaatacagttatagcaatagattcaggcaggcataatggaaattattatgtatacacccatggaggcactttgaatgccggaattgatgcaatttcatgggcacagaaagcagaaagccttggggcaggagaactcctggttacttctataaacacagatggcacaaagaaggggtttgatactgacctgattagaaaaataacgggaagtgtcaatatccctgttattgcctccggtggtgccgggtcacctgaagatttccttggcgtattccaggccggggctgatggggcgcttgcagcttccatcttccatgaagggaaatatactgcaaatgagatcaaaaaatacctgaaggggaatggtgtaaatgtcagatta

SEQ ID NO: 34678 - DNA, 588 bp, Ferroplasma acidarmanus
gatttaaaatttgaagggctcatgcccgttgttgtacaggacagtgagacaaaagaggttctaacgcttgcatatatggatggagaagcatacaggaaaagcatggaaacaggccttatgcattattattcaagatctaagcagcgggtaaggatgaagggggaagccagtggaaatatacaggaaataaaggatgttaagatagactgtgataatgactccctcttattcatggtaaaacagaagggtgctgcctgccacctgggaaccaaaagctgcttcagggaaattgcaactcccgctgttgcaggaaatataaattattcactggaagttctccttgaacttgaatcattaatagctaaaaccaaaaacacacccaggaaaaattcgtacacaacggaactttttgaatctggagaggagaacataaagaaaaaggttggtgaagaagcagtcgaatcaatactggcacagggcaaggacagaattgtgtatgaaactgcagacctgctataccatctccttgtattcctctcatacgagaatataaaactatccgatataatggatgaactatcaaaaagg

SEQ ID NO: 34679 - DNA, 1293 bp, Ferroplasma acidarmanus
ctttccgctatggggtattttctggatggttacgatttgagtgtgatatccgtatttactcttgtgcttgttacatttaagccattccattatgatccatttacggaatcttttgttaccggcgcagcacttctgggtgcctttgtgggtgccgttattttcgggcattttgccgataatattggcaggcggtatctgtatatattcgatctcatattcttcgctgtatttgctatactatctgcgttatccacgaacatatatgaaatgataatattcaggttcttcgtgggctggggagttggagcagattacgctttgagtccggtatacacaacagaaatgtacccggacaaaaagaggggtgcaggatatggctgggtctggacattctggagcatcggtgcaggagcggcatttgcaatcggatacgttttttatatgataaaccctcttgtgggatggagatatacactggctataggtgcaatacctgcaatagttacagtagtgttaagaacacggatgccagaatctgtgagatgggatatactggagccgggcaaatcaaaattatccgcaaaagacctggattcaatagcagaacgggtagggattacaaaagaggatataaaagctataatagctgaaagggagaaggaagaaaatatcgccgccggttcattcacagcactatttaagggggaatatggaaaacgtacggctattatatggttccagtggatactctatgatatagctggatatggtataggcctttattcaccaattatactaactacactgggaatatcacatagttcttcactactgttttcccttatatttaacatgccggttggattcctcggtgcattcggtgcagtaatgcttaatgacaggcttggcaggaggcctttgcaggctttaggattcggtggaatggcaatagccatggctatgttctttattgcatccagtgcgatagcaagcatagggataattatcggaattgcagcatttgtgattgactatggcataggcaaccttggtcccggtgataccatgggattatacgcaatagaactgcttccaacaaaattgaggtcttcatccatgggcggtgctacaggcataacaaggatagcttctttccttgctgcgttcatgtttccgcttataagtgcatcactgggcaaatcatcgttcttctttatccttctcggtttaatggttctggcctttgtatttacaatattctttacgccagaaacaaaggggttaaccctggaa

SEQ ID NO: 34680 - DNA, 1341 bp, Ferroplasma acidarmanus
atgatcgtttcaccactggattatcgatatggcagggacaatgtaaaaaacatattttcagaggaaacaaggttaaatattatgctaaatgttgaagctgcaattgcccaggccgagtcatattacggcatcatacctgaagaggcatatgcagacataagaaaagttgttgataacaatgaagtaaaaataggcagggtaaaggagatagaggcaatcataaaccacgatgtaatgtcaatagtggaaggtttaacggaaaaatgcactactggaaaaaattatgtgcatttcggtgttacttccaatgacataaacgactctgcctctgcagtgcagatgaaaagagccataagcataataatatctgaccttgaggatctgggcaaagcccttgtaagcaggataaaagaaaatgaagagacaataatggttggtaggacccacgggcaacatgcatcccctataacactgggactaaagtttgctgtgtacctttcagagatcggcaggcatctggagaggatccaggaagcaagaaaacggattattgcaggcaaaatccttggcccggttggaacaggcgctgcacttggaaaaaatgcccttaagattcaggaaaaaacatgcgaaatactgggcataacacacgaaacggcatcaacccagatagttggtagggataggtatattgaatatctttcaataataaacaatatatcggtatccatggaaaaatttgcaaccgaaatacggaatcttcaaaggccggaaatttatgaactttcagaatatttcgatagtgataagcaggtagggtcaagctccatgccatcaaagagaaaccccatagtttccgagaatatagttagccttgcaagattaacaaggtcatttataattcctgaatatgaggcgggagtccagtggcatgagagagaccttaccaacagtgcactggagagatttaccataccatatgtatccatactcgcagatgatataataactaaaatgaccggtgtattttcacatttgtttataaaccgcgaagagatgaaaaaaagggcatatggagatgagtttattatgtctgaaagtgttaccaccaccttaacggaaaatggcatgcccaggcaggatgcccatgaatttgtcagggaggcttcaatgcatgcctataaacagaaaaaaacgttaaaggaaactctggtggatatgggtattctaaaccacatctctgaaaaaatacttgatcgagctatggagcctgaaaatttcctcggtgtttcaaaagaaatatgcgaagatgcaataaaaaactttgataaccttcaaaaa

SEQ ID NO: 34681 - DNA, 1107 bp, Ferroplasma acidarmanus
gaagaaattagcccgggacttgaaaacgtatacataaaatatacagaattgacttttattgatggacagaaaggaataatgcgatacaggggatatgatattaatgaactggcagaaaaatcatcctttgaaaaagtttcttatctaatgcttttcggaaagtttcctgatgattccgaattaaaaaatttccaaaataagataaacagccatctggcactggatgattatttaaaggatatactaagagccatgccagaaacctctgattcacttggaatattgcagacactgttgtcagcgaaagcatctaaagaatctaattataaatatacgaaagaaaatgatggggaaaaaataccagaaattctgggctctgtcctttctatggttgcaaatatatacaggctcaaatcaggaaacaatataatagaccctgaacccggtgaaagttatgcagaaacattcctgaaagcctgttctggaagtgcagataaaaataaaataagtgctatggattctgcacttattctttatatggatcatgaaataccggcatccacaacagctgcactggtaacagcatccacactatctgatatgtattcatcactggcatcagccattgcagcattgcgtggcccactccatggcggagccgctgagggtgcttacaggcagtttctggaaataggggaaccagaaaatgttaatgcatggtttgaaaacaatatactcaatgggaaaagaaggcttgttggattcgggcacagggtttacaggacatatgacccccgtttgaaaactttcaagaaatatgccgatatactttcaacaacagaagagcagaaaaaaatactggctattgcaaaaaggcttgaagaagcaggtgtcaaagcttttgggtctaagggtatatatacaaatacagatttctatgcagggatggtttttaatgcaataggctttccggtagacatgtttaccactttatttggactttcaagaatatcagggattctggcacacattacagaatacgtggaaacacaggagaggcttatcaggccaagggcgatatatagaggttctggagaaaggaaatac

SEQ ID NO: 34682 - DNA, 678 bp, Ferroplasma acidarmanus
atgaaatcgaatattgttatagcaggtgttggaaagggaatgggtagttctctcgcatattatctcaaaggtggagactacaacgtttttctaatatcccgtggaagcaatgtaagagaagttgccggtaaaactgaatgcgagttttataatgcagatttgaattcatatccacaatgcgtggaagccattaaggcagcggatcgatcaatgggaggcatagatgcggttatcaatgtagcaggaaattattattcaaataaaagtattgaagaaacagagccagaaatgttcatggaggctattttgaataatgctaggacattttacaacattgcccgtgcagcaattcctttgcttaaacggcaaaaacatggctccataataggattttccgcgtcagaaaatgtgtattataattcaaatcctgggtatgcagcaggaaagggggcagtttattacatggtaaaaagcctcgccagggaacttattaaatataacataaaagtaaatggtgttgctccgggattcattggaaaagatgatgatgaaatgaaatcaaatatagaacttggaataacccggagatatccaccagatgatattaacagaactatagaatttctgatcaactctgaaatggtcacaggagagattataccagtagccgggggccat

SEQ ID NO: 34683 - DNA, 300 bp, Ferroplasma acidarmanus
ttctgttctaaatgcggtgcactgatgacaccctcaagggataaatatatctgcaatagttgtggcaatgaaattccaaaagcaggaacagctgaccagaaaattatatcaaagagttcagataaagaaattataatggtagccaaggaagtaaacgcggaaccacttgatagcgatgccgtgtgcccggtatgccatcatacaggagcctattatctcctcaagcaaacacgttctgcagatgaacctgaaacaaagttttatacatgtgagtcctgcgggcatagatggagagagtat

SEQ ID NO: 34684 - DNA, 1674 bp, Ferroplasma acidarmanus
actgtagccgatgtcataattaaaacactcgtaaacttcggtgtaaaaagaatatatgcaattccaggggattctctaaatcctataatcgatgcaatacggagaaataaagatataaaatatgttcaggtaaggcatgaagaaggcggtgccctcagtgcttcatatgaatcaaaatatacggggaatttggcagcatgtatgggaacttctggccctggttcaatacatctgctaaatggattatatgatgcaaaaacgcagcatgttcctgtaatagctttaacaggccaggtggaaacagaactgttgcatcatgattattttcaggaagtaaacctggttaaattatttgatgacgtttctgtcttcaatgcaagaattataacaccggacaatgcacattatttaatatggaaggcctgcagagaggctataacgaagaaaggtgtagggcatattgatatgcctgtagatattttaatggaatcatgcaaagaggaggacctatcatattacataaatccggtaaattataacccgggcggcctggatgaggctgtaaatttgattaataatagaaataaaccggttataatgattggtggcggttccagaaactatcgcggagaaatagacgaatttgccgaaaagataggagctccgataatatattcattgaacggcaagggtgtgttcaacgatacggataaaaaagtgatggggggcatcggacttctgggtacaaagccatctatcaaagcaatagaaaaatcagatttaataatattcctgggtaccatattcccgtatacacagtttttgaaaaatgtagacaatattcaggtgaatacaaatatagatgatttgaataaaataatgaaggcaaattattcttatctatgcgatataaaatatttccttgataatatcaatgtaaatgaaaaagataaaaaattctatcaggaaatgcaggatgaaaaggcaaaatggtcggaagatatggtcaggctcgcgagcaaccataaaaatcccataagggctgaactcttaacagataaaatatcaaagaaaattgaagacgatgcaataataattacagatacgggcaatgtaaccctgtggtcaaaccgttttcttaatgctgggaacaacaataagttttatttttcatcctggttaggaaccatgggttccggaattcccggatcagtaggtcttgcctttgcatcagggaaaaaaatttgtggactgataggcgatggcagctttgcaatgacggtaatggaattgattactatcaaaaagtataatctgccggttaaattaatagtgtatgataacagcatactgggcatgattaaacttgaggaggaggtaatgggatatccggaatacggcgtggacttatataatccagatttcgcaaagcttgcagaatcaattggcattacaggaataagagttgataccgtcgaagcactggatgcagggattgataaattttttaaatgcgatgggccggcagtacttgatgttgtgactgaaacaaatgaaactcctatgcctccaaaacttaatttcaaagttgcagaaaaatatgtaacatcaatattaaaagaaaaattagaaacaaaagattaatttaaatcaggtcttccagctgtgaaacaa

SEQ ID NO: 34685 - DNA, 1461 bp, Ferroplasma acidarmanus
atgtttattggcggtgaatgggtagaatcatcagagaaccaggttctgaaagtactgaatccatctacaggattgcctgttgccagtgtccaatccgcatccagagatgatgtcgggaaagctatagacgcagcaagaaactcatttgactcaggaatctggagcagggccacccccggagacaggtcaaatgtccttctaaaagtggcggatcttatagagaagaaccaggataaatttattaaagttgaaactgagaactccggaaaaagtataaaacagatatccggttatgatattccatatactgtagacaacatacgcttcctagcaggtgcctgcaggacgcttgaagggaaagcaatgaatgaatatgttgcagatgggacaagtgcaataaggcgtgagcccataggggctattggcattataacaccatggaattatccattaatgatggttgtttggagagcttttcctgcccttgcaatgggcaattctgtcgtggtaaaaccggctagctatacaccactgacaacacttatgcttgcggatatactgaaagaagcaggagttccggatggggtattcaatgtgattactgggccaggcagctctgtcggggaggaaatggcaaaaagcgaaaagctggacatgatagcatttaccggtagcacagaggttggaaaacgcctgtcagtacttgctgcttccaatttaaaaaaagtttcactggaacttgggggaaaagcaccgtttatagttttcaaagatgccaatatagatgctgcggttgaaagtgccattgtaggcggattggtaaacaacggccaggattgtgcaaactcaacaaggtattatatacaggaagaggtgttcgataaattcgtttccctgttgaaaaaaaggatacagaaattaagaattggagaccccatggacccgtcaactgatatggggccattaatatctgaaacccagagagaaagggttgaaggatatatagaaaaagggattaaagaaggcggaaaattgctttcaggtggagagaggcctgagataccgggccacaaaaaaggttattacataaaccctgcacttatttacacagagaatgaggattctgcaattgtaaaagaggagatatttggcccggtatttaccatattaaaatttaaagactataatgatgcaataagaagaagcaacgacgttacctatgggctcgggtcctctgtatggacatcggatattaccacagccatgagagcaacaagggatttaagattcggaacagtctgggtcaatgaacatgttgtggtgccttctgaaatgccatgggcaggatataaggaaagtggtcatggagcatccttatcaccctattctctagaggaatttacatatataaaacatgtatacttcgatctaacagggaaagtaagaaaagactggtatgat

SEQ ID NO: 34686 - DNA, 1176 bp, Ferroplasma acidarmanus
cgtattttattcggtgagtggcaatctatgcgcgttggcgaacaattaaaagaaatagaaaagaaaaataccctaattgtaactgatcctaatgtttacaaattcgggttactgaacgacattgaaacatcactttccaaatttcagataaagtacgaagtttatgataaaatttccaatgaacctacaatggagaacatcgtgaatgcggtggaatttgcgagaagcaatggaaaatttgactcggtagttgcagtaggtggaggaagtgtccttgataccagcaagatggtggcatctatggtaaccaataagggagagcctgcggaatacttaacgccggtcgaggataaatttaaaaatccggggcttcccaagattctgatacccacaactggcggtacaggaagcgaagtttcaaacatgtccgttgttataaacagggaatctatgtataaaacatgggcggccagcagcaaccttcttgcagatactgcaatagtagatcctgtactgaatgtcagcgcaccaccacggactactgcagcgagtgggatggatgcccttgcgcacaatatagaggggttaatcagcaaagaggctaatcctatttctgatggcatggccacaaaggctgcgtcattaatttttagaaatttacggacagcctacaatgacccttctaatatggaggcaagatcggcaatgtcaatgtccgctatgcttggtggaatggtgatcactttcccgtgggtagccggcccggcggttctcgggcattgccttggcgaagcttttgggccaaaatatggagcaattcacggcgttgcagtaggcatggcactgccatacatactggatttcaacatatctgctgcctataacaagataggctcactggccagaatattcaatatacgttataaaggagaatcggcaagggccgtagcatcaaaaattccaccggcaataatccagctgcttgaagacctggaaatgcctacaacgctgaaggatataaatttcccagcatctgatattgaaaaatttggtgattatatattttcatcaaggcagaaactctacgatctccccagatttaatcccaggaggctcacaaaagaaaattctatcaggctaatacagaatatgtatgatggtacactggaaaaccag

SEQ ID NO: 34687 - DNA, 1914 bp, Ferroplasma acidarmanus
aaaacactctgggaacctggaaatgaatataaagaaaaatcaacaatgaatcaatttttaaattatgtaaataccaataatcatacgaatatgaatagttataaggagctctgggaatggtctgtaaaaaatcctgaaatcttctggatatcactggcagacttctccgggctggatttaggggaatacaattctatattatctgaaaacaatgtaaatgccagatggtttgaaggagcaagggttaattatgccgatcgtgtgtacagaatgcgtaacatagaaaaggctgctattatttcatataatgaggaaggaaaagagcaggttataacttaccatagcctgtggcaaaaagtttcttctctcgctgcatattttcaaagcaatggaatagctgccagtgacactgtctgcgcatatatcgggaatataccggaagcggtgataactttacttgcaacagcatctataggggcaatatggtcatcatgctctcccgatttcggcattaaaggtgttattgagcgattctcacagatttcacctaaggtgttgatagtttcaccggaatactcatacaacggcaaattatatgacaggactgaaaatgcaattaaaattttgaaagcacttcctgaagttcggattgcaataactactggaaataaagaaatacatgatttcacaaagatgaattcaattccagacagcagaagtgagttcgtcccaataaaagttgaattttcacatccactatggatactttattcctcaggtacaacaggaaaacctaaagcaattgtgcacggacatggggggatactcctggaacatttgaaggtaataatgctgcatatgaatattaaggaaaatagtgtattcacatgggccaccacaacagggtggatgatgtggaatgtccttgtaggcgggctcctggccggctcaactatattgctctacgacggaagcctttcatatccggatacaggcatactatggaaactatctgaaaaatatggtataacacatttaggtgtcagtgctgcttatatcgggtcattgatggattccaggataaaaattaaggatcattatcagctggataaactcgagtttatagggtcaacgggcagcccattatcccctgatgcttttgaattcgtatatgaaaacattaaaggtaatgtatggctttcatctttaagcggtggaaccgacctctgttctgccatctgtcttggttcgcccacattgcccgtatatagtggcatgctccagtgcaggggcctcggagcacatgtagaggcacttgatccggatggaaagccagtaataaatgaaaaaggggaacttgcgataatggatccgatgccagacatgccagtatttttctggaacgacccggataaaacccgttactatgagagttattataacttttatccaggcatatggaggcacggtgattatatttccatagatgatgagggcagggtaataatctatggtaggtcagatgcaatattgaaccgtaacggcataaggataggaacaggcgagatatattcatccctcaatgggattgaaatggtggatgattccattgtaataggttatacagattccaggaaaatatacagaataacactttttgtagttctaagagggaatgcaaaactggacgataatctgattggaaccattaaaagtaaaatcagggatgacctttcacccaggcacgttccggattatattttgcaagctccttcagtgccttatactttaaatgggaagaaaatggaagttcctgtgagaagaattctggaaggtgcattgccaggagatattttaaacagggattccgtaaaaaatcctgattcactggattattatgttgcagtagggaaa

SEQ ID NO: 34688 - DNA, 1056 bp, Ferroplasma acidarmanus
tttaaaaaaataaaccatatagagttctatgtttccagtgccaagacatggtcatattttatggaaagggggctggggcttgaccttaaagcttactcagggcttgaaacaggaaaccgtggcaaatcttcctatgtattgaacaaaggtgacataaatcttgtgttctccagttcaatggaaaagcattctgaaataaatgattcaataagccttcatggcgatggggtcagggacatatcactggaagtggatgatatagaatttaccaaaaagcacctggaatccagaaacattaaagtttcatcaattaaagaggagaaagacgataatggaaaaatcaggagggctgtaatgcaaacttatggcgatacaatacatactatgatagaaaagggagattataagggctttctccccgggtacagggaagaagatacacataccgctgacactggaatatacaaggttgaccatgttgtcgggaacgtctacgaaggtgaaatggaccagtgggttaattactatattaaaaatatgaattttagccagcttgtaacatttgatgacaaaatgatcaggactgactattctgccctaaggtccaaggttgtcaaatataacgacaatatagtatttccaataaatgaaccggcacagggattaaaaaaatcacagatacaggaatatcttgattattacaattcacagggagtgcaacatatagcactaaaaacggataatataatagaaactgtatcaaagatgaagcagaatggaatacaattcctgcagactcctgcctcatactatgacacattaactgaaagggtaggcaatgtggatgaggatattgaagaactcaagaaactcaatatacttgtagaccgcgatgatgatggatacctgctccagatatttacaaaaccactgacagacagacccacagtattcttcgaagtcatagaaaggaaaggggcaaaatcatttggcgccggtaactttaaggccctcttcgaatctattgaaagagatcaggccatgagagggaatcta

SEQ ID NO: 34689 - DNA, 1389 bp, Ferroplasma acidarmanus
tttaagtttggtttttcagagtgtggatttcaatctgaaatgggtttgtctggtacggataataactctgactggtttatatggtcaaacgataaaagaaacattgaaaaacattatgtgtccggtgacctgcctcaaaacggtgtagcctattgggatttatataaacaggaccatgataatgcagacaaattaaatataaacgctgcaagacttggaatcgaatggtcaagaatctttacggaatcaacagaaaatatagaagttgatataaaatatgacaatgacgatataataaatataagtataaatgatgaaacaataaggaaattggatgaaatttcaaataaagatgcaataaaacggtatatggatatattcaaggattttaaatcaaggaataaatttttaattataaatctttatcactggacaataccaaaatggctgaatgatccatccaaattttcagataatgataagcagagagcaataggtggttgttttaacaatcatataattatagaatttacaaagtattgcgcatacattgccagcaaatttgataatatagtagatcgctggtcaacaatgaatgagccaaacatggtgtatcagggttgcagtgttgacagttcgtataatggcatatccgcaagaaaaaagaaatttgcagaggcacatgccagggcatacgacgccataaagctatattcacaaaaacctgtgggcataatatttgcaaatggtgatatccaatctatagatggcgataatgatatagttgataaggctaaattttttaacaggtattccttttttgattccataattaatggtgatttgtcatggtaccacgaattaacaaacgatggaaaaccaataaaaacacgtagtgatatgaaaaacaaagttgactggcttggactgaattattatagcagggatgttataaaaagaaatgactcaggttgggaaatattaaaaggttatggccattactgtggggatatcaaaaattctctggataataggtcagtgagtgataccggttgggaaatatatcctgaaggcatatataatataataatggattatcataatagatataaaatacctataactattactgaaaatggattagctgatgatatggatagatacaggtctaattacattttatcacatttttataatatagaacgtgcaataagcgacggtgcaatagtagaaggttactatcactggtcattgacagacaattatgaatgggcatctggtttctcaaaaaaatttggcttatttaaggtaaatatggaaacaaaggaaaggtatatgagaccgagtgcactaatttataaggaaataatagatagccatggtgttcct

SEQ ID NO: 34690 - DNA, 1524 bp, Ferroplasma acidarmanus
tttaactgggtatcggaaatttttgaaaaattatttgccggaaatgataaagatgcaataatatatattaatgagggcacaggcgaggagagaagaatatcatacagaaaactatatgaaagctataaccagtttattaattttctcagggcagagggcataaataagggttcaagtgtatacattatggcaggctctatccctgaacagtgggttgtaatgatgggggcactgaaagccggcttcattgttatcccgacggcagcgaatttaaccgagtatgagctgaattacaggttttcccaggatagcccggatgtaataatatcagatgaggcaagcgctgaaaaattggaacatgtacttaacacagaagctttaaaactggtaataggaaatagggagggctggataagctttgatgaaatatacaaaatggagataaatgctgaacccgcggaacttggaaaggatgatttattcattaagtattttacctcaggtactacaggcatgccaaaggcagtaaggcatagctcgattttataccccataggccagttaagcaccgttactgcaataggaataaggccagagtatattcacaacaatctcagttctcccggatgggcaaaattcgcatggagttctttttttgcgccactgtgtgcaggtgccactgtactttccatagattacaggggcaggttgaattcttccaggtatctggaattgatagacagatataaggttaacacattctgtgcaccgcctactgcatggaggcagttcatctcattaaaaaatttaaatattgaactgaagcatttaaaggaaaccgtgagtgcgggtgagccactcaatggcgaagtaataaacaagtggaaagaacgctatggaactgtaataagggatttttacgggcagagtgaatcaacagctatggttgccaacctggcaggagaagaaccggtaccgggttcaatgggaaaacctttaaaatcttacaacctagtgcttgtggatgatgatatgaatttgataacccacccgttaaacataggaaatatagctgtgggcgattactcgggaacatatggccttttccttggatattcggacagggaaaaggatgcatcggttttcgtgaatggctattatttaacaggtgacaaggcatattttgacgataatggatatttctactttattagcaggacagatgatgtgatcaaaacgtccgattacagggtaggcccatttgaagtggaaagtgcaataataaaaaatgaggctgttctagagtctgctgtaatcggtattccagattctatgaaatacgaaaagatcaaagcctttgtaatattaaaagatggatatgtaaaaagtgaagaaacagcgaaatctatacatagtacagtaaaaactcttcttccagcctacaagtgcccgagagtaatagaattcacagatgaattgcctaaaactatcagtggcaaaataaagcggaaggaattaaaacaa

SEQ ID NO: 34691 - DNA, 1728 bp, Ferroplasma acidarmanus
aaattaaagaaatccctatcctctgtggacatatttcttatcagtttcagtggaatggtcggatccggatggctgcttggagttcttgctggccctgcatatgccggcccggcatcaatactaacatgggttgtagccggagtattctttataattctggcacttgtattcagtgagctggggactttattcccttacagcggttcactggtaaggttcaacgaattctcccatggccctgtgagcaatttctaccttggctgggcatatatgatcggtgccatagctactccaccggttgaagcagctgcgcttacaggatttatcagcagttatgttccgggaatttataactcatctgttgccctgctaactccactcggcgtaatagttgccctggcacttctgggattatttattatagttcagtatgctggtgtcaacgtctttgggaaatctaatgctgtaatgacatggtttaaaatggctgctattattctgacaataatatttgtatttgcattcatattccatgcaaggaacttttttgcactgtcccatggctttcttccatatggcccatcctcagtattcgctgccatggttccagccggagttatattctcctatgaaggtttcaggcaggggcttgactatgcaggggagaccaaaaatccaaaaaggtctgttccacttggcatgataagtgccatgctggctgctatggcgacatatattatgctgcagattgtatttatcggtgcagtaaactggaaagcagcaggcgttcctgtaggcgattggagcggcttattgtcatcaacatggtctgcaaacccgttcttctatgctttccattctaccgatgagacccttcttataggattttccatattccttattatagtagctgttgtatcatcggcttccactcttggagtatatgttggatcttcagccaggtcattatatggaatggcaaaaatgaattatatcccggcatttttcgggaagatccatccaagattcaggactccatggatttcgctggttgtaactttcataataggggccatgtttttacttcctttcccaagctggtacgcccttgtgggaattaattcgtcatttacagtttttgcctatctggctgccggaattaccaacacctcgttaagaaaaacggcaccggaaatggaaaggccatttaaaactcccttccttacagttatggcacctctggcattcgtaatagcctcaatgcttgtctatttttcaggatggagcacggtggcacttcttttattaatagtcgatggcgggctgccaatattcctgcttagccgttatgggagggagactttccatattaacatgagatcagcatccctattttctgctatatactgggtaattttcatatttatagggattatttatgccctctcattattgccatttgaagagtattttgcgctcttttcagctaccattttagtgactccctatctgctttacaggatgtctggaagaaccgcatccatacacataagggcttcaatctggattgtagtttacagtattatactgggaataatgtcatattatggttcccttggcatcaatgcaataccattcccctatgactatataataatggccataatgagccttacaatctattttatagccataaatacagggtaccatacggacaaattaaaagaa

SEQ ID NO: 34692 - DNA, 1194 bp, Ferroplasma acidarmanus
ggaaaaagcataaagaatatatctgatgcctacgggacacctgttattgtctacaatatggcaagggtaagggaaaatatacgcaggatcagggatgctttcaatggtattaacataaaagttcattttgcagtaaaatccaattataatccatacatagtttcacagataatcaaagaaggcactggcatagatgcggcaaattataatgaagtgaagctggcaataatgtgtggactgggaagccgtgatattattgcgacacctaacaacctttcaggcacggaactgagaacgataaaggaggaaggagtagcaataaattttgaccatgaagggcagatgggtctgttaaagggaagtcttcctgaaaccgtatcattcaggattaatccaggaataggaaagggtgaattccctggaattacaacaggtggcaaaaacgttaaattcggtatatccgtagatgatgcaatatcagcttattctgcggcaataaaggcaggagtgaaacactttggtattcatatgatgacaggctccaatgtacttgaaccggaatttttcaatgaatctagtggattattctttaaaatcgcggaaacaatttcagacaggacagggatcgactttgatttcattgacataggagggggtttcggggttccatatacatcagatgagcatgcactggatattggtaaaacggcaggttacatatcagataattttagggcctcaaataaccgggggtattttaaagattcgcgtttgataattgaaccggggaggtatatagttgctgattcggcaatattgctttctaaagtgacatccataaaacattcagatagggaattaatcggaatagacgcaagcatgaatacacttatcaggattccactttatggggcacgccatggcatattattatccgggcatggggagaacacatcctcttccagatttgatatagtggggcaggtatgtgaaaacaccgattatattgcaaaggatataagtatccctgaaccagctgttggagatatcgtggtcattgcagatgcaggagcctatgtggcttccatggcatctaactacaatctcctatcacgccctgcagaactggttcttgaaggagatagagaaattttgacaaaggggcatgacggtttagaatccatgcttgctggt

SEQ ID NO: 34693 - DNA, 1173 bp, Ferroplasma acidarmanus
atggaactggttaaagcatcagatagggaatttatagttgcagttgcacagagactattagccattaaatctatttcaccacaatccggtggagaaggcgaacttaaaaaatctctggaattaaaaaaaatcctgaacgaacttggctatgacagttataacgagtataataccacggacaataccgggacaataaggccgaatattgtattaaaattagggagttccagtaaaaccttatgggtcatatgccatatggacactgttcctgtgggggatatatcactctggaagcatgagccttttaaggctaccatagaaggagatagaatttatggcagggggtcagaagataatggccaatcaatatttaccatgcttcttttgctcaagcatattaaaagagagcaaatgaaaatgaaccttaacgtagcattcgtatcggatgaggaaacaggaaatgattacggaattaaataccttatctcgaaaggcatattcgctaaagatgatcttattatcgttcctgatgcaggaacagagggcggctttattatagaaacagcagagaaatccaccatgcagttaaagtttgaaataaatggcattcagggccatgccagcatgcctgaaaattcattgaatgccttccgtgtagcgtgcaaattcatagacctgatggatttcaacctgcatgatcagttcgggaagacaaataaattgttcgtgccgccatattccacatttgaaccaacaaagcacgaacagaatattgataacattaacactataccgggcagggatgttttttactgggattttagaatacttccccagtatcctgcagacgaaatattaaaaagcatagatggtctcatagagaaattttccaaaacatccggtgccaaaattaaatacactgttattgacagggttgatgcaccggacccaacacctgatggtgctgagatagtagtattgttaaaaaaggcaataaaatctgttatcgggaaagatgcctttacggtaggaattggtggtgagacatttgcatcttttctaaggggaaaggggttttctgttgccgtatggtcaaccaccgtaattgagagtgcgcacatgccggatgaatactgccttataccacatatattgcaggatattgaggtctac

SEQ ID NO: 34694 - DNA, 1527 bp, Ferroplasma acidarmanus
attggaattgatcttggcaccagcaatacatcagcagctgtagccctagttaccggcggagaatataaaaccattgcaattccactatccggtaagaaaactggaagttccctgaaaagttctataacatttggcgggtcagatataatgtttacaggagccgatgccgacaggatgctcaagaaatacccaggtggaaacgtttctggttttaaaacaagaatgggaagcgagtacctgtatcgtacaggggaaaaattccattcacccgtagaactgagtgcaattattcttgcaagggtcaaaaacattgctgaagaatatatgcatgacagggtaaaagatgctgtaatagctgtaccggcttatttcaacaataatcagaggaacgccacccgtgaagccgcagcaatagccggaataaaggtaaaacaatttgtcagcgaacctgctgcagtagcaatatcttactggaatcgtgcatcaaaggcagaggcaaaaaatatactggtttttgatatgggttcaggaacaacagatgtgagcattgtaagggcacaggggaaggatttcagggttattgcaacatccggaaacacgggactcggtggtaccgatatggataggcgtatagaggaaatgatgaaatcttttctccggattaatggtatatccccatatcctccagaccttagaaaagacgcagaaaaattgaaaatttacctctcaaatcatgaaacaggggattcactgttagggagtacaaaaattaaatacactatggattcaaaacagcttgatagcatagtatctgacatgttacctgaaatttacagatgcatagatacagccatattgaattcaggcataaagagaaatgaactggacacagttataattacaggaggccctactaaaattccttttttatttcattccattgaaaactatctttccaccagggcggtaaaacaggggaagtttgacacagctgtgtctacaggggcagcaatacttgcctcaggatttatccatatgggtaccggtgagatatctaaaattaaggttagtgatgttgtgcccatatcactgggcagtgtcacacgcaacgatattgtagttaccatgatacctgcaaatacgccggtgccctgtaaagcaacaagaccctttaccacgataagggactaccagagcgaaatagaggtaaaggtagtccagggcgaacggccacttggcacagataatattgtgctagggcattttacactttcaggcataaaaccggcacccaggggggaagttgctattgatgtgacatacagtgttgataaaaatggcatactgacagtctccgccagggacaatgataccgcggcaataaaagagattaagataagtgagactatgcagcacagccaggaagaaataaaagaaatgaaggaagcggtaaagaaatattttaaagtagattcagagcggaagaagatggcagaaattatgaacagatcagagcagcttctgcac

SEQ ID NO: 34695 - DNA, 858 bp, Ferroplasma acidarmanus
aaaaaagtagctgtaataggttcaggaataatgggccagggcatagcccaggtttttatgagaaacggaatggatacacttttaattgatataaatgaccgtatactggaaaatgctaaaaatagcattgcagatggaaaattcgggctttcaaggcttgttgaccgtggaacaatcacggaaggccagaaagcagagtatatgaaaaatctatctgtatccacagactatggaatgttaaacgacagggaatttgcaatagaagctgtgccggaaataatgccgttgaaattaaaagtaatggaaagcattgaaaaaaatatacctgaaaggtccgtaatagcatcaaatacctccggaattatgatatctgaaattggaatgaatattaaagacaagtcaaggcttataggaatgcactggttcaatccggcaccggtgatgaagcttattgaggtggttaaaacacgtttcacatcaggtgatacagtaaatatggtacttgatatggcaaggtcaatgggcaaagagccggtagtggtaaacgattatccgggatttttcacaacaaattttgtccattcatggcttgttgaatccctcagattgtatgaaaaaggaattgccgggaaagaggatatagataaaatggtaaaactgggatttggttttcccatggggccctttgagctcatggatactatcggcctggataccatgaaagaaataggcgattacctttattctgaaaccggagacatgagaatactgccaccacccatactgaaagaaatggtgtacgcaggttataagggaagcaaaaaggtaaaaatggacagcaaaggcggctggtacgat

SEQ ID NO: 34696 - DNA, 1140 bp, Ferroplasma acidarmanus
cttacatcagtaggatggtctgaggaaaatggagtgaaccggcttgcacttaatgaatatgatatacaggccaggaaaaaccttgaagatgaaatgagggcagtaaaagcagatataaagcaagatgatgccggtttaatatttggaacgctgggttccggtaatgacaatacagccataggttcacacatggattccgtacccaatgggggaaggtttgatggcttctatggtgtaatgtccggcatgcagcttttaaaggatcttggaagcacattaaaaaacaggaaaattacagctatagattttaccaacgaagagggtgccaggttccagccatcacttttaggctctggaatgtcaacaggcgtattcacaaaggaattcgcctattcccggaaagacagcgatggaattacatttgaagaggccttggagaagtctggatacatgggagaagaacagaaccgggttaaaaaccaggacataacacggtacctggaactgcatattgagcagggccctgttctggaactggaaaattaccaggtaggaataccaaaaggcatagtaacaatggttgttgacaatgtatcctttaccggtgaatctaaccaggcggggccaacacccatgaaggtaagaaaagatgcactggtagccgcatcaaggtttactgtagcagtaagggacatggcaaaatcatcaggaaaggaattaacaatgacggtgggaaaaattaataatttccccaatgcatacaatgttatacctggaaaagtaacgatgaaccttgataccaggagcccggataaaaaaactgcagaagagtattcaaaaatggcaaaggaaatatcagaaaaaatagcctcagaggaaggtgtaccggtagatttcaaaaaccagtggactacggaaactacaatcttcgatgaggatatgagaaaggaaataataaaatcctgcaaatcgctcaacctgaaatataaagaattatatagctggccagggcatgacgcacagtatatgaacagggtagttcccactgccatgatctttattccatcacataatggaaggagccatacaagggaagaatactcatctgatcaggatttaattaatggatattctgtgttg

SEQ ID NO: 34697 - DNA, 894 bp, Ferroplasma acidarmanus
ctttgccttggcgggatgtcatttggcagttcaaaatggatggctgatccagaaacatcagggaaaataattaaaaaagccatagattacggcattaattttattgatacggccaatatatattcatccggtgaatctgagaaaatcataggggaagctattacaggttacaggccccagcttgttttgagtacgaaaggcggtggaaaggtaaatgatttcacacagggattcagcagggcaattttattcaatgaaatgaaaaacagccttaagaatctcagaacagattatatagatatttatttcctgcatactatatttgataatgtagatttcagggatacggtacatacactatcctcttttatttcatccggtaaagccggatatatagggcttagcaattttatgggataccagcttgctgaattttcaacaataatggaaatgcaggagaatataaaacctgcaatactacagaaccattataatgcagtttacagggaagacgagagggatgctataccattctgtgaaaaacatggaattgcatactctccattctcgcctatagctgccggattcctctcagggaaatataagagaggattagagaatgaaacggtacggacaaaaacatatccagttatgaaagaacggtatttcagtgattcggattttgatatacttgagagtgtagaggatatagcaaagaaaaaaggggtaaaagtgccacaacttgcccttgcatacgtgctaaataaaggattcatccctgtcataggggctacaaagccagaatacctggaagatgatatagctgcactggatgttaaactagacagggaagaaatggaggctatagacaggaattataaaccgcataaaatt

SEQ ID NO: 34698 - DNA, 507 bp, Ferroplasma acidarmanus
gttataggaacagggtgtttctggtgcagcgaagcaattttcaagttgattaaaggtgtaaataatgtagtccctggatacgcaggcgggcatactgagaatccgacatacagggaggtatgtactgataaaaccgggcatgccgaagttgttaaagtctcctatgagcctgatgtaattagccttgaaaaacttcttgaactttttatggctacgcacgacccgacatctctcaataagcagggaaatgatattggaacacagtacaggtcaattatactgtataatgatgatgcggaagaaaaaatgataaaggattttcttaaggagcatcagaaaaattacagcaaacctatagttacagaggttcaaaagctcgataggttctacgaagcagaggattatcaccacaattattttgcaaataaccagtcaaatccgtactgtgcaatggtaataaaacctgaagtaaatgattttataatgaaacacggaaatatattaaaa

SEQ ID NO: 34699 - DNA, 768 bp, Ferroplasma acidarmanus
gatttaaccggaaaggtagctattgtaaccggtgcaagtggtggaattggaaaagctattgcaattgggctggcatctgcaggcgcctccgttgcagtccattttggcaggaacaaaaatgctgcagatgaagtagtaaataaaattgtggcagctagggggaaagccatcgcagtgagtgcagatatggcagatccggtggctgttgaggaaatgttcaggaaagtagattcttcccttgggcctgttgatattcttgtgaattcagcagggatagatggtgtccgtgcaatgctaggagatgatgatatagaaaactggaaaaaggtaatatctataaacctttacgggccttatttctgttccagaatggcaattcagagaatgaagaagaaaaataggggagtaatcatcaatattacctctgaccatgttaatattccctggcagggttacagtgcatattgcagttcaaaagctggtctggacatgatggctaaaacactggcacaggaaacggcgactatgggcatcagagttatatcaattgcaccaggtgccataaaaactgctataaataaatctgtctgggaaaatccggatacccttaaagaccttgatgataaaatagccatgggattcccgggagatgcagaagatgtagcggatgcagtcctgtttgcagcaagtgatatggcaaaatacataacaggaactacaattgtcgttgatggcggaatgctgatatatccagatttcaggcatggc

SEQ ID NO: 34700 - DNA, 1053 bp, Ferroplasma acidarmanus
tcacttctcttatcaaggacgcttataggtctcgcagtaggtgcagattcagccattgcaacagcatatatagcagaatatgctccgaagaaccgcagggggcatctatcccttatgcagcaatggatgataacatggggaattctgggtgcatactttgtgggcatgggcgtatttttcatagctccacagctggcatatacaattgactggagggtgcttcttggtgtggctgcaataccttccctgatagggctggtgttccgtttctatatgcctgaatctccaagatggctgatactgcatgaaaaatacgataaggcaatagcatcactgaaacgttttaatgttacggcaaagttgtctgaaattaaaaatacacacgattaccttgttgcaaaagaaacaaagcaaaaagcaacacccggaataaaaagggcttttgttatagtagggctttttatgatgttccagcaaattaccggtataaacattcccttctattatggcccggttgttattgcgaaactccacatattcggttcaacaggtggaactgctatatcaagtgcagtttttggaattgaagcatcatcaatacttgccattataaatgtacttgccacacttatcggtttcaggcttatagattcatacggcaggagatccctggcacttctaggatactctggcatggcatttttcgatgtgctgggtgcagtactgtacctttcacatatagatattggcctgctcataggattcgccgggttcataatattctttgctttcggtgttggtggtaccggctggatcatccagggagaatatttcccgacacagtacaggggattatttgcttcccttattgccgttgtggactggatatcaaactttgcaataattgagctgtttcctgtgatggatctgaaaatagggcttggatacaccatggctgtgtttgcagtgctttcaataatggcagttgttatcttcttctacataatgccaaaaactaagggcaagagtgtggaggagattaatgatatattt

SEQ ID NO: 34701 - DNA, 768 bp, Ferroplasma acidarmanus
aaactgggggaatccccaatatggagagatgggttgctatattatgttgatatattaaacggaaaaatatactcttatggtgagaatataactcagctgcatactgacagtattatacctttcatagtcccatgcgatgatggactgatttttgccacaaaggattctataaaacatttaattttaaagagtggaaaagttgaaactatttttaagatgaaattcgatgagattgttagattcaatgatggcaaatgcgatatgaacggagttcttttcgccggtactatggatatgaatgaaaaagacccccttggttcactatatagatttgataataaagagagtaaagtgcttgacaggatcaccatatcaaatggaacaatatggaattacgataaaaaaattatgtattatatagattctcccacaagaaaaataagggtttttaactatgataataggaattcggctattcttgatgaaatggaaagtatagatgtttcagtatttcctggtgtaccggacggtatgacaatagattctatgggcaatttatatgtagccttccatggtggttcgtctgtaatagtttttgacagcaatggaaaggttataaaaaaaatttatgtgagtgcaaaaaatgttgattcctgcgtgtttggaggggatgatttaaaaaccctttatattacaactgctatggatgaaaatggagatggtggaaatctttataaaattaaaaatgagatttccgggattccatct

SEQ ID NO: 34702 - DNA, 494 bp, Ferroplasma acidarmanus
tttatcactatagaaggcattgacgggtcaggaaaaacaacacttgtaaattcactcaggaaaatatttgataacattcacttcaccaggagccgacagataaattccagctggcaaacctgaaaaccctcagtacccccttcaattcattttataattttttcctgtttacatatgacaggctggagcaccaggatgaaataaacggatttaaaaatgttatatgcgacaggtatcttgcatcgtccattgcctatgaggggcccatgattgaggaactttttggggataagaaggaaacggtactctggatgttggaagtgtcaaaaatgctaaaattgccagatatgataatttatctggatgctcatctggatgttgctctggaaagaataaggaatagcaggaaaaatttgaatttcaggggaaagcaattatcaattctggaggagaaggaaggtttgaaagcaatacaggattactatgaatacttc

SEQ ID NO: 34703 - DNA, 744 bp, Ferroplasma acidarmanus
atgaaaatactgtcgtggaatgtaaacggaatcagggctgcggttaagaatggaataataaaaactcttgaaaatgaaaatcctgatataatacttctgcaggaagcgaaagccgataaaatggacatacctgaagaattgcaccatactggatataaaatatatgtaaatccggcagataaaaaaggatacagtggcacaatggccatggcaaaacaggaaccattaagttacaccacaggaacaggtgaaaataataaagatgtggaaggaagaatacaaacactggaatacgataatttttatttaatcaattcatatttcccgaactcacagcacgggctcaccaggcttgactacaaaattcagtttaacagggagatactggaatatatggataagctgaaagctaaaaaacctgtaatcattacaggcgatttcaacgttgcacatgaagaaatagatatagcaaggccaaaggggaacgaaaaaaatgctggatttactattgaggaacgggattctatgactgaaattttatcacacggctatgtagacacataccgttatttccacaaggaacccgggcactattcatggtggtcatacaggttcaatgcccgtgaaaagaatattggctggcgcatagattattttcttgtaagtgataattttattgggaaagttgaggattcattgattctggagaatgttacaggttcagaccacgcaccacttgaactt

SEQ ID NO: 34704 - DNA, 1038 bp, Ferroplasma acidarmanus
atgtctggaattgtaagttacgggtcatatgttccaatatacaggataaaaccagaggaaattgccaggatatggggcgacgatccggaaaaaatgaagaataatctatttatattaagcaaatcggtaccttcaccggatgaagatgttgcttctatttctgtggaagcggcaagaaatgcccttaaaagaataaatataaatccgggagatattggcgctatttatgttggttcagagtcacatccatatgccgttaaaccgacagccaccatagtggcagctgcaatagggatgccgcttgaatactttgccgcagattatgaatttgcatgcaaagcaggtactgccggaatgcagaatgttaaggcaatggttgattccggttatatcaaatatggcattgctattggatcagatacatcgcagggtgctccaggggatgctctggaatacagtgcatctgcgggcggaacagcaatgattatcggaaaggacaatgtaatagcagaaataaatgatacattgtcagtatcaacagatacccctgatttctggaggagggaaggagaaccatatccccggcatggagaaaggtttacaggcgatcccggatacttcaagcacgttttagctgcctcaaaggcaatgatggaaagaatgggaacaaaaagcagcgattatgattatgttgtatttcaccagccaaatgggaaattcccaacaagggcggcaaagatgcttaattttacagaagaacagtataaaactggccttttgacaccctatatagggaatacatattcaggttctacaatgaccggcctatcagccatactggatgaagcaaaaccgggtgacaggattcttgcagtatcatttggttccggtgcaggctccgatgcctttgatataacaataacagaaaatatgaaaaattaccatcgtgaaaacgctccaggtgtaagaaaaatgattgaaaatgtgaaattcatagattatgctatatatacaaagtttaggaaaatactggttatg

SEQ ID NO: 34705 - DNA, 1146 bp, Ferroplasma acidarmanus
gaagtttatattatcggcgcaggcgaaacaaagttcggtgaattatgggacaaatcattgagaaatctggcagttgaagctggattgaaggcagttgaggatgcagggatatattcaaaagatatcgatgcaatttatggtgcgaattcacttgctggaatcataaacatgcaggaaaatataggcgctctgatcgctgacttttcaggtttatccgctgaaggaataccttccttaagggtagagtcatctacagcttccggaggcgcagcgttgagggacgcatacctctccataaaatctggagaatatgacgtagttgtagttggtggtgtagaaaaaatgacagatatacacggaagtgacatacttgaaaaatcgtcatccattctggatcgggaatgggaagccttttttggtgctacgcctgcagcaatggcagcgcttatagccaggaaatatatgcacgattttggagttgagaaagaagcactatcaatgttttccgtaaacgaccatcttaatggttcaaaaaacccggacgcacagttcaggaataaattaaccatacagcaggctatgaattcaactgcagttgctgacccactgaatatgatggattgctctccaatgagcgatggtgcagctgcagtggttctggcttccgagagcttcattaaaaagaacaaacgcgagggagtacgcatattgagttcagctgtggcagaagactatctttctgttggctctagaaaatctatatacacattgaactccacaaagcttgcagttgaaaaggcattgcggaaatcagggataaaaaggaatgatatatcatttatggaggttcatgattcattttcaatatttggtttgctggaactcgaggaccttggattcgcagaaaagggcaaagcaaaagatcttgtatacgatgaaataaagcttaatggcagcattcctgtaaatccctcaggcggattgaaagcaaagggtgacccatatggtgccgttggtgttggccaggctgtagatgcatacaggcagttaaagggcaaggcaggcgataaccagattaaggatgcaaaatatgcacttctgcataatatggctggaaccgggacatcatcaataatacatatactg

SEQ ID NO: 34706 - DNA, 1299 bp, Ferroplasma acidarmanus
gaactaccggggcctaatgcaaaaaaaattatggcagaggatgaaaaatatctggcaacatccacaaagtcattgcctgtagttgcatacaggggccaggggtgttatattgaagatgttgatgataatgtttttcttgacttctccagcggaataagtacaacaaacataggttatggcaatgaatatgttatctcaaaagtccaggaacagctgcataaattgtggcactttgcaggaacggatttttactatagcgagcaggtagaagcagcaaaggcactgataggagtatcacctggcagccacgacaaaaaggttttttatgcaaacagcggtgctgagagcaatgaagcatcactgaaactggcaaggagctatacaaaaaggccacagtttatcggattcataggcggattccatggaagaacaatgggggcactgtcatttacggcatcacaaccagtgcatcatgagggtttcttcccggaaatggccggtgttacacatataccatttccagacccatataggaatccattcaacatagatggctatgaagagcctgaagacctgacaaatgcggccatagattatctggaagattatgtgtttggaaagtttttgccatccaatgatgttgcagctatacttgtagagccaatacagggtgaaggtggatatattgtgccaccgatggatttccacaaaaaactcatggagctagcccatgataatgaaatactgtacataatggatgaggtgcagacaggattcggcagaaccggatatttctttgcttcggaatatttcggtgttgaccctgacattatgtctgtagccaaatcaatagcctcaggaatacctatgggtgcatctgttgtaaagagcaaatataattttgagaaatcagggttgcactccaacacatttggcgggaaccttcttgcctctgtttcaagccgtgccacaatagaagaaataaaaaataaaaatatggttgaaaacgcaagaaaggttggagattaccttaataagaggctacacgaattgcaggaaaaatatgataacataggagacgttagggggcttggattaatgcaggcaatagactttgttaaaaatagaaagaccaaagcccatttccgtgggctcagggataaaactatagagaatgcctataaaaacgggctcatattgctgggtgctggtgagagcgccataaggtttatacctcccttgatcgtgaatgagaaacagattgacgaggctatagatatacttgataactcaataaaa

SEQ ID NO: 34707 - DNA, 759 bp, Ferroplasma acidarmanus
atagaagtaacgaatctgtacaaacgttatggaaccactacagcacttaatggtatcagtttatctattgccggtggccagatatatggtatacttgggcccaacggttccggcaaaactacattattgaaaatacttgcaggaatattgccgccttcttcaggggaagttgtgattgatggcatgaatcttaccggcaactcagacaatataaaatccataacagggtatataccggaaacacctgcattatacgaatcacttacccccatagaatatttcaactttcttgcatctgtgtttaaaatcgaggattccgttttgaaagagcggataaatgcattttccaatgcccttgaaatagggaaataccttaatgaattcatagggtcattatcgttcgggacaaaacaaaaagtggctattatcggatctttaatacacgacccgaaaataattgtcatggatgaaggcatgaatggtcttgacccgaaatcatcaaaaattattaaggaactattaaaagatatgacagcaaagggcaaaacagtaattttttccacccatataatggaaatagcggaaaccgtctgcgataccatttctatattatataacgggaacatagccggaaccggcaatcttgatcaattaaaaagtgaagcagggtcaaacaacagtgatcttgagggggtattccttaaactgaccggagacgaggaccttgacaatctgcttgactctctgagggaatctata

SEQ ID NO: 34708 - DNA, 1023 bp, Ferroplasma acidarmanus
tttatgagtattaaagccgttgttatggcaggtgggaagggtactcgcttaaggcctataacatattcaattccaaaaccagtggttccaattgctggcaaaccatgcatgctgtatttgctggactcctattacaatgctggaataaaagatgttataatcacaacaggatacaaattcagttcgctgataacaagcattatagaaaacaggcataatgaccaggctatactcttctcagtagagaaagaacccgcaggaacagctggaagcgtaaaaatggtctcaaattttatagatgatactttaattgttggaagcggagacatactttctgattttaatatttcagatataataaattttcataaaaaaaacaaggcaatggtaacaatagtcttaactgaagtagaagatccgaggcaatttggaatagtagaaatggaaaataacaggattgttaggtttttggaaaaaccggacagggaccagacattttcccatattgccagtacgggaatttacgttatagaaccagaaattctggattatataacaacaatgccctatgattttgccaaggacctgtttccggaacttatgaaaagaaacatagatatatatggttatatgggaaagggtgtatggcttgatactggaaggcctaatgaccttataacggcaaatcagattatggtggagaaatatggcaaaccaagcaatgtggattttataaaagggaagaatataatacttgatatggcaggaatccataatacagggatagacaaatgctatataggaagaaacataaaggcaggtgataatgtatatatcaaatattcagccctttatgataatgaagttattgggaacaatgttgaaataacaaattctctgttgatggataatgttaccgtcagggaaaataccaaaatcaggaattcggtgataatgaaaaactgtgtaataggtgaaaactcggaaatcgtggacagcataattgccccggatatggattta

SEQ ID NO: 34709 - DNA, 744 bp, Ferroplasma acidarmanus
ataaaaataaatgacgaaatcaggcttacagatgataaatttctcatgatagcagggccatgctccgttgaaagtgaggaacagattatcagggttgccacgcaattaaggaaaattggggtcaatgtgctgagaggaggcgcattcaaaccaagaacatgccctgattccttccagggccttggagaagaagggctaaaattgctggctaaggcaagggatgccacaggaatggcaattataaccgaggttatggacatggatgaattgccacttgttgcagaatatgcagatattctccaggtaggatcaagaaattcacagaatttttcactccttaaaaagattagcaggtacgataaaccggtactgttgaagagagggttcgggaatactgttgatgaactgatatcatcttcaaagtatctttccatgaatggcaataagaggattatgttttcagaacgtggaataaggacatttgaacaatcgacaaggtttacacttgatatctcagccattcctgtcctgcatgaaaaaactgaatacccggtgataatagaccctagccacccggcaggggttaacagatatgtagaaccactggcactgggtggtacagccgcaggcgctgatggcctgatgatagaagtccatcctgacccaccaaaggcactcagtgattcagcccagcaacttaccgtcccgcaattccagaatttatatacaaaggtaaagaatata

SEQ ID NO: 34710 - DNA, 336 bp, Ferroplasma acidarmanus
gaaaatttaaaatataccaaatcacacgaatggtttaaaattgatggagatgtggctaccgttggcatcacagattttgcacagcatcaacttacggatatagtttatgttgatatgcctaagaaaggcaccgtaaaaaaggcaggagatacccttttaacaatagaatcagtaaaatccgcagaggatgtatttttccccgtcagtggagaggtaatagaaacaaatgaagaactggataaaaagcctgaactggtaaattctgattgctatgaaaactggcttgtcaaaataaagttaactgataataaatacgattccatgaccgcggcagaa

SEQ ID NO: 34711 - DNA, 789 bp, Ferroplasma acidarmanus
tatgaagatgcagattatgtgatattcggggccccattcgataatacgtccagttacaggagaggttccaggctggcacccaattccatacgggctgcctatgataatcttgaatcatatgaggtaaattatggtataaaccttctcgatgcaaaaatatgtgaccttggggacctcccggtttatgaggatgttgattatatactcagtgagattgaaacggccactgctacaatattccacgacaagaaaataccggtaatgcttggtggtgagcactcccttacagtaggtgcactgcgcaaccttaaagatattacaatggtaattattgacgcccattctgatttcagggattcatatatgggcaataagaataaccatgcatgtgttacaagaagggctcttgaactcctgggtaaaaacaaaataatctcaatagggacaaggtcaacatcatacgaggaaatagcttcaggagaatatgaaaatgttagattcatctcagcaaatgaggtccgtgcatcaggcatagatgaagttataagcgaagttatggaaaaaacatcggatagggtttatttctccattgatatggatggtttcgacccggcatatgcacctggcgttggaactccagagccatacgggcttacatcatatgatgttcgcagcatattaacatcaatatcagatagaataattggttttgatataaatgaaatgacgccactatacgataatggcaatacatcaatgcttgctgcaaaattaattcaggattttata

SEQ ID NO: 34712 - DNA, 660 bp, Ferroplasma acidarmanus
ttacaggatctgaatccggttgaaatgctgggaaaaattgggaaatattatggaaaaggtgctgtgttcacttcaagcctggggctggaagacatggtcatcacagatatgattgccagaaataatattaatgttgaaattgcgactatagatacaggaagactccctgatgaaacataccagcttatggaaacggtaaggtcggagatgggtattgatttaaaaatatatttccctgaaagagaagatgttgaggacatgatcaattccagaggaatcaatcttttctaccattcgttagataaccgccatttttgctgtaatgtgagaaaggtaaaaccacttaaaaatatacttcgcaaaaggtcggtttggatcacaggaataagggcagaacagactgttgcaagaaaaaatgccagaaaagttgaatatgtaagggatcacaatgtctggaaagtcaatccacttctggactggagcagggatgaaatatggtcatatgtgagtattcacaaagttccatacaacattctgtttgaccagaactataagagcataggttgccagccatgtacaaaggcagtgggaaaggatgatgacgaaagatctggaaggtggtggtgggagaacggcgtaaaggaatgcggccttcatttg

SEQ ID NO: 34713 - DNA, 1104 bp, Ferroplasma acidarmanus
catggtggaaaacttgttaatatccctgatgtcagtgatagggaagcacaccatacaattgaagttagctacggtactgccatcaggataatgaatatgaagatgggaatcctgagtcctttgaagggattcatgggagaaagtgatttccattctgtggttgagaaccaacgtctggaaaatggtcttccatggagcattccatacacactggacataggagagaaagaattcagatgtgtaagagcaggtgatactgtcaggttaagccagaactcaggggtaattgccataatggatgtaacagatatttacagatatgacaggattgaatactgccggaaagtatttggaactacctcaaccgaccatccgggtgtcagaaacatcagggaaagtacgggtatatgtatggccggggaaatcaagtcagctaaccttccagaaattccattcctgaaagaaacactttttccggtggacacaaggcagatatttctggaaagagggtggaaaaccgttactggattccagacaagaaatgttccacacagagggcatgaagagatgcagagaactgcactgcgtgttacggacggcattttcataaatcctgtaattggtaaaaagaaaccgggtgattacagggacgagattattatgaaatcatacgataccctcataaataattattacccttcaaacagagtcctcttttcaccccttcactatgaaatgtcatatggagggcccagagaggccatgatacatgcaatcatgagaaagaatttcgggtgcacccactttgtagtgggaagggatcacgctggtatcggaaacttttatggaccatatgacgcccagaaaaatctccaggcctttgaacttggcatagaaatcatgaatatggatgaggtcttttactgcaagaagtgcgaacagctggcaacttcgcgggattgttcccatgtggatggagatagagttcatttcagtggaacaatggtgagggatactttgaaaaacggattatctccagaaacttatctctttagaaaagacgtatatgaaacaataaacaggcatgataataaatttgtagag

SEQ ID NO: 34714 - DNA, 1263 bp, Ferroplasma acidarmanus
gtactttcttccatgggggttatgatggatggttacacgctcacagttttttcctatgcattgctctatctgataaacgtaatgtcactgaaaagctatgaaatctcaattatggggatatcatcaataggtggagttcttataggcagttttatttccggatacattgccgacatctacggaaggaggttcatatatatttacgacctttttcttgtttcaatatttatctttcttacaggccttgcaacaaattatatcaatttttcaattcttgagttgatagttggtattggaataggtgcagattatcctgtaagttcatcaatccaggcagaattctcgccaacaaagtccaggggaaagtttatgttttttaacatattttcattttccattggttctcttatatttctggggtttgccgtgccgcttgttctgtttacaggagtcaatgcatggcgttatatgtacatgataggagctgtttttcctattcttgttctatattcaaggaaaaaaataccagaaagcccatactgggtacagcataaatatggtaaagtggccggtgaagaggcaaaggacaaattcgaagcatcaacagggtattcaatcgaaaaccttccggaaataagcccgggaaagacaaggctgagggatgtttttaagggaaaatatgcagcatacatcatattcatttccatagcatggttctcctatgatattgtgagttatggcatatggacatattcaccacttatattctctactgaaataacatcatattatgccgacctctatgtggtctttaccggaatggcagaatcaataccagtagtaataggatttctaattgccatatactatgttgaccgtattggccgccggttcctcctgattattggattcctggggtcatttgccgtactgatattattcttttttgttaaccagtacatggttgtagggctactgatgactttcagtgctttcggttttgtccactttttccataacgttgggccaagcccgattacatatacatatcctgtggaaatatttccaacaagaatacggggaactgctatgggcttcgctacatctgtatcccgtattgggtctatagttgctgttttctcatttccaataatagatgcattatacggattaaaggcaataattatattctttgccatattcgaattcattggactggcccttactctgaaatatgccccagaaacaaaaggaaaggcatta

SEQ ID NO: 34715 - DNA, 3585 bp, Ferroplasma acidarmanus
atgaatcctattttagatgcgtttttcaaatcagagagtgtagttaattatcagattgattccatgaattatttttatgcttcaaagaacaatccggataatataatgcaacagatagtggacgaaaccaagatatccgatgatgcaacacctggagtaatagatcttgacccttcaaaaacaaagggcaaggacataaaaatttattttggcagggaaaggcagaatggcaaggctacgggagatccaacgatatgggtagacaaacctgaaatcaaggaagcttccggtgctacaaaccagataacaccacaggaagccaggctcagggaccttaactatatggcacccataatgttgcggctgcgtatagtggaagatgggatagaaagagatgcaaataccattaaaataggggaaataccggtaatggtaagatcaaaaatatgtacattgtcagaacagaatctggacctttacattgaaaaaaacaatggccctatagatgaaacaagggagaacaaactgagatatgtagacgaggatcccacagaccctggaggatattttatcattggcggatcagagagggtaatagtttcactggaagaccttgcgccaaataagatacttgttgagtatgaagaaaaatatgattcaagggtagaagttgcaaagattttctcccagaagagcggattcagggcattgatatctatggaaaaaggaagcgatggtataattaacgtttctatacccactgtagctggaacaatacctcttgtaatactgatgaaggcgctgggaatcgacaaggatgttgatatccatgaagcaatttataccgatccgagaatggatccattaatctatgccaatatagaggattcaagaaatcttaaaattctgccacccaatggaattaacaataatgaagatgcactgtcttacctggaaaagaggtttgctgcagggcaggccaaagagttcagggataagaagatcacacagatgctggatcgtgctttgcttccacaccttggagatgatgtttcagacaggttaaagaaggctatttaccttggaagaatggcaagatcacttcttgagcttaatttaggaatgcgtcatgttgacgataaagaccattatgcaaataagagaatcaaactttccggcgaccttctggatgaacttttcagaaatgcattccagtcagttatgaaagatctgaaataccagctggaaaaaacttacaataaaaaaagaggtatcaggctgaggcctgcagtcaggcaggatctgctcacacagaaagtactgcattccatggcaacaggaaactggataggtggaaggacaggcgtgtcccagctgctggacaggacatccaatatgtccacattgagccatctgagaaggattatttctccactgacaagatcgcagccgcattttgaggccagagatctccacccgacacagtgggggagaatttgccctaacgagaccccggaaggtcagaactgtggcctggttaaaaatgcatcacttataattaatgtaacccagggaatagatcctgatattgtaatggaagaattgcaaaacatggacatacacgaagtaacaaaggaagaagcttccgggcgtatttacctgaatggggatttcatagggtaccataatgacccggcaatactcaccgacacaataagaaatttaagaaggtcgggaaaattatcaaacgaggtaaatgttaaatacgattccaacacaaatgaggttattattaactgcgaccgcggaaggctaagaaggccattatttgtcgtaaatgaaggaaaaacagtaatgaatgaggaaatgctcgagaaattgagaatgggcgaatatacagtaaatgaccttatttccagtggagccatagaatggcttgatgctgaagaagaggaaaacgcatatatatcagtatttccattcgaatttcccgataattgcccagattgtggcaaagttctttacagggataatgtcacatggataaatccaggaaatagtgatgttactcttgagtgcgatgaatgccatgcacactttaagggtacaaataacctatccatggatcacacacactgtgaaatagatgcttcaatgatccttggagttgttgcttcccttattccatatccggaacataactcctcaccaagaataacaatagcttctgcaatgattaagcagtccatagggttgccacaggcaaattacaggataaggacagataccagggggcatttattgcactacccgcagattccacttgttacaaccaaggttatggatttcattaaatacaggaggaagcctgcaggccagaattttgttgtagcaatagtatcctaccatgggtacaacatgcaggatgcaattataatgaacaaagcatctatagaaagagggctgggcaggagttcattcttcaggacatatacagcagaggaaagaagatatccaggagggcaggaagataaatttgaaattccaagccacgatgtgcttggggccagagctgaagaatattataaaaatcttgatgaaaatggaataatattccctgaatccaaagtagaaggttcagatgtgcttgttggaaaaacatcaccaccgagatttctggaggaagaaaatgccgacaaacttggcccactgagaaggagggaatcttctgttacagtaaggcctactgaatccggatatgttgacaatgttttccttacagtttctgaaagcaacagcaggataattaaggttaaggtaagaagtgataggataccccagccaggagacaaatttgcttcaaggcatgggcagaaaggagttataggttatgtagccgcccaggaagacatgccattcacagaggatggaattataccagacctgcttttcaatccacattcagttccttcgaggatgactctgggacatgtgcttgaaatgatgggtgcaaaggtttctacaatgagcggtgagaatatagattccacaatatttgatggggaacctgagagaagccttagggaacagttaaagaaatatgggttccgtgaatccggaaacgaagtcatgtatgatggaattaccggaaagaaatttgaagtggatatatttatgggcgtaatttattaccagaaactccaccatatggtagccagcaagttccatgcaaggtctagaggccctgtacagatacttaccaggcagccaacagaaggcagatcaaggcagggaggtctgagatttggtgaaatggaaagggatactctgatagcccatggtgcgtctatggttataaaagaccgtttgctggatcagagtgatggtacaatactctatgtttgtggaaaccctacctgcgggcatatagctatttatgatttcaggaaagggacattgcggtgtcctgcatgtggcaatacaggcaatatttatcccatagaaacaagttatgcatttaaattgatgagggatgaattaagttcaatgggaattgtaatgagattggagctgggtgatatgaaa

SEQ ID NO: 34716 - DNA, 819 bp, Ferroplasma acidarmanus
attggcacaagaaatagcaaacttgcactgatacaggcaaacagtgtgaaagatgccctggaatccagaggttatgaagttaacataaagagctacacatctgcaggtgactcaaataaaaatattccattgtatcgcatgagttctaccggtgtttttgtggatgaattgaatgaacgggtactgaaaggtgagattgaccttgcagtgcacagcgcaaaagacattccatcaaatatacagaaagggcttgaaatcacagcagtaacgggaagagatgatttcagggacgttttaatctcacggacaccattggaagaaatgacagcaggttcggtaataggcacatccagcatgcggcggatcaggcaagccatgacagtgaatccagaaataactgtatcagatatcaggggaaatattgataccaggatatcaaagtatacggaaaaaaaatacactggcatcatcattgccatggctgcttataaacggatgaaactggatattgaacattttatcctctctgaagaacaattcctgccagcgccgaaccagggtataattgctatagttggaaaaagcaattcccccgcctccattatatctggagaaatcaatgacagagaaacatatagagacatgaagaacgaacggtttatcgctacatcattaaatctagggtgttccatgcccgttggaatactttcaaaagatggaaaaataaaaacaaggttctattcactggattctgatgaacacagggatatggtgttcagtgcggaaaacctggattctgttgtagaacatataaaagag

SEQ ID NO: 34717 - DNA, 1299 bp, Ferroplasma acidarmanus
ctgcgtaaaaaaataaatccttaataagaatgtagatacatgagatcatcggaattatttaaggaagcgctggaactgttccctctgggcgtaaattcacctgttagatattattcacctgaacctgtaatgtttgcccaggggcatggttcgaaaattttagatgtaaatggaaaagaatacatagactattccctgggattcggccctatgatacttgggcatgcaaaccctgatgtttccaatcacataaaatcacaggttgataaaggaatcttatttggctctataagtgagaatgaaataaaacttggcaaaaccataaagaatgctgtgggttccattgaaaggctaagatttacaaattccgggactgaagccacaatgcatgccataaggctggcaagaggattcacggggaaaaagtacattgtaaaaatggaaggcggataccacggtgcacatgactatgccctgataaaatccggcagtggcaccatgacattcggagttccatcttctgcaggtgtaccggaggaagtttccagaacagtgcttgttgggagatacaatgacgctgaaagcattgaaaagctgttcaaagaacacaggaatgaaattgctgcggtaattacagaaccggttcttggaaatatcggtgttataaatccggagaatgattttttgaactctctacgggaaataactgagaaatattcatccctgctcatatttgatgaagtaataaccggctttagattcggatttaagggatatcaggacattgcaggaataaaacctgatcttaccactatgggaaaaattatcgggggaggcgctcctgtaggcatgtttggcgggcgtgaagatattatggcgcatgtagcccctcagggtgatgtatacgaagcgggaacgttttcggggaatcctttgaccatggctgcaggaattgcaactcttgaccagttaaagagcaaggattattcagccataactaactatgcagccaggcttgaagaaaaacttaactcattgatatctgagtacaatattgatgcgactatcaatagatgccactccatgttccagatatttttcaataagaataaggtgaccgattacaagggagcaacagcatcagatacagaaaaattcaataaaatgttccatacgttactggagaagggcatatttttccctccaagccagtttgaaaccgagtttgtaagttttgcccactcagaaactgatctggaatctaccgtggatgccttttcatcggtgttgaaatgcctg

SEQ ID NO: 34718 - DNA, 501 bp, Ferroplasma acidarmanus
atgataataacaatcagcggagaatcaggatcaggcaaaactacagttggcaaattgctggcttccagtttaaattataaatttttttctggcggttattttttcaggaagaaagctgaagaatataacatggatctaattgactttagcaattatgcggagcatcatcctgaaattgataaagaagaagataggatgattgttgaattcatgcagcataatgacgatattatacttgaatcaagattatcgggatatatggcatataagaataatataaatgctattaaaatttatttgaacacagatattgccaccagagttgatcgattagccagcagagacaaaggagtagatagggctggaataatgacgcgggcaaggtcagagtttttaagatatatgattttctatggaatagattaccgggtttttacaaactatgactatataatagacacagaccatatatctcctgagaatattgttaacgatatagta

SEQ ID NO: 34719 - DNA, 699 bp, Ferroplasma acidarmanus
atgcaacagggtcaaatggcttatgacagagcaataacagtattttctcctgatgggagattatttcaggtcgagtatgcaagagaagcagtaaagaaaggttcaacagcccttggtataaaattcaaggacggcgtattgcttttatcagaaaagaaggcaagaagcaggcttgtagaaaagaattcattggaaaaaattcagcttgtagatgacaatgttgcaactgtaacatcaggtcttgttgctgatgcaagggtactaatagattttgcaagggttggagcacagcaggaaaaggtaacatacggttcgctcacaaatatagaaaaccttgtgaaaaaagtggccgaccagatgcagcagtacacacaatttggaggcgtcaggccatacggagtatctatcatatttgctggtacagacacaataggcccgagattatttgattgtgaccccgctggaacaataaatgaatataaatcagtggctattggtgcagggaaagatgcagttaccgattatattgagaaagaatacaaggatgacatgagccttgaagacacaataaaacttggagtagcagctcttaaatcagcacttgccgacgcaagctcaatgaaagagcctgaaatcgcttcaataaaagttggtgagactttccacgtttatacgaatgaggaagtttcaaaatacctt

SEQ ID NO: 34720 - DNA, 1251 bp, Ferroplasma acidarmanus
gttattcttggtttgcagtttggtgatgaggggaagggtaaaattactgattttgtcagcagagattatgatgaagttgtacgttttaatggcggcagcaatgcagggcacacagttgtcataaaaggtgaaaaatttaaattccatctggttccatccggagcaatgcagagcaataaagtcatacttggaaatggaatggttatagatccggaagaactcgtatcagaactggacctgcttaaaaaatccaagaaagatatagagataaaaatcagtgcaggcgcacacatagttaccaaaatgcacaaatgccttgacaagaaagaggaagaaatcaggtctaaattaaatatagggacaacatcccagggcatcggcccaacatacgaagataagtatgcaagaaccgggatacgctttatagacctatctaatccagaaattattaaagacaagattgaaacaatatacaatatgaagaaacaactgctaaagggcagcatattcgaaaatccggaagaaagggctaaaatggttaaggacctttgcggctttggcaattcaatcatgcaatatatggattatacggagaacgttataaacaacgattaccgccttggcaaaaatatactttttgagggtgcccagggaggaatgctggatatagattttggaatatatccatttgtcacatcttcaaacacacttgcaggagcactatcaaccgggtctggattctctttcagaaaggttgaccgtgttatcggagttttcaaggcctatacatccaaggttggttcagggccattcccctcggaaataataggggacagcacattgagggatttaggcagtgaatacggtacaactacaggcaggccaaggagagtcggctggcttgacctcccattgttaaagtataccataatgatgaacgatgtggactctttagccattacaaaggtagacatactggggaaaatgaaaacaatagagatagcaacaaaatatacaatagatggcaaggaaattgactattttccgagaaggctggatgattttgagaagttgcatgttgattatgtggagttgcccggttggggcgacatagaaaaccctgatgatataattgcaaacggataccaggcacttcccgagaatatgaaaaaatatattgagttcattgaggaaaaaacaggtaaaaccattgatattatatcgcttggggaagaccgtagaatgactata

SEQ ID NO: 34721 - DNA, 1296 bp, Ferroplasma acidarmanus
atgtacataggtgattaaatggatttcgatgctgcaattattggctccggtgcaggaggatattactccgcactccggctgctgaagcacgggaagaaagtccttatcatagaaaaggaaaaatttggcggtgaatgccttaactacggttgcataccgtcaaaagcccttatagaattaagtgaaaacataggttacctccatgatatgccaggagttaccatgaactataaaatagatatgaaagaatggcaggaatggaaagaatccatggtaaaaagaataacaggcggtgctgaaaagctttgcataagcctgggtgctaaagttgtctatggagtcgggtcagtaaaggacaggaatacagtcacagtaaatggtacagattatacagcaaaaaatataatcattaatacagggtcagtaccggtaaagataaaagggattgacgatgtttattataacagggagatgcttgcagttgaaaccatacccgcaaaacttgtcataatcggtggcggatatataggagttgaaatgggaactgccttcaggaaactcggttcagaagtttatattgtggaaatgaaagacaggatattacctgaaattgaggaagatcttgccagggaagttgacaaaaggctcagaaagcttggtgtgaatataatgaccggaatgaaggtgctttcagttaaaaaagataaaaactataaagtgtctatagaaggcagtgacacaatagaggctgataccgtgctcatgtctgttggaaggatacccaataccgagggcagtggaatagaaaaacttggaattgaaatggacgggcgcttcataaaaaccgatagccataagagaactaacattcctaacatatatgctattggcgatgtttcaggagtacctatgctggcacataaggcgttttacgatggatatgtagctgcagagaatatacttgggaatgatacggttgttgattacagggccatgccatttgtggtttataccgatccggaaatagcatttacaggaaaagcgggaactaaatcgaacaaggtaccggtgcttgcaaatcccagatcattgacaatgaaccagaaagacggattcttcaaattgtactacgatgatgacggtaccataacaggtgccggagtagctgcccctagatcctcagaatctataacagaaattagccttgcagttgaatcggggctttccatagatgatttattcctgaccatccatccacaccccactgtatcggagggtttgaaggatgcagcagaa

SEQ ID NO: 34722 - DNA, 1131 bp, Ferroplasma acidarmanus
tatacagttagtttgcctccaattggagaaggcattcaggaaggagagatagtaaaatggacagtaaaaccgggagattcgatcaagaaagatgatgaactggttgaagtaatgacagataaaataacggtaaaaataccgtctcctgttgcaggaaaggtatcaaaaatattgataaaggaaggagaaaccgctatgataggagatgctatggtagagatagattcccctgatgagtcaaatagccctgaaaaaccggtagagaaaccagcaacaacagcacaccaggaggtatctgtaagcacagatgaaaaaataccttctgtcaaggctactccagcggtaagggcctatgcaaggtcaaagaatgtagatattttaaaggtcaaaccggctgcccaggatggaaggattacaaaggaggatgtagatgcctatatgaagcaacctgcagaaccgattgcacaaaaggcaccatcaggagaggatgaggtcttcacgcctaccggcataaggaagcttatattcgacaaaatgacaaagtccaagcagataataccacacttcaccataacagatttcatagatacggaaaatattgaaaaagccataaaccagtattcaaagaaaaagtatgtgagctttactgcatttttcgtaaaagccgttactgtggctttcagggatttccctaaatttaatgcagtatacaatgaaaatgacagaacctataccataaagaaaaaatacaacataggggttgctgtggattctcctgccgggctaacagtggttgttgtcaaagatgtggcatcaaagaacatattccagatatctgaagagataaaggatatggctgaaagggccagaaatggcaaacttggattgcaggatgtccagggttcaacattttcagtaaccaatatagggtctatagggggaataatggctacaccaataataaattacccggaggtggcaatactagaaataaatactagaacctcgggatttgtaaacggcgaactgaaacatggattgtatcttacacttgcatgtgatcacaggcttatagacggcgctgaagcagccagataccttgaaaaattaaaggaagtgcttgaatatcct

SEQ ID NO: 34723 - DNA, 957 bp, Ferroplasma acidarmanus
acgcagatgacaatggtaaaggctttaaatagcgggcttaacaatgcaatggaaaaagacgattctataatactcctcggtgaggatgtgggcactgatggaggtgttttcagggtaaccgatggattactggctaaatatggaaaggaaagggttatggatacccccttggcagaactgggaatagtgggatttggcataggaatgtcaatggccgggcttaaatccataccggaaatacagttccaggattttatttacacggctatggaccagataataaaccagatggcgaagctaaggtacagaactaatggagattatacacttcccatggtgctgcgtaccccctatggagggggtgtacatggagggccttaccattctcagagcggtgaagcctatttcacacatacacagggattaacggttgtaaccccgtcaaatccatatgacgcaaagggattgctattatcatctatagagctgaacgatcctgtaatattccttgaacccaaaaggctctattatgcgggcaagatggatgttcccgatgattattataaggttgacctgagaaaagccagtgtgataagggaaggcgatgaccttacaataattacatatgggcctgctgtgccggttgtgaaaagcacggttgaaaaaaataacgtaaatgcccagataatagatttaaggactttgagccccttcgaccttgataccatacttgctggagttaaaaaaacagggaaagtgctgatagtccatgaatcacccaagatgttcggtgttggtgcagagctctcagcaacaatttctgagaaggcagtggattacctggccgccccaatattgagggttacagggctggacatacctattccatttgcccttgaggagtactatgtcccgaacgagagaaggataatggctgctatagataaattattaaag

SEQ ID NO: 34724 - DNA, 1014 bp, Ferroplasma acidarmanus
attagtaaggaaggcttgttggccgcgtataaaaatattgtaatggaaaggctatttgacaaaaaaatgctgaatgcaagcaggcagggatttttgcccttttatattccgcttatggggcatgaagctatccacataggaatgggaatggcaatcagggatgaggatttcttttatccatattacagggattttggtgttctcatccagatgggcatacctatagatactatattgtcacaggtatttgccactgcaacagacaatgaaataggaagggatatgcctgaccatttttcacttaaaaagtacaatataggtgcagtaataacacctgtagcagggcatcttacatctgcaacaggaattgcatatgcaaagaaatacagaaaagagagcggttccgttataacaacatttggagatggtgcaacttcaaccccggatttccatgttgccatgaattttgcaggagtttacaaactcccgatggtatttttctgtgaaaataaccagtttgcaatttctgtgccaacatatccaacagatgataaggcatttaaccagacctatgaagaaaccagaggtgcaatttacaagaaagcagaatcatacggattctccggaataaggatagacggcacaaacttcatagaagtatatagggctacaaggaaggcactggaaaacgcttctgaagaccctatccttatagaggcaatgacatacaggatgggaccacattccacagctgatgacccgaataaatacaggacagatagggtgcccgaaggaagcgagaaagaccccctgatagtaagccagaaacttctaaaggatatgaaagtgataacggatctggatataaagcagataaatgatgaaatggaagaaactacatcaaaacttatagatacctatgaaaaagcacctaaaccggataaggaaacaatgatgggaaacctttacgaagaagagccatggtacataagtgaggaaagaggtgatatacaa

SEQ ID NO: 34725 - DNA, 1392 bp, Ferroplasma acidarmanus
acaagtgattcaatgagttcagccatagacaggtcaatggatgaggcaaaaacatcgaaatttcattataaagtattatttatttcagggcttggattttttacagatgcatatgacctttttattataggtgtggtgatactgcttttgccatatgccggttggcataatatcagcatattttacaagggtctcgttacctctacagcactgcttgctgctgttataggttccgttgtgtttgggaggcttctggattattctggaagaaaagcaatatatgggttcgagctggtagcactcatagccgggtctcttggtagtgccttccttactcctgtaaacaacatattcatgctgcttttctggaggttcctcttaggggtaggaattggtggtgattatgcaacaagttccaccataatgactgaatattccagtacaatgaaccggggtaaatttgtgggtatgatattttcaatgcagagtttcgggcttatagcaggaccacttatatccatagcatttctttcaaactatgtttcaccttacataacatggaggcttctactggcaataggggcgataccggctattatagtaatatatttcaggagaaccatgccggagccaccaagatatactgcagatgtcaggggcgattacaaactggctgctaaaaatctaaaaactttcgcaggtttagactcaacaggcagcaaaggcaaaacaatcaatgcaccatggtatgtgttattcagggacaggaaatttctgctcacccttataggcacagcaggtgcatggttcctgatggactgggctttttatggaaattccataatgtccaacagcatattatcgttccttgtcccgtcaacggtatctggcatacactccataattatgacaaatgaatattctgcaataatattcggcgttgctgcatttcccggttactggattgctgctttcacaatagacaggatcgggagaaagcctgtgcagattaccggctttgcaatgatggcaatttccttcggaattatatcggcatttagcttcctgaccacctacaggttccttgattatttcctgctcctgtatggaataagctacttctttattatgttcgggcccaatgtaacaacctttgtatatccacctgaggtattcccgatttcaacaagggggctcggcacaggaatatcagcagctggcggcaaaactggcgcctttataggcaccctggcagatactattatattatccataacaggattgcatttcctcatgggaatgcttgccataatagcggcaattggattgatactcacaatagtgcttcttccagaaacaaaacgcagggatcttggggaaacatccggcgag

SEQ ID NO: 34726 - DNA, 1764 bp, Ferroplasma acidarmanus
atgcatattgcgattttagacagggaaaggtgccacccgaaaaagtgcaaccatgaatgccgatattactgccctcctgttagaagtggtgctaaaactatagagtttccagggcaatccgatgattttccggtaattactgaatcactctgcataggctgtggtatttgtgtgaaccggtgcccatttggtgcaattaaaattgtaagtgtcccggacgaattaaacaaggatatagtacatcaatatggaatagattcattccggctatactcacttccagaactcggaacaggcagggttaatgctatactcgggcagaacgcccttggaaagacaacaacaatgaatatactttcaggtgtccttataccaaattttggaaatataagcaaaaagaacgataaggattacgttatagaaagattttcgaaaagcatcatggggcagtatttcagggacctctataatgggacaaaaaaagctgtcctgaaaaatcaatatgtagacctcataccgcgcgttgccagcggcacagtaagggacataatgaaggacaatgaccatggcaatatggatattatagtagatgacctttcaatgaaaacattccttggaagggatgtaaaagagctctccggcggtgaactacagaagcttgctatcggaattacgcttatgaaagatgctgacatatatctctttgatgaagcctcatcatatcttgatattaatgaaagaataagggtttcagatataataagaaagctttcacaatcaaaaattgtcatggtagttgaacatgaccttgccatactggacaagatggccgaccaggtaaaccttgtatacggaagcccgggtgcatacggtgtaataacaaaggaaaagagcacaaataaggctataaacgcatttctatcaggatatctccgtgaggaaaatgtaagggtcaggccgacatccatagattttacagtaaaatcaagcaaaaggacttcagtaacaaccaaggttacatcctggactgcaatggaaaaaagctacggcagttttaatttgaatatcggagagggttacattaacagggaagaaatcataggtgtcctcgggcagaatgcacttggaaaaaccacctttgttaagatactttcaggtgttattaaaccggattcaggctcagttgaaaacgaactcaaaatagcatataagccacagtacatatctactgattacgaaggtactgtatacgaactgctatcaaccgcattgaaggaaaaaatggaggatgtattcataaaaaatgaaatcctttcgcctatgaacgtttcagagttatatgataactatataggagacctctccggcggtgaactccagaggacatccatagcattgacacttgccaccgatgcagacctctatctaattgatgagccctctgcacacctggattcctcatacaggatgaatgtggcaaggataatcaggcgtgtaatagaaaacaataagaaaagcgcaatagtggttgaccatgatatttacctcatagaccttatttctgatgcacttatagtttttaagggagaacagggggtatacggaaactccagagggcccatggaaatgagagatggcatgaacatgttcctgaaagacctgggaataacattcaggcgtgatgaaacaacaaggcgcccgagaataaacaaattaaacagtgcactggaccggcaacagaaggccagcggggaatattactat

SEQ ID NO: 34727 - DNA, 996 bp, Ferroplasma acidarmanus
atgaaagcttatgttttaaaagagccaggggtgcttgaattaatcaatacagaagccaggaagcctgatactggcgaagttcagataaagaccagggcatgtggcatatgtggtacagattttcatgcatacaatggaaaacaccttgctgtcaaatatccggtgatcccggggcatgagtttagcggggttatcacatcaataggtgaaggtgtaaaatcatttatgcccggagacagggtagttgttgatccaaatataacatgcgggcaatgtgaatactgcaaaggagggaaggaaaatttctgtgaaaatataaaaactgttggcataaactatccaggaggatatggcgagtatgtcactgttccggaaaaggtagtttataaaattcctgatactatgagttttgaagccgcagcaattgttgaacctgtagcatgcataatacacgcttttgataatacacatgtcccccttggcgggtcagctataatttcaggcactggttttattggccttgcatttttacagatattgaagggcatgggatattatcctgtatacaccatggacacgaatcctaccagaaacttgctggctaaaaaatatggttctgataaaatatacacgggcatagatgatttaatggaaagcgatattataggaaaggcaaacgttgttgttgaagctacagggtccaatagcatactttctaaaacaattgatatggcttcgccttccggaaagatcttcgcattttctgtgtatccgcccggtgaaaaaattgaaattgagtcaaataaaatatatagcaaggagatatcaatcttcggagatttcgtaaatccgtatacaatgaggaaagcaattaatatgataagctccgggcttatagattattcagggatggaagaccctgtaataaaaattaacgatattggaaacctcttccaatccggaaagagaaattttataaaacctttgatatcctat

SEQ ID NO: 34728 - DNA, 1353 bp, Ferroplasma acidarmanus
gcactggataatgccacaggaaagttccacttcagaacttttctgacagcagggatgggatttttcacagatgcctatgatttgtttattataggaacggtgctcgcaatacttccaatgattggatggcaccttacaaaaacagaaatagcccttatagggtctgtgtcactgatagctgctgtacttggtgcgctggcatttggcagattgctcgattatcttggcagaaaggctatttatggcctggaactggtattgcttgtaattggtgctttaggaagtgcattcctatcgtttaaaaacccctacgctttaatggcatggagatttttgctgggagtaggcattggcggtgattatgcaacatcttctgttataatggcagaatattccaatatgaaaacaaggggaaaatatgttggaatggtattttcaatgcaaagcataggtttagtagtttcttcattgcttgcccttacatttttactgagcacgaagattattccactggcagacgcctggaaaataatgctttcagtaggagccatccccgctgcaatagtaatttactacagaagaaaaatgcctgaaccaccgagatatactgttgcaaaagggcgtgctgcggaggcttcaaagaatcttaaatcctataccggaatagatgtagctgtctctaaaaataaagaggaggtaaatgctccatggtataccctctttaaggatagaaaattccttattacattaatagggacagcaggagcatggttcttaatggactgggcattttacggaaactccataatggcaagcagaattttcgcaaccataataacacagaccggattgtctggcttaataagatctacggaatactccgccatagtgttcattggatttgccctgccagggtactggctggcaacatttacactggataaacttggaagaaagccgatacagataacgggcttcataatgctcgcggtaacatacggaatacttgcattatttcctatactggataccccttcatttgtggtggagttcattgcagtgtatggtattagctatttcttcatgatgttcgggccaaatgttacaacatttgtcttcccatcagaggtgttccctgtaacaacaagagggtttggtacaggcatatctgcggctggaggaaaaaccggagcttttataggcacatttgttgatgtgtttataatagccgctgggctttcatcactcatgactgtacttgcaatattttcagtattaggcgttatagtaacaatactgtgcctgccagaaccgaagggaagggcaatggaagagatttccagggaaaaggaa

SEQ ID NO: 34729 - DNA, 633 bp, Ferroplasma acidarmanus
gaaaacagaatgcctttaattggagagaaattccctgaaatggatgttgttacaacacagggaagcaagaagttgcctgacgactacaaaggaaaatggtttgtcctattcagccatcccggagattttactccagtatgtaccactgagttcttttcatttgcacagagaaatgatgaattcactaaattaaatactgaattaataggattgagtgttgattcaaaaatatcacatatggaatggatcaactggatacatgacaatttaaaaatagatgttaaatttcccataatagcggatcctatgggaaacgttgcaaaatctcttggaatgatacatgctgaatctgcaacatctactgtaagggcagtatttattgtggatgacaaagcagtggtaagggctatactttattatcccctggagataggaagaaatatatctgaaattctcaggatgatcaaagccctgcagatggttgacaaatataagatagcaacacctgcaaactggcctgacaatgaattaatgaaagggaggtttataattccaccaccggcaactatgaacgatataccggaaagattaaaaaaatataagggatatgcctggtggttaacataccgtgat

SEQ ID NO: 34730 - DNA, 945 bp, Ferroplasma acidarmanus
ttaaatatctggacggaaaaatacagaccaagcaaactctcagatgtcataggcgaaaaagggaatataaacagactgaatgcctatgtaaaggataagaatataccacaccttatttttgccggaccgcagggaacaggcaagacatccacagctattgcactggctatttcattatttggcgattcatggaaagaaaattttatggaattaaatgcatccaatgaccgtggcatagatattattagggacaatatcaaaaactttgccaagatcaggccatcaaatgatctgggatttaagatcatattccttgatgaagcagaccaccttacaggggatgcccaggctgcattgagaaggacaatggagatgttttacaacacaacccgttttatattttcctgtaactattcatccaagataattccaccgattcaatccaggtgtgttgttctccgtttcaagcccattgacagggaatcaatgaagaataggttaaaggatatagctaaaaaggagaattttgaaatagacgatgattcccttgatgccatatacgaaatctcagatggcgatatgagaaaagccgtaaacgtcctccaggcagtaaagctttcaggaaaagtttccgctaccgcaatatatgagatatcaggggaaattaacagggacgaatataaaaatctgatcaatatggcaattgaaggaaattttaacgatgccaggaattatcttgacaagatgttaatcgactatggattgtcaggaatagatataataaaagggatgcactcatctatacgaggagagcagatagcatacaagcagaagctcgaaataatcatggcactggctgaggctgaattcagaattgttgaaggaggcacagacaatatacagatggatgcacttctggccaaattgtcctatatcggcagtgaa

SEQ ID NO: 34731 - DNA, 534 bp, Ferroplasma acidarmanus
aaaataaccatagaaaatatagttgcatcaacttcactggcggaacatttagacttaagccgcattgcattggccctggaaggttcagaatatgaaccggaacaattccctggattgatatacaggttaaaagacccgaaaacagcggtactgatttttagaagcgggaaagtaaactgcacaggcgcaaaaaatcttgaaaatgtcaagaagaccatagatatcattattgacaaactgaaaaaagctaaaatagaggtatatgacaatcccgatattatagttcaaaatattgttgcagtatatgaccttgaatcagaccttaaccttacagatatagcaatgtcccttggcctggaaaatgttgaatacgaaccggagcagttccccgggcttgtatacagggttgaggagccaaaggttgtactgctactctttggttccggtaaagttgtatgtaccggtgcaaaggaagagagcgaaatagaacaggcagtaataaaggttaagaaagaacttcagaaagtcggatta

SEQ ID NO: 34732 - DNA, 1434 bp, Ferroplasma acidarmanus
tttagagaaaaattccaaaatattacagagggctatacttttgacgatgtacttttaaaaccattgcattcatcaatagaacctaaaaacgcaaatgtatcaagcaaattttcgcggcatatcagcattggcataccgattgtgagctcgcccatggatacagtaacagaggagtcaatggcaattgcaatggcaagatatggggctattggtgtcattcaccgcaatatgtcagcgaatgaacaggttgagatggttaagaaggttaagaaagaggagagcattataatcagggacgttttttcaatagcttctgatactcctgtaaatgtagccagaactctcatgaaaacaaaaaatattgccggtttgcccgttgtagcttccggaaagctaatagggattttaaccaagagagaccttgaattttcagagtcggaaggcacagtaaaggatataatgacaaaggacgtaattactgctgatgagaacgtttcaatagaagatgcaaagtttatactttataaaaacagggttgaaaagctaccacttgtggactctaagggaaggctggtcgggctaataacagctaaagacataaagaccagggaaaaattccccaatgcatcaagggacgaacagggccagctcatggtgggtgcagctataggggcatacgatatagatagggctatcaatcttgaaaacgcaggatctgattttctggtaatagatacagcccacgcccataataaaaatgtcctctcatcccttaaaaagataagaaatgcaatccatatagacataatagcaggcaatattgcaacagcggaggctgcggaggatctaatctcacttggcgttgatggtttaagggttggcataggccccggttcaatatgcacaaccaggatagttgcaggtgtagggattccacagctaactgccatatcagatgttgcggacgttgccagcgaacatggaattcctgtaatagctgatggtggaataaggtattcaggagatatgataaaggcactggcggctggagcttccaccgttatgctcgggtcactgcttgcaggcacagaggagagcccgggtacagaaatgataataaatggcaggaaatacaaggcatacaggggaatggggtcaataggcgccataaaggccggaaaatcagatagatatgaaaaactcgggacaaatgagttcatagccgagggcgtggaaggttcagtaccatacaggggcaaagtttccgaaaacctgttccagttcgttggtggaataaagaccggcatgggataccttggtgcagaaaatctggaggagttaaagaaaaaagcagtatttataaaaatcaccaatagtggattaagggaaagccacccccatgacatacgcattgtttcagaacctccaaattac

SEQ ID NO: 34733 - DNA, 921 bp, Ferroplasma acidarmanus
gattatagcatagaaatagacaaattgacaaagatatttaacggaaaagttactgctgtcgataacgtcagcttgaaaataggatcagggcagatatacggcctgctcgggcaaaacggggcaggaaaatcaacattaattaaaatgcttacaggcagcctgactccaacatccggtacagctaaaattgccggattagatttaacaaaggactcaatgaaaataagaaagattaccggtgtggtgccacaggatcttacaacggatggagacctaagcgggagggagaaccttaaattgattgcagatttatacggcataccgaaaaaagaggcccttgaaagaatagatgttcttctccatatggttgatttatatgatgttcgggacaggcatgctgagaattattctggcggcatgagaaaaaggctcgaacttgcatgtggattaatgaatacaccagaggtattatttctggacgaacccacactggggctggatgttaccacaagggaaaacctctggaaatatatccggtcggtacagaaagaattccatataaccataatattgacatcccattatctggatgaggtggacgcacttgcaaatgaattatccataatagaccatggaaaaataataatttcgggtacatcagatgagttaaagaagagccttaagggtgatattataacattaaaagtaaaaaatgatgatgaatacagcaaactggaaaaattcccggaatcacttgaaataaaacgtatggaaacgggagatgtgaggatgaaggtaaacaattcagatgaagtgctgccaaagcttatgaagttcctgggggaaaatgaaatttctccagaagctataagcatacgcaaaccgtcacttgatgaggtatttatcgagtataccggaaga

SEQ ID NO: 34734 - DNA, 2202 bp, Ferroplasma acidarmanus
gatggtatattactcaggatagctgaggcaaatgcaaccgatcccggcatggccagggttaggcttgatgaaatttccagattagatcttgacgttgaaataggcgacgttgtcgctattgaaaaggtacggtctactgtggggagagtattcagatccaggccagaggacgaaaacaagggcattgttagaatagatagtgtaatgagaaataactgcggcgcttctatcggagacaaggtaaaggtaaaaaaggtagaagttgaggaagcaaagaaagtggtactcgcacccataataagaaaagaccagaaattaaggttcggggaaggcatagatgattttgtccagaaagcccttataaggaggcctttgatagaacaggatagcataagcgtccctggattaacattagcagggcacacaggtttgctatttaaggtaatcaaaacaattccaagcaagataccggtggaagtcagtgaagaaacacgtgttgaaatcagggaagatccagcttctgaagtccttgaagaagtgacaaaggtaagttatgaggatatagggggcctttctgaccagctaggcaaaataagggaaataattgagcttccactgaaacacccggagctttttgaaaggctgggcataacaccgcccaagggagtcctgcttaatggtccaccaggtaccgggaaaacccttatagcaaaggctgttgcaaacgaaagtggtgcaaatttctttgctatcaatggccctgaaattatgagcaagtattatgggcagagtgaacagaaactccgtgagatattccagaaggcagacgaatccgagccatctataatattcatagatgaaatagattccatagccccgaaaagggaagatgtgcagggcgaagtagaaaggagagtggtagcccagcttcttaccctgatggatggattgaaggacagaggtcatgttatagttatcggcgcaacaaacaggttagacgctgttgaccctgctcttagaaggccaggaaggtttgaccgtgaaattgttatcggagttcctgataaaaagggcagaatggaaatccttacaatacacaccaggggaatgccccttggcatggatgatgagaaggaaagtgaattcttcagcagaatagcagacattacatacggttttgttggggcagatctggcggctttaacaagggaatctgctatgaatgcactcaggaggtatttgcctgaaattgatctggataagccaatacccactgaggtactggagaaaatgattgttacagaggacgatttcatggaagcactcaaaacaattgaacccagcagcctcagggaagtaacagtcgaagttccaaatataaaatggaacgatattggtggactcgaagccctgaaatcagaactccgtgaagctgtggaactgccacttttaaatccagacgtatttagcaggctgggaatcagggcaccaaaaggattcttgctttatggcccaccaggtaccggaaaaaccctgcttgccaaggcagtggctaatgaaagcaacgccaattttatctccgtgaaaggcccggaagttctctccaagtgggttggtgatagtgaaaaggctgtccgtgaaatattcaagaaggcaaaacaggtatcacctgcaatcatatttatggatgaaatagattcaattgcacccagaagggggacatccatggattcaggggttacagaacgtattgttaaccagctgttgacttcgatggatggcattgaggtactgaaaggggtggtggttatagccgctacaaacaggcctgatataattgaccctgcattgctaagggcaggtagatttgataaaatcatatacataccgccgcctgaagaggaaggccgtttaaagatactggaagtccacacaaggaaaatgccccttgcgaaagatgttgatctcaaggatattgccagaaaaactgacggatacgttggggctgacctggaaaatctctgcagggaagccggaatgatggcataccgtaacaaccctgaagcaaccgaggtcaatcaggatgcatttataaaagccatgaaaactatacgcccatccatagacaagaacgttactaagttctatagcgaccttgcagcgactatgggaagggatataagcgagaagaagaaaacagag

SEQ ID NO: 34735 - DNA, 1065 bp, Ferroplasma acidarmanus
gcctatgcagcaccacttacttatcccatttaccaaaccagttcgtatatagttcctgagggccaaaaatacaggtacagcagggagtataatccaaccgttgaaaatcttggcattaagataaaggaaatggaaggagctgaagattacaatgttttctcttcgggcatgggagctattactacgacgttattatcattatcaaagcctggagatagaatattaacacacctggacacatttgcaaggtcctatcattttatcagggattttatgggaaagtggggaatcaagccggatattgccaatccgggtacggagaatattattaatggaataaaaaaaggtacaggaatagtgtttattgaaagcgtaaccaatcctatattaagggtgaacgatataagcaccatatctgagaaatgccatgatgttggagccatacttgttgttgattccacagttccgactccatataacgtaaaatctttaaaattaggggcagatatagttgtccacagttcatccaaatttattgcagggcataataacgtaatatcagggcttgcagcaggaagaaatgatttaatggagaaaattgatgccatgagaagaacgctcggaacatcccttgaccctaactccgcatttctgacagaaaatggaatgaaaacacttgaaataagaatggaaaagataaattctaatgctatggaaatagctgcagaacttcaaaaaaaccccgaaatatccagggtaatatatccagggctacctgaacatcctgatcatgaaatagccaaaaaatatatgaaaggttattccggcatagtctgctttaaggtgaaaaccgatcctgaaaaatttataggaaaactggagaaaatagttccggcaaacaccatgggagggacagaaacagtgatatcgacacctgcttcaatgtcacacaggtctttaacttcagaagaattgaatgttctgggtgtggattcaacatttatgaggctttccgtgggaatagaagacccggatgaaatagtaagggatattaacagggccctt

SEQ ID NO: 34736 - DNA, 594 bp, Ferroplasma acidarmanus
gtaagacttaccagaatagaacttataaatacgaaaaaacggataaaagtagcttctagaggactcgaactcctgaaaatgaaaagacaatccctggtaatggaattctttaaaattagcaatgaggtcagagggcttagagaaaacatcaaaaatgatatagaaaaagggttgaatgcaattaaagtggcagagataatagatggaactcttgaaatcgaaagaatttcatacatgttttcttcgccagaaattaaaataggcgggaaaaatataatgggtgttacaattcctgaaatgtcagcccaggcaggaaaaaagataattgacgattcatatcttgcaaattctgttcctgtgtcaatctatgatgcaattacactctttaataaaatattcaaagagcttctggaagtttcccagaaagaatcatcaatgcgcaaattgttaaatgaaatagacaagacaaacaggagatccaatgcaatagaaaatataatgattccaaggtttaacaacaactataaaatcatcagggagcatctggacgaattggaaagggattcatttgcaaccctgaaatttgtaaaaagc

SEQ ID NO: 34737 - DNA, 1344 bp, Ferroplasma acidarmanus
tacaggtcaatttcacagataaatggtccacttctatttgtggacgacgtgaaaaatgcatcgtataatgaaattgttagcataatactggataacggagagcgtgttaaaggccaggtacttgaaaccaggaacggcgttgcggttgtccaggtgttcggttcaactaccagcatgagcccaaagagtaccggggtatcgttcacaggaagcacattcaagcttccagtatctgatgatatgcttggcagaatattcaatggattcggtgaaccggtagacaatggcccgaagatttattcaaaggataaggtagatatcacaggtgctgcaatcaatccatattcacgtgaagagccaagtgaattcatagaaacgggaatatcaaccatagatggaatgaatacacttgttatgggacaaaagcttccaatattctctggagcaggattatcccataacaggctggcgacacagatagcgaagcaggcaaaaaccctgaaaggcggagaaaaatttggtgttgtatttggcgctattggaataacaagtgaggaagcaaactatttcatgaagcaatttgagtcgtcaggcgcactgtcagaatccgtaatattcctgaatctggcatcagatccatccatggacaggataatactgccccgtgttgcattaacaactgcagaatacctggcatatgagaaagatatgaacatgctggttatcctcacagatatgacaaattactgtgaagcactccgtgaaatatcatcttcaagggaggaaatccctggaaggcgtggatatcctggctatatgtataccgatttaagtacaatatatgaaagggcaggaaaaataaagggaaggaacggctcaatcacacagatacctattcttacaatgccaggggatgatataacaaacccggtgcctgaccttacaggatatataactgaagggcagataacactatcaagagaccttagcaggaaggatatatatccagaggtagatgtccttttatccttatcacggctcatgaaccagggtatagggtctgaccataccagggaagaccacagaggcctggccgatcagctatattcctcatatgcaaagggaaaagacgccagagcattaagtgagattgttggcgaagaagctttgagtgtatcagataaaaagtaccttcaatttgcagaggattttgaaagcaaatacgtaaaccagggagatactgaccgttccatagaagaaactttgaatcttggatgggacctgctttcaattttgcctaaagaagaaatgaaaaaggtaaaatccgcatatataccaaaatac

SEQ ID NO: 34738 - DNA, 1740 bp, Ferroplasma acidarmanus
gattaaatggaaaataaaggaagtatatatagtatatctggaccggtagtaatagcaacagaccttgatggcaaaatgtttgatgtggtacgggttggtgaaatgggcctcgtaggtgaagttataaaaatagttggagataaatttacaatccaggtttatgaagataccagcgggctcaaaccaggcgaacctgtatattcaacaggcaaacccctctctgtcgaacttggcccgggcctgcttaaatccatatatgatggaatacagaggcctcttgatataattcaatcagaaacaggtgattttatagtaaggggggcaacagcacctccactggatgaaaagaaagaatgggatttcgttccactgttaaaggaaggggatgaagttgagcagggatatatacttggcacagttcaggaaactaatataataacccataaaattatggttccgtatggcattcgtggcataataaaaagcataagcaaaggaaaattcaaagtatctgatactgtatgtatgatcgacactggaacttccaaatatgatataaaattgaagcagatatggcctgtcaggcaggcaagaaaggtatttcttaaatttgcacctgaaataccattaatcacaggccagagggtaatagattcattcttccctgttgctaagggcggcactgtagcagttccgggcccattcgggagcggaaagacagtaatacagcaccagctgtccaaatggtctgatgcagatataaccgtttatgttggctgcggggaaaggggaaatgagatgactgaaatactttcaacattccctgaactgcaagatcccaagagcggaaaaccactcatggaaaaaacaatacttattgcaaatacttccaatatgcctgtggcagcaagggaagccagtatttatacaggagttaccatagctgaatattacagggatatgggttatgacgtagctcttatggcagattcaacaagcaggtgggcagaggcactgagggaaatatctggaagattggaagaaatgccaggtgaagaaggatatcctgcctatctgggaaggagaatatctgaattttatgaaagatctggaaatgcccagataatagcacaggatgaaaggacaggctctataacccttataggagcagtatcgcctccaggtggagacctttcagacccggttgtgcagaataccttgagagttacaagggcattctgggctcttgacgcctcacttgcatccagaaggcattttccttcaattaactggcttaacagctattcgctttacctggactccctttccgggtggtttaaatcaaacgtgaaccctgaatggccacagatgcattcactcatgatgggtatactccagaaagaatcagagttacaggaaattgtgcagctggtgggatatgactcattgccagagaatcagaaaaacgttctggacattgcaaagattatcagggaagattttctccagcagaatgcctttgatgatacagatacatactgttcaataaagaaacagtatgaaatgcttacaattattaaaacacttaatgaaatgcaggaaaaatccatagcttctggattgaagttaacccagactgcaacacttcctgtgaggatgaaaatatcaagaatgaaagaaattccagaaaacgactttgagaaattctacaatgacgtgataaaggaaataaataatgaa

SEQ ID NO: 34739 - DNA, 901 bp, Ferroplasma acidarmanus
atagaaattttacacctttcaaaatcatttaaaaattttaaagcagtatcagatttaaaccttgaaataaacaacgggcaaataatggggcttgcaggcctgaatggtgccggaaaaacaacaacaataagggctgcatgcggtataatatttccaacttcaggaacgatcaccgttaataattttgatatagttaaagaaaaaataaaagcatccagaaacattggctgggttccggaactgccaaattttgaaccagatgccaggccagtaccccttctgaaatattatgcaggattttacggtataaaaccggacgaagcggagaaaaatgctattgaaatgatgaaacagtttgatatttacaattacaggaatagaaaattaaagtattactcccagggaatgaaaaagagatttgcactcatagctgcaatgataggaaatcctgacaattatcttttcgatgaaacattgaatgggcttgatccaaacggtgttaaagaggtaagggatttaattattaatctaaaaaagcagggaaaatctatactcctttcatcccacatattatgaactgcagaacgttgcagacaaaattgcaatagtaaagaatggttctgtagtcaaaacgctttcaagggatgatctgatgcatctagggacaacaggaacaaaaatacacataaaaaaccccgatgccggtatggaaaaaatattatcggaattcggggaatttacatcagatggcacctattattacatcaaaaataatggtgaagttgatgtttctgaacttaacaggcaacttgtaattaaaaattacagggtggattatatcagcatggagaatgaaacactggaagattactttttgaatatggtgaaataagatgaatgg

SEQ ID NO: 34740 - DNA, 1239 bp, Ferroplasma acidarmanus
atgagtaagacagcggtagagaaaatattttcagagaagagtggaacagattcaaaaagtggcgattatatagtggcaaatgtggattatgtaatggccaatgatattacggccccaatagccatagatgcttttaacgaacttggaatgaagccaaaaagcgacaaaataataattataccggaccattttgttccgccgaaagacatcaattctgcgaaacagtataaaaaatccaaggattttgcgcttgagaatggaacatggttttatgatataggccatggaggcgtctgccaccaggttatgatggagaagggttttgctgcaccgggaaggctaatagcaggtgcagattcccatacaaacacatatggtgcactgtcagcaatttctaccggcataggaagtacagaagcaggcgtaatatttgctactggcaaaatgtggttcaaaattcctgaaacaattaagataaaccttacaggaaaacctggaaaaggcgtagaagggaaggatattatactgcatgtattatcaaaaatcaaaaacggtggtgcagcatataaatgcatggaattttccggaaatataaagtatattgatatcaacgaaagaatgacaatggccaatatgacaacagaagcaggagctaaatgttcattttttgatacagatgaaaaaacaatagaatacctgaaccagagaaatacaggcagctataaaatagtaaaatcagatgaaaatgctgatttctctcaaacattcaatattgatatgaataatatagaaccctctattgcaattcccaattcgcctgacaatgttagaattgcttctgcaatacatgagaaaatagaccaggcatacatagggtcatgcacgaatgggagaatagaagatataagaaaagcagctgcaatactgaagggcaggaaagttaacagaaatgtcaggcttatggtagttcctgcaagccaggaagtatataaccaggcactgagggaaggactcataaatactatagtggaagccggtggctatttttcaggcacgacatgtggtgcctgcctcggtggatatatgggcgtactgggccctgatgaagtatgtatttcttcaacaaacaggaattttatagggcggatgggagataaaacttctaaagtatacctggcaaatccatcaatagttgcatcatcagccatacttggaagaattggaacaccggaggagata

SEQ ID NO: 34741 - DNA, 1053 bp, Ferroplasma acidarmanus
atagctgtcataccaggtgatggcattggaaaggaaataataccccaggtctgtgatctggtaacctctatagacccatcagttaattttacgttttataatatatcgtctgaaagatatattaataaaggcataacaataaaagatagcgaaatagatgaattaaaaagctacaattcaatttttttcggtgccataggtgatttcagggtaaagccaggaatcatggaacagggtgtcatactcaggctcagaaaggaactggatctttatatgaatatccgccctgccatctcatttagcaggataacagggaataatatacatatgacaattttaagggagaataaggaggatttttattctgatatttcaggatcattaaatgaacataaactgttcaggcaaaaaggaaacttttacaattataatattgatataaattctgaatcagatgatactatttattatacaatgggcttcctttcaagaaaaaatttaaaacgcttttttaatatggcatacaaaattgctgacactgaaactgtgacaattacagataaggctaatgctgtagacatgtattcattatggcgtgaaatagctatagaggaatcagaacctgccggtaaaaaaataaactttgaatatgcggattcacttgcttacaatatgataaataacccgttgaaatacaggtatataattgctccaaacctatatggggatatactttcagatatgtccagtgctatggtagggggcctcgggtatgcaccaagtggcaatataggcgactattcgtctatgttcgaaccggtacatggcagtgcgcctgacatagcagggaagaatatagcaaatcctgtagcatcaatactttcatgcataatgatgttaaagcatttgaaccagacagaaactgcaggcatcatggagaaatcagtagaaaatgtaataagaaatggtacaattccaatagaatctggaggcaatgccgggacacatgaatttataaataaggttaaaaattattgcacaatgacgaaaaat

SEQ ID NO: 34742 - DNA, 1158 bp, Ferroplasma acidarmanus
aaagtattattattatattcaggcggccttgacacatctgttatggcaaagtggattcagaaggaaatgaagaaagaggttgttacactcacattgaacataggcaacagcaatcttcaaaaaataaaggagaaggctctcgggctgggagtttctgatgcaatagtactggatgtaaagaacgagttttcagaaaaatatattgcaaaagagatttatgcagacggcatgtatgagggttaccccctatctactgctattgcgaggccgctgatggcagaaaaagcggtactgtatgctgaagaatatggctgcaacacaattgcacatggttcaacaggcaagggcaatgatcaggtaagatttgaggttacaatgaaagccctcaatgaagatataaatgtaatcgcacccgtaagggattggaatatgaacaggccggatgagattaaatatgcaaaggcaaacggcatagatatccccatgggtggaaaatattccgttgatgaaaacatatgggggaggtcggttgaaggatcgagtatagaaactgtatcaaatccgcttgaatacgatgtttatgaatgggttaagccacttgaggaaacaggaaatggcgatataatagatattgaatttaaaaatggggttcccgtttcactgaatggaaaacagtacgcccttaaagaacttgtggagaaactgaacgttatagcagggaacaatggaatagggcttataaatcacatggaagacagggtaaccggaattaaaagccatgaagtctatgaggtcccgggagctatggctatcatacaggcacataaaatgatggaatcacttaccctgaataaatctgaactggatattaaaaattatatggataatcaatggtcaaattttgtttacaatggattatggtatgacccggtgatggaacacataaaccagtttgaatccagcataaataaatacgtcaatggaaatataaaattgaagctttacaaggggaatatagtaatgcaatctatagaaagtgaaaattcaatatacaactatgataagataagctatgacaacagcaatttcaatcaggactcagctaaaggattcatagatatttacaaaaacaatacagtatatgctagcaatgccagg

SEQ ID NO: 34743 - DNA, 625 bp, Ferroplasma acidarmanus
ttaggacagaaagctccgggtttccttgttaatacaacaaaggggccattgagcctggaagattataagggaaattgggtgatattgttttcgcaccccgcagattttacgccggtgtgcacaacagaattcatggcctttgctagaagatacgatgaatttaaaaaaattaatacagagttaattggtttgagtgttgacagtatctatagccatatagagtggatgaaaaatataaaagagaaatttggcatagaaataccgtttcctgtaatcgccgatatcaataaagatgtggcaagggaatacaacatgatggacgaaaaaacaggttcgactgtaaggggcgtatttattatagacccgaatatgattgtaaggttaatgatatattatcctgctgaaacaggaagaaacatagatgaaattatgcgaacattaaaagcattgcagatgaactgggacagaaagctggccgcgcccgtcaactggcaacccggtaacgatggcattgtttcagctccaggaactcttgatgaagcaattaatagggaaaagaatggcagcaaaacatggtatttaacctatgaggcggtgagataaatggacgcagggaaaaaaatgg

SEQ ID NO: 34744 - DNA, 873 bp, Ferroplasma acidarmanus
gttgtcggcagtatcaatatggatattattatgtcttcggctagattgccagaaaccggtgaaacaataaaggcagataaatattatatgtatcctggcggaaagggtgcaaatcaggctgtgtctgttgcccgcaccggcgtaaagccacagttaatcggcaagattggaaatgattattttgctgaaatgattacaaattaccttagaaaggaaaatctggatttgtgtttaacctatggtgataaaaccggcattgcaatgattaatgttgaatcatcaggcaaaaatatgatcactgtgtatcccgggtcaaatgggaatatgtcctatgatgatttccataatattgaactgaaaaattctattgtaatgttccagcaggaaatacctttaaagacaataagggattttatatccagtaatagggaaaatggaaatctgttcattacagacccaagcccattttctgaagataactatatactggagaatagtggcattttgactccaaatgaaaccgaagcccagttaatagctggatgcgctataaacagcatagaagatgcggaaaaagcttccacattaatatccgggaaatacaaaaacaatgttatcataaaacttggttccagaggttcaatatcaaattttgagggagagataaaatatcataagccgtataatgtaaaaactgttgatacaacaggtgcaggtgattgttttaatggtgcgtttgcgtcggaattcctcaggaccggagatgtagataaaagcatggaatttgccaatatagcagctgcgctgtcaactacaggttatggcgcattcccgtctttcccatacagaaaccagattatttccataatggaa

SEQ ID NO: 34745 - DNA, 963 bp, Ferroplasma acidarmanus
ttagaagattatgagccaccggaaccgggggataatgaggtaacaatagaacagaaatataccggtgtatgtttcagggacatacttacacagcagggtttctttcctagagtctcacttccagtaatacctggccatgaaatagggggcaccataataaaaaaaggcaagaatgttaaagactttaatattggagatcgggtttccagccttatatacgtgccatgcggaaaatgtgaattctgtttatcaggaaatgaaaatctatgccctaataaagttgcatatggcgaaggcagaaatggcggttattccagatatgtaaacgcagatgagaggtctctggttaaagttcccccggaagttccagaggaaacagtccctattgcagcctgtgtcatagcaatgctttatcatgcgatagggagggtaggaaaaataaaaaagggtgattatgttttaatcaccggtgcaggcggtggcgttggtgtacatgcagtgcagatggtaaaggcacttggaggccatcccatagccgaaaccggatccaaatggaaagaagaggaattgtataaactcggtgcggaatatgttgtatctccggaaagggaatataataaggatgttaaggaaattacaggccagggtgcagatattgtacttgaagatgtgggaattgcaacattttcgaaaagcctgagaagccttaagacagggggcagactggtagttatagggaatttgaagccagagcctgttgaactacctctcgggcttattatcctcaagggcaatagcataaaagggagcataagctccacaagagatgatttaaaaaaagccctggaactttcaaaatcgcagatatcccctgtaataggcaataaaatagaacttcaggatataaatgatggttatgcaaacatgcttgataggaaagtactgggcaggttgctgataaaa

SEQ ID NO: 34746 - DNA, 756 bp, Ferroplasma acidarmanus
aaaagatttccggacaatgaaatgtatttgaagattattgacgatgttaaaggagaggatgtacttcttgtgggaaacacaaggagtgatcaggatataattgaatacctcctgcttctggatgctataaaggaggaagagccgaaaagtataactgcagtggtgccgtttttcgggtacgcaaggcagcatatgagatataataacggcgaaccggtgtcttcaaaggtttttacacaggcaataaatcagtatgctgacaggattataactgttgaacttcacgatgagcagacactgaattattctaaagttccatttaccgatattaaaattataaatccaatatataaatattttatggataaaaacatagattttgttatatcccctgacgatggcggatatgaacgcgttaaactgatgggttcaaaactgggcattcctgcctattatattgacaaaaaaagaattgattcaaccacggtaaaaatgacccttccggaggaagactataaagataagaatattcttattctcgatgatataatttcaaccgggggcacaataatcaaagcctccgggatgttaaaagacaaaggtgccagaaacatatatgcctgcgcaatacatggcgtatttgcaaacaacagcaatgagaaaatagagagatatgtaaatgagctcactgtaacagataccatagaaacaaaatatagcaatataacaatttcaggggaaatcgcagaatccctg

SEQ ID NO: 34747 - DNA, 1458 bp, Ferroplasma acidarmanus
tttccggaaaagaaagttatatctggcagcagaagtattacatacagagacctgtttgaaaaggttttgagcctgtcaacgtccatgaataaaatgggcatatcgaaaggaacggtgattgcagttgctgattataattcaatagagtttatggaattattgtttgcttccagccttacaggttcaatcatatatcctgtaaatataaaacttccatggaatatggcaatggaaacagtaaaagaatcaggggcagaatatgtatttgcatcaaaagagtttatgaatgcaggcatatacaaaggattccgcgacgaccatatagtatcgctgtctgaaaatggagattatattaaattccatgatatgcttacaagtgatttgcacagggaggagaaaacaaccggaaacgataattattccatattatttacttctggaacaacgggaaaacccaaggaagtgctgtatacaaacgaaaaatctgtaaacggtgcattaagtattctctaccagcttggattgtttaatacacccgccaaattaacttccagtgatactatattgtctcttatcccattttaccacatatggtcatgggggtctgctttccatgctgcgtatctgggtgcagattatataatcaccggaaaatataatccggagaatgtgctgaatgcaataaaagagaataaggcaacgtggataaatgctgtacccacaatggtttatgacctcttatcccatgatagggaaaacaggctgaatggaataaaaatgttaataggcggttcccctataagcaaaaacctggcggaaaagttaaatgcaaaggggattaaattttcaacaatatatggcggaacagatatgcttgccacatctatttcccttgggaggccggatcaacacgaatctttacggtctgtaacataccctgttcctatggtaagtgctacagtcagggataataacgggaatatactggaaaacggaacaataggagaattatggattaatgccccatggcttccggaaaaatacctcaataggccagaaaaccatgactatgaaaacgggtggttcaagacgggtgatgtgggtgaaatgacacctgatggtggaataaaaatcctggatcgtgtaaaggatgtggttaaaagtggtggcgaatggatcccaacgtcgattatagaatccctgatatctgagtttccaggaatagaaatagcggctgttaccggtatagctgatgagaaatggggagaaaggccagttgcatgggtcaaagcttcggaagatattgaaattaaagaaatcaggcaatttatggaaacccacgcatcaaacgggaatattaacaaatggtggattccagttgagtttattatcatagaagaaatgcctatgaccagtgttggaaaaatagacaaagcaaagctcagggaaatgaaaaaa

SEQ ID NO: 34748 - DNA, 1179 bp, Ferroplasma acidarmanus
atgaaagatgtttatatagcatattataaaagaactccgttctccagagcaaagcccgataatccatcaaaagatgtatacaacggggtatccatggatgtcctgctttcaaagcttataaaagattccctgagcacaggaataaatcctgaagacataggcgatgtaattacaggatgcgctattcaggcaggtgaaaactggacatatggaggcaggcaccagacacttctttctgaattgccggttagtgtaccatcaatggcaattgacagggcctgctcatcttcgctaaatgccactgcaataggtgcaatggaaattcagacagggaactctgacgtagtccttgccggaggaatggaacacatgacacatgtgccattatataatgatccgtatgtaaaatataatacggaattaatggaaaagccggaatacagaaaatatgatatggatgttacataccatgttggattaacagcagagaaacttgctgccattaataatatttccagggaagaaatggataaattttcatttgaatcccagaaactcactgcacatgcaatagaagaagggttctataataatgaaattcttccggttaaagtaacgcatgatggaagtgctaaaacaatcaatgccgaccagaccccaaggccagagagtaccctggaacagatgagccagttaaaaccagcatttatagaaaacggaagagtgacggccgggaattcgccgccgctgagttccggcgcttcacttctcatgcttatgtctggcgaaaaaattaaagaatatggattaaagccacttgcaagagtaatagactatgctgctgccggagtagacccgaccataatggggcatgggccagtacctgcaactaacaaactgctaaagaaaaataaactttcaccggataacatagattactgggaaattaacgaggcatttgcagttgttgcattgaatgctatcaagcaccttaatttagacagaaaccgggtaaatatacatggagggtctatagctatcgggcatccactaggtgcaaccggtgcaagaatagccggaacacttgcaaggacacttcaggaaaagaaaggcaatcttggagttgcaacgttatgtgtaggtggcggacagggatactcactcttaatagaaaaagtt

SEQ ID NO: 34749 - DNA, 1194 bp, Ferroplasma acidarmanus
atgataaaataaataaagccatggcatatatggaaaaatatgaaagatgtgtatattgtttcagcaaaacgtacacctatagggaaatttggaaaatccctggcaaaaataaaggccactgaactcggtgcggctgctattaaaggtgtaattcaggattcaggcatagacaaagaccttattgaggaggttataatgggaaacgttatacaggctaatgtcgggcaaaatccggcaggccaggcagcgttttctgccgggctcaaaccggaagtaacaaaaaatacagtaaacgttgtatgcgcctccgggatgctcgcaacagagaatgctgcaagggaaattatgctggaagagcatgatattattgtttcaggagggtttgaaaatatgagcaactccccattaataatgccttctgaattcagatgggggcccaaacagcttttatataagaatctcaaaatagaagattcaatgcttgttgatggtcttgttgatgccatgtacggcgaacatatgggtgtatccgcagagcgttcggcaaaaaaatacggaataacaagagaccagacagatggattttcagtagaaagccagaacagggctatcagggccacagaatccggggagtttgccagggaaattgttaaactggacaaccttcagaaagacgagggcatgaggaaaacatcaatggaagaccttgcgaaactaaaccctgcctttgacaggaatgggatactcactgcaggaagttcttcacagttgtctgatggagcttcggctcttattcttgcctcggaaaaggctttgaatgaatacggattaaaaccaatagcaaaaatcacaggattcagctcagcttcacttgatacaagggattttgtagaagctccaatacctgcaaccagaaagttgcttgaaaaacagcacaaaaacatcgattattacgatcttgtggaacataatgaggctttttcagtagcatccattattgtaagggaccagctgggagttgcccaggagaggtttaatgttaacggcggcgccattgctataggtcatccactcggaaacagcggttcgagaataattgtgacattgatcaatgcattacagagcaggcatatgaaaacagggcttgcaacaatttgccatggcggtggaggaggacatactcttacactcgaa

SEQ ID NO: 34750 - DNA, 906 bp, Ferroplasma acidarmanus
ataaagaacaaagaaattttagttaccgggggagctggatttataggatcaaacctggtaaatacattatcaaaggacaaccatgtatatgcactggatgatcttcaaacagggtcaatgcataatcttaaagattctatggacagaatagaatttattaaagaccgggtaaagaatataaatgattatgagataaatcctgattatattttccatataggcatatactcctcttccccaatgtataaaaataatccacatctaatagcaaatgccatagatgatcttattactgtacttgaatatgcaaaaaagaataaatctaaaatagtttatgcttcaacttcttccatatataatggaatagaggaacagaaagaagatgtaataccgaaggtatcagattattatacagaagccagaatagctatggaaagaatagccaacctttactgcaatctatatggcatggatgtctcagggatgagatttttctcggtgtatgggtataatgaaagatccaaaaaaatctatgcgaacctggtttcccagttcctatgggcaatgcatgacaacattgcacctgtattatacggtgatggggaacagaaaagagattttgtctttgttgaagaccttgtcaaagcactcatgcttgctgccgaaaataataaaaaattcaatgtgtacaatgtgggaacgggtaaaaattatacacttaatgaactggtaaaaatacttaacaaacatctgggaaaagacataaagcccgaatatatcgaaaatcccatgaaagacacatatgtttactatacccttgctgatattaaaaaaacagagcagaaaataggcttcaaagccagcatttccctcgatgagggaatagataaactcataaaatattat

SEQ ID NO: 34751 - DNA, 2292 bp, Ferroplasma acidarmanus
attctgtggtttagtgagatatcaaaagaagatttacctcttgtaggcgggaaatctgctaatctgggagaaatggttaaaatgaaaacggtgcctgtacccaacgggttttccaccaccagttatgcttataaagaatttattatagaaaatgacctggacgataaaattattaatataataaaacacaccgatatagaaaattccagaaaactcaaagaagcaagtgaagaaataaggcagctattcctcaatgcccatttcaacgctagcctcgggaaagaaatcagggaatattaccgcaaacttattgaaaaagaaaaaaacgtatacgttgcagttagatcatctgctacatcagaggacctaccagatgcaagctttgcaggggaacaggatacctatctgaatatacacggcgaagatgatgtggtacagaatataaaggcctgttatgcaagccttttcagcccgcgggctatatattacagggaaaagaaaaatttcgggcatttcaatatatatcttgctgtggcagtacagaaacaattattttctgaggtatccggggttatgtttacagttgatgtgtctacaggagacaattccaaaataattattgaatccagttatggcctgggtgaatatatagtgggcggtgttgttacgcccgacacatattatgttgacaagtcaacaatgaaaattacaaacaagataataacaaacaaaaataaaatgttaaaatgcctggagacaggcggaaccgaggaactggtggttgagaaagaaatggcgaataaacaatcgctttcagatgaagaagtcatccacctggcaaattatgggctccagctggagaagcattatggaaacagcatggatgttgaatgggcgaaggattcttttgatcataaaatatatattctacaggctagatttgaaactgtatggaatggaaacagagttggtgaagataaaatgcaacaggaaaaagaagcaaatgagaatgaggttattttaaaaggtttgcctgcatcgccgggaaaggtggctggagtggccaaagttttgctctcagttgaggaaatggataaatttaaggaaggagacatactggtaacaaaaatgactgcccctgactgggtccctataatgggcaaagcaaaagctatagtaaccgatgagggcggactcacatgccatgcggcaataatttccagggaacttggagtgccatgcattgtcggtacatcatcctatggaaaaaaggcaacagaagtactgaaagatggggaaaccattacaattgatgctaaaaacggcctcatataccttggaggcatcaccactggaacggaagaaaaaactccggaacagaatgtttcctacgaaagtgacattataacaggtaccaaagttcttgttaatatgggtgaaccacaactttcggaaaaagtttccaagcttccatcagatgggataggccttatgagggaagaattcatatgggcagaaataggtgaacatccgctctcattgataaaaaatggcaggggcgaatactttgtagaccggttatcatctgaactggcaaaggtttgcagggattttgcaccgaggcctgtagtattgagattttctgactttaaatctgatgaatacaaaagcctgaaaggaggaaaagaatttgaacctgaggaggacaatccactcctgggatggaggggggcttcaaggtattatgatgatcgctacaaggaggctttcaaacttgaactgcagggcataaagaaagcaagggacgattacctcctgaaaaacctatgggttatgatacctttcaccagaacagttgaggagttaaaaagggtagtcaagataatggaagataatggacttgaaaggacaaaggatttcaaactgttccttatggcagaaataccgagcaatattttattagcagacaaattcaaccagtatgttgatggatattcaataggttccaatgaccttaccatgcttcttctgggttcagacaggaataatggaaagatgagctccatgttcgatgaacgtgaccttgccattaaaagggcaatcaggtatctgataaaaatagcccacagggatggcaaaatagtatcaatatgcgggcaggcaccatcacagtatgatgaaatagtggactttcttgtcaggtccggaatagatgatatatcagttaatcctgatgctgttacacatgtcaggaagatggttgcatctgtagaaaagaggattcaactggaa

SEQ ID NO: 34752 - DNA, 996 bp, Ferroplasma acidarmanus
gcactgacaacatctccacccggtggtggcatatcttatagcagaattactatggcagatcatatggatgggaaagcaaagataagacctgtatacaccggaatatgtgggacagatcgtgctgaaattgctggccacctgccatttgcatataatcccaccgggcaaaattacatggtcattggccatgaggcggtttgccaggttatagatataggagaaaacaattccagaatcaggcctggtgactacgttatccccattgtaaggcgtaggggtacatgtataaattgcagaatcgggaggcaggataattgttcggatgcagataatgatataaccgaggcaggtataaggggcgctgatggtttcaactccgaatattttttcgattctccggaaaatttaataaaagttaatgatagttcaatggtgatgttaagcaccctgacagagccagcgaaaaacgtcatgaaagcctttgaaatatttaataaattatcggcacggtcaatattcgaatcggaagattccacatacacatctaaaaactgcctgataattggaactggaagtgaagcttttctatatgcctttatggcgagagaatatggcatgaccgtttatctaacaaacaggcacaggcttttagaagagaaaatgagaattatagaaggaattcactgtttgttttacaattaccttgaggaaaatggaccggataaaatagatcttcttattgataccagtggtgaccctgcagcagttatgaaatttgtagggaaattaaattataacggtatcgctattcttttcggaactaacggcgctgctcccgactcacaattgacggggaacgatctgaactatatcattgaacataatattgcagtttccgggtctgttgatggctccaaaaaacattacatggacgctatcggttatctggaaaagtggaaatactccagcagtgggattataaataagcttataacc

SEQ ID NO: 34753 - DNA, 834 bp, Ferroplasma acidarmanus
atgttacttgatggaaaagtagttgcatctgagaaaatggaaagattgaagagtgagattaaaggcatcattgaaaaatatggaattgagccggaattaaaattaatccaggttggcaatgaccctgcaagcaccatatatgcaaattcaaaaataaagaggggtacaaagcttggaataaatgttaccctggaaaaattcgataatattaccatgggcaagctggttgattatataaaagatgccaatgcaaattcgcgtataaatggtattatggtggagtctccacttcctccctcacttaattttcaggaagtagtggacaatataagtttttacaaagatacggatggaatgacatcttttaatcagggaaacctgtatacaaagaatgagatgatagcaccggccactgcgagggcagttgtagatatactggaatattataagatacaacctggaaatgcctgcattataaaccggtcagctgtagtagggcgccctctggcaatgttgttgcttaacagggactatactgtaacgttatgccatagcaaaaccgttgatattaaaagaatagcaagggaaaacaacgttcttgtagttgcaatcggaaaaccagattatatcgatgaaagttatgtaacatctgaatctacagtaatagatgtgggaataaattattctggaaataaaatatccggtgacgtaaattttgattctgtgagcaataaagcaaaaaatataacgcctgtacccggaggggttggaatagtaactgcaacagacatattcgagaattttctcaatgggctgaaataccaaatcaaagag

SEQ ID NO: 34754 - DNA, 1227 bp, Ferroplasma acidarmanus
atggattcattaatacatggctttcataagatgaccgtagatgaaagaagacagatcatcagggagttttcaggcctctcttcagaagatatggaggcaatggattacaggatggatattagcaccgccggaaatatgatagaaaatgtgtatactattatggattatccagtgggaattgccacaaacttcaaaattaatgataaagaatatttaatacctatgagcctcgaagaaccatctgttatagctgcgtgttccaatgccgccagatatgcacggccaggaggctttaccgcatattctactaattcttatatgcggggcgaaattgaattatataatgtaccggacccggattatgcagccataaatattcttaaaaataaggaaaatatattgaaaatggcaaatacaagatcaaaaacactctcaggcatgaatgctggtgcaaaatcaatagacctgcattttgttaataatgaacttataattaatattataatagatgtggctgatgctatgggcgctaatataataaataccatgctcgaatatgtgtcaggctatatagaagaactcacaggaggacaggcaaatctcaggatcatgagcaaccttacaacagaaagaattacatatgcatatgcaaaatttgacgggaaaatgcttggagaggaaacagtggataggataatacgggcaaatgaatttgcaaaaaatgatatataccgtgccactacccataataagggtataatgaacggcatcgatgctgtgcttctggcaaccatgaatgatttcagggcacaggaagcaaactcacatgcctatgcatccatgggtggatatggcccactgacagagtatagaaaagacattgacgggaatttgattggatcaataaaaatccctatagctgttggcacagtaggcggggcaacaaaaacatccagaaaagcaatgcttgcaatgaagataatgggaatacatggatccggtgaattttcaaatatcctgggttcagtcgggctggcacaaaattttgcagcactgcgggcactggcagcagagggaatccagagcgggcatatgaaattgcatgcaagaaatatagctattgcagcaggtgctacaggagaaatggttgaaaaagttgccggcgagatgatatccaccgggagcattagctacacagcagcagtcgatataattaaaaaatttagg

SEQ ID NO: 34755 - DNA, 894 bp, Ferroplasma acidarmanus
agaagcattatttcaatctctgaccttgacggtgaagacataaatgaagtattttcccgggcagataagatgcttgaaaatatagaatcaggaaagaaaattaatgttatgtcctctaaaatacttgcaactcttttttatgaacccagtacacggacacggctatcctttgaatcagcaatggaacggcttggaggttcagtaatcagcatggctgattcaaaaacgtcctcgacttcaaagggagaaacacttgcggatactataagaatagtggaatcctattccgatcttattgtaatcaggcaccctcttgaaggagctgcatttcttgcatccagattctcatcaaagcccataatcaacgcaggagatggttctggtgagcatcccacacagacccttattgatctttatacaataaggaaagaattcggttccatagacggcaaaaccataactattattggtgaccttaaatatggcaggacagttcattcactgctctctgccctctcgaggtataatgtcactgttaaccttgtctctccggaaaatcttgcaataccgaaacatgtatacaatgacgtaaagggcaggctaaatatgaatatttcaactgacattactaaatatctcggggaaaccgacatactttatgttacaaggatacagaaagagcggtttacggataagaatgaatacgcacggcttatcggttcatataaaataactgtaagtgatgtgaataagttaaagaagggagctattataatgcaccctcttccaagggtagacgaaatctcctcagaggtagataatactcctgctgcaagatatttcaagcaggcatattatggggtacctgttaggatggctataatttctatgata

SEQ ID NO: 34756 - DNA, 441 bp, Ferroplasma acidarmanus
ttaaaaatatcaaaaataaaggatgggacagtaatagaccatatagccgccgggaaagccctgaaagtccttgccattcttggcattgacgagtcaaattctataagtattggcatcagggtcaccagtgagaagcttgcctataaagatgtcataaaaatagaaaataaattccttgaaaaacttgaactggacaaaatagcactcatagcaaatgaagccactattagcataattaagaattatgaaatcatagagaagttcaagcttgatatgccacaggtgtttaaaggcatagttaaatgtgcaaaccagaactgtataacaaatgctggtgaaccagtaaaatccgagtttatgactgtgaatgctgacccattaacaattaaatgtgtttactgcaagaaagagatgtctggagaagagataattaataatata

SEQ ID NO: 34757 - DNA, 648 bp, Ferroplasma acidarmanus
atggaaatatatcttgacagtttaacaaaaaattatagaaagataaaggcacttgattcaataaaccttaaaatagaagggcatgggtgtaccggactgcttggccccaatggagcaggaaaaactacaatgttaaaactgtgcacgaacataataaaaccgtcacatggcaaggttgaattaaataatgtaaatgttgcaatttatccagaaaaggcacttgaacctgttggtgcacttatcgaacagccagagttttacagttaccttacaggatatgagattctggaatttacatcaaagataaaaggtatcgggaaggacgaattcaaatcagagatgaaacgcctcggggaacttaccgggatagatgcatatgccgatagaaaaaccggcacctattcacgcgggatgaaacagaggcttgcattatcagtggcaatgcttggaaacccggaaataataatacttgatgaacctactttcggtcttgatccaaagggcatggttgatgtgaggaatattataaaagatatagctaaggagcatctagttcttctgagcacccacctgatttctgaagcgcgtgagttatgtgacaggactataattattaacggcgggaaaatagaatatgattcagctatg

SEQ ID NO: 34758 - DNA, 1626 bp, Ferroplasma acidarmanus
ataaaatcttatccgcccggcattaaaagacatattcaaattcctgaaattggaatttaccagcaattttgcaggtcggccagtaaatatgcttcccatgtggctatagactttatgggaaataggataagttattccaggttaaagcaggaaatagagtctgcagcatcatttttaaaagggctgaatctccataagggtgataagctcacaattatgctgccaaatattccccagtatgttatttttttctttgcctcaatgaaacttggaatatctgtagtccagatgaatcctatgtacatgttgccggaaattgaatatgaactcaatgattcagggtcaagaaatattgtagttatgcatgatatgctctcaaaggttttgccgttgaaggaaaaaatgcttgacaatattatagatgtaagggttgaagattacctgccaccggtaaaagcccttctttataaagctgtaaaaaaagggaaaagtgaaaagcttgcagctccagcaggaattataccttattcagggaaatccaggaatcctgctgcagatgacgaatcaattgatccctataatgacgctgccctattacagtatactggaggaactacaggtgtcccaaaggcagctacactgacacacaggaatttgctggcaaacgtaaatcagctgatagaatggtttcctgaggatttcaaggagagcatatcttatttatcgtccataccttttttccatgtttacggaatgatgactgcaatgttaaccccgcttatgcaggggtctactattattcctgtacccgacccgagggatctgaaaatgacattgaacataatcaagaagaaaaagcccacggcgtttcccggcataccaacaatgtatcatagcataattaactatccagatctggaaaaatatgatatcagcaatattaaactttgcatttccggggctatgccactcccgctggaactgcagaaaaaattcgagggcaaaaccggtggaacgctggtagaaggatatggattaagcgaatgttccccggtaaccaatatttctcctttattgccggagtggaaaaatcgcaggaagccagggtccatagggcttccattgcctgaaacatatgaaaaaatagtagatattgatgacggcataacagaagtaccacagggcgtggaaggagaacttctcattaaagggccgcaggtaatgaaaggctactggaacaggcctgaggaaaataaacagatcctggtggacgggtggctccatacaggcgatatagctaaaatggatagcgagggttatttctatatagtggacaggaagaaagatatgataattgcaggtgggtataatatatacccggaggaagtggagaaagttctctacgaacatcctggcgtgtcccagtgtgctgttgtaggggtacctgacgcgcatcgcggggaaactgttaaggcaataatagtactttccgacaaatccgttacggaggacgaaattaaaaaatactgccaggaaaaactcgcaaaatataaagttccaaaaattatccagttcactgatagcttaccactgacacctgtgggaaagattgataaaaaagccctc

SEQ ID NO: 34759 - DNA, 1113 bp, Ferroplasma acidarmanus
gtaagtttgggattggaagatgtattcataaaatatacagggttaacatttatagatggaaacgcaggcgtgctaagatacaggggatatgacataaacgatcttgtccagaatactggattcgaggaagtgtgctatctcatgaccaatggggagctaccgaatagccagcagctggcagaatttaaaaaatctgttaaggaacattataagctgcctgaccatgttatggaattaatatctgacctgccaagggaagcggatacacttacaatgatggaaaccgcatttgcctctctctcctcaggtgattaccagtggaataaggaaaatgacagaaaacaggttccaaaaatcctcggggaaaatttgggaataatatcaaatatatacaggcacaagatgggaatgggactccagaatcctgacccgaaatacgactacgccgaagcatttctaaggaactgctttggaaatgctgatgagaaaaagatttctgcaatgaatgctgctcttgttatatacgttgaccatgaggtccctgcttctacaacagcagcccttgttgcttcttctactctttccgatatgtattcatgcataacagcagctactgctgcacttaaaggcccgctgcatggtggagcagctgaagcggcatataagcagttgcttgacataggaaatgttgacaatgtggagaactggttcaaaacaaacatattagatggcaagagaagactaatgggattcgggcacagggtttacaggacatatgacccgagaatgaaaatattcaagaaactggcaactacactggaacagacagatgagcagaaaaaactctttgaaattgcagttaaactcgaggaacttggtgtaaaggaattcggtggcaaaggaatatatccaaatacagattattattccggcatagttttcaatgaaatcggcttccccatatacatgtttacaaccctgtttggattttccagggttctcggatggctttcacatataacagagtatgtagaggaagaggagaggttaatcaggcccagggcagtctatacagggccagacaaacgtgattttgtgaaaattcaggataga

SEQ ID NO: 34760 - DNA, 4169 bp, Ferroplasma acidarmanus
attaggttttttaagatttacatgaaaagatatttattactggaggacggcacaacttatgaaggcactggttatggctatgagggcgagacaaacggtgaaatagtttttacaacttcaatgtccggttatctggaaactattacggatccatcgtatgctggtgaaatactaattttcgccttcccggaaattgcaaattaccccttaaatctggaacatatggaatccagtaaggtgcaggtcgccgggattattacaaaggacgcacattcaatttattctggcggagaatcaggaacaggattcaatgagtttttaaagcaaaacatggtgcctgcaatagacgggatagataccaggtcactggtagaaaaaataagggaatctggcgcaattaagggttatataaaaaacaaaaatgaatttccggataaatttgaggataccatggatctggaccttgtttccatggtgtcaattaaaaaatataagtattacaattcagggcataaaaaacagatacttttcatagatgttggaacaaaaaatagccttattaagaggctaagtgaaacagcttccctgcacatagttccatataactatgatttctttaacattaaattccactatgatgcaatttttctgcccaatggtccgggaaaccctggccatagttctttagagccattaagggcgtttataagggagaaaagtagcagcatgcctgtaatgggtgtgtgccttgggaatcaacttatagcactttctatgggcggcaaaacagagaaaatgaaatacgggcacaggggaataaaccatgctgtgctcatagggaacagggtttacattacatcacataaccatggatacgccgttaacggagattccctgaagggtacgggcatggaaatctgtggcaccgatatcaatgatggtacggttgaaatgataaagcacagggaactcccggtattttctgtccagtttcatcccgaagcatatccagggccctacgatagtacatggtttttcaatgatattaaaacaactctaggtgaaaaaatatgaattcagacataaaatgcacactggttataggttcaggcccaatagtaataggccaggctgcagaatttgattattcagggtctcaggcctgcctggcattgaaggaagagggaataaagacagtactcctcaattcaaatcctgcaactatacagacagacagagaaatagctgacagggtatacatagagccggtagacccggaaagtgtattggcaattatcaaaaaagaaaaaatagattctatacttccttcaaccggtgggcaggtcgggttaaaccttgttatcctgcttgagaggcttggaatactttcctcatacaatatcaaggtgcttggaacacctgtaacatcaatagaaattgcagaagatcggaaaaaattctttaacctgatgaaaaaaattggggagcctgtaatagaatcatatacactcacaaaaaatgattacagggatttaatgcctggcattaaaaaatatccattaatattgcgcacgggattctcactgggcggatcaggcggcgtcataattaagaatgtgaaggagttgagcgattactgtgatgattatttttcagttcatgatgatatggtagagcttgatgagtcgttacttggccttaaggaaatagagtacgaaatgatgcgtgacaataatggaaactgcatttcaatatgcaacatggagaatcttgaccccatgggagtacataccggtgaaagcatagtaacaacgccatcactcacattgagcaatgatagttaccagaaattaaggacatctgctatccatgttgtcaatgaaattggtgttattggatcctgcaacatacagtttgcccttgaccaggagaaagatgagtattacattgttgaggtaaacccgagaacatcaagatcctctgcactcgcatccaaagcatcgggatatccaatagccagggtatcaactaaaattgcagtaggatataacttaaatgagataaaaaatcctgtaaccaaaaacacatatgctgcatttgaaccatcaatggattacataactgttaaaattccaaggtggccattcgacaaattctcagtaaagagagagataggaattgaaatgaaatccattggggaagcaatgggcattggcagaatattcgaagaggctttgatgaaagccatatcttcgctggacattaaacaatctatacccatgaggttatttacatctccggaaaagacaatagaactgatgaaagtgccaaatgacctgaggttatttgccatatttgatggattattccagggcataggtgtggataaaatttcagaattgtcagggtatgataaatttttcatagtgaaaataaaaaatattgtagatgccatggaaacaataaaaaggggtgtaatccctgaaaatatggagaatctaaaaatgcttggaatttcagatgaaactatttcatattataccggcattccacaaactgaaataataaaatatagaattgaaaaaaagattgttcctgtatacaaaaatatagatacatgctccggtgagtttaatgctgataccacctacctctattcagcctatgatacacataatgacaacagaataagcaataaaaagaaagttatagtcataggttctggccctaacaggatatctcagggagttgaatttgactatggtgccgttaaatctatactgtcattgcgttcaatgggatacgaagctataatggttaacagcaatcctgaaactgtatcaacggattttgatatatctgataaactttattttgaacctgttaccctggaacatatttctaatattgccagtgcagaaaaacctgagggaattattattcagttttcaggccagaccgggcagaatatggcatccggaatatcggaaatatttaacaacataattctgggaactaagccggaagatatatacagaatagaagaacgtacgatattctcaaagaccttaaggagccttggcataaaacaaccagatttcattgaagcttcaaatattaatgagctggaagaaaaaatcaagggcattagccttcctgtaatcataaggtcaagttttattataggtgggagggctatggatataatatacgactatgatattctggttagccgtgtcagggaattatttattgaacgcccgggctcacctgtccttgtaagcagttatctaaaaaatgcaaccgaaattgatgttgattttatttcctcagctgagaaatctataatagcgggtatttctgtacacatagaagaagctggaacacattccggagatgcgacaatggtacttggccccggtgtagtggattctgatacgctggaacagctcaaagaaatagttgaaaagatgaggcaaaattttaacctttcagggttatccaatcttcagctggcaataaaggacagtgaaatatatgttatcgaactgaatgcaaggtcttcaaggtctgttccatttgtgtccaaggcaactggaattaactggatagattccggtgttaaagctatgcttggaattgagccagacctgaaatattctgagccggcatcattctttataaaagtgcctgtattcccattcaaaaggttcagggatatggatgtcatcctcggcccggaaatgaaatcaaccggtgaggcaatgtgttgcggaaaaactttccaggaggctatgtctaaggtaatacgcatcatgaaaagggattttaaattaaactctgtcattattacagtaaatgatgctgataaaaatgaagccataaaaataggcagaaaactcgcagcaaagaatgttaaaatatatgcaacaccgggtacatacaatgccatgaaggatgcaggagtgaaatcaaatgttgtttacagggtcaaagatttgaggtcaccgggaatcagcgaaataataaaaaatgaagatatatcaatgataatcaatacgccttcagaatcatatggctctataagggatgggttctcaatcagaaacctcggaatcaagaaagatattccgctcataacaaatatcaggtttgcatccgaacttgta

SEQ ID NO: 34761 - DNA, 690 bp, Ferroplasma acidarmanus
atgattcaaatccgggagcttgaaaaagaatatggcaaacaccagagagccctcgatcatataacccaggatctggatagtggaatagtatcaatcattggcaaaaatggagcagggaaaacaactcttttgagaatattatccacacagctgaaatcatcatccggtgatgcattcatcgacgggctcagtattaataaagatattaaagaaatcagaaataaaatagtaagcattccacaggaagcgtctcctataggaatacttacagcatatgagcaggtttttttatatcttacagggaagggattttctttccattcagccaggcaggaatccagaatggccttgaaggttgttggattgggagataagatggatgtcccaactgatatactctccggaggcatgaagagaaaaatgtttgttgctatggcactgggatgcaatgctgaaactgtatttttagatgaacccacaaccgggcttgaccccttatccagaatggaaacatggggtgcaataaaggagcttacaggaaatgttgttcttacgacacattatatggaagaggctacagagttatccaggaaaatatacatgatggactcgggaaaattcatcgggtcaggaactgcagatgaactcctctatgatttaaggggtaaagtcaggatagaatctaaggag

SEQ ID NO: 34762 - DNA, 1299 bp, Ferroplasma acidarmanus
gagttattcggcacgaatggaatcagaggagttccaaatgaagaccttacaacagatctagcaatggggataggaaaggcaataggaacatttttcaatggaggtaaaattgcaatagcaaaggatacaagaatcagcggggacatgttcatgcttgctgttgcttctgctatcatgtctacaggttctgatgtgatatatgtgggcgagttgccaacccccggactccagtactactgcaaatcaaagggtattccaggcgttatgattaccgcatcgcataatccgccacagtataatggaataaaggcaatagataaggatggtactgaaattgacgaagaaagcgaaataaaaatagaggatatatacaacggcaaattattcaaacaggcatcctgggagaaaatcgggacgtataattatgatagtactgcaataggtctttatatggacagcatagtcagcatggtagatgaaaaggccataaaggaaaggcgcctgaatgtagtaattgatacagggaacggggcatcatactataccagccccacaatactgacaaaattgaattgccatgtggtttcattgaacgcaaatcctgatggcaaattctcatcgaggaattcagaaccaaaacctgagaatctggtggatcttatatctgtaatgaaaaccggcaaatttgatctggggattgcacatgatggtgatgcagaccggtgcgttttcatcgacgaaaagggcaattatattgatggtgataaaagcctggcattgatagtgaaacataccattcaaaagggcgatatagtcgtaactcctgtaagcagttctgatgcacttgaaaacatatgcagggaaaagggtgcaaaattgatatcaactagagttggggctccgattgtggcacgtgcaatgatagataataatgcatctataggcggcgaggaaaatggcggtatcatatatggaaagcatcagttctgcagggatggggcaatgactatggcactgatgctaaatctccttacccatgaaaacaaaacagtatcaagtctgcttgaagaaatacctgactataccatggctaaatcatctgtagcacgtaaaaaaagctgggaagaaataaaaaaattgctaatggaaaatttttccgggaaaaagatggattttaccgatggtgtaaaaatttttgatgaagatggatggacattaatacggccttcagggactgaaaagattatcagaatattttctgaatccccatccaaaagccttgcggaagagtataataaa

SEQ ID NO: 34763 - DNA, 417 bp, Ferroplasma acidarmanus
atggaacgaactttagtactcataaagccagatggtgtaaaaaggcatctcattgggaatattatagaaagattcgaaaataaaggcttgaaaatagtttctttgaaactgatgaaagtatctgatgataaagcccggcaacattatagcgttcatagtatgaaaccattttttgaaggtcttgtatcttatttaacatcaggtcctatagtagctttaatacttgaaggtgataatgcgataatttcgtgcagaaatctcgccggtgcaactgatggttctgccgcagccgcaggtaccataaggggcgacttttcattgaacatcgaggaaaatatagttcatgcctccgattctccagaatcttttaaccacgaatataaaatattctttaatgagaacgagataatggattat

SEQ ID NO: 34764 - DNA, 1785 bp, Ferroplasma acidarmanus
tttcctttttctgccatagtggataacgaagacataaaactcgggcttattgtaaatgcaatagatagcaatattggcggtttactcataacaggcccaaagggcatagccaaatcaacaatggtgcgtgcactgtcatccatacttccggaagttaaggcggttaagggatgcaggttccattgcgaccctgatggggatctgtgtgacgaatgcctggaagcccggaaaaaaggagagcttaaaactgaaaacatgaagataaggataataaatctgcccaatagcactacccttgaccgtgttgtcgggtcacttgatatatcccatgccataaaaggtgaatctgttctccgtgaaggtttgataggcgaagcaaacaggggaatattgtatatagatgaggttaacctcctagatgattctatagtggattcaatacttgattcagctgcttccgggataaatatcgttgaaagggagggagtatcttacacacaccctgccagattcatccttgtaggcacaatgaatcctgaagagggggaactaaggccgcaattgcttgaccgttttggcatctctgttgaagggaaaatgccagaatcgccggaaaaacttcttgatatagccgatcgtgttgaagaatttgatagtgatagggaaagctttatagaaaaattcagggcaccggatcgtgaaattcagttaaagatagttaatgcaagaaaactgttgccatatgtgaaaataaaaagggaatacagggtttttgtagcagatttagtgattaaaaattccctgagcaacagggccatgataagcactgtaaaaactgcaaaagcaatagctgcatattacggcagaacagaagtgaatgaagatgacctgaagaaggcactgcaattcgcccttaaccacaggatgaaggaaaaagggaagagcaggccagattataattttaatgacccgggcaataatggagataacacgggcgataaccaggaacaggattctgccagcaatcagcccactcctcaggatcaaaagaatcatgaaacaggaaaaaatggaaaggagaagcaggagaagcagcagaagcagaaggaaaacagggaaagcacagtacataatcttgaagtagataccggcaaaaaaatagaaacaaaaaaatcagggcgtagcggaagagcaaagcaattcaggcatagaggcaggaaatcaggaacctacatggatataaggcattcacttctgaatacatggagttcgggcttcagaatgataaatgagaaaaccattgttatgaaagattcctactcaaaaggctcaattccatttataatagccatagactcgagcaggtcaatgaatttcagttcaagaattgaaatcgccagagaattttcagatatgctgctcaaaaaattgtatattatgagaagcagagttgcacttataaaatttgcaggcgagagatcggaagtattaatgaatttctcacgcaattttacggcgttgaaaaacattatcgataatatttccagtggcggaaagaccccactgtacgatgcccttgagaatatatataaattatcttcgtatgaaaaattaaaaacggtatcacttctggtaacggacggaaggggaaatgtgtttccaggaaatgcaagggaaaacctgatggaaatatctaagaaaattaagccattgtcaagtatgtacataatcgataaaaatgacaataaatttcttccaacatataacggtataatatcatcatac

SEQ ID NO: 34765 - DNA, 3387 bp, Ferroplasma acidarmanus
tccgttatccagtcatttttacacgcaggtgaggaaacaggcaatgaaataaaaataaaatatccaaggcttgatcctgtagataaggaatttatagactttgttagagatgccgatgctgtattcatccatcatttttccggtgaaaatatttacagcaatattcttgaagacatagaaagcgtcattaaggggaagaagaatgtaatagccattgacccgatactgagcaattattcaacggtgagcaaatttgtcgaagaaaaagtatcaaattactatttctacggtggctatgaaaatattaagaatatggtattattcattgaaaacaccataaccccccggcattatgaagagccggttgagatgccattttccggaatctatgaatatggaaatactgagtttcctaagaaggtaggaatattattttaccggacagcatgggtagacagggacacaaaaataatacagtacattatagataatttaaataataataaaatttctgcaataccggtgttcacaaacggctttggtgaccggtcaaggggaataatgagtgctgaagaatgcataaatacatatttctacagcgatgggaagccagttgttgatgcagttataaatctattatcgttctccctaatcaagaaggaggataaaagtacactgatgaatctgggtgttcctgtatttcagggtttaatatattattataaagaggaaaaggaatggcttgattcttccgggctggacgttgtatcaactattatgagtgcaatgcttcctgaaatggatgggactatagagcctgtacttatcggcgttatcaagaaaatttatgatagaggcgctatatacagggaactcgttcccgttaaggagcaggcacaatatatgattaacaggatccggaaatgggtcaacctgcgctatatgaaaaattctgagaaaaagatagctattatactgcactcaggctcatctttcaaggatctggaagccaatatcggtacagcaacaggcctggacacgcttaattctgtatccagcataatgtcattactccgcgagaatggatataatatagattacctgccggagaacggcgaatctcttattaaaacaataatggagaaaaaggcaatacctgaaggaaagtggacgcctgttgaagaaataataaataagggcggatccgtctatggaatgccagtaaaagagtatatgaaatttttccgcgaattgccagaggattcgcaggatatgataatcaagcgctggggggaacttaacactgaaagggactacatgctacttaacggtaccatgcatattcccgggatcatatcagggaatatttttataggcatacagccaaagagaattacatttgctgacaatgataatagcatcaggtcaatacatgactccctgacgccggttacccattactggcttgcattttataaatggatccaggaaattttcagggcagatgcaataatacatgttggaacacatggaacactggaattcacgccggggaaaggcctcgggctatcaccatcagattttccggagatttctatcggtgagattccaaatctatacctttattccacaaatgttcccggagaagggataatagctaaaaggagaagctatgcagtccttcttgattatattactccgccaacagcctacgatgatgttcccgatgatataaaggagctagaagacctcatagatgattatgaggaaacagaaaaggcagagaatacatcaagggaaaccatgatccttgagaaaatccagaagatttcagataaaattggcttatccatagattttaaggatgcacataaagctacgcatgaaattgaacaccgcctcaatctcttcaaggattccataatcagcaagggattatatatctacggaaaagatattgacaaagatgatttaaaggattacgttacaactgccacacgttttgacgagtcactatccaaaaaatatggcaaggaagaagctgaaaatcaaataatggcctatttaaatgagggtacaccaattcccgaactcgaaaccggaataatagaaaaactaaagttttcgcctgaaaacgaaaagaacaatctcctgatggcattgaatggcaaatttatagaacccggagtttccgggtcgctcaccaggggaaggtatgatgtattgccgtcaggtaggaatttttatgccgttgatccgttcaagatacccagccattcagcatggcaggttggtgtaatactggcaaacaaactcattgaaaatgaatacaaaaaaaataataaatttccggaaaccattggatttgttctctggtctaccgatgcatacaggtcagatggggaattgatatcccagatactatatacaattggtgtagaacctgtgtggcaggaagggacaaagaaggtaaaggatgttaagccaatacccatggatgtccttaaaaggcccagaatcgacgttgtggtagaatccagtggcattgtaagggacaatcttttcaatataatagaattaatagatctggcaataaaaaaggtatctgaactggatgaagatgatgatgtaaatttcatcgtcaagcaccataagaaatacgggcaccttgatagaatattttcttcgaagcccggttcctacggttccggggttaacaatgcaatagaatcatcaaaatgggaaaatgagaatgaccttgcggatgtatttacggaatggatgggatactcatatggcaaaaacaactttggaagagaatcaaaggatgagctgctttcaatctctaaggatatagaaactataatacataaaagggaaatcgatgagatagacataaacgacgattcgtgcaattattcctatgcaggcggcttctatcttatggcaaagaaaagcggttcaaagccatcgcttatgtttgaagatacatttaatcccaataagccacaggtaaggacaatgaaagaggaaatagagcgtactgctattgggaaattgttgaatgaaaaatggattgaagcacagaaaaatttcggctatagaggtgctacagaaatgctgaagaagatcgagcatctatacggatggggcgctaccaccggaatggtgaacgacaatattttcaataatatagctgataaatttgtactggacagggaaatgaaggaatggttcaaaaaagaaaatccatgggcactttcagaaattacctcaagaatgatagaggcatataagcgggatatatggcatgcaagcgatagcatgaaggaacagcttgaggaagaatatatggaaatagagggggagaacgaatgaggacatacc

SEQ ID NO: 34766 - DNA, 1594 bp, Ferroplasma acidarmanus
aagacagttgaattaaaagtatatggaatgacatgcgatgattgtgtgaggcacgtaagcggtgggctaaagcaggcggaaggcgttactgatgtttctgtttccctcaaagacggaatggcagtcgttaaggccatggatactgttgatccggagaacctattaaagctggatgttttcaaaggccagtataaagcacagttaaaaagtgttaaaaatgagtgaatacgatctggcaattataggttggggagcagctggttttgccgccgccattaaggctagtgaactaacctctaaccagatgaaaatagctttaatcggcactggaccaataggggggacatgcgtaaacgttggatgtgtcccatctaaatttttaatagaagcttctaagaattataaggaggcaactaagccatcataccgtggaataacagcaaatgcaaatattaacttttcagaatttatggaatcgttgaatgattttgtttccactgagaggaataccaaatatgcagatgtaataaaaaatttcgaaaatatagatatgtatgaagggatggcaaaatttattgataacaatacagtagccgtaaacaataaagatataaaagcacttaatttcattatttcaaccggatcaagaacattaattccggaaattaaagggcttacagattattacacaagtgacacaatctggaatatgagagaacttccagggaagatagctgtattaggttcgggtgaagtggcacttgagctggcatatgccttctcaaactttggcactgaagtccatatttttaacaggtccaatagaatattgaaaggatttgatgaagatattaataatcacctgataaacgctttaaagactaacgggataatctttcaccttgggcagaattttcaggaaattataaataaaaatggcaaaaaaagcatagttacagaggcgggaacatttgacaactttgatagcttgcttgttgccacaggaagggtgccacaaatagacaaattaaacttaaaagctgctgggatttcaaccgataatggtattgttgttgatgatagccttaaaaccacaaatccaattatatatgcagctggagactgcataaggcaatcattaaaactggaaacactcgctggaaaagaaggcgttatcgcagttgaaaacatgcttggtgggagtagaacaatcaatatgcatgaagtgccatgggtagttttcactgaaccaaatgttgcatcggttggatatacagaggcagaactgaagtcgaaaaatatagaatatgatgtgagaaccgtggaattaaaaaatgtcgtaaaagccaacatcctgaatagttatgacggtattgctaaggtcatatctggaaaggataagaaaattctcggggttcatgttgtggcacctatggccgcagaatttataattgagggagtataccttattcaaaatgggttaacctacgacaacctcataaatgctatgcatgtattccctactgtagcagaatctataaaaataggtggacaggctttcataagggatatatcaaagatgagctgctgtatg

SEQ ID NO: 34767 - DNA, 1023 bp, Ferroplasma acidarmanus
atgggggtagatatatcaggaatcctggtcaaacatcagaccagcataagggagaacggaggtataacagtatccatagatgcttttaatataatttaccagtttctaagcagcataaggggtgaggatggagaaccgcttaaggatgaacacggaaatattacatcacatctttccggaattttttaccggacagccacattgctggagaacaatataaaacctgtttattcatttgatgggaagccataccggctgaaggatgaaacattaaaggaaagaaaagccataaaagaaaaaaatatagctgaacttaatcttgcaatggaaaacaaagatgcggaaaaaataaaaacactatcctccaggattaattatattacggcagacatagtatcagaatccaaaaagcttttagacatgatgggtgttccatgggttcaggcgccaagtgaaggcgaagcccaggcttcctacatgagtaaagtaggagctgttgattctgtaatttcacaggactatgattgcctcctgttaggtgccaggagggttctaaggaattttaccatgtatggccggaggagaatttccggaacaggaaaattcataaatattacccccgaaatcatagatttaaaggaaaatcttgacaatctgggaattacacaggatcagctgattggcatcgggattcttgttggaactgattttaatccgggcataaggggaataggcgcgaaaaccggactatccctgataaaaaaatacggcgatatagaatctgtgctgaaacagaagaataaaaccatagataatctggatgaaattaaggaattttttctgaatccaccggttgaggatactggagaattaaaatttgcaccgccttacagggagaaaataattgaatatctctgtgcggaacatagcttttcagagaataggataaacagtatacttgacaggatagaaaagaattactccggagcaaaccagtccagccttgataaatatttttagagg

SEQ ID NO: 34768 - DNA, 3429 bp, Ferroplasma acidarmanus
gtagactctattgaaatggaaaacttcaaatcttatggagacaaacaatcaattaaaattaacaaagggttcacggtaattattggcccgaacggttccggcaaaagcaatattggcgacagcatgctctttgttcttggcatcagggcaaacaaaactgtcagggtagataaacttgaggattttatccacaaaaccgatcctccaaaaaaacattgttacgttgtattaaacgttatatccaacgaaaataacaggtattccataaaaagggagcttgtatacaaccatggcgaatacaaatccaattattatataaatgataaacgtgcgagcaggactgatgtattgaagcttatagatagcttccatatatatcttgacgcctacagcttcgttctccagggcgatataaacaaccttgtaaaaatgacaggaaccgaaaaaaggaagctttttgaatccattgcagggatagaaagttataaggaaagaattgaaagtgcgcagaatgatataaatgggctgaatgaaaacctcaatagcatggatgctgtgcttttagaaataaaaagtatgcttgataccctggaagtagatagggaaaacgccttaaaatacaataagctcaataaagaagttaacgaattaaaattcttccttaaagtaaaggaccgggacaggataaaccaggaacttgccatgtataacgggaatatagagaaaagccaatcagacatagataatctggaaaatgagaataaaaacctgtccatacagagggatgaagccattaacaggataaaggaaatagaagataaattggatgcaatgggtgggcaggaagttaaaggcattagaaaaaggatagaagaattgaatattggaattgcagagttaaaaacaaagataggcagcactggtgaatcaaagacaaattcagaagcacggttaaaaacttcccgtgaggcctataacttcaacagggaacagctggaaaataaactcaaagagaagaaaaactatgagtcttaccttaagggaacagagaattccatagctaaaattaacagggaactggaaaaattccggcaggaaaattacgaaaactcaaaattgacaagggaaattaacgacaggctcgcagcaatcgatgtagaaatgcagcaggcaaatgaccagattatcaatgattacgacatcagaactatagaacaggaattgtcaggattttccagggaaaataccatgaacgaggaaaaaataaaggaagaatccataaaagtaaaggatttaaaatggaaaatagataacctgaaaaaaaatattaaagagtatagtgaagaaatcaatgaagtaaataaaaaatttcttaccgtgaggaacaagcttaatgaactcgtaacaatgaaaagcaacaacgacgtggaaatcaggaataaggagaaagaactccgtggccttaactatagaggcacagctagcccggcattaagggaaataaacagtatgatggaaacggaaagtggaattcacgggccactgggaaaactcatagaatatgaggacaaatatgcaaatgctgtgattgtggctgcaggaggcagattgaattccatagttgttgataatgattctgtggcacagatgtgcatacaggcaataaaagcaaagaaattggggcggttgacattcatacctctgaataagattgccacttcaccggacaggcaaaaggcagcagaattaataaattcaggcaatgctattgattttgtcagaaatcttataacctgcgaccctgcatttgaaaaagccattaaatacgcattcggtgacaccgtacttatggatacactggaaaatgcaaggaagcatatgaccggagtacgtatagtaacgctggatggggatgttctggacccttccggagcaatgacaggcggatcaattaaaaatgatgaaattctggcaaaccgtataacgaaagccatagctgaactggaggaacagaatgaaatactgaaaagtgagataagcttcaaggaaaaagaaaactcggaaatatcctccaaactggctgaccttacaaggaagcgggatatttcaaccagcaatattaataattacgaaacccagctgcaggaatctgagaactccatagaggcagcgaaaacaaggattgaagaaattaaattgaaaataaaggatgcagaagatagaaaaagcaattttgagttcaagaaaaatgaagtaaagatgcagctatttaccctggataaggaacgtaaagagctatttaaaaaattaaaggaactggccccagaaaatgtggagatagaaaaacagatggaagaggaactgggcaatgaaatgaaaagcagggaaaattattccagtaaacttgcacagattgaaactgaatttaaacacttcacagaaaaaagccaggagctggaggaaaaaataaccgggcttgaaaatgaaataacaaaatttaccggcatggtagctgaattcaaaaataaagtcgaagcaatggaaaaagagcttgaggaaaaccgtgcaaaagaaaatgaaatagattcccgttcaagggagctttataccgaaaaaaaccaggtttccactgccagggacaaattatttgaaaatataaggaagaatgatgatctaataagcaataaaaaagccattatagcaggccttaaaacaaaaatagaaaatctggcattccagcttgaaacaataaattacgagatagaaaatacaggcatggaatacatagagttcaacatgagcatatccgaggtgaagcaaaaaatagatgaaaacagccgggaaatcgaaaagttgggggcggtaaatatgaaagcaattgaacagtatgacatggaactcaataagtacaatagcacagaggaaaaatacaaaaccctgctttcagagaaaaatgaccttatagacctgcagaatcagatcatagaagacgaaaagagaatattcctcgaattatttgatactattaattcccagtttcagaaaatttatgcaaggttatcagaaggaggagaggcaaacctggaaatcaccagcagggatgacccgttgaattctgaagtttatataaaggtaaagcccaggggaaaacacatgataaaaatagacgcacttagcggtggtgaaaaaagtgtggctgtactggcattgatactttcattccagataaaaaatccatcgcccatatactatcttgatgaggttgatatgttccttgacgggcataatgccgaacatgtaggcgaattatttatggaaaattccaaaacttcacaggtggtgatggtttccctgaagggtgcggtaacgaaatttgcggataacctgattgctgtaaccacagataagcatggaaatacaaaaataata

SEQ ID NO: 34769 - DNA, 954 bp, Ferroplasma acidarmanus
gacagcgaacttgaaaataagaaacttacaatagaagatttacccggtgttggggaggcaacagctgaaaagctaagggaaaacggatacgacgatattatggctatcgcagttgcgtcgcctaaggaccttgctgatatcagtggcatagccgaaggtgcagctgtaaaaataattaatgcagccagaaaatatgctgatgttggcaattttgaaacaggggaagaaattctgaagagaagaaaagaagtaagaaaacttagtactggtgcacaggggcttgacaatcttattggcggtgggctggaaacacaatccataacagagtttttcggtgaatttggttccgggaaaacacagataatgctccagcttgcagtaaacgcaacaatgcccgaggaacagggagggcttaactcggatgtgctcattatagatacagaaaatacattcaggcctgaaagagtaatccagatggcaaaagcaaagaatcttgatcctgatgagacacttaaaaggatacacgttgcaagggcatataatgcacatcaccagatactcctggctgagaaggcatccgatatagcaaaggagtttccaataaaactattgatagtggattcattgacatcccacttccgttcagaatatgttggcagggggtcacttgcagagaggcaacagttgttgaataagcatatgcatgatctgttgaaatttggaacaatattcaatgctgttatagctgttacgaaccaggtatctgcaaatcctgcagtcttcttcggggaccctatgactccaataggagggaatattgtagggcataccgcaactttcaggctctatctcagaaaagccaaagcaggaaaaagaatagcaaggctaatcgattcgccttacctgcctgaaggggaagctgtaattacactcactgaggacggaataatagac

SEQ ID NO: 34770 - DNA, 1125 bp, Ferroplasma acidarmanus
gattaatcatacaatgtgacaggtaccggattaatgcaatatttcagggaatattattataaaaaccatcttggcatacctgatatgctattccagagggagattggctttataccttttaacggtacaatgatcaggcataaaaaattcgatagccagaacgaaatagaaaatttcgtacgcagggctataccaaggcacctttattattcatcttcctattacaggtttcctgaccagcataaaatgcttgaaaaggaatggctcggtgcggaacttatctttgaccttgatgcggaccatattgaaggagcagataaaatgacatatatggaaatacttgcggaggttaagaagcatactctgaggctcctggaaatgcttatggatgattttggatttgaagagaaaaatattcgcctttatttctccggaggcagagggtaccatgttcatgtggaaagtgataggatatacacaatggattctgattccagaagggaaatcggagattatatcaaaattgaaggattgaatatggaggatttgaagttgcttgacgatagttactttgaatatggaatacttaagaaatttaacatttacatatccaatttttacagaaatctggatgaaaattacataaaaaaagtattcccgaaatcctggtggaattatttagagtatctggaaaaatattacaatggggaaaaaatcagggatttcctcagcaatgaaaaaggaaacaaatttaagttgttgataaagcagaataaaagcaatgaaaacgcttcaatagattatgacaggataattcttggcaaaattcttgaagattttaaaagtaatgcgctggcagagattgatgaacctgtaaccacagatatccaccgccttataagattcccctatagcctccacggtaaaacagggctaatggttaaaccggtagctataggcgaattaaaaacctttaacccgcttgatgaggctattccagatgtgtttcagggaagggatgtaaaaattaatttaaagatagataaattttccatagaaatgaatcgacaaaattataatatagccaggggggagaactctgtcccattataccttgctatattc

SEQ ID NO: 34771 - DNA, 1422 bp, Ferroplasma acidarmanus
cttgaccctgtttttggaaatccaggcactactgaaataccgatgttgcgtggcatcagaaactattacctgacacttcatgattccattgctctgggaatggctgatggatatgcacagtataacaatactgcttccattgtgaatctccatacacttccagggctgggcaatacaatgtcctttgtgaacactgcgaaatggaaccgttccccggtggtaataaccgcagggcagcaggatacgaggcatattgtctttgacccgctgttatcaggagacctcttaaatactgtgtcgggcctggtaaaatattcctatgaaataaaaaatccatctgatattcctacagccttcagaagggctaaggccatagctatgacaccaccaatgggccctgtattcatatctgtgccaatggatatgatggattatactgctgaaaatttatatttcaatgatgttagaacaaacgtttcttcctatgaccctgaagctgtattcgaaattgttgaaaggataaacaaagcaaaacatcctgcattggtgtttggatatgaaatagatgtttacaacgcttacgcagaagcggaagcttttgctgacaggttaggtgtagaggtatacagtgaaccgctggcatccagaggaacatttaacacagccaacgaacactatgcaggggacctattgcctgcctcaacactgatgaacctgaaatttgtgaataacgacctgatagtcttcatcggtggcgatataacattttatccctatctcccatcattgccattcccgggaaaagatgtaatatttataggtacagacatatcacacaaaacaggtgatggatatacaatgaatccaaaactattcctcagtgaagctgtaaaattaataaaggcaaaaggtgactataaaaggggtactgattatctgtatgcaaatagggtggcccgccagaggctaagtatgggcgtggattatgtactgtttaaagctaaaaaattattttccgattacaccatagttgatgaagctatatcagcttccgagaacgtgcgttccacatttggctacggatacaggaaatactatacggcaaaatcaggccagcttggatgggctacagcagcggccctcggaatagggatgaataacaaaaaaactctggtaattattggtgatggcgcattcatgtacactgtgcaggggttgtggactgcaaagcattataatatacctgttaaattcctggttctcaacaacagtggatacaatatactcaaaagcttttcaaagagctattatccggatatggagaaaaaagattatttccagctgaaccttgacatagaatctgttgcaaagggctttggagtggagacacatacagctgatgaaaacctttcagatctggaa

SEQ ID NO: 34772 - DNA, 1407 bp, Ferroplasma acidarmanus
aatataattaatggaattgaggaaaccggtggggagagaatagaactaaagagcccggtagacgggtcattgatagggtatataatagatacggataaggatacagttgaacgggcaatacaatcatcccgggaggctttcaataaattttaccttgaatccacaataaaatccaggcaggaattgatcgggaaacttactgatattgtccaggaaaaggccacaatatatgcagacctggaatcaaaaaataccgggaaaactatccgccagagtacttttatggatatacctctggcaatatcccatatcaggtactttgctgaaacagatgaattcaaatttcagaggaagattacgcatccggaatacccaggcacagagggcatagtccagaacgcacctatgggcgttgtagcttccatagcaccatggaatgttccctttttaatggctgtatggaaaatcatcccaccggtactggctggaaacgctgttgtcattaagccatcacattatacaccattgactgctattgaacttgtaaaagatatgaaggcagcgggctttccagatgggcttgtgaatcttgtaaacggcacaggcaggacaaccgggaacctcctggtgaacagtgaccatgttgatatggtaagtttcacaggttccacccctacaggatccagaatcatggaacaggcggctaaaaacataaagaaagtatcccttgaactcggtggaaaatcacctaatatcgtctttgcagatgccgatctggaccacgctgtaaaaggcgtaatatttggaatattccttaacgcagggcaactctgtgaatctgcaagcaggttaatcattgaagaatcaattatggacaaattcctccagaaagtgaaaacatatctggattccatgaaatcaggaaatccaatggatttcgagaccgatatcagcgccataacaactaaggagcaaaaggaaaaaatagagtcattaattagccagactgtcaaatcgggcggaaatatattttattcaaagaatatgcagggcacacctgataagggtacatattttcctccaacacttctaaccggattaactccaggacaacaaatttctgatgaagaaatatttggccctgtattgacagtatatccatttaaatctgaaaaagaagccatagatctggcaaatagcacaaaatatggccttgctgccggaatatggacaaaggatattgagaaagccgggagggtagcatcaatgatagaggcaggaactgtatgggtaaacgaataccatctattgtcagctgctgcaccgagaggaggatttaagaaaagcggcattggcagggagctggggcttgaaggtattctggaatatacacagacaaggcacata

SEQ ID NO: 34773 - DNA, 1272 bp, Ferroplasma acidarmanus
aaaattattacagatgtaccgggaccggagagcacattattactacagaggcaaagggaaatggaatccagcacagtaatctatctggatagttttcccattgcaattaagagggctgaaaactcattaatagaagacctggatgggaatattttcattgactgggtatcaggaatcagtgttatgaatttgggatttaatgataaaataagggatgccgtgaaagcacagctggatgacatatggcatgctctggagattcctacggaagttagaattaattttcttgaagcattgagaaatagcttccctccagagatgagaaattataaaacaatatttggaatcagcggtgctgatgcatgtgaaactgcaatcaatattgcacatgcaataaggaaaaagaatgccccaacaattgcattcgaaggtgcataccatggagtatccgggggaattattgctgccactgccgggagaaaatacagggaagcagtatacagcgatggatttaagataataagggtgccatacccatatgaattatggtatgactatgatgtttctgatataatttccataatgaaaaagataatggatgatggagaagcaggatacgataggcccgattctgttatagttgaacccatccagggagaaggcggttatattgtacctccagatggatttttaaaggccataagggaattctgtactgaatacgaccttacaatgattgttgatgaggttcaaagcggtgtaggcaggacaggcaagatgtgggcatttgaatatgaaaatattacccctgacatagtgtgtgtcagcaagagcataggaggtggtttgcccgtatcattggtttattaccgggacgactatgacaaaaaattgccgaagccattccatctgggaacgtacagggccaatccactggcaatggctgctggaataactgttatcaatgaggttccaaaatattttgataaggtaaaatccagcggaaaggaaatgttaaacaaattcaacaagatagattccaatcttataggagaagtacgtggcaagggctatatgataggcatagagcttgtagacaacggaaagccaatgaattcgaagcgcatgatggaattaaagcatgaactcctccagaacggattgttaatgcatacatgcgggcactatgggaatgtattcagattcatgggtgcgttgaatatgcctgatgaattaataaatacaggaattaacattttcggcaaggtttta

SEQ ID NO: 34774 - DNA, 1062 bp, Ferroplasma acidarmanus
tattatcagatactgggagtagataaaaccgcttctcaggaagagatacgttcaaagttcagagaacttgctaagaaataccaccccgatgtaaattcaggcagtaaggaggctgaacagaaattcaaggaaatcgcagaagcgtatgaagtgctttcagatccccagaaaaggcaacaatatgatgctaccggctctacaacatttggagatgcaggagctggcggtggcgcaggctttaactgggataatttctcacattttgacgatattaatgatatatttaataccatattcggcggcggatttggaagaggaaatttcaatggttcctatggcagtagtagcccccagccggacctcgatatttatgtaaaacttaacgtcactatggaggatgcatattacggtgcatcaaaacctattaagttcaaaagaaatgccatgtgtgaagtatgcaatggtacaggagcggaaggtggagtactggttacatgccccacctgccatggtaccggccaggaaagaataagcagggggcagggtttctttaactttgtccaggtaatagtatgccgtacctgtatgggaaaaggaaaaataccgaaaaccccctgcaaagcatgtgctggaaaaggatacataccaaaaatggagaacatttctataacaataccaaagggcgttgataccaacacaaggctcaggacacagaaactgggcaactcttttggtggtgtgaccggtgacctatacgctgtcgtttatgtccagccgaacccgaatataaaacgtaccggcgataatctctacgttaaagaagccatagatttccctacagctgctctgggcgggtctgttgaaattccccttttcaaagagaaatttactttaaatattcctgctggaagccagccagaggatgtattgaggattaaaggtgctggaatgcctaaattaacctcacgtgggagtggagacctccttgttgtgctaaaacttcaggttccgaagcaccttacatccagggaaaaggaactaatagaggagctcaagggcgaa

SEQ ID NO: 34775 - DNA, 1875 bp, Ferroplasma acidarmanus
atgagtaaaataataggtatagatctaggtacaagcaattcggcagcggctgttgttatttctggaaagccagaaaccattccagcagcagagggcgtatcactgggcggaaaatcttttccaagctatgtggcgttcacaaaagacggacaactactggtaggcgagcctgcaaggagacaggctctccttaaccccgagggaacaatatacggtgccaaaaggaaaatgggaacagatttcaaatataaaatattcggaaaagaatatacgccgcagcagatttcagcatttatattgcagaagataaaaaaagatgcagaggcatttctcggtgaaccggtaaacgatgctgttatcactgtaccggcatatttcaacgataaccagagacaggcaacaaaggatgccggggctatagccgggcttaatgtaaaaaggattataaatgagcctaccgctgcgtgcatggcttatggaattgataagctcaacgaaactttaaaaatacttatttacgattttggcggaggcacacttgatgttacagtgatggatttcggccagggagtttttgaagttatgtcaacatccggtgatacaaaactgggtggcagtgatatggatgaagctatagttaacttccttgctgatgatttcaaatccaaggaaggaatagatctcaggaaagacaaatctgcatatatcaggttaagggatgcagccgagaaagcaaaaatagagctgtctacagttctggaatcagatataaaccttccatatataacagccactcaggacggcccgaagcacctggaatttaaacttaccagggcaaagctggaggaacttattgcgccaatagtcggaaagtctgcagcatctctggacaaagcacttgaaggagccaagctttcaaagggtgatataaacaagattatactcattggcggacctacaaggatgccatatgtcaaaaaatatgttgaagattactttggcaaaaaatccgaaggcggtgttgacccgatgcaggcagttgcaacaggtgctgcaattcagggaggagtgctgatgggagatataaaagatattgtacttctggatgtaactcctttgacacttggcatagaaactgttggtggagttatgactccgttgataaatgccaatgctacaataccaacaaagaaaacccaggtcttctctactgcagctgatatgcaaacatctgtcgagattcatatagtccagggtgaaaggccacttgttaaagatgatgtttctctaggaaatttcgtactcacaggaatagcacctgcgccaaggggagtcccacagattgaagttacatttgatatcgatgcaaatggcatactgaacgtttccgcaaaagacaagggtaccggcaaatcccagagtatttctatcagtgcctcaaacaagctttccaaggatgaaatagaaaaaatgaaaaaggaagctgagcaatatgcagaagaggacaagaaagaaaaggagacaatagaaacactgaataacggtgaatctctggcatatactgtagaaaaaacaataaacgaagcaggggacaaacttgacaacgaaacaaaggataaaataaagggcattataaaagacctgaaggatgctgttgagaagaaagatgtagataaagtaaaggagattacagaaaacttaacaaaggaaatgactgaagtctacactaaaatggctcaggcgcagcagccagatcagggcgccgggcaacaatctgaacaacagtctgaacagcagggagaagagggatcctcgcaggaacagaataataacgaacagcaatcagatgacagtactgttaataccgactataaa

SEQ ID NO: 34776 - DNA, 939 bp, Ferroplasma acidarmanus
gaaaataatattctaaaggaaaccgtagcagaattctgtgaaaaaaatctcgatgaaaagaagatcgaaaacgaaggaattagcaaagcaacaacagaacttctggcttcccagggttttcttggagctacaattccagcaaagtattccggttctgaactggataatacgtcatatgaaattatacttgaagaaatatctaaatattcaccttcagtagcaatgaaaattttcattttaaattcactgtattatccctctgtaaaaggtacatctgctgaatccacactaacagatgcagcatccggaaagctggatgttgctgttgatgttataggtaatggaagtgatctgaaggaaaattcagggaaactttctggaacattaaaaagtattctcggtacagatgctgagaatattatattattcaatggaaaaacatcaatggtttcaggcaagtttaaatcagccgctcgggatttcatgggattccgaggaatgaaattcggggatgtaacactggataatagcataaccattcttgatcagaaaagcaggaaggataaaattatagaggaatcatatggcccattgtctgcaattgcacttggaatgatatccggggcacttcaaaaagccattgattacacatctgtgagaaaagccttcggcaactatcttaaggattttgaacctatttcattcaggctgtcgagattcagatccatagaatctgttttaagaagtgccctttatggtggtgtagacccatattatgcatttaatctggccatggaatccatggttgaaattgcaagatattctgtcaacacacatggtgggtatggatatttccaggattttggcgttgagaagttttacagggattcaatagtaatgaaatctatattttatggaaatcaggaattgaaaaaactt

SEQ ID NO: 34777 - DNA, 1062 bp, Ferroplasma acidarmanus
gaagaatatgatgaatacagaaacaaaatcagggaatttgccctgaaagaatttacagaggacgtggcagcagattatgatagaaaggaagcataccctgatgagctcagaaagaaatcactttcacttggaatagttgatatgcagaaccccgcaaaggtaatgataggaattgaggagctctgcagggttgatgccgggcttgggatagctcttaccacaccatatttcggcagcgaagttataatgctattcgggaacgatgcgcagaaagccatacttgaagatgtttacaaaggaaagtatatacttggtcttggtgtcacagaaccatcgggcggaagtgatgtggctggattgaaaaccacagcaaagaaacagggcaataagtatatattgaatggttcaaagatgttcattacaaatggttcaatagctgattacctggtagtattggcaagaacttctgaagattcaaacccccaccatggtttgagtacatttcttgtgaatacaaaattgaaaggtttcaaggcaaacaaacttgttgacaaactgggagtcagggctacaaataccgctgagttgcaatttaacaatattgaactgagtgaggacgaccttataggcgaggaaggaaagggtttctattatattatgatgtttttcaatataagcagaatttacgtggcagcacagtcactgggaatagcaagaggtgcatttgataaaattaagtcttacataaaggagaataacataaaggacgaggaatcaatgttcaggctttccgatgtgggcacaaggatagaagccacaaggcaaatgacatacaatgccgctacatacctgtttgaattcaagccaaaaccggaattgaccagcatggcaaaggcttatggaagtgaaacggcagtatatgctgcagaatctgccatggaaatacttggcgaccactctgcatatgaagatgtccagagaatattcagaaatgccaaaataatggagatctgggaagggacaagtgaaatagaaaaactggtaattgcaaggtatatatta

SEQ ID NO: 34778 - DNA, 1173 bp, Ferroplasma acidarmanus
atggaagatgtatacatagttgattatagaagaatacccttttccagggcacgtcccagggaccctgaaaaagatgtttataatgatttgagaatggataagatgctgtctgaattgatcaggcattctgtcagtgaaactaagataaacccggctgagatcgaggatgttattaccggatgtgctttccaggcaggagaaaactggacatatggtggcaggcaccctgtacttcttgcagatctgccggtctcagttcctgcaatgtcccttgacagggcatgctcatcttcacttaacgctacaggcataggggctctggaaattatggcaggcaaagcaggcataataatttcaggtggaatggagcatatgacacatgtgccactgggcgtagataaccagtttataaagccaaatatggagctgatggccaaccctaaatattcaaaattcaatatgaacgtatcatataatatgggattgaccgcagaaaaacttgccaagctaaggaatatttccagggatgaaatggatgaatactcatacaattcacacaaaagggcagcaaaggcttatgaagatggtttcatgaaaggcgaaataatgcctgttaccgtaaatggaaatacaataacttcagatctgggaattagaaaggatactacactggaacagattaaatcactgaagccagcatattcagaagatggaataataacggcagcgaattcttcttccctgaatgacggcgcatccatggtcatgttaatgtcagggaaaaagttaaaggaatacgggctaaaacccatggcgaggatagtagactttgcagcagcgggtgttgatcccacaataatgggcgaaggcccggtacctgctacaaagaaggtactggaaaggaataacctgaaaccggaagatatagattactgggaaattaacgaggcatttgctgttgttgttttaaacgcagtacatgcattcaaccttgaccttaaccgtgtgaatattcatggtggtggtttatctataggccatccattgggagcaacaggtgccaggatagccggtacactggcgaggacacttgaggacaaaaaaggagacctcggaatcgctacattatgtgttggcggtgggcagggctattcaatgctattggagcgtgtt

SEQ ID NO: 34779 - DNA, 1560 bp, Ferroplasma acidarmanus
gattttaagttaacgataaataatcttcttgatagtgcagttcgggcaaatggagaccagaaaattatctataagaatttgcagttaacatataattcattttacaaaaacgtcaaaaattttgcagccaatcttgtaaagataggcgttaaacccggtgataggatagcagtaattgattacgacactataaattacatgtattgctattactctattccaatgattggcgcagtgatacatatggtaaacatcagatatcctccagaaatactgtattataccataaaaaattcagaggatacctatattgtagttaattcagattttatgccactgttaatgcaatttaaaaatatgtttgaattcataaagggttttattgtttactccgagcacgggcatgaaaattatcagctcgacaatgtatattatgccgatgaccttttaaaagacacagattataatatcacacctccggatgagaatgacatggctacactattttatacatcaggaaccaccgggctgccgaagggagtgtattacaaccacaggcagcttgtgcttcacagcatggctactgcagaaggcctatcagatgatccaatattgcttaataaaacatctattcttcttccccttgttccaatgttccatgtacatgcatggggcatgccatacttcgccataatgaaaggattgaaatatgtgcttcccggaaaatacgaatgggacaggatagtggaaacaatggaaaaggagcatgttaccaattccgcaatggttccatcgatactgtatctgctcctgcaggcaaagagggggccggaagtgctcggcaaactaaagctaaaatcagttatcggtggcgcagcactgaatgaaggcttagccagatctgccgagtctataggcatgtcccttgtaacaggatatgggatgtctgaaacctgccctatcctcacactggccagttataccaatgatatactgccattaagcgaggaaataaaggaaaaataccgcagaaaaaccggtgtacctgttcctatggtcaacctgcgtgttgtttaccagggaaaagatgtagcaaaagacgatacggaaataggagaaataatagtacaggcaccatggttgacagcaggttacctgaaagacccggagaaaactgcaaagctatggatcgacggatggctgcatacaggcgacctggcaacaatggataaatacggatatataaaaattgttgatagggaaagcgatgctgtaaaatccggtggtgaatttatcccgtcaatggttcttgaggacctcataagcaccgttcccggagtaggagaggttgccgtaaccaaaaaatccgatgaaaagtggggcgaaaggccagtggcttttataaaaggaacagcaaccgtagaagccataaaagaacacatgcagcaattcgtggacacggggagaatagccaagttctggcttccggatgactatatatttgtggatgactttgaaaagacaggaacaggaaaaataaataaggttgtacttagaaaa

SEQ ID NO: 34780 - DNA, 1935 bp, Ferroplasma acidarmanus
atatatatcagcatgattaaacaggtagcggtaatcggcgcaggtgtaatgggtcatagcatagctgaagtctttgcattaaatggatataaggtgaatctggaagatttttacccggaagttatagagaaggcaaaagtggggattaatggcagtctggacaaactcattgcatcggggaagattaatgatgcagctaaaaaagcagctctggacaatatcaaattttttaataatattggagaagcagtaaaaaatgtagatctgtcaatagaagttgtacctgaaatttataatattaaagtcaaggtgctgaaggagatagcagagaatacagataaaataattgcctccaacacatcaaatattagaattactgaaatgggagaagaaataaaaaatcctgaaaggcttgttggaatgcatttctttaatccgccgatactcatgaagcttgttgaggtaataaagggagataaaacttccatggaatacgttgaagagatatatgaactggctggaaaaatagggaaaaagcccataaaagtccttaaggatgaagcaggatttgttgtcaacagaatatctgcccccgagatgctattactctgcaatgcatatggcaataaaatagaccgccctgaggcaattgacaaatactttaaatcccaggggctgcccatgggtccctaccagctgttcgactatgtaggcctggatacagttgttgattctctccagtattatggaaaagagctgtctccggattatggaaaatgccatgcctttgatagtttcatagaggcaaagcatctcgggcttaaaacaggcagtggcatatacaaatgggaaaatggaaaagctattatcccggatgccaacgaaagcgaaaaaattagccttatggatatgtttgccctggaaatcaacgaagctacaaagcttatagaagacggggttgcagtacctgacgatatagaaattggagtaaaatacgggctaaacaggccattcgggccaatcaccgtggcaaatggattgagcaacgatgaggtgcttgagacacttaataacctttacaaacagtataaaatagaggtttttaagccatcaaaaactatagagtcccataaaatgaaggagtctttcaataaaaaacctgttgaagtgaaaaaggaagaaaaatcagggattcttgattatagcaaagatggcaaggttggtgtgatcacaattaaaaatgggaaaaataatttaatgagctttgagctcctgaaggcactggacaaacaacttgatgccatagaagaagccaatgatgtaaatgtggtagtaataaaaggaaatgaaagggcgttctctgcaggagcagacctgtcacagtttataagcaatccatatatgtttatgaaaatatcaaatacaggggaaagcatattcgacagaattaccaggatgaataagattttcattgcacagctgcgtggatatgtccttggaggtggctttgaactgtcacttgcatgcgacataagaacgtctttgccggattcggtaataggattccccgagacatcccttggacttatacctggatacggaggaagccagaggctgccaaaccttataggaatttccagggcaatggacatgatattgacctgcgagaggattagcggtgaaaaggcatatgaatacggaataattacaagactatttaaagaagagctggaagaaaatacaatgaaacttgctaaagacctttcagagaagatatcgcctgcatccgtttatgtagccaagcgccttatatataatacagcaacaattaatcttgatgaagaagcactttcaatgggcatgctatatgcaggaaacgacatgaaagagggcgttaaggcattccttgagaaaagaaaaccggattacaaaggg

SEQ ID NO: 34781 - DNA, 1140 bp, Ferroplasma acidarmanus
atgaattatgagaacgaacacatagcaaatacgtatcagaggctcccggtaaacgtccttaatggaaacggggctatactgcatgacataaatggaaaaagatatattgacatgatgggtggatacggagtagccatactcggatacggaaataaaaaaataaaggaagcggtatgcaggcaattcgatacaatacccattgcacatgcatctgaatacactgcagcaagggaggaattcatcaaaaaccttaccgggatagttcctgccgggctggataaattttaccttggaaacacaggtgcggaggccatagaagctgcaataaaagtggtaattaaatcctctaaaaatcataaaattatagccatgacaaattcttaccatggaaaaactgccggcgcattgtcgatcacctattctgaaaaatacaggcaatccttcggagatttgctgataaagaatgttgagtttataaggtacaacaatatggaagacctggacaaaatcagaaaagataatgatatatcagcagtattttttgaacctgtccagggcgaaggtggaataaacatacctgacagggattatgtaagggaactgaggcaaattacagaggaaaagggcataatacttgttgcagatgaaatacagtccgggcttggcaggaccgggaaaatgtgggcacatgaacattttggcattaaaccggacattataacaataggcaagggcatcgggggtggaattccattatcagttacagcgggaaaaccggaatttatggataaccttgcaaagggagaacagtcttcaacaaccggaggaaatcccatagccatggcttccggaagtgcagtcatagaacagcttacagatgatttaataaatgaagttgcagtgaaaggggaactattcaggaataccctgaaagaatacctggcagactcgaggattgtaaaagaaataaggggtttagggctcatggatgctatagagttaagggtaaaatttttgccagtatttatggatatcataaacaggggagttcttccactatattcaggaatcaatatattgagaatgctgccgccatatgtgatatctgatgcggagataaccgaagctgcaaaaatcatg

SEQ ID NO: 34782 - DNA, 714 bp, Ferroplasma acidarmanus
gttttgaaaataggtggaagcgtactggataattttctggaaaatgacaatctgtactccataatacagcagtttgattgcccccttgcaatagttcatggcggtggcaattatctggatacccatgctgatagctttaactacactaaaaaatttgttacatccccggagggaataagaagcaggtatactgataaaaacacactggaaattttcacaatggtgatgaatctaattaaccagaaactggtattgaatttaaaggaacacgggataaaagctgtaacgctaaatggaataataaacgcaaggagaaaggaaaaactgataataatgaatgaaaagaacagaaaaatgataatcgatggcggttatacaggcagggtagaaagtgccgactctattcccatacgggctgtaatagatgaagggtatatccctgtaatttctcctgtggcatacgggaatggaaactatttgaatgttgatgctgatagggccgcagcatatgttgcaggatccatgggatcagattccctggtgtttcttacaaatgttagcgggctttactataaggaccgtgttatagaaaaagcagacgttgcatatattaaaagtattttgaatgagattggaacaggcatggataaaaagctaatggcttcaattgaagcccttgaaatgggggttagacaggtcactatttcaaacccc

SEQ ID NO: 34783 - DNA, 1041 bp, Ferroplasma acidarmanus
gtgatgaaagtaggcattgtcggggcctcaggatatgtgggtggtgaactcatgcgcctgcttgtcaggcatcctgaaatcgagattacatcggtatcatccaccaggcatagtggagaaaaagtttcgagaatacatccggacctttacggacttacggatttaaaatttgaagatatcacaccgctggatatggcagggaaagttgatttaatattcctagcactcccacacgggacttcaattaaatatgtgcctggcctggttgaaaccggtgtgaaaattatagacatgagtgcagatttcaggcttaaaaatcctgaactgtacaagccatggtatgggtacgaacacggatatcctgacctcataaagaaatttgtatatggcatgcctgaacttcacagggaacagataaaaaatgctacttatatagcaacgccaggatgcatagcttcctcatcaatatacagcatagccccatttctttccctggagctttccagtgatataataaatgtggatgcaaaggttggttcctccggatcaggatccgggctggacgaatcaaaggtattctcagagaggtttgattccatcagggcatataaaccggttaatcacaggcatacacctgagattgagcaggagctggaatacgcttccgggaaaaaggtaaaaatagcactttccgcacactctgtaaatatggtgaggggcatacttaccacatccagcatctacagtgaaggcgatgaaataactttgtggtcactgctcaggaagttctatggcaatgagaaatttataaggctaataatggacaggaaaagcaattacaagtacccggacccgaaaaccgttataggctcaaatttcgcggatattggatttgccattgataaatatgtgaagagggtagtatcatttggtgctattgacaacctgattaaaggagctgcaggcaatgcagtccagtctatgaatataatgaatggatttaatgagtatgagggccttatgatgccatccctttttccg

SEQ ID NO: 34784 - DNA, 777 bp, Ferroplasma acidarmanus
gaccttaaaaacaaaaatgcaatagtttgtgccggcagtaccgggataggaaaaggagttatttccgtgctggcaaaatacggtgccaatataaccacattttcgcgaacaaaagaaaacgtagaaagccttaaagaggaaatcaggaaggaaacaggtgtcacagtaaatgcaatgtgtgcagacctttccaaaaaagacgatctaatgcgggttgtggattccgcacatgagcagtacggtaaaattgatttccttgtcatgaactatggagacccacgggttgacccattcatgcagcttaatgaatctgattgggattataacattgatatgatctttaaatctacaataaggatggttgatatgtgtgcaactgatatgataaaatcgaattccgggcgtataatatttattacatccatgaccacgaaaaacccccttgaaaattttgcaatttcaaattccctgaggtctggtgtagtagctcttggaaaaacactctctatagaactgggaaaatacaacataaatgtaaattcaatctcacaggggtatttctacacacggaggctggaaaacataataaaaaagaattctgtttccagtggaaagccagttgaagaagttgaatcccagctgatgaaagaaataccgcttggaaggtttggcaaaccggaagaagttgggaatcttgtcgcatttttatgttctggcatgtcttcctatattaccggtataaacatacccattgacggtggagtaataaaatcaatt

SEQ ID NO: 34785 - DNA, 2331 bp, Ferroplasma acidarmanus
tcactcgaagatttatttaagaaactaaatacttcaaaagcagggctttcaggcaacgaagcaagttcaagacttcacacctatggttataatgaggtttcggagaagaaagagagttccatactaaagtttttaaagaaattctggacaccaatttcctggatgctggagcttacaataatcataacatttatacttggaaaatatgacgattctctgataatacttttcctgctaatatttaatggtgtaatatcctttacccaggaatcaaaggctgataatgcagtagaactattaaagaaaaaactttcagcccaggccagagtcctgagagatggtaagtggaatgttatagaaacaaagtttctcgtgcccggggatattgtccatctaagattgggtgatgtggttcctgcagatattaaaataatagacgatgagctggaaatcgaccagtccgcccttactggagaatcactgtcagtaacaagaaaaaagggagatacaatatattccagctctgtggtaaaaagaggtgaatgcaatggtctggtaacagaaacaggcagcaagacctatttcggaaaaacaacagaactggttgaaatagcaaagacaaagtcacacatagaagaacttattatgaaaataataaaagacctgatagccatagatactattcttgttatagcacttatattattttctatctaccgtggcgtggacattaccgaagttatcccctttgcactggtaatattaattgcatcaatacccgtagctctcccggcaacattcacaattgcaatgtcccttggcgcccttcatatgtcaaaacgtggtgaaatagtcacgaggctatccgctatagaggatgcggcttccatggacacattatgcatggataaaacaggtactattacagaaaataaattgactataaaaactccaaaggtctatacaggagatgaattgtccctgattaaatatgcatcatatgcatcgcagagaaaaagtgaggacccaatagatgatgccatactggactatgccgatttaaaatctgtaaaaattgactatgcaaatagaagcaagtttacgccattcgacccttcaattaagcgtacggaagcaataataaacgaagcggggaaatctgttaaaatagtcaagggtgcaccacaggttatatcagagcttacaggcaatgtaccggaaacatatgaaaatgatataaaatacttctcatcccagggattcagaattatttcagtggctgcaggaacagataaactcgaaattctgggggttatacccctatacgatccgccaaggaaggattcaagggatttaattactgaattgaagcagctcagtgtatcccctgtcatgattacaggcgacaacagcctcatcgcagaagaagttgcaggcgagatagggctggaaaagaaattatgcaatgcagaaaatataaagggtaactatgctggtgcatcagattgttcagtttttgccgaggtttttcctgaagataaatattatatcgtgaaggctttacagaaatccgggcatattgttggcatgaccggtgatggtgtaaatgattcccctgcattgaaacaggcagaattcggtgtggctgtcgcatcagctacagatgtggcaaaggcatctgccagtgttgttctgacccattccggacttacagatatagtggacgggataaaatccggcaggagaatttaccagagaatgcttacctacacattaaacaaaataataaaggtaatccagattgttttcttccttacactttcattttttgtggtagggttttttgttacaacagcatttgatgtaattctccttatttttgccaatgattttgtaacaatggcaattgcaacagataatgttggatactctataaaacctgaaaggtggaacgtgaattcattaatctcatcatcagttatccttgcggcattccttgttgttgaaagctttatattcctctatatcgggctctatgcagggttaagaatcagccagattcatacttttatatttgatatgctggtattctccggccagttcacagtttacatggtacgggaaaggaaaagattttccaattctatgccttctaaaattctgttgctttccagcattgtcgatataataattatatctttcatatcatattatggcatcctggtaactgcaattccattaaaatttatcctgatcagcataggattaacgttcatatggatggtgtttatggatacaataaaaaatgtagtattcaggcattataaatta

SEQ ID NO: 34786 - DNA, 1278 bp, Ferroplasma acidarmanus
aagatacttgtggttaccagccgtgcaccattttcataccggtatgctccgggaggtgatgtcaggatatataatgtaggtggagttgccacagccctcagcacaatgcttaagggaaccggaggcacttgggtatgctggggcgatggaaagaatgacatggcacaccaggaggaaactacagatgggtataagatagcaagggtattcctaaacaaaactgaaaaattcgggttttacaatagctattccaacagggttttatggccattattccactattttagaaacaatatacattttgactccacagcttttaagtattattatattgcaaatgaaaaatttgcaaaaaaaataaaggaaaatataacgccggatacaataatatgggtgcatgactaccagcttatgatgatcccgtcaatattgagaactatggacatatccaattatataatattctcatggcacatcccatggatatctcctgaatttttcagcatactccccgaagcaaaatttctcgcacagagcatttcaaaatctaatctggtaacatttcataccaggctgtatgagaagaattttttcaatactctggagtaccatgaaataaaagttaaaaatagattaaaaactcttgcaattcccctggggatcgataaaaatttttttcacctgtctaaaaccatggcaattaaaccaaaaaaagaaaaagcatcaattatattttcaatagaccgccttgattatacaaaagggcttctacagagggtaaaggctattgagaagattctcagttacagaaaggaccttatagggaaattagtatatttaatgaacgttacaccaagccgtacaggcattccagaatatgatgaaattaaagagcaactggagatggaagtgggaagggtaaacggtctttacagtacaacttcatgggtgcctataatttacatatacaggaaaatatcacagaaatatctggtttcattatatgcacgaagtgacatagcattgattaccccattaatggatggtttaaaccttgtttccaaagagtttgtagcaactacggataagggtgtgcttatactatcaaaattcgccggggctgcggaatatatggacggagcgttgatagtaaaccctaataatataaatgaactggcaagtgccatagtaagggcaatggaaatggatggagaggaaaaaatgtcacggctcaaaaggatgaaaaaggatgtatatgtaaagaacagtaactggtgg

SEQ ID NO: 34787 - DNA, 960 bp, Ferroplasma acidarmanus
ctggaaatagcttccaggtcaacgggaaaaataaaacagaaaaggctggagcaggcagccaaccttaaaaaaatatatgaatccataggtggagaagctgttgaggaggacaggatttctgaggggaaaaagatacttgggacattgaatatagagccacctgagattccaaaagttacatttcaggatgttgctggattagaaaatgtaaaaacagagattatgtcaaagataatataccctatgcggtataaagagctatcacaggaatataatattgaattcagcggcggcatgcttctttatggcccaccaggcaccggaaaaaccttcatcgttaaggctattgcgaatgaagtaaaagccaattttataaatgtaaatccatcaacactttacagccagtggttcggccagtttgagaaaaatatttccctccttttccgtgctgcctatctattatcaccatccatattattttttgatgagatcgatacgctggtgccaaagaggtcaggctcagaatctgatgctgccaggagaggtgtttcacagcttctcaccgaagttggcgggttaacatcccagaaagacagaaacgtatttatcatagccgcaacgaataatccctggggaatcgatgaggcaattatgaggccaggaagatttgatgtaaagatatatattccaccaccggactatgaatcaagaaagaaaattttccagttgaagctttcagaggttaagcacatagaccatattgattatgatgaacttgcaaataaaacagagaggtattctggagctgatatagaatttatatgcaagaaagctgtacagaatgtatttatggaagtaataaaaacaggcaataaaattgatgtgtccacagatgatttgctggaagtcatttcacagatacggccatccatagatgcagggcttcttagaaaataccag

SEQ ID NO: 34788 - DNA, 840 bp, Ferroplasma acidarmanus
gttatattattaagttacggaagccctgaaaggattgatgatgttccggaatatctatcaggcatatttaatgggaaacccgtaccggaaaagatcatggaagaaaatattaaaaaatatgaaatggtcaatggcatatctccctcaaaccagataattaaaaatttaaaaaataaacttgggaaattgctggcaagatatggtgattttgagatcatagatgcctacaagcactggcatcccggaatagaagaaacagtatcatcactggatgcagattatgaggaaataattgcattgccactgtttgcttttaagtcaaacaatattagaaaatcatacgaaataccggtgaaaaaagccatggaaggaaaaaatatgaaactgaggttcataaatggccttgattacagcatactggcttctatgtgggtttcagagatcagcaaatacgtatatgattttgacaatttcctgttcactgcacatagccttcccctgatagatgacgaatctgattatcaggcatcactggaaagaaatgcagggaaaatttcagatatgcttggcattgaaaagtattatactgcattttacagccaggggccacatggaaaatggattgaaccatctatatattctaagattgacctgtttaaagaagataaaattaacaatttacttgtatctccaattggctttttatatgaacatctggaaatactatacgatcttgatgtaaagtataaagagtttcttgaatcccggggcataaaatacgcacgtgccagaacaccatcagattcggatggcatggccatacttctaaaaaacgcaata

SEQ ID NO: 34789 - DNA, 987 bp, Ferroplasma acidarmanus
tttattccagcattgaaacaggaaccgcatgaccatatccctgtatggtttatgcgccaggcgggcagatatatggatgaatataaggaactccggaaattatataatatcaggcaaatgtgcatggatcctgaaattactgaaaaaattacatatgcccctgtaaaattgctcggagtggatgcagcaataatattcgctgacataatattgcctctggaagccatggggtataaaatagattttaacagttcagggcctgatatagggaatggatacaggcacaataaaagtatggaaggaatacatgagttcaatacaggagatttaaaatacagaacatatgacgcaatccggctcttcaagcagaatcaccctgaaaccccccttattggcttttccgggggaatcataacagttatgtcatatattattgctggagtttctgataataatcttgtatacacaaagaaggttatgttaaatgacccttcatttggaataatgaaaaaaatgattaaaaacatgatacttgactatgtaacaatgcaggtcaaagccggcgtggatgccatacagatatttgattcatggcttggcgccttatcgccatacacctttgagaaatacctgaaaaacgacattattgaactggtagaatcaataaaaagcaaggttcctgttatatacttttcaacaggcagttcaggcatgatagaacaatttaatgatattaagccggatatactgagtgttgactggagaataaaattatcccatgccagaacaatattaaatggtagcataggaatgcagggcaatttagacccgtatcttgttcagtacagcagggaagcagcactggaagaaactggtagaatcctcggtgaagcaggaaaggatgataattatatattcaatcttggacacggcgtattgccggaaacagatcctgacacgctcaaaagcataacagacaccgttcat

SEQ ID NO: 34790 - DNA, 1245 bp, Ferroplasma acidarmanus
tactatatacacattataatgacagataataatggatttttaaggttaaagtgggcaagagaccatatgccagtttgtgctaatatacgtgaaagatttcttaaggaaaaaccattcaagggaataaaaattgcgatggcactgcatgtggaagcgaaaacagggatatttgcacttttgcttacagaaggtggtgctgaagtccgtttagcctcatgcaatcccctcagttcagatgacagtgttgtccaatcattaagcaaagattataattatatggtttatgctaaaaagggagaatctgaaaaagaatactatgaaaatattaataaaactattgaagctgcacctgatattatcatagatgatggtggagaccttacaaaccttgttgcctcaaaaccggaactggtaaaaaaagtgattggtggcaatgaagagacaactaccggtgtggtaaggcttaaggctatggaaaaagcaggagctttaaaattcccaatgtttgacgtcaatgatgcgcagatgaaacactttttcgacaacagatacggttcagggcaaagtgcactggatggatttatgaatgcaacaaatatcctcatagcaggaaaaaatgcacttgtagccggatatgggtatgtaggcaagggagtagccatgaggttaaagggcatgggtgcgagggttactgtaacagaagtggaccctgtgaaagcaattgaagctgttatggatggatttacagtagatacaatgaacagcgctataagatactgtgatctcatattcacagctacgggcatgaaaaatgtggtgagctatgatgatatgctggttgcaaagaaaggcataataatgggaaatgtagggcattttaacaatgaaatagattactcctcacttgaaaagaaaaatataggaaaaacacctgtgagaaatcttgttacagaatataaacttgaaaatggcaatacagtgaatttaatatctgatggaagattgcttaaccttgcagcagggcaggggcatccagttgaaattatggatttaagctttgcacttcaggctctgacagctgaatatattgtgaaaaataagggaaaactatcaaacaaagtttatcctgtgccggcggaaatagatacagaggttgcaaaaatagcactggaatcacttaattttaaaatagatacatacacagaggagcagctaaaatacctggatagctatcaggaaggtaca

SEQ ID NO: 34791 - DNA, 717 bp, Ferroplasma acidarmanus
tctgtaaagaatctcagggacgtagtagatatgctcggtaccgttgtaactgaagctaaatttaaaataggccagcagggcatatctgtaaatgctgtggaccctgcacatgtagccatggtttcactggaaattccgaagggcattctcctggaatatgatgtggaaagtgaggaggaattatcacttgaccttgaaaaggtaaaaggtattttaaaacttgcatcgggcaatgattccttcataataacaaaagataaggaaaaattaagatttgagataggcaatataattaaaagcatatcacttcttgacaatagccagataagtacaccaagagttccgcaaattgttgcagaggattatattgtaataaacaaaggagaccttgaaaaggggttaaaggctgctgaagatgtatcggatgccataaggtttacaatgaaccctgatagcttttccgccaaatcaatgtcagatgcagatgagagtgaaatgatattgcccggtgacaagctgaaagaaatacagtgccacgagtctataaaatcatcgtatcccctggaatacctcctgaagtttatgagatcaatatctccaaatgaggaagtaaaactttccttcaaaagtgattatccacttacaattgaattcaatctaggttcagaatcggcggacagaataaaaggaagatttttgcttgccccaagaatggaa

SEQ ID NO: 34792 - DNA, 1239 bp, Ferroplasma acidarmanus
atggaaaatttagatccgtttgatattgcgctggaacagcttaacaaggctgctaaagttatgaagcttgataaggcaagcatcgatgttttgagttctcccagggagatccttcaggtgagcatacctgtgaagatggataatggaacaactgaagtttttaccgggttcagggtacattataataatgccagggggcctatgaaaggaggaatcagatattatattaaagaaaacctttctgaagtaaaggctctatcagcatggatgacatggaaaacagcacttctcgggcttccattcggtggtgcaaagggtggtataatatgcgacccgaagaaaatgagcaagatggaactggaaagattgagcagagggtatatcgatgccatagcaaacttcatcggccctgaaatagatgttccggctccagatgtttatacaacaccccagataatgggctggatgatggatgagtacgaaaaaatagtcaggcattcagctccaggagttatcacaggaaaaccattgacaataggcgggtctcttggaagaggagatgccacagccaaaggtggaatgtatgtattaagagaaggtgcaaaatacaagggcatagaccttacaaaggcaaaatttgccgtgcagggtttcggaaatgcaggccagtttgctgttaaattcgtaaaggaaatgtttggcgcaaaggttgttgcagtttctgactcaagtggcggaatttacaaggaaagtggcatagactatgcagaacttcttgcacataaagaaaaacacggatcagtagaaaacttccccgggtcaaagaacatatcaaatgaagaattattagaatctgatgttgatgtattgataccctcagcaatagaagaccagctaaccggcgcgaatgcatcgaaagtaaaggcaaaaatcgtgctggaacttgcaaatgggccatcaacaccggaagctgatgaaatattctacaaaaacaatgtgttgctgttacctgatttcctatccaatgcaggtggtgtcacagtatcatatttcgaatgggttcagaatataaccggagactactggacagaggatgttgtatacagcaagctggatgagaagatgacatttgcaacaaaagatgtactggcaacccatgaaaaataccagactgaccccaggacagctgcatatataatagccatacagagagtactcgacgctatgaaagccagagga

SEQ ID NO: 34793 - DNA, 1245 bp, Ferroplasma acidarmanus
atggaaataaaatcagaatgggggcacttaaacagggttataatgcacaggccaggaacagaaataacatatgcaatgctggcacctaaaccatttttatttgagcgaccgtttaactattccattgcaaataaagaacaccagaatcttgaagatactctgagggaaaatggtgtaaaagttgaccttcttgaaaatttaatcgttgacgaagcagaaaaaaaagcgtcattccgccaaaaactggaagaaaaaataatggcgctggtaaatttttacggtacaatggaatcagtagaggaggcaaaaaaagacatggaaaagaatataaaatatgttgacccgctttccctgttccaggcattgataatggagccatcaatagaccttaaagagtacgttcccggaatacagtatccaagggtttattccaacctcccacttgccaatctttatttcatgcgtgaccagcaggctgtatcatccggagtacttttaggaaaaatgaaaatgcagcagaggagaaaagaaactgatatcacatcattcgtattcagtgaaatccttggggcgaaaaccaaaaaaattacagaggggtattttgaaggtggggatttcataccctgtggggatttttgcctaataggtacgggaaacaggacagatgaaacaggtgcaatggaagcaatcaattcaggaattttcaattttcccacggtagcaattatcaccaatcctttatacgattttatggacgggcatgatgtaatggtcaatatgcatctggatacttatttcaatatacctgcaaagggaatggctatcacatccgttgagcttgccagggtagcccgggcaaagatatatacaagggatagggaagggcattatgcacaggaaacagaaacaacgctttatgatttcctgaaaggggaaggctatgaatttattaatcttggtataagtgagcagctttcatactcttccaattttttgacgctgtctgataggaaaatagtggcaattgactcttcaaaagtaataaaaaagctccttgcagagaatgtttttgacactgatacacgccagaaaataataaaagatatggaattgaaaagtggaaaaatgttcccggacagcgatgcaatggcaaaaagcgggatagatgtgataaaaatagacctaagtgaaataacaggcggctatggcggagcccattgcatgacctcagcaattgatagaaca

SEQ ID NO: 34794 - DNA, 903 bp, Ferroplasma acidarmanus
aaaacagatgaagttaagaattgtcctgaatgcgggtcaattcatttggttaaggattatgacaggggtgaattgacatgctatgattgtgggattgttatagaagattccctgatagatcaggggcctgaatggcgtgcatttgattctgaacaggatgggaagaggtcaaggaccgggtcacctatgagttttttaagccacgacaaggggcttgctacagaaatatcatggtcaaataaggactattatggaaagcggattccgcataaaaacaggtcgcagatataccgtgtaaggaaatggcatcagaggataagggttagcaatgctgccgaaagaaacctggcactggcgctccaggttttaaatgaggacggggcaaaacttggaattccgaaagatatcaaagaaagtgctgcactgatttatagaaaggctgttgaaaaaaaccttatcaggggaaggagcatagaaagcattgtatgcgcatccatttacgcatcctgcaggatgatcaatatacccagaacacttgatgaaatttcaaaggtttccgaggtcaataagaaaaaaattggaaaagcttaccgccatcttgccaaggaactggcacttaatctacagccaacaactccatattcatatgtatcacagttttgcaataaactggacctggacaagcaggttataatggacagcgagcatataatcaggcttgccggagaatcaggtctatctactggaaaggggccaactggcatagctgctgcagccatatacatcgcagccatgaaaaacggtaaacagcgtacgcagaaggatgttgcccgtgtgtccggagttaccgaggtaaccatcagaaaccgttacaaggaaattagcaaaaagctcggaatagat

SEQ ID NO: 34795 - DNA, 963 bp, Ferroplasma acidarmanus
atccagaaggtatatattaaatgttaaggtgataaaatggcaacagaaaagaaaaaaaatatttatgagatagacaagtgtcctgagtgcggttcttcacagttagtaagagattatgaacgtggtgaattagtttgctccaactgtggccttgtcatagatgacagttatattgatgaagggccggaatggagggctttcgactcagaacaaagtgaaagcagggccaggacaggttctccaatgacatacacgatccatgacaagggattatccacagatatttcatggaaaaacaaagattcatatgggaaatcaataccaacaagaaacagggcacagctgtacaggctcagaaagtggcagaagagaataaaggtatcaaatgcagcagagcggaatctttcacaggcattgcaggaactggaaagaatggcttcaaacctgagcatacccaatgatgtccgtgaaacatctgcagttatctacagaaaagcagttaagcagaatatgatcaggggcaggtccatagagggagtcgtagccggatcaatttatgcagcatgcagaattacaaatgttccaaggacactggatgaaattgcatctgttacaagggtaaagaagaaagaaataggcaggacatacagaattatggccagatacctgaaactgaatatactcccatcaaaacccgatgactacgtgaacagattctgttccaagcttagattatcaatggaagccaggaagagggctgaggaaatattaaaaatggcaatagacaatgacctgacatctggaaaagggcctacaggagttgcagcagctgcaatatatatagcatctctcatcactggggaaagaagaacccagagggcaattgctgaagtagccggtgttactgaggtaactattagaaacagatataaggaactgacagaaaaactcaatttaacaatt

SEQ ID NO: 34796 - DNA, 1692 bp, Ferroplasma acidarmanus
cgattgaataattattttatcaggcttttaaaagagatacttgcatataaaaggaattccacaataattatttccgccatactggcgtcatctgtaatagcaatgatcgggccttacataataggtatagctacagattctattatagccctgaaatttaaaatacttataattctggcggtactatatcttggcatttatataataaattatatagcagaaaacaggcggactaaatacatgatgaatacatcccaggccgtaataaaggggctcagagacagggcattcaggaatcttcagtacgtaccattaaaatactatgcaggcaagaatgccgggcagattataagcaggataaccaatgatgctgaaacactttcagattttcttacattccagcttccacaggtagttgcaggcatagctggaattatagcttccatatttattatgatctaccttgacccactacttacagtatacgctgttattattatcccgatgctgcttgcaactgtatttcttatgaataaaagaattaaattcaattacatgaatgtgaggagaaggatagcagagcttacaggcaatgtaggagaatctattaacggggtaaaagcaataaaaagctccggaacagaagatgttttcaatgataattttgaaactgtcaactcaaataattatgaagccaatatacgcgcagtgcggcttacctcactgttttcaagcatagtccagattatagaggggttagggataatgatagtactctatgaaggtggtgcagaggtttttggcagggttataagtattggaatccttgtatcctttattgtctatgtccagagctttttcaaccctattgtccaactgtcccagttctataattcataccagtcttcctccatagcaatagagagaatttaccgcataatagatgaagaaaatgattatacaaccaacggttctaacatacctgcattcacggacaagctcaaattcaacaatgtcacattttcctatgggaaagagaggataatagacaatctttccatggttattgaaaaaggcaagaggatagcaataataggaaaaacaggcgcaggaaaaaccaccatatcaaatcttatattgaatttttacaaacctgacaccggaacaataaccatggatggggtggatataaataactttaataccatggaatacagaaagctttttggggtaattttgcaggatccgttcctattcgatggaactatacttgaaaatataagatttgcagattattccattccggaagaggaaataaaagaaaaaatctccagcctcgggcttgacagcattatcgggcctctggggttatatgctaatgtaggtgaacgtgggtccaatctttccgaagggcaaaggcaggcagtttcaatattaagggcagctgttaataacccgcagatcataataatggatgaggccacatcacagctggatatgaaaaatgaatctataattcagagtgcaatattcaaatttatggagggaaaaactataattatcatagcacaccatctccagactataatacattctgattatatatattacatagacaggggcaaaacgctggaagagggcgaacctgacatgttaatgggtgaagggacgagattctatgatctttacata

SEQ ID NO: 34797 - DNA, 1614 bp, Ferroplasma acidarmanus
ataggagcatcacttgcatatgcctatctccggctgcttgttccactatatattggagatgctgtcaacaacctggttggaaaaaactatattattatcctccattttgcccttcttatttttggtgtaacggtggcatcatctatatttgattttgccattgattactatgcaaataaggcaagccagaaatttgtttacaatctcagaaaaaatgaattttcacatttgctggcaaaaaattatgaatattttaatagcaattctacaggcaatatactttcaaaatttaccatggatatagaaacactgaggaggctggtaaatatgtcactttctaaccttttcagtgtaacattccttattataatagcaggcattgaccttaccaggttatattacggatttacagtaatatttttcgtggttatagcaccaataatttattttaccctggttatgcagaggaagcaaagaaagtactggcgtgccctgagggacaaatacgggacaatgaacaacctgatcaaccagaatattatcggaaacagggttgtcagaagcttcactgcggaagaggaggaaattaaaagatttaataactccactgattcatatttcgatgattataagggaatagcaggcgtaaggtctctgtataacccacttcttgcactctttttaagccttgcaataggatttgttttaatatatggcggaatagaaagcattgattccatcatctcagttgggagtgtcattgcagcggtaaatatatttacactggttctccgccctgtgaggttttatgggcgttatatctcattctatgaaaatggcatggcaagcctcgatagaattaacgcaataaacaatgataactctgactataaaggtacattgatcccggaggtgcatggaagaataagcctggaaaatctcggctataagagcaataattcaactattttaaccggcattaatatggatatagctccaggcgaaagggtagccattgttggagagaccggtgctggaaaaaccacactggtaaatattatttcggggttatacaagaactatacaggccacgcatacctggacggaacagagttaaaggaaatagatgataagctgataagggaaaaaattggcatagtatcacaggatgcaatactgttttcagggactatcaggtataatataacaatgggaaaggattatactgatgaccaggtaaggaatgcagcaaaactttccatgcttgatgatttcattgacagccttccgtcaggttatgatacgccggttggtgagaggggaataacactctccggagggcaaaaacagaggatggctattgccaggataataatcaggaatccacagattattatatttgacgattccacatcaaatctggatgcggacacagagacaaggtttttgaatacaattcaaggattcatcgcaggaaaaaccaccataataataagccataaaatctcatctgtaatgctggctgaaagggcatatgttattgaaaagggaagggttactgaatatggctatattaaggacttgataaagagcaatggctctttctccgatata

SEQ ID NO: 34798 - DNA, 252 bp, Methanosarcina mazei
gtattgatcgcacggatatcttgcgaaaactgaaatttgcttttagatgaagcaacaagttcacttgataacatagctgagcagcgcgtaatggaatcaattgatagaatctcaaaggatatgacagtaataaccatcgcacaccgtttgtctacggtaaaaaatgcggatgcaatttatgtgctgaaaaacggagagattgttgagagtggaaaacacgatgagttgcttgagttaaagggtgagtactat

SEQ ID NO: 34799 - DNA, 450 bp, Methanosarcina mazei
cgcctgagcgtttacgataacctgatggcggtactgcagattcgcgacgacctgagcaacgagcagcgtgaagaccgggcgaaagagctgatggaggagtttcacattgagcatctgcgcgatagcctcggccaggcgctctccggtggtgaacgccgccgcgtcgagatcgcccgcgcgctggccgctaacccgaaatttatcctgctggatgaacccttcgccggcgtggaccccatctccgtcattgatatcaaacgcattattgaacacctgcgcgacagcggtcttggcgtcctgataaccgaccataacgtccgggaaacgctggccgtgtgtgagcgtgcttatatcgtcagccagggccacctgatagctcacggtacgccacagcaaatccttgaagacgagcaggttaagcgcgtgtatcttggggaagacttcagactc

SEQ ID NO: 34800 - DNA, 953 bp, Methanosarcina mazei
atgaacaacgcttcggtagagtatgtgcggggaatttcggtggtgaaggctttccggcagacggtctattccttccgccgtcttcatgacaccatcaaggcctatacctccatggtcatcccttacaccttaagctggcaaaactctttttcggcgttgtcgccctggtcaacaatatctatcttttgtggtgccggtgggaattttcatcgggatgagaaccacggactatatcggctttttaagtaattttattttctatttgatttttgtccagtcggtggccacgattttgatgaagatcatgtatgtcaacggcaacgccatgaagatcatcggcggggtggaggccatggacagggtcttggcggaaccggagctccctcagccggctaatccccaaacggtgacccaatatgatgtgaacttggggatgtggtgttttcttacgacaaagacaagaaaaccgaggctctttccggggtgagctttgtggcgaagcaggggcagatcaccgcgattgtgggcccttccggcgggggtaaaagcaccatcgcccatttgattccccggttttttgatgtcagcgggggacagatcaccatcggcggtgtagatgtgcggcagatgaacagccattacctgatggagaaggtgacgtttgtctttcaggatgtgttcctttttaaacaaagtgtcatggacaatatccgcatgggcaacccccaggcttccgatcaggaggtcagggaagcggctcaagccgcccaatgccacgattttattatgaagctgccccaggggtatgacacggtgatcggcaccagaggagtgcatttgtcgggaggtgaaaagcagcggattgccatcgcccgggctatcgtgaaagatgctcctatagtgtactggatgaggctacggcttttgctgatccagaaaatgagcacctgatc

SEQ ID NO: 34801 - DNA, 708 bp, Methanosarcina mazei
gtacctcctgaaatattagagttgaaatctctgactcagaattaacatctatgagaatcaattgacttcgctacctcatgagatatcagagctgaaatctcttactcaactttccatatctggaaatcaactgacttcattgccttctgaaatcgccaatttagaaagccttactcaacttgacatttctagaaatcaattgacgtcgttgccgctggaaatcacagaactcaaaaatcttactcaacttgacataagttctaataaattgacttcgctgccgccagaaattttaaaattaggtatagatattgagtggggaaataattcggcagaaaaaggaatattcttagaaggaaatcctcttgaaaagcctccaatagagattgtaaaacagggtcgtgaggcagttatcaattatttcaagtcattggaaggtgaaaagaaaccgttaaatgaagttaaagttttgcttgtaggagatggagaggcaggaaaaacctcactgttaaagaggctcttaggcgaaggttttgatggaaatgaacatcagactcaagggattaatatcaaaaagtggggatttaaagacaaagataaggaaataaaagttaatttttgggattttggtggacaggaaataatgcatgctactcatcaatttttcctttccaaagaagcctttacattcttgttctggattctaga

SEQ ID NO: 34802 - DNA, 984 bp, Methanosarcina mazei
ggccgtgtcttagcggtgcgcggcgcgctgatcgaagtgtaagggctcgccggcgccgcgcagatcggcagccgcatcgagatcgccgcgccgggcggcatcgtccaggcggaagtgaccgcgctcgaccgcgaagtcgcgctgtgcctgccctttgtcgatccgcagggggtgggcctgggcgcccgcgccgagcttggcgccggccagttcagcgttcgcccctcccaggcctggctcggccggatggtcgacgggctcggccgcccggtcgacgggcttggccccctccccaatggcgccgatccgcagccgatcaaggcgccgccgcccgccgccgccaatcgcgcccgggtgggtgaacgcatcgagaccggggtgcgcacgctcgacctgttcgtgccgctgtgccgcggccagcggctcggcctgttcgcgggctcgggcgtcggcaagtcggtgctgctctcgatgctggcgcgctggacccagtgcgacgttgccgtcatcggcctgatcggcgagcgcggccgcgaagtgcaggaattcatcgaggacgatctgggtccggagggcatggcccgctcggtcgtcgtcgtcgccacttcggacgaacccgcgctgatgcgccgccaggctgcctggaccacgctcgccgtcgccgagtatttccgcgaccaggggctcaacgtgctgtgcctgatggactcggtcactcgcttcgccatggcgcagcgcgagatcggcctggcgagcggcgagccgccggcgaccaagggctatacccccaccgtcttcgccgagctgccccgcctgctcgagcgcgccggccccggcgcaccgggcaagggcatgatcaccgggctgttcactgtcctggtcgatggtgacgaccataatgagccggtcgccgatgcggtgcgcggcatcctcgacgggcacgtcgtgatgcgccgcgcgatcgccgagcgtggccgctatccg

SEQ ID NO: 34803 - DNA, 517 bp, Methanosarcina mazei
gttcgtatcggtacccgtgttagcgccttgagcggtgtgtcaggctgaatgggtaaagtcccaacttcaagcgcaccatcccggtattatcgtggagctggagcttatcaaaaccaaaggggataaaattttagatgtcccccttgccaaagtgggtggcaaaggtctgtttgttaaagaactggaagaggcgatgcttgatgtccgcgtcgatctggccgtccactctatgaaagatgtgcccgccgaatttcccgatggccttatgctaggtcccatcctcaagcgcgaggacccccgcgatgcgctactctccatccactaccagagtttggctgaactgccccagggcgctctgattggttcctcttcgctgcggcgccaaagccagatcaaggccaaacgtccggatctgcgtctggattggttacggggcaatgtgggcacccgcatacaaaaattggtagaggggcaatttgatgccattatcttggcggcggccggggtaaaacgttct

SEQ ID NO: 34804 - DNA, 447 bp, Methanosarcina mazei
atggaacagacatacgttatggtaaagcctgacggagtccagcgcgggctggtaggagagataatctccagaatcgagaagcggggcctgaaaatcgttgccctcagaatgaacgtcatcagtgaagccactgcaaaagagcattacagtgaacatgcagccaagccatttttccccggccttgtcggattcataacgtcgggaccttcagtttcaatggtagttgaaggaaaagatgcaattagagttatgagggctataaacggggctacaaatcctgtagatgcagctcccggaacagtccgtggggattttgctctggatgtaggcagaaatgtagttcatgcttccgattccccagaagctgctgcaagggaaattgcaattcactttaaggactccgaaatcgggaactattccaggattgacgaggtctgtctgtacgaa

SEQ ID NO: 34805 - DNA, 927 bp, Methanosarcina mazei
gcaacaaaatgtgtacatgccgcagaaaagccggatccgattttcggagcgcatacaactccgatattccagacttcaaccttcatttttgaaaacgccaggcaaggggcagcgaggtttgcaggagaggaatcaggatacgtatatgccaggattcctccaaacactcccacgcatgcggttctcgctgaaaaatttgctgcactcgaaggtggggaagcagggcagacatttgcctcgggaatggcagcggtcactgcaattgcattaaccgccctgaagcaaggagaccatcttatttcaacggatgtagtatacggatgcacctatagcctcttttctcaggttttgccagggcttggaatagaagtcagtttcgtcgatacttctaaaaccgaaaatgtaaagagagcctttaagcccgagacaaaaatggtctttcttgagagtcctgcaaatcctacgcttaatgtatgcgatattcctgaaatagccagaatagccagagaaaacgaggccctctgcgttgtggacaacactttcgcaacaccttatttccagaggcctcttgagcttggagcagatctttccctgagtagctgtacaaaatatattggcggccatgcagacctgcttggcggaatcgttgcaggaaataatgattttatagaccgaatgtctgaagttgttggatatacaggaggcattatgggcccgcatgaagcctggctctgcataagagggcttaaaacactccatatccgaatggaaaggcacgctgaaaacgcaatgaaggttgcggaatttcttgaatcccgacccgaggtagagtgggtcaggtatccagggcttccaggtcatcctcagtacgaacttgcacgcaagcaaatgagtggattcagcggtatgctctcttttgaagtaaaa

SEQ ID NO: 34806 - DNA, 1089 bp, Methanosarcina mazei
cgaatcaaaaagttctctcgtggtaaagaaactccatttttaactgttgacctgcagaagatagagcaaagctatgacgaacttgtagagcacatgccctttgcaaaaattcactatgctgtaaaggctaaccccatggatgaggttgtgcttgccctgaagagtaaaggctccaattttgatgtagcaacggtttatgaacttgatcagcttctcaggcttggggtagaacctgaaaggatcagttacggcaatactatcaaaaaagagaaagatatagagtacgcgtatgaaaaaggagtgaggctttacgttactgattctgacagcgatctgaaaaagttagctagaaaagcaccgggttcaagagtatttttccgtatccttactgaaagcgatggggctgactggcctctctcaaagaagttcggttcgcaccctgacctgatatataagctaattcttaaggctgaaaagctggggcttgagccttatgggctttcttttcatgttggttcccagcagagggatattggtcagtgggacaatgctatttccaaatgtaagtatctttttgaggcagcagctgaaaaaggtatacatctgaaaatgatcaaccttggtggaggctttcctgcaaaataccaggctcaggctcatgaccttgagacttatgctggagaaatccgccgctttttacatgaggactttggagaagagctacctgaaattattatagaacccggacgttccctggttgccaatgccggcataatagtaagcgaagttgtaatgatttccaaaaaagccagattcaaccagtacaaatgggtttatcttgacattggcaaattcgggggccttatagaaacccttgatgagtgcattaaataccctattttctgtgataaaaagggttgtgccgaagaagtaattcttgcaggcccgacctgtgacagcatggacatcctgtatgagcatcacaagtatacatttcctcacacaatgcgcgagggaaaccgtgtatatatctttacggcaggcgcctatacccagagctacagttccgtgtgctttaacggtttcccc

SEQ ID NO: 34807 - DNA, 712 bp, Methanosarcina mazei
  unsure (1)..(712): unsure at all n locations
cgccatatgcttggcatggatggtttggcccgtcacgaaatcggtgccattttggattctgcccaggcttttcgcgatgtcaattatcgtgagatcaaaaaggtccccaccctgcgtggcaagaccgtgatcaatctcttttacgaaaactccacccgcacccgtacctcttttgaactggccggtaaacgcatgagcgccgatgtgatcaacatctccgcttccagtagctccgccgccaaaggggagaccctgctcgataccgtggccaccctacaggccatgcgtcccgatgtggtggtgctgcgtcatggggattctggtgccccccactttttggcccgccatctggatgccggtatcatcaacgccggtgatggtcagcacgagcaccccacccaatcactgctggatctgctcaccattcaagaccacctggaagagatgggcaaaagcagctttgaagggatgaacgttgccatctgtggcgatgtcctacatagccgggtggcccgctccaacgcctttgccttgcgcaccctgggtgccaatgtgcgttttgttggccccccaacccttatgccctctgaagcgaccaaggtgtttggcgttacggtccaccataatatggaagaggggctgncggggggtggatgtgatcattatgctgcgtctgcaactggaacgcatgacctcggcctatctgcccagt

SEQ ID NO: 34808 - DNA, 876 bp, Methanosarcina mazei
ggacactacatggacagagtaatttccatcgtagggcatactgcccttgattacattgtagatgttgaaagaatcgcaggaaaaaatgagtcttctcctgtcattgactatgaagaatatcctggtggaggggctgccaatattgcggttgccattgcaaagttggggggaaagagccagctgatttcccctgtaggtacggattttgtaagttcaggatatgaaaaactccttacagaagcgaatgttgatctctcccgcctttatagaattgaggaccagaaaatttctaaagcctttattttcactgataaggaagacaaccagacaacctatttttactggggagcttcttcaaaattcaagaaattggaacccgaacctgtagattttgttcatcttgcaaccgctgactcggtgtataacgcgaaactcgcacaaattgccggcttcgtctcctttgaccctggccaggatcttgttacgtattcaaaagaaaatcttgaactcatacttgctcacactgacatcctttttgcgaacagacacgaaataaggcgagtttcagagatgaccggaaaaagcttctctgaactcaaggcgatgatcgacatcattgtggtcacatacgattccaagggtagcaagatctatacagataaaaatgaatttttaattcctgtaatctctgtccaggctgcagatcccacaggagcaggagatgcttacagggcaggtttccttctcgccctcacaagaggataccctcttcccacctgcggaaaaattgggtctacagtagcttcttttgctgtgcaggcacgaggttgccagacagaccttcccacctgggaagaaatgaaagcccgttatgaa

SEQ ID NO: 34809 - DNA, 1050 bp, Methanosarcina mazei
atagatgaagaaagggctacccggcaagttagatatgcaattgatcacggagtaaactatgtcgacacggcctggccgtatcacatgggagaaagtgagcctttccttgggcgggctcttgcagatggatatagagaaaaaattaaacttgctacaaaacttccttcctggacaataaatagtagaaaggatatggacagtatcctgaatgcccaacttgaaaggctcaggactgaccatatcgattattaccttgttcacgggcttgtaggacttttatgggacaaaatggaaaagcttgaagtgctgaattttcttgatagggcaaaagctgacggccgaattataaatgcaggtttctccttccacggatcggcaggggatttcaaacggattgtagatgcatatccctggactttctgtcagattcaatataatttcctcgatgaaaagaatcaggcaggaacggaagggcttgagtatgctgcttcaaaaaacctgggtattattatcatggaacccctgcgaggaggcaagctgacaaatcccgtacctcctgaagtacaggagatctggaatgaagctcctgtaaagcgcactccagccgaatgggcccttcgctggatctggaaccggcccgaggttacagttgtgctttcaggcatgaatgaagagtctcatattgaagaaaacctgaaaaccgcatctgaagcctatccaaactctctgactgaagccgaactgcagcttataaaaaaagcggaacaaaaatacaggaaacttatgaaaaccggttgtacgggctgtagatattgtataccctgcccttcaggcgtcgatattcctggctgttttgagatctacgataacttttacctgtcaggtaatgaaaaagaagcaaaacttatgtatgcggcaaagccagggggaataataagaggggatgcagcagggtatgcctcccagtgcgtccagtgcggacagtgcgctgaaaaatgcccacagcacctggatattccttccctgctcgaagccgtgaaggaaaaattt

SEQ ID NO: 34810 - DNA, 210 bp, Methanosarcina mazei
ttcttgaacgcagcaggagcaaaaccagtcggtgcaccaatagcaatcgcattaaccgggattgcgtccgcaatagctggaaaagatatcggtacagcagcaattggtgcaatggcagaaaacgaaggattattcggtaagggcttgatccttactgtcattccagaaaccattgttatcttcggtcttgtcgtcgcactgcttatcaat

SEQ ID NO: 34811 - DNA, 594 bp, Methanosarcina mazei
gtcaaaaaagcacttatccctgcagcaggccttgggacccgtttcctgcctgccaccaagtccatgcccaaagaaatgctccctataattgacacacctgtaatccactacgttgtagaggaagcaattgcctcgggaattgaggatattatcatcatcacaggtagagggaaacgagcaattgaggactatttcgatgattctcctgaactcgaaatgcaccttgcgaaaaagcataatactgaactccttaagcttgtccgggatgtttcctcactcgtggatattcactacatccgccagaaagaacctaacgggcttggagatgcggtccttagggcagaaaaccatattggagacgaaccttttgccgtgcttctcggggacgatattattgttaatgacaagccctgtacggctcagctcattgaaaattttgaaaaatatgggagatccacgctcgcagtggaagaagttccttatgaaaaactaagcagctatggaattataaaaggaaaaccactctgcgactccctttatatgcttgaggatatcgttgaaaagccgtcacctgaaaatgctccttccaatctg

SEQ ID NO: 34812 - DNA, 622 bp, Methanosarcina mazei
actgcagctatttctaccaaaaacctgtccaaaaaatacggctctcgcttagttctagaaagtctttccttgaatgtagaaaaaggaagtatttatggctttttgggccagaatggtgccggaaaaacaactacaataaaattactttcagggctttcaatacccacgcaaggacaaatttttgtttatggtatggacctgtcttccgaatcaggaaaagttaaacagattctgggcctggtaccgcaggattcaggcttttatgatgaacggacagccttaaaccatatggtatattacgggagattaaaaggcctgagtaaaaaagaaagcctggaacaatcaaggattttactgaaccaggttgggcttggaaatgagatgttcaaaaaagtaggctatttttcccatggcatgaaaacacgactaggaattgcacaggctcttttgaatagcccaaaagtactgattcttgatgagcctactaatggtctcgaccctgttggaatccggcaaatccgacaaattctttttgaatgcaataacaatgggatcacgatatttcttttcatccataatcttttgggaaatacgggagatttgtacttatgtaggaatctgg

SEQ ID NO: 34813 - DNA, 1059 bp, Methanosarcina mazei
ccgtgctgacagcttcaagaaatctttttccgaaagaaataccaccgtgagatcgttgcactggaagatatttcttttgaggtacaggaaggtgaaactcttgggattgtcggacaaaacggcgcaggcaaatcaaccatactgaagatcctttccggaattttgcttccagacaccggttcaatagagattggtggaaaggtcacaggcctgctggaactcgggactgggtttaaccctgagcttacaggtattgagaatatttatatgaacggaaccttccttgggatgcccagagcagagattgatgagaaaaaatctgagatcatggattttgccgaactgggagagttcatctacgagccaattagaacttattcctcaggtatgttaatgagactggctttttcagttgcaatacacgcagaacctaaatgcttccttgttgatgaggcactgtcagtaggggatgcatatttccagcaaaaatgcatgagaaaaatccttgaatttaaaaacacaggcgggtcaattatttttgtatcacatgatatgaatgcagtgaaaacactatgtgactctgcaatactgctggataaaggtcgtgttcttgagtacggggacccgaagagtattgttgattactattacgggatgatattaaagaaatcacatatgggagacactgaggttgaattgacgaaaatcgattccatagaaagaggaggtgcatcaagcacttcaacaggtgaggttagactggtatcttttaatattttaaatgaacgaaacgaaccgatctcttatattgagagtgaacagactgtaaaatttgtgtgtgaactagaaagcttaaaagatttttctgaccctcactatggactggcaataagaaataatcttggagtgtcggtatttgaaaccaatacttactgtatgggaataacaaactcaccattaaaaaaaggacagaatattaaaatcacttatgaaatgaagattcctttatcggctgggaactattctatctcgataggagtagcaaatagtggatatgat

SEQ ID NO: 34814 - DNA, 816 bp, Methanosarcina mazei
aaaaaatatgatgatttcgaggctgtgaagagtatttcgttcagtatcaaaaaaggaactatatttgggcttctgggcccaaacggagcagggaaatccactactattaagctccttacctgtcaatttcctccgacctctggtactgcatacattggaggattaaacaccgtattggatgcagtagagataaaaaagaaaatcggcgttgtttttgagtctcaaaacctgtacgaagaattatcggtttatgaaaatctcaactttttccgccagttatacaattctccgaaggaaagaataaatgaagttctgaagatcgtaggaatggaaaggtatcagaaaaacaaagtaaagactttttcaaaaggcatgaaacaaaagataatgatttctcgggccctgctcaatgatcctgaggttttatttctggatgagcccggaagcggattggacccacgttcagcaagggaaataaggcagatgattcttggtcttaaggaacagggcaaaacaatccttataacgacacataatatggaggaagcagattttctatgtgactatttggctatcatacataaaggctctataatagctatggacacacctggaaatctgaaaaaaaagtatggtaaagatgttttgatgatcaagactgtaaaaggagatatttacgaatcgccgctgaatacaaaagccagtagcgacatttttgagaaactctctgaaaataatcagatatcccttgtacattcaaaagaagctacaattgaagatgttttcataaaattaaccggggagaaattgactgat

SEQ ID NO: 34815 - DNA, 699 bp, Methanosarcina mazei
gggttagctctcaacaattcaagctattacgcagaggcattaaagtcatacgataaggcgattgaacttaactctcaggattcagctgcctggaataataaagggaacactctttctagtttatatgattacgaaggagcattgaacgcctacaataaagcagttgaaattaacccccaatactcagatgcctggtacaataaagggaatactctttgtagcttaggccgttatgaggaagcagtaactgcctttaataagacacttgaaattgaccctcataattcatttgcctggtgtaataaaggaatagctctgtccagtcttggtaattacgaagaagcaatgaaatcttttgataaagcactcgaaattgactctcaaaattcacttatttggtctaacaaaggactagctcttttcgaatttggtaagtatgaagaagcagtaaaagcttataataaaacaattgagattgatcaaagtaatacagaaacttggaataataggggatcagcatttttcttgataggtaactacgaagaagcgatgaaaaactacaataaaacaattgaacttgaccctgagtactcacttgcctggtataatcgtgcatgtttgtattctcttatcaatgacaaagagcagtcaatatctgatttgaagcgcgctattgaaatcaatccggcgtacaaagaa

SEQ ID NO: 34816 - DNA, 993 bp, Methanosarcina mazei
gaggaagcgataaaagctttagataaagccatagaagtaaaccctcaaaatgcagttgcctggtatgataaaggatcgattctcaaaaatttaggtaattacgaagaggcagttgaagcttttgacaaagcaactgaattagaccccaaaaaatcatctgcttggaataataaaggaaatgctctgtctagtttagggaactatgatgaggcaataaaagcatacgataaagcaatagaaattgaccctcaagatccaggtccatggaataataaaggaattgctctgtctaacttaggaagttacgaagaatcgattaaagcctttgataaggcaatagagattaacctttcaagttcagttacctgggccaataagggattagttctgtccatattaggaaattatgaaggagcaataaaagcttttgataaatcaatagaaattgatcctcggaattctattgcctgggttaataaaggaaatgccctctacaattcaggtgagtatgagggagtaataacagcctgtgataaggcaattgaactcgatcctaaaaacttagacgcctggaccaataaaggtaaagccctgtccagtttaggtgattatgaagaagcaataaaagcttatgataaagcacttgagatcgaacctcaagacccgctcacctggaataatagagaaattgcttttggtcatttaaacaattacgaagaagcgttacgagctcataatagagagatagtaagcgattccgaagatccagaagtctcatggaacgataaagggttagctctttactattcaggtaattacgaagaatcagtaaaagcctatgataaggcaattgaacttgacccagaatatgcggatgcctggttcaataaaggaaattctttttttagtttaaagaattacgaggaggcaataaaagcatatgacaaagcgattgaacttaaacctcaaaattcacttgcctggaataataaa

SEQ ID NO: 34817 - DNA, 609 bp, Methanosarcina mazei
atgggtcatcttatacttgtcaggcatggagaacctggattaaagccagaagaaaggcttgccggctgggtggatatttctctcagcaggaaaggaatcgaagaggctcttcagtgtgcagcagagcttgaaaagttcgaactggaccttgcttttgcctcaaaccttgtgcggacgcaggaaacacttttcttaatattgtccgggcagaagaaaacaggggttgttgtccatgaaagtacagggaagaaaggaaatccagggaaaacggactggtactcgtatcctgaaaagctcggtaaaaaacttatcccgatttatttcacaccttatttaaacgagcgctactacggtaagcttcagggcaggaaaaaacagaaaatggaagaaaaatacggagccgaaaaacttgcctcctggaggtggaactttcagccaggcccacctgaaggagaaagtctcaaagtcgtgtatgaacgtgcagtaccttatttcaaagagaaaatcctgcctgccgtaaaggcaggaaaaaacgtgctgatctgtgcccaccagggcagtctgagagctctggtcaaatatatagaagagatttccgacgaggatatc

SEQ ID NO: 34818 - DNA, 1131 bp, Methanosarcina mazei
agattaatcccaaaccagagcccacataaagagccaatgaacatggaaactaaaggtcttaaagacgttttcgataaagttttcaccgaaatacaccaggccagggaatcagtgaccccgacgcttactccgaaggaggtgggcagaatcttgacagtttctacaggtatcgcaaatgtatctggccttcctactgtaggttttgatgaacttatcaagtttccaggggatttgtttggaatcgcgtttaatgttgatgaaaaagaaatcggtaccgttctactgggcgaatactcacatctgcatgctggagatcaggttgaacgcactcaacgggttatggatgttgccgtaggcgaagaattgcttggacgagttattgaccctctaggtcgtccacttgataataaaggaccaatagtttccagtaaacgtttgcctatcgaacggcccagtccagcaattatggatcgagctcctgttaccgtgcctctccagaccggtgtcaaagttattgatgcgttaatcccaatcggacgtggccagagagaattgattttaggggaccgccagactggcaaaactgcaattgctatcgatactattcttaaccagcgcaattttaatgtcctgtgtgtttattgtgccattggccagcgtgcatccgcagttgccagagcagtggcaaacttaagggaaaggggcgcaatggattacacgattgttgttgtaactgaaggcaatgacccatcagggctaatctatattgctccttacgctgcgaccagcattgcagagtattttatggaagcaggccgagacgtgctgattgtttacgatgacctgaccaatcatgcacgagcctatcgagaactttcccttttacttcgtcgtcctccgggacgggaagcgtatccgggtgacattttttatattcactcgcgactgctggagaggtctacgcacctgctcaaagaacttggtggtggatcactaactgctcttcctattatcgaaactgaagcgcagaatatttccgcctatattccaactaatctgatttcaattacggatgggcagatttacttttcaccttcgctttttgagctgggtgtgctggctgcaggtgat

SEQ ID NO: 34819 - DNA, 1632 bp, Methanosarcina mazei
atttattctttacttgctcctcttttgatgttgatagaagtcttcatggaccttcaacaacccaggcttatggcaaatattgtggatataggtgttcaaaacagagattcgggatatatattatcgacaggcttcaaaatggtcctttgtgcgtttgccggattaattggcggcgcaggctgcggtgtgatcgcctcgtttgcatctatgatgttagccgggagtttgagagaagagttatttcataaaatacagtcgctttcctatacggaaattgaccatttcaaaacatcgtcgcttattacaaggctgaccaacgatgtaacgcaaattcagaatatgtttctcatgttgctgcgtggcatggtacgttcaccattgttgtgcatcggcggcatatttatgtcctttttgctgagtcccagtctttcaattgttttctttatcattttgcctattctcatcacttgcgtcgcatttgtgatgatgagatcggtgccgctttatacgcagatgcagttctggcttgacaaggttaataccgtcatgcgtgaaaatctgctgggtgtacgtgttataaaagcctttaatttagaagacaaacagaatacgcttttcagcaacgtgaatacaaaatttacagaaaaaagcatacgggcacagaacctgacctttacactgatgccgatagctactctggttatgaatctgagcgtggttgccatcctatggtttggaggcaatatggtcgtttccgaaaatattgaaaccggtaagataatggcatttgtcaattaccttgtgcagataacaaactctcttataatgcttgtcaacatgattataaacatttcacgcgcacaggcatctgcaggacgtataaaagaggttttagtctgtgaagcgagtattaaggagtgcaattctccagtattgccaaagaattatgacattgagttcaaaaatgtcagttttagatacggtgaaagcggagaatatgttctgaaagacttgtcgttcctatttaaggaagggcagacagtaggcattatcggagctaccggctcaggaaagagctcagttgtaagcctgattcctcggctgtatgaggcaacctgcgggcaggtcctgatcggaggttgtgatgttaaggatatgccagtacagcacctgcgcagtagtattggggtcgtgctgcaggaaaatattcttttccacggaacagttaaagaaaatatgaattttggtaatgaagaagcagacgaagcgaaaatatgggatggccttcaagctgctcaggcagaagattttattcaggccctcccttacaaattacaaagtcaagttgaacaaagaggcaaaaacttttcaggtggacaaaaacagcgcctttccatagcaagaactcttctgaaaaagccaaaaattttgattcttgatgactccacaagcgcagttgacctttctaccgaggcacgcctgcagtttgaaattgcaaaaaagatgaaagaaaacacggtaatcgtcattgcgcagcgtatatccggcgttatggacgcggacacaatattgatgcttgaccatggcagcgttatcgcgaaaggcacccataaagaatactggaaagaaaga

SEQ ID NO: 34820 - DNA, 1001 bp, Methanosarcina mazei
aagacaacgataaaattgaaagttgcagaagccgatcaacgggatgttgggaaaggcattgtccggataggtgaaagtttccgggaaaaactgggtcttgagcctttcgatgttatagaaatcaaaggggggaaatcgacttcagcccttatagggcgcccatacccgagtgattcaggacttgagattatacgtatggatgggtttatccgtactaatgcaaaaaccagtatcggggaatatgtagctatttgtaaagccgactggaaggaggcaaaaagcgtaatatttgcgcctgtagccagaggtatgcagatctatgctccaagcgaaactcttaaagccgtattcatgaaccgtacggtttcaaaaggggattttatttccactacaagtttaaggaaatcgagggaaagtgagacttttggcaaaggagttatgttcgaagatttcttccaggactttttcggccagggcttcgagccatctttcggacttggagaaataaaattgcaggtagtttctacctctccgtcggggatagtgaagattacagacttaacgcaggttgagcttttgtctgaagcaactgaagtaatccctgaacagaatattcctactgttatgtatgaagatctgggtgggctaaaagaagccattgggaaagtcagggaaatgatagagttgcctttgaatcaccctgaactttttgacaggctagggatcgatgctccgaaaggggtactgctccacggtccgcccggaacgggaaagacgctgcttgcaaaagcagtcgccaacgaatccgacgcctactttatttctatcaatggccctgagattatgtccaaatattacggcgaatccgaaagggcaataagggaaattttcgaggacgcagaaaagaatgctcctgcaattatcttcctggatgagatcgattccattgcccctaaaagggctgaggtgacggagaagtcgaaagaagagtgttgtcaatt

SEQ ID NO: 34821 - DNA, 648 bp, Methanosarcina mazei
ctgttgcctgtctatgataaaccaatgatattttatcccatccagactctcgttaacgcaggcatcaaagaaataatgatcgtatccggtcgaggtcatgccggacattttcttgagcttctgggttcaggtgcagatataggggttaagtttacttatgaaattcaggaagaagctggagggatcgcacaggctttaggtctcgcagagcgttttgctgatgaagaagatgtggcagtaatccttggggacaatatttttcaggataacattaaagatgacgtctcaaactttacagatggtgccaagatattcttaaaagaagtccaggatgcccacaggtttggagtagctgagcttaaaggtgacagggtaataggaatacaggagaaacctcgtgaacccaaaagcaattttgcagttaccggtctttatatatacagtaatagtgtattcgaagtagtcaaaacccttaagccttctgcgcgaggagaacttgagataactgatgtcaataattattttgtaaataatgggactatggaatatcgaattctggacggtttctggagtgatgcaggtacttttgagagtttattgagagcaggggtactgatccagaaccattgtaaaaacaaaaacgcggag

SEQ ID NO: 34822 - DNA, 876 bp, Methanosarcina mazei
tcaggaaaggtctccaggaaaattgccgcaaaggaagaactgcttcttattctcccgaaaatagacagagttttggagtcagaacctgccgtgcttcgaattgacgccgaacctataatgattattggggatattcacggggaccttcaggcccttgaattcataatagaaaaaaggcaagaaataaactgtaagaatattctttttctcggagattacgtggacagaggacctcaaggtgtcgaagtacttacaagagtttttcgactgaagcttgaagagcctgagcacatattcttactcaggggaaatcacgaaactgtggatatgaacctctactatggcttttttgaggaaatcggtttcgatcagggttttcttctaaggacaagccggacatatgataaaatgccgatagcagctgtactttcggagcatacattttgcgtacacggcgggattaacggaaccggcagcattgacgacatcaggaaggaagaagcctttgcttttccttatctctggaatgatccttcgaaacaccctggactcaccgcttcaacccgaggctcgactgtaaaagagttcgggccagatattgtagatggctttttacagacaaataacctgaaaaggattataagaggccatacagcccttgaaaatgggtacagatggtggtttgatgggaaattgctctctctattttcctgccctgactatgttggactagggaatgcggcggcttttgcgctatttgaaaaagaagagattaaacttttcgtctttggaaagcagtaggaataaaagaaaacttactcaaaagaaagcttacccaaaggaagactatcaaaagaaagcttacccgaaggaaga

SEQ ID NO: 34823 - DNA, 842 bp, Methanosarcina mazei
attgaagagtgggaagaatacagatatgtcgaatcaggaataaatagcttcattgatcaaatggacgaatccagcttaaaaaaaatggcagaacatgtctgtaataccggaggaaagcgaattagaccaatcatcctccttctctccagtgagatctgttcaggttcgtaccaacagagcctcaatgcagctcttgctattgaattgatgcactcggcttccctcatccatgatgacctgctggatcaggggcttgttagaagaaatctgccttcagcccctgaaaaatttggcccttctagggctcttctttgtggcgattacctgattgcaaaatgctttgagtttatttctccatatggggagaaagtagtccgagacttcggaaaagccgggatggatatggctgaaggagaagttcttgatctgagactcgataaggacaatttcggagaaaataactatttcgaatgcatttacaagaaaacggcctctttatttgccattagcgcttccataggggcatacactggaggtgctgatgaagttctggccgagcgttttaatttctttggaaattgcctgggaactgcataccagattgttgacgacattcttgagtttcttgaagtggtcgaaggcaaggaatcgaaattcacatctgaaactctgccgcatgtttacatgaagaatatgtcaaggaagaagccatagaaaaatctacagatgctgtaaagctgcgtgttaatgccgcaaaagatgccctgttgacatttaatgaatgtccggcaagggaaaaactctttcagattactgattatataactgttgatatgcttgag

SEQ ID NO: 34824 - DNA, 921 bp, Methanosarcina mazei
ttgaaaactaaaaatgtagtagtcacaggtggtatgggtttcattggttcccatcttactgagaggctacttgaagataatgaagtaacagttattgataacgaatctacaggtaacattgaaaatataagacatctactagaccacgaaaatctaactgtaataaaaggcagtatagtagacttgaatttaacagaaattttcaaagacaaggattatgtttttcatcttgcagcaattcccagtgttccaagaagtgtaaaagatccttttagttcaaataactctaatatcacaggaacactgaatgttctgacagctgcaaaagatactggaattaagaaattaatattttcttcttcctcttcggtgtatggcgatacgccaactctcccaaaaagagaagatatgcccataaacccaatgtctccatatgcaattacaaaagcaaccggagaaatgtactgcagggtttttcaggatctttatgatctgccaacagttagtttaagatatttcaacgtttttggccctcggcaggacccaaattctcaatatgcagctgtaatcccaaaatttataactgcaattctaaacgatgagagtcccgtgatatacggagacggagaacaaagcagagacttcacttttgtcaaaaaagttgttgatgcgaatattctttcctgcgagtctaagaaaactggagttttcaatatagcatgtggtagaagaattacaattaatcagttagtcgattacgttaatgaaatactgggaaagaaaataaaatcgatacatgcagaaccaagaccaggggatattaagcactcattagcagatatatcaaaggctaaagaattcggatataatcccattggtaattttagggatgaacttaagacagtagcagaatggttcctg

SEQ ID NO: 34825 - DNA, 474 bp, Methanosarcina mazei
aaaatccgcgccgcagaaatagaagatgtccccttgattcttgagttcgtcaaaggcattgcaaagtttgaaaacctttcccacctggtcgcagcgacagaagaaactctagcagaggccatgtttggaaaaaagccctatgctgaggttttctttgccgaactggacggggttcctgccgggtttactgtctttttccacaatttttctacttttgtgggaaagcctggactctatatcgaggatatttttgtaaaacctgagttccggggaaaaggaatcgggaaagcaatgtttctccattgtgtaaagcttgcaaaagaaagaaactgtggaagaatggaatgggcagttcttgactggaaccctgcaaggaaattctacgaacgtcttggaggaagctctgcagatgggtggcagatctatcgcatggacgaggaaaaatttgaaagcgcgtttgaaaaataataaatt

SEQ ID NO: 34826 - DNA, 1737 bp, Methanosarcina mazei
ctgtggcattcactgggagcagaagagatatttagaaaacttgcttcatcatcgaggggcctggacactgaagaagcagccacaaggctgcatgaatatggaaaaaatattcttccaacacgaaaacctccaggacttgcagaaatagtttttcatcaatttaaaagccctttgatttatattcttcttattgcaggaattatctcagtgcttctaaatgacttgagagacgcaggattcatttttcttgtagtagtaataaatgctgtaataggcactatacaggaatggaaggctgaaaagagcgcatctcaattgcagaccattttaaaaattgtgtctcgggtcaggagaaatggatctgagattcagattccagcagaggaaatcgttcctggtgatatagtcctgctcgaatcagggagccgaattcctgccgatcttcgtattctctatgcctccaacctcacaatcgatgagtcgcttctcactggagaatctgctgctgtagagaaaactgtggacatcctcgtagaggacactcctgtgagtgatcggggcaatatggcatatgcaggaagtactgtaattacagggcgtggttgtggagctgtaactgcaaccggaagccggacagaagtcggtatgattgcgcgggcggtcacagagaccgaatctgcaaaaccgcctttgctcattcgcatggaagacttttcccataaaatcggaatcgctgtaattgcagcaagcgttgtgatgagtgcagttgccctctcgcaggggattgcgcctgttgaggtttttttccttgcaattgccctgatagtatccgcaattcctgaagggctgcctgtaggggttacagtagcactttcaattgcgtctacaagaatggctaaaagaaatgtaattgttaggagtctttctgcggttgagagcctggggagctgtactacaatcgcaactgataagaccgggactctgactgtcaaccagcagacagcaaaaacggtagtattgccttcgggagacctgtttgaagtttcaggagaaggttatcttcctgtcggccagatcaaaaaaatagcacaaacaaatgaagcttctccgtcggatgacgaagagatggagagcttacgaaggcttgcactggcggctacaatttgcaatgaaggcactctatacaaggaaggtgagacatgggttcaccatggagacgccattgacattgcatttcttacgctggcatccaagctgggaatcgatcaggataaggtcagaaacgaagtaaaaatagtcgccgaagttccgtttgaatcagagagtatgtacgctgctgtgtattatcgggagaataaaagtggacctataaagatagctgtcaagggagctatggaagctatccttccgtactgtacaaaaatgaattctctgagaaaagttgttccaactgatcccgatttacttaatagtgaacttaattccctgatggaaaatgggtatcgtgcgcttgtagtagctgagggtatagtctcagaggagacaaatggtgcttttgatctcaaatctgtaaatccagagctcacgtttctgggcatcgttgggtttatagacccgttgagacctgatgtcaaagaagcagtccagacttgcaaaaaggctggaattgatgttataatgattacaggagatcatccgaagactgcatttgcaatagcagagaacttggtatagcat

SEQ ID NO: 34827 - DNA, 1032 bp, Methanosarcina mazei
cttttacaaaaaattttggatggcgatgtagctctccgcaagattgaggaatttgcagaccctgaaacttcagtaaaactcagacggctggcaatacaggaatttgcaaaacttgaatttgaacatatccaaaatttttcccttgatgttgaagccgcatcgaaaaggaatattgaaaacatgataggggcagttcagattccccttggaattgccgggcttcttaaggtaaacggagaatatgcgaattctgaatactacatcccacttgctacgactgaaggagctcttgttgccggtgtaaatcgcggctgttcggttatcacgaaatcaggaggagcaaacgtcagagtctttgaggatgagatgacaagagcgcctgtttttaagctggaaagtcttagcagagctaaagaattttatgaatgggtaaaatgtcctgagatttttgaaaagatgaaagtcgttgctgaaaaaactacacgctttggaaaactgctttctgtaagacccttcgtaaccggcacatacgtatacctcaggttctcgtatgatacaaaagatgctatgggcatgaacatggtgactatagctactgatgccgtgatgcacctcatacaagacgagttcggagcgcatcctgttaccctttcaggaaacatgtgtatcgacaaaaaaccggcttcaataagcacaattcttggaagaggaaaaacggttgtagccgaagttacgattccaaaggaaattgtaaaggagaccctgaaatgtacgcccgaatctatgtttgaggtaaattatagcaaaaacctgctgggttcagcaagagcaggagcacttggtttcaatgcacatgctgcaaacattattgctgcgatctacttggcctgcgggcaggatgccgctcacgttgttgaagggagcactgcaattacaagcatggagcttacaaaatatgaagaaattcaatgttctgttactctgccttccctggcttgtagaaccgtttggggaagctttggcttggaaacc

SEQ ID NO: 34828 - DNA, 894 bp, Methanosarcina mazei
ctaatcaagaaatttggttctcttactgcactcaatgacattagtttctcagttggtgaaggagaaacatttggttttttgggtcccaatggggctggcaagaccactaccattcgtattttgactggagtttcgagaccaacatctggaacagcaactatttttggccatgatattgagcatgacactattgccgcgcggcagtcaatgggtatagtgtccgagaattcaaacgtttatgatgaccttacagcatggcagaacatgatgttttctgccgaactttatcatgtgggacggaaggaaagagaaaaaaaggcaaatgaactgctcaaaaagtttgaattatacgaacgtcgaaacgataaagcccacggtttttcaaaagggatgaaacggcgtctgacgcttgcaatgggcctggttaatagcccgcgtttgttgttcctggatgaaccaacctcggggctcgatgtacagagcaatcttattattcgggaagtggttgacgatctagttcttgagggtgtcacggtttttttaactacacacaacattgaggaggcaaatgttatgtgtgaccgggtagcgattatcaataaagggtatatcgttgcaattgatgctcctgagtccttgaaaaagactatgcagagtgtgcagtcgatagaggtctcttttgatcataattcggcagatcgtcttgacgagcttagccgtctttcaatggtaaacggagtacaaaaagcaggtgataagtttaagctatatactgaagatccctctgaggttatcaatgccgtaatggcttatgctcacacgcataaccttaaagttgtcagtatcacaactcttggcccaagtctggaagatgtatttatacggttgacaggt

SEQ ID NO: 34829 - DNA, 651 bp, Methanosarcina mazei
attgaaattaaagatctttcaaaggcatacatgccggaaaaacccgtgctttcaggaatcaatctcgagtttcgacctccttccattgtgggattaatagggccaaacggggccggaaaaactacctttatgaaagttcttgttcggcagctccttgcatcgaccgggtcaataaaaattgacggaacggacataagcaaaagtgaaaattatctcaagaaccggcttgggtacctaccccaggaatttggcctttatgaggaactaaccgtataccagttcctggattatatggcgcttttaaagggtctaggtcgtgaaaaaaaagagcggattgaaagttgcatagaaaaaaccgggctctccgaaaagaaaaattccagaataaggactctttcaggggggcaaaagcaaagagttggaattgcacaggctcttttgaatgatcccgaacttcttattgttgacgagcctactgttgggcttgacccggctgaaagggtaaggttccgaaatcttctggccgaaaatgcgaaccacaggcttgtgcttctctcaactcacattattgaagacgtggaatcgatttgcaaccggctaattgtcctgaacaggggtgaaatcctctttgacgggaatcctgtagaactg

SEQ ID NO: 34830 - DNA, 935 bp, Methanosarcina mazei
aaaaagaagtgtacatgtgacgccgcaattgacgaactgcttccggtagcccatccagaggaactatataaagcttctcgctacctggtagacgcagggggaaagcgcctccgccccgcagttcttattctggcagccgaagctacaggctcggacctcaaatcggttttacctgcagcggtggccgtggaacttgtacataatttcactctgatccatgatgacataatggataaggatgacatccgtagagggatgcctgcagtccacacgatatggggtgatgccggagcgattcttgcaggtgacactctttatttaaagcttttgagatcctgtcaaaagttcaaaatgagccggcaaggattttaaaatgtatggatgttatttcaaaaacctgtaccgaaatctgcgaaggccagtggcttgatatggattttgaaaagagggaaaaggttagtaaagctgaatatattgagatggtggaaaaaaagacctcagtcctttatgcagctgcagccaagatcggagctcttcttggaggagcttctgatgagattgctgcagctttatccgagtatgggcgctttatagggattgggttccagatgtatgatgatgttctggatatggtcaccccggaagaagtgctcggtaaagtaagaggcagcgaccttatggaaggaaaacatacccttattgtaatcgacgctttcgaaaaaggtgtgaaactggacattttcggaaaaggggaagctactcaggaagaaaccgacgaagccgtccggattttaaccgagtgtggatcaattgattatgtaaaggaccttgcaatttcatatatcaatgaaggcaaagcaaaactggatgtcttgcgggactgcccggaaaaagagcttctccttcagattgccgattatatgatctcaagaaac

SEQ ID NO: 34831 - DNA, 1274 bp, Methanosarcina mazei
atgttattcaaaaagttgtctgatgtttcggaagctgaaatgcagaaattgctctcccggggttccgggcttgaggacgtagcaaaaaccgtttcaaccgtgctttcggatgtgcgtaccaaggagattccgcgctcagggaatatacggctaagttcgataaagttgaacttgcaaactttggggtaagtgaggaggaatttcaacaggctctttccggcataagtccagaacttctggatcaccttaaatccgcagctgcaaacatacgggctttccatgaagctcagcttccgaaagctacctggtttatggaactcaaaccagggatcgtgctgggtcaaaaggcaacacctctggaaagtgtaggtgcgtatgctccaggagggcgggcatcctatccttcaaccgtgctcatgactgtaatccctgccagggttgcaggtgtagagcaggttatagtgtgtacgcctccaaggccggatggctccgtacacccgcttacacttgccgctgcaaaggttgcaggggcggacaaagtgttcaagcttggaggtgtgcaggctatagggtcaatggcttatgggactgaaacagttcctaaggtggataaaatcgtagggcctggaaatgtttttgtcacagctgccaaaatgcagatcagggatgttgcagaaattgattttccggccggcccaagcgaagtactcattattgcagatgagtccgcagatgccgttatggtcgcctcggatattcttgcacaatccgaacacgatccaaattcggtttcgatactcgtcacaggttcggatacgctggcagaagctgtaaaaagagaggttctggttcaggcggaacaggctgcaagaagcagtattataaaatcttctcttgaaaatgccgcaattcttattgcagattccctggaacaatgtattggctttagcaataaatttgctcccgaacaccttgagataatggtagcggacccggattttgtacttgacaggattaaaaacgcaggatcgatttttataggaaactattctcctgtccctgttggggattatgcctcaggtacaaatcacgtgctccccacatctggatatgccagagtttattctggtctgaatataaaccattttattaaatactcaagtattcagagaatcagtaagagtgggcttgaaagtctaaaagaaactgtaatcgcattagccgaggaagagggtctacaggcacatgctgatgctattagaactcgttttggg

SEQ ID NO: 34832 - DNA, 1473 bp, Methanosarcina mazei
gaagaaattaatttgagagttgctgaagcttatcataaggacgtgggcaggggaattgcaagaattgacactcgcttgatgcagcagatggggcttgtaagcggggacataattgagatttcagggagagcaaagacctatgcaattgtctggccaaatgtggagcgtgaacaggaaaatcggatccggattgacggaaacttgcgcagtaatgccaaagttgggattgatgacaggttacaatccagaaagtccaggcaaaaaacgctcagagagttacccttgctccttctcagcctgtaagacttgttggaggggctcactacatccttagaattattgaggggagacctttgaacaaaggtcagcagatcagggtggaaactgtaaataaccctttgactttcgtagttgcatctacaagacctgcaggacctgttgttgtcactaaagatactgatatcgtcatcaaggaaaaatcagctgaggagatccgggttccagaaggcatttcatatgaggatatcggtgggcttagaagggaaattcaactggtcagagaaatgattgagttgcctttgagacatcctgaactcttccagaagcttggaattgagccccctaaaggtgtactgcttcatggacctccaggcacgggcaaaacactgattgcaaaggcagttgcaagtgaaaccgatgcaaatttcattactattagcggtcctgaaatcgtttccaagtattacggagaaagcgagcagaagcttcgcgagattttcgaggaagccgaaaaggaagcaccttccatcatctttatagacgagatcgattccatagcccccaagcgcggtgaagtcacaggcgaactggaacgcagagtagttgcccagttgctctcacttatggacgggctaaactccagaggcgaagtagttgtaattgctgccacaaaccgcccgaactcaatagatgaagctctccgccgtggcggaagatttgacagggaaatagaaatcggaattcccgatcggaatggcaggaagcagattcttctcattcacaccagaggtatgcctattcaggatgtaagccttagtgaaattgcagatgtaactcatgggtttgtaggcgctgatctgtcttctctctgtaaagaagcagcaatgcatgctctcagaaggataactcctgaaatcgatatcgaagaagacgaaattccacaggaaattcttggataaactagtggtcaccaaagatgatttcaaggaagctctgaagaatatcgagccgtctgcaatgagggaagtttatgttgaggttccgatgtaggatgggaggatatcggaggactggaaaatggaaagcaggaacttattgagggtgttgagtggccttaagtatcctggagtctttaagattatattaaaatccagaggggtttatatttgggcgccggtaggaaaaatttgaagg

SEQ ID NO: 34833 - DNA, 1866 bp, Methanosarcina mazei
atccctctggtggctgttgaaactgagccttcaaaacacaattgtccttgttacggaagaaacacttatcgaacttcgcaagaagccggtacagggctacgaaaaagcaacccgaggcgtaaccacctacgaagacataggaggcttaggggctgagataatgcgcgtccgggaaatgatagagttgcctatgaagcatcctgaacttttcggtcacctgaatattgagcctctaaaggagtcattctctatggcccacccggaaccggaaaaaccctgattgcaaaagccgtagccaacgaatccggggcaagtttccattacattgccggccctgaaattgtaggaaaattctatggagaaagtgaagaaaggctaaggaaaatcttcgaagaagcgactcaggatgctccatctgtcatttttattgacgaaattgattcaattgctccaaaaagagagaatgtaacaggggaagtggaaaggcgtgtggtcgcccagctccttactctacttgacggaatggtagaaagaggtcaggtcgtggttataggagccacaaaccgtgtagatgcgattgaccctgcactcaggagaccaggccgctttgacagagaaatccatattggtgtgcctgataccaaggataggtatgaaatcttgcagattcataccaggggtatgcctatagaaagagatgaggaaaccgaggagatcggaaaagtcgaaaccgaagctgatgaggctgccctggagagggaaagaaaagaaaaggcagataaatatctgatgtatctggctgaaagaacccagggatttgtaggcgcagatctgctggctcttgtacaggaagctgccatgcggtgcctcagggaaaatcttcctgaccttgaccttgaaaaggaagcaattccacctgagaggctggaaaaaatcgttgtaaccaagaggaactttgaagatgccttgatggaggccgaaccttcggctctaagagaaatttatgtggaaatgcccacagttagctggaatgatgttggagggctcgatgaagcaaagcagtccattactgaggctgtggaatggcccattaaaaatccagaaaagttctctcacatgggcataaaagctccaagaggaatcctgctttacggcccgccaggaaccggaaagactctgatagcaaaggctgttgccaaagagtcaaatgcgaactttataagcgtcaaagggcctgagattttctcaaagtggcttggagaatcggaaaaagctatcagagagaccttcaggaaagcccgacaggttgctccctgtgtgattttctttgacgaaatcgattcgattgcttctatgccagggatggaatctactgacagtcacacttcagagagggtgcttaaccagctccttaccgagatggatgggcttgagtcccttagggatgtggtagtgattgctgcaaccaatcgccctaaccttctggaccctgcgatcctgcgtccaggacgttttgacaggctggtttatattggttctcctgataggaaaggaaggctcaagatcttcaggatccatacaaaagatacaccccttgctgaaaatgtaaaccttgaaactcttgccgatgaaactgagggttacgtgggagccgatatcgaatccgtttgcagggaagccgtaatgattgccctgagggaaaacttcgatacagaatatgtagaaatgagacacttcagagaagcgctgaagaaggtaaaacccacaattacggagaatatcgctcagttctacgaaaaaatcgaggcacagttcaagggaggtcagagactcacagaaacagctggctacatcggttacaggtaa

SEQ ID NO: 34834 - DNA, 1136 bp, Methanosarcina mazei
ttattcggaactaatggtgtacgtggtatcgccaatgaatatataattccagagctagcagtcaatttagccagaagccttggtacatatatgggttcaaaaggcacggttgctgtaggctgtgatactcggatttcaggtcagatgctgaagtctgccgcaatcgctggggctctttcaacaggtctgaatgtaattgacgtgggaacgcttcctactccttctattcagtactatgtgcgcgatcacgccgatgcggggatcgttattactgcgtctcacaacccaagacaatataatggaatcaagttaattgctggagatggtacggagttccccagggatggagaaagagagatagaaaaaatttactcctctggaaaatattccattgtatcttgggagaagactggaagtttcagggttgatccaggagttaacgactattatatcagaaatgttatcaatgcagtagatgccgaaaagattcgcagccgcaaactcaaggtagtcattgatacaggttctggagcaggttcactcactctccccttcctgctcagagaactgggttgcaatgtgctgactcttggagcgcaacccgacgggaccttcccctggcgaaatcctgagccaacacctgatgctttaaccgagctttccaacttgtgaaaataaccggtgccgattttggagcagctcacgatggagatgcggataggatagtctttatagatgaaaatggcgaattcttaaatgaagaggttctgcttgccatgatggcaaaatatatgcttgaacgcgaaaaagggcctatagtaactcctgttagctcctcacagcggatggccgacgtagcaaaagaagaaggtgttgagctttactggacagcagttggctccatcaacgtcgcccgaaagatgatggaagtaaatgcagtcttcggaggcgaaggcaatggaggccttattttccccaaacatcaatactgtagggacggagcaatggcctgtgccaaaatccttgaaatcctggctggcgggaaaaagctttccgagcttgctaagagtgttcctcagtacttcaacgcaaaaaccaaagttccctctgtaaattcgcaggccacaatagaaacg

SEQ ID NO: 34835 - DNA, 1134 bp, Methanosarcina mazei
tatgaaaatcatttctttagtccctaaatcggcaggttccagatgagcagcatacaggagcaaatacaggaaatcgaagacgaaattcgaaagacccagtacaataaagcaacttcccatcacataggccgtcttaaagccaagatcgctcgcctgcgagatgagatcgagaaaaaagcctcggcaagaggaggaggggaagggtactcggtcagaaaatcaggagatggaactgtaacacttgtaggttttccatcagtaggaaaatctacgcttctgaacaaaatcacgggtgccaattctgcagtgggtgcatatgagtttactacccttacagttgtgccaggagtgctggaacataaaggggcaacaattcagttccttgatgtcccagggcttgtaaaaggcgcttcttcaggacgtgggcgtggaagggaagtcatatcagttatcaggaactctgatatggttatatttttgcttgatgtcttccagccaaagcattacgatgtacttatggacgaactttatcaggccggaattcgcatagaccaggagccccctgatgtagtaatcaagaaaaaagaacggggcgggatagagatcaactcaaccgttgaccttgacctggatgaggaaactatcaaggctgtgctggatgagtataagatccacaacgcaagtgtacttataagagataacataacagttgaccagcttattgacgttgtcctggacaaccgcagctatgtcaggtctctaatagctgttaacaaggttgaccttgcctatccccaattgatcgaagaatgcagaaagctataccctaacgcgatctttatttcagctcatgagggcataaatatcgagactctcaaagactctatttacgacaggttgggtttcattcgggtctacttaaaaccacagggccagtctgcagacatggaagagcccctgatagttatgagcggaaccaatataggccagatttgcgatcgcctgcacagggatttccgcaggaagttccgatatgcccaagtctggggtgactctgcaaagcacccggggcagagagtaggcattgatcatagaatgcaggatgaggatattcttacaattatcatccagaag

SEQ ID NO: 34836 - DNA, 665 bp, Methanosarcina mazei
atactctcagtccagtcactcacaaagaaatttgatgattttacagctgtaaaagatatcagtttcaatgttgaaaccggctcgatctttgcttttctcggtccaaacggggcaggtaagtccacaactatcaaaatgctcacaactgttttgaagcccacatcaggaaaaataagcattaacggtttcaatgcacttaaagagcaggacaaagcccgtgcatctttcgggatagtctttcaggactccagccttgatgaagaactgactgcttacgagaatattgtttaccacgcagtcatctataaggtacctaaaaaggaaagggacgaaagaatccgaaaagcctggaaattgtcgggctctggaacaggcgggaagactatgttaaaaactattcaggcggcatgaagcgcaggcttgagattgcgcggtcgcttgtccactaccctaaaatccttttccttgacgagcccacggtaggccttgatcctcagactcgaaactctatctggagccatatcaggagcctgaataaggaaaaaggaatgacaatttttctgaccacgcattacatggaagaagccgaagcagttgcagaccagattgcaatcattgaccacggaaaaattatagagtccggcaatgttgaagaaataaagaaa

SEQ ID NO: 34837 - DNA, 1252 bp, Methanosarcina mazei
  unsure (1)..(1252): unsure at all n locations
cttatggacgggcttaaggctcgcaagaatgtaatcgttatagggtcaaccaaccgtcccgaagccctggaatgtagcactccgccgcccaggcaggtttgaccgagaaattgaacttagagtcccggatactgatggaaggctagaaattttccagatccataccagngggaatgcctcttgccgaaaacgtaaacctcatggattttgctcaaataacatacggatttgtgggagctgatattgctgccctatgcagggaggcagctatgagtgccctgcggagggttttacctaaaatcaatcttaatgaacctgaaattccagctgaaattctggattccctccaggtaataagagaagattttgaaaatgctctcaaagatgtccagccttcagcaataagggaaatcctgatcgaagtgccaactgtcggttgggacgacgtaggcggtctggaagaagtaaaaaggctcctgaaggaggtagtagaatggcctctcaagaatccggaatcttatagagatattggggttgaggctcctaaaggggtccttctgtatggccctccgggtacgggaaagactctgcttgcaaaggcaatagctcatgaatcggatgctaattttattacagccaaggggagtgatttgctttccaaatggtacggggaatcagaaaaaaggatagctgaggtctttacacgggcaaggcaggtagctccttcaattatttttctggacgaacttgactcgcttgcgcccattcgcggggcttctataagtgagcctcaggttacggcaagaatccttaatcagcttctctccgaaatggacgggcttgaagagctcagggctgtagtagtaattggtgcaaccaatcgcccggacgttatcgatcctgcacttatccggcccggacgttttgatgaactgattctcgttccgatccctgatgaaggagctcgcagggagatcttcaaagtccacaccgaaaaaatggaacttgcagaggatattgatatcgannanaagcttcgtttgctataaccgatcagtacacaggtgcagacattgcagctgtatgtaaaaaggcaggaaggcttgctctgcgtgaggatattcacgcaaaaaatgttaagcagagacacttccttaaagcaataacagaaactgggccttcagtaactccggatacaatgaaatactacgaggctataaaaggcgaactcaggacaaggaaatctaaggaa

SEQ ID NO: 34838 - DNA, 771 bp, Methanosarcina mazei
  unsure (1)..(771): unsure at all n locations
cccggaaagcgggttttaacttacagggcccgttacgaaatgaggaaccaccgtggtggagccagtttttcagctcgggaaacaatagncaggttnacaggtggagcccttgcaaaactcctgctttccagattcggaatcctaattgctggacatgtgcttgaactcggagccctccgcgcaaaacctctttcttttgaagaaattcttgaaaatgtagaaaagacccctgtacgctgtgccgatcttgaggctgctgaaaaaatgcttgagaaagttgcggcccttcggcaggaaggagacagtatcggtggcattgtcgagcttattataagaggtgtgcctgcaggccttggagaacctgtctttgaccgactggatgcagaccttgcaaaagctctgatgagtattcctgccgtcaaaggctttgaaattggggccggatttgaagctgctcgcctgtacggtagtgaaatgaacgatcctttccgaataaaggaaggaaaaataaccacttcaagcaataacgcaggtggaattcttggaggtatttcaaccggattggacattgtctgcagggcagcagtaaagccaactccgtccataggaaaagttcagcagacagttgacctcaaaaccctggaaaatactgaaattgcaataaaaggccggcatgatcccacaattcctccgcgcatggttccggttgccgaagctatggttgcccttgtgattgctgatcatatgctcaggagcgggtttattaatccg

SEQ ID NO: 34839 - DNA, 2397 bp, Methanosarcina mazei
ataggggaaaatgtaaatctcaaaatcgatgaaatcaaggattcgcctgcggatgaagtcctgaaaaaccttaattcaagtaataagggactttcttcatcggaagctgaaaaccggattaagcagtatggttataatgaaatttccgaaaagaaaatcaacccgcttataaaatttttcagttacttttggggtccaattccctggatgatcgaagcggcagctgcaatttcaggtgtcattcatcgatgggaagactttgtgataatctccttgctcctcatcttaaacgcggttgtgggattctggcaagaacataaggctgacaatgccattgagctccttaagcagaaaatggcccttaatgccagggtacttagagaaggacaatgggcccaaatacctgcacgggaattggttccgggagacattgtacgcatacgttcaggggatgttgtacctgctgaccttaagctccttgaaggggaatatctgcaggtagacgaatcagcccttacgggagaatccctgcctgtagagaaaaaatctgatggcattgcctattcaggatctgtgatccagaaaggtgaaatgaatgctctggttgtggctacgggcatgaatacctattttggagcaacaacaaaactggtggccgagattcggaccaggagccactttcaaaaagctgttctcaatatcggaaactacctgattgtccttgcgggctgtattgttgcaattgttttagttgtagaagagcttttcaggcacactccttttctggaaaccctccagtttgcgcttgtgctaatagtcgctgcaattcctgcagctcttccagcagtaatgtccgtttcaatggctgtgggagccactcaactggcaggtaaaggagctatcgtcagcaaactggtctccatagaagaaatggcaggaatggacattctatgttcggataaaaccggtacaattacccagaacaagctaaaattatccgagttggtgcctttcggagactttaaagaaaacgaccttctgatctatggatctctggcttcaagggaagaggacaatgaccctattgacaatgcaattctccagaaggcaaaagacaccgaatcccttgaagacaaaataaaaacttatacagtcaagaaattcacgccatttgaccctgtcataaagcacactgaggctacggtaaaagggtcagaaggagagtttaaagttgccaaaggcgcaccccaggttattctgggcatgtcaagcaataaagaagaaataaggcagaaagtagaagaaaaagtaaattctatggcttcaaaaggatatcgtgccctgggggtgtgtgcagaagaggaaagaaaatacaggtttgtagggctctttggactttatgacccaccgcatgaagattccgctgagacaataaagacagcaaactcccttaacgtagatgtgaaaatggtaactggagaccacgttgccatcgccaaagagatagcaagccaggtaggtctgggcacgaatataattacagcagatgattttaaagaaaaatccgattccgaagcccagaaagttgtagaaaaagcagatgggtttgcccaggtttttcctgaacacaaatacaagatcgttgaactccttcagaaaaaagaacatattgttggcatgacaggtgatggagttaatgacgtccctgccctgaaattggctgatgcaggaattgctgttgcaggggctacggacgctgcaaaatcggctgcagacatcgtatttacaagtccaggtctttcgataattattaatgcaattcaacaaagccgcatgatatttcagaggatgaagagctatgctatctatcgaattgccgaaactatccgggtacttttttttattgccacttcaatacttgtgctagatttttatcccataaccgccatcatgatcgttttgcttgccattttcaacgatgttcctataatgactattgcatatgacaaagtgaaatattcccagaaaccagaagaatggaatatgcgcgaagttgtgaaggtggccacatttctgggagttataggtgtatttttttcgttctctaccatttatataggaatttatttttttcacctcacttttaatgtactacagtcttttattttcctgaaactcgtagcagccgggaacctgaccatattcctttctcgaaataggggacacttctggtcacctcctccaggaaaacttcttttatgggctgtggtgattacaaaagtgatagcaaccctctttgtagtatatggaatttatataactcccataggatggggtctggcgatttttgactgggcctatgcacttgcagcttttgtttttatcgattttctgaaa

SEQ ID NO: 34840 - DNA, 1077 bp, Methanosarcina mazei
ttgaaaatagcccagatctgtccccgttattcccctgacataggtggagtggaaactcatgtaaaagaaattagtgaaaggctggttaaagcagggcacgatgtggaggttataacaaccgatcccacggggaaattgagaaagcgagagataataaacggagtaagagttctaaggttcagatcttttgctccgggaaatgcatattacttcgctcctcagatctatacttatctcaaaaagcacgactatgatataattcatgcacacagttatcatgcttttcctgcattcttcgcatccttaagcagacacaatggaaaatttgtgtttacgccgcattatcaccggcacggccatactgcattccgcgatttactgcataagccgtacaggctttttgggaaaatgattttctccagggcagattccgtaatatgtgtctcagagtatgaaaagaaacttgtagaatcagattttgaggttgccgcaaaaaccgtaaagatccctaatggaataaaccttaaagagttcgaagatttgaggcagccgggaaaaagcttaaatgggaactccgaaagagaaaagcttcttctctatgtgggtcgcctggaagaatataaaggggtacagtacattatccagagtttgtctgaacttcaggatttccggttgagaatcatcggaaaggggccttacgaagctgagcttcgcgatatggcagaaagttcaggggtggaaaaaaggattgaatggttaaaagatctgtcaaggaaagaactgcttgaatgctatacagatgcggatatatttttgatgctttcttctcatgaagcatatggaataacggttgctgaggcactggctgcgggaattccgtgtatagtggcaaaagggagcgcacttgaggagtttgtggatggaaggaactgtattgggattgaaagtccggtttcaaaagagaaagtgacaggggcactgaagaatattgtgagacaggacaaaatagaaaaatccgggatagataaaaacataatggattggaatgaagtctcggctgaaattgaaaaacaatac

SEQ ID NO: 34841 - DNA, 1572 bp, Methanosarcina mazei
gaaaaggaaaaagctttcgaccccgaaagtatgaatctttcaataaaacctggagacgacttctatgaatatgctgagggagactggataaaaaaccatcctgtgccccctgacaaatcccgatacggagagtttgcaatagtaaaggacaggaattatgaccgtgtcaaagaaataatggagagagcagctagcaatacctcagctcctgatggaagcctagagcagaagattggcaggttctacagtatgggaatgaataatgccactctggaaaagcagcatcttgactcaatcaaaagcgagcttaagatgatagacaatatctccaatgcctccgacctccagaccgtttcgacgcaaatgatggaatacgacctagatactttcttttcaatgtatgctgcacccgacaaaaaaaacagcaagatcatgattgcaactcttactcaaggagggttaggcctcccagatagagatttctatttcagacaggacaatgaatctatcaagatcagagaacagtatttgactcatgttaccaggatgtttgtcttcctcggtgatagtccagagattgctgagaataatgccaggaccgtgatgaggatagagacccggctggccaatgcatcatttaccaatgtggaagacaacgatgaggtcaaaacgtataacaagatgagccttgaggagcttcaggcctttgcaccaggcattaactggtcttgtctcttcgtctctcttggtcatccggatgtagccgaggtcaacgtcagaaatccttcatattttaaagagttgagcagcgcccttcaggacgagaacatagatgattggaagactttcctgcgctggaagcttattttagggacatcaccttacctgagctccgacgtagaagaggaacactttgatttttatggaagaaaactcaatggccagcaggaaatgaagccccgctggaagagggttattgatgcggaaaacgaggctatgggcgaggccgtaggccgtgtctatgtggatagatattttgatccaggctccagggccaggatgcaggagatggtattgaacctgaaaacggccttcagggagagaattcaagacctgacatggatggagcctgaaaccaaaaaagaagctctcaaaaagcttgaagttctggaggtgcaggtaggctacccggatgaatggctgaactattcagagcttgaagttaaaaacgactcatatgccatgaatgtcctaagggcctctaaattcaagttccatcacggccccagcggtctggatagaataggccagcccgtaaatcgcaagctgtgggagatgaatccccaggagactaacgcctatgcggactacaataaaataattatagtcttcccggcaggcattcttcagcctcctttcttcaataaagatgccgacgacgctgttaattacggtgccataggtgctattatagggcacgagatgactcaccacttcgacagccagggcagaaagttcgatgcaagtggaaatttaacagattggtggacacaagaagatgccgaatatttc

SEQ ID NO: 34842 - DNA, 3260 bp, Methanosarcina mazei
gataactccagccaggtccagagtaactccagcagcagtcagcacctgaacattgccattgtgaccggatacagaagccatgagcttccactaaaaaatctagcggaagaggtcaacagtaacaacagcctgaaccttactcttagctgctttatggctgactacgtaatggaaaatgacgttgaccttagtgcaatggacataatctacatcaacatgctcagtccttcaacagcccagaagctcacaccgacagtggacagtgcaattgctaacgggtgtgtggttattgatgacgatacccttctgaatgagagcatcccgcttcctgaagaccagatcgaaagttacagggaaaaactgaacgactactggagtaatggggcttacgaccagaacaacttgaaaaaccttatattctgcatcgccagtgactgctgcggcagatctgacctgctatatgaggagccgcatacgcttccagaaagagcgatttatcacacgaacatgacaggttactttaccgattctctggatacctatcttgcctggtattcaaaccggagcgatggagggcatgtctacgatcctgcaaagcctacaattgcaatcaccatgtaccagagctatttccccttccagattgagccaattgatgccctgatctcaaaactggaagcaaaagactacaatgttattgccacatacggatctgatgatcttgcctccggcgactttttcaagcagggagatgaggttcttgtggatgcaattatttcatttacatactttggcaacaaatttgatgccgaagagctcggtgtgcctgtaatcaacggcattgttgacaattacatgaacaggaccgattatgaagccagcagcagaccgcttcctgcggacaagatgatgaagctcgatttgcaggaactctggggagctattgacccaataataatggctgcaacggaagtagatcccgaaaccgagactgaaacttcggtttccatagattaccaggtagactggcttgttgaccgtgtggaaagttgggtgaacctcagtgaaattccggagtcggacaaaaaagttgctataatctattataatcatggaggagggaaggataacataggggcttcttatcttgatgtcattccaagtttgtcaaaccttcttgacgctatgtctaaagacggatatgctctgaatgaaaatcagaccttaaacgaaactgatctcctgaatttgatgcttacccaggggtataaacatagggacctgggcacctggagaactccagaaaatggttgataccggcaaagtcgttcttctcccagaaagtacttatgagaaatggttctcggaactccctgaagaaagacagcaggaggtcattgaccaatggggtcctgcacctggaaagattatggtctgggaaaacgagactggaaaataccttgttattcccagaattgaggtagggaagaatgtgattctggctccacagccttcaagaggctggcttgatgataatgaggctctctatcacgacaaggatttgcctcctcaccaccagtacattgctttctatctctggctccagcattctgaggaagaaggaggattcgacagtgatgcccttgttcatttcggcaggcatgggactcaggaatggctgcctggaaaagagtttgggctctctcggtacgactggccttccctgatgataggtgataagcccgtgatttatccttacgttatggatgggctcggagaaggcaatgaggcaaagcgcagaggaggagcagtaatagttgaccatcttgtacccccgattctttcggcaggaagctatgggaattattcaaatctgagtgaagctatccagaactatgaacaggctgaggctgatgcctctcttaaagcggctcacaggtctgaagtcttaaacctgactcagtctctttccctggataaagaacttaacatgacagaggcagaaaataacgagacttactttaataccactttccttgaagggcttgaagatcttctggacgagtataagagccagtctatgccttacgggcttcatatcctgggtacaagccctaaaggagagcagcttgttggcatggtaaattctatgcttggaactgactttgcagactcggttaatgaattcaataaaaccgaaggggctcagctttatttgcttgaccttgtccttaaccagggagtcaattccacaaacgcccagaagcaggtgctcggaaaaagcaatgaaaccgtcagtaccctcctatccaatgcggaagaatatgctgcaaacctggctcttggagaagaggaaatcgatcaggttttcaatgccctggacggcaagtttatccctggaaatctgggaggagaccctgttagaaatccggaaactctgccgtctggaagaaacttctatgcgtttgaccagcggatagtgccaacagaagctgcctggactctcggtcaggaaatggctgaccagatgcttgaagcttatgttaccgagcacgggacttatccgaaaaaggtggcttacgtactctgggcaggagaaacaacaaggcacgaaggggttatggaagcagagatcctctacctgctaggggttaagcctgtatggaacagcggcagagtagttgatgtggaagctattccaatggagacgctgggcaggccaagaattgatgttgtaatgcagatctctggactctacagggacatgtaccctgacaaggttcgcctgctggacaaggccgtaaaactggcttatgcccaggaagactctcccaattatgtccgggaaaatgcagatgctctgaaatcttctttgacgagtgaaggttcccttaatgatagtgaggctctggacctttccctgctcaggattttcgggtcttcggacggcgcctacggcacaggccttccaaatgcgatctcttcaagtgatacttgggaaagcaacgacgctcttgcagagctttacatcaacaagatgtgcaatgcctacggagaagatgtgtggggcgaagatctgaaggatctttttaaagaaaaccttgaaggggttgaagctacagtgcacagccggagcacaagctcttagggactctggattatgacgatttattacagtaacttggagggctgaatttgcatcagatccgatcgggacgaatatctgatcatatttaggaaatgtgaaatgggacagaaag

SEQ ID NO: 34843 - DNA, 1494 bp, Methanosarcina mazei
atgcatcttatagaagagtccctcggtaattactttgaaaaacaggtggctgtagaccctgaccacgagtttataatctatcctgaccgcaaccttcgttttacctatgggcagttcaacgaacgggtcaataaccttgcaaaagggctgctagctatagggataacaaaaggggatcatgtaggaatctgggcaaaaaatgttcctgattggcttaccttcatgtttgccacggcaaagataggagcagtacttgttactgtgaatactgcctacaagagccatgaggtcgaatatgtattaaaacagtccgatatgaaggctctggctatgattgatagttacagagacgttgattatctcgaaataattaatgaactggtccctgagctcaaaacctctgagagggggagactgaaaagcaaaaactttccctatcttaagagtataatttatgtaggacaggaaaagcaccggggtatgtataacacaaatgagcttatgcttcttggcagtcattatcccgatgacaagctccgcgagattatgaccagcgtcgactgtgacgatgttgtcaatatgcagtatacatcaggtactaccgggtttcctaaaggagtcatgctgacccataaaaatatcctgaataacgggctttctattggagaccgccagaggtttacctatgtagacaaactctgttttcccgtgccactttttcactgttttgggatagtactaggagttatggccgttctgactcacagagcaacgcttgttatgctcgaagtttttgatcctctattagtacttgccgctgtccataaagagaaatgtacagcgctttacggcgtgccaacaatgtttattgccgagtatacacatcccatgttcgacatgtttgacctatcatctctcaggacaggaattatggcgggttcgacctgccccgtggaagccatgaaaaaggtcgtaaacgatatgcactgctatcagattaccagtgtttacgggcttacggaagcatcccctggtatgacccaaactgctgtagacgatcctctagaactcagggtcgaaactgttggtaagcatttcccgagcgtagaggtcagggttgttgatcccgataccaatgagcctgtgcccctaaatactgtaggagagatatgttgtcgcgggtataacgtaatgaaaggttactataagatgcctgaagaaacgaaaaaagttatcgatgaagacggttggcttcacagtggagaccttggaacctgtgacgaaaacggttactacagaatcacaggcaggattaaggacatgattatccggggaggagaaaacatatatccaagggaaattgaggaactcctgcttaccatgcccgaaattacagacgttcaggttgtgggcatccctgacaaaaaatacggggaaattgtaggtgcctttgtgattctcaaaaaaggtcagactttacagaagtcggtccga

SEQ ID NO: 34844 - DNA, 1347 bp, Methanosarcina mazei
atggaaaataaatatgatattataattattggaacgggtactgcaggcagaacttttgcgggtaaggttgcacattcaggattaaagattgctatagttgactccagggaatatggaggcacctgccctataaggggatgtgatccaaaagaagtgcttaccaatatcactaaggtcattgactctagtaatcgactaatgggaaaaggtgtaaggatagacgctcctttaaaactcgattggacttcactcatcaagttcaaaaagacatttacggaaggctattccagcaaaacagagaaacatctggttgggatgggaattgatacatatcatgggagagcgcatttcgaaaatcaaaacacagtcgttgttggaatggataaacttaaaggggagcatattttcctggctacgggtgcaaagcccagaacactcaatattcccggtgaggagtacattatcacaagtgagaagctaatggaaaccaaaaagcttcctgagaaaatcattttcatcggaggcgggtatatatccatggagttcgctcatattgcgcgaagaactggagccgaagtaacaatcctgcaaagaagtgaaaaggttctgagagcttttgattctgatatggtagacctgcttatgaaagcttctaaagctgcaggaatcaaaattcttacaaataaacctgtcatttcagtagaaaaagataataatggtcttattttaaaggttcaatctcaatctgaaactgaaccagaaattcagatcttccgtgcagatatggtagtgcaaggggcaggtcgtgtagccgatatagaggatttgcgtcttgaaaatgccaggattaaaaccgaaaagggagctattgtagttgataagcacatgaggacctcaaactcccgaatctatgcaggtggagattgcgcattggaaggcatgcagctaactcctgtagcagctcttcagggagaagttgccgcaattaatgtccttgagggcgatagtgccgaggcagactacacaggcattccgagtgcagtctttaccattccggttctagcgtcggtaggaatcagtgtggctaaagatgacgataagtataaagtgattttccaggatagaagcaactggtacacaacccgaaaaaaaggaatggagtttgcagcttcaaaagtaattattgatgaagcaaatgaccgtataatgggagcgcatattctgggccctaatgccgaggaagctatcaatattttcgcttcggtaatgcggcttgggctcaaggcatcggacataaaaaaactgatctttacctatcctactacatgttcggatattccttatatg

SEQ ID NO: 34845 - DNA, 1359 bp, Methanosarcina mazei
gaaaagataactgcaaaactaaaagttgcagaagctgatcaaagagatgtaggaaaaggaatcgtccgggtcgacgatagtttcagggaaaagctgggcctcaagccatttgacgttgtggaaataagagggggaaaatcgacttcagcgctgttaggacgcccatatcccagcgattcgggtctggatattatccgtatggacgggcttatccgtaccaatgcaaaaaccagcataggggaatacgtggatattcgcaaagccgactggaaagaggcaaggagtgtaactctcgcgcctgtagctaaaggcatgcagatctatgctccaagtgaaactcttaaagccatattcatgaaccgtacggtttctaagggagattttatttccaccacaagtttgaggcggtcacgggaaagagagactttagggaaaggaattatgttcgaagatttctttcaggatttttttggtccaggtatggggcagtcatttgggttgggagaaataaagttacaggtggtatctacttccccttccgggatagtaaagattacagacatgacagaggttgagctcttacctgaagctgcagaaataactcctgaacagaatgttcccactgtcatgtatgaggatctgggtggggttaaagaggctatcaccaaaataagagaaatgatagagctacctttgaagcatcctgaactttttgacaggctgggaatcgacgctccaaaaggagtactgctttatggaccgcctggaacaggcaagacaatgcttgcaaaagcagttgcaaacgagaccgatgcttactttatctcagtcaatggtccggaaattatgtccaagtattatggagagtcagaaaaagggatcagagacgtcttcgaagacgcagagaaaaacgctcctgcaatcattttccttgatgaaatcgattccattgcacctaagagagctgaagtgactggagaagtcgaaaggagagttgtagctcaactcctttccctgatggacgggcttaaggctcgcaagaatgtgattgtgatagggtcaaccaaccgtcctgaagcaattgatatggcacttcgtcgccctggtcgatttgacagagaaattgagttaagggttccggacactgaaggaaggcttgagattttccagattcacacaagaggtatgccacttgccgaaaacgtaaatctcatggacttcgctcagataacttatgggtttgtgggagctgacattgctgcgctttgccgggaagctgcaatgagttctttgaggcggattctcccgaagattaacctcaatgaacctgaaattccaagtgagatccttgacacactt

SEQ ID NO: 34846 - DNA, 423 bp, Methanosarcina mazei
ctcaatgatgtaattattgttgcggccacaaaccggcctgatatggtagaccctgcgcttctcagacctggccgctttgacaggctcatctatatcaagccaccagataacataagcagggaaaagatctttgagatccatacgcagggaaaaccccttgcagaagatgtaaatctttctgagcttgctgatatgactgaagggtatgtgggagcagacatcgagggtatttgcagagaggctgcgatgctggccctgagggaaatagttaccccaggagctagcagaaaggatatcgagaaacgggcaggagaagtcataatttcaaagaagcactttgaacgtgcaatccgccgtgtaaagcctacaacatccagggaaagccttgcggcttatgaacggagtgctgaactctttgctaaa

SEQ ID NO: 34847 - DNA, 1218 bp, Methanosarcina mazei
cagcacctgtgtacctgtgctgcaggacttaagctcacgcctgatatggaagcgttcctggaaatgcctatgagagaactctatgtttccctgcctgtccacatggatgacggttctataaaagtttttaaaggcttccgggtgcagtacaacgaagctctgggccccacaaaaggaggtgtgcgttttcatcctgaagatactatggaaactacgagagcccttgcagccctcatgacttggaaatgtgctcttcataagctgcctctgggaggagcaaaaggcggggttatttgcaaccccaaagaactttcacatcgagaaatcgagcgcctgagcagggcctacatacgtgggatttatcagataataggccctgatagagatatccctgcccctgacatttatacaaatccgcaggttatggcctggatgatggacgaatactcaaaactcgcaggcaggaatgtgttcggttccattacaggcaagccgacaagccttggaggctcggcaggcagatacgatgccacggcaagaggcggtttatacactataagggaagctgcagaaagaattggaataagcctgaaagcttcaagggttgcagttcatggtttcggaaacgtaggatatcatgccgcttatcttgcaaataaactatacggctgcaaggttgttgctgtaagcgacagcaaaggtgcgatcttttcaccctatggacttgaccccgaagacgtttcaggccataagcactcaactggttcggtgctggactatcccgaagcagagaacctgactaacaaagagttgcttgaactggatgttgaaatcctgattccggcttctcttgaaaacataataactgaagagaacgcgggaaatattaaagccaggattcttgccgagatggctaacggcccaacgacagtcgaaggagaagcaatcctgaattcaaaaggaattcatattatcccagatattctgtgcaatggaggcggagtcattgtctcatactttgaaatggtacagaaccagtcaagcacacagtgggaagaagaggaagttcaaaatcgtctggagagaaaaatgaaagaagcatatttttcggtgtatgatttcgcctcaaaaaacaatgttgaaatgcgtcaggctgcatatacccttgctgtcggcagagtggttgaagctatgcagctcaggggctagatatgaaaa

SEQ ID NO: 34848 - DNA, 903 bp, Methanosarcina mazei
atagaagtaaataatcttgagcattcatatggttctgtaaaagcggttgacaatatcagttttactgtaaaacagggagagattttctcattccttggtccaaatggggcaggcaaaagtactgtgattaatattcttacgacactcaggaaactccagaaaggcaacgccagagttaacgggtatgatgtaacaaaggaaccaaactccgtaagaaggtcaataggaattgttttccagatgctttgcctcgatcatgaaatgacggtgtctgagaatctggaatatcacggtaggatctattcgatgaaaaaaaaagaaagaaataaacgcatcgaagaacttttaaagctgacagatctggaaaataaaaaggataccctgggaaaagatttgagtggaggcatgaagcgaaggcttgagcttgcaagaggattgatgacaaaacctgcagtccttttccttgatgaaccaacgataggtttcgatatccagacgagaatgagaatgtgggaataccttagagagattaagagagagggcactactatattcctgacaacacactatatggaagaagccgatcagttgagcgacaggataagcataattgaccatggaaaaataatcgtaaccggaacctctaatgagttaaagaataaacttggtaaagaccttatttatctggaaacaagtgataataaggctgctgcagagatcttaaggtctctagtgtcagttaaaagtgtaacagaagatacgaaatccctgagaattatgatcggggaagacgttactcatgtgcttcctcaaattatggagaaaattcggagagaggggatagatattataatcgtaaatattaaaaaaccgtcaatggatgatgtttttgttcattacaca

SEQ ID NO: 34849 - DNA, 978 bp, Methanosarcina mazei
atgaaaatattacaggtaactaattttttcaaaccctcttgggaagcaggtggaattgcaagggttgcctatgaaatttcaaaaaatttagtacaacagggccatgaagtaacagtttttactaccgatggatttaaatcgaggctgaaaactattaagaacaagcctgttaatgtagatggaataaatacctattatttccgaaatctgtctaattatttaacaaaacgcaatattgtcatcccttattatttaccttttatcgctagaataaaaattcaggattttgatgttatccatattcatgagcatcggacattgcttgcagtaatcgttcattattattcaaaaaagtataatattccatatgtgttacaagctcatggaacacttccaaacactattggtaaacagaatctaaaaaagatatttgatgttttatggggaaataaaatattaaaggatgcatctaagctgatttcagtatccaatacagaagttgatcaatatttacaaatgaatgtccctattgaaaaaatggtcattattccaaatggtatagatgttgattcattatctagcttacctgaaaaaggtagttttagagctaggtaccatattaatcaaaagcatgcgatattgtatttaggaaggttacataaaataaaaggtgttgattttctactccggtcttttgtagagttggttaaagatatcgacgattctgtattgatattagctggtccggatgacggttataaagataaagcgaaagaacaaatacgtgagtttggtttagaaaaaaaggttatttttactggatatatgggaccaatggataaaatttcagcttatttggatgctgatatcttagtttatccctcttctttcgaaatattcgggcttgttccatttgaggcaataatgtctggcactcctgtaatagttactgatgactgtgggtgtagcgaatttata

SEQ ID NO: 34850 - DNA, 1154 bp, Methanosarcina mazei
gggctcttactgctcgtaaaaggatcagacctcttcgtattaacatcatcccggattgcaagaaggtttggagtatccgaatttgtaataggattgactcttgtgtccgtgggcacgtcagtgcctgagcttgcatcctctctgacggcatctttccagcaagcaagtgggatagttataggcaatatacttgggtcaaatattgctaatataggtctgattgcaagtacggcagctctcctgacaaatatcaagactgaagaggttatgctgagaagggatggctatataatgttatttgcctcttttctcctctttttttttatgctcgactttaaaatttcgaggttagaagccttaatttttattttattttatcttgcctatcttttattcctgctcgataaagtgaaaagacatgaagaagagatatattttaaagattttatgatttattttttcaaatttgagtatcttttcgatctgaaatcaagaattaaactccaggttcaggaacgcgaaaaaagaaatcaaactttgaagaaacgaaaaaaagcacccaaataaccggaaaaagaactcaaagaaaaacgaaagcgaatccgaaattgaaatgcgaaccaaaaatgaatcataaccgaattgggaaccaatcgaaaacggatcctgaatatgaagatattgatgtcgaagttacagaagaaaacctttacgaaaccagccttttaatagaatttttcaagcttatagcaagcggggctgcaatcataattggggcaaagtattttgtcgaacaggcagtcttctttgctctgctgctggaagttccagagacgcttataggaataagccttgttgcggttgggacttcagttcctgaactcatggtaaccatttcggcagcccggagtgattatgctggcattgctcttggaaatgtcatagggtcaaatattgcaaatatacttttgatactgggatgctcaggacttgtccacccaatcacggtaaccggcctcagtatttattatatagcgccttttatgctgataatgagcctcctgctcatcttatttatacgaacgggctggagagtcaaaaagttcgaagggcttatcctgatccttctctatctgagcttcatggttctgatc

SEQ ID NO: 34851 - DNA, 1053 bp, Methanosarcina mazei
atgaaaggatttgcaatgcttgaaattggaaaagtaggctggattgatactgaaagaccttcagcaggaccatatgatgcaatcgtaaggcccattgctgtcgcaccttgtacatcagatgttcatactgtctgggaaggtgcgcttggaaaccgcaaaaacatgattttaggacacgaagctgtaggtgttatagaagaaaccggctcagaggtcaaagacttcaaaccaggagataaagtaattgttcctgcaattacacctgactggcgatccatagaggcacaggacggaatgcctatgcattcaaatggaatgctttctggatggaaattttcaaacttcaaaagtggagtctttgcagaatttttccatgtaaatgatgcagacatgaatttagctctacttccaaaaggaatgcccctcgaacaagctgtcatgctatcagatatggcaactactggaatacagggtgcagaaatggcaaaaattaaaatgggctctacggttgcagtcatagggattggtcctgttggcctgatggcggtggcaggtgcaactattcttggtgcaggcaggctcattgcagtgggaagtcggaaagtctgtgttgatcttgctctggaatacggagcatctgaaattgttgattacagaaaaggtggacttgttgaacagattcttgaaaagacgaatggaaaaggtgtggactctgtaatcatagcaggaggaaatgaaaatacaatttcagatgcagtcaaaattgtaaaacctggcggcacggtatcaaacgtcaactactacggaaccggagacatacttcctattccacgtattgaatggggatcgggtatgtctcaaaaagatatacgtggcggcctgacaaccggaggtcgtctgagaatggaaagaatggcagacctctgtacctacggaagaataaaaccagaaaaaatggccactcatgtattcaaaggattcgacaaaatggaagaggctctcatgctcatgaaagaaaaaccaagagatctgatcaaacctgttgttcttctg

SEQ ID NO: 34852 - DNA, 699 bp, Methanosarcina mazei
gaatttgcaatagaaactattcatttgagtaaattttttggaaaggaaaaccaaattcgcgcagtggataacctaaatctgcaggtgagaaaaggagaggtcttcggttttgtgggtcctaacggagctggcaagaccacaactatgaaaatgcttattggtttgcttgagccaagcgaaggaagcggaaaggttgcaggtttcgatatcatccgtgaggtaataaatataagagaacagacaggagtccttcccgaacctgccggtttttatgataatctcactgcaaggcagaacctgcgtttttatgcaaagctctataatatcgaacccgatgttcgggaaaaaaggattgtaaatttacttgaaactgtaggtcttacccgtgccattgaccagaaaacaggcggtttttccacaggcatgcgaaagcgttttgggcttgcccaggctttgatcaacgaaccctcagtccttttccttgacgagccaacaagtggtattgaccctcttggcgctcagatgatgagggaccttataaaagacctgaaccgaagtaaaggagttaccgtttttctgagttcgcattctatggaagaagttgaagagatctgcgaccgcatagcaataattgcaagaggaaaacttctggcagtagggtctgtggaggatttgcgagatattgtaagagcaaaggaa

SEQ ID NO: 34853 - DNA, 2469 bp, Methanosarcina mazei
gaaatgctccagaggctccaaacaacttacgaaggcttgagtagctctgaaagtagtgagcgccttaaaaaatatggggccaatctccttaaaccaaaaaaaagttcaaatacccttaaaattttactttcccaatttaagagtccgattattcttattttgctttttgcagccggattgtctttttttcttggagatgttacagatactgtaattattataaccatcattctgatcagtagtttgcttggcttctggcaagagaaaggagctgcagatgcttttgaaaaattgctcagtgcagttgaggtgaaggcaacagtagtaagagatggagaagaaaaggaagttcctatagaacaaatagtacctggggacgtaataatcttcagcgcaggcgatatagttcctgcagattgcctgattctggaatcaaagggactttttgtcaatgaagctactctcactggagagacttatccagtggaaaaatcaacaaaaaccctgaactcagaaacccctcttgcaaagcgtacaaactccctctggatgggaaccagtgtggaaagcggaagtggaaaagcacttgccgtaactacaggaaaaaatacagagtttgggaaaatatctgaagagttaagaacaagtgctccagaaacggagtttgaacgaggtattgcaaagtttggccattttttgatggaagttaccatgttaatggtcattacaatctttgcaatcaatgtttatcttcagcgtccaattctggattcttttcttttttctcttgcgcttgcagtcggacttacaccgcaacttctacccgcaattataagcgtgaacctttctcacggcgcaagagaaatggcggaaaataaagtaattgtcaagaggctggcctctattgaaaatctcggcagcatgaatctactatgttccgacaaaaccggtactctgactgaaggagaacttaagcttcattctattcgggatgtgaaaggaagtcagagtgaaaaaatccttctttacgccagtctcaatgcctattaccagaaaggttttaaaaaccctatcgaccgagcaatcctgacacagaatagattcgagatgggagaatataagagcctggacgaggtcccttatgatttcatacgcaagcgattaagcgttcttgtctcaaaaaacgagaataacctgatgattactaaaggcgcgctctcgaatattcttgagatctgcactctagcagaagtagagcctgggaaaattgtagaaatttcagaggtcaaggaaaaaatcgagcaacaatataaggattttagtgaaaaagagtttcgaacactcggtgttgcatatagagaaataaacaggcagactaaaatcgaaaaagaacaggaaaaaggaatgacctttatcggatttctcttgttttttgacccactgaagccagaaattgcaaaaacgatagaaaacatggagcaacttggcatttctctgaaaataattaccggggataacaggcttgtggctaccagtattggtaaggaagtaggatttgacgcctcaagaattctaaccggaagcgaaatatatcagatgacaagcgaggcccttataggaaaagtaaatgacattgatatctttgctgaagtagagccaaaccagaaagaacgtatcatccttgcactcaagaagagagggaacgttgttggatatctgggagacggtattaatgacgcatctgctcttcatgcagccgatgtaggaatttcagttgacagagccgcagatgtcgccaaagaagctgcacaaattgtgctgatggaaaagagtcttgattcactcgtagaaggcgtcaaaggcggaagaaaaacctttgccaacaccctaaagtatgttttcatggctaccagcgccaactttggaaatatgttcagcatggcaggagcgtcccttttcctgccttttcttcccctgctgcccacacagatcctgctaaccaatttattgactgattttccggaaatgactatagccacggatactgttgacaaggaactggttgaagaaccacatcgctgggacataaatttcatccgcaagtttatgatggtatttggctttaccagttcggtcttcgattacctgaccttcgggactctgcttctcctgctaccgggtatgatagaacaattcagaacaggctggtttatagaatccgttatttcggcatcaatgatagtgctggtaatccgaagcagaaagcctttcttcgagagcaggccaggaaagtacctgctgatagccactgtgctgatcgtagtcatgactcttgtttttccgctaactccttttgcagcactctttggtttcaaacccctgcctttacaggtcattttaacccttggagccataatagggctttatatcattgcggctgaggcaataaagagaattttttataaaaaa

SEQ ID NO: 34854 - DNA, 996 bp, Methanosarcina mazei
atctttctacttggccttgttcttttggtcaaaggttcagattattttgtaaaatcagcttcaacaattgcagagaagcttggtgtttccgaatttattataggtttgacactcgtcgcacttggaacatcaattcctgaacttgcttcatcaatagctgcttctctccagcatgcaagcggtatcgtaataggaaatgtcgttggatcaaacatcgcaaatatagggcttgttgtagggttgtctgcagttatctctccagtgaaaactgaaatagagatgctcagaagagatggctatgtcatgctctttgcagctgtgctcttctttgtttttattctgaacagagaaatctcaatactagagtcagcctttttcatactgatcttcattgcgtatgtgtttttcctgtttgaagaaagcgagaaatacaaagggaaactgcattttaaagagttcataatatactttttcaagtttgagtatataagcagcgcaaggcaaaagttcaattgcataagagatagtaacgctgaaggcgaaaactgccagtccagagaaggtttcacaaaagacatactggttctagtattaagttgtggagcaattataatcggggcaaagtactttgtgaacaaatcaatcttctttgcagaactccttggagttcctgaaactataataggtaccactctagtagcatttggcacatcccttccagaacttgtagtgacactatctgcagcaaagcagggtttcgggagcatagcccttggcaatattataggctcaaacatcgcaaacatatttttaattataggattttccggattaatctatccgatacctgtcgagcagataagtctattctttacgactccagctatgattttgataagcgtaacactcctcgtgtttatcagcacagactgggaaataaaaaggtgggaaggaatagctttggtagccttttatgcatcttttctaatagtgcta

SEQ ID NO: 34855 - DNA, 1992 bp, Methanosarcina mazei
tacccttttactgcaatagtagggcaggagaaaatgaagaaagctctgatcctgaacgctataaatccaaaagttggaggagttctgatcaggggtgaaaaaggtactgccaaatcaacagctgtccgggcccttgccaatcttctgcctgaaatacaggtagttgaaggctgtaaataccgctgcgatcctaatgatgtaaatgcaatgtgtgaagaatgcctggaaaaggtaaaagctggggctcttaagagttcttctataaaaatgaaggttgtggacctgcctgtaagtgccaccgaagaccgcgttgtaggaactcttgatatcgaacatgctatcaagaaaggagaaaaacgctttgaacctggtgtacttgctcatgctcacaggggtatcctgtatgtggatgagattaatcttctggatgatcatcttgtagatgtactcctcgactcagcagcaatgggagtaaatactgttgaaagagaaggaatttccttctcccaccctgcgaattttgtgcttgtaggcaccatgaaccctgaagaaggagaacttcgaccccagttacttgaccggttcggtttatgtgtggatataaagggaatcatggatgtagccagaagagtggaacttatcaaatacaggctcagctatgaaaccgatcctgaagcttttgcagcaaactggcaggctgcagagtccgagctttgtgaacagattcttctggcgcagaaattacttcctgaagtaaagatctcagacagcatgcttgaattgatcagccagatctgtgttgatatgggagtcgatgggcacagggcagacatcacaatgatgaaaacctcaatcacgcttgcagctttcaacggcaggactgaggttcttgaagaggatgtaaaagaagctgcagaattagtccttcctcaccgtatgcgaagaaaaccgtttgataattattctgataagcaggataaactcaacgagagtatggagaaacaaagggaaaagaaaaaggaaaaagaaaaggaaaaagaaaaaaataaaaatgaacagcaaaaaaaagagcataacgagcagtcaggaaaagcgcaggctcatcctgaagagcagaattcagatgacccacaggatagcaccggggaacagccggatgcttcctcagaaactatttttgcaacaggagaaggttaccagataaagcagttttctcccgattttcgcagagaaaaccgaaatgggtcaggtcggcgcagcaaaactctgacgaaatctacacagggcaggtatattaagagtaaaatcccagaagagaaaacaacggatattgcttttgatgctaccctgagggcagctgcaccctaccagcttgtaagggaaaaaaacggaaattccatagtaattcatgacttggatttcaggcaaaaagtccgtgagaaaaagataggcaaccttgtactctttgttgtggatgccagcggttctatgggagctcagcagcggatggtagcttctaaaggtgcagtgctttcaatgttgatggacgcttaccagaaacgtgataaggtggggcttattgcttttaaggggacaggagcagagctgttgctgccgccaacttccagtgtggaaatggcacaaaaatatctggaggaactgccaaccggaggaaagactcccctttcccatgggctgatgaaaggttatgaaaccatacatgcagaactccgacgcgatcctgatacctgtccgtttatggttctgatctctgatgggagggcaaatgtcagtatgaatggtgaacctcctctccaggagacaaaaacaatagcttccatgttcagaaaagaatgcatacaatcggcagttattgatacggaaagcagtattattaaattcgggcttgctcaggaaatttccagtgcgcttggagccaaatatctcgcacttgaggacctgaaggcagattcaatagttgaagctgttcga

SEQ ID NO: 34856 - DNA, 1224 bp, Methanosarcina mazei
tataagatccaaaagatacatgctcgggagatcctggattcaaggggaaatcccactgttgaagttgatgtgtttacgccaaagggatttggcagagccggtgttccttcaggggcttctactggtacgaatgaagcccttgaactgcgggatgcagaccctaatagatatggaggaaaaggagttctcactgcagtaaagaatgtgaacaccatcatccagaaggagttgctggggcttgatgtcagaaaccagcgggaaatcgatgagcttatgatcgagctcgatgagaccgataacaaatcaaaccttggggcaaatgcaattcttggggtatccatggctgttgcaagagctgctgcagattccttgaatgttcctctctaccgctatttaggaggctcaaatgcatttactcttccagtgcccacaatgaatgtccttaacgggggcaagcatgcaggcaatgatcttgcaatccaggagttcatgattcaacccaaaggcgcagaaaccttttacgaagctctccagatcggagccgaaatctatcacgttcttggtaaaatactggaaaagaaatacggccggtcttctactaatgtgggctatgaaggaggatatgctcccaagatgagtgagtcaaccgaagcccttgatgcccttgcccaggctattgaggaagcaggctacactgacaccgaggttacaatcgggcttgatgctgcagcctccgagttttatgaagatgaagcctacgcaatcgacggcaagaaactctctgctcccgaactgatggactactatgtcgaacttgtgaactcctatccaatcctttccattgaagacccattctatgaggaagcctttgaggacttcgaagctctgaccaatgagctctgggacacaattattgttggtgacgacctctttgttacaaacattgagaggctttcaaaaggcgttgacatgggggcagcaaatgcacttctcttaaaggtcaaccagatcggaactatttccgaagcttttgatgccgcaaatatggcttccagaaacggctataccgtaatagtaagccaccgttctgccgaaaccgaagacacaacaattgcggatatctcggtagctattggagcagaaatgatcaagaccggagctccggcccgtggagaaagaacagctaaatataaccagcttctcagaatagaagaagacctgggt

SEQ ID NO: 34857 - DNA, 657 bp, Methanosarcina mazei
gaacagatacacatgcctctgatcggagatgatgcaccatcatttacagcagtgacaactcagggacaaatcaatttccctgatgattacaaaggtaagtgggttattcttttcagtcatcctgcagatttcacacccgtatgtaccaccgaattcatgacttttgccagtatgcaggaggaattcagagagatgaacactgagcttatagggctttctatagacagcgtattctctcatattgcatggcttaagagaatagaagagaaaattgaatataaaggaatgaaaaatctcgagatcaaatttccggtgatagaagacctgaagatggatgtcgcaaaaaaatatggtatgatccagccaaaaacctctacgacacaggctgtaagagccgtatttattattgatcctgaagcgaaaattaggacaatactctactatccgcagtcaacaggaaggaatatgcaggagatcaagagagttgtggccgccctgcagaaaaatacggccgaaaaagtcgcaacgccggctaactggcagcctggggatgatgttattgttccagctcccagttcgatggaagccctaaaggaaagaactggtaagctcgaagaaaacatgtactgtcttgactggtttttgtgctttaaaaaa

SEQ ID NO: 34858 - DNA, 799 bp, Methanosarcina mazei
aagataggatttatcggagcaggaaaaatgggctctgcacttatgcagggaattataaaggccggaattgtaaagcctgaaaaccttggcgcagccgacgtgtacgagcctttcttgaacgatctaaaggcaaagcttggcattaatatatctactgacaattccgttatcgccagggcatccgatattcttctcctagcagtaaagccccagactctgggttctgtactcgaaaatcttaaagctgacataacttctgataaacttataatctcaattgcagctggtgtgcctcttgccacttacgaaaatgcgctccccgctggcacaagagtcatacgtgtgatgccaaatattgcggccacagtttccgaagctgcttcaggtattgctccaggtaaaaatgccactcccgaagacgtgaaaactgcccttgagatcttttctgcagtcggcactgcagtccaggtgtctgagtccataatggacgcagttacaggtctttcaggcagcgggcctgcatttatctttcctgtgattgaggcaatggccgatggggctgttcttgaaggaatggacaggaaaagtgccctcactctctcagcccagactgtacttggggctgcaaaatgatgcttgaaacaggcctgcacctggagaactcaaggatatggttacttctcctgccgggactaccatccaaggtgtccatgctcttgaagaggctggagtcagggctgcatttatgaatgcagttataagggcaaccgaacgctcaaaagaacttggaaagaagtaa

SEQ ID NO: 34859 - DNA, 912 bp, Methanosarcina mazei
aaaatttccgtgattggtgcaggaaacgtaggggcaactacagtccagcgactagctgaacttgaacttggcgaaattgtcatgacggatattgtggaaggactaccacaaggaaaagcactcgaccttatacaggcaggggcaataaaaggttatgatacgtcaataattgggaccaacgattatgcagaaatcgtagactctgatcttgtaataattacagcagggattgcaagaaaacctgggatgactcgggaagatctgattaaaacgaattctaaaataatagcagaggtttccagaaatattgcaaagtatgctccagactccatagtaattaatgtcacaaatccgcttgacattataacgtacatagctatgaaatcaacaggatttgagacaaagaaagtattcggaatgagcggagttctggattcgggacgttttgcaagctttattgcagaagaactgaagtgttcaaaaaaagatgttcaggcaatggttataggtggtcatggagatctgatggtgcctcttcctcaatatacaacagtgtcaggagttccactcacggacctgcttccgggggatagaattgccaggctggtagagaggacagtaaacggaggagcagagatcgtagagctccttaaacagggcagtgctttttatgcaccgtccgcggctattgtctcaatggcggaagccgttattaaaaattcaaagagaattttgcctgcttcggcttatcttgaaggacattacggacaggaaggtatttacttcggtgtacccgtaaagcttggggcatcaggagtagaagaaatccttgaactcaagctcgatgaaagccagtacgagactctcagaaaatcctcggaaactattcgaaacacgatttcacagctagaa

SEQ ID NO: 34860 - DNA, 1152 bp, Methanosarcina mazei
tactctgatcgaatcaatgcactacccccatacctttttgctaccatagacgaagcgaaggacgaactaattgccagaggagtcgatgttatagaccttggcgtaggagaccctgacctgccgacgcacccgcacattgtcgaggctatgcgggaagctgtctgcgaccctaaaacgcaccagtatccttcttatgccgggatgccggaattcaggaaagcggcggcggactggtgtaagaaatacaagggagttgagcttgaccctgcgactgaagtccttgccctgatcgggtcaaaggaagcggttgcgcatattccactcgcgtttgtcaaccctggagatgtcgtgctctataccgatcccgggtatccggtttacaaaataggaacaatgtttgcgggtggagaaccgtatccactaccgctaactgccgaaaataatttcctgcctgacctggattcaattcctgagaatattctgaaaaaggcaaagttattcttctttaattatcctaacaatccaactgctgcaactgcggacatgcagttttttgaaaaggtcgttaagttctgcaaaaaatacgacatcattgcagtgcatgacaacgcctactgccagatgacatatgacgggtacgaatctccctctttccttgctgccaacggggcaatggacattggcatggaactctattcgcattctaagacctataacatgacaggctggaggctcgggtttgcggtcggaaataaagaccttataatggggctcggtaaggtcaaatccaatgtggactcaggcgtctttgatgctatccagatcgcgggcattgcagcactctgttcttcgcagacctgtgtcgaagaaacaactaaaatatatcaggagagacgggatgctctgatagaaggactcaaggccatgggcctcaaagtaaagcttccaaaagctaccttctatatctgggctccggtacctgaaggtttcacctcaatgagttttgcaaaactcctgcttgaagaagctggaatcattgcaacccctggtgtcgggtttggagaagccggcgaaggctacattagatttgccctcacaaaatcggtcgagagaataagagaagctgtcgaaaggatgaaaaaactaaaattc

SEQ ID NO: 34861 - DNA, 1364 bp, Methanosarcina mazei
atgaaaataaaatccgttaatccttacactgaagaagtaaactggacatatgattcgttttctttcgaagaatgtgagtccaggattgaaaattccagggctgccttttccgggtggagttcgttatctgttgaggaaagaacaaaatacttttcaagggctgggaaggtcatcaggcagaatgccgaaatttatgccgaaattattacgaaaagagatgggaaaagctatcagacagatcaagaggcgagattgaaaacatgcgcctgcctctgtgattattacgcacgaaaaccgcggcagagtttctgaaagacgaagttcgtggatatcggaagctgaaaaaagtacgtaaccttagagcctcttggattaattttcgggatgatgccctggagtttcccgttctggcatgttttcaggttgcggtgcctgcaatgtgtgcaggaaatgtgtgcgtaatcaagcattcttcgaatatgcctgcttcggcgctggaaattgaaaaaatatttcttgaggccggatttcctgaaaatgttttcaataccctgttaattgactcaaaaactgcaatggaaattattgaagaagaactggtcgatgggatttcactctctggcaacatagacgcaggctcggagataggggaacttgcaggaagcctggtaaaacctcttgtacttgaactgggaggttcggaccctttcatagtactagaaaacgctgatctcgagagagctgtgcaggttgctgcaaagtccagttttctgaataccgggcagagccatattgctgccaagcgatttattgtcttggaagatattgctgtggactttattgaggcatttgagcttgaaattcagaaactgaaaatcggggaccctatggatgaagaaaccgatattggacctcttgcaaagaaagaatttctcgatagtcttgaaagagtcctgaaagacgcaaaaaagaaaggtgcagaaccccacgtttacggagaggaacagagtaagggttttttcttcagaccgaccctcattcctgcagccagtaccgatatgaaggtttgcaatgtagaggttttcgggcccattgtcccggtgatcacggtaaaagacgaagatgaggcagtcaaagttgcaaactccaccgagttcggacttggagctgaaatatggtccagagaccttgaaagagctcagagactggcaaaaagcataaaatccggatttgtggtcattaatggaatggttaaaccagatccgaggctgccttttggaggagtaaaaaaatcaggaatcggacgagagctttctcattatgggctcaaggaatttgtgaacataaaaacggttgtggtcaac

SEQ ID NO: 34862 - DNA, 1620 bp, Methanosarcina mazei
cgttaccttgaggttatgagggttcttttaaagtacaaccttattccggaactctaccgagatctacgcacagattatatttcaaatcctgagtgcacctgtacttttgatctagaaaacaggcagacggctataaaactcaggaaagctttcgaagatcttgggcctacttttatcaaaattggacagaccatgagcaagcggcctgatcttgttccgcatccttatgttatagaaatgtcaaaccttcaggacaaggttaagccgataccttttgaggagatggctgaatcccttgaccttgcctgtgtttgcgaatttgagacacttgaggaacgaaaacgaaaaaaaacagatgcagagcttaaagcttcccgggagagaaaagcaaaagcttttattgaaatctttgacagctttgatccggagcccattgccagtggctcgattgcgcaggtttataaaggagttctggaaggcaaaactgttgctgtaaagatccttcgcccgaatctaattgatattataaatatcgacctttctatcctggatgatttcaggccggttatgataaaggttctcggcctcggaagtaattttgatatcgatgctttctcgctggagatcagggagatgcttacccgcgaagttgacctgagaaccgaagccgtcaatatgcggcgttttgaggacaatttcaaaaacgtaaaaaacgtgtctgtgcccaggatctatcccgactactgttcagccaatgtccttacaatggagttcataaagggaactcagattaaggatataaccaatatgcctgtgccccagagcaagaaatctgaatatacgcgtatcatcactaaaagttatcttaaacaagtttatatagacggcttttaccatgctgaccctcacggtggcaatatgctggttcaggaaaataataccattgctttcatcgatttcggggctgtaggcagcatcgatgatgagctcaaaaaaaatatgctgaagttttactatgccatcaataacagggatgtggaaggagcaacccagggtttcctgaaaatagggggcgccgatgtgcgagatgtggatattcgcaggctcaggaaagatatggatagcctgattgcaaaccagaactacgggcttgaaggcaggcagagtgacaattatgcaaagctcggtttgaaatacgatattcggttgccgggagaattctcaactctgcagagggcgatcctgctaatcgaaggagtctgcctggaactggatccaaaatacaatattaaaaccattgctattcctgtgctgatggacgcttataaaaagcttaatactccaaaaggtaccgctcttcacatcgaattttccaccgagcctatggacgaaaaggctgaattgagagatgcaattcgagaagtcaccgataaaatggaaggaatgggggataagtttcttttcttaaagcagaaggaaacaaggaaaactactttttcaaaagaactctatctggctgtcctgcttattgtctcaacttacatactgttaaatggaggtgttttttcctgggtaggactggctggatttgcaggttcggttctgatagcacttctcctc

SEQ ID NO: 34863 - DNA, 1122 bp, Methanosarcina mazei
atgaaaatcgcctttgtgtacgatgctgtttatccatgggtcaagggcggcgcagaaatgcgcatacatgagctgggaaagcggctctcagctaggggacacgaagtacacattttcggagtcaaatggtgggaaggagaagatacttttgagtatgatggcatgactcttcacggcgtctgtaaagctcgaaacctttatgttaatggtagacgctcgatttccgaggcaataatcttcgctgcgaaactattccctgagctcaggaaagaaaattttgaccttatagatgtgagtgtctttccctatttttcctgtttttccgtaaaagcggtttcaattctgaaaaaagtaccttcagtacttacctggcacgaggtatggggtgattactggtatgaatatttaggaagagcaggaattttcgggttgctggtcgagaaggtggtctcgaagttatcagaaaataatattgcggtctcgaaatggacaaaagataaacttgagggactaggggtgcctggagataagatcgcggttattcctaacgggatcgatcttaaaagaatctctgggattgagcctaactgggaaatgaaccctgttagccctgaaaataaggcctatgacatcatttttgcaggccggctcataaaggaaaaaaacgttgacctgctgattaaagctgtagctcttcttaaagccgattttccaggtctcaagtgctgtattgttggggacggacctgaaaaggcagccctggagaaacttgcaaggagaagcggggtttgcgagaatgtagaatttgcaggctttcaggaatacggagcattgatcggaaaaattaaggcttcaaaggtgtttgtgctgccttcaagccgagaaggattcgggatggtagttatcgaggcttttgcctgcggagtgcctgtggtgacggttagagcaaagtataatgccgcacaggggcttgttgaagatggagttgacgggtttattgtggggattgaggagagggagattgcaaaagccgtggtaaaaataattgggaaggcctcaaggaatagaaaagcttcagaagccgcattgagcaaagctgaaaactatgactgggaagaaata

SEQ ID NO: 34864 - DNA, 693 bp, Methanosarcina mazei
aaggaaaaaaaccttacaaaccttaatttatctgggaatcagctaacacaagtaccacaagaaattggagaacttaaaaaccttaccatgcttgatttatctgagaataccctcactatactgccacaagagattggagaacttaaaaaccttaaaacacttgatttatctgggaatcagcttatccagttgccatcagaaattggaagacttaaaaatcttacaattcttaacttatacgataatcagctgactcaactgccaccggaaattaaagaacttaaaaaccttacagcgcttacattatttaataacaaactaacccaaatacctccagaaattggaaagcttaaaaatcttgagacactttacatatattgcaatcagctgacacagcttccaccagaaattggagaacttaaaaacctttcaatacttgcactaaataagaacaagctgacccaactgccatcagaaattggaaatcttaaaaatcttgagacactttccttatatcgtaatcagctaatagaacttccaccagaaataggaaaacttgaaaaccttaaaacactttacatagataataataagttaactatactgccaccggaaatttcagaacttaaaaaccttataactcttaatttatctgccaatcccttaacttcaccccctccagaaattgtttca

SEQ ID NO: 34865 - DNA, 2364 bp, Methanosarcina mazei
gtaatgccgctttttgaggtagtggtctacccgaaaagccgggccaaattccttgctgacaaagtcacaggggaaatactcctaaatgacatgaaaaacgccgaatctgtatctgccatcgggctgacggtaaagaacggcacaaaggcttcagacctatccgaagagagtctgtataaaattggaaacttgcttaatattacatatgtacagccttctgatgacggatatcttgttgtcgcaaagggtattgaaagggtagaggcggtttctctttaccagaagaatgggctgttctacgcaacttacaggcctgtccatgatctgccggatttcgatgaggacgctgaaactgaggtaatggcaaatataaaaaagacaattcacgagatcagtgcccggttccagggttctgaacagtttaccaagtcaatcgataagatggactccattgaccagataatgggatttgtcatgccgtacatacccgtaaaacttgccgaaaagcaaagactccttgagcttgcctcggttcgtgagaggtatcttctgttccttcacattctgacaaagcataaagaaaatatcaatctccagatcgaaatggcaaaaaaagtcactgacaaaataagcaagtcgaacagagaagcaatgctccgtgaacaactgaaggtgattcaggaagagctcaacgaaggggatgactcggcttcaggcgatgctgcatacagggagaaaattgaaaactcaactatgcctgatgaggtaaaaaagaaggcattttccgaattaaagaaactagaaaccggaggcagtcacaatcctgaagcccctggtataaggaattatcttgacctcctgctcgacctgccctggataaccgaagagaaaaagagcatcgatatcgccgaagcccgtcgtgtgcttgagagcaaccacaatgggctggaaaaggtcaaggagagaataatccagcacctggcagttatgaaattaaaacacgagaagcagggctcaattctgctcctgataggaccgcccggaaccggtaaaacaagccttgggaaaagcattgctgatgctctgggcagaaaatatatccggatcagccttggaggtgtcaaagacgaagctgaaatccggggacacagacggacatacatcggcgccctgcccggaaggattattcagggcatgagaaaagcaggcacgaaaaatcctgtgtttattcttgatgaggttgataagctttcagcttcttactctggagacccggcaagtgctctcctggaagtccttgacccagaacagaacagcacgttctcagaccactatctggaaatcccatatgacctgtccgatgttctattcatagcgacagcaaactctatggcaaatattccctggccgcttcttgacagaatggagaccattgagatttcaggttacacaaagaatgagaaacttgcaattgcaaaagatcacctggtgccttgcatactggaagaccatggtcttgatgcggagaaacttaaaattgaagatgaggcccttaaagtaatcatcgataagtatacccgcgaagccggagtccggggacttaaaaagcagcttgctaagactgcaaggtttgtgtcagaaaagatcgtatcaggcaaggccgaccttccttacgtggtcagggctgatatgctcaaagaaattctcggaaaagagataatccggcaggaagaggccagaaaagaaaatgtacccggcgtggttacaggacttgcatggacgcctgtgggaggagatattctcttcatagaaggtacttttatgccaggcagtggaaaactcacacttacaggccagcttggggatgtgatgaaagaatctgcaaagatatcgttgagccttgttcggtcacggcttgcaaacaccgcaaatagctttgactttacttcaagcgatatccacatccatgtgccttcaggtgcaaccccaaaagacggcccgtcagcaggcgtaaccctctttaccgcccttacatccctgataatcggaaaagcggttgatcccaaacttgccatgacaggggaaataacgttgagcggtgcagtactgcctgttggaggcataaaagagaaagttctggcagcccacagggcaggcataaagaagataattttgcctaaagaaaacgaaagagaccttgaagatgtgcccgaagatgccagaaacgaacttcagttcgtgcctgtagagaccattgaagaggtcttgagagaagccctggatattgatctacccaggccggtagtaccatcatcatatcctggaagcagttatgcacctgcacatagtgtataaaagttaaga

SEQ ID NO: 34866 - DNA, 276 bp, Methanosarcina mazei
atcttaaacagggtatatgagatcatactggatcgaaaacagaactatgacgagcgctcatatgtctgcaagcttttgaaccatcgtaaaggtatgaacaagattcttgaaaaagtaggtgaggagtcaattgaaacaatccttgcagtcaggaatgaaaaccatgaagaaatcgtttctgaaagttcagaccttattttccatcttctggtaatgcttgcggcaaataatgttacccttgatgaaatcgcagccgagctcagtgcccgacatgaa

SEQ ID NO: 34867 - DNA, 1094 bp, Methanosarcina mazei
atggaaaaacacaaaattgcaatgatcagtgattggtattttccaaaggtaggaggaatcgagtattcaatgcacacccttgctaaaaccttgagcatgcatggatatgaggtgagcgttattacaagaagctatccgggtgttcctgaatacagtaaaagggatggagtatcagtgataaggctcaaaggtagacctttgccaggacagagtcgatttctcatgcccggcgcatataaagaactcttcaaccttttaaaggatggggattatgagattgttaattgccatggattggattcacccataggcatgattgctcttattgtctcccgaaaacttggaattcccgtagtagttaccaatcactccctggtaggagatacaccatatagttcgcttttatatcttgcaggtaaattgcttctaaagaataccgacgctgtaattgcagttagttcagcagttgaaaaagactcaaatctgatgacaaaaaaaccgatttaccgtattttcaacggggtagattctgaagataaaatcatcaaagtccctttccctgttaataccgaaggaaaacttgtaatcgtcacagttgcacgcatgacaaggaaaaagggcgttcaaaacattgtagatctagcccctttacttctggaaaaacataaaaatttgctgtttgtaatgataggagacggcccactcagggaaaagcttgaaagcacggtagaagagtcaggtttatccggaaatttctactttacaggggaagtatcaaggaaaaagtgctgggatatctggaacaggcagatatctttgcccttccttcgagtaatgaagcttttggaatttcgattctggaggcaatgtcaaaagaggttcctgttgtagcaatgaataatagtggggtttcggatattatcagaaatggagtaaatggctatcttgcagacagccttacagaattttcagactatcttgagaaccttatagaaaaacaggccctgcgaacttccttttccaggaaggctttaagagggctttcaaattatgactggaacctgatctgtaaacagacaagcaaggtatataca

SEQ ID NO: 34868 - DNA, 1839 bp, Methanosarcina mazei
gtggttctgaaccataatggttgggtgaataatgttgtattcagtcctgatggaaaatacgcagccacggcgagtaatgataatacagcacgtttatgggatgcagatacaggtaaacaaatttttgttctaaaccatagtggttgggtgaataatgttgtattcagtcctgatggaaaatacgcagccacggcgagtaatgataatacagcacgtttatgggatgcagatacaggtaaacaaatttttgttctaaaccatggcgattgggtgaataatgttgtattcagtcctgatggaaaatacgtagctacggcgagtaatgataatacagcacgtttatgggatgcagatacaggtaaacaaatttttgttctgaaccataatggttcggtaaataatgccgtgttcagtcctgatggaaaatacatagctacggcgagtaatgacaatacagcacgtttatggaatgcagatacaggtaaacaaatttttgttctgaaccataatggttcggtaaataatgccgtgttcagtcctgatggaaaatacatagctacggcgagtaatgacaatacagcaggtttatgggatgcagatacaggtaaacaaatttttgtactgaatcatggtagttgggtaaataatgttgtattcagtcctgatggaaaatatattgctacggcaagttttgacaatacagcacgtttatgggatatagctacaggtaactcaatctttgctctgaaccatgatagttgggtgtatgatgttatgttcagtcctgatggaaaatatgtagctacagcaagtggtgataatacagcacgtttatgggatacagacacaggcaacccaattttgattatgaatcataatggttcggtaaataatgttgtgttcagtcgtgatggaaaatacatcgccacggcaagtgatgacaaaacagcaggtttatgggatatagctgctacagaagttctgaaccataatggtccggtatatggtgttgtgtttagtcgtgacgaaaaatacgttgctacagcgagtggtgacaatacagcacgtttatgggatacagatacaggtaaacaaatttttgttctgaaccataatggtccagtatataatgttgtgttcagtcccggtggaaaatacgtagctacagcgagtaaagacaatacagcacgtttatggaatgcagatacaggtaaacaaatttttgttctaaaccataatggtcgggtatacaatgctgtgttcagtcctgatggaaaatatattgctacggcgagcggtgacgatacagcacgtttatgggatacagatacaggtaaacaaatttttgttctgaaccatagtggttgggtgtatgatgttgtattcagtcctgatggaaaatatattgctacggcaagttttgacaatacagcacgtttatggaatgcagctacgggtgaacaaatttttgttctgagacattctgataaggttcttagtgctgtgttcagtcctgatggaaaatacgtagctacggcgagtaatgacaatacagcacgtttatgggatgcagatacaggtaaacaaatttttgtactgaaccatggtagttgggtgaataatgttgtattcagtcctgatggaaaatacatagctacggcgagtaatgacaatacagcacgtttatgggatgcagatacaggtaaacaaatttttgttctgaaccatagtggttgggtgaataatgtcgtgttcagtcgtgatggaaaatacatagctacggcgagttatgataaaacagcacgtttatggaatgcagatacaggtaaacaagttttt

SEQ ID NO: 34869 - DNA, 660 bp, Methanosarcina mazei
atagaaataagaaaattatccagatactttggaaacctgcttgctgttgacaatcttgaccttgatgttggaaatgagatctttggccttcttggccctaatggagcaggcaaaagtacgacagttatgatgcttacaactctactaaaacccagcagtgggactgcaaaagtctgtggatatgatatagtaaaagaatccaaaaaagtaaggtcaaagataagctatgtaccccaggatatggcagttgaccgaaaactcacaggtagggaaaatgtactgctttatgcgaaactctatggcatccctaatagggagtcaaaggtagatgaagtgattgaaatgatggggctttcagatcgtgccggtgaccttgtagcaacatactccggaggaatgagaaggcgccttgaacttgctcaggcgcttgtgcacgaacctgaggttctgtttctggatgaaccgacccttggactggatgtgagtggcagaaagaagatatgggagcatatcaggatgctcaaggccgaagggatgaccatcttcatgactacgcactacctcgaagaggcagaaaaatactgcaatagggttgctattatcgataaaggacgaattgcagttatcggctctcctgaaaaccttacacactccataggg

SEQ ID NO: 34870 - DNA, 1260 bp, Methanosarcina mazei
ggcccgagagccagggagattatcgaacaggactgtaaaataacatcagcctgtacagcccgtccatatcctctggttgtggacagcgcaaagggttctgtaatcagggatgttgacggaagagaatacattgacctgattgcaggaattgctgttatgaatgcaggctattccaatcctgaggttaaagctgcaatctcagctcagcttgaaaaaatgactcactgcggatatggagatttctttgccgaacctcctgtaaagcttgcaaaaaagttagaagacctttcaggctattcaaaagtattttactgtaacagcgggactgaagccgtggaagctgcaatcaaacttgccttctggaaaacaaaacgtcagggccttatctcattttataactcctttcacggccggaccctgggctccctttctcttacctgctcaaaagccaggcaaaaggaacattttcctgtgcttcacacagctcattcccattatgcctactgttaccgctgtccctttaaactcgagtatccttcctgcgggatcgagtgcgcaaaagagcttgaaaacctgattttcaggcgggaattgagcccgacggatactgccgcagttttcgtggaaccggtccagggagaaggtgggtatatcgtcccccctcctgagtttcataaggaagtgaggaggatctgtactgataacgatgtcctccttgtagcggatgaagtccaggcaggttgtttcaggacaggccctttccttgcaatggaaaattttggggttagggctgaaatctcatgctttgcaaaagctcttggaggagggcttccgctgggagcaatgcttgcagaccgcgagcttatggactggccacagggcatccattcaaacacttttggaggaaatcttctggcttcagccgcatctctcgcgtctcttgagtttctggaaaaggaaaatattgagcaccgagtaaaggagcttggttcccagatgaagcaacgcctgagggagcttcaggaaaactttccatgcattggggacgtacgcggcctcggactgatggtcggagttgagattgtaaaacctgataaatcaatcgatccgatacagagggatagaattctgaggaaagcctttaaagaaggaattctgcttctcccctgtggagattcggtaattcgtttttctccgccgctggttatcacagatgaagaacttgactctggacttgagaagtttcagaaggctctggaa

SEQ ID NO: 34871 - DNA, 1440 bp, Methanosarcina mazei
gattttatggttcaggagtacaaactgtttatagggggagaatttaaggactcttcaaccggagagacttttgaagatataaatccggctactctggaaaacctggcaacaatacaggtcgctggagccgaggacgtggacatggcagttgaggctgctgaagcagggttcaggctctggaacgaggttccggctgcaaaaagagctgaggtactcttcagagcagcccggattttgcaggaaaggaaggaagaactgtctgtccttatgacaaaagagatgggaaaggtgctgcctgagacaaggggagatgtacaggaagccattgatatcacaaattatgccgcaggggaaggaaggcggatgcttggagaaacaacgacttccgaactcaaggaaaagttctgcatgaccatactcaggccgataggagtagttggcttaataacaccctggaactttccgattgccattcctgcatggaaggttatgccagctcttgtagctggaaacgcaattgtatttaagcctgcaagtgacacgcctctgcttgccttcaagctgatagaggtgcttagtgaagcaggcttgccccccggagtgataaatctggtaacagggcccggaggcactgtcgggaaagctgtagtccagcaccctcgcataaaagctatctcctttacaggcagccttgataccgggaaatggatcatggaagaatgttcaaaaaccatgaaaagagtctctctggaactcggaggcaaaaacccggtaattgttatggatgatgccgaccttgaactggcccttgagggtgtgctgtggggagcttttgggactacagggcagcgctgtactgctacgagcaggctgattctgcatgagaagataaaggacgaattcataaaaaggctgcttgcaaaagcaaaggctctcagtataggtgggggacttctgcctgagacggacatcgggcctgtaataaacaaagcgcagcttgagaagatcgaaagatacgtgaaaataggaaaagaagaaggagcaactcttctttacggaggaaacagaatcgatccagggcttccaggctatttcttcgagcccacaatatttacggatgtcaggccggacatgcggattgcacaggaagagattttcgggccagtcctcggaatctttacagtttcagaccttgaagaagcaatcacacttgctaatagtaccaaatacggactttcttcggcaatttacaccggaaatataggaaacgctttcagggcaatcgaaaaagtagaagcaggaatcacatatgttaatgctcctacaataggagccgaagtccatctcccttttggaggggtcaaagggacaggcaacggttttcgggaagccggtaccgaggccgtcaaggagttttccgaggtaaaagctgtgtatata

SEQ ID NO: 34872 - DNA, 450 bp, Methanosarcina mazei
agcgacctgaaaaaagcaacctttgctgcaggctgcttctggggcattgaagaagctttccgacaggttaaaggtgtagttgcaactgcggttggcttcagcggcgggcattttgaacgccctacttatgaacaggtctgcacccttgataccgggcatgccgaagcagttcgggtaattttcgacccaaaagtggtgtcttatgaaaccttacttgatgtcttctggaaaatccatgaccccactacaaaggacagacagggacctgatgttggaaaacaataccgctcagttatcttttatcatgacgagaagcaaaaggcttctgctttggcttcaaaagaaaagcttgaaaaatcaggggttttcaagaaccctatagttactgaggttgtgccggtttcggaattctatatggccgaagagtatcaccagcagtattttgaaaag

SEQ ID NO: 34873 - DNA, 2039 bp, Methanosarcina mazei
gaggatattgaaaatattgaaagctcagttaaggtttccgaggatattgaaaatattgagagctcagttaaggtttccgagaatagtgaaaccactgaagccacaagtattgcccttaataaaaccttccacttctggcatgtatatgtgcgaggcctgaagcctggagtccactatgcatatcgaataggtggtccttttgatccctccagaggatgccgttttgatggagataaggtcctgatagatccttattctaaaggaaacaacaaaacactctggaacagagaaaaagcctgcatgccaggagacaaccttgcgttttctatgcgtagcgtggtaattgatatgtcccactacaaatggggaaataacagtcacgtaactgcagaaaagatatatgagatgcccggaatgggcgaaaagctctacggcaaaaaaaggctgcaagaactgaatgaaaccatcatctatgagctacatgtaggcggattcacccgatctccaacatcaggggctacagcgtccggtacattttcaggagtaattgacaaaattccatatctcaaggaacttggtatcacagctgtagaattaatgcctgtctttgattttgatgatgcaacaagccttgacggaagaaaacaatactggggctatgaccctatatgtttttttgcgcctcatagcggctattgtgtgaatcctgagtatggggctcatatggaagaattcagggacatggtaagagctttgcacaaagctggaattgaggtagttcttgatgtggtcttcaaccatacagctgaaggagacaacctgggtccggtattttctttcaagggtatagataacagcatatattatctcctggaacctgacgagcaatactacagcaattactcgggttgtggaaacacagtgagctgcaaccatccgatttcccaaaaattgatagttgattgcttgaaatactgggcaaaagagatgcatgttgatggttttcgttttgatgagggctctatcctttcgctggataccaatgggaaggttatgaagtatcctcctgttatatggcagattgaacttgacgatgctctcggatacataaaagtgattgctgaagcctgggatgcagctgcactcaatcaggtaggatacttcccgggcccaaggtgggctgaatggaacggttattatcgggatgagatccgccgctttgtaagaggagatcccgggattgtaaggagggttgcaagccggattgccgggagccctgacctctaccagtccgaatcaaggcttccgatcaatagtgttaatttcgtgacttgccatgatggatttacacttaacgaccttgtttcgtataaccacaaacataatgaggctaacggggaaaataacagggatggaattgagaataatttaagctggaactgcggggttgagggagagaccgaagaccggaggtcgaaaccttgcgggaaagacagatcaaaaatttcgctgcaattctgttgctgtctataggggttccgatgatttgcatgggagatgaagtcagacgcactcagaaaggcaacaacaatgcttattgccaggataatgagaccagctggtttgactgggacttagtagagaaaaatcacgatatgttccgtttctggaaattgatgattgattttcggaaacgccatactactatccttcgcccccgatattttacaggcaaagaaaacgaacgcgggctaaaagatatttcctggcatgggtgtaagctctacagtccaggctgggatgaccctcatgcaagagccctttcttttaccatgggggaaccaggagatgaagaagatatacatgttctgatgaatatgtactgggagcctcttgagttcgaaattccagaactcaaaggtataagtagaagctggtatagagcagtcgatactttcctgccttctcctcaggaaattgccggagccggagaagaaactcaggtcaacgggaacagctacattgtgcagggtaggagt

SEQ ID NO: 34874 - DNA, 879 bp, Methanosarcina mazei
ggcgagataaaagctgtcgataacatcagttttacggtaaaaaaaggggagatattttcttttctcgggccaaacggggctgggaagagtactgtaattaatattcttaccactctcctgcctatgcagaaaggaagagtaactattgcaggctatgatttgagaaccgagcctgaaaaagtcagggaatcaatagggattgtctttcaggagttaactcttgatagggatatgactgttcgggagattcttgaataccacggaaggctctattccatgccaaaagttcaaagacaggcgcgtgttgacgaattactcagtctggtagagcttgaagcaaaaagggatgtcctgacaagacatctgagcggcggaatgaagcgcagacttgagattgcaagagggctcatgacccgtccgagagtgcttttcatggacgagcctacaatcgggcttgaccctcagacaagaataagaatctgggattacgtaaaggacatcaaccggcagggcacaactattttcctgacaacccattacatggacgaagccgaccagctcagtgacagaataaacatcatagatcatggtgaaatcattgtcacaggcaaaccctgggagttaaaaaatgcgcttggtgaggatcttatatatctcgaaacaagtgataacaggggagcttccagcctgttagagaaacttgatactgtaaaaggggttcgaggcaaatcaaaaggaataattgccatggtcaatgtggacggtacctacctgctgcctgagatcatggataaacttcggaacggggggattaagatcagggccgtaaaccttaaaaagccatcaatggacgacgtttttgtccattataccggaagg

SEQ ID NO: 34875 - DNA, 1020 bp, Methanosarcina mazei
ttgtccaaagttgcattaataactggaattacaggtcaggatggcgcttatcttgccgaattattactcgaaaagggatacattgtgcatggaatcaagcggcgatcttcttcttttaacacggcaagaattgatcatctttacaaagacccccatgagagaaatgttaattttttcatgcactatggggatttgacagattctaccaatctgatccgcataatccaggaagttcagcctgatgaaatatacaatcttgcagcccagagccacgttcaggtatcttttgagactccagagtatacggcaaattctgatgctataggaactctcagactactagaggctatccgcatcctgggttttgaaaagaaaacaagattttaccaggcttctaccagtgaactctatgggaaagtccaggaggtcccccagaaagaaactactcctttttacccaagaagcccgtatgccgcagccaaactgtacgcatactggattacagtcaactaccgggaagcctatggtatttttgcatgtaatggaatccttttcaaccatgaatctccaatccgtggtgagacttttgtgacaagaaaaatcacaatggcggctacaaggataaaatacggcatgcaggataggctttaccttggaaaccttgattcaaaaagagactggggttttgcaaaagactatgtagaagccatgtggctgatgctccagcaagaagagcccgacgattacgttatagcaacgggcgaaactcactcagtccgagaatttattgaacttgtgtttaaagaactcggaatcgatataatctggcagggaaaaggagaagaagaagtcggaatcgatgcccttacaaataaaatcttagttgaagtagatcctgagtattatagacccactgaagtagaaatgttgattggcgattcatcaaaagccagaagaaaacttggctggcaaccaaaagtcagactggaagaactggtaaagatgatggtaaagtccgat

SEQ ID NO: 34876 - DNA, 908 bp, Methanosarcina mazei
atgaaagcggttgtccttgtagcaggcaaaggcacaaggatggaacctctaacttccggctgtcctaaagttatgctccaggttgcaaataaacccatcctcgaacatatacttaattcagccatcgaagcaggcatcgaaggctttgtcttcattaccggttatctcgaaaagcagataaaagagtacttcggggacggaaacaaatggggagtaagcatagagtatgtacagcaaaaggagcagctagggactgcaaatgcgataggctgtgcaaaaggctatgttgatgggactttccttgtacttaacgggatatgctcatagagcaggaggactttcaagaccctggtctcaaggacagtagaagctgtcatctgtgtaaaagaggtggaaaacccggcggatttcggagtgcttgaaaccgagaataatagagttgtcaggataatagaaaaacctaaaaatccccctactaaccttgcaaatgccgggatatatcttttcagggaatctatttttgactttattgacagaaccaaggcctcagtgagaaatgagttcgagattacggactccatccagatgctgattgatagtggaacagccgtgggttacagccctctcgaaggtagatggatagatatagggtatccctgggacctcttgaaagcaaacgaataccttctgaaaggccttaagagcagctgtgaaggtactgtagagccgaatgctaccataaaaggagaggttgtaatcggaaaaggcactattatcaggaacggttcttatatcgaaggcccagtagtgataggagagaattgcgatatcgggcctaattgttttatccgcccttccactgcaatcgggaaccatattagggtaggaatgctgtggagataaaaata

SEQ ID NO: 34877 - DNA, 1242 bp, Methanosarcina mazei
aaactcttcggatcttcaggaataagagggatagcaaacaaagaaattacgcccgaacttgcacttaatgtagggcttgtactgggaagccggaaaaaaactgcggttatcgggagggacccaagagtttcggcccctatgatcgagcatgccctgattgcgggaatgactgccacaggctgtgctgttacagaaataggccttgtatctaccccaaccctggcatatgcagccagagaatacgaatgcggtgtaatggttacagcctcccacaacccctcagagtatgtagggatcaaactctggaaccctgatggcatggcctttgactcggcgcagcaggaagagatagaaaaagcgattgaagatgcagacttttccctggttccctggaacctgataggcaagttcgaagaagacggaaatgctatccgagcccatatgaatatgatcaaaaagcttgtaggaagttccagtctaaaagtcgtactggactgcggatgtggagcaggagggacaattaccccatatctccttcaggagcttggttgtgaggtaataaccctgaacgctcagcctgatggccattttcctgcgagaaaccctgagccaaacgatgaaaaccttaccatgctcaaaaaagctgttgtggatttcggagccgatcttggaatcgcacacgacggtgatgcggaccggatgatggccgtagacgagaaaggcaattttgtatcaggagatgaaatgcttgcaattttcgggctatacgagtgcagtggtaagaaaggaacagtcgtcgtgcctgtggacacttcaatgatggttggcgattctcttcaaggttcagagattgtgaggacaagagtcggggacgtttacgtcgcagagggcataaaacagagtggtgctatctatggaggcgagccatcaggaagctggattttcccgaagatttcctactgtccggatgggatttatgcagccgcaaaacttgttgagattgtcaaggaaaaaaagttaagcgagcttcgcgaagagcttcccaggtacgccacaaaaagaggagctctcccctgtgcaaatgacaaaaaggcagagtttatggaaaaagttaaggctaaactcgagcccctgggaaaagtccttgatatagacggtattcgcgtggaaatggacaatggatgggtacttgtccgcccctcagggacggaagcaaaagttagaatcacagctgaagcccga

SEQ ID NO: 34878 - DNA, 1851 bp, Methanosarcina mazei
atgtgtggaattgtaggatatgcaggggaaaactctgctgcatctgtcatcatagagtctctcaaaaaactcgagtaccgtggatacgattctgctgggatttcaattctgggcagcggaatcgatacttataagtcagtaggtaaaattgtaaaccttgaagccacaatcccagatggaataagtggtaacattggaatagggcacacccgctgggcaacccacggaagacccagcacaataaatgctcatccgcatacctccggaaacccatgtaaaatctcggttgtgcataacggaatcatagagaactacatggcattgaaggaacaactgactgcagaaggatatgaatttaaatcggaaaccgataccgaagtgatcgcccaccttctgcataaacacatatacggcaaacccgatggaagagaagcaaaatgcgaacttcttacaggactgcgggaagcgctaaaagagatagagggttcttatgcccttgcagttatctgtgctgacgaacagggaaaactcatagttgcccggaaagacagcccacttgttataggactcggcaaaagagagaactttgccgcatcggatgtaactgcttttttgaattatacgagggatgtaattttcgtaaatgactttgaaaccgcagtcctgactcctaccagtgtagagatctttgacagagaaggaaaagtccgcgaaaagaagatagaaaagatcgagtgggactttgaagctgctgaaaaggccggttacgaacatttcatgctcaaggaaattcacgagcaggtgagtgcgattcacaatacacttgcaggcaaggtctcggaacttgaaggaacaatagatctcaaagaacttaatatgaccgatgaagagataagaaaactttcaagggtccagattctggcatgtggaacctcctggcacgcagggctacttgggaaatacctttttgagcagcttgccggaattcattgcgatatagacatttgctcggagtacaggtacagaagcccggttataagtgatggaactcttgccatcgcaatcacccaatccggggagactgcagatactctcgcggccgtcagggaaataatgtcctacaactgccctacgcttgcaattacaaacgttgtaggaagcaccattacaagagaagctaacagtgtgctatataccagagcaggacctgagattggagttgctgcgaccaaaaccttcagcacccagattacacttctttatctgcttgctgtcaagttcgccctgtcaagaggtaagctaagtcctgattatgttaaaggattcattacaggtctaagaaaaataccaggccagattcagcagattctcaaccagaaagaagcagtaaaggaatgtgcagagaattttgctcatgaagagaactacttcttcctcggcaggcaccttaactatccgattgcccttgaaggagctctcaaattaaaagaaatctcatatttgcatgctgaaggttttgccgcaggcgaacttaaacatggaccaattgcgctgcttgagaaaggaacgcctgtagttaccatcgcaacaagagggcagacttacgagaaggtgctgagcaatataaaggaagtaaaagccagggatgcgacggttatcgcagttgctgataacaaagacaccgagatcggaaaatatgcggatgttgtccttacaattccccaaagtagcgaactgctttctccgctgctcagtgttgtagtcctccagctgcttgcttattatactgctcttgctcggggatgctctattgacaagccacgtaatcttgcaaaaagtgtcacagttgaa

SEQ ID NO: 34879 - DNA, 1080 bp, Methanosarcina mazei
atcatgtgcggaggggcagggacaaggctcaggccactaactttcaagcatcctaaacccagcataccgattcttaataagccgtcagtccgacatctgatagagcatctttcaagggaagggttcaatgaaatagtcatgaccctagggtacatgggagagcgcatagaagagcagctcggagacgggcacatgtttggagtacatatcgactatgtgtatgagaaagaaaaactcggaactgcaggcggcgttaaaaatgctgaagagtacctgaaagacgagccgtttatcgtgcttggtggagatcatgtacttaacctcgacctgagggagatgtaccgtttccatgaagcaaacgatgctccggtaaccatagggcttctttcgattgacgacccgagagaattcggaattgcggacatggacattaacaaccggatccaccgcttcctggaaaaaccgaaagcaggccagatattcagcaacctcgcaagcactggaatttatatttgcagcccttctatatttgaatggatccctaaaggtaagaaatacgactttgcaaaagaccttttccccttcatgcttgcagccgacaaaaaaatcaatggtgtacttgtccggggaaaatggactgacgtaggaagttcggccgcctacaggcaggcgcagcgctggatgctcgatgcccttcctggaacaacaatcgaagggaatttcacaacccggaacgcaagaataaagggccctctgtccataggaaacaatgtatgcataggttcgaattcttcccttgtagggccaatagtaataggagaaaacacaactataggtgataatgtccttatcgggccttacagcgtgataggctcaaactgcactatagagaacaatacaaagatcctttcatcttatctttttgataatgtgtttataggaaaggactccaatctctcaggaggagtggtgtcagacgaaacaattataggagaacactgcttcctcgaaaatggaaccgttatcggacataaagtactgatcggaagtaactcaacaatacattccggagttaagatc

SEQ ID NO: 34880 - DNA, 657 bp, Methanosarcina mazei
atgaaagacaacttaccggaaaaaggtgcaatcgttcagagagaccgtgaaacctatgcaatcgcccctcatatcccaggaggaattgcggaccctaacactctcaggaagatagccgacgttgcagaaaaatatggagctgctgcccttaagatgacttctgcccagaggattgcaatcgtaggcctgaaggaggaagaccttgacaatgcgtgggctgatctggatatgaaacccggcgccgctgtagggctttgcgtaagaagtgtaaagttctgtcctgggactactttctgcaagcaaggaaaacaggatgcagtaggcctgggtcttaaactggatgaaaaataccacggaatgtcgatgccttccaagttcaagatggcagtttccggttgtccaaactcttgctctgagcctgccattaaggacataggggtaatgggtactgctaaaggatataccctgatggtaggaggtgctgcggctgcaagtccaagacttgctgaggttgttgcaaaaaacctgtcagaagaggaagtccttgacgcaatcgatagaattgttaatttctataaaaattctggcacgaaaaagaggcttggaaaattcattgacggcgtgggtcttgaggaattcaaagcccaggtaggcctg

SEQ ID NO: 34881 - DNA, 1344 bp, Methanosarcina mazei
aaggactacgatattataattattggaactggaactgcgggcagaacccttgcggataaagtggcacattcaggattaaaaatagctattatcgactcgggagaatatggtgggatttctcctcccagaggctgtgatacaaaaaagatgttcacagatctcgccggggttactgattcaaataatcgattaatagagaaaggtgtagggacaaattatccattaaaaattgactggccttctcttattgaattcaaagggaaagttacgaaagaatgtcctggaagaattgagaaccattttgttgaaatgggaatcgatacataccacgggaaagcttattttgaaaatcaaaacacaatcgttgccggggaagacaaaattaaaggagaatatatttttcttgctacaggttcaaaacctagaaaactcaacatttccggagaagagtatgttaccacaagtgaagagtttatgaaaaccgaaaagctccctgaaagaattatctttatcggaggcggtcacatctccttagagttcgctcatgttgcacgaagagccatgtcagaggttacaattctgcacagaagtgaaaggctcctgaggcactctgatgttgacatggtgaatttgcttataaaagcgaccgaagccgcaggaattaagattcttatgaataaaccagtagcttcaatcgaaaaagacgctaatggctttctggttagaactggttccaaatcaggaaccgagtcagaaactcagagcttccgtgcggatatggtaattcatggagcaggccgcgttccgaatatagaggagcttcatcttgagaaagccgggattaagattgaaaagggagctattgtagtcgataagtacatgagaacctcaaaccctcgaatctatgcaggtggagactgtacatcagagagtctgaaacttaattctgtagcagctcttcaaggagaagttgcagcagctaacatccttaacgagaatagtctcgaagtggactatacaggtgttccaagtgcagttcatgcaatacctgtcctagcttcagtaggaaccagtgcctctaaaaacagtgacaaatataaagtgatttaccaggacagaagcaactggtacacaacccgaaaagcaggaatggagtttgcagcttcaaaggtaattattgatgaagcaaataaccgtatagtgggagcttatatcctgggtccaaatgctgaagaagctatcaatattttcgctgctgtaatacggcttggactcaaagcttcggacataaaaaaactggtctttacttatcctactacatgttcggacattcgttatatgttg

SEQ ID NO: 34882 - DNA, 1011 bp, Methanosarcina mazei
tctagagactttcttacaatcgatgattttgacacgcacggaaagacaattcttgtaagggttgacctgaactcccctatggatccacagggtaatattctggatgatatgcggatccgaagccatattgccaccttgaaggatcttgaggacgcaaaagttgttttgcttgcacaccagagcaggcccggaaaaaaagactttactacaatgaagcctcatgccaacctgatgtccaaatacctgggaaagcaggttctttatgtagatgatatttttggaacttatgcaaagaccaggattgcttctatggaaaatggagatgtcatcctgctcgaaaatgtaaggttctattctgaagaaagcctcgaaagaactccagcagaacaggcaaaaacttatccggttaaaaaactggcaccttttgtagatatcttccttaatgatgcctttgccgtatctcacaggtctcaactttccgtagtaggatttacagaggttctccctaccggagccggaagggtcatggaaaaggaactcacgtctttggatcgggggatcaaaggaggggaacggccaacgattttcgttctcggaggggcaaaagtcgatgattcgctccatgtggcggaaaatgtgctttcaaatggaggagctgaccgggtactcctgaccggagtagtagcaaatgtggcacttgcggcatccggtatagatatcggaaaagtaaatctggacttcatcaaatcccagggctacgaagaccagatcgaaaaagcaaaaagtatacttacgaaattcaaagataaagttggtcttccaagggatgtggctttaaacgacaataagaagcgggtcgaattgcctgtttcagaacttaattctaattctcttcctataaacgatattgggcttgaaaccattgtggactttaccagtgaaatcgcaagtgcaaaaactgttatcttaaacggccctgcggggatttccgaagttgctgagtttgccctt

SEQ ID NO: 34883 - DNA, 4005 bp, Methanosarcina mazei
ctcatagatattacttctgcaatggatacaacatacatcaacacctcaaattatgataagattttttccgggactatcccatataattctactgaagaaaaattcttctataatatgggttccagaggagtcctgaaggaaaacactgagaacttcctcatatatctcgcaaaaacttatggagataaacctgagcttacgaaagactgggtttatgaagatcctatcgaattccctgaagcagcaatttatcatccggatgctcgttctctcactaatgaatctcagccagactggtttgaaaatactactgattaccttgaatggtactctacctcaacgaactcaaattcaactaactcaaatgaatcacgacatatttacgacaagagcaaacccactatagggatatggttccatgcttccgactatacaggtgacaaccttgaagtcatagatgctcttatccacgatctggaaggaaagggctgcaacgtaattgcaggttttgatactttcaacgatattcataagttttactttgacgaaagcggagaacctcttgtccagtgtgtaatttctcttaagagcttccgtttgaattatgatgatcctgataaaggtgtacaggagcttgaagaccttgatgtgcctgtcctcacgggattggttgttacaaaccctgctaattctactgacatagctgatagtaatagaggtatccccagtgaagaggttgtatacaagactctgctcccgagcattgacgggattttcgagtacattgtaataggaattgataattatgattccgcaacaggtgaaagcaactatgaacctctgccttctcagattgactggatggcaaacaggtcgattaactgggcaagcctgaagttagaagaaaacgaagacaagaaagtagctatgatttactataattatccttcaggaaaggacaatattgtagcaaattatctcaactccacccagagcatgtttgaactcctgaatgcaatgaataaaagtggctatgaggtctccggaattccggaaaacagtagtaagctcatggagatgcttcaggcccagggcatcaatgttggttcctgggctcccggagttctgaatggaatggtggaaaataggactgaatggggccttcaactcatacctgtggatacctataaagagtggtttgggtctgaaattccggaaaatctgagagccaatgtaacagctgaatggggagaaccctggtccgaagatctgcctcaaaataagagtgttatgatctatgagaatgaaaccggtaaatacattgtaattccaacggtgcgtttcggaaatgtctggctcatgcctcagcctgccagaggaacaggacaaaataatgacaccctttaccacagcaacgttgtacctcccacacatcagtatatagctttctatctctggctaaaccatgaattccagcctgatgcgcttattcatatgggcacgcacggtacgcatgaatggctcccgggccccacttacggcatgaaccggactgcagactggtctcctcttctgcttcaggacattccgaatatctacccctatatcgttgccaacgtgggagaaggaataactgcagagtacaggggtaatgctctaattattgaccatttgactccaacccttgaacgcggtgggctttatggagatttgctaaacctttcaactgatgtggaggggtattacgaccccgggatttcttctcagacaagagcaggatatcagaatgccatagtaaatgagataatagcactcaacctcagtgttgatctgggtatagaaaatgtaactgttcttcaagattacaacgaaacggagtttggaaatttcgttaaaaacattcttcatgaatacctggaagacgtaggaaatgaaaatatcccatacggtatgcatatcctcagccatgttcctacgacgaatataacaggtcctgaaagtgatgaacttaccggaatggtaagggctatgcttggaggtagctttgaggataatatcactgccgccttctaccctgaatcttcatatcctcttggaattccattgaatgatacaaaagttaccagacttgtctgggaagtcgtaaccaataatacgagcgtttctcaggcgcagactgcagtttatgggataactaacagcacggttacacttgatctcgaacaggggctggattataaagacaggctccttaactgcgatgtggagattgacagaattctttcagccctgaacggaggctttattccaccaggttctgggctggaccctgtaatgaatccggatgcagttcctacagggcgcaattattacagcataaattcgaagctctatccctcagaagcaacctgggaagttggaaagtctcttgcaatccagatgcttgaggactattataatgaacatggggaataccctaaaaaagtttcattctcaaggttcggggtggagtttattgcggaccacgggactctggaagccgaagtgctctacctgcttggagtaaaacctgtatgggacgagtacgggtatgtaaccggagttgaagctatccctgaagatgaactattgccaaattatgatacttcaactcctgggaggccgcgtattgatattgtttatactaccgcaggtatgagggacgctttcccggataagatcaaaatgatagatagtgctgtaaagcttgcaagctctcttcctggcgtaaactatccaaattatgtaaatcagagctctctcacactctacgattccctgatatctgaagggtatgacaacgagactgcaacaaagatctctacaatgcgctgctttgcagtaatggacggcacttatgatataggggtctcagatgctatcagtgcaagcgggtcatgggataatgaagaagatattgcaaatgtatacttgaacaagatgggatacgcttacggagaagatttctggggaatacagtccagagcactcctggaaggcaacctgaaaagcgttgaagcttcagtacattcgtcctcttcaaacctttatgactcccttgataacgatgaccttttccagtatttcggcggcatgaacctggcaacgaggtatcttagcggcaatactccggagatgtatatttcggacacaagtaactcggacggggctcagatgttgggaatgcaggagtacctcagcaaggacttgcgggccagatatttcaacgacaaatggatcgaaggaatgcaaaaatccggatactcaggcggcagcatgatgtccgaatttgtggacaacctctttggatgggaggtaagtgaccctgaccttgtggacgatactgtctggcaagaagtgtatgaaacctatgtaaatgatccttctatgaaagaatggttcaagcagaataatcccagtgcttaccagtctgtaacagcgagaatgcttgaggcagtcaggcacgattactggacaccctcagaggatgtcattgaaagcctttcaaaggaatacgaagagtctgtcgccgagaatggggcttcatgctgtcaccacacctgtggaaatcccctgcttcatgaattcgtaagtggaaaagtatctgttccgggctactccgagcaaatagaagcggcaaccaaagtcgaaactctggagaccacagaagagacccagagcagtagcggtggtagccatcacgaccatgatactggaaatgctaccgtaataccaagagccagttcatccagtaaccagacgtctcaagattcggacggaggatatggtacagatacttccgaacctgatcctgaagttcagaaatcttcagatactgattatgttgaagggtatgagatgcagaaagattctgctgaagaacctgataatagtgggttctcgttttcgggatctgatattatcggaattctccttgtagtggtagccgccggcggaatttaccta

SEQ ID NO: 34884 - DNA, 1641 bp, Methanosarcina mazei
gtggaattggatattctggtaagtgagacccttaaagccaggtatctgcatgaaggggaaaataattgggaggacatctgcgagagagttgcagaagcagttgcattaactgatgaagagtatctagatttcaaagacctcatgcttagaaaggtttttcttccaagctcgccgacgctcatgaatgcgggcacagagtttgggcaacttgcagcttgtttcgtaattcctgtagaagacaaagtcgaggaaatcttcgattcgattaaagctgcagccttgatccagaaaaccggaggaggcacagggtttgatttttcaaaaatacgtcccgaaggttcttctaactcatgtggcgatgacgcgacgagcggtcctgtagctgtcatgaaacttttcaatgaggcaactgagatcgtaaaacagtttggaaggcgacgaggtgccaatatgggcatccttgatatttcccacaatgatatcctttctttcatcaggtcaaagcatgtcgaaggagagttgagcaatttcaatatctcggttatggtgcctgatgctttcatggaacttgttgaagcagataaggctgatgaagtttggaacaggcaaacagatgtgacagtcgggcgcatattttccgagattgtagaaggaatctggagaaacggcgaaccaggcattcttttttatgatcgaataaacagggacaacttcacgcctgcacttggtgatatctcggccacaaacccctgcggggaggaaccacttctgccttttgaagcctgcaacctgggcagcataaacctttctctttgtgttatagacgggaaagtaaactgggactttctcagggaagtagctggaaaagcgatccgttttctggataatgaaattgataaaaatgcatatcctgttccggagatcgagactgcaactaagaggaccaggaaagtagggcttggggtaatgggacttcacgatatgcttttaaagattgggctgccctacgactcacaggaagctctcgagcttgcggaaaagcttatggaacagattacctgggcttcgatcagggaatcaaggaagcttgctgtggagaaaggaagttttccgggatatgaggattccacatgggaacttcctatgaggaatgctgcattaaccgcagtcgctccgacaggcacgatcagcattcttgccggttgttcggcaggaattgagcctgttttcagctgggtttacaggcgaactcagaccgtaggcagggaatttatgcttgttcatccgttttttaaggcgcatttcaaatcaaaactgtcggaagctgactatagctggcttctggagcatgtctataaatacggtacgttgcaggatgtggaaaatccagaacttgtaagcgaagaggaaaagcagcttttcaggtcagcccttgacattgactggaaggctcatattgatatgcaggccgcatttcaacgacattgccatgcaggaatttcgaaaactatcaatatgcctgcttccgcaggaaaagaggatatcgacaaggctttggtttatgcctggaaacaggggttaaaggggcttactatttataggactggaagcagacagtatgtggtgctcagcctacaaaaa

SEQ ID NO: 34885 - DNA, 1095 bp, Methanosarcina mazei
aagttttcagagaacgtggccagaatagatacctcagggatcaggaagatttttgaagccgcaggctcggatgctattaaccttgggctagggcagcctgattttgacaccccggaacatattaaggccgcggcaataaaagctataaacgaaggctttacgggttatacggtcgggccgggaattccagagttaagagaagccctgagttccaagttcaaggaagagaacgggttctcggtttcccctgaggaaataattgtaacttctggagcatcggaagctcttgcaattgcccttgcagccctcttaaaccatggagatgaggtccttatctcaaaccctggcttcgtttcttacaatgcacttaccgaaatcctgagtggcaaagccgtaggtgttcccctcgccgaagaccttactatgaagcctgaggccgtgcttgagaaaatcactccgaagacccgagcgatcgtttttaattctccttcaaatcccacaggtacagtcgcaagcagggccgatataaaagccctggccgagattgcagacgactacaatataaccattatttccgacgaagtctacgagtacttcgtttatgaaggagaacacgtaagtcctgccagctattcggacaatgtgattaccgtaaatgcgacctcaaagagctatgctatgaccggatggagactagggtacgtggcagccagaaaagattacataggccagatgcttaaggtgcaccagtatttccaggcctgcgccaactcaatagctcagaaagccgcttatgccgcagtggcagggcccaaagattcgatcaaggctatgcgagaagagttcagaaagcgcagggacgtacttgtaaaagggctgaatgatctaggaatggaatgtgcccttccaaaaggtgctttctacgctttcccaaaagtcccgaattccacagaggttgcctcgaaatttatctcaaacggcgttattgttactcccggcacagccttcggaagcgaaggagacggccatatcagaatttcctatgctgcttcaatgaaagatatcgaaaaagccttaggcatcatggaaaaagta

SEQ ID NO: 34886 - DNA, 2019 bp, Methanosarcina mazei
cttattgtaacggaaaaaaatatagcagcaaggaggatagctgcgattctggctccaaaaaacccgaagaaagatagagtcagtggagtagacgtgtaccggtatgagattgtgtccgatgaagagaagcaggaaactgtagttgtagggctgtcgggccatatcgtagggatcgactttcccaaggagtacaataactggcagaaagtagaatctaaaacccttatcaatgccgatattataacaactcctatcaaccgaaagatcgtaactgcacttaaaggcctggggaaaaaggcgagcagggttacgattgccactgactacgaccgggaaggagaactcataggagtcgaggctctcaatatcataaaacaggtaaatccggatgttccttttgaccgggtgcgctacagcgcaataaccccaaaagcaatagaagccgcattttcaaatgcaacagatgttgattttaatctcgcggatgccggccattccaggcaggtcattgaccttgtctggggcgcagcccttacccgctatatttctcttgctgcaggcaggcttgggaagatgtttctttccgtaggcagggtacagtcgccaactctttctcttattgtggacagggaaaaagaaaggaatgtttttgtcccgactccttactgggagatctatgccgaacttcaaaatacagaaggaaaaaccttctcagctcagcattcaacccgccgttttctggataaaaaggaggcaacaaaagccttcaaaaaactggggaaaaaggccgaattaaagggaatcgaaaaagggaaaaagaccgaccagcccccggctccttttaataccacaggtttcataagtgcagcaaactcaatcgggctcagccctgcaaacgcgatgcgcatagctgaagctctctatactaatggttatatttcgtaccccaggactgacaatacggtctatcccgagacccttgacctgagggctcagattgagattttcaaagaaggtccctttaaagagtacgcagacgctctgcttgaaaaagctgaactcattcctacgcggggaaaaaaggaaactaccgaccatccacctatttttccggcttcccttgcaaaagagtccgacttaaaagaggacgagtggaaggtctacgaacttgtagtcaggcgcttttttgcgacctttgcagggccaagcgaatgggaaactatgcgcttgaaacttgacatcaacggagaagaattcaaggcaaacggggcaaggcttgtggaacagggctggagatggtactatccttacaatgcgcctgaagaccggctgttccctgaactgcatgaaggcgattccctgaaagtgattaaaaaagatatgcaggataaagaaacacagcctccaggccgttatggacagggaagacttatcaatattatggaagagcttgggcttggaacaaaggcaacgcgacacgagataatcagcaagctttattccagggcctacattcacggaaacccggtgcagcctacgaatacctcttttgcagtaatggatactctcgagaagtattcccctactatcacaaaaccagacatgacaaagctgcttgaagaaaatatggaccggattgctgagggcaaaatcaaagaggctgccgttcttgaagaatcgcgggatatgttaaagcaggtcttctcggaactcgataaaaaccgggaaaaaatcgtggaatctctccaggcaggccttagagaagataaaatcataggcacttgctctagctgtggaaacgaacttataatccggcgttcgaaaaggggaggccggtttataggctgcaacaattatccgaattgtaccttttctcttcctctgcctagaagtggacagatcatagttactgacaaggtctgtgaagttcacggcctgcaccatatccgtataatcaactcgggaaaaaggccctgggaccttggttgccctcagtgtaatttcatagaatggcagaaa

SEQ ID NO: 34887 - DNA, 741 bp, Methanosarcina mazei
atggcaccacagatgggctatgatagggcaattacggtttttagccctgatggaagactttttcaggtagaatatgcccgcgaagcggtcaagaggggaacaacagccgtgggaatcaaagcagctgatggggtagtgctgcttgttgacaagcgaataaccagcaggcttgtagaagccgagtcaatcgaaaagatatttcagattgacgaccacataggggctgcgacttcagggcttgtggcagatgcccgttcccttgttgacagagcccgtgtagaagcgcaggtcaacagagtttcttatgatgaacccataggtgtggaggttatctctaagaaaatctgcgaccacaagcaaacttacacccagtatggtggagttcgcccatatgggactgcacttctgattgcaggcgtggatgacaatctgccaaggctctttgagactgacccgagcggtgctcttctggaatacaaggcaacagctataggcgcaggcagaaacgcagtcgttgaggtctttgaagcagaatacagacaagacatgaatatggatgcggctatccttctaggtatggatgcactctatagagctgccgaaggcaagttcgatgcgtctacccttgaggtaggtatcgtgtcacttcaggacaagaaattcaggaaattagttcctgaagaagttgagaattatgttcagcagatccttgaaaaacataaggaaactgagaacaaagaa

SEQ ID NO: 34888 - DNA, 762 bp, Methanosarcina mazei
cttaactatacgctcgactgcgggcaggtcttccgatgggagcgaaacggagattggtggacaggggttgtcggagaccaggttatccggctttctcaggaccaagggcaactgattgttgattcaaatcttcagcccgagtttcttactcgctatttccgccttgacgataatctgccttcaatctacgaaagcataaaccgggatctgctgatcgacagagcaatccgcaaatatcggggcctgcggctgatcaggcaggacccctgggaatgccttatttcctatatgctctcaacagcctcaagcattcccacaatccagaaaagaatctacctgctcagccggtctttcggtcaagaaatcgagccaggctatttcagctttcctgaccctgaaactcttgcaaatgtcgatcccgccgagcttgacaaatgtaagctgggcttcaggacccagaacataatagccgcagccgaagaagttgcgtcgggcgagctggaccttgacgtgcttttccgcctggaatacaggtatgcgcgggaacgccttatgaggctcaggggcattggggaaaaggttgctgactgcgtgcttcttttcgcttttgataaaatggaagcctttccagtagatacccacatcagacagatcatccagcattaccatatagatgacagttactttgaaacctgcaaaaacatgagctgtatgggggactggggaagggaatatttcggacactactgtgggtatgcccag

SEQ ID NO: 34889 - DNA, 1185 bp, Methanosarcina mazei
atgaaagaaatcgaaggtggaatctgtgcagtaaaaggcgtatctgcaaacggaattaaagccggaaaactgggattgactgttattcttgcaaaggggccggcagcaggcgtttttacaaaaaataaggtcacagcagctccggttacccttagtaagggagtaatcgagactcatcaccgtctttcgggattaattgtaaatagcggaaatgctaacgcctttacaggtgatgacggctttctggatgctatggaaatggcatccgtacttgcccagaaacttgatcttgaagctgacacggttgcagttgcctcgacaggggtaattggcagaaggcttgatgtttccttaatcacggaacatcttcctgaagtcctcaatggtctgggcagttctcctgagtgcagccgtgaagctgcaaaagcaatgatgactacggatagagtcgtaaaagaagtagctattgagatggactgcgggatcaggataggagccattgccaaaggttcggggatgatcgagcccaatatgggaactatgctctgttttgcatataccgatgcgaaagtgcctgccgacgtcctggatgctgctctcagaatagcagtggataaaactttcaatatggttgtggtggacggggatacaagtacaaacgacatggtactccttacttccacctgcaagtctggagtcaagccctgtatggactgtctggatgactttgaggaggggctgatttacgtcttcaccgagcttgccaagaaaatggcaaaagatggagaaggtgctacaaaacttattgaagctagggtagttggcgcaaaaacacacgaggacgctaaacttgctgcaaaggcaattgtacgttctcctctggttaagtctgcaattttcggaaaggaccccaactggggaagggttgtagccgctgcaggctactcaggttcggaacttgaacaggaaaggcttgctctctctttttcaggaggaggagaagaggttgaacttgtaaattccggcgagatttccagttcttcggatctagagcttttgaaaaaaataatggcaaatgaagaaattgtcattacccttgaccttaatctgggaaaggaacaggcaatagcctggggttgcgatctgacctatgattatgtcaggattaactctgaatatacgact

SEQ ID NO: 34890 - DNA, 1008 bp, Methanosarcina mazei
atcaaggctggaataataggagcttcgggatatacgggaggagaacttctgcgcttgctcgttaaccacccaaatgttaagctggagctggcaacttcccgaagcctggcagggaagcccgtaacgagcacccataggcatcttgaaggttttctcgacctaaattatgaaaatcctgattctgaagatatcagggagcgctgtgatgtagtctttcttgcagtacctcacggatctgccatgaactatgtacctgaactgcttgatggcaacactaaggttgttgaccttagcgcagactataggcttgaaacctcggaatttgagaaaatctacgggataaagcatagtgacccaaggaatgccgtttacgggcttgtagagctccaccccgaagttgcaaaagagaatttcgtggcaaacccaggatgttttcctacaggttcaattcttgcagcagcaccgcttgcagcagctggacttatcgatattgcggtttttgattccaagacaggaatctcaggagcagggatctcgcccactcaaaactcacattatccaaacctggcggaaaatatcatcccatacaaacttacagcccacaggcacagagctgaaattgtccaggaactgaccgggcttgaaggaaagctcaggaacattaatttcactccacacgtaattccatctatcaggggaatctttacaactgctcacctctttacaaaggagacactctccacggacgacttaaagacgatttacgaggaattttacagggacaggccgtttataaggttcccttcaggagttccttccctaactgcagtcagaggttctaacttctgcgatataagctttgaagcggataaagaaaataacagggttgtcgtgctttcagcaatcgataacctggtcaaaggcgcttcaggacaggctatccaaaatatgaacctcatgttcgggctggatgagacatgtgggctctggatgcctgctacggctccg

SEQ ID NO: 34891 - DNA, 1851 bp, Methanosarcina mazei
atggcaaaaatacttggtattgaccttggtactacgaactcatgcatggcagtaatggaaggcggagaagctgtcgtgattccaaatgccgaaggcgccagaacaaccccatcagtggtcggattttccaaaaaaggagagaaacttgtaggacaggttgcaaagaggcaggccatttcgaatcctgaaaatactgtttattccattaaaaggcatatgggagatgccaattacacggtgactcttcagggaacacagtataagccgcaggaaatttctgcaatgattcttcagaagctcaagaccgatgcagaagcttatcttggagagactatcaaacaggctgttatcacggttcctgcttatttcaatgacgcccagagacaggctacaaaggacgcaggggcaattgcaggccttgatgtcctgagaattatcaatgaaccaacttccgcatccctggcttatggtctcgataagggagatatagaacaaaaaattcttgtttatgacctgggtggcggaacctttgatgtatctattctcgaactcggaggcggagtctttgaggtgaaatctacaagtggtgacactcgccttggaggagatgacttcgaccagcgtatagttaattacttacttgctgagttcaggaaaatcgagggaatcgacctctccaaagacaaggctgtactccagcgtttaactgatgctgcggaaaaagccaagatcgagctgtctggagttgcaagtacaaatatcaaccttcccttcctaacagttggtgcggacggagaaccaaagcaccttgatattgacctgacaagagctcagttccagaagatgactgaggacctccttgaaaagacccttgtatctatgcgccaggctctcagcgatgcaaagcttactccaaatgatcttgacaaagtgattctcgtcggaggtgccacaaggatgcctgcagtagtcgagcttgtggaaaactttacaggcaaaaagccctacaagaacatcaaccctgatgaagccgttgcaattggagcagccatccaggccggtgtgctcggtggcgaagtcaaagatgtcctgctgcttgatgtcactcctctgactctcggaatagaaacgctcggaggtatagcaaccccacttatcccgagaaacacgacaattcctaccaagaaaagtcaggttttctcaactgctgctgataaccagccttcagtagagattcatgtccttcagggagaaagaggagttgcttccgaaaacaagactctcggtcgctttactctggacggtataccaccagctccaagaggcatcccgcagattgaagttacatttgatatcgacgcaaacggaatcctgcatgtaggtgcaaaagacctcggaaccggtaaggaacagtccatttccatccagaagccgggtggtctctcggatgacgaaatcgatcgcatggtcaaagacgcggaattgcatgctgaagaagacaaaaagcgcaaagaagatgtcgaaaccaggaacaatgccgaagccctgatcaatgctgcggaaaagactttgaaggaagccggagatgcggcaaccgaagaccagaagtcaaaggtaactgccgcaatcgacgaccttaagaaagctcttgaaggtaaggacagcgaagatattaaatcaaaaaccgaagctcttcaggaagccgtatacccaatttccactgcaatgtaccagaaagcccagcagcaggctcagcaagcccagcaggctgaaggtgaagcaggaagccatgatgcacaaggtcctgatgagacagtcgttgatgccgattatgaggtagttgacgacgaa

SEQ ID NO: 34892 - DNA, 1065 bp, Methanosarcina mazei
aaagcagtactaggcttagaagacggaacagttattaagggcaccgggtttggtgccgaaggcacagcttgcggcgaacttgtttttaccactcaatttacgggatatgaggaggctctaacagatccttcttacaagggtcagattttaatgttcacttacccccttatcggaaactatggtgtcagcggggagcgcgtccagtccgataacatgcatgcggaagggcttgttgtaagggaggcctgcaaaaagccctatcattataaatcatcccgttcgatcaataaatttttagaggatgaaggaaagccaggaattgaaggtgtggacacacgaatgctcaccatcagggcaagggagcacggaaccatgagggcagcccttatcgcaggcagcgacgacggggaagaggctgttgatgtagcaagaaacgctccccagctcacggatgaggaacttatttcccttgtaacatgtaaagagccatatttcattcccggagcagaaggtgcctggaaaggtggcagcaaacgcaaacatgcggttatagtcgacctcgggattaagcgcaatatcataaacaaccttcacaagcggggaattgaccttactctggttcctgcaactacaaaaccctcggaaattgcaaattatgaacctgaccttctttttatctcaaatgggccaggagacccggaaaaagcaacagatgcaatcaatgctgtaaaggcttttgcaggcacgattccagtctgcgggatctgtttcgggcaccagatcatttcccttgctatgggagcaaaaacctacaagttgaaattcgggcacaggggaggaaaccagccagtaaaggacctgattgaaaacaagatattcataacctctcagaaccacggatatgccgttgatgcggactcacttgacggcacagggctctatgtaaagtacctgaatgcaaatgacaaaaccgtagaaggagtttctcacaaagacctggatgtttttagtgtacagttccatcctgaagcccaggcagggccgatggataccgaggaaacgttc

SEQ ID NO: 34893 - DNA, 3210 bp, Methanosarcina mazei
atgccaaaacgcgaggacataaaaaaggttttgcttataggctcaggaccaatcactatcggacaggctgcagaattcgacttctcaggcagccaggcctgcaggtccttaaaagaagaaggaataaaggttgtccttgtaaactcaaatcctgcaaccataatgaccgatcctgaaatggctgattcggtctatatcgagccacttgatgccaagatagtagaaaagattattgaaaaagaacgcccagacggaattattgcaggtattggagggcagaccggccttaatattaccagtgaacttgcggaaaagggtgtctttgagaaatatggggtcgaaattctgggaactcctgttgaagccattaaaaataccgaagacagggaactcttcaaagagaccatgctcaggattggagaaaaggttcccttaagccgggcagttaattctttaaaagaagccgaagatgttgttgatgaactcggtcttcctcttattgtccgtccggcatacacccttggaggagcagggggcggaattgcccgcacaaaagaagagctgcttgaaattacggaacgtgggctcaggcgcagccgtatcaaccaggtactcattgaagaaagtgtgcttggctgggcagagatcgagtatgaggtcatgagagatgaaaacgatacctgcatcgtgatctgtaacatggaaaatattgaccccatgggcgtgcatacaggagaatcggctgttgttgctccttcccaaactttaagcgatgccgagcaccagatgctcaggagtgcctcaatcaagattatccgagctctcaagatcgagggtgggtgcaatatccagtacgccttaaaagaaggcgattaccgcgttgtcgaggtaaatccaagggtttcaaggtcatcagcccttgcatccaaggctacaggttacccgattgcccgcgtaactgcaaaaattgcaattggaatgaagcttgatgagatcataaacaatgttactaagagcacacctgcctcttttgaacctgctctggactacgtaattaccaaaattcccaggtggccttttgataagttcacaactgcagacaaaaccctgactacagccatgaaaagtacgggagaagtcatggcaattggcaggaccattgaagaatccctgctaaaggcttttaagtccctggatatcgacaatcagttaggaaataagcactgggacgagcctgaaactaaaactctccttaagactcctacaagcgaacgcctttttgttatcttcgatgcacttgagaagggtatgtcggtaaaagaaattttcgagctttcgagcatcaaccccttctttatctcaaagataaaaaggatcgtggatatggaaaaacgcatcagggcagaagaactcactcctgaactcctgcgtgaagcaaaaaagatgggcttccctgatactcgccttgccgaactgactggcagtaccaggcaggaaataagtgacctcagacataaagccggaatcctggctaccttcaagatggtagatacctgtgcagccgagtttgaagcagctactccttattattattctacttacgaggactcctgcgagacaaatgccaccacagataagaagaagattcttattcttggtgcaggcccgataaggataggacagggaattgagttcgattactgtactgtgcatgcagttactgcacttcgggaagaaggcatagaaacccacattattaataacaaccccgaaaccgtatctacagactttgatacctcagacaagctcttttttgaacctcttacccttgagtatgtgatgaacgtaatcgagcgtgagaagcctgatggagtacttgtgcagttcggaggacagacctcggtaaaccttgcaattcccctcaagcaggagttgaagcgcaggaccgaccttaacaccgtaattctgggcacggaccctgatgacatggaccttgccgaagacagggaaaagttctatatccttatgaaggagcttggcgttccacagcctgaaggtggatatgcaacttcccataaggaagcaatcgaggttgcgaagcggatcggcttccctgtgcttgtgcgtccttcctatgtgctcggcgggcgggcaatggaaatagtatacgatgaaatcgaccttgaacgctacatgaaagaggcagtcagggtctctcacgaacacccaatactgattgatgatttccttgaggcagcctctgaaatcgatgtggatgcggtctgcgaccagaaagacgtaattatcggcgcaataatggagcatatcgaggaagcaggtgttcactccggagattcggcctgtgtaattccaccgcagagcctctcacctgaagttcttgatcaggtaagggactatacccgcaaaatagctcttgccctcaaggttaaaggactgattaatatccagatggcagaaaaatgtgggaaggtctatgtacttgaagcaaacccgcgttcaagcaggacaattccttttgtttcaaaatccgttggaatcccacttgcaaagattgcagccaaggtaattgcaggacacagcttaaagagcctgggctacacggacgagccaaaacccaaacatgtctcaattaaggaagtcctcctgcctttcgataaattaccaggtgcagaccctgtccttggcccggaaatgaaaagcactggcgaggtaatggggattgactacgacttcggaagggcatattataaagccgaacttgcagccgacaatgtcttacctcttaccggaaaagtcttcctttccataaggaatgcagacaaaaccgaacttgtggacgttgcaaagaaactgcaggcagcaggtcttgaacttatgggcacagagggcactgtaaactatcttgcacggcacggggtcttcatggatgtagtgaaaaaggtccatgacggaagcccgaatgtcatagatatgatgcgcagggacgaggttgaccttatcatcaataccccgacaagcaaacagtctcgcagggacggttcaaggatcaggcgggctgctgttgatttcaaagtcccgtacatcaccacaatgcaggccgcaatagccgcagccgctgccatagaaactatgaagaaaggagaggaacttacaattaaatccatcaatgagtaccacaaagagatggaa

SEQ ID NO: 34894 - DNA, 826 bp, Methanosarcina mazei
atggcaaagaaagttgcacttgcatattcaggagggcttgacacctcagtgtgcatccctatccttaaggaaaagtacggatacgacgaagtagttacgatttcagtcgatgtcggccagcctgaagaggaaatcaagcgggcagacgcaaaagccgagaagatcagcaacaagcattatacgatcgatgcaaaggaagagttcgttaaagattacgtcttccccctgatcaaagccaacggaagctacgaaggctatgtaatgggaacctcaattgcccgcccgttgatcgcaaaaaaagtggtcgaggctgccaggaaagaaggagcagtagcccttgcgcacggctgcacaggaaaaggcaatgaccagctccgtttcgaggccgttttccgccagaccgacatggatgttatcgccccaatgcgggaaatgaacctgacccgcgagtgggaaatcgactatgcaaaagagcacggaatcccggtggaagtcacaaagtccaagccctggagcgttgacgaaaacatctggagccgcagcatcgaaggcggcaggcttgaagacccctcttttgtcccgccggaagagatcttcgagtggacaacctcgcctgaaaaaacccctgaacagcccaggattgttgacatcggttttgaagctggagtcccggtttcccttgacggcgaaaaaatgagcggctacgcccttgtgaagaacatgaatgaaatcgcaggcgaaaacggcgttgggagaaacgatctgattgcagaacgcgtgctcgggttaaaagctccgcgagaaatattaacacccgggtgcaccg

SEQ ID NO: 34895 - DNA, 1143 bp, Methanosarcina mazei
atgctttacagaaaaattccaaagaacggagataaactttcaatactgggattcggatgcatgcgcctccctgtgatagaggatggaacaatagacgaagaaagggttacccggcaagttagatacgcaatcgatcacggagtgaattacatcgatacggcctggccgtatcacatgggagaaagcgaacctttccttggacgagcccttacagatggatatcgagaaaaaattaaacttgctacaaaacttccctcctggcttgtggaaaatcgagaagatatggatagattcctgaatacccagttagagagacttaatacggaccatatagattattatctacttcatagtctggcaggagaagtatgggataaacttgagcctcttggtgtgattgattttcttaataaagcaaaggacgacggacgaattaccaacgcaggtttttcttttcatgggccaattgaagattttaagcggattgttgacgcttatccctggactttctgccagatccagtacaactttatggacgaaagaaatcaggcaggaactgaaggacttaaatatgcagcctctaaaggactgggtgtaattgttatggaacctcttctcggaggcaatctggctagcccggtacctgctgaagtgaaagatatctgggatgaggctgaaacgaaacgtacacctgcagagtgggctcttcgctgggtgtggaaccatccagaagttacggttgtactctcaggcatgaacgaggaatctcatatagaagaaaacctgaaaatcgcatctgaggcctatccaaactccctgactgacactgaaatgcagcttgttaacagagttgagcaaaagtaccgtcagcttgtgaaaattggctgtactggctgtcgatactgcatgccttgcccttcaggagtaaatatccctgaatgttttgaaatttacaataacctccatatgtttggtaatgtagagggtgcccggtttaaatatgcagtcaggatgagtggcgtatttacaaacactgaacctggaggatttgcttcccagtgcactgagtgtggtcaatgtatggaaaaatgtccccaaaatctaaaaatacctgatctgctcaaagccgtagaagaagatctg

SEQ ID NO: 34896 - DNA, 3941 bp, Methanosarcina mazei
atgaaaattatttcaataacgtggaattcatacattcccactctcctcaaggccgccaacgatcttggtatagagcttgaagcccactattcaaagattctggaagataatccggaagaagccgagaaggttcttcttgcatgcgaacatgcagatgcagtctttctatactatacatcaacccctttctgggaagatttctatgaaaagcttgaaccgttaaaaaagagggtacctgtaatctgtgtaggaagtgatccttcctcacttaccctctcttcggtgaaacttgagattgcagctacatgcttttcttatatcatctatggaggacaggaaaactttgccaatatgctgcgctatctcttaaaggaagtttttggatgtgagattgaaacaaaacctcctgaaaagataccatgggatgggttatatcatccggatgcagagaaaatattctcaaacgttgaagagtatctcaactggtacgggcctttgaaagataaaaccgtgggactgcttatctcccggacttcctgggtaaacaatgaacttgagatagaaaaaaaattgataaaagagttagaaaatcttaacctatcaattatccctgtttttgcatattccttgaaagatgaggaacttggaagcaggggaatgaatgaggtcatagaggattatttcatagaaaacggcaggaccattatagattgccttgtaaagctttctcctttttttattgcaagcagcaaaaccgaagagagaaatgcatcgtgcgcagcaaaaggcatagaagtcctgagaaaacttgacgtccctgttttccagcctgtaacttcacactatatgactgttgaggaatggcaggagtcaatgggattaagcactgagatcggatggagtgtggctctcccggagtttgaaggcggaattgaacccatcatgataggagcaggtaaaaaagaaggaaattacatggggcgttttcctatcgaagaacgctgctcaaaatttgcatccagaattttaaaatggactgaactcaggaaaaaaccggtcaaccagagaaaagttgcctttatcctgcacaacagaccctgtacaggtgttgaaggttcggtaggagacgctgcaaatcttgattctctcgaaagcgtggcaaggatactgaaccggatgcaggaagcaggttatgtcgtcaatcctcctgaaaacggaaaagaccttattgaaaccattctcaagagaaaagcaatttccgagttcagatggactcccattaatgagatagtgaaaaacggaggagcccttgattttgtggaaaaagaagaatacgagaaatttttcaataccctgagtccaaaagtaaagcaaagagtaattgaaagctggggaaaccctcctggagaagaagtagacggcattcctgctgccatggtctatgataataaaatcgttgtgacaggggtgcagtatgaaaacgctgtggtctgcgtgcagccaaagcgaggatgtgcaggtgccaggtgtgatgggaaagtctgcaagatcctgcacgacccggaagttccgccaacccatcagtatctagcaacttacagatatcttgaaaacacctttggagctgatgtactcgtacatgtggggacccatgggaaccttgagttcctgcccggaaaaggagtcgggctttcaggagattgctatcctgatataagcatagggacaattccccatctctacatctacaactctgacaaccctccggaaggtacaattgccaaacgccggagccttgcttgtttgatagaccatatgcagactgtcatgacctcaggagggctttatgaaaaccttgcagaacttgacaggctgcttggggaatacgaacaggcgaaacatgataagggaagagagcacgccctgaagcacctgatccttgatgagatcaaaaatcgaatctgaattccgagataaaagccgatgaccagactccctttgaagaggtagtaagaaaagcgcatgaagctcttgggaagataaggaacacccagatccaaagcgggatgcatatcttcggacaaatgcctgaaggcgagaaaaaagttgaattcataaactcgattttaaggtatgatgaccagggaagtgtgggaaacaaagtctcgattagaaggttgattgcagaacttctggaacttaaccttgatgaactgatctctgaccagagccggatttccgaagacggaaaatcaaatggacagttgcttgaagagatagattcactctctaaagaccttataagaacatttataaataacccggaaaaagagccagcccggataatcaaagagatttttgaaggaaaaagctttgaaaaacagaatatcaaaggaaaaagctttgaagagcagagtgtcaacaaagagataaataatcctgaaatagagccaaacaggataattgaagagatttttgaaggaaaaggttttaaagagcagaaaattaaaggaaaaagttttgaagagcaggaaattaaagatctgagtataaatcccgtacttcttgaggatgccgtttcgatctgcaatagaatccttgaccttgaatcaagaatagatgattcccttgaaattgaagcccttttgcacggttttaatggaggatacatccctgcaggtccttcaggtctcatcatgcgtggaagagatgatgtactgccaacaggcaggaatttttattcacttgacccaaaaagaattcctacaaaagctgcctggagggtaggacagcaactctcaggggtcctgattaataagcacattgaagacgaaggtcggtatcctgagaatgtgggattttactggatggcaaacgatgtaatgtgggctgatggagagggaatggcccagataatgagccttatcggggttgaaccagtctggctaaacaatggacaactgaaagggttctccgtgatcccccttaaagaattaggcaggcccagaattgacgttacggtccgagtttccggaattctgcgggacaatttcccaaactgtcttgaagttatagacgaagcaatccaggctgtggcttctcttgatgaacctggagagatgaattatctaagaaaacatagccttcagatgattgaagaaggagcggattccagagatgctactttaaggatcttttctagcaaacccgggacttattcggcaggagttcagcttgcagtctatgcaagtgcctggaaagacgaaaaagacctggcagacatcttcctttactggaatgggtatgcttatggaaaggatgtaaaaggcaaggaagctcacactcagcttgcgtcaagccttaagactgtagatgccacctttaataaagttgtaagcgacgagtacgacctattaggatgttgctgttactttggggtccacggaggctttacagctgcagccaagcaggcttccggaagagatgtaaaagtttactttggcgatactcgagaacctcagcacgttgaaatccgggacatggctgacgaaatgcgaagggtcgtaagagccaagctcttaaatccaaaatggattgaaggcatgaaacagcacggatataaaggtgcgcaggacatttctaaaagagtgggaagagtctatggatgggaagcctccacccagaaagtggacgactggatttttgatgatatcacaaaggccttcgtgcttgatgaagaaatgcgccgcttttttgaagagaataatccctatgcccttgaggaaatgtccaggcggctccttgaagcacagtcaagaggactctgggagcctgaccccgagcttcttgaagaattaaaaaaatcctatcttgagatcgagagctggatggaagaactggcaggagaaggagaatttcagggtggagctgttgatataatt

SEQ ID NO: 34897 - DNA, 1191 bp, Methanosarcina mazei
atgtcaagcaagacaacatttgaaatagaggacaagtgcctcccgcctttcttcgtgaagcagaaaatctccattgaaaaaggagatggagtttatgtatgggatgaagaagggaagatgtatattgatttcacagcaggttggggtgtaacatgtattggtcatgcaaacccggtcatcaccgaggccttgatcgatcaggggaaaaaaataattcaaaaccccaattcgggacttacatattctccggcacgtgcacgtctactgtccttactcgcagaaattctgcctctcaatcttacaagagtattcttcacaaatagcggagctgaagcaaatgacgctgccattaaacttgctcgaaaggtaacaggcagacctgatataatttctacagatcaaagttttcatgggcgtactatcagtacaacatcggctacaggtcaggccaagcatagagataggtatagtcctctgatgcctaattatcgttttgttccctatgatgacttagaggctatggaaaattctctggacgagaatgttgctgcagtaattcttgaacctattcagggagaaggtggagtttgcataccttctgaaggatatctgaaagaggtaagcaacctgtgcaagaagaacggaagcctgctgatcgtagatgaaatccaaactggcttctttagaacagggccagcttttgttacaagttcctatggtgtgagagcagactttatgacaatggcaaagggaattgcaggtggtttcccatttggtgcttttgctttgtctgagaacgtcgcaaagaaactcgagatcggcgaccatggaggtacatattgtggcaaccctcttggttgtgccgtttcctatgcagtgataaaatacctgatagataacaacatttccagaaatgtagaagaaatgggctgttttgccctgaaaagaatgagcttatggcctaatatttatggaaatgtaattgctgacataaggggaaaagggcttcttattatggtcgaattccagagcgaagagattgctacaaatgtcaaaaacgagtgcttggcaagaggcttgtttgtcactcaaactcagggcaatggaatcaggatatttcccgcactaaacgttaagaaggaagagttagaggaaggtcttttaattatcgaggacgtggtcaagaaaatt

SEQ ID NO: 34898 - DNA, 462 bp, Methanosarcina mazei
atgaaggaaaaaagagacctgaaaattcaggcaattgaaaatggaacggtgatcgaccatataaaggctgggcaggccttgaatgttctgcgtatacttgggatttccagtgcttttcgagctactatcagtttcgttatgaatgcacccggcgcagcaggcataaaagacgttgtgaagattgaaggtaaggaactcagcgtcgaagagcttaacaggattgccctcatatctccaaaagccactatcaatattataagggattttaaagtagttcagaaaaataaggttgtacttccttcttatgttgaaggtgttgtacgctgtatcaatccaaactgtatttccaatagcagtgaacccataaaatccaaattttccgtgctccagtccgaagaagaaggggtaactctaaactgcctttactgtgaacacgtaatttcggaaaatatagccgaaaat

SEQ ID NO: 34899 - DNA, 921 bp, Methanosarcina mazei
atgtcatttaagaacagaaacgtcatttctatgaaggacttttcgcggaaagaaatcaattacattctggatacggcagaaaagcttgaacctgtggccagaggtaaaaagaggtcccggttgctggatggaaaaataatagctcttcttttttttgaaccaagcacaaggacaaggctgtcttttgaatctgctgcgcagagacttggagggcaggttctcaacctgggttctgtggaagcaagttcagtaatgaaaggagaaaatcttgccgatactattcgcgtaatcagcaaatatgcagatcttattgttttgcgtcatcctcttgatggttcggcacgaatggctgcggaatttgcaagtgttcctataatcaatggtggagacggctctttacaccaccctacacaaactttccttgacctctataccattcgcagggaaagccacctagaaggtctgaagatcgctatggcaggagatctgaagtatggaagaacagttcattccctgtgtcatgccctatccctgtacggagctgaaattaccttagtttcgcctcctgaactccggatgccccaggagattatcagggatcttcaaaagaacaatattcgaattagagaaaccgatgctcttgaagaaataattggagacgtcgaggttctttatatgacaagggttcaaagggaacgtttccctgatcctgaagagtatgaaaaggtcaaaaacaagttgaaggttacaggtgacctactgaaaaacgcagatcctagccttaagattcttcatcccctcccacgggtcaacgaaatctctcctgaagtggattcaacaccatatgcatgttatttcgagcaggctttttatggggttcctacgcggatggcacttcttgctcttgctacgggagtgatt

SEQ ID NO: 34900 - DNA, 966 bp, Methanosarcina mazei
attctcgggttcggtgcaatcggacagggcgtggctgaagtattccttatgaaaaaagagtatctggaaagtatcgggctggaagtaaaagtagttgccgttgtggactcaaagggtgcaactgttaatcctgaaggggtggatcttgccgactgccttgtcaggaagaggagagacagaacggtagctcttgagaatatctctggagtcgaggttatccaatctgtagctcatgatcttgtaatcgagactaccccgacaaatatactaactggcggggcaggtatgcagaatatgtttgcggccttcaaaaccggaaaagatgttattacctccaataaaggccctcttacccttaagtacagagaactcatggaagccgcaaaggcagcaggctctcatttcaggttcgaagcgactgtcggtgggtcaatgcctattatcaacctggtaaacgaggtgcttgcaggcaataaggttaaaagtatcaaaggaattctaaatgggacctgtaattatatcctgacaagaatgctggaggaaagagcaagttacaacgacattcttgccgaatccatgcagctcggtattgctgaaaccgatcctacatatgacgtggaaggaattgatacagcctgcaaactcgttattcttgccaacgcaattttcggaattgatgctacttataacaacgttgaggtaacgggaatcacgaaagttacgcctgaagctcttgagatggcttatgaaaaagggcatgttatcaaacttataggtgaagttagcagggaaagaattcatgtagcccccaggctcgtacctatcaaccatccccttgcagtcggagggacgctgaatgtggcgtcagtagaaaccgaacttgcaggagaaattacggttacgggtaagggtgcaggcccgattgaaactgcgagtgcgattcttagcgatctgatcgcaatttat

SEQ ID NO: 34901 - DNA, 2433 bp, Methanosarcina mazei
gtgtccggtatgacctgttcggcctgcgcctcaaatattgagagagtactgaagaaaaaagcaggcgtggactcagcagttgtcaaccttgaacttggaagggcaaatgttagttttgatccctcacttatctctccgaaagaaataggggaaaccatcgagtctatcggatataaggtagaaaaagattccgtaactctgagtcttgaaggtatgagctgtgcctcttgtgctgcaaatatcgagaaagtccttaacaggactgaaggcgtgatttcagcgtctgtaaatttcccgcttgaaaaggcagttgtagagtttgactcctcccgcgtctctgtcagagaaataattgctgcagttcagggaattggctatggagcatttgttaaaaccgaagctgttgagtatgaagacagagagcagatgtccagagacgctgaaatcaggaggcagagaaataacctgataattgctcttgttctgggaattccaatagggctgggaaacatgagtatgatgtttcctttcctgtcttttgtacctgatttcctttccaatcatatcgtcctttttatactatctactcttgtcctccttttccctggcagacaattttttgtagggactattagggggttcaaatatggcgtaactgacatgaacctgctgatcgcagcagggacaggatcagcctatcttatcagtgtagcagccacatttcttgatcttggccctgggtataatagtctgtattatgacaccgtagctttcctgatcatcttcattgtccttggcaggtatctcgaggcaagggcaaggggtcaaacctctgaagcaattagaaaactgatgggcctcagggcaaaaacttccagaatccttgtaaatggcattgaaaaagagattcctgtcgaagaagtagcagttggcgacattgttgttgtaaggcctggagaaaaaattcctgttgatggaattatagttgagggaggctctgcagtagatgagtccatgctcactggagaaagcattcctgtagaaaaatttccgggtgataccgttataggagctactcttaacaagacaggatcttttaattttcgagctacaaaagtcggggctgatactgcccttgctcagataatcaggcttgttgagactgcgcagactacaaaagctcccattcagagagttgcagatgttgttgccggaaacttcatagtaaccgtacatattattgcgcttctggcatttttcttctggttcttcataggttactggcgctatggagtcggggaatccgtaactctaggtggaatcagcccattcctgttttccttgcttatagccattactgtgcttgtaatctcgtgcccatgtgcagtcgggcttgcaactcctgccgctattatggtcggtaccggtcgaggtgcggaaaacggggtccttataaaaggtggggaagctcttgaaagagcgcataaacttgatactatcgtttttgacaaaacaggcacgcttacggcaggtactccgaagctgacagatttagttgccgtttccggtcacgaggaaaaagacgtactttttattgcagcaacggctgagagaggctccgagcatccccttggggaagctattgtaaacggggccgaagaacaggggatcaggccaggaaaagcagaaaatttccattcgattcccggaaaaggagtagaagcctattttgaagaaaaaagaattttgcttggcacgcgcaaacttatggaagaagaaggattttcctttaaagaattagaagctgaaatgcgagcttttgaagagagcggaaaaactgcaatgctcgtagctttcggggaagaaattattggtcttgttgcagttgctgatatcctgaaggaaaactccatagaagctattgaaactcttaacaaaatggatctagaagtagttatgatcacaggtgataatgccgttacagctaatgcaatagcaaaagaggtaggtattccaagagtgctggccgaggtgcttcctgaagacaaagcaagtgaaattaagaagcttcaggaagagggcaagcttgtcggaatggtgggtgacggcattaatgatgcccctgcgttaattcagtccgatgtcggaattgcaatgggagcaggtacagatgtagcaatggaatccgcaaaaattgtgcttatcaaaaatgacccaagagatgtggtctcagccattaagctgagccggcttaccataaacaaaattaaacagaacctgctatgggcttttggatataatacgataggaattccaattgcagccggaattctttatccctttattcacagggtcctgattacacctgaatttgctgccgctttcatggctctaagttcggtctcagtgactaccaattccctgttaatgaaa

SEQ ID NO: 34902 - DNA, 1392 bp, Methanosarcina mazei
atgaaaattgtaatgaaatttggaggaacttccgttggggacggaaaaaaaatccgtcatgttgcccagcttctgaagaggtaccgtgaagaaggcaaccagatcgtggtagtaacctcagcactcggtggagtaaccgacgagcttctggagaatgcactctttgcctcaacaaaaggcaaagtctcccttgtgaaagagtttaaaacagaaattacaaacaaacaccacaaggctgtgaaagacgccattgatgaccccacagtcgcaaaagaagttatccaaacacttgacctccgcattgatgagctcgaaaaagccctggttggaatctgctatcttggcgagcttacttcaaggtcaattgattacatttgctcttatggagagcgcctggctgctccgattgtgtcaggagctattcgttcccttggaattgaatcaactgaattcacaggtggagaagcaggaattataacatcatcggattacggaaatgcaaggcctctcgagaaaacttacgaacttgtgaataagaggcttggatgcagacttgagacacagattcttgtagttacgggatttatcggagaaaacgaggaaggaattattaccactctgggaaggagtgggtctgactttacagcttccatactgggcgcagctttaaaagccgatgaaatctggctctggaaagaagtaaacggtatcatgactaccgatccgagaatcgtgcccgaggcaaaaactatcccgcaaatttcttatgccgaagccatggaactttcttacttcggggcaaacatactgcacccacgcacgattgagcctgctatgcgcgaacacattcctgtgcgcgtcaagaatacttttgagccgaagttacctggcacactcgtagttgcggaaaagttccagtgcaagaatgtagtaaaagccgtaagcttaatcaaaaacgtggctctcatcaacatttcaggcgcagagatggtaggggcaatcgggaccgtagcaaggctcttcgcagtacttgcaaagtcaggcgttaatgttattatgatcagccagggctcgtccgaatcaaatatttccttcgtgatcagtgaggcacatgtgaaaactgcattaaaagccctgcatgaagagttcaaccgcggaatcgtaaaagagataacttcagacaaaaatgtctgcgtagttgcagtcgtgggtgcaggtatggcaggaactccaggcgtggcaaaacgggtctttggagcgcttgggaattcacttattaatattatcatgatcagccagggttcttcccagtacaatatctctttcgtagtgcgggaaaacgatgcatttgctgcagtcaagaccctgcatgatgaattcgaattatataac

SEQ ID NO: 34903 - DNA, 1017 bp, Methanosarcina mazei
atgagtcaatttaccctgagagagaggtttgaaaaggcactcaaaggagaggctgtagacattattcctgtctgttccgtaactcagacaggcactgtagaactaatggaaacgactggagcatactggccccaggcaaatttcaatgccgatcagatggctacgcttgcacttgccgggtatgaaactgcaggatttgagaatgtacgctgtccttttgacatcaccgtacttgcagagacccttgggtgcacagtagacgaaggaagtatagatatgcagccttatattacggatttcccctgcaaaaacgagaaagatgtgaagaacataacggttccagattcgcttcttgagggcaggcggacctcggtagtcctggaagcggttgaaattcttaacgaaaaagtaggagagacggtgcctgttgttgcaggggttgttggccctgctggacttgctttcatgcttgccggaataaaaaattatattacatggtttgtgaaggatactgaagttgttgaggaactaatgggtgttcttaccgatgcctgcatagaatatgccaatggtctgcttgaaagaggcgcacatgccataacccttatagactccgaagcaggacctgatattatttcccctaagatgttcgaagaatcggtctttcccctttacaggaaattttgcaggaaagtaaaaggcttgaaagtccttcacatgtgtggcgacgccacagccgttcttaattctctcggagatgcaggttttgatgggataagtattgaagaaaaagtaagtgtaagtttcgcaaaagcggctataggcgatcgggtacggcttataggaaatatttctccgtccgataccctgcttgcaaaagggcctgaagcagttctccttgaggctactgcctgccttgaagatggaattgatatccttgctccaggttgcgggctggccccacatactccacttgagaatataaaggcgcttgtcagggcaagagacgattacttc

SEQ ID NO: 34904 - DNA, 1329 bp, Methanosarcina mazei
ttattcggaacaaacggcgtacgaggtatcgccaatgaatatataactcctgaactggcagtcaatttagccagatgccttggtacatatatggggtctaaaggcactgttgccatagggtctgacactcgaatatcgggccagatgctgaaatctgccgcaattgccggggctctttctacaggcctgagtgtaatcgatatagggataatccctactccttctatcctgtattatgtacgcgacttcgcagatgccggaatcattgtaactgcgtcccataatcccagacaatataatgggatcaaatttattgcaggagacggctcggagttttcaagagacgcagaaaaagacatagagaaaatctatcattccggagaatactccattgtatcctgggaaaaaaccggcagcttcagaatcgatcctggagtcaatgaatattacgtgagaaacattattaaatctgtaaatgccgaagccatccgcagccgcaaattcaaagtagttacagacacaggctgcggagcaggttcccttactcttcctttcctgctcagggaactgggctgccaagtcttgacccttgaagcccagcttgatggaacattcccctggagaaatcccgaacccttacctgaagccctgaccgaacttactaatcttgtaaaaatgacaggctctgatctgggagtagctcaagatggggatgcggatagagtagtattcgtggacgaaaatggacagttcgtaaacgatgatgttctgcttgccatgatagcaaaatatatggcaaaacatgaaaaaggtcctttagtgactcctgttagttcttctcagcgaatggtcgatgtcgcagaagaggaaggtgtcaaattatactggactgctgtaggctccataaacgttgtccgaaagatgatggaagtaaatgcagtcttcggaggcgagggtaatggaggccttatcttccccaaacatcaatactgcagagacggagcgatgggttgtgccaaggtccttgaaatcctggcaagtgggaaaaagctttccgatcttgaaaaaagtgtacctcactacttcaacgaaaagaccaaagtgcctgctaaaaatgcgcatgctattatggaaatcgtgaaaaatgaagcgtcaggacttgggcacaaaatagacacatctgatggagttaaaatctggcataaagacggttgggttctgatgcgtccctctggtacagaaccaatattccgaatctttgccgaagcaaaaaatcaggaaagggcagaggaacttatgcaggaaggcctggacatgataataagagca

SEQ ID NO: 34905 - DNA, 2409 bp, Methanosarcina mazei
atgtctgagaacaaaagtaagtacatacgctggtttgatgagacttcgattgaagatgttccgcttgtaggcggaaaaaatgcctctcttggagagatgtacagggaactcactccaaagggagtaaagatcccgaatggtttttcagttactgctgaagcttactggcatgttctcaaagccggagggattctggagaaactcaaacaaacaatggaagggctagatacctcggatgtgtcagaacttgcaaaaaggggaaaagctgcaagggacctgatccttgaggctggaattccggatgacctctggcaggaaattaaatccgggtatgaccgcttatgtgagcagtatggagaaaataccgatgtagccgtgcggagttcagcaacggctgaagaccttccaactgcttcttttgcgggccagcaggaatctttcctgaacatcaggggttatcccgcgcttcgagatgcctgcgtacgctgtattgcctcgctttttactgacagggctatttcctatcgggtaataaataattttgatcactttaaagtggcactgtcaataggaataatgaaaatggtcaggtctgatctggcttccagtggagttatatttactcttgatacggaaaccggattcagggacgtagttttcattaccggttcttacgggcttggggaaaatattgtgcagggacaggtcaatccggatgagttctacgttttcaagccaactttcagggaaggatataagccgattatcgagaagaatttaggggataaagaaattaagatgatctatgggcaaggcggctccaaaacacttaccaggaatgtaaacgttcctgaggctgatcgacgtcgtttctgtctcagtgacgaagaagtgcttaaacttgcatggtacgctattaccattgaagattattactcaaataaatataagaaatccatgcccatggatatcgaatgggcaaaggatggagctacaggggaactttttgtagtgcaggcaagacctgagactgtacaatctcagaaaagcagagacattctagaaacttatgtgctcgaaaagaaatctaatgtccttacaaaaggcaagagcataggagacaaaattgctgctggaaaagcgcatgtaatccctaatgtttcagatctgccttcttttaaacagggagagatcctgattgctgattctacaactccggattgggagcctgtgatgaaaatagcggctgcaattgttacgaaccagggaggtagaacttcccatgctgcaattgttagccgggaacttggaattccggcagttgtagggacagtaaacgcaacagaagttctcaagacaggtaaggaaattaccgtaagttgtgcggaaggtgaagatggacttgtgtatgagggaattcttcctttccacaaagatacattgagccttaaagacacaagacgccctaaaaccgcaattatgatgaaccttggaaatcctgatgaagcttttagcctttccatgatcccaaacgatggaattgggcttgcaaggcaggaatttattatctcaaactatatcaagatccatccaatggctctagtgcatcctgaaaaggtcaaagactctaaagtccttcaggaaatcgagaaacttacccaaaactccgataacaaagaagaatatttcgtagataagcttgctcagggcgtcggaaccattgctgcatctttttatcctaaggatgttgtagtccgtacaagtgacttcaaaagcaatgagtatgcaagcctgcttggaggcagctactttgagatggaggaaaataatccaatgctgggtttcaggggagcttccaggtactttaatgagcgttacagggaaggttttgctcttgaatgcagggctctgaaaaaagtcagggaagagatggggcttaaaaatcttattattatgattcccttctgcaggacagttgaagaagctcaaaaagtaattgccgaaatggagaaaaacgggctaaggcgaggagaaaatgagttgcagatctatgttatgtgtgagattccaaataatgtccttcaaatcgacaaattcagtgaatatttcgatggcttctccataggctcaaatgacctgacccagctaaccctcggagttgacagagactcggaaattcttactgcagaattcgatgagcgggacccaggtgttacgaaaataatggcaatggccgtgaagggagcaaagcagaatggaaggcatagcgggatctgcggacaggcacccagtgactatcccgaaatcgcagagttcctggtaaaacaggggatagattctatttcacttaatccggattcggttatgaaagtcacccttaaagttctggaaacggaaaaggggctggga

SEQ ID NO: 34906 - DNA, 1575 bp, Methanosarcina mazei
atgactcaggcaagaagacctcttatgcttattatttttgatgggtggggttacagggaagcaaaagaaggaaacgctgtcatgacagcacgaactccaaaccttgaccggctggaaaaggagtgtccctggtgttttttaaaagcctctggagaagctgttggccttccgaaaggtatgatggggaattcggaagttgggcatctgactataggggcaggacgaattgtaaatcaggaccttacccgaataaatatttctatcaagaacggagattttttcaaaaatccggtttttctgaatgcaatttcaaatgtcaaagctaatgcttccagccttcacctcatgggccttgcttcctgcggaggcattcacagttatatgcctcatctgcatgcccttctcaaacttgtgcaggagaaggatttaaaaaaagtctatatacatgcttttctggacgggagagacgaacctccaaaagctgctctaggagatataaagaaactggatgcattttgtaaagagcacggtaatgctaaaatagcaaccgtttcaggccgttattatgcaatggatagagataagcgatgggataggacaaaacttgcctatgatgccctgacaagaggagtggctccatataccgctccaaatgcagaaactgcagtttctaatgcctactcaagaggagaaactgacgagtttgtaaagcccactataattactgagcaagtaattactgagcaagtaattactgagcaagcagaaaaacctgtggcgacagtacaggataatgattctgtaatcttcttcaatttccgggccgatagggcacggcagataacctgggcttttgtaaaagatgactttgacgggtttatgagagaaaaacgtcctgaggtttactttgtctgcatgacccagtacgacgaaacccttgaggtgcccattgcttttcctccaataaagctggaaaacgtacttggagaggtgctgagcaagcatggactcatccagctacgcatagctgaaaccgagaaatatgcccatgtgacctatttccttaacggcggcgaagaaaagcgttataaggatgaagaccgctgccttattccttcgccgaaaatcgctacttacgaccttaaaccagaaatgagtgcatatgagattacggatgaagttatcagaagaatacagtcaggaaagtatgatgttattgtccttaactttgcaaacatggatatggtcgggcacaccggaatctttgaggctgcagttaaagcggtagaagccgtggataagtgtattggcaggattgttgaggttctaaaagaaaaaggcggtgtggcacttattactgcagatcacggaaatgccgaggagatgatagacctaaaaacaggagagccacatactgcacatacctcaaacccggtaaaatgcatttacttcggaaacagtgagataaaagctctcaggaatggaaaattgtgtgacgttgcaccgacgattcttgagcttcttggaatccctaagccgcaagagatgacaggaaagtcacttttggtaaaagat

SEQ ID NO: 34907 - DNA, 705 bp, Methanosarcina mazei
atgatgatcgcaggaattgatgaagccggaaaaggccctgtaatcgggcccatgtgcataggaggcgtaaaaattgaggaatccagagcgcatatcctcaaagtgctaggggttgcggattccaagaaactgacgccaaaaaagcgggagcaacttgcagcccaaattaaaaaacacgcagacggcttttttgttcttgaggtcagcccttcccaaattgacgagctccgcaagatcatgacaatgaatgagataatggtggtctgtttttcaaaagtgctcgaacagttaaagcctgacctcttatatgccgatgctgctgatgtcaatgcagaacgttttgcaaccaacatccgcaagcaatattcaaaaaccaaccctgaccatgcaaaagaaatagagattatttccatgcatcaggccgatgctacttatcctgttgtatcggcagcctcaattattgcgaaggtgcgcagggatgagcttatcgaggagcttaagaaagaatggggcctcgactttggaagcggttacccttcagacccaaaaacaaaagaattcctgttgaactggggaaaagagcactcaggagagttccctgaaattgtcaggcagtcctggcagactgtagaaaatatcagggaagaactgaaaaaaactggaaataaaaactgaaaagaaaaattaaaaagaaaaattaaaaag

SEQ ID NO: 34908 - DNA, 1251 bp, Methanosarcina mazei
ataatcacaggcgcgcagttcggcgacgagggaaaaggcaaaattgttgaccttcttgcaaaagattacgacattgttgcccgtttccaaggaggaaacaacgcaggccatacagtcagagtaggaaatgaggtttacaaattacacctgattccttcgggtattttacttaatgctagagttctaatagggcctggggttgtcctgaatcctgaggttcttgccaaagaaatcgcaatgtttgaaaagcatggcatacaggtaaatgccgaaaaactcggagtcgatgcgaagacaagcataatcatgccttaccacatcgaaatggatggactaagggaagaatcaagggaaaagaaaattgggactacaaaacgcggaataggttacgcgtatatcgataaagtagcaagagacgaattccgcatggctgagcttgtagaccaggaacgttttcttgcaagacttgaggaacttgctccccagaaagaaaaggaaatagcaacactgggaggagatcctaaaatcgttagagaccctgcactaattgaacgatatcttgagctgggaaagcagtttgccacttatataacagatgtctccagagaaatcaataaagctcttgatgaaggaaaacacgtgatggctgaagctgctcagggtacacatctcgatgttatacacggaacgcagaaattcgtaacttcttcttctacaattgcaggctctgcctgtgccaacctcggagttggccctacaagagtaaataatgtaattgctatagtaaaagcttatatcacaagagtcggtgaaggcccacttccaacggaactaacaggagaactcggggaaagactacaaaaagccggaggagaatttgggactactactgggagaggcagaagatgtggatggtttgatttacctctactgaagaaagctattgctcttaatggatataccgaaatttccctgaccaaactggatgtactcacaggccttaatccaatcaggatctgtaccggctataccttcaagggggaaaatcttgattatcctccagaacttactgctgatcttgccgagtgcatgcctgtttacgaagaccttcctggctgggaaactgaccttactgaagtaaaagccttcgaggaacttccggaaaacgcaagaaactatgtaaaaagattggaagaactgatggaagtaccgattaattacatttcagtaggtccgggcagggcgcaaacc

SEQ ID NO: 34909 - DNA, 1038 bp, Methanosarcina mazei
cttcaggaaatcaacaaattgaaagctcatctggaacagcttactgagcctcctctctttattgcaactattcttgaggtaaacggagaaattgcacttataaggcagcatgggaataatcaggaggttcttacccagatccctgaagagtgtattggaaagattgagcctggcatgagagttgcagtaaatggggcctactcaattatttccgtagtcagcagagctgccgatgtgcgggctcaggtaatggaactcattaactctcctggtgtggactacagcatgattggcgggctggatgacgtgcttcaggaagtccgggaaagcgttgaattgccacttaccgaaccccaacttttcgaggaaatcggaatcgaacctccttcaggtgtcctgctccacggggctccaggtacgggcaagactcttattgcaaaggctatagcttctcatgcaaaagcaacctttatccggatgtcgggatctgatctggtccagaaatttgtaggtgaaggctcaaggcttgtcaaagacattttccagcttgctagagataagtctccaagcattctctttatagatgaaatcgatgctgttggcagcatgaggacctatgacggaaccagtggctcggccgaggtcaacaggacaatgcttcagctccttgcggagatggacggttttgatcctaaaggcaatgtaaagatcgttgctgcaaccaacaggattgatctgctcgatcctgctctcctcaggcctggcaggtttgacagatctatcgaagttccacttcctgacgagaaaggaagggctgaaattcttaaaattcacactcgcaagatgaaccttgcagatgatgtggatttcgaaaaactggcaagagtcatgaccggtatgagcggggcagaaatcagtgttatcgtcaaagaagccggaatttttgtgctgcgtaggcgcggtaaacagattaccatggcagatttcctgaaggcacacgaaaaggtcgtaagcactgaagaacctaaaattcctcag

SEQ ID NO: 34910 - DNA, 1383 bp, Methanosarcina mazei
gatataactgcagaacttcaaaaaatcgttggtgggcgactctcagtctcgccttcggaactttattgttattcttctgacgcatcccaggtcaagggaatgcctgattacgtggtacgcccgaaaagcacagacgaagtaagccggattgtcaggcttgcctatgagaacgagatccctgtgactgcaaggggagcaggcacaggacttgcaggtggtgcagtccctgttaaagggggcattgtgctggatatgtcgggcatgaataggattcttgaaatcgatattaataatattcaggtccaggtagaacccgggattattcaggatgatttaaatgaagcgctaaagccgtatggttttttctttcctccaaatcctggcagttcagccatgtgtactatcgggggtatgatagcttacaacgcaagtggaatgcgctgcgttaagtacggtactaccagacactatgttcgcgaccttgaagtggtgcttgcggacgggacagttattcataccggttcaaagatgctgaaatccgcagcaggatatgacttgacccagcttattgtgggttcggaaggcacactcggcattgttacaaaagccaggcttaagattgcccctctccctaaaactcgaaaactggtaattacttcctttgaaaacgcggaaattgcagggcaggcggtcgtaaaaaccttctcacacggggtcattccctcagcctgcgagattctggacagggtttccctgcaggttctcaaacgttacgacccgaaccttgtgcttccttcagaaggcgatgtaattcttttcgaggttgacggcactgaaagctcggcacgtgaagctgcagaacagatcatgaaagtctgtactcccctgtctctctctataaggcttgcggaaagtgaaaaggaaatggcagatatctgggcagccagaaaactcgtaggggctgcggtttctcgcctggacccaacaaagagccgcatctatgtaggagaagatgtgggagttcccataaagcgaatccctgaactgctaaaacgagcacaggaaatcgctgagaaattcaacctgccggctatgaaatacgggcatataggagatggaaacctgcactttgcacttttcattgatgtcctgaataaagatgaatgggatcgcctaaacaaagctgcggatcttattcacaggacagcgattgagcttggaggtacagttagctccgaacatggaataggtgcggccagggctgaatacatgaaagcccaatggggccctgcccttgaggtaatgcgtgcgatcaaaaatgcccttgacccgaaaggtatactgaatccgggcaaactggggttgtgagaatatgaaaaacga

SEQ ID NO: 34911 - DNA, 2124 bp, Methanosarcina mazei
atgacaattgtcgcatttgcagaaaagaataaggcagcatcccagattgccagcatcctgggcgagggggaagttgagaggataacagttgaagggctgcctgtatacgaattcaagtggaaaggtgaagagtggctggtaatgggactttccgggcatattatgaattatgacttcccagagcagtataacaaatggaaagaagtcaatccgggtgtacttcttgaaatcgacccgcaaaaacttgtaacgcgaactgattacgctgctgcggtaaaaaatctggcaaaaagagcaaacaagatagtccttgcctgcgactatgacagggaaggagaaaacataggatttgaagccaagacacttgcagagaaagtaacaaatgtgccgattgaaagggcacgtttttcgtctctctctccaaaggaggttaaaaaagcttttgaaagcctgataaacccggactataacatggcaatggctgcagaagccagacagattctggaccttaaaatgggagcagcttttacccgctttgtcacgctttcagtcagggagagggcaagaacaaaggacatactttctatcggtccctgccagacacctacctgcgggtttgtatacgaaagggaaaaggcaatccgggcttttcaggcaaaggacttctggaagataacggctattttctcggcagaaagtggaaaagaaggaggaaaagaaggaagaaaagaaggaagaaaagaaggaaaaaaagaaagaggagattttgaaggtactcacagggcaggaaatattcacgataaagaaaaagccgctgagatcttcaaacgactgaaaggaacaaaggaagggttagttgcgaaaaaaacagtaaaagaaacgaaaaccagtcctcctaatcccttaaatactacggaattcctcaaaagggcctccaagtttctcggaataagcccggaacttgcccttgaggttgcagaacagctttaccttgcagggtttaccagctaccccaggaccgagacaaacaaatacgctgaagactttgatttcaagtccctcgtctttgactttgcacgccagaaagagtacaagccttttgcagagtctatccttatagctccaattgtcccgaaaaacggggagaaagatgcacacgaccacccccctatccacccaatcagagcggcttcaagaggagaagttagctctgcagtaaatatccctcaggcacctgaagtctataaccttatagcaaggcatttcctggcaaaccttatgcctgcagccgtcttcgagaaaacgcatctccatctgctcgtaaatgaagagccttttgactcgtccggaaccgtgcttaaggattcgggctggctcgaagcctatccctttgaaaataagaaggataaacttctcccgtttgtggaagaaggccagaaagtgggcgtaaaaaagctcagcaacacaaaatccaaaaccagcccgccaaagaaactgaccgaagccgaacttttgacccttatggacaaaaatggaatcgggacaaaggcaacggctcccacccatatcgaaacaaataagaagcgaggatatcttgagacaaagggaaaaacaatctctattctcgatacaggctttacccttatggatgggctctctctgaccgttccgattctagtaaaacctgaaataagggcaaagattgaagcccttattcaggaagtagaagatggaaaaaaagagttcgaagctgctctttacgaaggcacaaccctaatcaaggagatgtacgcccagcttgaagcaaataaaaaggagctgacttcaagcatagcaggcacgattaaggatgaagctgccctcgaagacaagaaaaactacattggaacctgtaaagcttgtgggcatgtgttaagaattgtacagactgattcaggccgctttgtaggctgcacaggctatcctgactgcagaaactcgtatcctctgccaaaagccggagctttgaccgtactcaggagcaaggaatgtaaaaaaggaggagtagctgtcctgaaagtcggaaacaaatataactgggctgtaggcataggcccctgttttacctgcgaccttgaaaaagaa

SEQ ID NO: 34912 - DNA, 725 bp, Methanosarcina mazei
atgagactggctgtaatcgaaggtgatggaataggtagggaaataatccctgcagctgttaaagtccttgatgctttcgggcttgagtttgaaaaagttcccctagaacttggctatacccggtgggaaagaacaggaactgcaatatcaaataatgatctggaaactataaaggggtgcgatgctgtcctttttggagcaattactactgtaccggatccgaattacaaaagcgtgctcctgaccatacgaaaagaactggatctgtatgctaatgtcaggcctgtaaaacctctgcccggcataacaggagttaccgggagaaacgatttcgattttattattgtcagggaaaacactgaagggctgtattcgggaattgaagaaatagggcctgaactctcctggacgaaaagagtcgtcacccggaaaggttccgagcggattgcagaatatgcctgtaagcttgcaaagaaaagaaagaacaagctgaccattgtccataaatccaatgtcctgaaatccgacaagctgttcctcgatgtttgcaggcaaactgccagtgctaacggcgtggaatatgaggatatgctggttgactcgatggcttacaaccttattatgcgccctgaaaggtatgacattgtggttacaacgaacctcttcggagacattttaagtgatatgtgcgcagccccttgtaggaagtctcggccttgtcccag

SEQ ID NO: 34913 - DNA, 840 bp, Methanosarcina mazei
atgatttctatgaaaaaatatgatgttgttattattggagcaggtcctgcaggatcttacgcggcatatatgttagctaagtctaagatcaacgtgcttgttattgataaatactcctttccacgttacaaaccctgtgcaggaggtttaactgcaaaagcgtttaattcctttgattttccgatttccaaagaggtaaaatacagtacaaattctattgtaacctcatacaaaaaccagatctttcacaatatttcaggtaataaaacacttgttaaaatgattgaaagaaaagaattcgatgactttcttattaaaaaggccgttgattcgggagcaacgtttcttgatggtatgaaagtgactgaaattacctgggagaatgcagagtttagtatcaaaacagattcggagtttttccgatgtaattatttgattggggctgacggtactaacggtattgttaatagaacatttaacattgttgagagagacctttatggttttgcggtggaaattaactgtcccgtaagcagggataatattggaaaatttaatatgacttttgattttgggacagttccaaatggttatctgtggatttttcctaaggatgaatacgtttgtgttggagcctatacaacaaatagaaaaatgaaaaatattcaaaaatatcttcttgattatattgaaaagcttgggcttgttcctgaatctgaaaaacttaaaggacatattattccttattatggaattaactataagcaacccgattttccgtgtgtcctggtaggagatgctgccggttttggagaatactggactggggaaggcatttat

SEQ ID NO: 34914 - DNA, 675 bp, Methanosarcina mazei
atggtaagtcgtgagtatgtgaaaggggatcttcccgaaaaagctgcaattctgcaaagagatggcgaaacgtatgcaattgctccccatattcctggaggaatcgtatacccggaaactcttcgaaaaatagctgatattgcagaaaagtatggggctgctgcccttaagatcacttcggcccagaggattgcaattgtagggttaaaagaagaagatctggatgcagcatggggcgagctaaatctaaaacccggagctgctatagggctctgtgtccgtagcgttaaaatttgcccaggcactacattttgcaagagaggcaaacaggattcagtcgggcttggattaaaacttgatgaaaagtaccacgggatgcagcttccttccaagtttaaaatgggagtttccggctgccagaattcgtgctctgaacctatgataaaagatatagggctaatgggcactgcaaaaggctttactttatctgtcggaggcagtgcaggaccccgtccgagacttggtagtgtagtggcaaaagaccttaccgaagaacaggctctggatcttgtcgaaaggataatcgacttttacaaaaagtacccaaagccacgaagactaggagaagttatcgacgagataggacttgagaaattcaaagaagaagtggggttg

SEQ ID NO: 34915 - DNA, 1776 bp, Methanosarcina mazei
attgcaatcgagggtatgataaggaaagcaactgaagtgagaccaagaattactaaagctgcttttgagtgcctcaggtgcggatatctgacttttgtagaccaaaatagtttcaaattcgaggagccctttgcaggttgtgaaggcgagaattgcggaaagaaagggccctttaagataaggatagaagattccacttttatcgatgcgcagaaactgcagatccaggaatcacctgaaaacctgaaaggaggttcccagccccagagtcttgaggtggactccgaagatgacctgacaggaagtgttacccccggagatagggttataattaacggaatcctgaaatctagacagcgcactctgaaagatgggaaatctaccttttatgaccttgttttagaagcaaattccatagagcacctggataaggattatgacgaactcgaaataactgctgaagatgaagaagagatccttgaactttcccgtgatcctgaaatttacggcaaaattgttagttctgttgcgccttctatctatggatacgaggacataaaagaagctcttgtccttcaacttttttctggagttgtgaaaaaccttcctgatggttccagaataaggggcgatatacatattatgcttgtaggagaccctggaattgcaaaatcccagctcctgcgctatgttgtcaaactctccccgagaggcgtttttacttcagggagaagtgcgtcagcaagcggtttgactgcagctgctgtaaaagacgaactcaacgacggtagatggacaatcgaaggcggtgcccttgtcatggctgatatggggattgctgcggttgacgaaatggacaaaatgaaaaccgaggataaaagtgccctgcacgaggcaatggagcagcagacgataagtattgccaaagcgggaattattgctacgcttaaatcccgctgtgcccttctgggagctgcaaatccgaaatacgggcgttttgaccgttatgaaggccttgcagagcagataagtatgccgcccgcactgctttcccgttttgaccttatctttgttttgcttgatactcctgaccataacttggacactaaaattgcaaaccatattctgcagtctcattatgcaggagaactctttgagcagaaggaaaaacttcctggatcacagattaaggaagattttgtcgaagccgaaatggaagttatcgagcctgtcattcagcctgaaatcatgcgaaaatacgttgcatatgcccggaaaaacgtgtttcccgtaatggaggaggatgcaagagctcatctcataaatttctacacagatctccgaaaaactggagagagcaaaaacacccctgtgcccgtaactgcgaggcagcttgaagcacttgtccgtctctcggaagcaagtgcaagagtccgcctgagcaatacggtcacgcttgaagatgcaaaaagaactatcaaaataatgatgaattgcctgaaaaacgtaggtgttgaccccgaaaccggagcccttgatgcagatatacttgcatcgggcacaagcatgagccagagaaataaaataaaaatcctgagagatataataaagaaggtaagtgagaagcatccgggagctaaagctcctctcgaagaggtttatgctatagctgaaaacgaacacggaatagataaaattcatgctgaagagaacattaagaaaatgaagcaaagaggagaccttctttctccagatcagaaccatataaggcttgtt

SEQ ID NO: 34916 - DNA, 1248 bp, Methanosarcina mazei
actcttgccgtacatgcaggcgcaaaacctgatccggctaccggagcaaggtcagttcctatttatcagactgcagcgtatgtatttaaggacgctgaggaagctgctgatctattcggactcaggaaagaaggcaatatttatacccgccttatgaaccccacaaccgatgtctttgagaaaagaatagctgctcttgaaggaggcataggtgcccttgcagtagcctcagggatggctgcaattacaaccgcacttctcactttcacaaggcccggagacgagattatttcaggggataagctttacggaggaacctacgagcttttcaattatactttccccaagctcggaagaaccgtaaaattcgtagatgtcggtaagcctgaagaattcaaaaatgcaatctcggaaaaaacaaaagccatctatgtggaatcaataggaaatcccgggcttgatattcctgattttgaaaaactcgccgaaatcgctcatggtgcaggaattccctttgtagtggataatacggtgtctcccctgatcttacgaccaattgaccacggggtagatatagtcgtatattcagcaacaaaattcataggaggtcatgggacttctataggaggggtaattgttgactcaggaaacttttactggaaacctgaaaaattccctgagatttgcgagcctgatcccggataccacggtctgaagtataaggaagcctttggaaaggctgcctttattgcaaaagcaagggtgcagttcatcagggacactggggcatgcatttctccttttaattcattcctctttaccctggggcttgaaactctgcctctcagaatgaaaaaacattgtgataacgctctggagattgcaaaattcctggaaaagcaccctaaggtttcctgggtttcgtatcctgggcttgaatcccattgcagctatgagcttgcgaagaaataccttaaatcagggtatggcgcacttataggctttggaatcaaaggtggagccagggaatgcaaaaaatttatagaagggcttgagatcttttcccaccttgcaaatatcggagatgcaaaaagtcttgtaattcatccagcttcaaccacccatgaacagctatcaaaagaagaacagcttgcctgcggcgtaactgaggactttatcaggctttccataggaattgaggatgcaaaggaccttatttccgatattaagcaggcactctccgaggta

SEQ ID NO: 34917 - DNA, 897 bp, Methanosarcina mazei
aaggatgtactttcgataactgacctgtccaaagaagagatttatgaactcctcgaatcggccatggacctgaaagaaaaacgcaaagctggagaacctacagagtacctgaaaaacaaaagcctggggatgatttttgagaaagcttccacaagaaccagggtttcctttgaggttgcaatgaccgatttcggtggacattccctttacctgaattccagagatattcagataggtagaggcgaaactattgaggacactgccagaactctctcaggttaccttcacggaatcatggccagagttatgagccacgagaccgtagagaaattggccaaatactcaaccatacccgtgattaatgcgctttcggaccgggagcacccctgtcagatccttggtgacttcatgaccataatggagtacaaggacaaattcgaagacctgaagttcgcctgggtaggagacggaaacaacgtctgtaattcagccctgctaggctcggcgattgtggggatggaattcgcagttgcctgcccgaaaggatacgaacctaaacccgagtttcttgaaaaggcaaaatccctcggaggcaagtttacagtcacggatgacccgaaggttgctgtaaaagatgcggatatcatttatacggatgtctgggtctccatgggtgatgaagccgagcaggagaaacgcctgaaggaatttgccacgttccaggtcaataccgaactccttggagttgcaaaaccggacgtaatagttatgcactgcctgccagcccgtagaggtcttgagattacggatgaagttatggacggcccgaattccgtaatttttgaagaggctgaaaaccgcctacatgcgcaaaaagctcttatcctgaaattgatg

SEQ ID NO: 34918 - DNA, 516 bp, Methanosarcina mazei
aatcagaaacaggaacttatcgcagccctcaaggcttgcggagccgtacgctacggaaatttcacacttgcctcgggaaagaagagcaaatattatatagacatcaaaaaagccagtactgaccctaaaaccctgaaacttatcgcacggcaggcagcattcaggataaaacagatggacgtgaacataatagcaggagtggaacttggaggtgtgccattggcaaccgcggtttccatggaaaccgaactccccctgcttatagtccggaaatctgtaaaggactatggtacaagaagcaggtttgtaggcgactttaaaccggaagacaggattgtaatgctcgaagatgtcacgacaagtggaggatcggtcagaaacgcaattgaggttgtcagagaaaccggagcaaatgtcacatatgtaatcagtgttgtggacagggaagaaggagcaattgaaaacttaaaagaggcaggtacggaacttgttcctcttgtgagtgcaagcgatctc

SEQ ID NO: 34919 - DNA, 1572 bp, Methanosarcina mazei
tcaaagcagataatgtttgatgaaaatgcaagaaaggcacttttaaacggtgtagataaagttgcaaatactgtcaagatcactctcgggccaaagggacgttatgttgtactggataaaagtacaaaacctgtggtcacaaacgacggggtaaccattgcaaaggagatcgagcttcatgacaagttcgaaaatatgggggccaagcttgtcaaagaagttgcttccaaaactcaggataataccggagatggaacaactactgcaactcttcttgcccagagcatgattcgggaaggcctgaaaaatatcagtgccggagcaaacccgatagatgtcaagaaaggtattgagatggcaacagaaaatgttgtaggctatctcaagagcaagagtagtgaggtaaaaggtaaggagaaaatcgtacaggtagctacagtttctgcaaataatgatgaagagattggcaatttgattgccgatgccatggaaagagtcggctacaatggtgtaattactgttgaagactctaaaacaatggagaccaatctggacgtcgtggaaggaatgcagttcgacaggggttttgtatctccttatatggcaactgattctgagaagatggtctgcgagtttgaggacccttacatccttatcacggacaagaaaatcaacagcatgaagcagatcgttcccgtgcttgaaaaagtcgcctctgaaggtcgttctctccttattattgccgaagatgtcgatggggatgcccaggctgctttgatcctgaatatcattcgtggggcactgagagtctgtgctgtcaaggctccaggatttggaaatgagagaaaggagatgcttgaagacattgccgtgctgactggtggacaggtaatcagcgaagacaagggcatgaagcttgaggaattcgatgattatatgctcggaagtgccagaaaagtcacaattgacaacaacaagaccatcattgtggaaggcaagggcgataaagcaaagattaaggaaagggttagcctcattgaagctcagattaatattgctgacgtggagtataagaagaccgaactcaaaaagcgccaggcaaagttaggaggcggggtcgcagtaatcaaggtgggagctgcaaccgaaaccgagctgaaagagaaaaagatgagaatcgatgacgcgctcaatgccacaaaagccgcagttgaagagggtgtggttatagggggcggaattagtcttttccgtgcagctgccattcttgactccctgaaacttgaaggtgatagagagataggtgtaaaaatagtccagagagctatcgaggaacctgtacgccagattgctgaaaacgcaggtaaggaaggtgctgaggtcgttgcaaccatcagggctgaaccccgcgaactctttgggtacaatgcaaagaaagatgtctttgaagacctctttgaagcaggtgtcattgaccccacaaaagtagtcagaagcggcctccagaacgcggcttcaattgctggaatggtacttacaaccgaagctcttgtcacggacttcaatgacgaa

SEQ ID NO: 34920 - DNA, 1245 bp, Methanosarcina mazei
gtgcattacatgcgggatatgcggtcgcatctgccctgtaggagcaattgaggtaatgaaatgaaggacatgtatgatgttttagtgataggtgcgggtcctgcaggttctattgccgccagaaccgcagccgaaaaagggctggatgtacttttaatcgagaaacgccaggagataggtgaccctgtacgctgtgctgaaggcgtgaacaaagcatatctcaaaaaatacgtggaaattgacaagagatggatttgtgctgaccttagtgcttcccatatttacgcgccggacggtacaaagatagagatggcagaagaactctctggtggagaagtaggttacgtccttgaaagaaaagtatttgaccgggctcttgcagaaaaggctgccgaagccggagcggaagttagggtgaaaaccagagccactggccttatcattgaagacgactttgtcaaaggagctaggctcatgcatctcggaaaagagtatgatgtgcgggccaagatagtaataggtgctgacggggtcgaatcaaaggtaggcagatgggcaggcatcgatacttccttaaagccgatagacatagagacctgcgcccaatacctgatagctggagcgaacatagaccagcaccactgcgaattttacataggtaatgaaattgcaccttgcggctatatatgggtctttccgaaaggcgatggaaaagccaatgtagggatcggagttctcgggagcaagactggaaaattcaaaccaaggcctgtagactatcttaacaagtttctggaaaataaatttcccgatgccaggatagtcgagatggttttcggaggagttccggtttcgggtagcattgagaaaacttccactaacgggttgatgctaataggagacgctgcccgccaatccgaccctatcacaggcggaggaattcttaacgcaatgaatgctggaaagatggcaggagaagctgcatatgcagctatatccgcaggagatgtctccctcgaaaaactcgaagaagtttatgagaaaccgtggagagcaaccctggggcacgatatcgacatgagccttatagtaaagaattgctttatcaatctaagcgatgaagacctgaattcgcttgctcattccctagaaaaggtgaaatttgaaagaatgagccttcttgacctgttacaggctctctttaaagccgataaaaaacttctatgggaccttcgagtacttttc

SEQ ID NO: 34921 - DNA, 657 bp, Methanosarcina mazei
ccattcattgtattgaactataagacttatttacagggtacaggtcagggagcaatggaaattgcaaaggcctgtaaagctgtatccgaagagtcaggtgtcgagatagcagtagccccgcagcttccggatatttacagggtagcctcggaagttgcgctcccggtcttctcgcagcatctggatgggataggagcaggaagcttcacaggccacgtttttggaaaatgcataaaagaggcaggtgctgtagggactctgatcaaccactctgaaaagcgtctgacccttgcagagattgaggcatcgctaaaggctgcaaaggaattcgggctcaggtcaattatctgcactaataatgtcccgacaactgcagcagcggcagtcctggggccggattatgttgcaatcgagcctcccgaacttatagggagcggaatccctgtctcaaaagctgaccctgaggttgttagcggttcggttgaggcggttgcaaaaattaatccaagggtaaaggtactctgtggagccgggatttccaaaggtgaagatctaagggcagctcttgaccttggttctcaaggcgtgcttctggcatctggaattgtgaaagccacagacccaaaagccgcacttgaagaccttatccgtctgatt

SEQ ID NO: 34922 - DNA, 653 bp, Methanosarcina mazei
gtccgctttctggatactactttgagagacggtgaacaaacacctggcgttgcccttacaaaggacaagaagcttttaatcgcccgagcgcttgatgaaatgggggtctcaataattgaggccggttctgcaatcacttccaaaggtgaaagggaatctatcagagctgttgcaaatgcagggcttaacgctgaaatttgcagctactgcaggatcgtaaagtccgatgttgaccgtgctctggaatgtgatgttgactctatccaccttgtagcacctgtttcagaccttcatataaagacgaaaatcaaaaagggtcgggatgcagtaaggcagatcgcagttgatgtaattgagtatgccaaggaccacggcctgattgtggaattgagcggggaagatgcctcgcgcgcagaccctgagtttctaaagaccatctatgccgacggaatagatgcaggcgctgacaggttatgcttttgcgatactgtaggccttctggtacctgaaaggacaaccaaaattttccgggacctgtcttcttcactgaaagctcctcttagcattcactgtcacaatgatttcggttttgcaactgcgaacacggttgctgcctggctgcaggggcaaaacaggcccatgtaacagtaatg

SEQ ID NO: 34923 - DNA, 1628 bp, Methanosarcina mazei
atggcaggacagccaatattcattttaaaagaaggaagtaagcgaaccagaggcagggatgcccagaataataatattatggctgcaaaagcagtagcagaagcagtcaggacaacccttggtcccaagggcatggataaaatgcttgtggactccatgggcgatgtggttattacaaacgacggggcaaccattctcaaagaaatggacatcgaacatcctgcagcaaagatggtagtagaagtagccaagacacaggatgaggaagtaggagacggcactaccagtgcagctgtggtcgcaggccagctcttaagtaaagctgaggatttaattgaacaggaaatccacccgacaattatcgcatcaggatacaggcttgcagccgaaaaagctgtagaagtcctgaattcccttgcaatgacagtagaactgtccaaccgtgacctgctggtcagcattgctgaaacagcaatgactggaaagggtgctgagtcctccaaaaaactcctctcagagattgctgtagatgctgtaacaagcgttgtagacaaaaatggaaagaatagtgttgacaaagacaacatcaatgttgttaagaaagtcggtggcaaggtcgaggattctgagcttatccggggcatgataattgataaggaaagaatccaccccaacatgcctgaaaaagtaaaggacgcaaaaatcattcttctcaacagtgcaatcgaactgaaggacactgaagtagatgcggaaatctctataacctctcctgaccagcttcagtccttccttgatcaggaagagcagatgcttaaaaagatcgtccagaaggttatcagcagcggagcaaatgttgtcttctgccagaagggaattgaagaacttgcccagcactatcttgcaaaagcaggtatctttgctgtccgcagagttaagaagagcgacatggaaaaactcgcaagagcaacaggcggcaaactcatcaccaacatggatgaaatcactcctgaagacctcggatatgcagcactcgttgaagagaaaaaggttggtggagacagcatgacttttgtcacaggctgcgacaacccgaaagctgtaacaatcctgctgcgcggcggtacagagcatgttgttgatagtattgacagtgctcttgaagatgcccctgcgtgtggtcggagttgcaatcgaagatgagaagctcgttgcaggcggcggttccccgtgaagttgaggttgcactcaggctccaggaatacgcagcaactctcgaaggcagagaacaacttgcagtcaaagcctattctgaagctcttgaaatcattccaagaactcttgcagaaaacgcaggtttagatccaattgacatgctcatggatctgcgttcacagcacgagaaaggtgtaaaggccgcaggactcaatgtttacgaaggcaaagtcgttgacatgtggaaaaacttcgtagtagaacccctcagagtcaagacccaggttatcaatgcagctaccgagtctgcagttatgattctcaggatcgacgacgtcatagcttctacccgtgcagcaggccctgaagaaggcggaatgcctccaggagcaatgggtggaatgccgggcgga

SEQ ID NO: 34924 - DNA, 684 bp, Methanosarcina mazei
acgagaataaagatctgtggaatccgcagccctgaagaaatcgaaattgcagccctttacggagccgatgcagttgggtttattacagaagttcctgtcgagagcccaagaaagcttgattccgatactgccgcttacctcgtgtccagagtccctgaaaccctgagttccgtactggttatcatgcctgaaaacgcggatactgccgtaggtctgattaataaaataaaacccgatatcgtgcagatccactccagactgccccatctcgaacttgaaataataaaagaaaaaacgggcatccctatcataaaaactctgtccgtacctgcacagggagaggcttcaaacgcaggttccggaaatcctgcttctgtctcaagcctacttgaagaggtcagtctactggaagaagccgacattgtagattccattctgcttgatacggcaaggtccgaaaagcccggaggcacaggctgtgtgcacgactgggctctgagccggcgaatctcagaagaaacgcgacttccccttatccttgcaggcgggctcaagcctgaaaacgtgcggggagcaatcagggctgtttcgccttatgctgtggacacagcatccggggttgagacctgcgggaaaaaagatgccgtaaaaatcaaaagttttattgaagaagtgaggtgtgcc

SEQ ID NO: 34925 - DNA, 1385 bp, Methanosarcina mazei
atgtcgtgtgagctgatgttgaaagagcgaacaggaatcattaatccaatgtatacctgtcagcctgcaggtgcccaatttgtgggaattggtataaaggattgcattccgcttgtacatggcggtcaggttgcagcatgtttgtcaggttgttgttcgctcagcatttcaaagaaaattttgacattgcgtcttcgtctctgcatgaaagcgccgccgttttcgggggcgcaataagggtagaagaagcggttgaagcacttgttgcgaggtaccctcagctgaggatcatacctataataactacttgctctaccgaaacaattggagacgacattgaaggtataatccggaaagtaaacaaggatattaaagaaaaacatcctgacagagatgtgaagcttatagctgtgcatacgccaagctacagcggtagccaggtgacaggttacgatacggcaattaacgcggttgtacaagctcttgcaaaaaaagatgagccttcaggaaagttgaatgtattcactggatgggtcaatccaggagatgtttctgaaattaagcatatattatctgagatgcaggttgacggaaatatacttctggacaccgagacctttgactctcctattatgcctgacaaatcggcattcgcgtatggaaatacaaccattgaggaaatagccgattctgccaatgctatcgggtcgattgcattaagccgctatgagggagcaaatgctgcaacatacttaaaaaataaattcggcgtgccttcggttgtaactccaactcctataggcataaacaataccgatattttccttaaaaatatcagcaagcttaccggcaaacccataccagaatcactggttattgaacgcggaaaagcaatagatgcgattgtagaccttgctcatatgtttttcgcgaataagaaagtggccatatttgggaatccagaccttgtcttcggtcttgcgcagttttgcctggaatgcgaacttgaacctgtgcttttactattgggcgacgataatacactgtataaaattgacccaaggctcgaagcacttaaagaaaaggcaaattgcgatataaaagttatctggaacgctgatttatgggaactggaaagccgtgtcaaaaataaatccatagacattgatttaattttgggacattcaaaaggacgatacattgcaatagacaatgatatccccatggtaagggtaggcttcccaacattcgatagagcagggctgtggaaatatccagcaatcggatacaaaggagcagaatggctagctgaaacaattgccaatacgatttttgcatccatggaaagtaagcatgacagagaatggataatcaatgtctggtaa

SEQ ID NO: 34926 - DNA, 846 bp, Methanosarcina mazei
tctcctgtgattagaaatgaaggctttgaaattattgacaccacattgcgtgatggggaacaatctgcaggtgttgtgttttcggttgaagaaagaatgaatataatttcagctttagataaagcaaaagtgaaatggattgaagctggcattcctgctatgggtaaacaggaatgtgaagacctgaaactaatgctcaacctgccgataaaatcgaaccttattgcatggaatagagcaaatttggaggatttaaaggcatcaattgattgcggatttaaatttgttcatgtgtctttaccggtatctgatctgcatattgaacataaactccaaaaaagccgaacctgggtgctggatcaattgaaaaaatgcatggaatatcttcaaagttgtaaggtaacgattattgtaggagctgaagatgcgtcaagggcagacccagaatttttgcttcaatatgcaggtattgcagcctcttacggtgcaataagaatccgatattcagataccgtaggatgcctggaccattttacgacatatcgcaaaatcaaagaaattgcagatcatagtcctcctcctgttgaaattcatgcgcataatgatttcggcctggccgtagcaaataccctggcagcatataaggcgggagcaaagtttgcaagtgtaacagtaacagggctaggggaacgtgctggtaatgcctcaatggaagagacagcattttcattaaaacgtttttacaactacgattgtgggattgagcttgaagctttgccgtttctggctgaaatggtctcaaaagccagtgaaaggacattgtttccatataagccattagtaggg

SEQ ID NO: 34927 - DNA, 1539 bp, Methanosarcina mazei
atgactcaggcaaaaaaaccacttatgctcattattcttgatggctggggctacagggaagcaagagaaggaaacgctatcctggcagctagaactccaaatcttgaccacctgatagaagaatatccctggtgtttcttagaagcctcaggggaagctgtaggccttccagagggccagatgggaaactcagaagtcgggcacctgaatatcggggcagggcgaattgtgtaccaggatctaacccgaataaatttctccataaggaaaggtgacttcttcaagaatcctgcttttttgggtgcaatttcaaatgccaaagccaacgattccagcctgcatctcatggggcttgtctcctacggaggcgttcacagctatatggcccatattcatgcccttatcaagctcgcacagcaggaaggggtgaaaaaagtatatatacatgcttttttggacggcagagacgtgcctcctaaagccgcccttaaagatatagaggagcttgatgctttttgtaaggagaacggaaatgctaaaattgcaactatatcagggcgctattacgcaatggacagagataagcgctgggatagaacaaaacttgcctatgatgccctgactatgggagttgcgccttacaaaacacctgatgcagaaactgcagtttctgaagcttataaaagaggagaaactgatgagtttgtaaaaccgactgtaatcacagattcagaaggaaagcctgaggcagtcataaaagataatgattctataatcttcttcaatttcaggcctgatagagcaaggcagcttacctgggcttttgtaaataaagactttgagaactttcccagagaaaaacacccgaaagtttactatgtttgtatggcccagtatgatgaaacactggacttgcctatagctttcccaccggaagaacttgaaaatgtgcttggcgaagtactgagcaagcaggggctggcccagcttcggattgccgaaaccgaaaagtatgctcatgtgacttttttcctgaacggaggacaggaaaaatgctatgaaggagaggatcgctgcctcatcccatcaccaaagattgctacatatgaccttaagcccgaaatgagtgcatatgaagttacggaggaagttatagggaggattcggtcaggaaagtatgatgtgattgtccttaacttcgcaaacatggatatggtcgggcacaccggaatctttgaggctgcagtaaaggcagtggaagccgtagatagctgcgtgggcaaaattgccacggttctgaaagaagtaggaggtgtagcgattataactgcagaccacgggaatgccgaacagatggaaaacccgacaacggaagagccgcatactgcacatacttcaaatccggtaaagtgcatttacttcggaaatgatgaagttaaaggacttaagaacggaaaactgtgtgatcttgcaccaacccttctagaactcctcaagatccgaaagcctgaggagatgacaggagaatctcttattata

SEQ ID NO: 34928 - DNA, 2427 bp, Methanosarcina mazei
ggctggtcttcaagcgagaaagcattgtataacaatgcatcgtatccacccacccatcagtgctttgctttctataagtatatgtcccgggaatacaaggcagatgcactgtttactatattctcaagcgtggaactaatgcctggaaaagaatgcggcctttctgcaaatgactggggagcacttttgcttgaagacatgcctcatgtccatgtcctcccaatggatgctgaaggtgtatttgatagaaggagagcaaacatgctcgtcattgatttcatgacacctactatagtgccttcaggcctttatggtaacctttccaacctgcaacaggaaataacattatttaaacagacctctgacagtgcagtgaaagagaattacaggcaggatataattaaccagacaaaaaacatcagcctcgataatgacctgaatgttgacattgactcaattgcaggtgatacaaaccttacggatgctttcattgacaaacttgcagactacctttctgaactgaagacctcttacatgccgtatggttctcacgtacttggcgaagttcctgagggagaaagccttgttatgctcataaaaagtatgctaggggatgagtatatagaacatgtcgaatcacttggaggaagcgaggaactttcaatatcgctcttgaatgagactatattgaatggaacatctccatatgatgcacaaataatggtgcttggtcggaactctacagaacttggaaacgaccttgacctgtcattagaatatcttgaaaggataaagcaatgtgactgtgagattacaaagatacttgatgcacttgatggcacatatatcactccagggccttctggagaccctatcaggaatccggatgctttgccaactggcaggaatctctatacattcgatgacaggctcatcccgacaaaagcagcatggaatgtagggtcacagctcgcggaagagacgttaaagctaaaacttgaagaggacggccagtatcctgaaaagatagcttttctgctgtggtctgtggaaactacaagaaaccagggtgttatggaatccgagatattccagcttctgggagtcgaacctgtgtataatgaaaaggacagggttacaggcttaaagctcatagattctaaggaacttggaaggccaaggattgatgtgatggtaaccacttcggggctctaccgggatgtatatccgagcaagatcgaacttatagaccaggctatcaagatggcagctgcagcagataacgatacgtatcccaactatgtaagagaacattccaatgcaacataccagagccttattgcaagaggatataatgagtcacttgcatacaacctgtcagtttcaaagatattctgtccacctcccggagggtacacaccaggcattcaggaggttatccccagtgatacatgggaagatgcagacgagatcgcaggtctctatattgacagaatgggatatgtctacagccaggagatatggggagaacattactccgatgtattcgaactgaaccttgaagatgttgatactgcagtttttagcaggacatcaaatctttatggtgtgcttgatcactcgatggtagcagcctattttggtggtttgagcatggcaattgaaagtgttagtggtactacacctgacatgtatattaacgaccttagcagttccgcagaaattgaaacccttaatgaattccttagtaaggatctgcgttcacgttacctgaatccaaactggatagaaggaatgatggggaacggttttgacggtacgagatatatggactcagtatttgaggtcatgcgcgtatgggacgtaacagacccggaccttgttactgatgatacatggaatgagatgtatgacacatatttcaaggataaacataataccggtgttactgagttccttaaatctacaaacccatatgcttaccaatcaatggctgctacagcattagattcgattcgcacaagttactgggatgcctccgacgaggttacacaaagccttgttaaagaatatgtggaatctgtggccgaaaatggtgtcacctgctgccaccatacctgtggaaatgccctgcttgatgaatatgtccagggtgtgatgtcagttcctggcgtagttgatgagaagactgcaaatgaatataagaaactgatgcaagaagcaacggaaccttcgcagcaatcaggtgagagtagtagcggcagtagcagccatcatgatcacgatactggaaaagctactgtaatttcaggaaccagtaaaaccagcaaccagacctcaagcgctggtgaatctactaataatcaaactgttaagggctcagatgcaggatatggtacggatacttccaaacctgctcctgaaatt

SEQ ID NO: 34929 - DNA, 1356 bp, Methanosarcina mazei
atgaaacttaaatccattaacccttatacggaaaaaataaactgggcttatgattccttttctatcggggaatgcagagcccgtattgagaaatccagaactgctttttccttatgggattcactgcctgtagaggaaaaggcgaaacatttcaaaactgctgccgaaattcttcgggagagtaccgatacttatgctgaaattattacaaaagaaatggggaaacctgtaaggcagtccaagaacgaggttcagaaatgcgcccagctctgtgattattatgcagagaactcgactgaactcctgaaagacgaaattgtagatataggaactgagaaaagttatgtaacctttgaacctctgggagtgattttcgggatcatgccctggaattttcctttctggcaggttttcaggtttgcaatacctgcgatgtgtgcaggaaatgtctgtgtgctcaagcacgcttcaaatgtgccaaaatcggcgctggaaatcgaaaatatcctccttgaggccggatttcctgaaaacgttttcaatactctgttaattgactcaaaaactgccatgcagattcttaaagaagagctggtggacgggatttcgttcacaggcagcgtgggcgcaggctcgaaaatcggaaaacttgcagggcgaggtatcaaacctgtagtactggagcttgggggctcggaccctttcatagttcttgaggatgctaacatcgagagggctgctcaggcagctgtaaagtcccgttttctaaatgccggacaaagttgtactgctgccaaacgattgattgtcgtagaagatatcgttatggattttatcgagtcgtttgaattcaaagtgaaggaactgaaaatcggagatcccatggatgagaaaaccgatattgggcctcttgcaaagaaggaattcctcgggagtcttgagcgagtattaaaagatgcaaaaaagaaaggtgcaaaacctcacgtttacggagaagaacataaaaaggggttcttcttcaggccgaccatcattcctgcagccagtacggatatggaagtgtgcaggactgaaattttcgggccaattgccccggtgatcacggtaaaggatgagaatgaagccgtggcgattgcaaactccaccgagtatgggctcggggcgaaaatctggtcaggagatctggatagggctgaaaggctggcaaaaagaataaaatccgggtctgtatctatcaacggaatgatcaaatccgatccgaggcttccttttggcgggactaaaaaatccggggtggggcgagaactctcacactatgggctcagggaatttgtgaatataaaaactgttgttgtt

SEQ ID NO: 34930 - DNA, 3957 bp, Methanosarcina mazei
agttatgtctatgtagctgatgagagaaatggacttgttattttaaagacagatattcagaatcctgagccagtgccgcctaagagtgatattccaagctctacttatggttctccaagttccaatccaaatggggcttattccaaagaaccagtaaatttgggaactggcagctatttctaccaatatcaagatttgtctattcctggtcgtggcttacctctgacagtttctcgttcctataattctatggataatcgcagtgggctcttcggttctggctggacattcaattataacatgaatttaactgttgataataacggtaatgtaactgttttgggaggagatggtcacactgacacatatattctaaatccagatggtacttattctcggcctttgagtgtttttgatgatttaatcaaaaattcggatgagacttacactttaaccaagaaagaccaaactaagtataacttttcctctgaaggtaaactggtcaatatagtagataagaatggtaaccaaattaatttcacatatactggcgaacaacttactaaagtgactgacgcttccggaagagaactgattttagcttatgatcacaatggtcacattatctcaattactgatccaatgggcagggtttggagttattcctatgatgatcagggcaatttgatacagtgtaagaacccgataggcggaaaattgagttatacatatgatgaaaatcactggatgacctcgataactgatcctcgaggaaaccatcccatgaaaaatacctatgatgagaaagggcatgtaatcagccagagtaattctctcaatgcaacttatacctttaattacgactcagaaaatcgaaagactactgaaacggatccatttggcaagaataaaacttattcattcgatgaacatttctgggaactgaatgaaactaatcaattaggatatacgatttcttatgcctatgacgaaaacggtaacaggattagtgttactaacgaaaacagtaagactaccaaacttgcctacgacgccaatggcaatatcattaagacaactaatcccttgggctacagtaaatcaatgacttatgactcaaaaaataatctgattagccagactgatgagttgaggcataaaacctcttttgaatacgatgataatagcaatcttattaagagtatagacgctcttggccatgagactgttttcagttatgacaaatatgggcaagttataggcgagactgactccaacaaaaaaaccgcaacttttagttataacaataacggtgatcaaattacaatcactgatgctaatggaaaaacttcagcctttacttatgatactgtaggcagagtaactaccaaaactgatgcaaaaggtaatagatatacatttcagtatgatgcccttgacaatctcctaagcatcaccgatcctatgggacaaactacaagtaacaaatacgatgctgctggaaataaaattagttttacagatgctgaaggtagattaacaaagtattcttacgactctttaaatcagttagttaaagtaacgaatgcaatgggtggagtagttaggtacaaatatgatgccgttggcaatctggtttccacgacagacgcaaaagggcataaaacaagctatgattacgatccactaaatcgccaggtctctgttactaatgcattagggaaaactacacgtaacaaatatgatgcgattggcaataaaattagtattactaatgcatatggaaagtcaacaaggtattcttacaactccttaaatcagttagttaaagtaacgaatgcaatgggtaaagtagttaggtacaactatgatgctgttggaaatctgatctccacaacagatgaaaatgggcataaaataaactacggttacgattccctaaatcgccaggtctctgttactgatgcattaaggaaaactacacgtaacaaatatgatgcggttggcaataaaattagtattactaatgcatatggaaagtcaacaaggtattcttacaactccttaaatcagttagttaaagtaacggatgcaatgggtggagtagttaggtacaactatgatgctgtaggaaatctgatctccacaacagatgcaaatgggcgtaaaacaaactatggctacgattccctaaatcgccaagtctctattactaatgcattagggaaaactacacgtaacaaatatgatgcggttggaaacaaaattagttctactgatgcaaattggagattaacaaaatattcttacgactctttaaatcggttagttaaagtaacggatgcaatgggtggagtagttaggtacacctatgacgccgtaggaaatctgatctccacaacagatgcaaaagggcataaaacagactatggttatgattcattagatcgtcaagtttctattactgatccattgggaagaactgcacgtaacaaatatgatgcggttggaaacaaaattagttctactgatgaagatgggaagaccacttcttacggttatgatgttttaaatcgcctaacaaaggtttcctaccctgatgatcaaaaagtgagttacaactatgatgccgtagggaatcgcttgacgatgaaagatagccatggaacaactgcatataagtacgataaactgaatcgcttgcttagtgttctcaaccccgatggccaaaaagtgagctacacgtataataaagttgggaatcgcgttaaaatgacgtatcctgatggcaagacgacttcttattcttatgatgctgtcaataggttaataggtgtaattgattcggatggtcatattacaagttattcttatgctaaaaatggtaatttgaaaactatgaacactcctaatggggtaaagacagaatattcctatgataaagccaacagattggttgaattaattaataaaaacacaactcaggttgtttcaagttataagtacaccctggatgctgcaggcaatcgtttaaaagttgatgagcaacttgcggaaggggtcgagtctggagattcagagttaaaagagtcacagcttttgactactacatatggatatgataagctctatcgcttaaccaaagtcgattatccttctaacaagactgtaagttacaaatatgactctatgggcaatagaattagcatgactacaaatgttgacgggatcggctcgactattagttacaaatatgatgctgctgatcaacttttgcaatcagggaatatctcttattcatatgacaaaaaaggaaatctaataaaaaagagagtaaactcaacacagtttatgtcttacagttatgatgaggcaaatagattaaaaaatgtttccgaattcgtaagtaacactaatactccaaaatcttcgtataattttgaatatgatggagacggaaaccgcatcataaaaacgacaataaacggcgagaacgcacagtccaccaaatatgtattggacatcaacagcgctttaccccaggtgctcaccgaatcagatacaaaaaacacaacctgctacacttatggaacagaccttatttccatgaccaattctgaaaacgcagaatactattaccattatgatggactgggaagtgtacgcagtctcagcgacagcaaaggaataattaaaaatacttacttgtatgatgctttcggacaggtacagaaggaaataggtacagttgacaatgaattccgtttcacaggggaacaaatggatgatgaaactgggctgatttatcttagggcaaggtattatgaccctagtgttggaaggtttattaccaaggatgtaatcaaaggtagaagggtaactacgcagagcatcaatcgttatgtgtatacaacaaataacccggtaaatctagtcgatctaactggttattgtgga

SEQ ID NO: 34931 - DNA, 1422 bp, Methanosarcina mazei
atggtagatagaagtcggcccttgaatctcggtaaggtcatctcggtgcgcggcagcattgtagatgtattgttcgagaggcatttgccacctgtatatacactgctacgtgcaggaaggctacgtgcaggaagggaaagccagattgccatagaagttttgacgcaacttgacgcgcatcatgttcgtggaattgctctgaccccaactgagggtcttgctcgaggcatggcagtggaagatacaggtgggcctttgaaagcgcctgttggtagggaaatcctttctcgaatgttcgatgtgtttggaaataccatagaccgcaggaaacctccgtctgatatccagtggcgctcaatccatcaagctccgccaccactgatgcgtcgatccactacgtctgaaatcttcgagactggaatcaaagctatagatgtactggtaccgcttgagcgtggaggtaaagcaggtctattcggaggagcaggcgttggtaagacagtgttgctaaccgagatgattcataacgtagtcaagcaacaccagggagtgagcatattttgcggaataggcgagcgttgtcgagaaggggaagaactttatcgtgatatgaaagacgctggtgtgcttccgcatacggttatggtattcggccagatgaacgagccaccaggcgcccgttttcgtgtagggcatacggcactgacaatggcagagtacttcagagacgatgaacgccgagatgtgctactgcttatagataacattttcaggtttattcaggctggttccgaagtatctggcttgatggggcagatgccttcacgcctgggatatcagccgacattgggaactgaattatccgagttagaagagcgcatatctactactgatgccggagccataatgtcgattcaagcggtgtatgtgcctgctgacgatttcactgacccttcggctgtgcatacattctcgcatctatcggcatcaattgtcctctctcgtaagagggcaagcgaggggctttatccggctattgaccctttgcagtcaaactccaaaatggccacacctggcattattggtgaaaggcattatcacctggctcagaaaatcaggcagacgcttgcgcaatactcagaacttaaagatattatctcaatgcttggcctggagcaattatcgcctgaggaccgcaatgttgtagcccgcgctcgccgcctggaacgtttcctgacgcagccgtttttcaccactgagcagttcacaggcattaaaggcaaaaccgttagcctttcagatgcgctcgacggctgcgatcgtatcttgcatgatgaattcaaagactattccgaaggcgacctctacatgatcggaacaattgacgaagcaatagccaaaaaatcaagccgggaaaaatca

SEQ ID NO: 34932 - DNA, 813 bp, Methanosarcina mazei
attatagatgggaaagttcttgcaaagaaaattgaagatgaagtgaggtctggagttgaagcccttgtaagtggccggggaattacgcctggacttgctactgtccttgttggcgacgaccctgcttccaaaatgtatgtccgcctgaagcacagagcctgtgaacgtgtgggcattcaggcagaagaccactttcttccggcagaaaccagtcaggaggaacttatctccctgatcaatacccttaacaaagaccagaatgtgcatggaattctgcttcagctcccgcttccgaaacatctcttccctcaggaagcaatggaagcaatagctcctgagaaagatgcggatggctttcacccctacaatatgggaaagctaatgatcggtgatgaagggcttgttccatgtactccacatggagttatccgggcgcttgaagaatataatgtgcctgtaaaaggcaaaaacgtggttattgtcgggcatagcaatgttgtcggaaaaccattggcagcaatgttccttaaccggaatgcaacagtctcggtttgtcatgtatttacagatgaccttaagaaatacactcttgacgcagatattctggtggttgcaactggagtcaaacaccttatcaaagctgacatggtaaaggaaggcgcagtaatctttgacgtgggtattaccaaggaaaaagatggcgtatacggagatgtagacttcgaaaacgtgatcaaaaaagcagccctaatcactcctgttcctggcggcgtaggccctctgacagttgccatgcttatgaagcacgtactt

SEQ ID NO: 34933 - DNA, 933 bp, Methanosarcina mazei
atcgttaaagagttgacaaaaaaattcggagaatttactgccgttgacagtgtctcattttcggttgaacccggagagctttttgggcttttaggccctaacggtgcgggaaagacgactataatcaatatgctgacgactcttcttcttccgactgcaggtggcgctgaaatcgcaggatatgatcttagaagggatcctgattcgatcaggaataatatcggaataatatttcaggatccttcacttgatatagggcttaccgggagggaaaatcttgaatttcatgccatgatgtacaacattcgttcagatgagcggaaaaaaagaatccaggaagtgcttgatgttgtgggactggctgacaaagctgagattcttgttgaaaattattctggtggaatgaagaggcggcttgaaattgcaagggggcttattcattatccaaaagttttgtttctggatgagcctactctcgggcttgatgcacagacccggagatcaatatgggaatatatcggaaacctgaatcgaaattatgggacatgcgtcatcctgactacccattatatggaagaagctgatttcctctgtgatcgcattgcgataattgatcatggaaagataattgcactcgatactccatcaggtctgaagaaccgtctactgggagattgtgtcagcctgactattgatggaaaggttgctctcatagcgactgctcttggggagaaagaatgggtaagggaagttgttcctgatggaaaaacgcttgatctcattctatcggattatgagaaaaacatacctgacatttttcagaccgcctccaacctgggtgtcgggatcagttcgataaatttcagcaagccaagccttgaggatgttttcctccgccttacaggttcaataatacgagaacaagaaggcagc

SEQ ID NO: 34934 - DNA, 990 bp, Methanosarcina mazei
attgcggtaaacggttacggaactataggaaaaagggttgcagacgccgttagggctcaggacgatatggaagttgtcggaatttccaagacaaaaccgaattatgaggcagcagtggcacatcggctaggatatgacatatatgccccagctgcaaatctcgaagcttttgagaaagcaggaatgccagcagctggaagtattgaagagatgctagagaaagctgacctggttgtggactgcactccagggggaattggggaaaaaaataagcctatttatgagaaagtagggataaaggcaatctggcagggaggagagagtcaccccattgcgggtttttcctttaatgcagagagtaattacgaacaggctgtaggccgcgacctgacaagagttgtctcgtgtaatactacagcactttgcagggctatttcaactatagacagagaactcggagtaaataaggtaagagccagtctctcaagaagggcagttgatcccaacgaaattaaaaaaggacctgttgatgcaatcgtacttaacccggttaaacttccgtctcaccacggaccggacgtaaggagtgtgcttccacacattaacataacgactgcagctataaaagtcccaacgactctgatgcatgtgcacactgtaaatatggaagtcaataaggattgcactgcagaagacgttaagaatatctttggttctcagtccaggatccgtttagtagggcaggggattacttcaacagctgagataattgaatttgcacgggatattgggcgccccagacacgatatgtgggagctctgtatctggcctgaatctattacagtgaccgataaagagctttacttcttccatgctgtccatcaggagtctatcgtcgttccagagaacgtggatgctataagagctatgatggaacttgaaagcgacggtgcaaagtcaattgaaaagacaaataaggctattggactg

SEQ ID NO: 34935 - DNA, 1203 bp, Methanosarcina mazei
tatttgacgatgagtgatgtcgtactggacaataaaagagtacttgtaagggtggactttaactcaccaatggatgataatggaaacatcctggacgataagaaaattaagagccatttgcctacgttgcagtccctggagcactcaaaagtggtcctgatgtctcatcagggtcgacctggagatgaagactataccaccctggaagcccatgcaaagctggcaacagagcttttgggtcgagaagtaacctacgaggatgatatattcagctcatgcgcaaggaatgctataaaatcccttgcccagggagagatcctgctccttgagaacacgcgtttcaatgccgaagagatcacgaaccgcccgcctgagaaacaggctaaaagccagatggtcaagaagttgtatccactatttgatctctttataaacgatgctttttcagtttctcacagatctcagtgttctgtggtagggtttacagaagtcttgcctagcgttgctggcatacttatggataaggaaattacaggcttggataaagccttgaaatgtcgtgagcacccagcaatcttcatactgggaggagcgaaagccaacgactccataaaggcgatttctaatattctcaaacgggctggagctgataagatccttaccacaggggtagtagctacaatatttatgatggcaatgggcgtcgatgtaagcgaggtcaacaggaaattcattgaagataagaaatatatggaccagatttcgattgcttccaagctactcaaggattactcaggcaagatcatcgtgcctcaggatgtagcgttaaacagtggtggagaacgtcaagaagtcgaagtggacaagataaaaaaaggaaatcttccaatagctgatattggccgagagaccatcgaaaattattccaaatatcttaaggaagcaaaactatgtgtttttcatggcccaaccggtatttttgaactagataatttcaggcttggtacggatgaacttcttaaggctgcggctcaagcaagctattctgtcgcaggaggagggcataccttagatgccattgatcaactcggtctgggctctaaattttctcatataagcatgggtggaggtgcaagtataacctatatctctggcgagcccttgccaggaatcacagctctgaaaaaaaatgcattcaggtac

SEQ ID NO: 34936 - DNA, 576 bp, Methanosarcina mazei
tttaattttggagtcagaactgtgttaaaggcattaattttcgatatggatggcgttcttgtggactccatgcccttccatgcagtagcctggaaaaaggctttctttgatatgggtatggaaatccaggaccaggatatttattcaatcgaaggttcaaatcccaaaaatggccttcctttgcttatccgaaaagccagaaaagaaccagaagcatatgattttgaaactatcacttcaatctacaggaaggagttcaaacgagtctttaagctgaaagccttcgacggaatgagagagtgtctagaagtccttaaaacgcgtttcctgctatcagtagtctcgggctctgaccatcttattgttcacgaaatcgttgaccagcttttccccggcatattcgatattgtggttacaggagacgatgttaaaaattcaaagccatatcccgatccttttcttaaagccgttaaactcctgaatgtgcagcgggaagaatgcatagtaatagaaaacgctattctgggtgtagaagctgcaaaaaaagccaaaatctactgtatagggattcccaca

SEQ ID NO: 34937 - DNA, 4260 bp, Methanosarcina mazei
gaaagttccggcagcagcatccctatggtggggatctattatccaggctctgacaatgaatcattttattttgaggacacaccaacataccttgcctggtacaaacgtggttctgaaagctacaggagctatgaccccaacaagcccactatagggatctggttccacaggacagacttgcaaaacggatataccggggttgtggatgccataatccggaatcttgaagacaaggactgtaatgtgattgcaggttttgacactttcgataacatcacggagtattactgtgatgaaaacgggactcccctggttcagtgcatgatttcccttaaatctttcaggctaaattacaacaaccccgaacagggaattgaagaacttaaaaatctcaatgtttcggtcctgagaggcatagtggctgaggaatctgaatatgtggacgctgcagacagcagccgtgggattcccactgatcaggtcgtccgcaaaactatcagccctgacctggacggaatcttcgaatatattgttgttggcaaaagtgaaaaaaacagtactaccggttattatgaatacgtcccgatgcctaatcaggttgactggattacgaatcgctccatcaaatgggccgaactcaagctaaaaaataattcagagaagaacgtcgctgtaatctattacaactatccgtcaggcaaagataatgtcgcaactgcaagctatcttgacggcgtaaaaagtttatgtaagcttcttgaggttatgcaggagaacggctatgatatagattatgttcctgaagattctgatgaacttctggaccgtttaatgctccagggctacaacgcagggtcttgggccgaaggtatgctcgatgaccttgtggtaaacaggacggactggggtgtcgagcttgttcccatagagacttatcacaaatggttcgaaacccttccagaagagcttcaaacatctgtaatcgaaaaatggggagagccctggaacgaatcagaagatatagcctctagccccatgatatgggaaaacagcagtggaagatatgttgtactccctgctgtcaggtgcggaagcgtatggcttatggctcagcccgcaagaggatttttccaagatgaaaaagctctgtaccatagcagtgagacgccccccacccatcagtatattgctttttacatgtggttaaataatgagtttaaacctgatgcaataatccatatgggaacccatggcacccatgaatggctgccgggacagtcttgcgggatgaacaggacgagcgaatggtcccctattttgctcggagacattcccaatatctacccatatatcgtggctaatgtgggagaagggcagactgcagaatatcgtggaaatgcccttattatcgaccaccttactcctactatggaaagagcaggagcatacgcggaactggaaaacctcacacggctcatgcaggaatattacgggctcgagatgaacacacagaccaaggttgcctaccaggcggagattattgaagaaatggaaagcctgtcccttgatgaagaattagggatcaacgcaaccgaactgcttgcctataataccacagagtttgatctcttcgtaagggacgttctgcacgagtacattgaagatatcgaaggagattccattgcttacggtctgcacgtcctatccgaagtcccttcctgtaacagccttgacccacaggaggacgaacttactgatgttgtcagagccctgctgggtagcgactttgaggtaaacttgacaaatgccttttatcaggagtacccggaagggatccctgaaaatgatacgaaggtcaataatctgatctgggaagtaatacgtaatggaacggacgttcatgaagctcaggagatggtctatggtcagagtgatccccttataagttcagaccttgaacaaggactcggatatctggatttggtacttgagcccgatgactcggaactgttctctcttatcaagcgaatcgtgggagaagaactcaaagctgatctcaaaaccgatttttattcaaataccactgaatacccagatggaatccctgaaaacgatacaaaacctgatgatcttctctggaaagtggtttgtgaaaatgtagactctgaagaagcccagaatcaggtatatggctggaacaattcctcggtaacagcagatctcgattacggggctgattacaaagaccagatcctttatccacactgggatgaactggtatacatggtgcgttcaatgctcgggagctcttttgaatcccgggtcgaagcagctttctattcgaataccacggagtatccgctgggtattcccctgaccgacaccaaagttgacaggatgatcagggaagttgttgtcatgaattccactcccgaagaagcagagctagacatctatggaaccacaaacgacactataagcgaggacctgcttaccgggcttgagtacaaacagagacttctgaattcgaatgtggaactggaccgtattctttctgctcttgacggctgctatattccaccgggaccaggaaatgatcctgtatccagaacggatgccgtacccaccggtcgaaacttctatggaataaacccggagctctacccatcggaagctacctggaagatgggaaaactcctggctcaggagctgcttgcagattattatgagaaatatggagattatccgcacaaggtcgcattctccagatttggggtggacttcattcaggaccacgggacccttgaagccgaaattctctacctgctgggagtaaagcctgtctgggatgataatggtatagtccagggagtggaactgattccggaagaagaacttttgcctagctacgattcttcaaatcccggaagaccgcggatagacattgtttacgtaactgccgggatgagggacgcttttccggataaaatcgaaatgattgatgatgcagtaaaacttgcaaacctcgccccagacggtaactattctaactatgtaaatgaaagcacacaggtattctacgacaaactatatgaagaatacttaaatgagaccggaaacgctacggcggctgccgcccttgcagaaaatctttccacaatgcgctgttatgctgtgaaagacgggacctatgaactcggggtatccaatctggtagaggccagcggaaactgggacaatgaggaggagattgcggaactttacatgaacaccatggggtatgcttacggaagcgagatatggggttacaagagttcggagatctttgctcagaaccttgcggatgtggacgctagcgtccattcctctacatcaaatctctacgatgcttttgataatgatgatttcttccagtattttggaggtctgaacttggcagtctattatctgacgggagaatatcccgagatgtatgtctcggacacaagggacgcggattctgctgaaatggttacccttcaagaatatctaaacaagaacctgcgctctacttactttaacgacaagtggatcgaaggtatgatgggatcagggtactctggtgcttccatgttttctgagtttgtagataatgtctggggctgggatgtgaccactgacctcatcagcgacgatgtttgggaaaacatctatgggacatatatcgatgaccctgagatgcagaaatggtttgatgacaacagccctgcaacattccaatctatcactggaaggatgctggaagccgcccgcaaaggctactgggattgtgactcagagactcttgaaagtcttgcaacagcatatgaaaaatcagttgcagaaaacggggcaacctgctgtcaccacacctgcggaaatgttcttctcaccgaatttgtggaaggttttgtttctgtacccggcttcagtcaagcaatggaaaaggccacaaaatccagtgaactcgatgacaaaaattttacaacacccaaggaagaggaaaagacatcccattccagcagtagtacggggaaagccgaggttgtttcagactcaggaaaccagacgcaagcagagatttcagatggaggatatggcatggacacaagcaagccggatgcacagaaaacggaggactccaattatgtggaaggatatgagatgcaaaaagaatccaccaagaacgaaagtccctcttcgggaatatctttttcaggagccgatatcgtgggaatcgtc

SEQ ID NO: 34938 - DNA, 1218 bp, Methanosarcina mazei
ctcatagaatccggaaacatgaagatggactgggcaagaaaccatatgcctgtacttgccatcgtcaggaaaaaatttgaggaggaaaaacccctaaaggggatgaaggtaggaatggctctgcatgtggaagcaaaaactgcagtccttgtagagaccctcgctgcgggcggtgcagaggtagcaattaccggctgcaatcctctcagcacgcaggatgacgtgtcccttgccctcggcacccgcaagaacataaactgttttgcaaaatacggagtcgaaagccaggaatattacaaagcaatcgaccaagtcctggacattaaacccgatatcacaatcgatgacggggcagaccttatctttaaattacatacagaaaggaccgacctgcttccgaatattcttggcggctgcgaagaaacaacaactggtgttcacaggcttcatgcgatggaaaaagaaggagctctgaaaatgccggtaatcgcagtaaacgacgccatgaccaaatacctctttgacaaccgctacgggacaggccagtcagcctgggatgggattaacaggacaacaaacctcctagtagcaggcaaaaacgttgttgttgcaggttacggctggtgcgggcgcggagttgcaatgcgtgcttcaggccttggggcaaatgtaatcgttaccgaagtcgatcctgtaagagctcttgaagccaggatggacggttacagggttatgaagatggcagatgctgcaaaattaggtgaaatctttgtgaccaccacaggaaaccgcgatattctcacagccgaaaatttcaagtccatgcctgacggagcaatccttgcaaattccggccacttcaatgtggaaatcgatatgggagcccttgaatctcttgcgaaatccgtccggaccgtaagacacaatataaaagaatacgatctcggcgacaggcgcattaatgtcatagccgaaggcaggctggtcaatctggctgctggcgacggtcatcccgccgaggttatggatatgagttttgcaaaccaggctctctgtgtgcgttatattgctgaaaacaagcttccgaacggagtccataaggtacctctggaacttgatacttttgtggcaagaatgaaacttcagtcaatgggcataaccatcgatgaactcacgacgacacaggaatgctacatgagcggttgggagtgcgggaca

SEQ ID NO: 34939 - DNA, 642 bp, Methanosarcina mazei
gaaatttcaagaaaggccgccaaaatgggggccgaccttctcgaaattcggcttgatttgcttgggatcagggacctggaaacagctgcagaaacaatcagaaaagtaaaatccgaaaccggacttccggtaattctcacaaatcgctcaattacggaaggaggaaaatgggaaggaaaagaggccgatagaattgaacttcttacaaatctcatttccctgaaagacgggccagatgcagtagacatagagctctctgctgggagagaagcaagagaccaggtaataaaagcggcaaaagcccacggaaaaactgtaatcgtttcttcccatgacttttcaaggactccggcttttcaggaaatgaaaactattctggaagaggcatttctggcaggggcagatattgcgaaacttgctgttatgccgcaatcgagaagagacgtacttaacctgttaagagttgcactggatgccagggaggcaggaaatgctgtatgtacgattgccatgggtaggcttggaaaacatacaagggtaattgctcctttctacggttcggtcctgacatatgcggctgttaatagtgaagtttctgccgcgcccgggcaatttcaggtagacgaagtaaagaagatattg

SEQ ID NO: 34940 - DNA, 828 bp, Methanosarcina mazei
caagtttttggcgtatttggagaccctatagctcattccctttctcctgcaatgcataatgcagctttttcagcccttggaatggactgtatctatcacgctttcagggtgaaacccgaaaaactggaaaaagcaattcttggggctgaagctatggggttcggagggttgaatctgacagtgcccttaaaagagacagccttgaaacttgactgcataaaaccggacccactggccgaaaaaataggagctgtaaacactatcgttttcggggaaaccggagaaataaaagggtacaacacggacggactaggagcaaagcaggcacttcagaattctgcagtggaaatggaggggtctaaaatcgtagttacaggtgcaggtggagcagcaagatccattgcttttcagcttgcagccgatggcgctgaaatcacaatagtaaaccgtaccgaaggaagggcaatcgagcttgcaaaagatatctcagctgcatccctttctggaaacgtaactgggaaagggctctccggattaaaaaacttgttgcaggatgccaatatcctgatcaacactacgactcttggaatgcaccctaatgtagatactgcgattgccacagcagaagatctccaccctgaccttactgtttttgatattgtctataatcccctggaaaccaggctcttaagagaagcaaaagcttcaggcgcaaagactgtgagtggagtcttaatgcttgtctaccagggagctgaagctttcaagctctggacaggaatcgaacctccagtcgaacttatgaaaaaaacggttttggaggctttg

SEQ ID NO: 34941 - DNA, 1539 bp, Methanosarcina mazei
atgccatatcacacgtttaagtgcagcgaatgtattcctgaaagggctatgcatgctgttataaaaggtccaggtgaagatttgacgtcctgccttccccttggatatctcaacacgatccctgggacgatttcagaacgtggatgcgctttctgcggtgcaaaacatgttataggtgcacctatgaaagatgtcatccatctgtgccatggcccagttggatgtacctatgatacctggcatactaagcgttatattagcgataacgacaacttccagcttaaatatgcctggacgacagatatgaaggaaaagaacgtcgtattcggcgctgaaaaactgctcaaacaaaatattattgattgtttcaaggcatttccgcatatcaaaagaatgagtatctaccaaacttgcgcttcagcacttattggagacgatataaatgcagttgcgaaaaaagtgatggaagaaatgccagatgttgatatctttgtctgcaatgctcctggttttgggggacctagccagtcgggaggacatcacaaaatcaatattgcttgggtcgatcaaaaagtaggaacatttgaacctgaaatcaaaagcaaatacgtcatcaattatgttggtgattataatatccagggagatgcggaaattatagtggattatttccagagaatggggattcaggttctttccacctttactgggaacggatcctatgacgaccttaggggtatgcatctggcccatctcaatgtactagaatgtgcgcgttctgcagaatacatctgtaacgaactaagaaaaagatacggaactccacgtcttgatatcgatggatatggttttgaaccgctctcagcatcactaatgaaagtggctatgtttttcggaattgaaaaagaagcccaggatattatagacgaagaaattgctagatggaaaccggaacttgactggtatgctaaacgtctgaaaggaaaaagaatttgtctctggcctggcggctccaaactctggcattgggcacatgtaattgaagaagaaatgggagttaaagttgtctcagtgtattcaaaattcggtcatcagggagacttcgaaaaaggcgttgctcggtgcagtgaaggagcacttgctattgatgatcctaatgaacttgaagggattgaagctatggagatattaaaacccgattgtgtccttacaggtgtccgtccgggagaggtttccaaaaagatgaggatccaatatctcaatattcatggatatcacaacggtccatataaagggtttgaaggatgggtcaggcttgcaagggatctctacaatgccatctattcaccgattcatcagctttctggtttgaatatcagtaaggatgagatccccactgataaaggattcgtgactaggaagatgatttctgatgtgaatatcattgaggatgggaaaactccaatcgaggaaaggccatacaccggtgaatgtgatattgttacaagactacgcggaaaaaaatatcccaagcttgaa

SEQ ID NO: 34942 - DNA, 1386 bp, Methanosarcina mazei
atgtcttgtgaactaaaacaacgagaacgtccaggaattatcaaccctatattcacatgccagccttgcggagcacagtatgccagcgtaggaataaaggattgtatcgcgattgttcatgggggacagggatgcgtaatgttcgttcgtatgctattcgcgcagcatttcaaggatagcttcgagatcgcatcctcgtctcttcacgaggatggtgcagtatttggagcccttaatagagtcgaagaggctgtagatgttcttttgatgaggtatccacatgtaaaggtcatacctatcatcacaacatgctcgacggaagtcatcggcgatgatattgatggtcttattaggaaacttaacaaaaagcttttgaaagagaaatatgcaaatcgggaagtacatcttattccgattcatactccaagttttaaaggaagcatgataacaggatacgatgtggcggtgcatgatatcgtaaaagagtttgcaaaaaaagataaacctaatggaaaactcaatctaattaccggatgggtcaatccgggagacgttacagcgctcaagcaccttctatcagaaatggacatagatgcaacagtccttttcgaaatcgaaagctttgattctcctttgatgccggataaaagtggattcgcccacggtagcacaacgatagaggacttgaccggaactgcggatgcactgggaacaattgcattgaacaagtacgaaggtgggaaagctgccgaataccttaaaaacaaatttgatgttcctgcaatcataggaccgactcctattggaatccgtaatacggatacgttcctgcaaaatttaaaaaaaatgaccggaaaaccaattcccgaatcacttgttcgtgagaggggaattgcaatcgacgcaattaccgatcttacccatatgttttttgccgacaaaaaggttgccatttacggaaatccagaccttgtcataggtcttgctgaattctgtctagatatggagatgaaacctgtggttcttcttcttggcgatgacaataacacatataaggatgatccgcgcatcaaagaattccaggaaaaagtcgatttcgatatgcagatcattatgaacgcagatctgtgggaacttgaaaggcggatcaaggataaggaagttgaacttgatcttatcctgggacattccaagggtcgctggactgctattgataacaatatcccgatggtacgtgtaggtttccctacatttgatcgtgcagggctataccgccatccagttgttgggtatgaaggtgctatatggctcgctgaacagatggcaaacacacttttcaccgatatggaattcaaaaaggatagggaatggatattgaatgtatgg

SEQ ID NO: 34943 - DNA, 597 bp, Methanosarcina mazei
cgagggaaactgatcacacttgagggcattgacggctcgggcaaaagcacagttgcagaaaaacttcagaagaatcctgaaattaaagcctttaaacctgtttttaccagggaaccaacaagaggcactctaactggagatgccgttgaaaaagctattcagtcagataccgaccagtttgccgagcttttcctttttacagctgaccatgcagaacatctggcaaaacttataaagcctgcacttgaaaacggaaaaatagtaatttctgaccgctattccgacagccgatatgcttaccagggcataaccctgaagactcgcctggaaaatcctcttgaatgggtaaaggatctgcaccggagctggactattgttccagatctaacctttctctttgatatcaggcccgaaatttcaattgaacgctgtggaaaacgaggagaacaaagcaagttcgagaaattagaatttttacagggagtcagggcgattttcctcaagcttgcggcagatgatccagaacgttttgttgtaatcgatgcttcccgttctcccgaatacatagaaaaggaagttgtgaaaaagatactggag

SEQ ID NO: 34944 - DNA, 1017 bp, Methanosarcina mazei
atgaatgagatggcacttaaagaaagacttttaaatgcacttgaaggcaaagaagttgacaaagtaccggtctgttctgtaacccagacagggatcgttgaattaatggataaggtgggggctccctggccggaggctcattctgaccctgaaaaaatggcgacgctcgcgattgcaaactatgaattaagcgggcttgaagctgtgagagttccatattgccttactgtgcttgccgaagctatgggttgtgaggttaatatgggaactaaaaacaggcagccgtcagttactgcacatccgtatcccaaaagccttgagggtatggaaatgcctgagaaccttcttgacatgggcaggatccggactgtacttgattcaatcaaaattataagggaaagagtagggccagatgtacctattataggaggaatggaaggacctgttactcttgcttccgatctggcgagtgtaaagtcctttatgaaatggtctgttaaaaagcccgatctattacatcaggtactggattttgcaaccgatgctacaatagcttatgcaaattcaatggttgttgcaggagcagacgtaatttctgttgccgatcctgtagcatctcctgacctgatgagtccggactcttttaaaaatgaactccagtcaaggctgcagaaattttcctcaaacgtaaattcggttacggtcctgcatatctgtggaagtgtgtctccgatccttgactatatggcagattgtggtttcgaaggtttaagcgttgaagaaaaagttggcagtattaagaaggctaaggaagtgcttggagatcgggcaaggctcgtaggaaatatctcaagcccctttgttctgcttccaggtccgatcgataagataaaagaagaatcgaaaaaagctatttccgaaggtgtagacgtactggctcctggctgtggaattgcacctatgactccgctttctcacattaaagctatggtcgaggcaagagacgaatattacgct

SEQ ID NO: 34945 - DNA, 1443 bp, Methanosarcina mazei
atgcgaattgatgcgtatatcactgagtacgccagaaaaactcctcaaagcattgccctggaagagggaaagagttcaatttcctatagctgccttgacaatgatataaacacaattgcttcacttttaatggattttaaccactgccgattttcaatactggcagaatcaggcatgctgtatgtgaaagtgctcatggcagtatatcgatctgcgaatatcgcaattcctctaccaatagaatttcctaaattcagtattgagaaaatccttgatgccgcccatgtcaacaatatcatcgtaaccgatacacaatactcaagatttggagaggacttttttgagcgttttggaactgtagtaattatttccagcaatacttctggagagtttttgcgtaagaagattgaaacagaagtgaataatccacaactacagctcgtcctttacacttcaggcacgacaggcaccccaaaaggtgtaatgttaagtaacagaaatctggtagcaaacgcagagtcaataataaaggtactcaggataacttccagagataaaggagcactggtgatatccccacatcacgcttttgggaattccataattaactcccatctggtagctggcagctcagtcaggattggaaatatgaatttcatagactctattttcaaccttataggatcagacatatccatattctatggggtacccagtacctatcgtatactccttcgatatccggatagattcaaaaaggatttctcaagagtcagaaccgctgcatcagcaggtggagaaatggatcgggatattgtaaacgacataagggaattagctccagatctggagattctaccgatgtacgggcaaactgaagctacggcaagacttgcttatctgccagcagaagatgtgaatgagctcgttgacactataggaaaagcaattccaggggttatactggatgtctttgattccgagtacagaccagcaaaacctaatattacgggtgaactggttgctaccggagacaacattatgctgggttacctcgatgatgaaattgccactgggatgaaaattatagatggatggctgcataccggtgatcttgcacagaaattacccaacggatatatcaaactgctgggacgcaaggatgaccttataaaaatcggtgatcatcgtgttaacccaagagaaattgagaaaagcatagaggaaaataacgaagtatccagggtttttgtcgtacctgtgcaccatgaacttatgggaaccgcaattagcctcatggtcatacctgcaaaaggaacagaaattgaaaagttgtatgcattctgtcgaaaaagcctgccaggatacctgcgtccaagagaaatactattcattgatcaccttcccataagcgagaatggaaaaatatccaaccgatccatt

SEQ ID NO: 34946 - DNA, 1416 bp, Methanosarcina mazei
attaacggaaaggctgttgaagcgtgcagcggcgaattttttgatatcataaacccggcaacaggtgaacttattgaccgggttccaaaaggcacggaagatgatgcggcaatagccgttgaatcggcgtcgtcagcttttaatggctgggcttccacatctccgcagcaaagagccaggattctttacacagctgcgggaattgtaagacagagaaaggatgaacttgctgtcttgcttacccgggaacaggggaaacctcttgccgaagctaaaaacgagattgaaggttttgcacatgtccttgagtattattgcgggcttgcaagtagttttcacggagattttgtcccggtccctcaaaatggatatgcttttactgtaaagaagcctctgggggtctgtacagccataattccctggaatatgcctgctcttattatggcatggaaaataggccctgccatgatttcaggaaatacgcttgtcctgaaacctgcaagcaatacccctcttactaaccttgccctggcttctatcctcagcgaggcagggcttcctccaggtgtactcaatatcgttacaggccctggtgaggttgtgggagaaagcctggttaagagcccgaaggttaaaaaaatctcctttaccggagaagtgagaaccgggaaacgtatagccgagcttgcagccggcgggatgaaaagagtaacccttgagcttggaggaagtgatccaatgctggtctgtgatgatgctaacctggaggctgcagtcgcaggggctctcaggggaagattttacaattgtgggcaggcctgtactgctgtaaagaggctttttgttttcgaatccgtagctgaaaggttcataaaaaagcttgaagcaggcatccggaatttaagggttggaaacgggttgcatgaaaacatcgatctggggccccttaacaaccgcaggcaatgggaatatataaaagagcttgtcgcagacgccgaagaaaaggatgaaggcaggatagttgcaggaggcagagttccagagggcagcgcctgtagtaaaggatatttcttcgagcccacacttattgtagatgtggacagaaaatccaggcttctgaatgaagaagtattcggtccggtgctgcctgtagtccgggtaaaagaccttgatgaagcgattgaagaagctaacaatacctgctatggccttggtgcctcaatctggacaaaaaaccttgacagggctcgtataggatgcgaacagttgaatgcaggaattatctggcttaatcaacatctaaaggttgctcctgaagttcctttcgggggtaccagggagagcgggattggaaacgaaaacgggcctgatgctctttctgaatatcttgatctgaaaaccgtaatgctaaaaatc

SEQ ID NO: 34947 - DNA, 2700 bp, Methanosarcina mazei
gaggtgtattacgaccaggaaataaactctgtttttgaagagcttggagtctcagaagcaggtttgagttttgaggaagccgaaaaaaggcttgaagagtatggcgaaaatgaacttaaagaaaaagaaaaagtctccgtcctgcagctctttatctcacagtttaagagcatcctgattcttattttgataacggcttctattgtttcggctcttctcggggagctagttgatgcaatagtcattatttttacggtttttcttgcaggtattctcagtttcgtgcaggaatatcgagccgagaaagcaattgagcttctaaggtcccttacctcgccggaagcgactgttaaaagggatggggtcgaaaaaagagttccctcaaaaaatcttgttcccggagatcttatccttattcagaccggagaccgcattccagctgatgccaggttagtcaaagagttcaatctcaaaactgatgagtcctcccttacaggagaatccgtgccagttcagaaaagcattgaagccctgccttctgaaacttctgaagctgacaggacaaacatggtctacacaggaactgcggttgcttacggaagaggcagtgccattgttaccgcaaccggaatgaatacggcttttggggaacttgccgggcttctggggacaatagagaggtccaggacgcctttacaggaaagccttgacaagtttggcagatggattggtactgcgactcttgtaattgtagcttttgttgcaatgcttggggttttttatggtttccctctccttgatatgtttttatggggcgttgctcttgcggttgctgctatccctgaagctctccctgcagttgttacagtagggcttgggcttggggtaaggcgtatggtcaaaaggcacgcccttgtaagaaaactgccatctgtagagacgcttggagccacaaatgttatctgttcggataagacaggcacgcttacgcagaataaaatgacggttgaaaaaatttgcgtcaatgatcaggttttgaaggttacgggagcaggatattctcctgagggagagttctttaacagagatgaaaaagtttctaccgatgatccccatcttcagattctcttgctgggagctgttctctgtaacgatgctggtctttttaaggaaagtgatacatgggagatcaaaggagaccctacagaggcagctcttgtggttgttgctgcaaagtcaggcttacataaagttgagcttgatcaaaaatattctcgccttggagaaatacccttttcctctgaaagaaaaagaatgactacctttaataaactggaaaccgattctagcaacttccctataaaaggacttactgccttctcaaagggagctcctgaagtgattcttggctcatgtacaaagatttttcttgacggtgaaataaaatccttatctcccgaaatgaagcaattgattgaaggaaaagttaaggaaatggctgatcaggccctcagggttatggctctttcatttcgccttctggatgaggaactctatattgaaaaaacttcttcaaaagagctcccttcagagagaattgaagaagatatggtcttttcaggtttaatgggcatgagagatcctccaagagaggaagtaaaggttgcaatccagaaatgtgaagatgcaggtattaaaaccgtaatgataacaggagaccataaaattacggcgtctgcaattgcaaaggaactggggatcttaaaggcaaacgatcttactcttacaggctcggagcttgatcgccttgaggatgtcgagttcgaagacaaggtcgaaagggtttcggtttatgccagggtctatcctactcataaattgagagtaatagacgcccttaagaaaaagggctatgtcgtagcaatgaccggggatggggtaaacgatgctcctgcccttaaagctgcagatatgggaatagctatggggattacgggcacagatgtcagcaaagaagcctcaagcatgattcttacggatgataattttgcgtcgattgttgcagcggtcgaggaagggcgaaacatctttaaaaatatccgaaacttcattacttatgggctctcagcccatatcggtgaggttctcatagttctcattgctatcctgggatggcagatcctgcctcttattgcggttcagatcctctggattaacctgattacggatgggcttcctcctatggctctgtcggttgaacctcctgacaatggtattatgaaacagaagccaagaaacgttgagaaagggcttataacccgtcgggaaatctcagccagtctgggaattggagggttgattgcacttcaggctcttctcgttttaaactgggctcttgacagaaatttctctattgagaaactccagaccctgatctttacgctagtagttttctcagagatgtttaatgcctttaactggcggtctgaccgatattcgatcttttccctgggactttttacaaacagacctctggtttatgcagtcctgacaacagtaatcctgcaactcgtggtaatttatgttccttttttccagacagcttttaggaccgttccactttctctctttgaatggggagtggtactttctcttgcttctaccacgcttatctcaatggaacttataaaatatttctca

SEQ ID NO: 34948 - DNA, 864 bp, Methanosarcina mazei
attcgcattgcaatacccaataaagggcgcctttacgaacccacaatctctattttcaaagatgcagggctcccaataagtggaggggccgaaagtcgaaaactttttgcaaaaactaccgatccggatatccatatcctctttgccagggctgctgacatccctgagtacgtacaggacggagctgcggacgtaggtattacaggcatagatctgattacggaaaggggagcaaaggttgaaactcttcttgaccttaaattcggaaaggccagccttgttctggctgtccctgaagactcggacttccagaaagctgaggatcttgaaggccgaaagattgcaaccgagtttccggaaattacacaccagtacttcaaaaagcatggagtcaatgttgaggttataaaggtcagcggagcctgtgaaatgactccacatgtgggaatagcagatgcaatcgtggacatctcaagctccggaaccactatgatgataaatcatttaaagcctattgagactgttttttcttctacagtctacctgattgcaaataaagaaagcctcaggacaaaggaaaaaattctggacatcaaaactgcactggaaagcgtacttaatgcaaaagatcggcgttatcttatgatgaatgtccccgagtcttccctccaggcagtaaaagaagttcttccaggaatgtcaggtccaacggttatgaaggtcgagtccagcaaattgccaggagaatccatccttgcagttcacgctgttgtggacgcagacttgatttttaccattgtaaataagctgaagaaagttggtgcgcgtgacgttcttgtcgtacctatcgaaagaataatgccc

SEQ ID NO: 34949 - DNA, 573 bp, Methanosarcina mazei
atgagaacaggcagaatgtcccgcaaaacaaaagagaccgatatccagcttgaactgaaccttgacggcactgggattgccgatgtcaacacaggaatcgggttttttgaccatatgcttacttcttttgcaaggcatgcagaatttgacctcaaggtacgtgcggaaggtgacctgtacgtggacgagcatcaccttgtggaagacacaggaatagttctcggaaaagtgcttgcagaggcactcggggatatggcaggaactgctcgttttggggaagccagaattccaatggatgaagcccttgccgatgttgccctggatataggcggacgcagctatcttgtcctgaaagctgagtttgcatctccccaggtagggcaattcagtacccagcttgtaaagcacttctttgaaacgctggcctcaaacgcaaaaattaccatccatgcgagtgtctatggtgacaatgatcatcacaagatcgaagctcttttcaaagcctttgcctatgctatgaaacgtgctgtaaaaatcgagggtaaagaggtaaaaagtactaaaggtaccctg

SEQ ID NO: 34950 - DNA, 1089 bp, Methanosarcina mazei
tttaaggcattggggctttcagacagtatgttaaaagcccttaaaaagaaagggtttgaagaaccaaccccaattcaggaaaaagtcatcccgctttttttgaaaggagaatgtgatattatagggcaggctcagaccggaaccgggaaaacaacggctttcggagcccccattatagaaaaaattccggaaaaatcaggaaaggtgcaggctatagtcctgaccccgactcgagaattagcaatccaggtctcagaagaacttaactctctgaaaggagacaaaaagctgcatattgtcccgatttatgggggacagtccatgacccagcagttcagaatgctgaaaagcggagttgatattgtcgtgggaactccaggaagggtcatcgatcaccttgagcggaagagcttgaatcttgagaacattgcttatttcgtactggatgaagctgatgaaatgctcaatatgggctttattgatgatattaaggaaatcttaaaggcaactgggcctgataagagaatgcttttcttttcagctacaatgccaaagcctatccttggcatcatcaagaaacacatgaagaactatgaatatgttgctattaagaaagaagatcttgatgtgaaccttactgagcagatttatttcgaagtcaaggaaagcgacaaatttgaagccctgtgcaggattatcgatattgaagacgaattctacgggcttgtgttctgcagaacaaaaaccgatacctcccaacttgcccagaagcttggagaccggggatatgcagccgatgctctgcacggtgatctttcccagcgtgaaagggaaaagatactgaacaggttcagaaaacaaaagattaacatcctcgtagcaaccgatgttgcagctcgaggtatcgatatcatggacctgacccacgtaattaactattctcttccgcaagaccccgagtcttacgtacacaggataggaagaaccggtagggcaggaaagcagggaactgcaattactttcgttacatctacggaatacaggcggctcacatacataaaaaagacttcaaaatccgcaatgaagagg

SEQ ID NO: 34951 - DNA, 2793 bp, Methanosarcina mazei
gacccatttggggtcagagacacaattgaaacagctgccggaaaagctacgatttacagtctgggtaaactggaagaaaagggctatgagggaatttccctgcttccttactccataaggatcctgctggaatctctgctcaggcatgcagatactgaaaagcatataataactgctgaggatgtggaggctcttgctcgctggagcccggaaaatataagtgacagggatattccgttcattccatcaagggtgatcatgcaggactttacaggcgttccggctgtagtagacctggcagccctccgctcggcaatgcagcgccttggaggcgatcccgcaaaaataaatcctgttatccctgccgatcttgttattgaccactcggtccaggtggattcttatggcacggcatacgctctcgaggaaaacgagaaaaaggagtttgaacgcaacacggaacgctattctgtcctgcgctgggcccagaaagcctttgacaattttagagttgtgcctccaggaaggggcattatccatcaggtgaaccttgagtatctggccccgcttgtgcatcttaaagagaaagatggggagttatttgcatttcctgatactcttgtagggacagactcccatactacaatgattaacggaattggagtactcggctggggagtaggaggcatagaagccgaagccgtaatgctcgggcagccttattatatgcctgtgcctcaggtagtgggcttcaaactttacggaaaacctgcccctggagttactgccaccgatcttgtcctgacaattacgaagatgcttagaaaagagggagttgtcggcaaattcgtggaattttacggtcccgggttaaattcactgagtcttccggacagggcaacgatctcaaacatggctcctgagtatggtgcaacccttggaatttttccgcctgatgctgagacacttgactacctgcgaagaactggcaggagcaaagagcaggttgatcttgtgaaaaagtatatggaagctcagggccttttttattcaactcatgatccggaccctgttttcagcactaccctggaacttgatatgagcacggtaaaaccctgtcttgcaggcccaaagcgtcctcaggaccagcttttcttgagtgaggtacctgaaaattaccatgaaattatgaagcagacctttatccgaaagaaagaatcagggcttgaactttcccaggatcctgcttaccagcgctggatagaagacggaggaacgccttttgaggaacctgaaactcctggtgcagaagaggaaataaaggaatcttcggaaaaatctttcagggtaacacatggttccgtagtgattgcagcaattacttcctgtaccaatacctcaaacccttcagttttaataggagccgggctgctcgccaaaagggctgtagaaaagggcctgcacgtcaaaccttttgtaaaaacaagcctttccccaggttctagagtagctacggaatatctgaaagctgcaggccttttgccctatctcgaagcccttggtttccaccaggttggttacggttgtacaacctgtataggaaacagtggacctttacctgaaaaggtttcaaaagaaattaaggaaaatgaccttactgtcgcagccgtactcagcggaaaccgtaacttcgaaggacggattaatcctcttgtcagggcaaactaccttgcttctccacctcttgttgtggcctatgcaatcgcaggtaccgtgaatatcaacctcgaaaccgatcctcttgcttatgatccaaacgggcgccctgtttacctcaaagatatctggcctgcagaaaaggaaataagggccgctgaaaagaacagcatcaaaccttcaatgttcgaaaaagaatattcaggtgctttagagggctccaaacgctggaaagagctggaagctccaacaggtactctctatgattggaactctatgtctacatatattcaggaacctccatacttcatggacttcccacctgctccaccttcgcctgcggatataaagaatgcaagagttctggcccttttcggggacagcattaccacggaccatatttcccctgcgggtgccattccttcagacagtcctgcgggcaggtacctgatttcctggggtgtgagccctgaagatttcaattcttatgggtccaggaggggtaaccacgaggtaatgatgcgtgggacctttgggaatattcggctcaggaacaggctcgtgggcagggaaggaggatggaccgtataccattcccggaaagaagacttccccgaggaaccctgtgaaggaatccctatttatgacgcagccatgctttatgcggaaaatgatactcctctgatcgttatcgcaggaaaggaatacggaacaggcagttccagggactgggcagctaaaggtacgttcctgctcggagttaaagcagttattgccgagtctttcgagcgtattcacagaagtaaccttgtcggcatgggagttcttccattgcagtttaaagaaggcgagaatgccgatactctgggccttacaggaaaggaaagttatgatattctgggcattgaatacatggaaccacaaggagaacttactgtaagggcaaaagacgaagatggtaatgaagttcagttccaggtaactttgaggctggattcggctgtagaagtcgagtattacctgaacggtggaattttgcataagttcctgcgggattccgtgaagaaaaattaatag

SEQ ID NO: 34952 - DNA, 1065 bp, Methanosarcina mazei
ggcataactgtgaggtataaaatgagtaaaaatatctgtttcatcgatgggttggagggcattctgaaatacagggagatagacattaaccagctggttgatcttccctatgatgccgtttcctatctgcttatcctcggagatctccccggagatcaggaacttgccgagtattcagcctgcttgcatggggagcgtgaagtcaacagggaggtgatagatgttatccatatgtgcaatttcaacattgactctatagaagcgctgcgtacaattgtttcttttatatcacaattcgatccggacatcaacgacagctctcctgaaggaaacatgagaaaggccacaaggttaattgccaagataccaaccatagttgctgcgtattatagaatcgcaaacggaaaagaacctgtacctccggatccatccctatcacacggagctaacttcctgtatatgttaagaggaaacaaaccaactcagttggaggctgaggtcatggaaaaagacttcatcctcagcgccgaacatgaactaaatgcctctactttttcttcaagagttaccgcctctactctttcagatctctattctgctgttgtttccggactctgcacccttaaaggccctctacatggaggggcaagggcagaagtcacagccatgatcgaagagattgcttgcccagaaaatgcggagaattatgtccttgataagctgagtaaaaaagaaaaaattatgggctttggacatagagtttacaaaacttacgatcctagaggcatgatattcaagcagcttgctaaacaactcgcagaagcaaaaggagatatgcactggtacaacattgccgaggtagtagaaaacactgttatccgtgaacttgtagaaaagaaaggaaagccaatctatcctaatgttgatttctattctggagtcatttacaaatatatggatattccccctcaacttgcaacatcaatcttcgcaatcggcagggtctcaggctggatagctcactgctttgaccagtacgagaagaaaaagatcataaggcccaga

SEQ ID NO: 34953 - DNA, 3182 bp, Methanosarcina mazei
  unsure (1)..(3182): unsure at all n locations
gtgaagctcaaaaacctgcatattgaaaacatccggagctataaaaaactggattttacatttgaagacggagttacagtcatttccggggtgaacgggagcgggaaatcaagcctgcttgaagcatgttttatgggacttttcgggagcaaaattctttcaaaggactttgtgcttgcagatgtaatcttcaagggggccgaaaacgcaaaaataaacctgggttttgagcatttagggcaggattaccttatagaacaggctttcaggtattcttctaaaagtgaaaacgcttcgaattcgaaatgcgtgctctatgccaatggggaaagtattgttgatcaggctacacggacttacgaagaggtctgctctcttctgaacatggacgaagaggcgtacagaaactgtgcttacatcaggcagggcgaaattgacgtactcattaatgcaaaaccaaaagacaggcagcggatgatcgacggcttgctgcagcttggaaagctcgaagaatacagggaaagagcaggaagcgcaaaaacggctgtaagaaggcttcaaagggacaccagtaacagcctttcgggtgtaaaagccgaaattgaggggatcgaaagtacagaaccgcatgccgttttgaatgggctcaggcagaagataaaggaaagcgatactatcttaaaaaaatgtaatgaaaataaagaggctgcagctgcccagaaagaaaaactcgaccttatgattacagaacacagggaacgtctccaggaaatccagactctgaaacaggccctgtctaaatctcaggaagacaaggcaggctgtatccgggaaaaagaagcctttgccagagaagcccatgaacaaaggcaggctctgcttggactagaggaagagaataatcatattcggggagaatgcggctttggagaccttgagattgaggctttgagcttgcagaaggaaaaagaggagtttcttgccagggaaaaggtaaatgtaatctcaaaagaacttgctcttcttctcagggaagaagaagttcacactcaggatctgcgcgactttgaaaacgaaaaggctgagaccgaacagagtttgatgcagtgcagggcggatatcggggctacaaacggggaaattgaaggaaacagaaaaaatatactgagaattgaggatgagaataaaaagctaaaagaagctgcaaaagagaccacaggcttcacggacacttatgaaattcctttgtttataaatgagctggaagaaaaagaaagccttcttcgtgaacggaaaaacgaagcctcaacaaaacttgcacttgctttcaaagaaaaagaaaccggagacataaatctcctcacacttgataaggaacttcaaaataccaaagtcgcagttcgaaaaagtaaaaccgaaattgaaattcttgaagaggagctcagggaaaatgaaaaggcagttctggaagttaaggagcaaaaatccgaagcttctgcagggttaaaaggacttggctttaccggagagcagctcgaggacctggaatacctcagcgaacttctgctggaaaacaaaaacaggctgcatgggcgagaaaaagagcttgaagctaccctcagggagcttgataaagttatccgtaaaaaccggcagctacttgccgaaggaaaatgccctacatgcgggcaggatcttaaaggctctgaaattgcatgcacaaccggggaatccgaacagaagagagaaaaacttgcagcagaacttctcgatataaagctccagcaagccgaagtcgagaaaaaacttaatcgactcaaggacgcaaaaaaactggagaagcggatttcggattacgacctggaaaccgaaagactcaaaaataaggcaaaagacctgcaagaaaggataacgatccacaaacccgaaccgaggaagattcccttaaacttgaaggccttaataaacanaaggaagaacttgaggctaagatgggcaagcttcttcctgatattaaagccctgcagggatgggaagcggcagctcaaaaagctcatggtgagagtgaaagagtacttcaagaggcaaaagcctttgagaaaaagcttgccgaaaacacctcggaaatagaaagcctgaacgggaaaatcaggacttccctggcactgatcgaaaattacgggcagaggcttggagagctcaatgagaaactaaaagggcttgccgaacgagagactcaggaaaaggaaaaactcaaaacctggaagttgagcttgaagccctgaggaaaaaagaagcccctggcaaaagaaacccatgacgagagttcaaagcatctcttgaagacaaaaaaactcggggcaaacctgatccagatggataatataaagcacaaaatctccgagcttgaggcttcaatcaggaaccttgccgaaaaagtcggcttttttgaccgggaaatccttgaaagaaacgagcgggtaaaacagcttgaaggaaaacttcagggaagcagattcgaagatcttcagtcaaagcgtacccagcttgaagagtatcaggcaaaccttactgaaaaaacccggcaaaccacggccgccaaagatgctctcttaaaagaagttggtatggttgagaatagtttaaaacgccgcaatgagctgaaggatgaactcaaagcccttgagaacaggaagcagtaccttgaagccgtatatagcaatgccgaggagcttgagagcatgtatatgcgcgttcgggcggatatgcggaatagaaacataggggctctttctacccttttgaatgaaatgttcagcttcatgtacacaaataatgcgtattcccatatcgaactcgacccggaatataaccttacggtttacagaaaagacggcactccacttgaaccaaaactccttagcggaggagaacgtgcaatctttaaccttgtcctgcgctgtgcgatctacagacttcttgctctgggttttggcggagatagggcagacgggcttccccctatgatccttgacgagcctacagttttcctggaccgcgggcatataaaccagcttttgaaactcatagacatgatgcgtggcataggcgtaggccagattattgtggtctcccatgacgagtcccttatagattcggcagaccatgtcttccaggtagaa

SEQ ID NO: 34954 - DNA, 840 bp, Methanosarcina mazei
ttgaagattataggtggaccagcatcacaattacttgccagccgcactgcccgggctttagggatagagcctgtactttccgagtttaatcgatttcctgatggggaactttatctccgaatcgcagaagagaccgaaaacgagcatgtgacccttattcagagtacgcccactgattctgatctcgtttctctgctccagcttattgatgcttgtgaaggagcaaaagagctcgatgtcgtgattccttacatgggatatgccagacaggacaagaagttcaagcccggagagccaatcagtgcccgcgcaattgcccgctgtatcagggctgaccgcgtttttacgataaacatccacgaaaaaagtgtgcttgaacatttccatggccctgcggaaaatcttgacgcagctaaacttgtcggggagtatattgcaggtcttaacctggaaaacccacttctgcttgctccggattcgggggctgaagggcttataaagcacgtctcatcaggcctgggctttgattatgatcacctggagaaaacgagactcagcggggatacggttgtaatcaagacaaagaatctcgatgtaacaggcagaaatgttgtccttgtagacgatatgattgcaacaggtgggacaatggcagaatctatcaaaatgctcagatcccagggagcagcagatgtttacattgcttgtgtacatcctgtacttgcaaggaacgccgttttaaggctctttaatgcgggtgtaaaggacattcttgggaccgacactcttgaaagagcagagagcagactgagcgttgctccccttattgcagatgccatt

SEQ ID NO: 34955 - DNA, 1308 bp, Methanosarcina mazei
gaaatctcaagtatggttatatcccataagaaagcaaaaattgaggaaatggagtccgcctggcacggagatctggacggtctgctccataacttgtataatcatgaatatattcatgaatgcgttgtcttaaaaacctgcaaccgtgtcgaaatttatgttgtttcccccagtagcagtatacttttctcttttgcaaaggaaatgggagcttccacccatattattgacttctatgggcatgatgaatctcttgaacacctgctcaggcttgccggcgggcttgaatctatgattgttggggaagaccagattttagggcagataaaagaactctacgcttattctaaaaaagcaggaacgaccggaaaaatccttgacactgcctttgataaagctattcaggtaggaaaacgtatccgcaacgaaacccggatcaataaaggttcggtgtccataggttctgcagctgtggatcttgcagaggaaattctggatggactcgcaggaaaatccgtgctcgtgataggagcaggggagataggagtccttgtagcaaaggccctagctgcaaaggatatcgaggcaatctacattgctaatcgtaccttcaaaaaagccgaagaacttgcctatgaacttggagggtacgcagtcaagcttaatgatgtccagactcaacttaaaaacgctgatgttgtaattagtggtacaggtgctcctcattacattttaacccgggaaatagttgaaaaagccatagaagaacgagataaaacccgtaaactcctcttaattgatatagcaaatcccagggatatcgaggaatcagttgctgaactcgataatgtgaaactgtgcaatattgacaatctcagagtgatcagtgagaaaacgcttaaaatgaggaaagaagaagctaaaaaagccgaagctataattcaggaagagatcaagcttttaaacctccagtacaaacgccagagagccgataaaattatttccgatctttacaagcaaatatacgatgtgagaataagggagagggaaaaagccgttaacaggctctgtgcttaccatactatagggaaaatcgaaaccgatgtgcttgatgaccttactcattctatcgcaaacaaaattcttgccgagcctaccaaagttctccgccaggccgcagagctcggaaacgacgagttccttgatgtagctgcaaggatcttctgcctcgaaaaagacaaggtaaaggcagaaaaaataaaatccgactgcggaataaaagtggaaaaaatgaaacccgattgcgag

SEQ ID NO: 34956 - DNA, 966 bp, Methanosarcina mazei
tttccagatgtcaggttaagacgattgagaaaaggaaagatcaggaaccttgtgcgtgaaactaccttatccgtagacgacctggtccagcccatttttgtgaatgagactattgattctgctgttgaaattccttccatgcccggaatatacaatattcctctctctgaggttgtaaatgaggcaaaagagattgcagaactcgggattccggcagtgatcattttcggagtgcctgcattcaaagacgcagaaggcagttctgcatatggggaaaccgatgttgtccaggaggctgtcaggagaattaaggccgagcttggagacgaacttgtggtgatcacggacgtctgcatgtgtgaatacacaagccatggacactgcggaattgttgatttcgaaacgaaagaaatcctgaatgaccccaccattgaggtcatcggaaagattgcagtgagccatgcaaaggcaggagctgatatggtagctccgtcgtgtatgatggatggaatggtagaagccatcagacaagcgcttgatatgaacggatttgagaatattccgatcatgtcctatgccgcaaaatatcattcgtgtttctatgggcctttcagagaagccgctgagtcaggatattccttcggagaccgttctacctatcaaatggatcccgcaaacagcgacgaggctatcagggaagtaactcttgatgtggctgaaggcgcagatataattattgtaaagccagctcttccttaccttgatattatctacagggtcaagacggattatgggatgccaactgctgcatacaacgtaagcggagaatattccatgatcaaagccgccgcagctaacggctggcttgacgaaaagaaagcaatttacgaatccctcatctctatcaaaagggcaggagccgatattatcattacttactttgcaaaagatgctgcccgcatgttg

SEQ ID NO: 34957 - DNA, 1254 bp, Methanosarcina mazei
cttgagaaatccagacaaatgtatgagaaagcaaagacccttattccaggtggggtaagcagccctgtacgcgcaataaaaccctatccgttctatacggcatcagctaatggttcaaaaataaaggatcttgacgggaacgaatacatcgattactgcctggcttatggccctgctctcctcgggcacaatcaccctgtgataaaagaagctattaaagcccagctcgacaaaggctggctctacgggacccctaccgagcttgaagtaaaccttgccgagaaaattgcagggtattatcccagtatcgatatgctccgcttcgtgtctacgggaactgaatccacgatgagtgcccttcgacttgcccgcggctttacgggcagaaacaaattcattaaaattgaaggcggatttcatggagctcatgatgcggtgctggtaaaagcaggttcaggagctacaactctcggagaacccgattctctgggaatacctgcagatttcacaaaatacactttgcaagctccgtataacgatatcgaagcaatgacagggcttgtggagaaaaacagagatgagctggctgcagttatcatagagccagtgcttggaaacataggtccgataactcccctgcccggatacttggaagaactcagaaagcttaccctggaaaacgacgtgcttcttatattcgatgaggttatcaccggattcaggctcgcaatgggaggagcacaggaatacttcgggatcgtgcctgatatgaccacccttggaaagatcgtgggtgggggactgcctataggagtttttggaggaaagcgtgaaatcatggaaatgatctcaccatccggcccggtttaccaggcaggaactttcagcggaagcccgtgttccatagcggcgggaattgcagtgcttgactatctggaacaggaaaagatccacgaaaaagttaattcgaaaggcgattacatacgggctgtacttacagaaattgttgaggacgaagggattgattacagtgtatgcggaattgcttcaatgttcaagattttctttggagccgaacctcacaactatcaggaagccctgaagtgcgataaggagggttaccttgctttcttccacaggatgcttgcaagcggaattttcctccctccctcgcagtttgaaaccaactttgtctccgcagcccatagtgaagaggacatcgaaaaaacccttaaagcatacaccgaaaatctt

SEQ ID NO: 34958 - DNA, 864 bp, Methanosarcina mazei
atgattataggtacgcggggcagccagcttgcacttgcccaggccgagactgttgcacgccttttgaaagcaaagggcgttgaaaccagcttgaaaattataaaaaccagcggagaccggtttactgaccggcctttacacgcagtatcaagcggagttggggcttttgtcagggaactggacgaagttatgcttgaaggaaaaatagatatcgctgtccattccatgaaggatatgccaacgattcgcccaccaacacttccaaccgtagccgttctgaagcgggacaccccatttgatctactgttgacttatgacgggacccccctggacgagctgtccgaacaatccattataggcaccagttcacttcggagagctgcccagatcaaacgctacaggcctgaccttgttacacaggatttaaggggcaatattgatacaaggctgaggaagctgaaggaaggaaaatatgacgggatcctgctcgctaaagcggggcttgaacgcatgggctgggaacttgaaggagaaattctttctcctgatttcttctgtccctctcccaatcagggtacgattgcagttgtcacaagagcagaaactgaggctgaagctgcggtttccagactcgaccatactgacagcaggattgcaaccgaaattgagcgaatcctgatttccgaacttggaggaggctgcaccacgcctataggttcttatgccgaaattatgcctgaccggaaaaaactccatgtgcgggctgaggtcctttcccttgacggtgaggaaactgttggtataaatgaatttatccctatggcaggaggtattgaaaaagccagggaactagggagcagtctt

SEQ ID NO: 34959 - DNA, 1686 bp, Methanosarcina mazei
aagacaattgaaaaatacgcctatcaaaatgctgtaaaatatgggaaagccccccaacctaaagctgtaatgggaaaagtaatgggggagtgccctcaactcagatccgatccaaatgccgtatctgaagctcttaaagttattattcccgagattgcaaagggaaatcctgaaacctgggagacaaagctttcggaaattgcccctgagcttattgaagctcttagtgtaaaaaaagaaccagataagggtttaaaacctctagaaggggcagaaaatggcaaggttgtaatgcgttttgccccgaatccaaacgggcctgcaacccttggcagtgcaagaggcatggtagttaattccgaatatgtgaaaatgtacggaggaaaatttgtcctgcgtttcgatgataccgatcctgatataaaacgacctctgcttcaagcttatgactggtatcttgatgacttcaaatggctcggggttgtgcctgaccaggttgtctatgcttctgaccatttccctatgtattacgattatgcaagaaaacttatcgagatgggaaaggcttatgtctgcttctgtaaaggaggagatttcaagcggtttaaggatgcaaagcagtcctgcccgcacagagataccagccccgaagaaaaccttatgcactgggagaagatgcttgccggagaatatgaagaccagcaggcagtgctgaggatcaagaccgatataaagcacaaggaccctgcattgagggactggggagcattcaggataagaaagatgtcgcatccccgccctgaaattgggaacaagtacgttgtctggccgcttcttgattttgcaggggctatcgaagaccacgaactgggaatgactcatatcatccggggcaaagatcttatagacagcgaaaagcggcagggttatatctacaaatacttcggctggaaatacccgagaacaactaactggggcagggtcaagatccacgaatttggaaagttcagcacgagtaccctgagaaaagctattgaagcaggggaatacagcggctgggatgacccgaggcttccaacaatccgggcaatccggcgtcgtggaatccaggctgaagctctcaagaagttcatgatagagatgggagtcggaatgactgacgtaagcataagcatggagtctctctacgccgaaaaccgcaaaatcgtggaccctattgcaaatcgctatttctttgtctggaatcctgtagaactggaaattacagatgctgagccgacagttgctaagcttcctcttcaccctactgaccataaaagaggattcagggaaattgctgtaggaaataaagtacttgtctgcacggaggatgtcgaaaagctggaagttggctctattatccgcttaaaagatttctgcaatatagagattacttccctttccccacttcaggcaaagctctcagatgtttctcttgaagcccttaaaaaagcaaaggcaaaaatcatccactgggccccgcttgacggaataaacgtgaaagtacgcggtcctgaaggtgatcttaacggtatcggtgagcaggggattgcagccgaacttgacaaaatcgtgcagttcgagcgcttcggtttctgcaggattgatgccgtaagcgaagacgaaattgtggcttactttgcccac

SEQ ID NO: 34960 - DNA, 990 bp, Methanosarcina mazei
atcgcagtaaatggttacggaacgataggaaagagagttgcagacgccgtaagggctcaggacgatatggaagttatcggaatttctaaaacaaagccgaactatgaagctgcagtggctcaccagataggatatgacatatatgccccagctgcaaatctcgaagcttttgagaaggcaggaatgcccgcagccggcacaattgaagaaatggttgaaaaggctgacctggttgtagattgcacacccggaggaatcggtgaaaaaaataagcctatgtatgaaaaggccggggtaaaagcaatctggcagggcggcgaagatcattcacttgcaggtttttcatttaatgcgatttgcaattacgagcaggctgtgggccgtgatctggtaagggttgtctcatgcaacactacagcactttgtagagctatttacccgatagacaaagaattgggggtaaaaaaggccagggtagttcttgcaaggcgggcaaccgatcctaacgatgtaaagaaaggaccaattaatgcaatcgtacccgacccaatcaagcttccgtctcaccacgggcctgatgtaaaaagtgtgcttccacagattaatattacaagtgcagccctgaagatcccgacaaccctgatgcacgtacacaccgtgaatatggaagttgagaaggattgcactgtagatgatgttaaaaacatctttggttcccagccaagaatccgcttcgtggggcagggtatgtcgtctacagcggaaattatggaatttgccagggatatgaagcgccccagaaacgatatgtgggagaactgcatctggcctgaatcaataactgtaggggataaggagctttatttcttccaggctgtacatcaagaatcgattgtcgttccggaaaacgtggacgctataagggccatgatggaatttgaaagcgacggtgcaaagtcaattgaaaagacaaataaggctattggcctg

SEQ ID NO: 34961 - DNA, 1143 bp, Methanosarcina mazei
gacgcggatattatagtaataggggcatctcctgcaggactgatggctgcaaggaacgcctgtgagaaaggggcggcggtccttttgctggaaaagaaagaagagatagggcatcctccccatcctgcaaactctttttttaaggggatgcttgataaatgcggagaaaaggtggacccttcttatgttctgcattatcttaaaggcatgaagattatttccccgtcaggaaggacagtcgaagttgaggctactggatatgccattgataaaactgctttcgacagattttatgcaaagaaaataatgaaaaccggcgtagatcttcgaacaggggtgaaagtacaggatatccagaaagaaggagataaatttactgtcaacacctctgccggagtatttacctcaaaactggttattatctctgacggtattaattcaaaaatggcatcccttgtgggcttgaagacaatgaaacatcctgaagatattgcctggggaattgaactggatattaaaagtcctggacttgggaaaccagagatgtttgagtattatgtagggaatcatgctccgggctggaaaactacatactctccaagaggaggtgacaatgccgcaatcggagcctatgtgcgccggtgcggaactgatgcaacgccttaccttaacgcctgggttgaaaatttcaaaaagcttaaagggctcgaagagcttgaagttgtaagaaaactgtccggaggagaccctatcgtgacaattccaggcgaatacataaccgatgggataatggttgttggtggggcagcaggtcagtcgggaataggatatgcaatgagggcgggccagatatgtggagatgtcgctgcagacgccataaacaaaggagatgtctcaaaatctactctcctggcttaccggaagacctgggaaaaggaatttctggccgaacactacctgggccgaatagggcttgagactctcaggaaaatgacggatagggaaattgatgagatgaccaaggtctttgaaaaagaggacctctcgtttattcatggaagttcagttgagcaggctatgcgggtttttgcgttcatgctaaagaaaaaaccctctgcgatcttaaagttcagagcactcttc

SEQ ID NO: 34962 - DNA, 1626 bp, Methanosarcina mazei
agcttggcagcacaaccgatctttattttaagggaaggcagcaagagaacccatggttccgatgcccagcacaacaatattatggccgcaaaggcggttgctgaagcggtaagaaccactcttgggcccaagggtatggacaagatgcttgtagactccatgggtgatgttgttatcaccaacgacggagcaacaatcctcaaagaaatggacatcgagcacccaggtgcaaagatgatcgtagaagtagctaagacccaggatgccgaagttggagacggaacaaccaccgcagccgtacttgcaggagaattcctgacaaaggcagaagacctgcttgaaagcggagtccacccaacagtgattgcaagcggctacaggcttgcagcagaccaggctacaaagacaatcgataccattactatcagtgcatctcctgaggataccgagactctcgaaaagattgcagccacagccataacaggaaaaggcgcagaggctcaaaaggaacatctctccaggcttgcagtcaaggccgttaagtcagttgctgagatcagcgaagatggaaagatcactgtagatatcgaggacatcaaggtggagaagagacctggcggaagtatcaaggattccgagattgtcgacggtgtaattgtcgataaagaacgtgtccacccggcaatgcccgaagtagtggagaacgcaaaaatcctgctcttaagcgtaccaatcgagctcaagaaaaccgaaactaaggccgaaataaagatcaccaatcctgaccagatgcagctcttcttagaccaggaagaagcaatgctcaaggaaattgtggacaaggtaatcaagacaggcgcaaatgttgtcttctgccagaaaggaatcgatgaccttgctcagtattacatgacaaaagcaggaatctttggtatgcgcagggtgaagaagagcgacatggataaactttcccgcgcaacaggtgcaaagattattaccagcctcgatgaaattgaggaatccgaccttggccatgccgggcttgtagaggaaaaagacgttacaggctcaaggatgaccttcgttacaggctgcaaggacagcaaagctacctcaattcttctgcgcggcggaaccgagcatgtagttgaaggaattgagagagctctcgaagacgctctcagagtagtgggcgttgctcttgaagaccagaagattgttgtgggtggcggctctccagaaattgaactgtccctcaggctcaaggaatacgcagcaacccttaaaggcagggagcagcttgctgtaatgaaattcgctgagtccctcgagattattcccagcaccctcgcagagaatgcaggacttgacccgattgacatgcttgtggaaatgcgctcccagcacgagaaaggcaacaagcgtgccggactcaatgtttataccggcaagatcgaggacatgtttgaaaataacgttgtcgaacctctcaggatcaagacccaggcaatcaatgcagccaccgaagctgcaattatggttctcagaatcgatgatgtaattgcctcatccagtccagccaaagtaggtggtccgggagcaattccaggcggcgaaatgcctgag

SEQ ID NO: 34963 - DNA, 537 bp, Methanosarcina mazei
cttaaaacctcactcattaattctcctgtgatcaagcgaggagaatataactactttatccatccgatatctgatggtgtaccgtccatagacccccatatggttgaagagatcgccgaatatattcttcagattaccgacatcaaaaaagttgatactattcttactatagaggcaatgggtattcctgtagcaaatgccctttctctgaaaacgggaattcctttgaccattgttcgaaagcggccttattttcttgaaggagaagtggaactttctcagagaacagggtactcgaaaggagctctttatataaacgggctcaagaaaggggacagagtaatcattgtagacgacgtcattagtactggcggaacgctgatagcactcgtaaaagccctgaaaactataggtgtagagattcaggatgtaatttcagttatcggtcgaggaacaggttatttgcaattaaaggagctcggggttgagcccaaaattctcgttactatcgacgtgagcgagaaaggtgtggagatc

SEQ ID NO: 34964 - DNA, 1221 bp, Methanosarcina mazei
attcaggaaataataaaaaagtatcccacgccgtttcatatatacgatgagaaagccattctggaaaatgcggagaaaatgaaagcagttttcagggaggttccgggttttaaagaattttttgctgtgaaagcccttccaaacccctttattcttaaaatcctgagagaaaagggctttggtgcggattgcagttctttaccggagttaattcttgctgaaaaagcaggaattaccggagaagacataatgtttagctcaaacgatactcctgctgaagagttcttaaaggcaaaagagcttggagcatacataaatcttgatgacataagccatattgactaccttgagaaatatgccggacttcctgatattgtctgtttcaggtacaatcctggccctcttaaagagggaaatgccattataggaaggcctgaagaagcaaagtacggctttacgagagaccagctttttgaaggctaccgcatactcagggatagaggagtaaagcgtttcggaatgcacacgatggtggcctcgaatgaactaaaagctgattactttgtggaaaccgcaagaattctcttcgaacttatagttgaaatctcaaaagaactcaacataaagttcgaatttgtgaacctcggcggaggcataggcatcccctataggcctgaagaagaacctgtttccttcgaagccgtggcaaaaggtgtcaaagaagcttacgaagccacaatcacagctagcgggctttatccacttaaagtgtttctggaatgcggccgtgtaattacaggcccctatggttacctgattacccaggttcggcacctcaaacacacctacaaagactatgtaggaatggactcctgtatggccaacttgatgcggcctggcatttacggagcctatcaccatataacagtgctcggaaaggaaaatgaggctcctgtccataagtatgatgtcaccggctccctatgcgaaaataatgacaaattcgcaatcgacaggcatcttccagaaattgagataggagatatccttgcaatccacgacacaggtgctcacggtcactctatgggtttcaattacaacggaaaactccgttctgccgaactccttctcagaaaagacggaagcgttgtgcagatcaggagagccgagactattgaagattactttgcaaccctggatttcgaagccctgaaagatttc

SEQ ID NO: 34965 - DNA, 1719 bp, Methanosarcina mazei
atggctcgattcatagagcttgcggagctttttgaagaacttgaaaaaataacatcccataaggaaatcgtcaggagaattgctaattttttatagggattggaaagaaaggaaataaaggacagtgcatacctttttctcgggagcataggacctgcctttgagaatataacactgggaataggagataagctcgctttaaaagctattgccggagcatacagagtttccgaagaggaggttaaaaaaagatattcaaggacaggggaccttggggatgtggcgtttgagttaaaccaaggagaagaaaagtctctggcaatcgatgaagtgtttgggagcctaaaagagataaaagaagcctcaggaaaaggaagtcaggaggaaaaaaccgggctgctttccagcatcctgcagcgagctagccccaaagaaggaaaatatatagtcaggattgtacttgggaaacttaggcttggttttggggaccagtttctacttgaagcattttctattgcttttacaggagacaaaaaatatgtcgtcaagatcaaagaaagctacagcgtctgtaccgacatcggagagcttgcagaatcccttgcagaacaaggtccaaaagctcttgggcacttttccataaaactcggccggcctgtcaggtcaatgcttgcgcagcgcgtgaaaacttttgaagagcttgaagaaagaatccccggaaaaaaagcagcagaagaaaaatatgatggggagagagtgcagatccataaaaacggagaagagatcaaagctttttctcgaaggcttgaagatataactgcccagtatcccgatgttatagaagcagtcaggaaaggcattcttgcgaagaaaatcgtgcttgatggggaaattattgcatacgttgaaggcgggaaagcaaacgattcaactggagaattttattcattccagagactaatgaagaggcgcagaaagtatgaggtccaaaaatatactgaaatttgccctgttgccgtattcttttttgatattctgtacctggaaggaaattcgctcctgaagaaaccttacccggaaagacgggctatccttgaggaacatgtaaaggaatcagaaattcttcaccttgctagaagaattgttacggataatcttgaagagatcgaggactttttcaacgaggctctggaaaagaggcttgaaggaattataatcaaatccatgggtcggaactcagcttacgaagccggaaaaaggagctggttctggctcaaatggaaagaagaatatgccagcgggatgagggagacctttgaccttgcaattatagggaaatattacgggcgaggaaaaagaaaaggttcatttggagcactcctctgtgcaattcttaatggagaggaacagcgttttgaaacttttacaaaagtcgggaccgggttcacagaagcggacgctaaagaaatcgacagcctgctttcagagcatattatttctgaagtccctaaaaatgtactcataaaaagtagaatgcttccggatatctttgtagagccttctctggttattgaagtccttggttcggagattactgaaagcccgagtcacactgccggacagggagaaggagataccgggcttgctctgcgttttcctcgctttttacgcataaggcatgataaaggaccttatgatattactacacttacagaagtc

SEQ ID NO: 34966 - DNA, 1596 bp, Methanosarcina mazei
ttggttcagatggaaaaaggtggccagccaatcataataatagatcctaaaaaagaagagacaaagggaaaagaagcgctcagcatgaacatcgcggctgcaaaggcagtggccagtatagtcaaaagcacgcttggaccgaggggaatggacaagatgcttgtcaatcctatcggggatatcacaatcacaaatgacggtgcaaccattttacatgatatgtccattgagcacccagcagccaagatggtggccgaagttgcagagtcacttgaaagctcggctggggacgggactacaagtgctgtcgtattcacaggcaatctgctggaaaaagcagaagaccttattgagagtggagtccacccgacagttgttgtcaaggggtacaggcttgcagccgagaaggctgttgaaattttagagagcctggcaatctcaactgccgagaatgaaaaggagaagcttttagaagttgccaaaacctctattacgggcaaagcttctgaaaagtacggtcgtttgattgcggagctctgcgtggatgctgcgctctcaattcgtgaaaggggagtagttgaccttaaagacgttattctttcaaaagatgtcggcggcaagatagaagataccgaatttgttgaaggcattgtaatagacaaggtcgctctggataaagaattccctctcagaattgagaaccctgcaattgctttgattgatgcccctatggagatcgctaagaccgcaaacaaagcaaaacttcagataaacgcatatggtgatcttgaggattttgtaaaacaggaagaagaagccttattcgaaatggcagactatatcatcagagcaggggcaaatgcggttttctgttccaaaggcatggatgacaagattgcagcctacctgcaaaaccggggaatttatgcaacccgcagggttaagaacgaagacatgcagcaccttgtagacgccacaggcggcaggcctatccgcaatatcaaagaactgacccagaaagaactcgggcacgccgggcttcttgaacaggaccgggacggcgaccagggcaagacctatctcagagagtgtaagggtgcaaaatccgtatccattgtcatcaagggcggtacagaacacatagttgacaaccttgaacgcgcaattgacgatgccctcagggtagtaaaatgtgccatagaagacggcaggatagttgcaggtggcggggcttctgaggttgaagtcgcacttgagcttcgggcatatgctcccggtataggtgggcgtgaacagatggcaatcagggcttttgcagatgctctcgaagaaatcccgaggacaattgccagaaacgcaggtctggacgctatcaacacaatagtgaacctcagggccaaagcataccgaaaacaaacgcaggcctgaacgtcaataccgggtgctgctgaagatatgctcaaaaaaggcattgttgatcctctcagggttaaggtcaactctgtcaaagccggttctgaagccgcagtgatggtgcttcgtgtggatgatatgcttcgcgcacagcgcgccgacatgcaggacgtaaaacccgag

SEQ ID NO: 34967 - DNA, 1014 bp, Methanosarcina mazei
gtgtacataagtgacagcactattcgtgatggttctcagatgccgggaatcgtcctgagcagagaacacaagcttcaaatatatgagtacctgcacgagatcggaatcgaaaaactcgaggccttcgtattcaataagagggatagagatgcggtagatttaatgtttgatatagggtatgagtttcccgaaatcacaggctgggcaagagcgtcaagagccgatattgacaaaattctcgaagttgatgggctggaagaaaccggaattctgatgtctgtatcggatacgcatattttttctaagatgaaactctcaggcagggaggaagccgaagagaaatatctggatgcccttcagtatgcagtcgaccacggacttcgcacacgtgctcatctcgaggatatgacaagagcagacaattatggctttgttttcccgctagttgaaaaaattatcgaaatcgaccctgattgtattatccgggtctgtgatactgtcggatacgggatgcccttcgttagtgtcgatgagccttatggaatcccgagaattgtacagtacctcaaaaaagaaatcggggcaaaaaatatcgaaacccatattcatgacgattacggattcgggtcagcaagttccattgcaggtttctggcacggggctaactggacaagcgtaactttcctgggtataggagaacgtgcaggaaacagcgaaatggaaaaaatcctgctattcctgagagatagggtagaaggttttgaaaaatataaccttgaaccagttactcgctttgcaagattcatggaaaaagaactgggactgcgggttcccagaaacaaagccgtggtcgggaaaaatatttttgcccacgaatctggaatacatgctgccggtgtccttaaaaatccctttaactatgaaccctatcctccagaactggtaggaggaaagcggctcctgcttataggtgactcttcaggtctggaagttatccgttataaaattcaagag

SEQ ID NO: 34968 - DNA, 1005 bp, Methanosarcina mazei
agtaaaaccgcagcagtaatcaaaggtgacggggtaggccccgagcttgtagatgcaatgcttaaagtaacagaagccgccggcacagacgttgaatttgttatgtgcgaagcaggagccggctggtgggaaaagcatggaggcaattcccttattccgaatgagacctgggacgtccttgacagttcagatgcctgttttaaagggccgacaaccacaccaggagggataggctctccaagaagtgtggctgtatctataaggagtaagtataatctttatgcaaatgtcagaccaatcaaaacttttcccaattcaagcgcccctcttggagatgtagaaatgatttgtgtgcgcgagggcacagaaggcctttacattggagaggaaattcagcttacagatgacgtttcaattgcaatccgtaaaatcacacgcaccgcatcccacaagattgccagctatgctttcgaggaagcaaagagaagaggctatgacgctgttgtgcccatccataagagcaatattctgaaacttacctgcggctctttcttagaggaggtagaaaaggtcgggcagaattatccagatatcgaaatctggccctatcacattgacaacattgcccagcaactgataaagaacccgcagatatttaataaaaaggttcttctttctacaaacctctttatggacgtaatcagcgaggaatgctcggccctggtaggcagtattggtctaatctactctgccaatatcggggattcttttgcaatgtttgaacctgctcacgggtcagctccaaaatatgcaggccaagacaaggttaaccctgtggcaactgtacttgcaggagcatggatgcttgattaccttgacgaaaaggaaaaatccgaagcaatatttaaagctacaaaacgcgtgatttccgaaggtaagtatgtaacttacgatctcggaggcaatgcaaaactcagtcagatggctggcgagattgcaaagtat

SEQ ID NO: 34969 - DNA, 1128 bp, Methanosarcina mazei
gaaagcgtccaggaccgaatgaggcaacttgaaagccgaaacagttatctggaagagcagtgcagccagattgaatccgaaaaacgttatctagaaaaccaaaagataaagtacgaacgagagatacgaaagctgcagtctgaactcgatcggatgaagacctctccgctcattattggtacggtcattgatgtaattaagaatgatagaataattgtccgaagcagtaacggacctcagtttctggttaatgtctcacaatatattgatgagaaaaaactgcttccaggagcaaaggttgccctgaaccagcatacgcttgctattgccgaggttattccttctacggaagaaccttttgttgctgcaatggaagtcctcgaaagcgtagaagtggactatgaccagatcggcggtctcgatgagcaaatacaggaacttcaggaagctgtcgaacttcctctcattgagccggaacgctttgctcggataggtatcgatcctcctaagggagttcttctttatggacttccgggaacaggtaaaacactgcttgcaaaagccgtggctcacagaaccaatgcaacttttatcagagttgtaggctctgagctcgtgcaaaagtacattggggacggttccaaactcgtaagagaaatcttcgaaatggcccggaaaaaggccccgagtattattttcattgatgagctggactcaattgctgcaaggcgtttgaatgaaactactggagcagaccgtgaggttcagaggacgcttatgcagctgctggcagagatggatggctttgacaaaagaaaaaatatcaggattattgcagcaacaaaccgtcctgatgtccttgacccggcaattctcaggccaggtcgatttgacaggcttgtccatgtccctatgcccggagtagaggccagaggaaagattctcaaaatccactgtgggaaaatgactcttgcaggagatattgattttaagaggcttgcaaaagctaccgaaggaatgagtggagcagacctgaaggcaatcgccaccgaagcaggtatgtttgcggtcaggaaaaacaaagaactgattgaaatggaagatttcctcgaagcagtggataaagtc

SEQ ID NO: 34970 - DNA, 1932 bp, Methanosarcina mazei
atgagtagacctaaacagatgacaagggccgttattgtcgggcacaaaagcattctaaaagaaaccatcgatgcactacatgatacaaatctttttcacgtcgaagactttgttgaagacgagtctggttttaagatcagcaagccattcaaaaacgcagaagaagtctctaaaaagcttgtgaagatccgatctatcgccaattatttggggattgaaagcaaaaaaccggtagttcagaaatctgacgctgttctgcgtgaacttgactctaagttaaatgaactggacaggacaatttcagctaaaacggaatcaatttctcagcttgaaaatgaattaaaagacatggattctcagaaaagggaagtcctgccttatctgtccatcgatcttgacttcgattatttccgtggctacgaaagcctcaaggttttcgcaggcactttaaaaaataacctggaagcaagtcagatttctagtatcacccaagcttacgaactgtactttgatcctcaatcaaaagcagttgtactgtttgtagctaataatgatgccgacaaagtttacgaattacttcagggtcttggattcaaagagcttagagttccggaaagaggtggtgttccaagcgaacttttaagatccattgaacagaaagaagccgacgtcaccagaaggatcgaatccttaaagggtgagatcgagtccttgaaaacaaagtacgccgattttatccttgcaagcgacgaagtcctgagtatcgagagtcagaaagcagagctgcctcttagaatagctacatctgaaaatgcattcataattgatggatggacccccaccgaaagttatgacaggcttgtcagtgtagttaacaacgccactaacggcaaggcatacattaccagcctcgaagttcgcgaggaggaagaagaagatgcccccgtcgagtataataactcaaaatcagtggcaccgatgcagcagattatggatctgtattcaagacctaaatattttgaaattgatccatcttcagcgattttcattaccttcccgctgatctatggaatgattctcggagacatcggatatgcactgatattgggatcaattgcactggctattaaaaaggcaataaagtcagatgcagtatctgatatgatgaatattcttatttattgtcagatttggacgattttctttggacttatttatggtgagtttctgggattccctctggcgagtacgcatgaagaacaaggtttactcccgttctggcatacagtaaccctgttccattcaattggaggagaggaatttactttcccaattcacagggctcacatggtaatgagtatgattgtactaagcgtcgtcgtcggactgattcacttaaatctcgggtacctgttcggattttcaaatattgcaagggaacacgggatgaaacacgctcttcttgaaaaaggcagttggatgattattgagcttggtgtacttattgcagctgttggttattttggcggttcagcattgatgtatgtcggtgctgttgttcttgttcttggaattgtgatgctcgccatgggtgagggtatcgctggtatagtcgaactgccatctcttatgggtaacgctctttcgtatgcccgtattattgcagtcggtttatcttcgatttatatcgcaagtacagtcaatgacatcgcttttggaatggtctggcctgatcattctaagatcggtttcgcggcaatagctgcaattatcgtatttatactcggacacgctcttaacaccgttctgagtatcatcgctcccggactacatgcactcaggttgcagtacgtagaattctttggaaaattctatgaaggcgggggcagaaaattcaacccattcggatatataagaaaatacacggaggaa

SEQ ID NO: 34971 - DNA, 549 bp, Methanosarcina mazei
atgggactagagattgttgtaaaagacatccaagagggtgcaagtgctgaggtttcccgtataaaagccgaaggcgatgcaaaggcctccgagatcataaatgaagctaaggaagtacagaaaaagacgctcggagacagccttgccaaggcagaagaggacctccaaaatctgcaccagcaggtcatatcaagtgcaaatctggaagtgaaaagaattacgcttaataagcgtaaggatcttctagacaaagtttatgtccagacagttgaaaaaattaagtcaatgccggcatccaaaaaagaagagctgttgaaaaatattctcagcaagtacgaagctagcggtgctagagtttactcttctaaagattctgaagatattgtcaagaagttaacttctctatcttacgctggtaatcttgatgctattggtggaattgttctggaaaacgaggatgggacggtcaggttagatttcacatatgattcaatcctgaaaaacgtgtatgagcgttcattgaagcagatatctgatctattatacggg

SEQ ID NO: 34972 - DNA, 1734 bp, Methanosarcina mazei
gtggaagtaaaaggtgaaatttatcgtgtgtctgggcctgtcgtcaccgttaccggcttgcaggcaaaaatgtatgacctggtcaaagtcggtgatgaaggtcttatgggtgaagtcatccagatattagggcccaagaccatcatccaggtatacgaagagaccgcaggtatcaagccaggggaaccctgttattctacaggttcgtctctgtccgtggaacttggtccgggtcttctttcaagtatttatgatggggttcagagaccactgcatgtcctgctcgaaaggacgggcggtttcattggcagaggtgtcactgcagatgggcttgaccacaagaaactctgggagttcaaacccgttgccaagaaaggcgattccgtaaaaggcggagatgtaattggtgttgtacaggaaaccgtgaatattgaacataagatcatggtgcctcctgatatctcaggtacaatttccgacataaagagcggaaactttacggtagtagacacaatctgtactctgactgatgggaccgaattgcagatgatgcaaaaatggcctgtcaggagacccagacctgttaggacaaaacttactccaaccaggcctcttgttacaggaatgagaatccttgatgggcttttccctgtggcaaaaggtgggacggctgcaattcccggacctttcggatcgggaaagactgttactcagcagtctcttgcaaagtggagtgacaccgaaattgtggtctacatcggttgtggtgaacgcggaaacgaaatggcagacgttctgagcgaattccctgaacttgaagacccgcagacagggcgcccactgatggagcgtactgttcttatcgctaacacttcaaacatgcctgtggccgcaagagaagcatctgtgtacacagggatcaccattgcagaatatttccgtgacatgggattagacgtgtcccttatggcagactccacctcaaggtgggcagaagccatgagagaaatctcctcccgtctggaagaaatgcctggtgaagaaggttatccagcgtacctatctgcaaggctggccgaattctacgagcgtgccggggttgcggagagtctttgcggtgagacaggttccattactgttattggagcagtatctccacctggtggtgacttctcagagcctgttacacagaataccctgcgtatcgtaaaagtgttctgggctctcgatgccaaactctctcagaggcgtcacttcccggccatcaactggctgaacagttacagtctgtacaaggacagtcttaatgactggtttgcagataacgtggctcctgattatgtgcctttgagggaaagggcaatggaaatgctccagacagaatctgaactgcaggaaatcgtacagcttgtaggttccgatgctctgccagatgaccagcagcttctgcttgaaatcacccgtatgctcagggaaattttcctgcagcagaatgcattccacccagtagatgcctacagcccgttcgctcagcagtacaggatccttaaggcaatcatgaaatggggagacgctgcaatggaagccttgaaatcaggtgttcctgttcctgaaattctcaaacttgaatccaaaaatgtgcttgctaaggtcaagtatgaggagaagtttgatgagtctatgaacgctgtcctgacacagatggataaagagtttgcatccctgagaggtagg

SEQ ID NO: 34973 - DNA, 1380 bp, Methanosarcina mazei
atggtaaaagagtataagacaatcactcagattgcaggaccgcttgtctttgttgagaaaacagagcctgtaggctataaagaaattgtcactatcaacatgcctgacgggaccacccgcagaggcgaggtgctggactcatcttcagacatagtggttatccagatttttgaaggtactactggtctggacaaggagtgtggtgtagtctttacaggggaaaccctgaagctccctgcatccattgaccttctcggaaggatcctttcaggttcaggagaaccacttgacggtggacccaggattgtgcctgaccagcttctggacatcaacggagctgcaatgaacccatatgccaggctgcctccaaaggatttcatccagacaggtatctccacaatagacggaacaaacacccttgtccgtggacagaaactgcctattttctcagcttcaggtcttccacacaacgagattgctttgcagatcgcaaggcaggctgcggtgccgggatctgaatctgctttcgcagtagtttttgcagcaatgggtattaccaatgaagaagcccagtacttcatgagcgacttcgaaaagaccggggctcttgaaagggctgttgtgttcctcaatcttgcagatgacccggctgtcgaacgtatagtcactccgcgtatggctttgactgcagctgaatatctggcatacgaacacggcatgcacgtacttgtcattctgaccgatattaccaactatgcagaagctcttcgtcagatgggtgccgcccgtaacgaaattcctggtcgccgtgggtatcctggttacatgtacactgaccttgcaactctctatgagcgcgcaggtattgttaagggtgcaaagggatcagttactcagattccaattctctcgatgcctggtgacgatattacccacccgattcctgacctgtccgggtatattaccgaagggcagattgtggtttcaagagaactgcacaggaaaggtatctacccgccaattaatgtgctgccatccctgtcaaggctgatgaactccggtatcggagcagacaagacaagggaagatcacaaggcggtttctgaccagatgtatgcaggttatgcagaagggcgtgacctgagaggtctcgtggctatcgtcggtaaagaagctctgtctgagagagacgtcaagttccttgagtttgctgacctttttgaggaccagtttgtccgtcagggcagaaacgaaaacaggacaattgcagacactctggacattggatggaagatccttgcacacctgcctgaaaaccagctgggtaggattgacaacaaatacatccagaaataccatcctgcacacagaaagggtcag

SEQ ID NO: 34974 - DNA, 615 bp, Methanosarcina mazei
caagacgtaaaaccaactcggtcggagctgattgagctcaagaagaaaatcaagctctctgaaagtgggcacaagctccttaagatgaagagagatggtcttattcttgagttctttaagattcttaacgaggcaaggaacgtcagaaccgaactggacgctgcctatctaaacgctgcagaaaaaatcaatcttgcctctgctgtaaatggaatggttacagtcaagtcaactgcctttacagcaaaggaatctcccgaaattcagctttcaggacacaacattatgggtgttgtggtgccacaaatcagctctacaggtgtccacaaatctcttgttgagagaggttacggtattgttgggacaaattcgtatattgatgagtccgcagatgcctatgagatcctggtagaaaagattatcacggcagcagagctggaaacaacgatgaaaaggcttcttgatgaaatcgagaagactaagaggcgtgtaaacgctcttgaattcaaagttattccggacctcattgcaaccatgaagtacattcgttttaccctcgaagagatggaaagagaaggtacttccaggctgaagagagtcaaggagagaatgaaa

SEQ ID NO: 34975 - DNA, 1122 bp, Methanosarcina mazei
atgacgcagtataagattccggtcctcccgggcgacgggataggcccagaaattatcgccgaaggcagaaaggtaatagatgccgctggcgaaagattcggttttgatgtagagtggattgaatacccgcagggagcagatcattatcttgaaacgggagaactgatttcggaagataccttaaaggagctatccggataccctgccatttaccttggttccatcggagatccaaggattgcccctggcgtccttgagaagggaatcttattaactgcacgcttttattttgacgagtatgttaaccttcgcccgataaaacttcttgatggggtgtggacccctctcaaagacaaaacctcgaaagatatcgattttgtggttgtcagggaaaacaccgaggacttctacgtaggggtcggcggtagagcaaaaaaaggagcgagcaaagaccttcttgaagtaaaaagaacgctctactctgcaaaattcggtcttgatatcgagactgacagcgaagaaataggataccagataggccttatctccaaggaaggtacagacagggttatcgagtacgcctttgaccttgccgagaaccggagaaaacacgtttcttccgttgacaaggcaaatgtgctttccgatatctacggcttctggagagaagagttcaatgcaatttctgcaaaacatcccggcgttactacagactttaatttcgttgatgccgtcacaatgtggtttgtgaaaaaccccgaatggttcgatgtggttgtaaccccgaacatgttcggagacattattactgatctcggagccatgatccagggtggccttggccttgctcccggtggaaacatcaacccgacaggcacgagcatgttcgagccgattcacggttcagctccgaagtacaagggacagaacaaagtcaacccgattgccacaatctgggcaggtgcaatgctcatagaacatctcggagaaaaagaagccgcagacaccatagttaatgcaatccagaaaaacattctggacagcaaagtaaaaacctatgacatgggtggcaagagcacaacctcagatgtcggagacgacattgcaaggataataaaggga

SEQ ID NO: 34976 - DNA, 801 bp, Methanosarcina mazei
gtgaagctgctaatcaacgcactgaaagatgaaaattcacacgtgcgattgagcgcggcagaggcacttggaaatattaaatctgagacagctgtgcagctgctaataaacgcactgaatgatgaaaatgaaaatgtgcagaggggagcggcagaggcacttggaaatattgaatctgagacagctgtgcagccgctaattaacgcactgaatgatgaaaatgaagatgtgcggaggagcgcggtagaggcacttggaaagattaaatctgagacagctgtgcagccgctaatcaacgcattgaaagatgaagatgatgatcttcggtggaatgtggcagagatacttggaaaaataaaatctgatacagcagtgaagctgctaatcaacgcactgaaagatgaaaattcacacgtgcgattgagcgcggcagaggcacttggaaatattaaatctgagacagctgtgcagctgctaattaacgcactgaatgatgaaaatgaagatgtgcggaggagcgcggtagaggcacttggaaagattaaatctgagacagctgtgcagccgctaattaacgcactgaatgatgaaaatgaagatgtgcggaggagcgcggtagaggcacttggaaatattaaatctgagacagctgtgcagccgctaataaacgcactcaaagatgaaaatgaatatgtgcggaggagcgcggtagaggcacttggaaatattaaatctgagacagctgtgcagccactaattaacgcactcaaagatgaagattcagatgtgcggagagaagcg

SEQ ID NO: 34977 - DNA, 3525 bp, Methanosarcina mazei
gtgtatataaaagagattgaatttgttaattttaagtctttcggaaaaaaagtaaagattcccttttataatgactttactacaatttcaggtccaaacgggagtgggaagtctaacataatagatgggattctttttgcactcgggctcacaagttcaaggacccttcgcgctgaaaaacttaccgatttgatttacaacggcgatgcgtcaaaaaagcctgattttgctcaggttactatccgttttgacaactcggaccataagttacctctagagcttgacgagattgaagtctcaagaaaggttcggcggacaaaaaacgggtattacagctatttttatttcaatggaaaatccgtaagccttggagaagtccattctcagcttgaaaaagccgggataacgcctgaaggctataatgtggttatgcaaggagatgtaacgcagataatctccatgacctctgtagaaagaagaaagattatagacgaaattgcaggggttgcagaatttgacgaacgcaagcaaaaggcgcttggggaactggaagtcgtaaaacagcaaatcgagcgcgtggatataatccttgaagaggtacgcacccagctaggaaaactggccggagaacgtgaccaggctttaaaataccaggctctcaagactgaaaaagtaaaatttgaaggatatctcctactttccaaactcaaggacgcaagggctgaactgcagaatgtggagaaggaaatcacaggcaaagaagagcatcttgaaaaagtccagattgtcctcaacgagagaacaaaggaacttcaggcgcttgaagaaaccctggaaaaactttcggttgaaatccgaaaaaaaggagaggatgaacagcttcaggtaaagagggagatcgaagagacaaagggagaaatttctcgctgcgtagatagtatcgagctttcggaatccgaacttgaggaagctgattcgaggcgcaggaaagcctttgtagagatcgattccaccaagggcaatgttgaggaactcaaagaaaaaattgaagccgaaaacctgagaaaagaaagcatttcttcagaactttccgagcgcaaaaccgaacgcatgctgcttcagagcagaattgcagatgtggacgcaaaatttgctgctacgcgggatgagctcatggctgccaggaagaagcttgaggatgcaaaaaacgagaaaaatgaattaatccgaaccgaagatcggctccttgataccctccggagaaaatctttagaactccgagagatagaaaaccagatcaaagatgctgaagccgcggttgctacttctgatagtgatacgctttctgtcaggtacgagcttgaaaagctttctgaaaacctggaatctcttatccgggaccgtgatgatattgaaagcagccatttcaggataaaggaagatataaagaaacttgagaacaggcttcacggcctccagcaggagtatacaattacggagacaagagtgcgggcatcggaacagggcagaggctattccagagctgtggagatgataataggggctgcaaggcaggaagaccttttcggaattaatgggaccattgcccagcttggaagagtggaaaggcaatactcaacagctctggaggttgctgcgggaaaccgaatgcaagcgattgttgtggatacggacgccgatgctgccgaagcaatcgaatacctgaagcggagaaaaggagggcgagcaacctttcttcctctcaacaaactgagagagcccaggcggcttgaaaatctaagttacgaaaacggagtaataggatacgcaattgaccttattcagtttgattccggttttgagcccgctttctggtatgtttttcaggatactcttgtcatggaaaaccttgaaagtgctcgccgcctcatgggaaaagcaagaatggtaacccttgaaggtgaacttcttgaaaagagtggagcaatggtaggagggtcaatatcctctaaatcgggcacttcttttgcagccgcagaaaaagataaactgcttgagcttgcagagaagatcaggtccctggatgaaagccggaatgcggcaataaacaagcaggacagcattgaaagccatcttttcgaactgagcagaaaaattcgggactgtgaggctacgatctcacgaaaagagagccagcttgatgaaattgcaggcagggaagcaaaacttgctgaacttcttgaagcaaaacaggccgaccttaaagcaattgaggagtccagaaccgaactcggaactgaaatggatagggtaactgcggaaaaagctgacaaagagaaggttgtatccgaacttgaggagcagatctcaggacttgaagcaaaacttgcggattctcccctgcctgaaatcaataaaaagatagaattcgtcgatgaggaactccgcaggctggatggccgaatccgggatactgaagccacattgaatgccctgaagcttgaaaaagagtatgctgaacagaaaattgccgaagcaaaggaacttatcagggaaattgatgagaagaaagcttcaagaatggaaaaagttaactctctgaagataaaaataaaggaatgtgaggaaaaacttgaggaaaaaaaagccagggaaattgagctttcgaatgaactgatagggctccagcaagaacgggaaaaggttcaggctgaacacaatgcggtcaaacgcagagtaagtatttcctcaactacgcttgaaaaggcaaagcagcaggtgcttacgctgaaagctacgaaaaatgcgcttttagatcaggaaaagcaatttgtcgaagaaatactcaaaagaggcatagaggagactgatgaggttccgaattacgaaaccgtttacatgcggattcaggcaatcgatgaagccctacgaaggctcgaacccgtaaacatgagagcaattgacgagtataatgaggtagagttaagactttcggatttgcaaggaaaacgtgacactctctttaccgagagagagcagctccttgagcgcatcgaccagtatgagcatttaaaacgagatgcctttatggaggcctatacaagcattaatgccaacttcaaggagattttccatgagctttccgacgggatgggtgaactcttgcttgataaccctgatgacccttttgcaggagggatgacacttagggcacagcccaaggaaaaaactctccagcggatcgaggcaatgtccggaggagaaaaaagccttactgcacttgcgttcatattcgcaatccagcaataccgtcctgctcccttttatgcctttgacgaaattgatatgtttcttgacggctggaatgtggaaagagtttcaaggcgcgtaaaaacctcaggatcaaaagtccagtttattgttgtttccttaagaaaacctatgatccaggctgcatccaggacaataggagttacaatgcaggaaaataacctcacgagcattaccggggtgaaacttaatggc

SEQ ID NO: 34978 - DNA, 549 bp, Methanosarcina mazei
atgagcgaatctagcatcaagatcgaaaatgtggttgcatccactaaactcgctgaagaattcgacttaaccgttatcgaatcaaagttcgaaggagccgaatacaacaagcagaagtttcccggactcgtttacagagtttcagatcctaaagctgcattcctggtctttacttccggtaaggttgtctgtacaggggcaaaaaacgttgccgatgtacatacagttataggcaacatggcgaaaaaactgaacagtatagggattacgactatagagaaccctcagattactgtccagaacattgttgcttctgcagatctgcatacgattttgaacctgaatgcaattgcaatagggcttggacttgaaaatattgaatacgagcctgaacagttccctggccttgtgtacaggatcgatgaccccaaagtagttgtgcttatcttcagctccggaaaactggtagttacaggtggcaagacccctgaagattgtgagagaggtgttgaggtcgtccgccagcagctcgacaacatggggctttta

SEQ ID NO: 34979 - DNA, 465 bp, Methanosarcina mazei
atgtattacgatataatcgaatctccaatcggtcccattcttctggcagggaatgaaaaaggactgaaacatcttgatttcttgaaaggcaagaaaagaatagaaatccctgctgactggatagaaaataaaaagtttttcagggaggctgcaaggcagcttgaagcttatttttccgggaaactagaatcttttgaccttaaactggctccagagggaacggattttcaaaagtccgtttggaaagctctatgcgaaattccctatggggaaacccgaacttataaagagatagctgtatctatcggaaagcccagagcttatagagctgtggggcttgcaaataaccgaaatccaattgcgataattatcccctgccacagggtcataggctcagatggaaaacttacaggttatgcaagtgggctggatataaaggaatttttattgaaacttgaggaaaac

SEQ ID NO: 34980 - DNA, 594 bp, Methanosarcina mazei
atgtccgttgtttcaaagtataaccgaatagcacccatatacgaactgatagacttgcctctggaatatttctttttccgggaatggagaaaagaagctctttcaggcctgagcggaaaaattctggaagtcggggtgggcaccggaagaaacctgaaatactatccggcaagctgtagggtaataggaatcgacaaaagtaaaaggatgctccgacgagcccaagaaaaagccgaaggcaggaaaaacattactctttatcctatggatgccgaacatcttgaatttcctgataacagctttgactatgtgatcacaacttttgtcctctgtacaatccccgatcctgtgaaagctcttaaggaaatgaggcgagtcctgaaaccatcaggggaactgatagctcttgaacatgtgcacagtgactacccttttgttgacttcatagaacatttaattaatccggttctgtttattcttcttggggatcatacaacccgacataccgtgaaaaatattgaaaaagccggcttcaccattaaggaagcgaaaaaactggcttttaaggatgttttcaggaagatcagggcaaaa

SEQ ID NO: 34981 - DNA, 1413 bp, Methanosarcina mazei
aatattttacgcagaggcaggctggaggctgcccaggacgaggaaatcttacgttatacctcctctatggaagctgacaggtggatttttgatgctgacatagcagtagaccttgcccacacagtaatgctaaaagagcagggcatcataaatagggaggactgcagtaaaatccttagtgggcttttaaaaatccgggaggaagggatggaaaagctcgatttcagctatgaagacatccatatctctcttgagtcaaggctcatcgatatggttggggaagacgttgggggcaggatgcattctgggcgttccagaaacgatgaggttgcaacttgtatcaggctggtgctcagggaagaactgaccgggctgcttgaagaaatccatgagctgaggcaagcacttctaacccttgcggaaaaacataccgagacgctcatgcctggttttactcacatgcagcatgcccagccgacaacacttgctcatcacctctgcgcccacgaagccgctcttggcagggactttgacaggattcaggacgcttactccagggtaaacctctgcccgcttggggctgcagcttttgcttccacgggttttaacctgaacaggaaaaggacccaggagcttctgggctttgacggcttgcttgaaaattcaatggatgcggttagcaccagagactttcttattgaatgcgcctcaggatttacaaacctcatgataaacctgagccgtatggctgaagaacttgtaatatggtcctcttccgaattcaatttcatagaactggacgatatgtacgcttctacttcttcaatcatgccgcagaagaaaaatcctgacactgccgaacttatgcgcgggaaaacaggagtagcagtgggcgcactaatgtctctgattacaatctgcaaagggcttcccctgagttacaaccgcgaccttcaggaagcaactccaaatctctggcggtctgtagaaacggtaagggcttcagtaaggatcatggaagggatgataaaaactatgaaagtccgtcctgaagtgcttgttgcccagtcagttacaggttttacaaccgcaaccgaacttgcggatacctttgtccgggaaaccggaattcctttcaggactgcccaccagatcgtcgggatgcttgcaagggaaatggaaaaaccaactctaaaaaaaatcgattccgttgccgaaattgtgctgggcgaatctctttcaagccgtgggctcaaggagaaaatggtaaaagaagccctgaacccattttcgaacgtagagataagaaaaatcgctggcggaccagctcccgaagaaatgcgaaattacctctcgaaaaggcagaccgagcttgaacttaacaggcaggaaattgcaaccctgaaagatatt

SEQ ID NO: 34982 - DNA, 528 bp, Methanosarcina mazei
atgcggataacagttagcgggcttcccggaagtgggacaacaacggtttcaaagctccttgcagaatactatgaacttgaactgatctcctcgggtgaaattttcaggaggatagccagggagaaggaaatgagcctggcagaattcggagctatggccgaaaaagacccttcaattgacctggctattgataaaaatcagagggaagttatccacagtcatgaaaagctgatcctcgaaagcaggcttgcaggccatatggccaaagaagtcccaaatgtacttaaaatctggataaaggctccgctacctgtacgggtaaaacgaatcttgaggcgggaaaaatcagtctcttttgacgaagagctcgaaagaacagttgagagggaaaaatctgaggccctccgctatatgaactattacaatatcgatattgacgacctctcaatttacgacatcgttattgattctgaaaaatggaatcagtaccagattcttgacattttgaaggtagctatcgattctctc

SEQ ID NO: 34983 - DNA, 576 bp, Methanosarcina mazei
aaaaaggaggttttgcggggtgcgagttttgcctttgaaaagggggaaatttacggactcctcggaagaaacggctcaggcaaaaccacgctgtttaactgcatcaatgaggatttgaggattgacggcggttcaattctccttgaagaaaatggagtgcagagagaaatttgtcctgatgatatcggatatgttctgtcgacgccagtagttccggagttcttgacaggcagagagtttttaaagttctttcttgacataaacgtgaaaaaaattccggacattaagcctattgacgaatatttcgattttgtaaagatcgaaagcgaggatcgcgacaggcttttgaaagattattcccatggcatgaagagcaagatgcagatgcttataagcttcatcgcaaatccatccattctgcttttagacgagccgctgacctcatttgacgttgtggtcgctgacgaaatgaagacgctgctgcgccaaatcaaaaaagaccacattattattttttctactcatatcatggagcttgctctggatttatgtgacgagatcgtgattctgagcggc

SEQ ID NO: 34984 - DNA, 1515 bp, Methanosarcina mazei
atgggtgaaaagaattcttccaaggttctcaccactggttttggaataccggtgggggatgatcagaacagccttacagccggaaatagaggaccggttcttatgcaggatgttcatctgcttgataaacttagccatttcgaccatgaacgtatcccagagcgtgtagtacatgccaaaggtgcaggtgctggaggttactttgaagtcactgcagacgtgaccaaatataccaaagctaaatttctgtctgaaatcggtaaacgtactgaagtttttgtccgtttttccacagttggaggagagaagggatcggctgattccgctcgtgatccacgtggttttgccgtgaagttctacacagaagatggtaactacgatcttgtaggcaataatacccctgtgttttttattcgcgaccctttaaagtttcctgattttatccacacacaaaaacgtaacccagctacaaactgtaaagatccagatatgttctgggacttcctttccctgacacctgagtcaattcatcaggtcactattctcttctcagaccgcggtactcctgctacctatagaaacatgaatggttattctagccacacctataagtggtataatgaaaagggtgaatatttctgggtgcagtatcattttaagactgaccaggggataaagaacctgacccttgaagaagcagaaaaaatcggtggatcggatcccgaccacgcgacaagagacctgtatgaggctatcaagaaaggtgattatccctcctggactcttgaaatgcaaataatgactccggagcaggcagaagattaccggtttgacatcagggatataaccaaagtatggccccatggtgatttccctaccatgaaaataggcaagttggtgttgaatcgaaatccaacaaattatttcgctgaagtagaacaagcagcttttagtcctgcaaatcttgtgccaggcatcggtatttcacctgataaaatgctgcagggtagggttttttcttatcacgatactcatatccaccgtcttggtccaaattataatctaatacctgttaatgcaccaaagtactcacctgaaaatagttatcagcgtgatggattcatgcgtgttgatgctaacgggggcagtggacccaactattggccaaacagttttggaggaccttctcccgactctgtttatctggaacctccatttggagtatcaggactagcagctcgcacactctatacacatccaaatgatgactttgtacaggctggaaatttgtaccgtgacgttatgactgactacgatcgtgaaaaccttgtaggaaatatcgtatctcatctctctgccgcacagaagcgtatacagcttaggcagacagcattgttctttaaagctgatcgtgactatggaagccgtgtcgctaagggtcttgagcttgatattaaggaagttgagcgcctagctaatatgaccaatgaagagcgagcccgagcaactgagaga

SEQ ID NO: 34985 - DNA, 2268 bp, Methanosarcina mazei
aaaactccagttgctgtattttatgcatctccaaaatcaggaaaagcacctttaagcgtgaaatttactgataaaagtacaggaaaaccaactaaatggaaatgggatttcggagatggaacatcgtcaacagaaaagagtccaactcataagtattctaaagcaggaaaatatactgttaaacttacagtaacaaacgcagcaggcagtaacacagcaacaaaatcaaagtatatcatagtgacagaaacttcgcaaacttcgactgctgcattttatgcatctccaaaatcaggaacagcacctttaagcgtgaaatttactgataaaagtacaggaaaaccaactaaatggaaatgggatttcggagatggaacatcgtcaacagaaaagagtccaactcataagtattctaaagcaggaaaatatactgttaaacttacagtaacaaatgcagcaggtagtaacacagtaacaaaatcaaagtatatcatagtgacagcaaaacctgttgctgtattttatgcatctccaaaatcaggaaaagcacctttaagcgtgaaatttactgataaaagtacaggaaaaccaactaaatgggaatggagttttggagacggaacatcgtcaacagaaaagaatccaacacataaatattctaaagcaggaaaatatactgttaaacttacagtaacaaatgcagcaggcagtaacacagtaacaaaatcaaagtatatcatagtgacagaaacttcacaaacgtcgactgctgcattttatgcatctccaaaatcaggaacagcacctttaagcgtgaaatttactgataaaagtacaggaaaaccaactaaatggaaatgggatttcggagatggaacatcgtcaacagaaaagagtccaactcataagtattctaaagcaggaaaatatactgttaaacttacagtaacaaatgcagcaggtagtaacacagtaacaaaatcaaagtatatcatagtgacagaaacttcgcaaacttcaactgctgtattttatgcatctccaaaatcaggaaaagcacccttaagcgtgaaatttactgataaaagtacaggaaaaccaactaaatggaaatggaatttcggagatggaacatcgtcaacagaaaagagtccaactcataagtattctaaagcaggaaaatatactgttaaacttacagtaacaaatgcagcaggtagtaacacagtaacaaaatcaaagtatatcatagtgacagcaaaacctgttgctgtattttatgcatctccaaaatcaggaacagcacctttaagcgtgaaatttactgataaaagtacaggaaaaccaactaaatgggaatggaatttaggagatggaacatcgtcaacagaaaagagtccaactcataagtattctaaagcaggaaaatatactgttaaacttacagtaacaaacgcggcaggcagtaacacagtaacaaaatcaaagtacatcatagtaacagaaacttcccaagctcctgttgcagatttttggggctggcccctctcaggaaatgatccactaaaagtaacatttacggaaaccagcaaaggatcaccaacttcatggaaatgggatttcggagatgggacatcgtcaacagaaaagagtccaacacacacatattcagctgcaggaacttacacggttaaacttatagcaacaaatgcagcaggaagtagtacaaaaacaaaatggaattatgtaaaagtttcaggaaccttacaagctccgactgcggacttctggggctggcccctctcaggaaatgatccactaaaggtaacatttacggaaaccagcaaaggatcaccaacttcatggaaatgggatttcggagatggaacatcgtcaacagaaaagagtccaacacacacatattcagctgcaggaacttacacggttaaacttatagcaacaaatgcagcaggaagtaatacaaaaacaaaatggaattatgtaaaagtttcaggaacctcacaagctcctgttacagatttttggggctggcccctctcaggaaatgacccactaaaggtaacatttacggaaaccagcaaagggtcaccaacttcatggaaatgggatttcggagatgggacatcgtcaacagaaaagagtccaacacacacatattcaactgcaggaacttacacggttaaacttatagcaacaaatgcagcaggaagtagtacaaaaacaaaatggaattatgtaaaagtcaca

SEQ ID NO: 34986 - DNA, 744 bp, Methanosarcina mazei
gttattctgaaacttgggggcagcgtcatcactgacaaagccgcaaatcaaggggttgtaagagaggatgccctcatgagaattgcaaaggaagtttccgaataccggggaaaaatgattattgtacacggtgcaggttcttttgggcacacctacgctaaaaaatatgagcttggtaaggtttttgatcctgaaggagcaattgtaacacatgagtctgtcaagaaacttgcatccagagtggtaggtgctctaaacgaatatggagtccgggctatagccgtacatcctatgtgctgtacggtttgcagaaacgggcgaatcgagagtatgtatcttgacaacataaaactcatgctcgaaaatgggcttgttccagtgctgcacggagatgttgttatggatctcgaactcaaagcgtgcgtgctttcaggggaccagatagtcccctatcttgcaaaagagctcaagattacacggctcgggttaggctcggcagaggatggagtgcttgataacgacggaaaaaccgtacctgagatcaccccgggaacttttgaaaatttcaaacgttacataagagggtcgggaagtaccgatgtcacgggcggcatgctcggaaaggtgcaggaacttctggaacttagcaaaacgtcttgtattacatcatatatattcaatgccaggaaagaagataatatatatcggttcttaaatggggaatctatgggaaccacaatcagt

SEQ ID NO: 34987 - DNA, 915 bp, Methanosarcina mazei
atgatttcgtgttctgcccccgggaaaatttatcttttcggagaacatgcggttgtctacggagaaaccgcaataggatgtgcaattgaattaaggactcatgtgcgggtggaattatgtgactctataataattcagtcggaaattggccgaacagggattgattttgaaaaacatccttatatctccgcagccattgagaaaatgagagaaatagtaccaatagatggtgttcatctgaaggttaattctgagattcctgtaggctcgggactcagctcatctgctgctgttacgattgcaagtataggtgcgctcaataaaatgtttggctgtggcctctctctcgaagaaatcgctaaaatggggcatgaaatcgaaattcaggtacaaggaaccgcaagccctactgacacttatgtttctacattcggagggattgtaacaattcccgacaggaggacgctgaagactcccgattgcgggattgttattggggatacaggagttttcgcttctacaaaagagcttgtaacaaatgtgagaaaactccgtgaaagttatccacatcttatagagcctctaatggttgtcattggaagaatttccaagaccgcagaaccttttttccagacaggagattactcttcaattggcaaacttatgaatgtgaaccagggtattctggacgcacttggcgtaaatacttttgaactctccaaattaatatactcctctcggggagctggagctttcggagcaaagagtacaggtgggggaggaggaggatgcatggttgcccttacagcacctgacaaatgtacacaggttgctgaagccatttcaggttcagggggtaaagcaataataacaaaacccacggaacagggcttaaggttagaatgaataactcaa

SEQ ID NO: 34988 - DNA, 1599 bp, Methanosarcina mazei
acagttattcaataccttctggatagattaaagcaactgggaataagggatattttcggcgtgccaggggactttgcatttccaatcaacaacgccatctgtgatgataaagaacttcgctggataggctgctgcaatgaactgaatgctgcttatgctgctgacggttatgctcgtgttaaaggaatgtctgcactgtctactacttttggtgtaggtgaactttccacactatgcggtatagcaggctcttacgcggagtacaatctggtattccatattgtcggaatgccaaaaatgcaggcacagaagacgcatgccatagtgcatcactcgctgggcgccggaaaatccagcatatttatggaaatggctacgccagtagtatgtgcaagtacgatgctcaccccagaaaactgtgttcaagaagtcgagcgtgttatcgaaacagccctggagaaccaccgtcctgtctatattgcaatacctcacgactatgtgaatgcggatatttcatcctttaattcacctgcaagaaaacctgtaaaaagcgaccctgtggctcttgaagaagtagtctcgattattgcaggtaaactcttgaatgcaaagcaagcctgtgttattccaggttttcttgttgaccggtttggactcaaggacctgtctatggctgttattactgcttcgggtttgccttatgttactatggctctggataaatcagttcttgatgagactaatccctcctacctgggattatacatgggacaacttatcaatcctgaaatccggaaatttgtggaatcctgtgactgtatccttgctatgggcactatcctgtctgatgttaacacgggtaagttcacggctaatttggataagtcccgaatcatcaatatcatgccttcaagtgtccatatagggtatactgattatatcaatgtaaaaatgcttgatgtactggaggaactcacccgaaggcttaacaagcgtaccgatatcagcggccctgttgccagacgtcctgccgttccagaggtaaatgctgaagatccaataacggctgactatttatacgcgaagtacgcggagttctttaagcccgatgacataatcatagctgactcaagttcatcattttatgggttaatacctctacttttaccgaaaggagctaagttcgagagccagatgctctggggagcaattggttgggccactcccgcttcctttggtactgcactggctgcacctgacagacgagtaattcttattactggagaagggtcacaccagatgaccgctcaggaaatcagccaattttatcgtcatggcctgaagcctattatcttcgtgctgaataatcacggctacctgatagaaagaatgctgtctgaaaaagtagattattgctataatgaccttgtagagtggcaatattataaattaccggatgttttcggctgcaatgattggattactagcaaggttactacctgcggagaccttgataaggtcatgagagaactagataatgctaaggtgggtgcgtatatagaaataatcacaccaaaactatcggcccctcagcttatg

SEQ ID NO: 34989 - DNA, 1218 bp, Methanosarcina mazei
agtcagccttgtgttaatatcggcatggtaggacatgtcgaccatggaaaaaccacacttgttaaagctttatcaagcgtttggacagatacacatagtgaggaagtaaaaagagggatttctatcagattggggtatgcagactccctattcatgaaatgtcccaaatgcccttctccccaatgttacactgtagagaagacctgccctaactgtggagaaaagactgaagaacacaggatggtgtcctttgtggatgctcctggacacgaaaccctgatggctactatgctatcaggtgctgctattatggatggggcagtactggtaattgcagcaaacgaagactgcccgcagcctcagacaaaagaacaccttatggcactggatattatagggattaagaatattgttatagtgcaaaataagattgaccttgtatccaaagaacgccttctcgagaactatcgccagataaaggaatttgttaaaggcacggtcgcagagaatgcacctataatcccgatctcggctcagcagaacattaatatcgatgtccttatcgatactctggaaactgtgatccctactcctgtccacaaagtagacaagcctgccagcatgttgattgcccgttcttttgatattaacaggccaggggcttcaattgcggaaatgcgtggaggagttatcggcggaactctgaccgaaggagtccttcatcccggagacgagctggaaataaggccaggaattaaggttacaaccgaaggcgttacaagatgggttccgattaggacaacggtttcgtctatctttgcaggtgagacaaaggtagaagaagcaactcccggaggccttttagctgttggaacttatcttgaccctaccctgacaaaaggtgactctttaacaggacagattgcaggcgtacctggtacacttcctgagaccagacatcagttcgtcatggaattacatctgctcgagagggtagtgggagttacaagagaagaaaaaatcaatgaaatcaaaaccagcgaacctcttatgctcaatataggaactgcaaccacagttggagtggttacaagtgccaggaaaaatgaagcacaggtggcccttaaacgcccaattagcgcagccatcgggtcaagggttgctatcagcaggagaatcgactctcgctggcggcttattggagtaggggtaattaag

SEQ ID NO: 34990 - DNA, 1029 bp, Methanosarcina mazei
atgcagcttcccagagatgttcttgttgggcatggcgtgcttgaggaaattggagatgtctgcagggacctgaaaatgaaaggaaatgcgctgatcgtaaccggaagtactacaaataatattgcaggaaagagagtcagtaacctccttgagagtgcaggttgtagtgcagaaatggttctgacgtgcaaagctactaaggaagaggttgaaaaggttatggaaaaggcccttgaagtcgagactaattttctcataggggttggaagcggcaggtctattgaccttgcaaaacttgcttcgacccgacttgaacttccttttattagcgtgccgactgcggcttcccacgatggcattgcatcttcccgtgcctcaattgtagataatgggagaagtacgtctgcacaggcccaggctcctattgccgttatcgcagatacggagattatttcagcagcccctttccgctttcttgcggctggctgtggagatataatttccaattatacggcagtgcttgactgggaacttgcaagcagactcaggaatgaatattttggggcatatgctgcagccctttcccgtatggctgcccgagttattattgaatgtgcggattcgattaaacccgagcacgagacctcggcaaggcttgtggtaaaggctcttgtatcgaacggggttgcgatgagtatcgcaggttcttcaagacctgcttcaggctcggaacatatgttcagccatgcccttgataagatagctccaaaacccgcacttcacggagaacaatgtggagtagggacgattatgatgatgtacctccacgggggaaactggcaagaaatcagggaagccttaaaaaagataggggctcctgtaactgccgaagaactgggtatagaagataggtatataattgaagccctgttacatgcacacagcattcgccctgaacgttatacaattcttgggagcggccttaatccttctgctgctgagaaagttgcaagaatcacaaaagtcata

SEQ ID NO: 34991 - DNA, 984 bp, Methanosarcina mazei
atgtcagaaatcagaaagcattactttctttccgagtactgtataattgccgaagaaagagctaaaaggccttcggattttgcagtcgcagacgaaggcagcgggaaacacagctctaaaaactgctttttctgtggaggagccgaggaaaatactcctcttgccactgctgtttataaaaaggggaaaatctattccgatacccctgaaaaaagagtacgtaactgggatttccgctgctttccgaacctttatcctgctctttcacctgtgcctgactccccaggccagaaggaaaaagggctgcaagctgaacccgggtatggttttcacgaagttatcgtagagacacctttgcatgggagaaggcttgaagatttttctaattctgaaatttcagcactcatgcaggtctatagagaccgtacatgcagttatgcaacccgtgaaaatatacgctacgtttccctgtttaaaaattccggggaaaaagcaggggcttcgattaatcactctcacagccagcttcttgccctgcctttttgtccttctcctctgtcaagggaattaaaggttatcaggaatatcgaggaatgcccttactgtgccatttatgacctggaaaaggcttctccacgtttaatatctaaaaacagcgaatggatagcctttactccttattcctcaatgggaccatttgaagtgtggttcctcccccaaaagcatgtcagttttcttggtgattgtagtgacaaacttctttttgctctgggggatattctgaaagccattctcaaaagttatggacgaattcttggaaatccaccctttaattatatgttttaccagctttccgaatctcctgaatatcacctgaaccttcgtttgctccccaggatttctattcatgcgggttttgaactcggtacaggaacttatattaatacggttcctccggaaagagcagcctcttatttgaaggaa

SEQ ID NO: 34992 - DNA, 1128 bp, Methanosarcina mazei
gtacctttaaggaaacatctactggacctgaagccctgcaggcatggagggttagttcaggaaacatctgaaacttatgggattcctgaaagtgaaattattgacttcagtgcaaactttaatcctctgggaaacccttttgagcatccagaaagcggattgaactttgatgagattcttaatactggttttaagaaacttaccgaatatcctgacaacaggtatcctgagtttcgagaagctgctgcaaagttcgtagggcttggagtaggcccaaagaatatcattccgggtaacggttcaacggaaattatcagacttgtagtggaatgcgtagttgaaaaaggagatactgtccttctaccctggcccactttcggagaatacgaaatgcagtgccggattatgggagcagaactgcagtatccaagccaggacgaagtcgaaacacttcctgacgagcttctggaaaaagcaaaaatcctgttcatctgcaaccccaataacccgacagggaaactccgtacccgaaaagaaatcaaggctcttgcagaacgctgcacgcagcacaaaacccttctttttgtggacgaagcttttatagagctttcagacccttcgcagagtgttgcagaccttacagtaaacaataattacgtttttgtcatgcgttcccttacaaaggactttgcaatcccgggaatccggatgggcttcggaatagcttcccctgaagtggctgaaatcctggatacagccaggctttcctggaacctcggaaccgtggcagacgctgtagcaacttcccttcttaatattgaaggcgggattgaaaacccatacctgaaaaaagcgagggacatgatcagggaagaaggagaggtttttaaagctaaactcgatagtataagaggttttaaagctggagaagtgaatgtaaactttatcctggttgatatcagcaaattcatgcttgattcaacggaattaactgcacgtatggcagctcgtggagttcttataagggactgtttttccctccacggccttggaaaggattacataaggcttgcagtccggactgccgaagaaaacgacaggctaattactgcagtcggggatgtaatt

SEQ ID NO: 34993 - DNA, 1146 bp, Methanosarcina mazei
tctaagtttgttgccgacgttgtgaaagaaattcctccttcgggaatacgccgtttttttgatctggtttccggacttgaggatgtaatctcccttggtgtaggagagcctgactttataactccatggcatatccgtgagatgtgtattcattctctggaaaaagggcaaacctcatatacatcaaattacgggcttcctgagctcagagacgaacttaccagaacttattacaggcgctatggtctggattatgatccttcatccgagatactcatcacaacaggggtgagtgaagctctggatatagcagtaaggacggtggtcaaccctggtgatgaggttattatcgtccagccttcatatgtggcatatttaccttctgttgttcttgcaggaggtaagccggttatcgtttccacccacagggatgatgagtttagcctgactgcagaagccctcaaacctgcaatcacggacaagacgaaagcaataattctcaacttccctaacaatcctacaggagcgatcatgtcaaaggaaggcctcgaggatattgctgacctggttgtggagaatgatctatttgttatctcggacgaagtttacgagtgccttacctatgaaggcaaacacgttccgttatcttcccttgatggcatgaaagaacggactgttatgcttaacgggttttccaaggcttatgcaatgacagggctcaggctcggttttgcaatgggttctcctgagattatacattcaatgatgatgatccatcaatattccatgctctgtgctcccataacagctcaaattggagcaattgaagcactccgtcacggtaaagatgaaatggagcggatggtccgggaatatgaccggcgcaggcactttattgtcagaggctttaacaggatagggcttgaatgctgcaaccctaaaggagcattttacgctttcccctatgtaggaaataccggactctcttcctctgagtttgcagaacgccttctggatgaaaagaaagtcgttgcaatccccggagatgcctttggagaggcaggtgagggcttccttcgctgcgcctacgcagcatccataaatgatatcagaaaagcgttagacagaatggaagactttgtggac

SEQ ID NO: 34994 - DNA, 1586 bp, Methanosarcina mazei
ctgcttgaaataagagacctttcggttgattttcctgcagaggaaaacactgtaaaagcagtttctcatgtcttctttaatataagagaaggagagacttttgggataattggggaaagcgggtcaggaaatctgttattggtctttccttgcctgaggcttcttccgacaaatgcaattgtctcaggaacagtgttttttcatgggcaggaccttttttctcttagaccttcagaactcaggaaaattaggggaaaacacatttcgctcatgcctcagaatcctgctggagccctgaaccctgttctgaaaaaccggcttcaaatagaggaggttttcgaagaaagaggagttgacaaaaaggaagggatgaaaaaatcgctgaggcttatgaaaaaacttcttttgagaaacccagaaaaactttgcgacctctatccccaccagctatctggaggcatgaggcagaggttgatagcttgcatgtctctttcttttgagcccgaacttctgattgcggatgaacctacaaaagggctggaccccgaggcaaaagaaggagcagtggagctttttactaaaattaaaaaagagtgtgggaagacgatgctcctgatcactcatgaccttgatctggctcttgaggtttgcgaccggatagctgtgatgtatgcaggagagattgtggaactggatgaggcttcgaaagttttgaacgcaccctcgcatccctatacaaaagggctcatcagagctcagccgagaaacgggcttgttcccctgagcgggcagagcccaagcaggataagccttcctgaaggctgctttttccatgagaggtgcaggtactcgagtatcgagtgcttcagaatacaccctgaaatgaaaaaacataagggaggatggatcaggtgtcacttccagtccttgaagtaaacgaactggcaatgagttttgggactctagaggtgttcaggaatgtcagtttttcagtatctcgcggagaaattctgggacttttcggaaaaagtgggtccggaaaaaccactattggcaaatgtattgtagggcttgaaagacccacgggaggagaaatccgggtccagggagcggatatactgaacatgggaaaaaaagagttcaggaaactgcgccctaaaatccagatgattttccaacaccctgagacttctcttgacccccgtatgaaagcttttgagaaccttatagaacccctgaaactccattccgggctaaagcaagatgccctcctgaaacgaggagaggaactggcagaacttacagggctgcgacctgaacaccttgctcgttatccggttcagcttagcggaggagagatccagaggatagtgcttgcaaggatcatggctttatctcctgattttatcgttgctgacgagccgacttctatgcttgatgtttcagtgcaagcacagattctgcgccttatgcagaagcttcagagagagacaggcgtttcctacctgctgatctcgcatgaccttgaggtgttaaggaaggtctgccacaggattgcctatctcgataatggaaccattacctca

SEQ ID NO: 34995 - DNA, 1110 bp, Methanosarcina mazei
atgaaaccaacacgagttcctaataatccttgtttttcttctgggccttgtgccaaacatccagggtattctattgaagagctgaaggatacaccttttggccggtcacaccgtagcaacttaggcaaggaaaaattagctgaagcaattaaaaaaacaagagatatgcttggacttcctgatgattatctggtaggtattgtaccggcttccgatacaggcgcttttgaaatgtgcttgtggtccatgctagggtgccgcggggttgatgtccttgtttgggaatctttcagtaaaggatgggcaaccgacatcactaaacagttaaaattaaaagatgtccgagtttttgaggcagaatatgggaaattaccagatttaaagaaggtcgatttcaagaatgatgtcgtctttgtctggaatggaactactagcggagtcaaagtacccaacggcgactggattcctgagaaccgggaagggctcacgctttgcgatgccacatctgctatatttgctatggatataccctaccataaactggatgtcattaccttctcatggcagaaggttttaggtggggaaggtgcacacggaatgctgattttatctccgcgggctgttcagcggttagaaagctatactcctgcctggccattacccaagattttccgactgaccaaaggtggtaaactgaataagaagatttttgaaggctctactattaacaccccatctatgctggctaatgaagattggctggcaacactaaaatgggcagagtctgtcggagggcttaaaccacttatccagcggacaaatgataatctggcggtctttgaggcatttgttgctaaaaacaactggattcatttcttagcggaaacaaaagagataaggtccagtaccagtgtctgctttaaagttgatttatccgatgaaaagcttaaagaactgattaaaacgcttgagaaagaaaaagttgcttatgacatcggttcttaccgtgatgccccttcgggtttgcgcatctggtgcggtgctaccgtcgagaaagaggatttacaatgcctctgtgaatggatcgaatgggcttacaatttggttaaa

SEQ ID NO: 34996 - DNA, 609 bp, Methanosarcina mazei
ttaaaagcaataatttttgatgtggacggagttcttatagattccatgaattttcaggccgaggcctgggttaaaaccttcaaggaaatcggtattaacattactagaaaagatatttatgagcttgaaggctcaaacaataagagattaattaaatcaattttcgaaaagtccggaaaagagcttgagccctggtatttcgaaaaactgcctgaaaagaaacgtgaagttctcgagtttgatcggataaagccttatgaaggtatccaagactgcattaaggcattgaaacggcatttcaagctcgctctggtctcagggtcacatactgatacagtaaataaagttgtcaataagtatttctctaaatgttttgacgtcataattaccgggagtgaccttgagcacggaaaaccggacccggacccttacctcaaagcccttgaaaaacttgacctgacaaaaaacgagtgcatggtaattgaaaatgcacctctggggataactgccgccaagagggcagggctttactgtgttgcagttacgggtatgcttgagcctgaaaagatagaacatgcggatctcgtgctcgaaaaccatgctgccctt

SEQ ID NO: 34997 - DNA, 1345 bp, Methanosarcina mazei
atgacgaaaagaaactatgcaactgtgaacccctgtgttatgtgccagcctatgggaagtgcccttgcttttaagggaattgagaatactatggttctttaccacggttctcaggggctgcagcacctatatgcgtctgcttcttgctcatcacttcagggaacctgtagacatcgcatcaagctcgctcagtgaaaaaggagcagtatacgggggcagggaaaacctgaaaaaaggattgagaaacgtgattaacaggtacaatccgaaagtaatcggagttgctacgacctgccttgccgaaacaattggggacgatgtacctgcaataatccgtgagtttaaagaagaacaagagatcggagacgatcctgaaaaagatattataattattccggtttcaactcctagctatggggaaagtcacgtaagcggatatataaaagccttagacgcagttgtcaggaaatttacggaaaaaactgaagaagaaaaatccgtaaaaatcccaaatggaaagctcaatgtcatccctgttgaaagtctctcccctgctgatgtacgtgaactcaaagagatctttgatgttatggctggagattatattttcctgcctgatatttccgaaacttttgacgctccgctgagagaagatctaccaaaaattgcgccgggtggtaccccactttccgaaattgctgacatgccaaacagtcgagcaagcctgggcctgggtacagttagtaagaacttagcagttaaatatctggaagaatcacatggagtaccaggatatgatgttccaatcccaatagggctttcaaacactgaccttttcttcactgagctggtaaagattattggatgtcccatacctgaaaaatatcagaaagaaagaggtaggctcctggatgctatggttgacgtgcacaagtatctctatggcgtaaaagccgctgtttatggagatcccgattttgtatttagcctcacaaccttcatgctggaactcgggataaacccggttctaatagctacaggaagtaaaagccgggactttgaagcaaaaatccggcaaatagttgaaaaaataaacccggaactcgaacctgaggttctgaatggaattgactttgacactcttaacgatgcagtcagccaatgtaatccggaagtccttataggaaattccaacgggagatacattgcaaaatcccggaacatccctcttgtaagggtcggcctaccaatacatgacagagtcggtgtacagcgcatccttaatataggttatagaggggctatggaattactggacagaatcaccaatacgattctggaagct

SEQ ID NO: 34998 - DNA, 1368 bp, Methanosarcina mazei
atgttagactataccccatgtgaagaagtaaccagagaagcagtaaccattaaccctgcaaaaacctgccagccaataggcgcagtctatgcagcccttggtgtacacaactgcatgccgcacagtcacgggtcccagggatgcctctcctatctgcgtatgtgcttaagcagacactaccgagaagctgccctggcaactactagcagtttttctgaaggaactgccgtattcggaggcgctgcaaaccttaaggaagccctcgtaaacctgactacaatatacaaacctgaagtaatcgccattcataccacttgcgtcgcagaaacaataggggacgacgtaggggtcatcttagaagatgtagaggccgaagaactcatagacccttctattaagatctgtgcagcttctactcctagttacgtgggcacccatattaccggctatgacaatatggtaaagtcctttgtaaccacctttactaaaaagagcaaaccaaacgggaaactaaacataatccccggttttgtagaacctggggacatacgggaaataaaacgcatactctcaataatgggaatttccagcattgtgtttcccgatacgactgatgtctttgatgctcctctgaccggcgaacctggaatgtatccaaaaggtgggactcctataggagatatagaggattctgcaaactcagtcgggacgattgctctctgcaggatggcaggaggctcagctgcaaagatccttgaaggccgctacaaagtcccggcaaaaatagggcctactcccatagggataaggaacaccgaccgtttcgtaatgaacgcggcaaaacttgctaatgtggcaattcctcccgagcttgaagacgagaggggaagacttgtggatatgatgaccgatgcacatccacactaccacggaaaaaaggtagctatttacggagatccggatattcttacaggcttgaccagtcttgtgatggaaatgggcatggagcctgttgtagtacttacaggaaccaagaattcggagtttgaaaaagaagtagaagaactcataggtccagagtacccggaggctgatgtaatttccggaggggacatgtttactcttcaccagataatcaagagaaagcctgtggatcttcttataggcaacacctatgggaaattcatatcaagggcagaggatatacccctggtcagggtaggtttcccgattatggacagggcaaacctgcattacttcccaatcatgggatacgcaggagctgcaagacttgtagagcgtataggaaatatcctgcttgacaggaaagacagagattctcctgattggctgcttgaaaccatcgag

SEQ ID NO: 34999 - DNA, 1431 bp, Methanosarcina mazei
  unsure (1)..(1431): unsure at all n locations
atgcaaattccggaccataaaacaaagattgtctgtaccatangcgccctgcttcctctntccgaagaagtgatcaggaaacttgtgcttgctggcatgaacgtggcaaggatcaatttttcccacgggagcttcgaaagccatagcgaagtaatccagagagtccgtaaggttgcagaggagcttgacaggacagttgcgattcttgccgacctgccaggcccgaagatccgtataggcaaactggaaaaagaaccgatcatgctccataaaggaaactctgtgacccttacggttgccgaaactacaggaaatgagacacgtattcctgtaagctacaagcaacttccggaaagcgtggttccagggagccttatttacttaagtgacggttttatccagcttcgatgcctggaagtttcgggaaaagatgtgctttgtgaggttcttatcggagggcagctctattctcataaagggctaaatctaccaggggcaaagatcttagttgattctgtaactggaaaggatcttgaaattcttgggtttgcccttagtaaagggatcgacactttcagcatttctttcatagaaagtgcggaagatattcgtaatgtccggaattttgctgcagctagaggaaagtctgtatatattgtttctaaaatcgaacgcaggcaagctgtagagaatatccaggacattctaaaagaaaccgatgctctcatgattgccagaggggacctcggggttgaaatacctattcaggaagttccttcagtccagaaggaacttatccatagtgcaaaacttcttggaattccggtaattacagccactcaaatgctggcttcaatgactgataatataaggcctacccgcgcagaagcaaccgatgtagccaacgcaatccttgacggcacagatgcggttatgctttcggaagagacggcagttggtaattatcctgtggaagctgttgaaatgatggcaaaaattgcaaaaaccacagaagactggcgttccgggacaaaatggggactagatgctattatcaagggcataacggcaagagatatgtcagtggatgaggtaataaccctccaggtgcatgaagccttgcaaaagttgccggttgcggccgtactgactcccacgagaagtggagcgaccccccgcaggatctcgcgcttcaagcctgatacctggatccttgctttcagccgtgtcccgagaacctgcggcttcctctctttatcctatggcgtttatcctatcactgtgaatgaaaatattgaaagctgggaaaaagagactactgagaaagccaaagaccttggatttgtaaaaagcggagagattgttattttcacccagggtccatcttcaggaagccccggaggcacaaatatgcttaaaatccttaccctt

SEQ ID NO: 35000 - DNA, 914 bp, Methanosarcina mazei
attccaagtgagatcctgacacacttcgggtcacaagggaagattttgaaaatgcccttaaagacgtccagccgtctgctataagagaaatccttatcgagattccgaatgtgagctgggaagatgtaggcggcctggagggagtaaaacaacttttgaaggaagctgtggaatggccccttaaaagtccggaatcgtacagggatataggagttgaggctcccaaaggagtgcttctatatggtccaccgggaactggaaagactctccttgcaaaagccatcgcccatgagtccgaagctaacttcatcacagcaaaaggaagtgatctgctttccaagtggtacggagagtccgaaaaaaggattgccgaggttttttcacgggcaaggcaggttgctccatctattattttcctggatgaactcgactctcttgcgcctattcgcggggctgccataggtgagccacaggttactgccaggatcctgaatcagcttctttccgagatggatggacttgaggaacttagagctgtagtggtaataggcgcaaccaaccgtcctgatattatagatccagctcttctaaggcctggacgttttgacgagttaattctcgttcctgttccggatgcgggagctcgcaaggaaatttttagggtccataccgcaaaaatgtcgcttgcagaggatgttgatattgacaaactcgtttccatgactgatcagtatacgggtgctgacattgcggctgtgtgcaaaaaggcaggaagagacgcacttcgcgaagaccttcatgctaaagaggtaaagcagaaacatttccttcaagcgattgctgaaaccgggccttcggttactcctgataccatgaaatattaccaggctgtacagagtggcctgagaaaaaga

SEQ ID NO: 35001 - DNA, 2046 bp, Methanosarcina mazei
atggaattgaaatatgtgcccacgacctgtccttactgtgggacaggatgtgggtttaacattgtggtaaaagatgggagggctgcaggcattgagccctggcaccgggctcccgttaatgcaggaaagctctgtcaaaagggcagatacgctcatgagttcatccatagcaaggatagacttgtaaagccgctggtcagggaaaacgggaagcttgtagagacaagttgggaagaagccctggcccttatagcagggaaattcatgacttttctccctgaagaaattgcctgcctctcttcggcaagaacctcgaacgaagaaaactaccttatgcagaaattcgcccgtgctgtccttaagacttctaacgttgaccattgcgcaaggctctgtcattcctctacagtcgctggccttgccgcagtttttggctcgggagccatgacgaattccatcctggacattgaagagtctaaatgcattttcattatcggtagcaataccctcgagcagcatccactcatcggaaggagagtaatgcttgcgaaaaagaagggggccaaaatagtctgtgcagaccctcgttgcacgcccacagcaaaacaggcagacctccatctttctatgtattcaggtacggacgtttctctcctaaatggactcatgcaccatattatagaaaatggctgggaagattcggtatttatctcaaaaaggacaaaaaattatgaggaaatgagatccgtggtcatacaggaggcctattccctgccaaacgtctcaaaaatcacaggggtgccagaaaatgacttaaaaaccgcagccgagtggattgcccaatcaaaaccatcggccctcatttattcaatgggcatcacccaacatacggtgggagttgacaacgtgagatccacggcaaatttaatgcttctaactggaaatctcggagttgccggagggggagtcaaccccctgcggggacaaaataatgtacagggagcatgtgatatgggctgcctgccggatgtgtatcctggataccagaaggttgcagatccggaaaaccacaggaaaatggaatctatctggggggtgagcggacttccgaaagctccagggcttacggttacggagctgatggaacagcttgcagaaggaacatcgactgtgaagtgcatgtatgttatgggagaaaatttcatgctctcggacccggatctaaacaaggtaagaaaagccatgaagcaactggactttctggtcgtgcaggatattttcctgagcgagactgcaaatcttgctgatgttgtcttgcctgcggcctgttatgcagaaaagaacgggacccagaccaatactgaacgtcgagtacagcggattaggaaagccgtagaccctcctggagatgctaaggcagactggcgcatcatctgcgaacttgccgggtgtatggggtacgggcctcaattttcctacatgaacgaagcggagatttttgaggaaatcgcaaaggttaccccccagtatgggggcatgagttatgagcgccttgaaaaacctgactctcttcagtggccctgcccggataaaactcatctaggaactccaatcctgcataccgaaaaattttccacctctgatgggctggcggagttttctggcattgaatggaagcccccagccgaagttccggatgtggaatatcctttcattcttactacaggaaggaacatctggcactggcatacagggactatgactcgcaggtcgaaaacccttgcttccgaagtcagaaccggctgggtggagcttcatccggaagatgcgaaaaagttaggaatccgcaaccgagaaacagtccgcgtactttcccggagagggaagatcgaaatcccttcaatggtcacagaagacataaaacccggggttgtcttcataccttttcattttaaggaatgtgcagccaacctgctgactaacggagctctcgatcccgtggcaaagattccggagtacaaggcatgtgcggtaaaaattgagaaa

SEQ ID NO: 35002 - DNA, 1242 bp, Methanosarcina mazei
aagatccaaaaccccagaagccctgaaattatggataatcgaactgcccgctttttgaaaacccgcttccagaaatattacaaaaatgccgaaataggccttcctgaccacctgcctaacagagaatgggcttttatcttctttgacagtatgcctgataagatgatgcacaggcacaaggccttcggctcacccggagaagctcttgactatctttacggcatggctcctgcgcatgtttacaattcgactgcttattacgaatatcctgatgcgcggaaaatgaatgagaaaaactggctaggggcagaattgatttttgaccttgatgcagaccaccttccagacgccccaaaaaactacgcagatatgctggagcttgtaaagaaggaaactttcaagcttatggatttccttttagaggattttgggttttcggagcaggaaattgaactggtattctccggaggaagagggtatcatttccatgttagaagcccaaaagtcctgaagcttggaagtgctgaaagaagggaaatcgtaaattatctcagcgggagagaccttgatttcaaatatttttttagggaagttgctatggatggagaattcgggaccggttcaaagacatttaaaggaatgaaaaacgtgccttttaaatgcacacttgtgggatatgattcaggctggggaagaagaattgcgctttatcttacggattatatgaaggccgaatgcgggaaaaggtacaaaaaagatatgtttcccgaacttcgcagatatgagaaagtcggggatactacaataaaaaagctaatcagtcttacaaatagcgaaaatggtttaaaggatattcttgagaaaggaaggcttgactttgacgtcagaaactttaaagatattgctgcctattttatgagagagtctgttgaagattttctgcacagatttgggaccagtgttgacgaacccgtgactgcggacatcaaacgtttgatccgggtgcctggctcattgcacggcgggtcagggatgctggtaaagaaacttgccctgtccgagttagagaagtttgacccacttaccgatgctgttgtctttggcgaaaggccggtaaaggtaacagttttaaaacctttttcggtgcaactaaagggcaaggatttaagagtcgaagaaggcatacaggaagttcctgagtatgcggcagtgtacttaatttgtagaggtgttgctgagtat

SEQ ID NO: 35003 - DNA, 963 bp, Methanosarcina mazei
gagatctggattgagaagtacaggcctgtgagactggatcaggtggcggggcaggaagaaacaatcgaacgcctgaagtcttatgttgcaacgaaaaatcttccccatctgctgttttccgggccacctggggtcggaaaaaccgcctctgccgtctcgattgcaagagaaattttcggggaagacctatggcgtgaaaactttaccgagcttaatgcgtcggatgagaggggaattgatgttgtccggacaaaaatcaaaaacttcgcaaaaactgcccctatgggaggagccgaattcaagatcatctttctggatgaagccgacgcactgacttcagatgcccaatctgcactccggcggacaatggagcgtttcagcaataactgccggtttattttatcctgcaattattcttccaggattatcgagcctatccagtcccgctgtgcagttttcaggttcaggagactttccgatgaagctatcaggaaacgccttgagtacatcgctaaagaccaagttttgtccattactgaagacggatatgaagctcttgtttatgtatctcagggagatatgagaaaagccgtgaattctctccaggctgctgctttcgttgagccgaataaatctatatccagagggaccatttacaggactaccgcaaccgcaaatccggaagatatcagaaacctgattgaaactgctctgcgtggtaatttcagggttgctcgaaaggaattgaataggttgctctacgaagaggggctttccggagaagacatagttggacagatttacagggcaatctctgaaatggataaccggatgattctggatcttgggctctctgaaaagcgcattgtcgaactcgtagacataataggtgagattgatttcaggctaactgaaggagcgactgaaaagatccagctcgaagctttactcgcgcattttgcg

SEQ ID NO: 35004 - DNA, 1724 bp, Methanosarcina mazei
gtaaaaattaccgaaaccatcctccgggatgcacatcaatctctactggcaaccagaatgcggacaagagatatgctcgaagtggttgaacaactggaccagatagggtatttttcccttgaaatgtggggaggtgccacctttgacagctgtatccgctaccttaatgaagatccctggcagcgcctgagggatatcaaaaaagaaatgaaagacacctacgctcagatgttgctaaggggccagaaccttgtaggttacaggcactattcggatgatgtggttgagaaattcgttactaagtcttaccaaaacggaattgacattttccggatttttgatgctgttaatgatgtccggaacatggaattctctatcaaagtggcaaaaggtcttggtgcgcacgtacaggggtacggtttttgcttaacacctataaagtcccggtacataccgttgagaaatacgttgaacttgcaaaacagcttgaagaactggagtgcgattccatctgtatcaaagatatggcaggtcttctttctccaaatgatgccacacgtataatcagtgccatgaaaaaagaaatctccattccgatttctctgcactgccactgcacttctggaatggctccaatgagctatatggcagcctgtgaagcaggggtcgatattctagacactgcactttctcccctggcctggggaacttctcagcctccgactgaaacagtcatagccgccctcaaagacactccttacgataccgggctggacctgaatgcttttgaaggagtggttaaatatttcaaaatgttgaaagagaaataccggggcatacttgaccctatttccgaacagatcgatactaacgtgctcatctaccagatcccgggtggaatgctctctaaccttgtatcccaactaaaagaacagaacgctcttgacaagtatgatactgtacttggtgaaatgcccagggttagagaggagcttggatatccgcctcttgtcacccctacaagccagattgtgggcacccaggcggttcttaacgttctaatgggtgaacgctataaagttattcccaaagaggtgaaggattatgtgcgcggcctttacgggcgccctcctgctcctataagcccggaaataataggtaagataatcggggatgaagaacctattcactgccgtcctgccgatcttcttaagcctgaatatgagaaaaggaaaaaggaagccgaggaaatgggtattgctaaatctgaagaagacatacttacctatatcctctatccggctattgctccaaagttcctgaaaggagaaatggaagaagaatctcttgcagtagttgcccctgtccctgaagtgcagcaggaacacaaagttccaactcatttcaaggtcgaagtagacgaagaaatctatgaggtcaggattgaacctcttggtggggaagtttccatatctgaggcttctcccaaaaaatcaagtgctaaatctgtaaaaggagctgtgtgtgtctcaatgcagggcatggttctctctcttaaggtcaaggttgaagatactgttgcagaaggcgatacaatcgctgtcatcgaagctatgaaaatggaaaatgctgttcatgcttctcattcaggtgttgtaagagagatttttgtttccgaaggggacactgtatcccctggtgacataatcatgtcaatcgaataa

SEQ ID NO: 35005 - DNA, 1455 bp, Methanosarcina mazei
atgttcaaaaaagtactcattgcaaaccgcggtgagattgcaatcagggttatgcgtgcatgccgtgaacttgggatttcaacggttgcggtctgttcggaagctgataaaaacgccctctttgccaaatatgcagacgaagcctacctgataggcccggccccttccagccagagctatctgaatatggaagctattcttgcagttgcaaaaaacacaggagctgaagcaattcatccgggctatggtttcctctccgaaaaccctgtctttgcaaaacgctgtgaggaagaaggaatcgtcttcataggccctccaagccatgtgattgccgaaatgggaagcaagatcagggccagaaatcttatggtgaaggctggtgttcctgttgtgcctgggacgaaagacgcagttgaggatccggtcgaggctgtaaaaattgcagaagagatcggctatcctgttttgattaaagcctcggcaggtggcggcggaattgggatgaaagtagttaattccagcgacgaattcgccactgcacttagctctaccaggcaaatggctggttcagcttttggtgactcctcggttttcattgaaaaatatgtcgaggagcccaggcacatagagatccagattctagcagatggatatggaaacacgatttacctttcagatagggaatgctccattcagagacggcatcagaagcttattgaggaagctccttcacctatcatgactcctgaactcagggcaaagatgggagaagccgcagtcagggtagcaaagacaattggttacgtaaatgctgggacagtggagtttctttattcaaagggcaacttctatttccttgaagtcaatactcgcttgcaggtcgaacatgggataactgagatggttacaggtatcgatattgtaagagagcagctcaggatagcctgggggaaaaagcttgagtttaaacaggaagatattgttattgatgggcattctattgagtgcaggatcaacgcagaagatccgttaaacgactttgctccttctcccggaaagatccggggatatcggtcagcaggtgggcctggagtcagggtggacagcggagtacatacaggttacaccatttctccttactacgattcaatgatttcgaaactctgcgtctgggcaaagacaagggatgcagcgattgccaggatggaaagagctctttacgagtatgtggttgttggagtgaaaaccaatatacccttccataaagcagtcatgcgtaatccagtcttccgcaggggcgacctgacaacggcttttatcgaagataataatattatggaagccgttgaagaggttgtcaaagcagatgctgaaaaaggggctactctggcttctgctcttgaagcaaaagacaagaaagttgcggccattacggctgccgtgcatgcctatgtg

SEQ ID NO: 35006 - DNA, 849 bp, Methanosarcina mazei
aaggttaacgagctcaggagcaagatagagaaaagcgaaaggcagttggcatcgatttttaaggaactgaagattaacaggaccgatatcgacgagctgaaagaaaagagagactctctgaaccatcaggttaaggaaagggttgcaaaagcacaggaactaagagacaagcgggatgagattaacaaagaaatcagggagtacaagggaaaaagaagtgatgtaaactcaaagacgcaagaactgttttcaggaattgctggactcaaggaacagcgagataaatacaataaatgttcccacggaagtgtggaatccctcacaaaagcttatgaagccgaacttgatgctttttttaataaagagctgcctcttgcagtggaaataaaaattttccagaaactgaatgacctcaataaacgcttgcaagctgcaaaaaaggcaaatgcactgcatacacaaatccaggaaagttataaagagtcaaaaggaatccataagagaggagatgaactccatgaaaagatccaggccctctcagacgaatctcaaacctgccacctagaaatgctcgaaaattttaagtctgcagacgaaatccgaaaagaagcaaatacatatcatgcccagcttacggataaaatcacaaacataaactcaattaaagaaaaaattgatccgcttaagaccagcattgctaataaccggaaggaactttcctcatatctggacaggttaaaagacctgcagcttacgaaagaagagcataaagtaaaccaaaaacacagcgacgcccgcgaaaaacttcagaaaaatgctcgtatgagccttgaagatcttaagctcctt

SEQ ID NO: 35007 - DNA, 624 bp, Methanosarcina mazei
cgcaggtacctcgtagacaatcttgaggcttacctgctactgaaagataacgttcgcgaggctatgctccgtgtcccaaggcataagtttgttccggaatatgagcaaaaagcagcttatatggacagaccccttgacatcggccacgggcaaacaatctctgccccgcatatggttgcgatgatgtgtgaactccttgaactttcggaagggcataaagtcctggagattggaacaggttcagggtataatgctgcagtgatgggggaactcgtaggaaaaagcgggcacgtgtacacggttgaacgtatagaagtccttgcgaattttgcaagggagaacctgaaaaaagcaggatataacaatgttacagtgctacttgaagacggttcaatgggttattcttagtatgccccttatgacaggatagctgtgacgtgtgcagctccttatatccctgaacctttgctggaacagttgaagcctggaggcataatgctcattcctgtgggagattattttcaagaactttacaaaattaaaaaagacagcaagggacgcatacataaaaagaaaaaaggtgaggtcatttttgtacctcttattggtaaacatggcttccga

SEQ ID NO: 35008 - DNA, 819 bp, Methanosarcina mazei
atgctcaccaaaagaataataccatgccttgatgtgacccttgacagagcaggtggctgtgttgttaagggtgttgagtttgtggacctgaaagaagccggagaccctgtggaacttgccaagcgctataatgaagagggcgcagacgaacttgtttttctggacattacagcttcggctcaaggcaggaaaactatgatcgatgtgatcgaaaggactgcggatgaggttttcattcctcttacgattggaggaggaataaattccattgatgcaattcgtcagattctccgagctggggcagataaggtctcagttaacacctctgctgtcaagaatcctgactttatcaaagagtcctcagatatatttggagcccagtgtatcgtcactgcgattgactgcaggcgaaacactgacataaagaataatcccgacaaaactattctggagcttgaagacggaacacctgcctggtatgaggttgtaatttacggaggcagagaggctacaggaatcgatgccgtgcagtgggcaagaaaagcagaagaattgggttccggagaaatcctgctcacaagcatggaccgggatggcacgtgtgccggttatgacctgccaattacgaaaaagctctctgaagagctcgatatcccgataatagcttcaggaggtgtcggaaaccctcagcacatttacgaaggattttcaattggaaaagccgatgctgcacttgcagcaagtatcttccacttcagagagtactcaattaaggaagtcaaagaataccttagagaccgggaaatccctgtaaggctt

SEQ ID NO: 35009 - DNA, 2523 bp, Methanosarcina mazei
atgacccctgcaatgtgccagtactatgaagccaagcaggcatatcctgacactctgatcttcttccgcatgggagacttttacgaatctttcggagaagacgcaaaaactattgcaaaagaactcgagatcacgcttacagcccgaggaaaggacaaatcaggagagagaatgccgcttgcaggaataccttaccatgcaattgacacctatctgccgaggcttataaataaagggtataaagtggcaatttgcgaacagcttgaagacccgaaaaaggcaaagggaattgtaaaaagaggggttgtcagggttgtcactccaggtacggcaattgactcttccatgttttcagatgcctcaaacaattacctcatggcagttgctgggagagaaattggaaagcctggaaagaatgccgaaaacgaattcgaaattggggtgtcgtttctcgatatttctacaggtgaattccttacaacgcaattcagggactcggaaaattttgaaaagcttctaagcgagctcgctcgcatgcggccgtcagaatgcattcttccttcatctctgtatgaaaatcccgcacttgccgagcggctgagagcccaaactattgtgcaggaatttgcccccgatatttcaggagcaaaggaagctggagaaaggttgaaaaaccatttcagggttgcaacccttgaaggcatgggctgtgagaacctggattttgcagtgtattcggcctgggctgccctggaatatgcacagactacacagatgcgggagcttacccatattaataccctgagaacctactcaaattccgaatttatgatccttgattccgtaactctgcggaatctcgaaattgttaaaaacgtgcgagatgaaggggacgaaaattctctttaccgcattctgaatcatacgaaaacgccaatgggaagccgtgccctgaaaaagtggcttttgaaacctttgctttccgtagaaaaaatcaactatcgactcgatgctgttgaagaactgacagcaaagcctctgctccgttacgatctccggaactggctttcagatgtcagggatatagaacgcctcgtaggcagggtagtctatgggaactcaaacgcaagagaccttgtagccctgaaaaaatcccttgaagctctgcctcctgtccgggattcccttctagaaaacattgaatccacaattttaaatgatattgcagtcggacttgcatcgttttccgaacttgaaaatctggctgaaatgatagatagagcaatcgttgatgagcctccaatctcagttcgggaaggaggcatgataaagtctggatataatgcagaactcgatgaactcaaggatattgcaagcaacagcaggcagtggattgcaaattttcagcagaaggaaagagaaagaagcggcataaagtccctgaaagtgggatataataagatttttgggtattacatagaagtaacaaatgccaacagcagccaggtgcctgaggattatatcagaaagcaaaccatggcaaatgccgagcgcttttttacccctgaactcaaggaaaaagagagccttatcctgacagccaatgaaaaagctatagctctcgagtatgaaatctttacagaaattttgcagaccctttcagcccattcaagagaacttcaggaaaccgccgaaagaataggcacgcttgatgtccttacagacctggctgaagtagcagaaaataacaattatatcaggccccagcttacagacgactgcaagattcttatccgggacgggaggcatccggtagttgaaaacaccgtacatggcggctttgtcccgaacgataccgaaatggactgcaaggaaaatcagtttttgctggtaacaggcccgaatatggcaggtaagtccacttacatgcgtcagactgcccttatagctattatggctcaggtaggttcttttgttcctgcatcctatgcttcaatagggattattgatcaggtctttacaagaattggggcatttgacgaccttgcaagtgggcagagtacctttatggtagaaatggttgagcttgccaatatcctgaataatgcaagcccgagaagtcttgtgcttcttgatgagatcggcaggggaacaagtacctatgatgggtacagcattgcaaaagctgttgtggaattcctgcataacagggggaaagtaggagtaagggctctatttgcaactcattaccaccagctcacagcccttgaagagaaattaaaaagagtcaaaaattatcatgttgcggtaaaagaagaaggtcatgagttagttttcctgcgaaagatcgtgccgggtgcaacagacaggagttatggaatccaggttgcaaggcttgcaggcgttccggaaaaggtaattgaaagggcaaatgagattcttaaggaactcgaaagagagaacgtgctcgaagaggttgaagacagcaagaacggaaaaaagagaaaaagtaaggctacagcg

SEQ ID NO: 35010 - DNA, 2001 bp, Methanosarcina mazei
aacaaaatagcggccggagaggtaattgaacgccctgcatccgtagtaaaagagctgatagacaactcaatcgatgcaggagctacggacatccgcatcgaagtcgaaaagggtggaaaacgctccattcttgtccgggacaacggatgtggaatggacagagaagatgccctgcttgcatataaaaagcatgcaactagcaagctcacaaggattgaagatcttaatactatttctacaatgggtttcaggggagaggctctttcgtctatcacagcggttgcaaaggtggagattcttaccaggcccccagaagaaattacaggtaccaggatagtgatccatgggggaaaagttctggaaacttcagctgcaggcacgactccgggtacgtctgtgaatgtaaaagacctgttttacaacatcccggcaaggcagaaatacctcaaaagcgaccgtaccgagcttgcccatattacagatacggtaatgcagcttgctctggcaaatccgcatatttcctttactctgctcagtgaagaaaagccagtcataagaaatgcaggctcaagcgagtctttcaaaagtattgtaaatcttctgggcccggatacggctcgttcaatgcttcccctggagtacaggaccgaagattttgaaatttttggatacatctcaaagcctgaaaccactcgacgagaaagcgaccagattttcctgttcgtaaatactcgcccggtaacctcaaggtccattaataaagctattcgcgaaggatattataccaaaattccgaaagagcgctatcctgtagcagtgctctctcttattgtcaatcccggggaagtggacgttaatgtacatccccgaaaagctgaggttcgtttcagccgggagaaagagcttggggatgcggtcacatctgcaatagaaaaagtactctccgaaaatgctctggctcctgaaattcgggaaaaaagagaccgagtttttcagaaaaccttcgatgtttcaggttctccaggtagattacaggtctctgaagctgcggaaatttttggaaggaaagagattggaaaggataccaggattccgaagaccggaattctggaaactggacttcctgaaagaagcaaagttatgagaaataaggctgagacctatgtttatccggtaaaagataccgaaaggaggctaaaacgttccgagcgccttctggactttaccacagagggagaaacgcaggaaacaggtgataaaaagctggataataaaatcgagcaggaaagagagaaagaaggagaacgtaaaaagagaataacaggtattcaagagaatggaattgaaaaagcaggctcggaagaacagaaatttgagggtataaatgccgaaaagatgcaaaagtctatacaaaaaccgaatacggattctttcgaaaacttgaggattatcgggcaggtatctaagctgtatatccttgccgaaaggggagaagaccttgtgcttatcgaccagcatgctgctcatgagagaattctttacgagcaggttttaaaaatgaaaaagtccagggtgcaggagttgatcacacctgtaaccatagaccttacacctaaagaaaaagtgcttatggaagagtatattccttatctggaagatttcggtttcgggatttcagaatttggggacaatacatacgtagtcaccttcgtacctgaggtattcggacggcttgaagaccccgaggttatccacgacatagtttcggaccttttagcttcaggaaaagttaaaaaagatacaggaatctcggaaaagatctgcaagaccctcgcatgcagagctgcaatcaaaggtggagctgcctgcagccccagacagatggaagagctaatagagcagcttaagaaagctgaaaatccttactcctgtccacatggcaggcccactgtgatcacatttacgaaaggggaactagaccgcatgtttgcaagaatccaa

SEQ ID NO: 35011 - DNA, 1020 bp, Methanosarcina mazei
gatctctggactttaaaatacagggcaggtaccctgaaggaaatgcttggaaacgagcatgctgtagctacgctttccgaacttgcccagtccgggactcttccccatcttattttctacggccctgaaaattccggaaaaacaacagcagctcttgctcttgccagacaactctatgggcgtacctggaaaaacaattttgcatacttcaatgcttctgatttttttgaccagggaaagcgctatctcgtccgagacaagcgtttcgtgcgttttctgggcaccgatgacccaaagaaaatctataaaagtgtaatcgatattttcaaggaaattatcaatgagtatgctggaatagcttcgcttgatgccgattataaattgatttatattgacaatgctgagtccctgaattctgatgcgcaacatgctctaaggcgaattatggaaaagtacagtgcaacatgcaggtttattctttccactaccaaaccttccaaacttattgctccgcttcgctcaagaggtcttcaaatttttttcacatatgttccagactcggttttgaaaactcatcttaagaaaatcggatgtgctgaaaagttgcagctttcggaaggtgcatttgatgcaatcctttattctgcaaagggaaatgttgcaaaggcggtgcagactctacagcttgcttctttagttgcacatggttcagtcattactgaagagatggtgtatgaggctactctgggcagggatgaaaatattgacaatttgctttctgcggctcttgctggagattttcctcgaggaaggaagctcctcgatgagatgatagttgggaaagggcttttaggggttgagattcttgaagggctttccgaagctctcgcagattcgggagaaacggatacagacattgctcggattattgtgaaaatttccgaagtcgatgcccgtcttaaggatgctgccaatgagaaaattcagcttgagaaactgatctcttctctttcctaattt

SEQ ID NO: 35012 - DNA, 882 bp, Methanosarcina mazei
atcatggaactgaagagagagaacgtgcttattgaagctctgccttatatgcaggagttctatgactcaatcatggttataaaagtgggcggaaatgcaatggttagcgcccagatcatggaggatattataaaagatattgtgctcctgcgctatgtaggaatcaaacctgttattgtacacggaggtgggcctgagattacggaaaaaatggggcggatgggcaagaaagctgagtttttccagggcttacgtattacagatgacgagacaatggagattgccaagatggtgcttgtcgggaacattaataccaaaattgtatctcttattggagtttgcggagggaaaggcattggacttactggatacgatggaagaatgatccttggtcataagcaagctgcaaaaaaggtattgattaacggtattgagactgaagttgatatcggctgggttggggagtgtgaggtaattaatcctgatattctccatatagtactcgaaaacggttacattccggtcatttctcctattgctgtggatgcaaaaggcaatgccctgaatattaatgccgatatagtagcaggtgacatcgctgcagctttgcatgctaaaaagctcattctgatgactgatgtttcagggttactgagagatatgaatgaccccaatagccatatctcccgtgtaactctggaagatatcgatcatcttatcgctgaaggcgttatacagggaggtatgatcccaaaactcaaaggcgcagcagttgcagtaaaaaacggggttgaaaaggctcatataataaatggaagcgtttctcactccatgcttcttgaactctttactgatcgcggaatcggaaccatggtctataag

SEQ ID NO: 35013 - DNA, 1266 bp, Methanosarcina mazei
atggcagctgataaaccgcacatgaacttagcagtgattggtcacattgaccacggaaaatcaacatttgtaggacgcttaatgtacgatgcaggagctgtacctgcacacgttatcgagaagtataaggaagaagcaaagcagaagggcaaggaatccttcgccttcgcatgggttatggactctcttaaggaagagcgtgaaagaggtatcacaattgacatcgctcacaagagattcgacacagacaagtactatttcacagtagtagactgtccaggccaccgtgacttcgtaaagaacatgatcacaggtgcttcccaggctgacgctgctgtccttgttgttgcagctcctgatggtgtaatggcccagaccaaggaacacattttcctttccagaacccttggcatcaaccagcttattgttgcaatcaacaagatggatgcagttgaatacagcgagaagagatacaaggaagttgtcgagcaggtctctggtatccttaagatgatcgggttcaagccaggcgacattccatttgtcccaacctctgcattctacggtgacaatgttgtgaaccacagtgagaagaccccatggtacaagggagtgactatgatggaagctcttaacaacctcaaagtaccagaaaaaccatccacccttcctctcaggatccctgtggaagatgcatacacaatttccggtattggaaccgtgcctgtaggcagagtcgaaaccggtaccatgaagaagggcgacaaggtagtcttcatgccaggcggagcagccggtgaagtaaaatccattgagatgcaccatgaagaaattccacaggctcttccaggagacaacattggctggaacgttcgtggtatcggcaaggctgatgtccgcagaggagacgtttgtggccatactgacaacccaccaaaagtagctgatacgtttgtaggacagattgtcgttctgcagcacccctcagcaatcactgccggatacactcctgtcttccacgcccacacttcccagatcgcatgccagctgatcgagcttaacaagaagctggacccgaagagcgggcaggtaaaggaagaaaacccgaccttccttaaggccggagatgcagcaatcgttaccatcaaaccaacaaagccgatggttatcgagccagtaaaagaaattccacagctcggcaggtttgctatccgtgatatgggtatgaccattgccgccggcatgtgtatgagtgttaaacagaag

SEQ ID NO: 35014 - DNA, 3443 bp, Methanosarcina mazei
gcttattttacacgggacaagatagtgcagcaccatatagactcgtttaacaagtttatagactacgggctgcaaaaaatcatagatgaacagaaaataatagaaaccgatatcgaggatacctacctcaaacttggaaaaattcgggtagagcatcctgtggtaaaggaagctgacggggcaatcgaaaaactttatcccaacgaggcaaggctcaggaacctctcatactcaggccctctctacctcgaaatgagcgtggtaaaagagggaattgagtccgaaccaatggaagcaaaaataggacagctccctataatggtcaaatctaagatctgtaaccttccaggacttagcgaaaccgaaaaagttcgctatggggaagatccacttgaccctgggggatatttcattatcggcggcaccgaaagggtggttatgaccctagaagatctcgctcctaacaaaattcttgtagagtatggggagaggtacggcgacactatagaagttgcaaaggttttctcacagaaacgcggatacagagctctagtaatcgtagaaagaggaagaaagtctctgctcgaggtttctttcccgtcgatttcaggccgagtattcttcattactcttatgagagctcttgggattgtaactgacgaagatattgtaaatgcagtttcaagtgatcccgaaattataaagttcatgctggaaaaccttgaagaagccgaagtcgaaacccaggacgaagcaatcgagaaaatcggggcccgggtcgctgcaggccaggctaaggaataccagataaaaagagcaaactatgttattgacaggtacctgtttccccatcttggaaacgacatgaaagacagaatctccaaggctcacttcctggcaagaatggctgagtcctgtttcgagctggccctgggcaagcgttcggaagatgataaagaccactatgcaaacaaaagactgaaactagctggagacctgatggaagacctcttcagggtatctttcaacaggcttgcaagagacataaaataccagctcgaacgcgcaaacatgagaaacagggagttaaatgtcgcaacaatagtcagggccgatgtgttaactgaccgcctgcagcacccactggcaactggaaactgggttggaggaagaacaggtgtgtcccaactccttgacagaaacgactatatctccacgctttctcatctgcgccgggtaatttcacctctttcacgagctcagcctcactttgaggcccgagacctgcatgcaacccagtggggaaggctttgcccttcggaaactcctgaaggtccaaactgtggtctggtgaaaaactttgccgagatggttgaactttcaacaggtatagaagatatcgatgggattaagaaaatcctccatgacctgaacgtcgagcgcgtggttgtaaaggtaccggaactcccgtccaaaatgaaagaaacattacttgatgagttcggagaagagattgttgaagaatacgaagagccttcggaaagcgaaagcaaattcaaagatgatgagttttacgattactcagatatggacgattccggatcaatgttcggtgattgagggggcgatgtcagatgactaaagcaaaagtattcataaacggggagcttgtcgggacccacgataaccctgcggagcttgtagacgagctcagaaagatgaggcggcagggtttcatatccagacaggttaatgtcgctcttaatagcaacacaagagaagtaattataaactccgatatgggccgagcaagaaggccacttatagttgtggagaacggagctcccagggtaaccgaagagcacgtagagaaaattaagaacaaggaaatcacctttgatgacctggtaaaagaaggctgtatagagtatctcgatgccgaagaagaagaaaacgcctacatcgcactctatgaagctgaccttaattcaaagcacactcacatggagattgatcctgaacttattcttgggatctctacgggaatggtgccttatcctgaacataatgcatctccgcgtaacaccatgggtgcagccatgatcaaacagtgtattggggttgcaaccgcaaaccagaagctcagacctgatacccgggcccatgtccttcactaccctcagagggcaatgaccagaaccagaacctcggaagcaataggttttgacgacagacctgcgggacagaacttcgtggtcgcgattctctcttatgaagggtataatattgaagatgccctgattttcaataaaggctcaattgaaagaggcctcgggagaagtcactttctcagaactttcgaaggggaagaacgaaggtatccgggtggacaggaagataagttcgagattcctgactccgaataccgtggagcgcgtagtgcagaagcctatgcaaacctggatacagacgggcttgtaaatcccgaaaccccggttggccccaatgatgtacttatcggaaaaaccagtccaccaaggttccttgaagaaccgtcagacttcgggatttcagtcgagcagaggagagaaagctcgatcacaatgcggtcaaatgaaaccggaattgttgacactgtaattctgaccgaatccattaatggaaccaggcttgccaaagtaaaggtaagagatgaaaggattcctgacataggggacaaattcgcttcaaggcatgggcaaaaaggagttatcggcctgaaagtcccgattgcagatatgccgtttacggaatccggcctgactccggacctgatgatcaacccacatgcaattccttcccgtatgactgtaggtcacgtcctggaaatgattggcggaaaggtaggttccatggaaggcagacgagttaatgcaacagctttctcaggagaaaacgaagaagacctcagagaagctctgaagaggcatgggtttgctcataccggaaaagaggtcttctacgacggagctaccggcaagatgatccctgcagatgtctttgttggggttattctctaccagaaactgcaccacatggtcacttcgaagatgcacgcacggtctcgtgggcctgtacaggtacttacccgccagccaaccgaaggccgagccagagaaggtggtctcagattcggagaaatggagcgtgatgtgctggtaggacacggagctgccatgtcgctaaaagagaggctgctcgacgagtcagataaggttgttgaacttgtctgttctcactgtggaatgattgcaacgtatgacaagcagcgaaatgtcgctttctgctcaacctgcggggctgacacggatatatacccagtggagatgagctatgcattcaagctgctgctggacgaaatcaaatccctgggagttgcgcccaggcttaaacttgaagatgcg

SEQ ID NO: 35015 - DNA, 2743 bp, Methanosarcina mazei
gagtttcttcaaaagttaaacgttgacgaaaatggactgagtgagcaggaagctaccagtcggctcaaagaatgtggagacaatgttcttgaagaaacagggaaagagagcataataaataagtatctcaggcagttccggaatttattctctatcctgttaactgtgggatcaattctgtctttcgttggagaataccttgatccagggcagggaaacctgtatataggaattgctcttgcaggcgttgtaatcatcaatgggacctttacattcatacaggagtaccaggctgaaaaaaccatggaaagttttcgtcagcttcttcctccccatgccagggtactgagagaaggaaaggtaaaagatattctggcatcggagcttgttgtaggagacgtcatccttcttgaggaaggagataaggttcctgccgatgggcgtttggttgaaattaataccctgaaagtggacaactcggctattactggcgaatctgagccccagcttcggtcacttgaatgcactcacccaaatatgctggagtgcaggaacatggttttttcagggactctgatacagagtgggaatggaaaagctgttaccttcgccactggacaaaatactcagatcggaagccttgcaacactcacacaacaaacttcaggcgtggatactcccattcgaagagaaataaattacttcataaaagtcatatctacaattgcgatttcccctgggaatagtcttctttatacttgcttttcttcttcaagatgtttttcttgcaagtttgatctttgcgattggaattattgttgccaatgtgcctgaagggcttttgcctacagttactcttgcccttagccttgcttccaagcgaatggcctctcggaatgcccttataaaacagcttgagtccgtagaaactcttggctcgacaacggttatctgtacggataaaaccggtacccttactcagaataagatggcagtaaactctatcatgatcggttttgaatgtcttgttatcgaaaaccctgccagcactaaaaaaacaaccacagagcaggatatcatcgaaagtacaaacaaagcagatatggaaaaacttacagattcaaggacagaaggattctgtgctctaaaaaaacctatctgggaccctgaaaaattgccatctgttttcataagagttgcagggctatgtaataatgcaaaacttcgcgagtctgccccgggatatactggtgatcctaccgaaggggcacttctcgtttttgcaaatggcctggaagatataggaaagctcaagaatgattaccctaggctggaagaatttccttttgattcgcttacgaaaagaatggaagttatctgccgtactcctgaaggaaaacttgaagtttatctcaagggggccccggaagtagttgtgaaaatgtgcagttcatccctagattcaagaggaatccggaaactggatgaaactgagcaacaaaaacttcttgaccggcacctgggccttgcaaaaaaaggagaacgaattatagcccttgcgtacaggcagatagaagatataaatgaatatactggggattttatcttcttaggatttataggaattgtagatcctcctcgccctgaagccagagaagctattgcaaagtgccatacagccgggatcaaggttgtcatgatcacaggtgatcacccggtcacggcagaatcaatagcaaaggacgtggggcttgcaaactcaggaaaccttgagatcattaccggaaatgagctggcaacgttatcacgcgcagaccttgcttcaagattaaaaaatccgagcattgtttttgcccgcacttctcctgtacaaaaactaaaaatcgtacagctctttcaggccgaaggggaaatagtgaccatgacaggagatggggtcaatgatgctcctgcaatcaagaatgcagatatgggcgttgctatgggcagtggcacggatgtggcgcgcgaagctgcggatatggtacttcttgatgacaatttcgctacgattgtgaatgctgtagaagagggcaggacggttttcgataatattaaaaaattcatcgcatacattcttgccagcaatattcctgagatcctgcctttcatagccttcgtcctctttgccctgccccttcccatgcctgtacagcttattctggcaatcgacctgggcacggatatgctgcctgcgattgccctgggaaaagaaaaaggtgaaggagatattatgaaaagacctcccagagcgagagaagaaaagcttttgactcctccactacttttcacagcttatgcagtaaagggtcctgtagaagctatcgcaggctttttctgctattttgctgtcctttttgaggggggttggagttttggcgagcagcttgcaaacaacaatcccctttacatgcagtcaataaccgctttcttttcagcagtgattatatgccagattgctaatgtttttgcttcccgaactcgttatcagtcagtcttctcaatgggtttatttagtaatcgtactgttctggtaggaattgcaagtgaactcctaattctggcatttattatctggaatccatcggcaaatcttattttcaatacgtctccccttgacctcagatatttgctaattgcagttccctttgcgattttattgcttggaatcgatgagttaagaaaatatctgttgagaaggaat

SEQ ID NO: 35016 - DNA, 1017 bp, Methanosarcina mazei
atgagcgaatttacacttaaaacgagactcttagctgcccttgaaggcaagcccgttgacaaagtacctgtctgctccgtaacccagaccgggattgtagaacttatggataaagttggagctgcctggcctgaagctcacaccaatcccgaacttatggcaaaactggcaattgctaactatgaacttagtggacttgaagctgtaaggcttccctactgtcttaccgttcttggtgaagcaatgggctgtgaaatcaacatgggtaccaagaacaggcagccgtctgtcaccgctagcccctaccccaaaaacctcgatggcgcagtcgtccctgcagatctcctgcagagaaacagaattccagccgtgctcgaagccattaaaattgtcagggaaaaagtaggacctgatgtaccaattatcggaggtatggaaggcccggttacactagcttccgacctgataagtgtaaaatccttcatgaaatggtccattaaaaaaactgacctcttcgaacaggctcttgatatctccgcagaagctgcaatcgcctatgcaaacgcaatggtcgaagctggtgcagatgttatcgctattgcagaccctgtcgcttctcctgacctcatgagcccggaaacatttaaacagttcctccagtcaagattacagaagttttccgctggtgttaactccgtgactgtactccacatctgtggtaaggttaacgcgatcctcagcgacatggcagactgcggttttgaaggactcagcgtcgaagaaaagatcggtaccgcagcggaaggaaagaaaatcattggagacagagcaagattagtaggaaatatttccagtccttttaccctgctgcctggacctattgataagataaaagctgaagcaaaagtagctcttgaaggcggcatagatgtgcttgcacctggctgtgggattgcacccatgactcctctcgaaaatgtcaaagctttggtcgcagcaagagacgagtactacgcc

SEQ ID NO: 35017 - DNA, 551 bp, Methanosarcina mazei
gagtatacaataactgtagagaatgtggtagcatccaccacccttgcggaagatttcgatctacaaaagatagaagtccagacttgagcaaagcagaatataataaagcgaagtttcctggcctggtctacagaactgagaatccaaaggctgcttttctgattttcacctccggaaaagtggtatgtaccggagcgaagaccgtcgataacgctaagatggccataatcaatctggctagcacgctcaagtccattggctgcgagaaaataaatccagaacctgatgttcatattcagaacattgtagccaccgctgatttggaaacgaacctgaacctgaataccattgttatagcctttggtatggagaacgtagaatatgaaccagaggtatttcctgggctcgtctataggcttgaggatcccagggtagtggtgctcatattcagctctggcaaactggtgatcacaggcggcaaatctccagaggattgcgaggagggcctgcgggtcataaagaaagagtttgataacttaggacttctttat

SEQ ID NO: 35018 - DNA, 1368 bp, Methanosarcina mazei
cgaaaagaaagcgattctttaggggaagttgaggttccagccgaccattactggggggctcagacccagaggtctctgattcacttctccatcggtgacgactacatgccaaaggaggtctattacgcttatgggtatgtgaaaaaggcatctgctctggtcaacgaagccgccggaataataccgccgtggaaagctgaattgatagcaagagttgcagatgaagttattgcaggtaaactcgacagcgaattcccgctctatgtctggcagactggctcaggcactcagtcgaatatgaacgtgaatgaagtcatcagcaatcgcgccatccagctcgtgggtggaagcctcggcagcaagtaccctgtccatcctaatgacgatgttaatatgagtcagtcgtctaacgacacctttcccacggccatgcacattgcaactgtgctcgaattcagcaaccgcctcattcccgcagctaccgctcttgaagagtcaatatgggctaaagcacgggaatgggtggatatcatcaagatcggtcgaacacatcttcaggacgcaacaccacttacagtgggtcaggagtggtctggctatgccacacaactcaatgacgcgctggcgtttgttaaacaatctctccagggattatatcggttggccatcggaggcactgcggtaggaactggcatcaataccccaccagacttcggtgaaaaggttgcaggtgagatttccaggctcacaggtcatccattcgttacagctccaaataaattcgcagctcagggctcccttgatgcaatggtaaactcaagcgcagccttgcgtgcattagcagtagcactgatgaagatcgcaaatgacctgcgatggcttggttcgggaccgaggtcggggatccacgagcttatcctccccagtaacgagcctggcagcgcgatcatgcctgggaaagtcaatccgactcaggaggaagccatgctaatggtttgcatccaggtaattggtgaagacaatgccgtcgcatttgccgggttacagggaaacttcgagcttaacgcaatgtgcccgataatcataaataatgtcttacattctgcacgtattctcggtgatgcttgcgtaaagttctgtgagtacggaatcaaggaaatcatgctcgaccggagtcgtatagacaaatttgtggacgactccctcatgttagtgacagcacttagccctgttataggctacgacaaggcttccgcaattacccagcgagcactggacgagaatactacactgagggaagctgcagtgaaaggaggtttcatcagcgcgaaggattttgacagaattgtggatccaaagaagatggta

SEQ ID NO: 35019 - DNA, 2619 bp, Methanosarcina mazei
aagttcgtatatttttttggaaaggatgtaactgatggcaaagctagcatgagagacttacttggaggtaagggcgcaggcctagccgaaatggcaaacctcggaattcccgtaccaccaggttttacgataacaactgaagtttgcgtactttatctgaaaggtaagaagtattctgaagaagtactcaaacaggttgaagaagcgatcgataagctcgagaccttaaacaacaaaaagttgggggacccagaagatccactgcttgtttctgtaaggtccggtgccagggtgtccatgccggggatgatggataccgttcttaaccttgggctcacggacaaatctgttcttggactcgcaaataaggtcaatgacgaaaggttcgcttacgattgttaccgcagatttatctctatgtttggagacgtagttctaggaattgacttcgacaagttcgagtcccttattgaggataagaaaaaagaacttaaagtcgagtctgacaccgatctcgatgcaaaagcactgaaagatctggctgaaaggttcaagggagtaatcaaactcgaaaaaggatttgagttcccccaggacccgaaggtccagcttcagatggcaattgatgctgtttttgattcctggaacaatccaagagccatcacatacagaaagcttaacgaaatcgatgacagctggggcacagctgtcaatgtacagaccatggtttacgggaacagaggaaatacctcaggcacaggagttgcttttacaagaaacccgtctacaggagaaaggaaattcttcggagagtaccttatcaacgcacagggcgaagatgttgttgcaggcatccgaactcctgactttattgatactcttgggaataagattcctgaagcctataatcagcttgttgatatctgtaggaagctcgaagcccacttcaaagatatgcaggacatagagtttactatccaggaaggaaaactctacatgctgcagaccagaacaggaaaacgtacagctgccgcagccgtaaagttagcaactgacatggtagcagaagggttgattgataaggaaaccgcagtcacaagggttaaagccgaacacatcgacctgctcctgcaccccagaattgaccccaatgcaaaactggaagtagtcgcaaagggacttcctgcatcacccggagctgctgtaggaaaagttgtatttactgccgaagtagccgaggaaatggctgagaagggagaaaagacaattcttgtcaggaccgaaacttcccctgaagacatcggaggaatggcagctgcccagggtgtcatcaccgtacgtgggggaatgacctctcacgcagcagtcgttggaagaggtatgggaaagccttgtgttgtgggttgtggagacatatccatcgatacaaagagcaacctctttatggtaaatggttacactgtcaaggagcatgattatgttaccattgatggaagcacaggcagtgtaattatcgggaaagtagagctgattgatgctgaaattaatgaggatctaaagaagattcttcagtgggccgacgagatcaggactctcggagtaagaacaaatgcagataatccggcagatgcaggtctagcccgtgaactaggggctgaaggtataggactttgcagaactgaacatatgttcttaggagaagaaaggattcccgtagtaagggaaatgatcatggccgaagatgagaagtccaggaggaaagcccttaaaaagttacttcctatgcagaaagaagacttccttggaatcttccgcagcatggaaggcctgcctgttactatcaggctgcttgacccaccacttcatgagttccttcctgacaaggaagagcttgacgcaaagctcagggaactcgaagcctcaggagattcttccggaaagatcaacgaggtaaagaaggtcattcagcgtgtggtttccctcaaagaaataaaccctatgcttggtcacaggggatgcaggcttggaatcacctatccggaaatctatgatatgcaggtacgcgcaatcatggaagcagcctgtgaacttacaaacgagggaatgaagattactcctgaaattatgattcctctcgtgggtcttgtaaaagagcttgccattacaagggaagaagtctgcaagatggcagaggcagtcatggctgagaaaggcgtaaagatcgattacaaagtaggaacaatgatcgaactgcccagagccgcaattgtcgcagaccagattgctcaggaagccgatttcttctccttcgggacaaacgacctgacccagacaaccttcgggttcagccgtgacgatgtgtccaaattcgtgcctatctaccagaaagcaggaattattgagcacgatccgtttgcagtcctggatcaggaaggcgttggcgagatcatgaaaatcggtatatcaaaaggtcgctctgtcaaacccgacctcaaaatgggaatctgtggagaacacggcggagagccaaggtccattcacttcgcctatgatataggtcttaactatgtaagctgctctccttacagagttccgattgcaagactcgtagctgcccag

SEQ ID NO: 35020 - DNA, 972 bp, Methanosarcina mazei
gaaagagaaaaaatacgtgccatgatcaaagctcgcaaagagaaacaaaaggagcaaagttttgagaaagaaaaggccgtgtgtccagaatgcggcagcagaaacctcgtccacgactatgagcgagccgaactcgtgtgtggggactgcggacttgtcattgatgccgattttgtggatgaaggcccagaatggcgagctttcgatcatgatcaacgtatgaagcgttcccgtgtgggtgcgcccatgacatacacaatccacgacaaagggctttccacaatgattgactggaggaaccgcgactcctatggaaagtcaatatcttccaaaaatcgtgctcagctttatcgtttaagaaaatggcagcgtagaatccgtgtaagtaacgcaactgaaagaaaccttgcatttgcactatctgaactggacagaatggcttcggctctcggtcttccgagaactgtgcgggaaaccgcagctgtcgtctacagaaaagctgtggacaagaaccttatccgtggaagaagcattgaaggtgttgccgcagccgctctttatgctgcttgccgccagtgtagcgtcccaagaactcttgatgaaatcgaagaggtatccagggtcagccggaaagaaatcggaagaacttaccgttttatttccagagaactcgcactaaagctcatgcccacgtctcctatagactatgtcccaaggttctgttcaggccttaatcttaaaggagaagtccagtcaaagagcgttgagatcctgaggcaggcttccgaaaaggaactcacaagcgggagaggtcccacaggagttgctgccgctgcaatttatattgcttccattctctgcggtgaacggagaactcagcgggaagttgcagatgtagccggggttacggaagtcactatccgaaacagatacaaagagcttgcagaagagctggatatagagattattctc

SEQ ID NO: 35021 - DNA, 2109 bp, Methanosarcina mazei
atgcggtattttacgaaacagagttgctaccctaaccaggcagaagccatggagaagatccactcggctctcctgaacgaaaaaaccgtactctttgaaggagcatgtggaacaggcaagactttaagtgcacttgctcctgcactgagtgtggggaaaaaactcaataaggtcgttattatagtcactaatgtccatcagcagatggttcaatttataaatgaggcaagagagatttcccgggataacgacataaaaacaattgttttcaagggcaaggcttcgatgtgccccaaaaatctcgattacgaagaatgcaggctcaaaggagaaaatacctatgacctccttgaccttgagcgggaaatttcttcaaaagaaaaagagctcaaggatgcctatgagaaatacaaacgaacaaaagatcctgctctttattccctgagaactgagcttgaaaaagaactcgaagaaactaagaaaaaatctcgggctttgaggaataattcctgcctggagttatatgaagtcctgaaatttgaaggtaacgaattttccaactggcttttttccgacgtaagaagcccggaagaaatcctggagtatgccgaagaccgggatatgtgcgggtatgaactgctgaaaaaagaactcaaaaacgccgaacttctaatctgcaattttcatcatgtccttagtgccgaaattttcatgatgctgcttaaatggcttgaacgagatcctgaagatgttattctgatttttgacgaagcacataatattgaggcatctgcccgttcccactcttcaacaatgctctcggaactgactattgaaaaagctctttcggaagtaggtgagactcctgaatctgacaattcccttatgttaggaaaagaaactgactcaggaggtggcattccccttgaccaggactatgcggctagactatatgcaaaaaagctgtttacctgcctccttaccgctctcagggatacatatgctgcaaaattgaagttcggggaaagaaacaggcttggaaaacactggcaggacattaagatcagcgacccttatgagcgctttgacatcctgaaagctcgctttttgcgagaagcgatgaaggaaggctttgcagatgaagaaaaagtcctcacaaggctgcgggagattggcgagtttggaggaaggctggaagagatttatgcggaaaattacaaaaaagggcttcttgcagttccgaaacgttcccagatccggtatgttgcagactttttatcctcttacctcgtactttcggacaggcaaaactactatccaattctgaatgtgcgcagagatttcaaaagcgatagaatagccggcaggattgagcttttcacatgcattcctaaaaacgtgactcagcctctgtttgattccatttatgcagcagtactcatgtcagctacactccgacccttcgaaatgataaaatccacgcttggcatctcaagggaagtggaagagatttcctatagtacgacctttcccagggaaaggaggcttacacttgcggtttccattcctccgctttttgcaaagaaccgtgacagcccggaaacgcttgagagcattaaagaagccctgcttgcagctactgttgcatcgccaggaaacgtgattatttacttccagagctatgctgaagcactccgctatactaaactccttgaacctgaactttctattcctattttccttgatgagacaggggtttcagcccaggaaatccgaaagaagtttttcaaaatcggagagcagggaggaaaagccttacttataacctatctctggggaacattgagtgaaggtgttgatttcagagattccaggggcaggaccgtgattatagtgggaatcggatatccggccctaaatgaccgaatcaaggctgtcgaatctgcttatgatgaagttttcggctgtggtgaaggctgggagtttgcagttcaggtgcctacaatcaggaaggtcagacaggcaatgggaaggatagtgcgttctccagacgactatggagtaagaattctccttgattctcgctaccagggctctcaggtacgtaaa

SEQ ID NO: 35022 - DNA, 961 bp, Methanosarcina mazei
gatgttgcaacaaccctaaacaacctcgcaggactttattatcatatgggcgcttacgacaaagcacttccactttatcaaagggcgcttgaaatctataaagaggtgccggaatctgaacacccagatgttgcaaattcactaaacaatctcgcagaactctaccgtcgtatgggcgcttacgacaaagcactcccactttatcaaagggcacttggtattcgtgaaaacattctaggttcccaacacctagatgttgcaaattcactaaacaatttcgcagtgctctatgaaagtatgggagaatacgacaaagcactcccactttatcaaagggcacttggtattcgtgaaaatgttttaggtttccaacacccgtctgttgcaacaaccctagacaatcttgcagtactctattatcgtatgggcgcttacgacaaagcactcccactttatcaaagggcacttgaaatctatgaaaaggttctgggttcagaccaccctgatgttgcaacaaccctaaacaatctcgcagaactctatcatcatacgggagcttatgaaaaatcactcccactttttcaaagagcattagaaatagtcgaaaagacactgggacctgaacatccagatgtcgctacaatcctaaacaacctcgcaggactccatgaaagtatgggagaatacaacaaagcactcccactttatcaaagagcacttgacactcgtgaaaaggtgcttgatccgcaacacccatctgttgcaacaacactaaacaatctcgcaggactctatcgtcagatgggagaatacgaaaaagcactcccactttctcaaagggcacttgaaataatagaaaagaaattggaaccgaagcatcctaatacagtaacaataaaaaacaattataatttccttctttcagagatgagtgaaggagatgaagaaaaatgatttttga

SEQ ID NO: 35023 - DNA, 1285 bp, Methanosarcina mazei
atgaaaatttccgttatagggtcaggatatgtgggctcggtcacagccgcatgttttgcagaagtcgggcatgaagtagtctgtgtagatatcgacaagaaaaagatggatcaaataaattcaggcattcccccgatctatgaagagggacttggagagcttttgcaaaaatatgcaggaaaaagtctcactgcaaccactgactatgaatttgcaatcaagaatacggacatttcctttatctgcgtaggaactccttccgcagaagatgggagtatagacctttcaattgttcgtgcagcaacagcaagtataggggcagtactggcaaagaaagaaggctaccatgtagtagttgttaaaagcacagttgtgcccgagacaactgaaaaatttgtccttcctattccttgaagaaacttcaggaaagatagccggaaaaaactttggagttgcaatgaatcccgaattcctcagagaagggaaggccgtctacgacttcatgcatcctgataaaatagttgttggagcaattgaccagaaatcaggagatcttgtctcagaactttaccggacctttaaatgtgaagtcacccgcacgagtctatcaacagcggaaatgatcaaatatgcaaataactctcttctagcaactaaaatatcctttgctaatgagattggcaacatttgcaaacggttaaacgttgatacctacgaggttatgaaagcggtaggtaaggattccaggatatccccaaagtttttgaattcaggagcaggatttggagggtcttgtttcccaaaagatgtaaaagcacttataggaaaggcaaaagaaataggatattctccagtgcttctggaatccgtaattggagtaaacgaaaaacagccaattcttatgaccgaaatactacagaagaaaataggaagccttgagggtaaaaaagttgcagtccttgggcttgcttttaaaaatgatacggatgatataagggagtctagatctatccctatcattgctgaacttctaagactaggagcagaggtttcggcttacgacccaatggcaatcgagaatatgaagcgaatctttccaacaattgaatactccgggaaagctaaagatgctcttgaaggtgctgacgcctgccttgtaatgacagaatggagtgagttcaagcaacttgactctgaatttgaagtcatgaaagaaaagatagtagttgatggaaggcggataattaaagcgaaaaatatagattatgagggtctctgctggtaa

SEQ ID NO: 35024 - DNA, 863 bp, Methanosarcina mazei
gttaaaaaagcacttattccggcagctggtcttgggacccgtttccttcctgccaccaagtcaatgccaaaagagatgcttcctattattgacacacctgtgattcaatatgttgtagaggaagccattgcctcgggaattgaggatataatcattatcacaggcagggtaaacgggcaattgaagattatttcgatgattctcctgaactcgaaatgcatcttgcgaaaaagcacaataccgaacttcttaaacttgtcaggaatgtttcttcccttgtggatattcactatatccgccagaaagaacctaacgggctcggggatgcagttctcagggcagaaaaccacattggagacgaacctttcgccgtgcttcttggagacgatattattgtgaataacaagccctgcactgcccaactcatagataattttgagaaatatgggaggtccacgcttgcagtggaagaagtccctcgtgaaaaattaagtagttatggaattataaagggcaagcctcttagtaattctctctatgtactggaggacattgttgaaaaaccgtcacctgaaaatgctccctcaaatatgggagcaataggccgctatgttttcacccctgaaatatttgactgtataaaagaagccgggacaggggtaggaaacgaaatccagttgactgatgggattcgggttcttaacaggtcacagatgatatacgcatgcaggttcaaaggaaaaagattcgatactggcgacaggttagggtacgtgaaatcaatagtagattttgcccttgaaaacgaaaaccttagagaagacgtacttgagtacttaagagaaatcctagcagaggtaaag

SEQ ID NO: 35025 - DNA, 1359 bp, Methanosarcina mazei
aaaattggagtacttggtatgggctatgtaggtattccttcagcggttcttttcgcagatgccccatgtttcaataaagttcttggcttccagcgcaattcaaaaagttcaagttacaagattggtatgctcaaccgtggagagagccctctaaaaggagaagagcccggcttagaagaccttattaataaagttgtaaatgccggcaagtttgaatgcactcctgacttttcacggatatcagaacttgatgccgtcacgcttgcaatccaaactccttttgcaaatcctaaagatttggaacctgacttttccgcactcattgaaggcataagaaacgtaggaaaatacttgaaaccaggaatgctcgtagttcttgagtccacaattacccctggcacaaccgaaggtatggcaaaacagattcttgaggaagagtcgggcctgaaagccggagaagactttgcccttgcccatgcccctgaaagagtaatggtaggcaggcttttaaaaaatatcagagaacatgatagaatcgtgggcggcataaacgaagcaagtaccaggcgggctatcgagctctattctcctgtattgactgtggggaaagtaattcctatgagtgcaactgcagccgaggtaacgaaaactgcagagaatactttccgcgatctacagattgcagcaatcaaccagcttgccctttactgtgaagccatgggcataaacgtgtacgatgtaaggactggagtagacagtctaaaaggagaaggtattacaagagctatactctggccaggggcaggcgttggaggtcactgtcttaccaaggatacataccatctggaaagaggagttaagataggtaatgggcagcttgactatccggaaagtgcagactcaatctatgtgctcgcaagaaaagtcaacgatttcatgcctgtccatatgtacaacctgactgttgcagctcttaaaagggttggaaaggagatgaagggctcaaatattgcaatgctcggctgggctttcatccgggattcggatgatgcgagaaacacgccttcagaaccttacagagacctctgcctgaaggcaggtgcgacagttaatgtgcacgacccttatgttgtgaactatccaggaattgagatttcagataatcttgaaaatgttatcagagacgtggatgctgtggttatttttgcagggcacagtgcatactctgatataaaggctgattgggtaaagaaaattacaggcaaggaaaaaccagttattgtagatggaagaaatgtaattgaaccggacgaatttattagtgaggggtttgtctataagggaataggtagaggcgat

SEQ ID NO: 35026 - DNA, 870 bp, Methanosarcina mazei
atgtttgaaggagcaatgcctgccctgataactccttttacaaaggatgacaggattgacagggaaggtttacaaaggaatattgaatttgttgaagagggaggagttgcagggattgtgccatgtggcactactggagaatcagcgactctttctgcacttgagcacgaagaagtaatagatattgcagtggagtgttcaaaggttcctgtgattgcaggaacgggttcaaataacacaggagaagctctccagtttacaaaacacgctgcagatgcgggtgttgacggtgtacttctgatttctccctattataacaagccaaatcctgcaggcctgcttacgcattttaagaaaattgcagaagcagtcgatgttcctatggttatgtataatatcccttcccgtacaggacaggatatgccactagaagttattgtcgaacttgcaaaagttgaaaatatcgtgggaattaaagaagccagtgggaatatcggtaaggtttcccagattctggaaaataccatagatgaagacttcgtggttatttcaggtgaggataatttgactcttccgattctctctgtagggggccaaggagtcatttctgtcgctgcaaatatagtgcctgacagaatgtccagaatggtaaatgcagctcttgccggagactacgaaactgcaaggaagattcattttgaaattgcccctctgattcgcgcccttttcctggaaacgaaccctatcccagttaaaaaagctgcggaacttgcaggcttggcaagtgggaacctgagacttccactcgcgcctcttagcgagacaaatactcagaaggttgcagatgaactcagaaaattgggggttata

SEQ ID NO: 35027 - DNA, 795 bp, Methanosarcina mazei
atgattaacgtagcagtactcggagcctgcggcaggatgggctctttaattgtggagaatgttatcaactctaaggatatgcagcttgttgcggcttttgacatcagctattttggaagggacgcaggagaatttgcccgtgtagggaaacttggagtccagatctcggatgtaaaaaaccttgaaactgttctgaaagaaagcaaggctgatgtccttatcgacttcaccgcagccggcgcaaccgtagttaacgctccgatagcagccagagccggggtaaatctcataataggaaccacagggttgactcctgagcagcgagcagtaattgacgaagctattcaggaaggtcaggtaagtgccgtcatttcccctaactattcagtaggcgttaatgtctttttcaagattatcagggaagctgcaaaatatctcgcagattatgatatcgagattattgaagctcaccacaaccagaaaaaagatgccccaagtggaaccgcccttagagcagccgacattattagtgaggctgtcggcggaagggaatatgtctacggcagggaaggtattgccccacgcggaaaagaaattggaattcatggagtccgcgctggagatatcacaggcgaccatattgtgcttttcgcggggaattctgaaagaattgagatcaagcacatagctcactcccgccagatctttgccaaaggtgcagtccgtgcagccgaatgggtctgcaggcaaaaaccaggaatttattcaatggacgatgtgcttggtttataagaa

SEQ ID NO: 35028 - DNA, 849 bp, Methanosarcina mazei
tctgagcttcttatcctgaagcctgaaggttatccattaagcggcatgatggacgaatatcccgttattgaaaatcgggatgtttttgaattctatgcccgggaacagtggaatggatatgttgctcgtaagggagattatctctttgatcggcggatgttcccggattttgcttaccgtatcatagatgtggaacctgcagaatccataataggaagttcaacctcaattattgtaactgaagaggaaaatgggcttccttcctcggcagaaataaagagtagcgttaaatttgaagacgtaatcgggcaggaacttgcaaagcaaaagtgcaggctgattgaacgcttccttgaagagcccgaacgctttgggaaatgggcgccaagaaatatccttttcttcgggccttcaggcaccggaaagaccatgcttgcaaaggctcttgcaaacaaaaccgacgttctcatcattcctgttaaagctacacagcttataggagaatatgtgggagaaggggctcgccagattcatcagctctatgaccgagcagaagagatggctccctgtataatctttattgacgagctcgatgccatagccctggatcgaaaattccaggagttgagaggagatgtaagcgaaattgtaaacgctcttctgaccgaaatggatggcatagtggaacgtgatggggtatgtactatctgctccaccaacaggatttattctctggactcagctataagaagcaggttcgaagaagaaattgagttcattcttcctagagaagaagaaatcgtcgagatattcgagtcaaatgtaaagactttccctttgcaggtagag

SEQ ID NO: 35029 - DNA, 2543 bp, Methanosarcina mazei
atccgtctctttggcagggagtggacgggaagagcgtttgctgttttgttcccgattttgaaccttatttttatctcaaggcctctggagaccttaatgccgtagccaggcttatcgaagagactttcacgcaagttaaaaaagtagaaattgttgaaaaattcgagcctattgggtatcagaaaacaaaaataaagatgctcagggttactacccacctgcccagagaggtgcccgaaatcagggacgagattctaaagctccaggaagtactgaaggctgaaggcaaatgggaagtctatgagactgatattctctttagaaatcgttttttaattgataaagatctcggaggtatggtctgggtatctgcagaaggggaagccgttgaccctgcaaaatatctccgtacaaatggttcaggcagttctcgctgtgggaagtttacatgtgatgcttcaatccttgcatccgggttaaataaagttgaaaatcttactctcgcccccctgaagtatctggcttttgatattgaatgcctgcctcttgatggaggaatgccttctcctgaggtttcgcctataatcatgattagcttttctttcgagcctgagtataaaggacataaaaccctcgtacttctggcaaaacctgtggaaaatctgaattccgatgtttggtcttacacggacgagaccgaaatgttaaataagtttttcgagatcttctgcgattatgaccctgacattgtaattggatataatcaccaggatttcgatattccttatataacggatagagtaaaaactctggtttcagaagggaactcaataaaccctgttgtcggccgggacggcagcaaaataggttacagaaaattcgggcttattactcgcactgaaatgaagggccgggtggttgtggatgcgcttcctctggtaagaagagctttcagtctgaagcagtacaccctgcgagcggtttcaaaggaactcctgagccgtgaaaaactggatgttccccctcttgaaatggaagagtactggctcgatacaggggaaaaattcaaaaaattcgttgactattcacgcagggatgcagagcttgccctggaacttatccttaatttgagactccttgacaaatatgtggcccttgcccaggtaagcggaagcctgcttcaggaagttgttgatggaggccagacttcgatggttgaaactcttcttctcaaagaatttgggctacgcgacagagttctacttccaaagcctgatgatggagtttcggccgagagatatgcaatgagttccgacctcaagggtggggaagtcctggaacctaagaagggccttctggaaaatgtgcttattcttgactacaagtctctttacccaactataatgatggcacataacctgtgttacactacagtagttacgggtgataagtctgatggggtgactatcaggcctccatccggaggagagttcgtgccttccgaggttttcaagggaatcgtgccttcgatccttgaagatttgcttaacaagaggacacagacaaagaaaaggatgagagggacttctaatgaaaatgagtatagggtacttgatgctactcaactcgccctgaaaatcctgttaaacagcttttatggttattccggatatgccagggcaaggctctacagcctgactcttgcaaacgctgtaaccagctttggaagaagcaacatcctcaatacgcgggaaattatcaacaacactataggtaaaataattctcaggaataaaacagctctgctccttgatgaagcaggagaactctctccccaggatagggtagttgaactgtcggttgcctacggagatactgacagtgtctttgtccactgtaaatctagaggagacctctctcttgaggaggttagccttataggtaacaggcttgcaaatatcgtttctgtgtctttgcctgacccgatggaacttgaattcgaatctattgctaagcgtgcccttcttatcgcaaaaaaacgctatgctctctggttttttgagccaaaaaattcaggttgggaagataagattaaggttaaaggcatggaaaccgtccgaagagactggtgtgaattaacttcggtaactctcaatagggtgcttgagcttgtgcttataaaaggtgatgttgaccaggctgtggaatacgtacgccagatagtcagcaaggtcaggaatctcgatcctgcaaaagactccgagattatcgaaagccttgttctcacacgcacccttacaaggaaaattgagagttataagaacaagcagcctcaccttacggttgctgaaaatctgaaaaaaaggactggtgtcgttccttctataggaacaagaataccttttgtcattaccgcaggaaaaggactctttgttgatcgggctgaagatccggactatgtaagggagaaaaacatcccgatagatgtcgattactatattaagaaacagatactccccccggtggaacgtattcttgaagtt

SEQ ID NO: 35030 - DNA, 1155 bp, Methanosarcina mazei
aacatgtatgtacctactcgaactttgtttggagcaggtcaattaaacaatctgcatacccagaaaatgcctggcaagaaagctatgatcgttatctctaacggaaaatccgcaagagaaaacggttatcttgcaagaactgaaaagcagttgaaattagtaggaatagaaaccgtagtgtttgacaaagttcaacccaatccattgaaatcaacggtgatagcaggcgctgctttcgcaaaggaacatggctgcgattttattgttgctctgggtggcggaagctgtatggatgcggtaaaagctatcgctattatggccacaaatgatggagactattgggattatgtgtttggtggaacgggaagagggaagcaaatggaacataaaccactctctgttataaccattacgacaacagcaggaacaggctccgaaactgatccttgggcagttgtaacacatgaagaaaatcacgaaaagattggatatggtagtgactacctgtttcctgttctggcagtggtcgatcctgaacttatgatatctgtaccacccgaatttactgcctatcagggatttgatgcattattccacagcattgaaggatacgtttctaacggtgtcaatcttatgagcgatatgtatgccatcactgcaatagaaaatatctcaaaaaatcttgcaaaagcagtgaagaatggaaacgatctggatgcgcgtgaaaaagtggcttttgggaataccctttctggtgtggttgagtgtgtagggagttgcacaagtcagcattccctagaacatgcaatgtcagcctatcatcaggaacttccccaaggtgcaggtcttatcatgctcagcaaggcttattttacacatctgatcgagaaacatgtatgtgataataggttcgtacaaatggcacagataacgtgaatgaaggatgcgaaggagccgatggatttcatcacaatgctggtgaaattgcaggaagattgcagagttgcagacctcaggatgtcctattacggaataacaccggaagaatttgaaaccttggcaaagaacgcaaaagatacggtgggtggcctgttcctttgtgacagaactgagctaagcatggaagattgtattgccatctataaaacttcctac

SEQ ID NO: 35031 - DNA, 726 bp, Methanosarcina mazei
gggaaagttgtattcattaccggaggggctaccggcattggccaggctactgcggtcgcctttgctcgtgagggcgctaacgtggcactgacttatcacaagcaaggggctgaacagactgctcgtatgattgaagaacttgatggacaagcattagtcatcaagtgcgacgtatcgcaagatgaagacgtgaaaaatgctatagaaaagactatccaaacgttcggtcggcttgattacgcctttaacaatgccggcattgaaggggaaaccgtaataactgctgaatatccagttgaagagtggaaccgggtcattgccactaatctcacgggagttttcctctgtatgaagtacgagattccgcagatgcttaagcaaggtgctggggcaattgtaaattgttcctccggggccggactgaccggttttccaggtattccagcatatgttgccagtaaacatggggtggtggggcttacaaaaacagcagcccttgattacgccaagtcaaatattcggatcaatgctgtttgtcctggaatgaccgacactccgatgatggaacggtacagtgggggcactcctgagggttacaaaaaaataatcgagcaggagccaattggaagaatgggcaggcctgaggagattgcgattgcggttctatggctttgttcagatgcagcttcctttgtgacaggcgatgcgatgcgtgtcgatggagga

SEQ ID NO: 35032 - DNA, 1071 bp, Methanosarcina mazei
gtatataagaagtgcataaatatggcggaaaatattcaatcaaaaggttatgctggaaaagatgagtccggaaagctagttccctggtcttttgaaagaagacctgtaggtgataatgacattctaattgacattaaatactgtggagtttgtcattctgacattcatcagatcaaaggacactggggaccacaacaatatccacaagtgcctggtcatgaaattgtgggtgtggttgctgctgttggaaagaatgtaacaaagttcaaagtaggtgatcgtgcaggagttgggtgcatggttagcagttgtatggagtgtgaaagctgcaagaatggtgaagaacatcattgcgacaacaatgcaactataatgacatatggttatcctgaagaatcatcacctaccggtataagccagggaggatattctcaaaatatcgttgtcacagagcattttgcaataaagataccagattccatagatctacaggaagctgctccattactatgtgctggtattactacttattcacctttaatgagagccaatttcaaaaaaggggataaagtaggagttgcaggaattggtgggctggggcacgtagctattaaattagccgtatcaaaaggtgccgaagtttatgcctttacaaccactgaaagcaaaaaagaagattgccttgcattcggagcaacagaagttattgttgttaactcaccaagcgacctacaaccatggaaaggaaaaatggattacatgatatccacaattccatacgcatacgaaatgtcatcatacattgattgcgtaaaaccatacggatacttcactcaagtaggacaaccaattggaggagaactcacaattaacaacttcaatatgattttcaatagagtaaacttcaatggatcacttattggaggaataccagaaacacaagaagttgttgattattgtgcggaaaataagatctatccgcaaattcagatgatcaaacctgaaatgatcaatgagatatgggagaaggtcgtaaataaagaagcccgctatcgatatgtaattgacatg

SEQ ID NO: 35033 - DNA, 990 bp, Methanosarcina mazei
ggtattttaggcgccacaggcgctgttgggcagagatttgtagaagcacttgcaaaccacccctggtttgagattacagcccttgcagcatccgagagaagcgctggcaaaacatataaagaagctgcaggctggaggttagatacagctatgccggaaagtgttgaagatatcaaagttgtcccggtagatccaaaagccgtagatgcggacgtggtgttctcggcacttcctgcagaccttgccctgacagtagaacccgaatttgcaaaagccgggtttgcagtggcaagcaatgcctcctcctacaggatggaaaatgacatacctcttgtgattcctgaggtaaatccagaacatcttgggcttctcgaagtccagcaggatacaagaggatgggacggatatatcattacaaaccccaattgttccactattgtcatgaccgttactttaaagcctcttatgcagtttggactcgaaaccacacaggtagccacaatgcaggcgatctcaggggcaggtttttccggagttgccgcaatggcaatttatgacaatataattccttacataggaaacgaagaaaagaagatggaaaccgaaactttaaagctcctcggagagtttaacggctctgaaatcgtgcctgcagatatgagagtcagtgcttcctgccacagggtccctgtaatagatgggcataccgaagctatctgggctggaatgagggataaaccaacgcctgaagaagtaaggaaagctttcctgaactttgaccccaggctgaaagaacttccttccgaacctgcaaaacctttaattgtaagagatgaaagtgacaggcctcagccgcgccttgaccgcaacatgggaaaaggtatgagcgtttcagtgggccgtataagagaaggaatccgctatatagcaatgggacataacaccatccgcggagcagccggggcaagtgtattgaacgcggaactcctg

SEQ ID NO: 35034 - DNA, 1245 bp, Methanosarcina mazei
actatattagatatcgtagaactactgttaaccgcagagatctataatcgctatccagaactggatgtaaatgatcttccaaaaaacattcgaaaaaactactggaatagcacagaaaaaaccgttcccaaacccatcacagccacgtttattagtattgaaaaactgtacgggcttaaggacatcgaaaaaatcgtaaggaacgtccccttcataaatactgataagtctcactttgaacttcgtctgagcgctttcgaacttgctgcggaatggtttgaaaagcaagaaggttctcagaaacggattgaaaataaccctgtcctggcttattactttgaaaaaataagggaggatgaggctgcaaactattcgcttgcaaaggcgaaaataagtcccaaggaatccgatagggaatggatagagtccaagatagcggagatccggaaagaggacaaaagcgaagatatgctgaaactcgcggtcattatcgctcctgaggatgtaaagcaaaaagttagagaccttgtgctcaccggggaacaaaagaacgaagttgaaaagatcacgaaggccatcgaacacagggaatatctgcgggagatcggtctgcatgatatcggaaaactcctgtttgttggccctcctgggaccggaaagacctcagttgcccgtgcactttcagagcggctctcaatcccgtttgttgaggtcaaactctccatgataacagaccagtatcttggtgagactgcaaagaatattgacagagtctttttgcttgcaaagaaactgaatccatgcatccttttcatagatgagctcgatttcgtagcaaaagcaagaacgtctgacgagaacgctgccatcaagcgagcagtaaataccctccttaaggccatagatgaaatcagccttgtggatcatggagttcttcttattgccgcgaccaaccacccccgcatgcttgatagtgcagcctggagacgctttgacgagattgttcatttccctctccctgatcttgagatgcgtacagacatactgaatatcgtaacccggcacatcgaaggggattatgacacagggaaaattgcggaattgacagacggctattcaggctcggacctgcgtgtcgttatacgggaagctgtcctgggtgctcttctcgaagagcgtaaaatacttacacagcaggacctgctggacgctgtagactctttcaatgagagggctggcctcaag

SEQ ID NO: 35035 - DNA, 1287 bp, Methanosarcina mazei
gaaattccaggagacaatactattaaagtttgggatttggaaaaaggagaagaaatggcaactttgagaggtcacgagaaggtattctcaattgcagtaactccgaatggaaaatatgctgtttcaggttcacacgatggaactcttaaggtgtgggatttagaaaaatggagagaaataagaagtttaagagcgcattcaaaatcaataactgcttttgcgataacttctgatggaaaacttgtcgttttgggttcacttgatggaaacctagaggtttggaatttggagacaggagaagaaaaagcagctttcaaagagcattcagagccaataactgaaattgtaatcacacctgacggcaagcgtgccgtttcaggctcatctgataacaccttaaaagtttgggatctggagaaaatggaagaacttacgactttaataagccactcaaactcagtaagtaaaatcgcaatcacccctagtggaaaatatgctatatcaggttcatctgataacactttaaaagtctgggatttgaaaaaattagatgaagaaacaatatctacaggacattcaaagtcagtaaataaaatcgtaatcactcctgatggcaaacttgccgtttctagttcatatgatggaactctaaaggtttgggacttgaaaacaaaagaagaaaaagtaactttaaaagggcactctgggccagtaactgattttgtgataactcctgatgggaagcgtattatttcaggttcaagtgataaaaccttaagggtttgggacttgaaaaaaggaaacatgactttaaaaggccacaagcgtgaagtgacttcagtagcaattacttctgatggaaaatatgccatctcaggctcatttgatagaacaattaaagtatgggacttggaaaacggaaaaataaaagtgacgttagaaggtcacaaaaactacatatccactatttcaattataccaaataaaaattgtattgtatcgtcttcacatgatgaaactcttaaggtgtgggatttagatagaggaatagacacaataactcttattggtcattcaggatcagtaagttcagtagcaataactcctgatggaaagtctattgtttcggcttcaggagatggtacacataaaatatggagtttggagaacagagaagaaatagcaactttggaaggtcataaatctgcaccatcaacaattgtgatcacaccggatggaaaatatgcagtttcagcttcatatgatagaaccattaagattttggat

SEQ ID NO: 35036 - DNA, 1164 bp, Methanosarcina mazei
atgagagacgtagcaattatcggagtaaagaataccaagttcggagaactctggggacgttccctgagggatatagtagtagaagccggggccggagcactcgaagacgcaggtattggtggaaaagaaatcgactccctctacgtaggaaacatgagcggaggccgatttattgatcaggaacatataggggctcttatcgcggactattcgggactttccaagaacctgcatgtgccggctacgcgagttgaagctgcctgtgcgtcgggtgggcttgcccttcgacaggccatcatggctgtagcttccggttataacgatatcgtgattgcagcaggagcagaaaaaatgactgatgtagagtctgaggaagcgtcttcagctcttgcagcagcggccgatcgggagtgggaagggatgacaggggcaacttttcccgggatttatgcaatgattgcaaggttgcatatgcacaggtatgggactaccagcgaacagcttgccgaagttgccgtaaagaatcataaaaatggctctttgaatcctattgctcagtataaaaacagaatcactgtggacgacgtattgaactctataatggtagccgatcctttacatatttttgactgttctccaataactgacggcgcttcagctcttgtgcttgccccagcggatattgcgcacaagtacacggatactcctatttatatcagggcaaccgctcaggcaagtgatacaattgcgcttcatgaccggcgggatataacaaccctcgatgcaaccgtggtggctgcaaaacgcgcatattccatggcaaaactgaggcctgaagatatcgaccttgtggaagtacatgactgcttcaccattgctgagatttgcgcaattgaagacctcgggtttgcagaaaaaggaaaaggcggaattgtcacagcaaacggggaaaccgcaataggaggcaggattcctgtcaatacatccggcggcctcaaggcctgcggacatccagtaggggcaacaggcgtaaagcaggccgtagaaattgtaactcagctgcgcggagacgcaggcaagcgtcagatcgaaggcgcagagtacggcatgacccataatgtaggagggtcaggagcaacagcagtagtgcatattttttcgagg

SEQ ID NO: 35037 - DNA, 1044 bp, Methanosarcina mazei
ataatgactattggaatcgtgtcttacggtgcttatgtcccccgataccgtatcaaagttgaagaaatcgcccgggtatggggtgatgatgcaaatgctcttaaaagtggcctgatggtatatgaaaaatccgtacctgatatcgatgaagacgcagcaactatagctgtggaagcggcaagatacgcgatgacaagaagcggggttgatccagaaaggattggggcggtatatacaggctcggagagtcatccctatgctgtaaagccaacaagcacaattgtctcccaggctataggagcgaccccaaacatgactgcagcagacttcgaatttgcatgtaaagcagggacagccgcagttcaggcctgtatgggactggtaagttcagggatgattgacctgggcatggctataggagccgatgtttctcagggggccccaggtgatgccctcgagtatactgcagctgcaggaggagttgcctgcctcattgggaaaaaagaatccgaacttgccgcaattattgaagatacttattcttttacaactgacacccctgacttctggagaagggaaggaatgccctatcctgaacacggaggccgttttacaggagagccaggctacttcaagcatgtgactaacggcgcaaaaggtcttctgaataaacttggaacaaagcctgaagattatgattatgcggttttccatcagccaaatggtaaattccctaccaaagctgcaaaaaccctgggtttcactaaggcccagattgctccaggacttgtagttccaaaaatcgggaacacgtattcaggttcctgtcttatgggaattgctgcaactctggaccaggcaaaaccaggggacagaattttcgcgactgcattcgggtcaggtgcagggtctgatgcttttagtataacggttacagataggatcgaggaaatacgaaacagggctccgacggtttccgaactgattaaagatcctatatatattgactatgcaagatacgccaaacataaaggtaagatccgc

SEQ ID NO: 35038 - DNA, 2015 bp, Methanosarcina mazei
tggtcattcctgacagcgtcaccgacattggactctaccagttccagaactgcgaggaccttatctcgatctacacgggcggagtaccatctatttcaacgaacaatatccggaactgcccctccttagaaacgataactgttggccacaggctttcttctattaccagctactcgatccgtgactgcccctccctggacgccatggtgtttgaggccgagggcgacgcaccgagtgctagtggcaactggaactataattgtcccaatctggtggtgtactactgtgagaacgctaccggcttcaccacaccgagttgggctggcaagccgtgttatccaataggctccccaaccgctgacttttcgaccaacaccattttcggcagtgcaccgctcacggtacagttcacctattcgggtgtgggtgcgaacgctttgtcctggtacttcgacgacgacgctactgtggacagcactgcgaggaaccccagttatacctacgatacaccgggtacctactcggccactctgtatgtcaacaacccatggggcagcgacagtaagctcagaacaaactacattaccgtgactgaggctcacgctgacggttgggcttacaccagcgacggcacctcggtgaccgtaaccggctactccggaccggacagcgacgtgacaatacccggtgagatcgatggcctgccggtgaccactatcggtgccagcgcgtgcaaggccctcacctccctgacctctgtgaccataccggacagtgtcaccactatcgacgccagtgcgttctacggctgcaccaacctgatctcggtgactatgccggacagcgtcaccactatcggttccagtgcattctatggctgcacaggcctggcctcggtgaccataccgaacagcgttaccactatcggctccagtgcgttctacggctgcacaggcctgatctcagtgaccataccgaacagcgttaccactatcggttccagtgcattctacggctgcaccaaccttactgtcatgatgttcaacggcaatgcgccgacgacggtcggcagcaattgggcatcgggcaccaacctagtggcatattactccgaaggcgctactaacttcacaacccctgagtggaacgaagtcccgtgctacccagcactcaccgccgcgaccgccgagttcacctcgaacatcgtctatggcagcgcaccgctcacggtaaagtttacctatacgggcgtgggcgcgaacgcgctggactggtacttcgacaacgacagtactgtagacagcactgcaaggaaccccagttatacctacgatacgccgggtacctactcgatcaaactgaatgtcagcaacccctggggcagtgacagtgaagttaagacggcctatatcaccgtagccgaaccggtcgataactttacctatctctccgacggtacctcggtgaccataaccggctactccggaccgggcggcgatgtcgtcattccgagcacgatagggaacctgccggtcaccgctatcagcgacagcgtgttcaagagcaataccaacatcacctcggtaaccataccggacagcgtcacaaccatcggctccagtgctttctacggctgcaccggcctgacctcggtgaccataccgaacagcgtgactaccatcggcaacaatgcgttcaacggctgcaccggcctgacctcgatgaccataggaaataatgtcactaaaattgacgatagaatgttctatggctgcagcgccctgatctcggtggtcattcctgacagcgtcacaaccatcggcgacagcgcgttctaccagtgcagtaacctggcttcggtgaccatacctgacagcgtcacaaccatcgacagctatgcgttccgtgactgcaatgcactgacctcagtaactatacctgacagtgtcactaacgtcgaatcaaggctgttctacggctgcaccggcctgacctcggtgaccatagggattggc

SEQ ID NO: 35039 - DNA, 2004 bp, Methanosarcina mazei
agtattggcaagtatgcgttctctagttgctctgctctgaccacattggccattggcagcggtgtcacagcaattagcgacggggcgttctataactgtccttcggtgaccacagtgaaaatcggtagcggtgtcactaatatcggtgccagcgcgttccaaggttgctccgctctgacaacagtgaccatcccggacggtgtcatcaacatcggcaccagcgcgttccgaagctgctctgctctgacaactgtagccatcccggacagcgtcaccagcatcggtagctctgcgttctgcggctgctctggactgacaatagttaccatcggaggcggggttacgagcatcggcggggttacgagcagcagcagttttgcgttctctgattgctctgctctgaccgcgatcgatgtcgatgccgacaacagtgtgtacactagcatcgatggagtcttgtacaacaaagacgtcacaactttgatacgatgtccgtcaggaaagaccggttctgtagccatcccgaacagcgtcacaaccatcagcagctatgtgttcccagactgctccggactaacaacagtgaccatcggaagtggggttacgagcatagacaattctgtgttctctgattgctctgctctgaccgcgatcgatgtcgataacgacaacagtatgtacgctagcatcgacggggtcttgtacaacaaggacatcacaacgttgatacaatgtccatcaggaaagaccggttcggtaaccatcccggacagcgtcacaacaatcggcgacagcgctttctacggctgcactgccctgacctctgtgaccatcccggacagcgtcacaacaatcggcaccagcgcattccagggctgcatctccattacctcggtgaacataggaaacaatgtcaccagcatcggcaattctgcgttctgcgactgcatcgcccttacctctgtgaccataggaaataatgtcatcagcatcggcagctatgcgttccagggctgcgctgccctgacctctgtgaccatcccggacagcgtcaccaaaattggcagcagtgcgttccagggctgcatctccattacctcagtgaacatcggtagcggtgtcaccagcataggtaattctgcgttccgccaatgctctgccctgacaactgtaaccatcccggacagcgtcacaaccatcctcgactatgcgttccaggactgctccagactgacaactgtgaccatcggcagcggggttacgaacatagacagttctgcgttctctggttgctctgctctgaccgcgatcgatgtcgataacgacaacagtatatacgctagcatcgatggagtcttgtacaacaaggacatcacaacgttgatacaatgtccatcaggaaagaccggttcggtaaccatcccggacagcgtcacaacaatcggcgacagtgcgttccgcgactgctccggactgacaattgtgcctataggaaataatgttaccagcatcggcagcagtgcgttttatggctgcacctatcttacctctgtgcctataggaaataatgttaccagcatcggcagcagtgcgttttatggctgcacctccctgacatcggttaccataggaaacaatgtcaccagcattagtagcagtgcgttccgccaatgctctgcactgacaactgtaaccatcccggacagcgtcacaacaatcggcgacattgcattcagcgactgctctggactgacaactgtaactataggaaataatgtcaccagcatcggcagcagtgcgttctatggctgcactgccctgaccttgatagccatcccggacagcgtcaccagcattggtggtagcgcgttccgcgactgcaccaatcttacctctgtgaccataggaaacaatgtcaccagcatcggcagcagtgcgttccgcagctgtaccgccctgacatccatgacgttcatgggcaacgctccgacgatgggcagcaga

SEQ ID NO: 35040 - DNA, 1272 bp, Methanosarcina mazei
atgcgtgtttctattgacaaatcctcaatcaaaggggaagtctttgccccaccttcaaagagttacactcacagagctgtaaccctggcagctctttcaaaagaatcaaccgtcaggcatcccctgatttcggccgatactcttgccacagtccgggcttccgagatgtttggggctttggttgagagggaagaagacagacttattatccacggaattaatggaaaacccaatgtacctgatgatgtaattgatgctgcaaattcagggacaactcttcgctttatgaccgcagtagcagcacttactgatggaattacagtgcttaccggagacgcttcccttcgtacccggccaaacggacctctacttgaagttctcaatcgactgggagtaaaagcctgctccactcgaggaaatgagagagctccacttgtcgttaaaggtggacttaagggacaggatgtgagtattgacggctctatcagttctcagtttatctcggctcttctaataacctgcccacttgccgaaaacagtaccatcctttctattacaggaaaaataaagtcaagaccttatgtagacataacccttgaaatgcttgaactggcaggcgttaaagttcatatcgatgacagtaatggtaccagatttataatcccgggaaaacagaagtatgatttcaaagattatactgttcccggtgacttttcttctgcatcctaccttcttgcagccgcagccatgaccgatggatctgaagttacagtcaaaaacctcttcccttcaaaacagggagataaggtaatcattgaaaccctgaaacagatgggagcagatatcacatgggataaagaagcaggcaatgtgaccgttaaaggaggaagacaattaaaagccataacctttgacgccggagcaaaccctgatcttgtcccgacagttgctgtccttgctgcagttgccaaagggacgagcaggattgaaaatgccgaacatgtccgatataaggaaacggaccgtctgcgagctcttgcaaccgaacttccgaaacttggggtagacctaaaagaagaaagagacagcctgacaattaccggcggaaaactgcatggagcgtcagtgcatggctgggatgaccacagaatagttatggctctttcagtggcaggaattgttgcaggaaatacaaaaattgatacaacagaatccgcgtcaatttcgtatccggagttctttaaagatatgcgcagccttggagcaaaaatt

SEQ ID NO: 35041 - DNA, 735 bp, Methanosarcina mazei
atgtttaaggcagcaattaatgcagagcttctgaaagacgcggttgccgcactagctgtaattgtagatgaggtcagattcaagataaaccctgaaggtatttcggtaaaagccgttgaccctgccaatgttgcaatgggaattttcgaacttggatcatctgctttcgacgaatataatgctgatgaatgtgaaattggagtcgacctgaataagattacggacctgctgggaattgcggataagaatgacacagtccggatggaacttgaagaagaaaatcacaaactcttgattgatgtcggagggctgtcttatacactttctcttctcgatccttccacaattcgggcagaaccaagagttccacagctcgaattgcctgccaaagtcgtccttaacggtgcagacctcagacgtgctgttaaagctgccgaaaaaataagcgaccatatgcttatgggagtttcggacgatacattctatatggaagcaaaaggcgataccgaccaggttcgtctcgagatgggcagggaccagctaatcgatctgaaggcaggcgaagcatgttctcttttctctctggattatctgaccgatatagtcaaacccacaaacaaagtcaatgaagttactctgtcccttggaaaagacttcccaatactcatagatttcgaaattgcgaatggttcaggaaggatttcttacctcctggctccaagaattgagtcggac

SEQ ID NO: 35042 - DNA, 720 bp, Agrobacterium tumefaciens
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattcttgagggaggatctatctcgttgctcaagtgcatggcgcaaagcagttattggagtgcggattttcgttggcatattattcgccacgagttagcagacgaggagaccttcatgaacgtggccaaggccagagttaagcagatgttacgccctgctgcaggcctttctattatccaagagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtatctcatccatgcacgccgacaagaacagaaattccctcgagttaacgcagccgcttacgacggattcgaaggtcatccattcggaatgtat

SEQ ID NO: 35043 - DNA, 972 bp, Agrobacterium tumefaciens
atgaacggtgctggcgaaatcaacgcttcgcggcatcgcaaggagaatgagttgaagacgtgccaaatcctgggagctcccgttcaaagtggcgcatcccaacccggatgcctgatgggacctgatgcgtttcggactgccggcttgacgcaagttctgacggagctgggctgggctgtcaccgatctcggagatgcgacaccaacggtcgaacccgaactcagccaccccaattccgcggtgaagaacctcgatgctctggtgggatggacgcgcagtctgtcccagaaagctctggagatggcccgcagctgcgatcttccggtctttctcggcggcgatcactcgatgtctgctggcaccgtctcaggtgtggcccaacgtacagccgagcttggcaaggagcaattcgtcctttggctggacgcgcatacggacctgcataccctccacacgaccgcgagcggcaatctccacggcacacccgtagcctactatacgggccaatccggcttcgaagggctgccgccgctggccgcgcctgtaaatccccgcaacgtatccatgatggggattcgctcagtcgatccggaagagaggcgacgggttgccgagatcggtgttcaagtcgctgacatgcgggttctggacgaacaaggggtcgtacgcccgctcgaagcttttcttgaccgcgtgagtaaggtcagcggcagattgcacgtcagccttgatgtcgatttcctcgatcccgcgatcgcgccagcagtgggcacgaccgttcctggcggagcgaccttccgggaagcgcacctcatcatggagatgctccatgacagcggccttgtcacgtcactcgacctggcggagctcaatccgtttctggatgagagggggcgcactgcccgcctcataaccgatcttgcctcgagcctattcggccggcgcgtgttcgacagggtgacaacagcattt

SEQ ID NO: 35044 - DNA, 726 bp, Agrobacterium tumefaciens
tttgacctttccggtcggagggccgtcatcacgggcggcgctcgggggatcgggcgcgctatcgctgacggcttcttagaagtgggagctgatgtcgtctgcatcgaccgtggatgggaaagctctgacctcccggccgataaccggcagattgtcacggccgatcttagcgaccgcagcgacctgaagcgcggattcgatgaagctgtggagcgactggggggccagatcgatgtccttgtcaacaacgcaggcatctgggacgacacgccgtcgctccatatggagcttgagatgtgggacaggatcatcgaggtcaatctgactgcggccttcgcgctgagcaggcatgcagccaggctgatgcttccccgaggccgcggacgaataataaacattggctccatccgcagtctgaggggaggccacaatgcggctgcctatgcagccagcaagggagggatcgccttgctcactcagaccttgtcgaatgaatgggcaccttcaggactaagggtcaatgccatagcgcccggcgctatggtcaccgtcctgactgaaaagctgcgccacgatcctgaagtggtcacccgcttcatcgagcgcatccctgccagaagatggggatcgcccgccgatgtggcgggcctggcgatcttcctggccagcgacgcctccgattatgtcactggtgcaatcatcccctgcgacggggggttccttgcc

SEQ ID NO: 35045 - DNA, 1584 bp, Agrobacterium tumefaciens
ttcgatttcatcgtcgtcggaggaggatccgctggcgctgccgtcgctgcaagattggctgagcgtgcggacttgcgggttctgctcctggaagctggtcgacagcagtccggcatccggttccggctgccgatattgactccgttcgcgcttgcgaaagaggatgcagtctggaacttcacgacattgcctgaacccggcctcaatggcagggaacttgtctggccgcgcggcaggggacttgggggttcctctctcatcaatggcatgctctgggtacggggagacccggtggagtatgacctctgggctgcctcaggctgtaccggctggtcttatggcgatctgctggatttcttcaagcgcagcgaaacatacattcccggtgatccggcgagcagagggcagcgcggggctgtgacggttaccaggcaccgtccagcagatcctctctctgatgccttcctgaaggcttgcggtaacatgcaggtatcacagcaggatgattacaatgcgggtatttcggaaggcgcaggctatctccagttcaaccagcgccggggattgcgtcatggcacagaccgtgcctatctctcgcccgccagcaggtgtgctaacctgaccattcgcgaaggcgctgttgcaaaccgcatcctcttcgaagggaagagagcgatcggggtggagtatcgcgcggctgatggcctgagatgtgccatcgcacggcgggaggtcgttctatcctgcggcaccgtccaatccccgaagctgcttgagctttcgggtataggggacggtgaggtgcttggccgggcaggtatcgtgccactggtgcacctcccgggcgtcggagaaaatctgcgcgatcaccttaatgtgcgcgtcggatttcgtacccgtttccgcggcaccctgaatgatgtccaacacagctacgtctggaaggtacgcgccatgctttgctggcttgcgcgaggcggcggtcccctatctaccataggggcgacagcccatgcatttgtgagaacccggtcggacctcgaacgggcggacgtgaaaatccagatgctgcatttcagtgcaccccacaataccggaaatatcagcggacgtctggatgagtttcccggcttcagcatctcgacgttcgtcctgaggccgaattcgacgggttccagccacatccggtcgggcgccgccgcggagccgccggcgatcgttgcgaactacctttcacacgaggaggatctccgctcgatgctcggtgcctttcgattcatcaacagaattgcctcggattcggtctttgatgatcttatggtctcacgggacaacgacctcgcgggtctgcagagcgatcaggacatcctggaatgggcaaaaacaaccggtctgacgtcctaccatcccatcggaacgtgcaagatgggtacggattccgcaagcgtcgtcgatccgagactgagagtgatcggtgttgacggactgagagtcgttgatgcgtccgtcatgccgacaatgccatcctccaacacgcacggacccaccgtcatgattggggagaagggggcggcaatgatcctg

SEQ ID NO: 35046 - DNA, 729 bp, Agrobacterium tumefaciens
atgttactccatctcatctacggaccgacttgcagcggcaaaacggacatggcgatccaaatcgcacaagaaaccgggtggccggtggttgcccttgatcgtgtgcaatgctgtcctcaaatcgcgacaggtagcggaagacctttggaatcggaattgcaatcaacgcggagaatatatttggattcccgccccctcaccgagggcatccttgacgctgagagtgcccatcgtcgactcatattcgaagtggattggcggaagtccgaagagggtcttattctcgagggcgggtcgatttcgcttctcaattgcatggctaaaagtccgttttggagatcgggttttcaatggcatgtcaagcggctacgtcttggggattcggacgcctttctcacccgagccaagcaacgcgttgcggaaatgtttgccatccgggaagatcgcccctcgttgttggaggagttggcggaactctggaactaccctgccgctcgaccgattttggaagatatcgacggatatcgctgcgcaattcgttttgcgcgcaaacacgatctcgcaatcagccagttgccaaatattgatgcagggcggcacgtagagctcatagaggccatagctaatgaatatcttgaacatgcgctctcgcaggagcgcgattttcctcagtggccagaagatggcgcaggacagcctgtttgcccggtcacgctgacgcgaattcgg

SEQ ID NO: 35047 - DNA, 1422 bp, Agrobacterium tumefaciens
cacctgcaacaatccggacggctaaagaagttttacatcgatggcaaatgggtccttcccagcggctcagacaaggtcgccgtcattaatcctgccaccgagctggaatttgcagaaatagcgctcggtaatgatgaagacgttgcgctcgctgttgcagctgcaagaggcgctttcgccggctgggctcgaaccggtccggcagaccggtcggaacttctcaatcgcgtccatcagctgatgcaacagagattggaacttctggcgcaagctttgacgatggaaatgggcgcggcgatcaattatgcccgaagcgttcaagttccccttgctgccgaacatatcaaggtggctcgcgacaatgcggccagctattcgtttctttcgcaacgggggcatacggcgatcctccgcgagccgatcggcgtatgcggcctgatcacaccgtggaactggccgttgtaccagataaccgcgaaggtcggcccggctttggcggcgggatgcacggtggttttgaagccgagcgagctttcgccccttagtgcgttgctgtttgccgaaatcatcgaagatgccggctttccgcctggcgttttcaacctcgtcaacggcgaaggcaccatcgtcggcgctggcttgtccgcacatcccgacgtggacatgatttccatcaccggctcgacccgggccggaattttggtcgcacaggcggcggctccgacagtaaaacgggtggcccaggaactcggcggaaaatcgccgaacatcatccttgcggatgccgatatgacgcgggccgtgcctttgggcgtcgctgcggcgtttcgaaatctggggcagtcctgcagcgcgccgacccgcatgatcgtgccgcgctcgcaccaaaaacacatcgaggaactggcagcggcagcggctctggaaatagttgtcggcgacccgttatcggagcataccacacacggcccggtcgcgaatcacgcgcagtttgaccgaattcagcggatgatatcgatcggcatggatgagggcgccaaacttgtcgtgggggggaccggcagacccgacggcctggataccggcttttacgtgcggcccacgatcttttcagacgtagatccgaaaatgcaaattgcccagcaggaaatcttcggacccgtcttgtccattatttcttacgatacgctcgaagaggcgatagagatcgcaaacgatacggtctacggtctgggagcccatgttcaggggacggaccttcaaactgtgcgaatagtggcggagcagattcgatccggacaggtgcatctcaattatccggcgtgggaccccaatgcgccctttggtgggtacaagcaatccggcaacggtcgggaatatggcaccgagggcatggaagaatatctggagatcaagtctatc

SEQ ID NO: 35048 - DNA, 860 bp, Agrobacterium tumefaciens
gattccaacgaagtgttggtcgactgccagaacgtctggaagatttttggcgcgcgcgcttcgaccgccgtgaaggcggtggccagaggtggattgtcaaagaagcaggtgctggaggatttcgactgcgtcgtcggcgtatgcgacgccagccttcaggttcatcgtggcgaaatcttctgcatcatggggctttccggcagcggcaaatcgaccttgatccgtcttctcaatcgcctcatcgagccgagcctcggaaaaatcacggtgaagggcaaggatatcgccaggctgaatgctgccgaattgcgcgaattgcgcgcccgcaacatcgccatggtgtttcagagcgtagcgctgctgccttaccgcactgtgctcgaaaactgccggtttcagtctcgaggttcgaggcgtagcgaaagacgagcgcaaccgtatagcacgcgccgcgcttgaaaaggtgggccttgccgactggacgtcgcggtatccccacgaattgtcaggaggcatgcagcagcgcgtcggacttgcccgcgccctggctgccgacccggaaatcattctcatggacgagccgttcagcgcgctcgaccctcttatccgtcggcagctccaggacgaatttcggcaattgacgaagtcgctcggcaaggtccgccgtcttcatcacccatgacctcgaggaagcaatccgcatcggcgaccgcatcgccatcatgaaggacggcgttatcgtgcaggtgggaaccgccgaggagatcgttacgaaacccgcagatgattacgtctccgatttcgtagcgggcatctccagaattcatctggtgaaggcgcatacggtcatgcagccggtt

SEQ ID NO: 35049 - DNA, 1464 bp, Agrobacterium tumefaciens
gccgaatacaaggcgattgcctcagaccttcagttcccggccaatgccttcattgacggggctttccggcccgccggttccggcaagaccttcaagacgatcaatcccgccaccggcgaaacgctcgccgatatttcggcctgcgacgtgagtgacgtggactatgcggtcggcaaagccagggcggcattcgacgacggccgctggcgcctgctgccacctggcgaacgcaaggccattttgctcacattcgcaaaactactggagcagcatcgccacgaactagccgtcatggaaagcctggacagcggcaagccggtttccgaatgccagaccgtcgacattcctgacacgatccacaccatccgctggcatgcggagctcatcgacaagctgtatgacaataccgcaccggtgggatcgaacgcccttgcactcgtggtgcgcgagccggttggcgtcgtcggctgcgtgctgccgtggaacttccctttgctgatgctggcctggaagatcggcccggcgctcgcctccggatgttcggtgatcgtcaaaccggccgaggagacaacgctgacgaccctgcgcgtcgccgaactggcgcatgaagccgggattccggctggcgtcttcaacgtcgttccgggcggcggcaaggaggtcggcgagccgatcggcatgcatatggatgtcgatatggtagcgtttaccggatcgacgccaacgggacggcggttcctgcgatatgcggccgactccaacctcaagcgcatcgtccttgaatgcggcggcaaaaatccggcggtggtgctggatgatgcggaagacctcgacctcgtcgccgagcaggtggtcaacggcgcattctggaacatgggcgaaaactgctcggcctcgtccaggctcatcgtccatgcaaaaatcaaggacgagctgctgcagcggatcggcgcctatatgcgggaatggaggatgggcgatcctctcgatccgcaaaaccgcgtcggcgcgctcgtcagcaaagcccatttcgataaggtccactccttcctcgaggacgtgaaggcagaaaatcttaccatcgttcacggtggcaagaccgagaagggaatcttcatcgaacccacggtcgtcgatgccgtgccccctgcaagccgtcttttccgggaagagattttcggcccgatcctgtcggtgacgaccttcaacacgctggcagaggcggtagctcttgccaacgacacgaattacggccttgccgcatccgtctacaccggaagccttcgcaaggcgatcaagctctcgcgcgaaatccgggcgggtgtcgtcacggtcaattgcttcggcgaaggcgacgcaacgacgccgtttggcggctacaaggaatccggtttcggcggacgcgacaaatcgatcttcgcgcacgataattattgcgaactcaaaacgatctggatcgacgtc

SEQ ID NO: 35050 - DNA, 906 bp, Agrobacterium tumefaciens
ttgaaattcgaaggtatatataccccggcgattacaccgctcggtcatgacggagagatcgaccgcgacgccttcgcagctgtcctcgagtcgctcatggaagcacgggtgcacggcatcatcatcggtgggtcgacgggcgaatattacgcgcagacggcccaggagcgcttcgatctggcagcctacgccagacaagtgatcggtacgcggctgccgctcgtcgtcggaaccggcgccacccgtaccgaagattccattgaatatgccaaggcggccaaggaaatcggcgctgacgccattctcgtttcctctccgccctacgcgctgccgaccgagcgtgaaaacgccgtccacgcgcttgcggttgatcgcgcggcgaaccttccgatcatgctgtacaactaccctgctcgcatgggtgtggtgatgggggaggaatatttctcccgcgtcggcaaatcgaagaatgtcgtcgccatcaaggaaagctctggcgacatgggcaatctgcatctcctcgcccgcaagttcccgcagattgcgctgtcctgcggctgggacgaccaggcgttggaattcttcgcctggggcgcgaaaagctgggtctgcgcgggctcgaatttcctgccgcgcgagcatgtggcactctacgaagcctgcgtcgtcgaaaagaacttcgacaagggacgcgcgatcatgaccgcaatgctgccgctgatggattttctcgaatgcggaaaattcgtccaatccatcaagcatggatgcgaaatcatcgggcttcgggccggatctgtccgggctccgcttcgccccctcaattccgatgaaaaacgaactctccagactgtcgttaccacgttgaagcgaacagtcgcccagattgcgtcgggagccaatcat

SEQ ID NO: 35051 - DNA, 882 bp, Agrobacterium tumefaciens
atgtcgcaggcaaaacttctgtgcgacacgatgagcacgctggcggaatcccctgtttgggacgaaaggcgtcaggtgcttttctggtgcgatatcctcggcaaaacggtgcggtccgcagcgctcgagcccggccaatatcgcgaatggccgtttcctcacacggtgtcgagcctcgggcttcgtgaaaacggcgatctcgtcgtcgcctgcggcatggatatcgtcatcctcgatcctgatagcggcaggacacgtctcctccactccattccggcgccggagggcattccctgccggcttaatgacggccgtgttggccccgacggcgccttctgggtaggaaccatgcacaatgttccgctctcagagatgaagccttacggcgaactctggcggatcaccgcaacgagcgccaagcgcatgcagacggggctgacatgcccgaacggtctggctttctcccctgacggttccatcatgtggcagagcgattccgtgcagaaatggatacgcagacgcaatttctacagggtaaacggcctgttcgacgagggtgtgctggtagctcagatgacggaagaaaccggacggcccgatggcggctgcctcgacagcagcggcacctactacagtgcgggtgtttccgccggcatgttgaatgtcttcgccgaagatggcggcaaacaaaccgccgcgataaagatgcctgtgccgcacccgacaatgccctgcttcggcggacccgatttcagcactcttttcgtcacctcgcaccgccacaacatgtcggcagagcggctcgaacaggcacctttctcgggcggcgtgtggatgatcccgacacagactaaaggatttgcacccttcagatttgaaggg

SEQ ID NO: 35052 - DNA, 2781 bp, Agrobacterium tumefaciens
accggtaaggccatgtcgggcttgaacacggatgtcattgcagcactgaccgccgctcagatcgccgccttcggcgccagtgcgatcgccggcctgacgtccgatcaggtagaagccttgagcggcagccaagtcagccttttgtccaccacgcagatcaaggcgttgagttcaacgcaggtcgccgccttgggtagcgatgtcgctgccttgtccaccagccagaccgccgtattgagtgcggcaagcatcaagggcctgaccccggagcagattgcaatcctgcgccccgatcagttttcggctttgaccacggcccagatcgcggctctcagctcgggacagataacggcgatgggcgccagcaacatcgcatcgctttccatggcccagatcgcggccataagcacgtcaagcatgaccggactttcaaccggccagatcgccgcgctcagcaccgagcagatttccaggctgtcgagcaggcagatggcaatgttgagctcggcacaaattgcggcgcttggcaccgaggccgtcgcggctctttcgacagcacagatttccggcctgagcgccgcgggtatttctgggctgagcaagcagcaagtggcgacattcagcaccgcccaggttgaagccctgacgagtgcgcagatcctcaacttcagttccatgcatattgccgaactggggacagaagatctggcaaaattcaccaccaaggatatcgctgcgatcagttcaagtgcgatcgcgggattgtcggcggaggcaatagcctcactgacgaccgcccagattgcggctctgaacacgcaaagcatcaatgcgctgagcaccgcgcagattgccgccttgacgaccgctcaggtggaggccttgacctccacgcaggtcaacgcgctcacctcgaagcagatcgcggccttgagcacggatgatatcgcgacattctcgaccaaggatattgccgcgatcaattcggatgcgattgcaggcctctccgcggagaccattgcgtcgctcgctacaggccagatcgccgcactgaatgtgagaagcatcgcggcgctcagcaccgtgcagatcgtggccctgacaacggctcaggtcgaggcattgaccactgttcaggtcggcgcgctcagttctacgcagcttgctgtcctgagcacggacgatatcgcaaccttctcgacgagggacatggccgcgctcggttcaagtgcgatcgccggcctatcgaaggacaccgtagcgtcgctgacgacagcccagatcggcgcgctgagcatggccggcatcagcgggctgagcacggggcagatcgccgcattgacgggtgatcagctcaacgtcctcaccaatacccagatcgccgccctcacctccaagcaggttgcggcatttgatgtgagcgacatcacggcactgtcgacaggccagatcgccgccctcagcgctgcgggtgcggcaggtctcaccaccgatcagatcgccgccctgagtaccgatcaggtcggggcgatgaccagcggccagatcgcggctctcagcgcaaaacagatcgccgctctcggcacagacgacattgcgactttctcgaccggggacattgccgcgctcagttcgaatgcggttgcgggcctctcaagggacactgtcgcatcgttgacgacagcacagatcgccgcgctgagttcggccggcatcagcggtttgggcaccggacagatcgcaggcctgacaagcgaacaggtcaacgtcctcaccaatgcccagatcagcgccctcacctcaaagcaggttgcggcacttgaggtgaccgatattgcctcgctttcagcggcacagatagccgccatcggcgccgcaggcgtggcaggcctcaccacggatcagatcgccgccttgagcatcagccaggtcgaggccctgaccagtgcccagatcgcggccctgaattcgaaacagattgcggctctcagcgccgacgatctggctatcttcaccaccgcggaaatggccgcgatcggttctggtgcaatctccggcctgccggcatcgaccatcgcatccctgacgacggcgcagatcgcggccctcggcgcggcggccgtatccggcctcaccaccgaccagatcgccgccctcggcaccggccaggtcgacgccctcaccaatgcgcagatcggcgccctcacctccaaacaggtgacggcactcagcgtttccggcatcggctcgctttcatcagcccagatagccgctctcagcacagcgggcgtggcgggcctcaccacggatcagatcgcggccttgagcaccagtcaggtcgaagccctgaccagcgtccagatcgcggccctgagttcgaaacagattgcggccctcggtgccgatgatcttgatatcttcaccaccgccgaaatcgcctcgattggctccagtgcggtcgcaggcctgtcggcgtcgaccatcgcctccctgacgacggcgcaaatcgcggccctcggaaccgcggccgtatcgggccttaccaccgaccagattgtggccctcggcaccggccagttgaacggcctcaccagcgcacaaattggcgccctcacctccagacaggttgcagccctcagcgcgaccggcattgccgcgctgacgaaaggccagatcgccgctctcgacgccaaggctgtcgcgggccttggcagcgcgcaggcaggcgcgctgagcgtcgaacaggtcgaagccctgtccacccgtcagattgcggcgttg

SEQ ID NO: 35053 - DNA, 2790 bp, Agrobacterium tumefaciens
atttccaagctttccacgtcgacgatcgccggcctgacgtcggaagacgtaaatgctcttgatagcaccaagatcaaggctctctcttcgtctcagatcgcctcgttgagcacggataaccttgctcttttcagctccgaagacctccgcgccatttcggtaacggcggtcaagggcctgacgctcacccagatggcgaaactgagctccgcccaggtcagcagcctgtcttcgtcccaggtcacggcactttatgccagccagatcgacgccatgtcgaccgaccagatcaaggcgctcaactcctctcaggtcgcagggctcagctccgcccaggtcgcaacgctgagcagcgacgaactcgctctcttcaccaccgacgagatcaagtcgatcagcgccaatgccatcgcaggtctttccgcggcggctatcgccggtctcagcaccgacaatgcagccgcactgacgaagtctcagatcgccgccatgtcttccacgcagttcaacgcgctcacgtcgggcagccttgcaaccttctcggcggacgaagtcaaggcgatcagcaacaagatcctcgctggcctcgatgtcaccaaactcagcaccggcaacatcgcagccctcagcaaggcacaggtttcggcgctgtcgacgacacagttcgctgccatgtcgaccgaccagatcaaggccctcacctccgatcaggtcgccggtctcagctccgcgcaggttgcgacgctcagcagcgacgaactggctctcttctccaccgatgagatcaaggcgatcggcgccaacgccgttgccggcctgtctgccgcagccctggcggcgcttaccaccgacaacgctgcagcactgacgaagacccagatcgcgggtctgtcttcgacacagctgaatgcactgacctccgccaaccttgcaaccttctctgcagatgagatcaaggccatcagcaccaaggcgctggccggtctcgatgttaccaagctcagcaccggcaacatcgccgcgctgaccaaaacccaggccgcatcgctgtcctcaacacagttcgcagccatgtcgaccgaccagatcaaggccctcacatccgagcaggtcgccggtctcagctccgcgcaggttgcgacgctcagcagcgacgaactggctctcttctccaccgatgagatcagcgccttcagcgccaatgcggtcgctggcctttccacagcagccctggctgccctcaccaccggcaatgcaaccgcactgacgaagacacagatcgctggtctgtcttcgacacagctcaatgccctgacatcaggcagcatcgccactttctccgccgatgaagtcaaggccatcagcaccaaggcactggccggcctcgatgtgaccaagctcagcaccggcaacgtcgcagccctcagcaaggcacaggtttcggcgctgtcgacgacacagttcgctgccatgtcgaccgaccagatcaaggccctgacatccgagcaggtcgccggtctcagctccgcgcaagttgcgacgctcagcagcgacgaactggctctcttctccaccgatgagatcaaggcgatcggcgccaacgccgttgccggcctgtctgccgcagccctggcggcgcttaccaccgacaatgcatccgcactgacgaagacccagatcgcgggcatgtcgtccacgcagatcaatgccctgacctccgcaaaccttgccaccttctctgcagacgagatcaaggcaatcaccaccaaggctctcggcggtctcgatgtcaccaagctcagcaccggcaacatcgccgcgctgaccaaagcgcaggttacatcgctttcctcgacgcagtttgcagccctgtcgaccgaccagatcaaggctctcacctccgagcaggtttcgggcctcaactctgcccaggttgcgacactgagcagcgacgaactcgctctcttcaccaccgacgagatcaagtcgatcgccgccaacgccgttgcgggtctctctgctgcggcgctggcagcgcttaccaccgacaatgcatccgcactgacgaagacgcagattgctagcctctcatccacgcagctcaacgccctcacctctgcaaatctcgctaccttcacggcagacgagattaaggcggtcaccaccaaggcgctggccggtctggatgtcactaagctcagcaccggcaacgtcgccgcactcagcaaggcacaggtttcggcgctgtcgacgacacagttcgctgctatgtcgaccgaccagatcaaggctctcacctccgatcaggttgccggcctcacctccgcgcaggttgcaacactgagcagcgacgaactggctctcttctccaccgatgagatcaaggcgatcggcgctactgccgtctccggtctgtctgccgcagccctggcagcgcttaccaccgacaatgcatccgcactgacgaagacccagattgccggcctgtcttcgacgcagctcaacgccttcaactccgcgaacctcgccaccttcacggcggacgaagtcaaggcgatcaccgccaaggctctcggcggacttgatgccaccaagctcagcaccggcaacatcgccgcactcagcaaggcacaggcggcagcattgtccacgacgcagttcgcagcgctctcgacagaccagatcaaggccctcacatccgagcaggtcgcaggtctgaactctgctcaggtcgcgacgctcgacagcaccgagcttgccctgttctcgacagacgagatcaaggccatt

SEQ ID NO: 35054 - DNA, 1107 bp, Agrobacterium tumefaciens
gtgaatatcgcggcgctctctccttatgaggcgaagcttgccggccttagccgcaaatcgcgcctgcgtgcgcttgcgccccgggaggggatcgatttcacctccaacgactatctcgggcttgccgaagcgccgcgcctgaaggcggcgattgctcacgccattggcaaaggcgtgccggtgggcgccggcggttcacggctgctgcgcggcaatcaccccgaacatgaggcgctggaatcggaagcggcggcgtttttcggggccgaaaaagccatctatttcggcagcggttttgccgccaatgtcgcgcttttttccaccctgcctttgcgggacgatattgttctccatgatgccctgatccatgccagcgtgcatgatggcattgcggcgggcaaggcgaaggcggtggccgtgccgcataatgaggtggaggctttccagcgggagataatccgctggcggcaggcgggtggtagcggccggccgtggatcgcggtcgagagcctttattccatggatggcgattgcgcgccgcttgcagccctggccgatcttgccgaacggcatggcggttttctggttgtcgatgaagcacatgccaccggcgtcttcggccccggtgggcgtggtcttgccgcgcaactggaaggccggagcaatgtgctggcccttcatacctgcggcaaggcgctcggtgcctccggtgcgcttttgagcctgcctgcggttcttgccgattatctcgtgaaccgcgcccgcggtttcatctattccaccgcgccttcgccgctgatggcggcggcggtgcgggaggccttgcgcatcgtcgcggacgaaccctcaaggcggtcgcgactggccgagttggtaggttttgccggcgaagaattgcaaagccagctgggtgtgacacccagcggttcgcagatcctgccggtgatgatcggcgacaatgcccgctcactgaagattgctgcacggctgagccaaggcggtttcgatgtgcgggcgatccgcccgccgacggtaccggaaggcacggggcggctacgcatcgccatcacgctcaacgtggatgaaagccagattgccgccatggtc

SEQ ID NO: 35055 - DNA, 1242 bp, Agrobacterium tumefaciens
tccccggtctggcatcccttcacccagcatgggctggaaccgccgatgaaacgtgtggtctcagcggacggggcgtttctggtggatgaggatggcaatcggctgttcgacgcgatttcatcctggtgggtcattacccatgggcaccggcatccggcgatcatggcggccatccgcgccgcgaccgagaccctggatcaggtcatctttgccgaattttcccatgaaccggctgagacgctcgcccgggggctgatcgagcttgctcctgctggactaagccatgtgttttattccgatagcggttcaacggcggtggaagtggcgctgaaaatggcgctcggttatttccacaattgcggtgaaaagcgcgatcgcatcgtggtgatggagcatggctatcacggcgataccatcggcaccatgtcgacaggcgagcgcggcgtgttcaacgccgcctatgaaccgctgcttttcggcgttgaccggttggcctttccggaagtgggcagcgagcagtgcacattggatatgtttgaggcttactgccgttcgggccgtgtcgccgcgctgctggtcgaaccattggtgctcggtgccggtggcatgaaggtctacgccgccaatgttctagccggactgaaacagattgcagaaagccatggctgtctcgtcattgccgatgaggtgatgacgggctggggcaggaccgggaccgtcttcgcctgcgagcaggcggcaatctcaccggatattctctgcacttccaaggggctgaccggtggttcgctgccgctggcggcgacgctgtgcagcgcgcagattttcgatgctcatttttcgaccgaccgccgcaagacctttttccattcgagttcctatacggccaatccgatcgcctgcgccgccgccgtcgccaatcttcaggtctggcgggatgaaccgattctccagcgcatcgggcaggtgcaacagacgctcggcgatcatatcaggcgctttgccgatgatggccgtttcgccaacatccggcaggcaggcaccattgccgcgcttgatctcgtggtgccggcgggtggctatctttccgaggccggtccacgcatgcgccagctgttccgcaggcgcggctttctcatccgcccgctcggcaacgtgctttacctgatgccgccctattgttcgacggctgacgatctgacgcgcgccttcgacgttatcgatgaggttgccgggatcgtt

SEQ ID NO: 35056 - DNA, 969 bp, Agrobacterium tumefaciens
acacgttcttcccgcatggccggttttggtcatgccgttccggcccgttgcgtcgacaatgccgaaatagaggccagtctggggctggaagccgggtggatcgagcgacggaccggcattcgctcccgttattgggcggaggcgggcgacacgctgagcggtcttgccgaaagggctggccggatggcgctggaggatgcgaagatcaatgccgatgacatcgcgctgacgctgcttgccacctccacgccggatcatcttctgccgccttccgcgccactgcttgcgcataggctgggtttgacgcgctcgggtgcgatcgatcttgccggggcctgttccgggtttctttatgcgcttaccctcgcggatggttttgtccgcacctacggccgcgccgtcctcgtcgtcgccgccaatattctcagccgccgcatcaatccggcggaaagggcgagcgccgtcctgtttgccgatgccgccggtgccgtggtgctgaccccgtgtccggaggtgaaacggggggtgttatcggccgatctcgttgccgatggcagcggttacgatctcatccagatcgcggcaggcggcagcagccagcccttttctgccggtatgattgcagaagatgccctgatgacgatgcgcgatggccgggaggttttctctcgcgccgtggcgctgatgacaaacacctctcagcgcgtgctgcatgaggcggaactgaccgcagccgatatcagccgtttcgtgccacatcaggccaatgcccgcatgtccgacgccgtttgcggtaatctcggaatcgagcgggaaaagacggtccgcaccataggaagcttcggcaattcttccgctgctaccatcccgctttcgttgtccatcaccaatgccgagcggccccttgcgggcggcgaaaccctgcttctgacggcggcgggtgcaggcatgacgggcggggcggtggtt

SEQ ID NO: 35057 - DNA, 918 bp, Agrobacterium tumefaciens
atggatatcaggcttgttggtgcgccgttgcagatcggggccgggcaattgggctgcgagatggggccgagcgcctatcgtgttgcggggcttgcccatgctcttgaagaactggggcatagggtggtcgataccggcaatgtgatgccggcgccgctcagggaattctgccaccccaacccggccgtgcatcatctcgccgaaaccgtggcctggaccgaggcgctgacggaggctgcctatcgcgaaagcgcggatgccgtgccgatcttcctcggcggcgaccatgcgatttcggccggaaccgtggccggcatggcacgccgggtggcggaaacgggccggccgttttttgtgctctggctggatgcccataccgattatcacacgctggagaccacccgcagtggcaatctgcacggcacaccggtcgcttatttcagcgggcgtgacggtttttccggctattttccgccgctttcccatgccgttgcggaagaaaatattggcatgatcggtattcgcagcgtcgatcccgccgagagggctgcgctggaaaagagcggcatcaccgttcatgacatgcgttcgatagacgaacatggggttgccgttatactgcgcgaattcctggcgcgggttcaggcggcaaacgggcttctgcatgtcagtctcgatgtggattttctcgaaccgtccatcgcgcccgctgtcggcaccacggttccgggtggcgcgaccttccgcgaggcgcatctggtcatggaaatgctgcatgatagcgggctggtctgcagtctcgacttggtggaactcaacccgtttctcgatgagcgtggcaggacggcgaccctgatggtggatcttgccaccagcctgatgggcaaacgcgtcatggaccgcccgacgcgggccggt

SEQ ID NO: 35058 - DNA, 909 bp, Agrobacterium tumefaciens
atgaccacagacaagacctccccttacgaaatccacgatgaccgcttccgccatctgatcgtcggcaatgcggaactggaagagctttattccggctgccgctgggccgaaggcccggtgtggtttgccgatctaaactgcctgctgttcagcgatattcccaatgaacgcatgttgcgctgggtgccggatggcgggatttcggtattccgtcagccctctaacttcaccaacggcaatacccgcgaccggcaggggcggcttgtctcctgcgaacatggcggccggcgcgtcacccgcaccgaggttgacggctcgatcaccgttcttgccgacagctatggcggcaaaagattgaactcacccaatgatgtcgtcgtcaaatccgacggcagcgtctggttcaccgacccgacctacggcattctctccgattacgagggctacaaggccgaaccggagcagaagacgcgcaatgtctacaggctcgaccccgcaaccggaaagatcgacatcgccatcgacgatttcgtgcagccgaacggccttgcattctcgcccgatgagacgaagctttatgtcgccgacagctcctatagccacgatatatcccgcccgcgccatatccgcgtcttcgacgtggtggacggtgtgaggctcgccaacggccgggaattctgcaatctcgacaatggcctgccggatggcttccgcctggataccgccggtaatctctggaccagcgccggcgatggcgttcattgctttgcgcctgacggtaggctgatcggcaagatcaaggtgccgcagacggtggcgaacctcaccttcggcggcccgaagaagaaccgcctgttcatcaccgcaacgaaatcgctctattcggtttatgtcgccgcaacaggcgcg

SEQ ID NO: 35059 - DNA, 903 bp, Agrobacterium tumefaciens
atggacctgaacagaactgtcagaaaagccgtcattccggtagccggcaacggcacgcggtttttgcccgccaccaaggcgatgccaaaggaaatgctgacgatcgtcgatcggccggtcgtgcaatatgctgtcgacgaggcaatgcaggccggcatcgaacacattattttcgtcaccagccgcaacaagaccgccatcgaggactatttcgacagcgcacccgaactcatcaacacgctcacccgctccggcaagaccgtgcaggtgctgcagctggaaaagatgctgccggttgccggcaccgtcagctatacgcgccagcaggtgccgctcggtctgggccacgccgtctggtgtgcgcgtgaactggtgggcaaggaacctttcgccctgcttctgcctgatatggtgtcctatggtgcgcgcggctgcattgccgggctgatggagctttacgacgaagtcggcggcaatattctcggcgtcgaggaatgcctgccggaagaagtctcgtcctatggcgtggtcggcgtcgggcagaaggtcaatcacggcttttccgtcactgaaatggtcgagaagccggaaccgtccaaggcgccttcgaattattacctgaacggccgttatatcctgcagccggaaatcttcgatattctcgccaggcaggaacgcggcgcgggcaatgagattcagttgaccgatggcatgaagcgacttgctgaaaagcagccgttccacgcgcagaaatattcgggccgcacctttgattgcggcagcaagcagggcttcatcgccgccaacgtcgccttttcgctgatgcgttcggatatggaggcccaggtcctcgcttcggtgaaggaactgattgcaaaccacgaaagccgcgtccaggcggcc

SEQ ID NO: 35060 - DNA, 1949 bp, Agrobacterium tumefaciens
atgcagataccacccgttttccccaaaggcgcaacccgaacggaaaacggagtggagttcactgtctattcccgccacgcctcgcaaatcgatctctgcctgttcgatgacgctggcgagaaagagacggcgcgcctgccgatgatgcgcggcgaagacgacgttcatcggctcacacatgagaatgccgggcccggcacgcgatacggcttccgtgcccacggcatttacgcccccgaacatggcctgtggtttgatcctgcaaagctgctgctcgacccctatgccaccgagatcgaccgccccttccggcacgatccctcgctttatgcctttggcgctgaaaccggcgcgatcatgccgaaggcgatcctttccgcgcatgacccggtcaagcgccagccgcctcgttttgccgaaggcgggttgatttacgaacttgccgtcaaatccttcacccagctgcatccttatgtgcctgaagatatcaggggcaccgtcgcggcactggcgcatcccgccattctcgcgcatttgaaaaaaatcggcgtcgatgctgtggaattgatgccgattaccgcctggatcgacgaacgccacctgccgccgctcgggctttccaatgcctggggttataatccggtcggcttcatcgcgctcgatccgcgcctctgccccggcggtgtgcgggaacttcgcgacaccgttgcagctttgcatgcggaaggtattggcgtcattctcgatctggtcttcaaccatacgggtgaaagcgatatcgaaggctcgattctatcactgcgcggcctcgataatctcaccgctttccgtcacccgcagggaaagccgggcgtgctggtcaacgataccggcaccggcaatacggttgcctgcgaccacccctatatccgccagctcatcgtcgattcgctgcggcatttcgttctcaacgccggcgtggatggcttccgtttcgatctcgcgcccgtgctcggcagaacagccgcgggtttcgacatggcgagcgagacgctggccgccatgcattcggacccggtgctttacgaccgcctgctgatcgccgaaccctgggatatcggccccggcggttatcaactcggcaatttccctgagagtttcctggagtggaacgaccgcgcccgcgatgacatgcgccggttctggcgtggcgatgccggcacgaccggggcgcttgccaatgcgctgtccggctcctcgccgatcttttcccgccatggccgcttaaaaagtcgcagcgtcaatttccttgccgcccatgacggtttcaccctgttcgatctcgtcagccatgagcgcaagcacaatgaaaagaacggcgagaacaatcgcgacggccacaatgacaaccattcctggaacaatggttttgaaggcctgaccgatgatcccgccattgtcgccgcccgccttgcggatgtgaaagcgctgctttccacgcttttcgtcagccgcggcaccctgatgttgacggcgggcgacgagggtggccgcagccagcagggcaatacaatgcctattgccaggacaatgagatcagctgggtcgactggtcatcgcttgtccctgagttgatcgaccacacggcgtttctcgccgcactgcgcaagcgcttcggtgtgttttctgagagtggcttcttctccggcaggggcgacgtgacatggcttgccccgggcggcgaaccgatgacggttgctgactgggagaggccggatgggcaggccttcgccatggtgctttccaccccggaccgggaaaccggcaaagctaccgagcttgccgtgctcatcaatcgcggccgtgacatcgttcccttcaccttgccgggcgatggttggcgctccatcggcacggatttcggcaatcccgccttcctgcccgcccgttccgtggtgttttatctgcgc

SEQ ID NO: 35061 - DNA, 1623 bp, Agrobacterium tumefaciens
atcaagactatcaagacgacgccttatcaggaccagaagccgggcacatccggcctgcgcaagaaggtgccagtcttcgcccaggaaaattatgccgagaacttcatccagtcgatcttcgacgcgcttgaaggttttgagggccagacgctggtgatcggcggcgacggccgttattacaaccgcgaagtcatccagaaggcgatcaaaatggccgccgccgccggtttcggcaaggtgctggtcggtcagggcggcattctctcgacgcccgccgcctccaacgttatccgcaaatacaaggccttcggcggcatcgtgctttccgccagccataatcccggcggcccgaccgaagatttcggcatcaaatacaatatcggcaatggcggcccagcaccggaaaagatcaccgacgcgatctatgctcgctctaaggtcatcgacagctacaaaatctctgatgcagccgatatcgatctcgacaagatcggcagcttcaaggtggatgaactaacggtcgacgttatcgatccggttgccgattatgctgcgctgatggaagagctgttcgattttggcgccatccgttctctcatcgccggcggcttcaaggtcgtcgtcgattccatgagcgccgtcaccggcccctatgccgttgagatcctcgaaaagcgtctcggcgctcccaagggctccgtccgcaacgcaacaccgctgcccgatttcggcggccaccatcccgatccgaaccttgtccatgccaaggagctttatgacgacgtcatgagcccggaaggcccggatttcggcgcggcttccgatggtgatggcgaccgcaatatggttgtcggcaagggcatgttcgtcactccctccgatagtctcgcgatcatcgccgccaatgccaagctggcgcccggttatgccgccggcatttccggcatcgcccgctcgatgccgaccagtgcggcagccgaccgcgtcgctgaaaagctcgggcttggaatgtacgaaaccccgaccggctggaaattcttcggcaatctcatggatgccggcaaggtgacgatctgcggcgaggaaagctttggcaccggttcgaaccatgtgcgtgaaaaggatggcctgtgggccgtgctttactggctgaacattgtcgcggcgcgcaaggaaagcgtgaaggacatcgtcaccaagcactgggcggaatatggccgcaactattattcgcgccacgactatgaggaagtggattcggatgccgccaatacgctggtggccatcctgcgcgaaaaactcgcgacactgcccggcaccagctacggcaatctgaaggtcgcggcggcggatgattttgcctatcacgatccggtcgaccagtctgtcagcaagaaccagggcatccgcatcctgttcgaaggcggctcgcgcatcgtgctgcgcctttccggcaccggtactgcgggcgcgacgcttcgactctacgtcgagcgttacgagccggatgcggcccgccacggcatcgaaacgcagtcggcgctcgccgatctgatttccgttgccgataccatcgccggcatcaaggcccataccggccgcagcgaaccgactgtcattacc

SEQ ID NO: 35062 - DNA, 1440 bp, Agrobacterium tumefaciens
atgaatgtcctttcggtttcatccgaaatttatcccctgatcaagaccggagggctcgccgacgttgtcggcgcgctccccatcgcgctcgaagcccatggcgtcagaacgcggacattgatacccggctatccggcggtgaaagccgccgtgacggaccccgtcaaatgttttgagttcaccgacctgcttggcgaaaaggccgatctgctcgaagtccaacacgagaggctagaccttttgatcctcgacgcgcccgcctattacgagcgttccggcggcccctatctcggccagaccggcaaggattatcctgataactggaagcgttttgcggcgctgtcactggcggcggcgcggatcggcgccggtgtgctccccggctggcggccggatatggtgcacgcgcatgactggcaggccgccatgacgcctgtctatatgcgttacgccgaaacaccggaaattccgagccttctcaccatccacaacattgcctttcagggccagttcggcgcaaacatcttcagcaaacttgccctgcccgcccacgccttcggcatggagggcatcgaatattacaacgacgtcagcttcctcaagggcggcttgcagacggcaaccgcgctcagcacggtcagcccatcctatgcggaagaaatcctgaccgcggaattcggcatggggcttgaaggggtgatcggcagccgcgcccatgtgctgcacggcatcgtcaacggcatcgacgccgatgtctggaacccggccaccgaccatctgatccacgacaattattccgccgccaatctcaagaaccgtgccctgaacaagaaggcggtcgccgaacatttccgtatcgatgatgatggcagcccgctattctgcgtcatctcccgcctcacctggcagaagggcatcgacctcatggcggaagccgtggatgagatcgtttccctcggcggccgcctggtcgtgctgggcgcgggcgatgtggcactggaaggcgcgcttcttgcggcggcatcccgccaccatggacgcgtcggtgttgccatcggttacaacgagccgctgtcgcatctcatgcaggcgggttgcgacgcgatcatcattccctctcgcttcgagccctgcggcctgacccagctttacgcgttgcgttacggctgcattccggtcgtcgcccgcaccggcggccttgccgacaccgtgattgacgccaaccatgccgccctcgccagcaaggcggcaactggcgtacaattttcacccgtcacacttgacggtctgaaacaggcgatccgccggaccgtccgttattatcacgacccgaaactgtggacacaaatgcagaaactcggaatgaaatccgatgtttcctgggaaaaaagcgccggtctctacgccgcgctttatagccagcttatttcgaaaggccat

SEQ ID NO: 35063 - DNA, 1260 bp, Agrobacterium tumefaciens
atgtcggaaaaaagagttcagcctttggcgcgtgatgcaatggcctatgtcctcgcaggcggaagaggaagccgtctgaaggaactgacggaccgccgggcaaaacccgcggtttattttggcggcaaggcgcgcatcatcgattttgcgctttccaacgcgctcaattccggcatccgccgcatcggcgtcgccacgcaatataaggctcactccctcatccgccacctgcaacgcggctgggacttcttccgtcccgagcgtaacgaaagcttcgacattctgccggcttcgcagcgcgtgtccgaaacgcaatggtacgaaggcaccgccgacgcggtttaccagaacatcgacatcatcgagccctatgccccggaatatatggtcattctggccggcgaccatatttacaaaatggactacgaatacatgctgcaacagcatgtggattccggtgccgacgtcacgatcggctgccttgaagtgccgcgcatggaagcgaccggcttcggcgtgatgcatgtgaacgaaaaagacgagatcatcgacttcatcgaaaagccggccgatccgcccggcattcccggcaatgaaggttttgcgctcgcctcgatgggcatctacgtcttccacacgaagttcctgatggaagcgctgcgccgcgatgccgccgatccgacctccagccgcgacttcggcaaggacatcattccctatatcgtcgaacacggtaaagccgttgcgcaccgcttcgctgattcctgcgtgcgttcggatttcgagcacgaaccctactggcgagacgtcggcaccatcgatgcctattggcaggccaatatcgacctcacggatgtggtgccggacctcgatatctacgacaagtcctggccgatctggacctatgcggaaatcaccccgccggcgaaattcgtgcatgacgatgaagatcgccgtggttcggccgtatcgtcggtcgtctcgggcgactgcatcatttccggtgcagcgctcaaccgcagcctgctgttcacaggcgtgcgcgccaattcatactcccgccttgagaatgccgtagtactgccgagtgtgaagatcgggcgtcatgctcagctcagcaatgtcgtcatcgaccatggcgtggtcattccggaaggactgattgtaggagaagaccccgaactggatgccaaacgcttccgccgcacggaaagcggcatctgccttatcacccaatcgatgatcgacaagctggacctg

SEQ ID NO: 35064 - DNA, 2397 bp, Agrobacterium tumefaciens
gaaatcatggccgcggaaatcatcgagcgactgacctaccgcatcggcaaggacgtcaaggttgcgaaaccgcacgactggctgaccgcaaccatcctcgtcgtgcgcgaccgcatcatcgacaaatggatggcatccacccgcaaggcctatgccgacaattccaagcgcgtttattatctgtcgctggaattcctgatcggccgcctgatgcgcgacgccatctccaatatcgggctgatgcatgaaatccgcgatgcgctgtcctcgctcggcgtcgatctcgacgtgattgccggtcttgagccggatgccgcacttggcaatggcggcctcggccgcctcgccgcctgtttcatggaatccatggcgaccgtcgacattcccgcctatggttatggcatccgttacgtgcacggcctcttccgccagcagatggcggatggatggcaggtggaactgccggaaacctggctggcgcatggcaatccctgggagttcgaacgccgcgaaagctcctatgaaatcggcttcggcggatcggtggagacgatcggcggatatgaagacccgcagcgtttcgtctggaaaccggccgaacgtgtgatcgccatggcctatgacaccccggtcgtcggctggcgcggcacccgcgtcaacacgttgcggttatggtctgcgcagcctatcgaccccattctcttggccgcctttaatgccggcgaccatatcggcgcattgcgcgagagcaacaaggcggaaagcctgacgcgggttctctaccctgcggacgcgaccccggccgggcaggaactgcgcctgcggcaagagttcttcttctcctccgcctcgctgcaggacattctgcgccgccatctccagcaatatcctgacttcacctcgttgccggacaaggtctcgattcagctcaacgatacccatccggccatttccatctgtgaaatgatacggctgctctgcgatgtgcacggtcttgaattcgacgaggcctggaggatcacccagggcaccttctcctacaccaaccacacgcttctgcccgaagcgctggaaagctggccggtgccgctgctcgagcgtcttcttccaagacatatgcagatcgtctacgcgatcaacgccaatacgctgctctttgcccgcaaggaaaagaagatggcggatcagcagatccgctcgatctcgctgatcgatgaaggcggcgagcgccgtgtgcgcatgggcaatctcgctttcatcggctcgcattccatcaatggcgtttcggcgcttcatactgagttgatgaaggaaacggtttttgccgacctgcacagcctctatcctgaacggatcaacaacaagaccaacggcatcaccccgcgccgctggctgatgcagtgcaaccccggcctcaccgggttgatccgggaagcgatcggcgacgatttcctcgacgatgcggaaaagctcatcgcgctcgaccgtttcgccgacgatgccggtttccgtgagaaattcgctgaagtgaagcgcctgaacaaggtgcgcctcgccaacaccgtggcacagcgcatgggcatccgcgtcgatccttcggccatgttcgacatccagatcaagcgcatccacgaatataagcgccagcttctgaaccttatcgaaacggtggcgctttacgaccagatccgttcccacccggaactggattgggtgccgcgcgttaagttcttcgcaggcaaggcggcgccgagttatcacaacgcgaagctgatcatcaagcttgccaacgatattgcccgggtcatcaacaacgacccggccgtgcgcgggcttctgaaggtggtgtttattccgaactacaacgtctcgcttgcggaaatcatggttcccgccgccgatctttccgaacagatttcgaccgccggcatggaagcgtccggcaccggcaacatgaaatttgccctgaacggcgcgctcaccatcggcacgctcgatggcgcgaatgtggaaatgctcgaacatgtcggcgctgacaacatcgtcatcttcggcatgacggcggaagaagtctccagggctcgcgccgaaggccataatccccgcgccatcatcgaagggtctgcggaattgtcgcaggcgctgtcatcaatcgcgtcgggtgtgttttcaccggatgaccgttcgcggttttccgccctgatggatggcatctacaacagcgactggttcatggtggctgccgatttcgacgcctatgccgatgcacagcgcaaggtggacgcgatctggagcgatcaggatagctggaacacgaaagcagtgcgcaacacggcgcgtatgggctggttctcgtccgacaggacgatccgccaatatgccaccgagatctggaga

SEQ ID NO: 35065 - DNA, 723 bp, Agrobacterium tumefaciens
ttcgatctttccggccgccgcgccctgatcacgggttcgtcccagggcatcggtttcgcgctggcgcaagggctttcggaagccggggcggaagtggtgctgaacgggcgcgacgaagcgaagctgaaagccgccgctgccggcatcaagggcgcgagaacacttgccttcgacgccacagatcatggcgcggtgcgcgaggctatcgaccgcttcgaggcggaggttggcgcgatcgacattctcgtcaacaatgccggcatgcagcaccgcacgccgctcgaggattttccggccgatgccttcgagcgcctgctgcaaaccaacatcgcctcggtattccacgtcggacaggccaccgcgcgccacatgatttcgcgcgggcgcggcaagatcatcaatatcgccagcgttcagacagcacttgcccgccccggcatcgcaccctacaccgccaccaagggcgccgtcggcaatctgactaagggcatggcgacggactgggcaaaatatggcctgcagtgcaatgccatagcacccggttatttcgataccccgctaaacgccgcccttgtcgcagacgagacgttttcggcctggcttgaaaagcgcacgccggccggacgctggggcaaggtggaagagcttgtcggcgcctgcattttcctgtcgtccgacgcctcgtccttcgtgaacggccatattctctacgtcgacggcggc

SEQ ID NO: 35066 - DNA, 975 bp, Agrobacterium tumefaciens
gcgattgtcgcccacggggcaaaggatgtgcgcatcgaagaccggccggaggaaaagccgggtccgggcgaggtgcggctccgtctggcgaggggcgggatctgcggcagtgatctgcattattacaatcatggcggtttcggcgccgtgcggcttcgtgaacccatggtgctgggccatgaggtttccgccgtcatcgaggaactgggcgaaggcgttgaggggctgaagatcggcggtctggtggcggtttcgccgtcgcgcccatgccgaacctgccgcttctgccaggagggtctgcacaatcagtgcctcaacatgcggttttatggcagcgccatgcctttcccgcatattcagggcgcgttccgggaaattctggtggcggacgccctgcaatgcgtgccggccgatggtctcagcgccggggaagccgccatggcggaaccgctggcggtgacgctgcatgccacacgccgggccggcgatttgctgggaaaacgtgtgctcgtcacgggttgcggccccatcggcattctctccattctggctgcgcgccgggcgggtgctgctgaaatcgtcgccaccgacctttccgatttcacgctcggcaaggcgcgtgaagcgggggcggaccgtgtcatcaacagcaaggatgagcccgatgcgctcgccgcttatggtgcaaacaagggaaccttcgacattctctatgaatgctcgggtgcggccgtggcgcttgccggcggcattacggcactgcggccgcgcggcatcatcgtccagctcgggctcggcggcgatatgagcctgccgatgatggcgatcacagccaaggaactcgacctgcgtggttcctttcgcttccacgaggaattcgccaccggcgtcgagctgatgcgcaagggcctgatcgacgtcaaacccttcatcacccagaccgtcgatcttgccgacgccatctcggccttcgaa

SEQ ID NO: 35067 - DNA, 1542 bp, Agrobacterium tumefaciens
caggcgggcctgctggccttttcagttggaaaaattgccgatggcgagccgatgatggcgatcgtgccggccgccgttgcggtccttatcctcgggcttctcaaggcgtggctggaaaaagtcgcggcgcggctgtccttccgggccgcgcgcgcagcactttcgcagcggcggttcgaggcgttgcaggccgtggcgaaggtttccccgctcgatctgtcgcgcacggcctcgggtgaggcggcaggtatcgtggcggaggctgcggaagcgctggtgccctatctttcccggttccagccggcgcgcatgaaagccaccatcgttcccctggttttcgtgctcgccatcctgccctttagctggattgcggcgcttgtgcttctgctcgccatgcccaccatcccgcttttcatggccctgatcggctggcaggcaaaggccgccagtgaaaagcagctggccgagacgggcaacatcaacgccttcctgctcgatcggctgcgcgggctggaaacgatccgcacgctcaaggccgttgacctgacggcggcgcgcctcgatgccgatgcgcagaacctcaagaagcggacgatggccgttctgaggatcgccttcctctcctccgccgtgctggagctttttgcggcgatcggcgttgccatgaccgccgtttatatcggtttccacctgctcggttttctcgatttcggcgcgtggggcgaaaagcttacgctggccgaaggcctcttcatcctgctgcttgcacccgcttttttcgagccattgcgcgaactctccgccgtctggcacgaccgcgcggccggcgaggcgtcacttaatgcgctcgccacattaacggccggcggtgctgccatcgtgggtgagggcgcggatgtggtgcgcgcgccatcttcgacacccggcctgctggagatggaaaacctttccttcgcttacccgaatgctccgcctgtcatccggaatttcaacctgacggttcagcagggcgagagagttgcgattcttggggcttccggttgtggcaaatccactatactctccttgattgccgggctggccgaggcgggtgagggcgtaatcaggatcggcggcgtcacgcttgatgacgcaacggctgatgggctgcgcggaacgatcggctgggtcagtcagaagccattcttttttgccgcgtccatgaaggcgaatattggttttggccgcttggcggtcagcgaggccatggtggaagaggtcctgcaccgcaccggactggatggattgacgcaggcgcgccggcatttgcagatcggagacggcggaaatggcatttcgggcggggaggcggtgcggctcgccatagcgcgcgctttcgccgatccggcaacgcagcttgttctggccgatgagccgaccgcgcatctcgaccgggaaacggctgctctcgtcacggataacctgctgcaactggcaaagggcaggacattgatcgtcgcgacccatgatccggtacttgcggcacgcatggacaggatcgtg

SEQ ID NO: 35068 - DNA, 1494 bp, Agrobacterium tumefaciens
gactggacggtcatcgtcggcagcggcatggccgggctgatggcggcgatgacgctggcgccgcagcccgtgctgcttgtgacgcgcggcgcgctcggcggcgaaacctcaagcgcctgggcgcagggcggcatcgcggccagcctcgggccggatgatcgcgcagccctgcatgtcgccgatacgctcgctgcgggcgatggcctttgtgatgaagatatggtggttggcatcgtttcctcggcccccgccgtcatagatgcgctggagcgggcaggcgttcgcttcgaccgggacgccggcggcaactatgtcttcgggctggaagccgcccatagtcggcggcgcattctgcatgccgaaggcgacgggtcgggtgcggcgatcgtcagggctcttacagatgccgttcgccgtacaccttcgatcacggttctggaaggcacggaagtgcgccgcctgttgacggaagacagcgtcatcgccggtctcgcctgcgccggcccgaacggcagcttccttctgccagcaagccaggtcattctcgccaccggcggtctcggcggactttatgacgccacgaccaatccctccggcaatttcgggcagggcatcatgctcgccgcccgcgccggcgccatccttgccgacatggaattcgtgcagtttcacccgacagcactttcctccccccggcgaccgctggcgctggtgagcgaagcggtgcggggtgaaggcgccctgcttctcaatgaaaacggcgaaaggttcatggcggcagtgccgggcgcggaactggcgtcgcgcgatattgtcgcccgcgccatcgaccgtgaaatcctgcgcggcggccaggtctttctcgatgcccgccaggcgctcggctccggttttgccagccgtttcccgtcaatcgacctgctttgccgcgaggcgggcatagaccccgcccgcgaactcgtgccggtccgcccggccgtgcattaccacatgggcggtgtcgccacggataataaaggcagaagttcggtgcgcgggctctgggttgcgggggaaaccgcctgcaccggccttcacggcgcaaaccggcttgccagcaactcgctgctggaggccgccgcgatgggcatgcgtgcggcgcaggatattgccggccggcccgcacccgcggcaagatcggcggctgccgtttcgcccaacgcgacagctgatttttcgcccgccgatctcgccgctgtcaggcccatcgtttcccgtcatctcggcatcgtcagacatgccgcgggactggccgaagccatcagggacttactgccgcttgccgagcgaaacggcccggcctccgacccggcggtggtcgctctctccatcgccgttttcgcagccctgcggagggaatcgcgcggcgcgcatttccgtgacgatttttcgcagaaggatgccaaggccatgagacgccgactgagcctgaacgacgtcgtcaccgtcgcccat

SEQ ID NO: 35069 - DNA, 747 bp, Agrobacterium tumefaciens
atgagcggcaccatcctcatcaccggcgcgacgtccggtttcgggcaggccacggcgcggcgtttcgtcaaggaaggctggaaggtcatcggcaccggccggcgggcggaacggctggaggcgctggcggctgaactcggccaggcctttcatggtatcgccttcgacatcaccgacgaggatgcgaccgaaaaggcgctcgcggctttgcctgatggtttcagggatatcgacattctcgtcaacaatgccggtctggcgcttggcaccgcgcccgcgccgcaggtggcgctgaaggactggcagaccatggtggacaccaacatcaccggtctcctgaacattacccatcatcttctgccgacgctgatcaagcagaagggcattgtcgtcaacctctcgtcggtggccgcccattacccctatttgggtggcaatgtgtatggtggcaccaaagccttcctgcggcagttctcgctcggtcttcgctccgacctgcacggcaagggtgtcagggtgacctcgatcgaacccggcatgtgcgaaacggaattcacgctggtgcgcaccggcggcaatcaggaagcctcggataatctctacaagggcgtcaatccgattacggccgacgatatcgccaatacgatctattgggtcgcctcgcagccgaagcatatcaacatcaacagccttgaactgatgcccgtcaaccagtccttcgcgggtttccaggtctatcgggaaagc

SEQ ID NO: 35070 - DNA, 1572 bp, Agrobacterium tumefaciens
tatgactatattgtcatcggggcggggagtgccggatgtgtccttgccaaccgcctttcaaaggatccgaacaaccgtgtcctgctcttggaggcgggtggcaatgacaattaccactggatccatattcccgtcggttatctctattgtatcaacaatccgcgcaccgactggtgtttcaagacggccgaagagccggggctcaatggccgcgcgctgatctatccgcgcggcaaggttctgggcggctgctcctccatcaacggcatgatctacatgcgcggccaggcgcgggactacgatgtctggcgccagcttggctgcgagggctggggctggagcgacatcctgccctatttcatgaagtcggaagatttttaccgcggcaagagcgacctgcattccgccggcggtgagtggcgggtggaaaaagcccgcgtgcgctgggatgtgctggacgccttccagaaggcggcaggcgaagccggcattcccgcgaccgatgacttcaatcggggcgacaatgaaggtgccgggtatttcgatgtgaaccagcgctctggctggcgctggaacaccgccaaggcatttctcaagcccgcacttggccgcaagaacctcacggttctgaccaaggcgcatgtcaagcggttgatcatcgaggagtgccgggttacagccgtcgagttccaccatgacggcgtcctgaaaaagatgcgcgcacggcgcgagacggtgctatcagccggcgcgatcggttcgccgcatattctggagctttccggtgtcggccgtggcgatgtgttgcaggccgccggtatcgacacggtggcggaggttcatggggtgggcgaaaacctgcaggaccatctgcaattgcgcatggtctataaggtttccggcgttctgacgctgaatgaacgggcctccaccctgttcggcaaggcgaggatcgggttggaatatgcgctgacgcgctccgggccgatgtcgatggcgccgagccagcttggcgtcttcacccgttcctcgccggagaaggaaaccgccgatctggaatatcatgtccagccggtttcgctcgacaagttcggggatccggttcacacttttccggccattaccgcaagtgtctgtaatctgcggccggaaagtcgcggctcagtgcatgttaaaggaccggatttcgccatgcagccggaaatccgcccgaactatctttccaccgaaggcgaccgtcaggtggccatcgacgccatgcggctgacgcgccgcatcgtcgcccagccggcgttttcccgcttcaacccgcaggaataccggcccggcccgtcgttcgaaaacgacaatgatctggccaaggcggcgggcgatatcggcaccaccatcttccaccccgtcggcacgttgcgcatgggctcggatgtggagagcgttgtcgataacaggctgaaattccgaaggctcgccgggctgcgcgttgccgacgcctcggtgatgccgcgcatcacctccggaaacaccaattccccgacgatcatgattgccgaaaaggccgccgacatgatcctt

SEQ ID NO: 35071 - DNA, 1911 bp, Agrobacterium tumefaciens
ctgtgggtgccgccgcgggaaaggctggagcactcggcgctttttgctttcgcggcgaaaaccgcaccgctgcacggtctggctgccgatgattatgccggcctcttgcgctggtccatcgacgccccggatgagttttacgatgcgctgtgggacgaactcgcgatcatcggcacgcgcggcgaggcggcattcaaagccggcgcgacgatccgggacgccgagttttatcccggcgcgcggctcaattatgcggaaaacctgttgcgcgatgccgatgaacggttggccatcatcgcctatcgcgacgatggcacacgacgcgagataagccgcaggaagctctatgatgaagtgtcgcgcatggtgcaggcgctggtccatgcgggcgtgaaggagggcgaccgtgtcggcgccatcgtcacgcatgatatcgaggcgatcgtcagctatctggccgtgagcgccatcggcgccatctggtcgtcctgctcgccggatttcggcccggcaggggcttcggaccgtctgtcgcagatcgacccgaaaatcctgatcgccgtgccggaatatggttatgccggcaaacgcattgatgtcggcccgaccatccgcgccgtggcggaaagtgcgaggcctgaaaagatcgtgctgattggtgattccgttgccgaaagcctcgccgatcttggctgtttgacgcttgcggatttcgtcgcgccctatgcggcgggcgagattgccttcaaccgtctgcccgtgaaggcgccgctggcgatcctttattcttccggtacgacgggcaagccgaaatgcattacccattccggcggcgggctgcttcttcagcacatgaaggagcagaagctgcaatgcgatatcaggcagggcgaacgcttcttctatttcaccacctgcggctggatgatgtggaactggcaggtttccggtctggcactcggcgcgacactggtgacctatgacggtaatccgggctatccaaataccgcgcggctgattgaccttatcgatgccgagggtattgccactttcggcacgtcggcgaagttcattgacgcctgcctgaaagcgggcctgcagccgcgcgagagccatgacctctcatcgttgcggacaatcctttccaccggctcgccgctcatcccgcaatccttcgattatatctatcgcgactggagggcggatctgcatctcgcctccatttctggcggtactgacatctgcgcctgttttcttggcggcaatccgctgcagtcggttcatcgcggtgaattgcagggcgcgatgcttggcatggatatcgatacgctcgatgatgaaggccgttccgttcgcggcgtcgccgctgaacttgtctgccgcaatgctcacctgtccatgccggtcaaattctggggcgatgaggacggctcacgttatcaggccgcctatttcgaccgttttcccggtatttgggcacatggtgattttgccgaactgcgcccctccggcggatatgtcatccatggccgctcggacacgacgcttaatcccggcggggtccgtatcggtacggcggaaatctatcggcaggtggaaaccgtgcctgatgtcgaggaggccattgccgtcgggcaggatattgacggcgaccagcgggtgatccttttcatacgcatgaaggaaggcgcggtcctgacggaggagctggaaaagaccattcgcagccgcatccgtttaggtgcgacgccgcggcatgtgccggcaaggatcatcgccgtcagcgccattccccgtacccgttcaggcaagatttccgaaatcgcggtgcgcgaaaccattcatggccggccagtgaagaataccgatgcactcgcaaatccggaatcgctcgaacttttccgcaacctg

SEQ ID NO: 35072 - DNA, 768 bp, Agrobacterium tumefaciens
aaaaccgtgctcgttacgggttccaccagcggcatcgggctcgccatcgccaagcgttttgccgaagccgggtttctggtcgccgtccacggtgtggagacggcggcggagggcgcgcaggcccttgaagcggttgcgacagtggcgcgccaccggccggtctatttttccgccaatctcgcccattacgacgagagcgcgcaccttccggaaaaagtcatcgccgagttcggccatatcgatgtgctggtcaacaatgccggcatccagaaggtcgcgccgatcgacgagttcgattttgccgatttctcgcgcatcgtcgcgatctcgctcgacagcgctttccatacgatccacgcagccctgccgggcatgaaggaaaggggctggggccgcatcgtcaatatcgcgtccgcgcatggattacgcgcctcgcccttcaaggcaccttatgtggcaaccaaacacgccgtggttgggctgacgaaaagcgtggcgctggaagtggccgagcagggcatcacctgcaacgccatctgcccgggttatgtctggacccccctggttgcagcccaggtggccgatcaggcgcgggtgcatggcatgagcgaggacgatgtggtgaagaaggtgatgcttgcgccacagccgaccagacggttcgtgcagccggaggaagtggcggaaatggcgctttatcttgcgggcgatatggcgcgctccatcaccggcacgaccatttccatcgacggcggctggacggcgaaa

SEQ ID NO: 35073 - DNA, 2349 bp, Agrobacterium tumefaciens
tcgggggtttcatttatggcagtcaccgtcactgcggtcattcttacgctgatcggccttgcgctgttcggcttcggctctcagctcgtcatgttgggcgggagcttttattatcttctttccggactggcctttctgttgacggccgttctgctgttcaagcgcaatcgcgccgcccttcacgtttatgccgttttcattgtcgcgacgcttgcctgggcagtctgggaagtcggatttgactggtggcagcttggaccgcggggcggcgtcattattctcattggtctttggctgctggtgccgtgggtcaggaaaccgcttggcttttcaagcccgaccggtctgagttacagccctaacgcttggccgctggtgctttccgttctcgcctcctttgcagttgccggctactccatggcgcaggacccgcatgatcaggcgggttcgttaccgcaggagatcgcatctgcggcacctgtctatggcggcgaagtgcctgacggtgactggcatcaatatggccgcacaccctatggccagcgttattcgccgctgacgcaggtgaatgtggacaatgtctcgcagttgaaggaagcctggcgttatcagacgggggacgtgaagctgcctgatgatgtgggtgagaccacctatcaggtcacgccactcaagatcggcaatacgctttatatctgcacgccgcataattgggcgatcgccatcgatgccgccaccggcaaggaaaaatggaaatacgaccccaatgtcggtctcaatcctgatcgccagcaccagacgtgccgtggcgtttcctattatgccgaaccgaacgccgctgccggcacggcctgcgcccagcgcgtctacctgccgacctcggacgcgcggctgatcgcgctcgatgcggccaccggccaggtctgcacctcctttgccgatcagggtgtgctgcatcttgaacagggcatgaagtacaatcccgccggttattattattcgacctcgccgccggtcatcgcggctggcaaaatcatcatcggcggcgcggtgaacgacaattattcgacgcaggagcagtccggcgtcatccgcgctttcgatgtgaatagcggtgctctcatctggaactgggattccggcaacccgcagaagaccgagccgatcgcggcgggtgagacctatacgaccaactcacccaacagctggtcggtgctgagttatgacgaaggcctcggcctcgtctacgtgccgcttggcaaccaggtgccggaccagcttggcatgggccgcagcgagaatgtcgagaaatattcctcctcgattgtcgcgctcgatatcaatacgggcaaggaccgctgggtgcgccagacggtacatcacgatctctgggacatggatgtgccggcccagccggtgctgctcgacatcaccaaggatggccagacggttccggccctcgtgggtcccaccaagcagggcgacatctacgtgctcgacaggcgcaccggtgagccgcttctgccgattaccgaggaaccggcgccgaccggagccatccctgaagacttcacatccccgacgcagccaacctcggcgctgtcgttcaagccggaaccgctgcaggaaaagaacatgtggggcgtctccatgttcgaccagctcgcctgccgcatccgcttccatcagctgaattacaagggccgctatacaccgccttcgctcaacggctcgatcatctatcccggcaatttcggcacgttcaactggggcagcgtggcggtcgatcccgagcgtcaggtgatgttcgggatgccaacctatctcgccttcacctcgcagctcgtgccgcgcgccgacattccgccgaagggacaggatgaaaagggcagcgaacagggcctcaaccgcaatgacggtgcgccctatggcgtctttatggggccattcctcggtccgctaaaaatcccctgccaggccccgccatggggttatgtcgcgggtgccgatctgcggaccggcgatgtcgcctacaagcataagaacggcacggtctatgacatgacgccgctgccgctacccttcaaggtgggggtgccgggcattggcggaccgatgatcaccaagggcggcgtcgccttcctcggtgcggccgtcgacaactatctgcgcgcctatgatctcaccacgggcaaagagctctgggaagcgcgtctgccagccggcggtcaggcaacgcccatgacctactcgctcgaaaacggaaaacaatatgtagtgatggtcgcgggcggccacggttcggttggtaccaagcccggtgattacgtcatcgcgtatacgctgccc

SEQ ID NO: 35074 - DNA, 1311 bp, Agrobacterium tumefaciens
atgcggattgtgatgatcggttcgggttatgtcggcctcgtgtccggcgcgtgttttgcagattttggccatgatgtggtctgcgtcgacaagatgccggagaaaatcgaggctttgaaaagcggccatattccgatcttcgagccgggtctggaaaccatcgtcgccaacaacgccaaggctggccggttgagcttcacgacagatctttccgccgctgtcgccaatgccgatgtcgtcttcatcgcggtcggtacgccttcgcggcgcggggatggacatgccgatctcggttatgtctacgcggcagcgaaagagatcgcccatgctcttgatggtttcaccgtcatcgtcaccaaatccactgttcccgttggcaccggcgacgaggtggagcgcatcattcgcgaggaaaacccctcggccgattttgccgtggtttccaacccggaattcctgcgcgaaggggctgccatcgaggatttcaagcggccggaccgcattgtcgtcggcctctcggatgagcgcgcacgccctgtgatgaccgaagtttaccgcccgctttacctcaaccagtcgccgctgctcttcaccacaaggcgcgcttccgaactcatcaaatatgccgccaacgcctttctggcgatgaagatcaccttcatcaacgaaatggctgacctctgcgaaaaggtcggcgccaatgtgcaggatgtttcccgcgggattggtctcgatggccgtatcggctcgaaattcctgcatgccggccccggttatggtggctcctgtttcccgaaggatacgctggcgctcgccaagaccgcgcaggattatgatgcgccggtacggctgatcgaaaccaccatcgccgtcaacgacacgcgcaagcgcgccatgggccgcaaggtcatcaatgcggtgggcggtgacgtgcgcggcaagaaaatcgccgtgctgggcctgaccttcaagccgaacactgacgacatgcgcgacagcccggccatcgccatcatccagaccctgcaggatggcggcgcaaaggtggtcggctacgatccggaaggcatggcgaatgcccggcacctgatggaagatatcgactatgcggcaggcccttacgaggcagcggaaggcgccgacgccgtcgtgatcgtgacggaatggaaccagttccgcgcgctagacctgccgcgcctcaaagccatcatgaaaagtcctgtgctcgtggatttgcgcaatatctaccgcacggacgaggtcgccggccatggcttcatctatgccgcggtgggtcgcccgcatgaaggc

SEQ ID NO: 35075 - DNA, 1497 bp, Agrobacterium tumefaciens
gacgtgaaacaggaagccgcggctctgctcgacaagatgggtgttgcccgcgatctttataccggcggcgacatggcgtccttcagccccgtgacgggtgagcagatagcaagcctcaggaccgtgtcggtagagggtgtcgcagccgtggtcgacaaggctgatgcggcgttcaggacctggcgtaatgtgccggcgccgcgtcgtggcgagttgatccgcctgcttggcgaagaactgcgcgccttcaagaccgatctcggccgtctcgtctcgctggaagcgggcaagatcccgtccgaaggtctcggtgaagtgcaggagatgatcgatatctgcgatttcgctgtcggtctctcccgccagctttacggtctcaccatcgccaccgaacgtcccggccaccgcatgatggaaacctggcatccgcttggcgtcgtcggcgtcatctcggccttcaatttccccgtcgccgtctggtcgtggaatgccgcacttgccctcgtctgcggtaattcggtggtctggaagccttcggagaagaccccgcttacggcgcttgccgtgcagggcatcttcgagcgcgccgccgcccgctttggcgatgcgccggaaggtctgtcccaactgctgatcggtgaccgcgccgtgggtgaagccatggtggattaccccaaagtgccgctcgtctccgccaccggctcgacccgtatggggcgcgatgtcggtccgcgtctggccaagcgctttgcccgcgccattctggaacttggcggcaacaatgccggcatcgtctgcccgtctgccgatctcgacatggcgctgcgcgccatcgccttcggcgccatgggcaccgccggccagcgctgcacgacgcttcgccggcttttcgtacatgacagcgtttatgaggagctcgtgccgcgcctgaaaaaggcttacgcgtctgtctccgtcggcaatccgctggaaagttccgcactcgttggcccgctggtcgacaaggcggcctttgacggcatgcaaaaggcgattgaggctgccaaggcggccggcggcgttgtgcatggcggcgaccgcgtcgataccggtgcggcagatgcctattacgtgaaacctgcactcgtcgaaatgccgaagcaggttggccccgttctggaagagaccttcgcgccgatcctctatgtcatgaagtatagcgatctcgatcaggcgatcgacgcgcataatgccgtcgccgcgggtctttcctcgtccatcttcacccgtgacattcaggaatcggaacgtttcctgtcgtcggaaggctcggattgcggcattgccaacgtcaatatcggcacatcgggtgcggaaatcggcggcgcgtttggcggcgagaaggaaaccggtggcggccgtgaatccggttcggattcttggaaggcctatatgcgccgcgccaccaacaccatcaactattccaaggcgctgcctttggcgcagggcgtttccttc

SEQ ID NO: 35076 - DNA, 3683 bp, Agrobacterium tumefaciens
gccgatggtgcaagcaatgccggtgtaactatccagcaggtgggaaacagtatcttccagaattttgcgccgccggtgcgcgaacagagcctgctgcgcaaggcggtcactgccgcctaccgccgggcagaagaagaatgcatggcgcctttgatcgaagcggcgacggtgacggctgaccaggcgaaagccattcgcgacaccgcccgcaagctgatcgaggcgctgcgtgccaaaaccaagggcacaggcgtcgaagggctggtgcaggaatattcgctttccagccatgagggcgtggcgctgatgtgccttgccgaagcgctgctgcgcattcctgacaccgccacccgcgacgcgctgatccgcgacaagatcgcgcgtggcgactggaagtcccatattggcggcgggcgttcgcttttcgtcaatgccgccacctgggtctcgtcatcacaggcaagctcacttcgaccgtcaatgacagcggcctttcagcggcgctgacgaagctgatcgcccgcgccggcgaacccgtcatccgccgtggcgtcgacatggcgatgcgtatgatgggcgagcagttcgtgaccggcgaaaccatcggtgaggcgatcaagcggtcgaagccgcttgaggagcagggcttccaatattcctacgacatgctgggcgaagccgcgaccaccgcaaaggatgccgagcgttattacaaggattatgaaaacgccatccacgccattggcaaggcctccgccggccgcggcatctatggcgggccgggcatttccatcaagctttcggcgctgcatccacgctacgcccgcgcgcaggccgagcgggtgatggcggagcttctgccgcgcgtgaaatcgctgatgctgctcagcaagacatacgatatcggcctcaatatcgatgcggaagaagccgaccggctggaactgtcactcgatcttctcgaagaactggcgctggacaaggaccttgctggctggaacggcctcggtttcgtggtgcaggcctatggccgccgctgccccttcgttctcgactacatcatcgacctcgcccgccgttcgggccgccgcatcatggtgcgcctcgtcaagggcgcttattgggatgcggaaatcaagcgcgcgcaggtggaggggctggaagacttcccggtctttacccggaaagtgcataccgatgtctcctacatcgcctgcgcccgcaagctgctcgacgcgcgcgatctggtcttcccgcaatttgcgacccacaatgcgcagtccatggcgaccatctatcacctcgccggtcccgatttcaaactcggcgactacgagttccagtgcctgcacggcatgggcgaaccgctttacagcgaagtcgtcggcaaaaagaaactcgaccgcccctgccgtttctatgcccctgtcggcacgcatgagacgctgctggcctatctcgtgcgccgccttctggagaacggcgcgaactcctccttcgtcaatcgcattgccgatccggccgtgccggtggattccctgctggaagacccggtcgcggtggtgaaggcctatgccgttcccggtgcgcagcacgaccgtatcgccgcccccgccgatctcttcggcccggaacggaaaaactccgccggcgtcgacctctccaatgaaacaacgctctctgccctcgacaaaacactgaaggcgggtgcagcaacggaatggaaggctgcggcgccacaggctggcggccagacgcgcccggtcctcaaccccggcgaccacagcgatatcgtcggccatgtgacggaacccaccgaggccgatgtcgaagcggccatgcagcgggcggcggcttcaagctggccctctatgccagtggaagaccgtgccgcctgcctggagcgcgcggccgacgccatgcaggccgaaatgcccacactgctcggcctcatcatgcgcgaggcgggaaaatccatgcccaacgccattgccgaggtgcgcgaagccatcgatttcctgcgttactacgcggcagaagcccgcaggaatttcaaatcggatgaaaaatcgctcggtcccgtcgtctgcattagcccgtggaacttcccgctcgccatcttcatcggtcaggtggccgcagcgctggtcgccggcaacccggttctggcaaaacccgctgaggagactccgctgatcgccgcgcagggtgtgcgcctgctccatgaggcgggcgttccgcaagacgccgtgcagcttctgccgggcgatggcaagacgggtgcggcgctggtcggctcaccactgacggcgggcgtgatgttcaccggctccactgaggtggcgcggctcattcaggggcagcttgccggccgggttctggccaatggccagccggtgccgctgattgccgagaccggtggtcagaacgccatgatcgtcgattcctccgcgcttgccgaacaggttgtcgccgatgtcatcgcgtctgccttcgacagtgccggacagcgctgctcggcactgcgcatcctctgcctgcaggaagatgtggcggaccgcacgctgaccatgctgaaaggcgcgctgcacgaattgcgcatcggccgcacggatcagctctccgtcgatgtcggccccgtcatcaccgccgaggccaagggcatcatcgaaaagcatattgacggcatgcggtcgctcggtcaccgcatcgagcagattgcgcttgcgggggaaaccggcaagggcaccttcgtaccgccaaccatcatcgagatgaaatcgctcgccgatctgaagcgcgaggtcttcgggccggtgctgcacgtcatccgcttcaagcgcgatcatctcgaccggctgatcgatgagatcaacgccaccggctacggcctgaccttcggcctgcatacgcgtctcgacgatacgatccagcatgtgctctcccgcgttgcggccggcaatctttatgtgaaccgcaacatcatcggcgcggtggtcggtgtgcagccctttggcggacgcggcctttccggcaccggccccaaggccggcggtccgctttatctcggccgcatgacggagaaagcgccaaagatagaccgcatcgccagccagcaggatcaggctgcggtcgatctcgcccgctggctggatgaaaatggtcagactgttgcggcagaagccgcacgccaggcggctgcgctttcaggccttggctttgagaccgagctggccggccccgtcggcgagcgcaatgtctatgcgctgcatccgcgcggcaagatcctgctggtgccggcaaccgaacaggggctttaccgtcagcttgcggcagcgctatctaccggcaactctgttgtcatcgacaatgcttcgggactggaaaaggcgatctacggcctgccggcaagcgtgacctcgcgcatcgtctgggcggatgactgggaaaaatcggcacccttcgccggtgcgctggtcgagggcgatgcggaacgcgtggttgcgatcaacaggaagatcgccgccctgcccggcccgctggttctctttcaggcagcgacgacggacgcactttccggcgaaagccagccctatactctcgactggctggtggaagaggtttcagtcagcgtcaacaccacggccgccggcggcaatgccagcctgatgagcattggctaa

SEQ ID NO: 35077 - DNA, 1821 bp, Agrobacterium tumefaciens
ttcatatccgaaagacggtagatgacagacacccagggtatcgccccggcgatcgcgcaggcgttggaaaaacgcggctacaaagacttgacccccgtacagcaagccatgcttgcgcccgaacttgccaacaaggacgcgctggtttccgcgcagaccggctccggcaagacggttgccttcggcatagcgcttgcgaccacgctgctgtcggaaaatacacgcttcggtcaggcttccgcaccgctggcgctggcaatcgcacccacccgcgaactggccatgcaggtcaagcgcgagctggaatggctttatgaattcgccggtgtctccatcgcatcctgcgtcggcggcatggatatccgcaacgagcgccgggcgctggagcgcggcgcccatatcgtcgtcggcacgcctggtcgcctgtgcgaccatatcaagcgcaatgcactcgatctgtcgtcgatccgcgccgtggtgcttgacgaggccgacgagatgctcgatctcggcttccgcgaagatctggaattcattctggaagaatcgcccgacgatcgccgcacgctgatgttctcggccaccgtgccgcgcagcatcgccaagctggccgaaagctaccagaagaacgccgtgcgcattgccaccgcttccgaacagaagcagcatgtcgatatcgaatatcgcgcgcttctggtgtcgccttccgatcgcgagaacgccatcatcaacgcgctgcgcttttacgaagcccgcaacgccattgtgttctgctccacccgcgccgcggtgaaccacctgacggcccgcctgaacaatcgaggcttctccgtcgtggctctctccggcgaactgacccagaacgagcgcacacatgccctgcaggccatgcgtgacggccgcgcccgcgtttgcgtggccaccgacgtagccgcccgcggtatcgacctgcccggcctggaactcgttatccatgccgacctgccgaccaattccgaaacgcttctgcaccgttcaggccgtaccggtcgtgccggccaaaagggcgtcagcgccatcgtggtaccggtcagtcagcgccgcaaggccgagcgcctgcttgagggcgccaaggtcagcgccgcatgggtgcgcccgccttcggttgaagagatcgtggagcgcgatggcgcacgccttctggccgacccgacgctcagcgaagcggtaacagatgacgaacgcgatttcgtcaacaagctgcttgaacagcacggcgcggaaaaagtcgccgccgcctttgtgcgcctttatcattcgggacgttcggcaccggaagacattttcgaagtcgcgctcgacaacactcgcaagccccgccgcgacagcttcgaaacaaccgaaaacaacgcgccgcgccgcgaccgctccgatttctccgacagcgcatggttctcgctgtccgttggccgaaagcaaagcgccgagccgcgctggcttatcccgatgctgtgccgcttcggcaagatcacccgccaggatatcggcgcgatccgcatgcagcagacggaaaccttcgtggaacttgcggccgacgccgtcgaccgttttacctccgccatcggcaaggacatgatgctcgaaaagggcattcgcctgaagcagatggaaggcaagccggaaatgaccggcaacgcccgtgaagacacaaggcccgccacagcgcagcgcaaattcacgaaatccgacaatgcgggcgctccccgagacgaccgcaaggctgacgacaagccctggaaaaagaaaaaagccttcggcgacaagccgaaatacgaaggcaag

SEQ ID NO: 35078 - DNA, 1266 bp, Agrobacterium tumefaciens
atggctcgcattgtcatgaaattcggcggcacgtccgtcgcgaacctcgaacgtattcacaatgtcgcacggcatgtgaaacgcgaagtggatgccggccatgaagtggccgtggtcgtttccgccatgtccggcaaaaccaatgagctggtggactgggtgcagaatgctgcgaaggtggccggcaccaatgccgcctccttttatgatgcgcgcgaatatgacgcggttgtcgcctccggcgagcaggtgacctctggccttctggcaatcaccctgcaatccatgggcatcaacgcacgctcctggcagggctggcagatcccgatccgcaccgacaatgcgcatggcgccgcccgcatcctcgagatcgacggttcggatatcgttcatcgcatgggtgaggggcaggttgccgtggttgccggtttccagggcatcggcccggataatcgcatcgcgacgctcggccgcggcggctcggatacgtcggctgtcgccatcgccgctgccgtcaaggcggatcgttgcgatatctataccgatgtcgacggcgtctacaccaccgatccgcgcatcgagcccaaggctcgccgcatgaagaagatcgccttcgaggaaatgctcgaaatggcgtctctcggcgcgaaggttctgcaggttcgctcggtcgagcttgccatggtacacaaggtgcgcaccttcgttcgctccagtttcgaggatcccgatgcgccgggcatgggcgacctcatcaacccgcccggtactttgatttgtgacgaggatgaaatcgtggaacaggaagtcgtaaccggcatcgcctatgccaaggatgaagcacagatttcgctgcgtcgcgtcgccgaccgtccgggcgtctccgccgcgattttcggaccgctcgccgaagcgcatatcaacgtcgacatgatcgtgcagaacatctccgaagatggctcgcgcaccgacatgaccttcacagttccttcgggcgacgttgccaaggctctgcgcgttctggacgagaacaagggccagatcggcttcgacgtcgcgcagaacgaaacgggcctcgccaaggtttcggtcatcggtatcggcatgcgcagccacgccggcgttgccgccagcgcgttcaaggcgctggccgagaagaacatcaacatcaaggcgatcaccacttccgaaatcaaaatttcgatcctgatcgacggcgcctatgccgaacttgcggttcgcactttgcattccgcttacggtctc

SEQ ID NO: 35079 - DNA, 2207 bp, Agrobacterium tumefaciens
ctgctcaagcggctgcgcgaaatgatggcggagcaccttgagccgcaggagcgtctggaccagatcgtccgtcagatagccagcaacatggttgcggaggtttgctcggtctatgtgctgcgctccgacagcgtgctggagctttatgccacggaaggtctcaacaaggatgccgtgcatcttgcccagctgaaaatggggcagggtcttgtcggcaccattgccgcttccgcccagccgctcaatctttccgatgcgcaggcgcatcccgctttccgctatcttcctgaaaccggtgaggaaatttatcattccttcctcggcgtgccgattttgcgctccggtcgcactcttggcgttcttgtggtccagaacaaggccagccgaacgtaccgggaggatgaggttgaagcgctcgagacaactgcgatgctcatcgctgaaatagtggcgagcggtgaattgaagaagatcacccgccccggcgtggaactcgacctgacgcgcgccgtgtccatcgatggcgatgcctacggcgaaggcatcggccttggtcatgtcgtgctgcatgacccccgaatcgtcgtcaccaatcttctgaacgaggatgcggatacggaaatccggcgtcttgccgatgccatcggttcgctgcggctctccatcgacgacatgttgcagcgccgcgacgtgcctacggaaggcgaacatcgcgaagttctggaaacctaccgcatgttcgcccacgatcagggttgggtgcggcgcatggaagaggcgatccgcaacggcctgacggcggaagccgcggtcgagaaggtgcagagcgacaccaaggcgcgcatgatgcgcctgaccgatccctatctgcgcgagcgcatgcatgatttcgacgatctcgccaaccggctgctgcgccagttgatcggtttcggcggtcataatcccgcgcaggattttccgctcgatgccatcgtgcttgcccgcgccatgggggctgccgaactgctggattatccgcgtgagaagttgcgcggactggtgctcgaagacggcgcggtgacgagccacgtcgtcattgtcgcgcgcgccatgggtatcccgatcatcgggcaggcgaccggcatcgtcgcacttgccgaaaataacgatccgatcatcatcgatggcgatgacggccaggtgcatttgcgcccgatgtcggatttgcagcgcgcctatgaggaaaaagttcgcctgcgcgccaagcgccaggagcagttccgcgcgctgcgcaatgtcgagccgatcaccaaggatggccagaaggtcaatctaaagatgaatgcgggcctgctggttgacctgccgcagctggaggaatccggcgccgatggcattggcctgttccgcaccgagctgcaattcatgatcgcctccaatatgccgaagggcgaggagcaggaagctttctaccgctccgttctgcggcaggcaaagggcaagagcgttaccttccgcacgctggatatcggcggcgacaaggtcgtctcctatatgcgcggccaggaagaggaaaacccggcactcggctggcgggcgatccgcctgtcacttgatcgtccgggcctgatgcgcacgcagatgcgcgcgctgttgcgtgccgcttcaggtgctgaactgcgcatgatgttgccgatggtgacggaagtgtccgaaatccgcgccgcgcgcgacctgttgcagaaagaagtgcagcatctgtcgaaggttcagccacgcgctgccgaaaaagctgcaattcggcgcgatgctggaagtgccgtccctgatgtggcagctcgatgagctgatgcaggaggtggatttcgtttccggtcggttcgaacgacctattccagttctcgatggcggtcgatcgcggcaatgcacgggtgtcggatcgttttgacaatctcggcaagccgttcctgcgcattctgcgcgatatcgtgcgcgccggtgagaaacaccacaccgccgtcacgctttgcggcgaaatggcaagcaagccactttcggccatggcgttgatcggccttggtttccgctcggtttctatgtctccgacggcgatcggtccggtcaaggcgatgctgctcgggctcgatgccgccaaccttgccgaagagctgaacgcggcgctggacgatcacaattcgctggaaagtgcgcgcgaggtgttgtta

SEQ ID NO: 35080 - DNA, 2577 bp, Agrobacterium tumefaciens
atgaatattgataaatactccgagcgcgttcgcggttttctgcaatcggcgcaaacctttgcgctcgccgaaaatcatcagcagttctcgcccgaacatgttctgaaagttctgcttgatgatgagcagggcatggccgcatcgctgatcgagcgtgcgggcggcgacgccaaggaagcgcgtctcgccaatgacgcggcccttgcaaaattgcccaaggtatccggcggcaatggcggcctttcgctgacggctccgctcgccaaggtattttcgaccgcagaagaccttgccaagaaggccggcgacagtttcgtgaccgtcgagcgtcttctgcaggcgcttgcgatcgaaagctccgcttccacctcggcttccctgaaaaaagcgggtgcgaccgcacaggcgctcaatcaggtcatcaacgacattcgcaagggccgcacggccgatagcgccaatgccgaacagggctttgacgcgctgaagaaatatgcgcgcgacctgacggaggaagcccgcgagggtagactcgaccccgtcatcggtcgtgacgacgaaattcgtcgcaccatccaggtcctgtcgcgccgcaccaagaacaatcccgtgctgatcggtgaaccgggcgtcggtaaaacggcgattgccgaaggccttgcgctgcgcatcgtcaatggcgacgtgccggagagcctgaaggacaaaaagctgatggcgctcgatatgggcgcgctgatcgccggtgcgaaatatcgcggtgagttcgaagagcgcctgaaggctgtgctgaacgaggtgcaggccgaaaatggcggcatcatcctgttcatcgatgagatgcacaccctggtcggcgccggcaaggccgatggcgccatggatgcgtccaacctgctgaaacctgcgcttgcccgcggtgagctgcactgcgtcggcgccaccacgctcgatgaatatcgcaagcatgtggagaaggatccagcccttgcccgccgtttccagcccgttctggtggatgaaccgaacgtcgaggatacgatctcgatcctgcgcggtctgaaggaaaaatacgaacagcaccacaaggtccgcatctcggattcggccctggttgcggctgcgacgctttccaaccgttacattaccgaccggtttctgcccgacaaggcaatcgacctgatggacgaggccgcttcgcgtcttcgcatgcaggtggattccaagccggaagaactggacgaactggatcgtcgcatcatccagctgaagatcgagcgcgaagccctgaagcaggaaacggaccagtcctccgtcgaccgtttgaggaagctcgaggacgaactggccgatacggaagaaaaggcagatgcgctgacggcccgctggcaggcggaaaagcagaagctcggccacgccgccgacctgaagaagcggctggatgaagcccgaaacgaactggcaatcgcccagcgcaatggccagttccagcgtgccggcgagttgacctacggcatcattcccggcctcgaaaaggaactggcagcggcggaagcccgcgatagcagcggtgccggttcgatggttcaggaagtggtgacgccggacaatattgcccatgtcgtctcccgctggaccggcattccggtcgacaagatgctggaaggccagcgcgaaaagctgttgcgcatggaagacgagctcgccaagtccgttgtcgggcagggtgaggccgttcaggcggtgtccaaggcggttcgccgttcgcgcgccggcctgcaggatcctaaccggccgatcggttcgttcatctttctcggcccgacgggtgtgggcaagaccgagctgaccaagtcgctcgcccgcttcctgttcgacgacgaaaccgcgatggtccgcctcgatatgtcggaatatatggagaaacactccgttgcccggctgatcggtgcacctccgggctatgtcggctacgaagagggcggtgccctgacggaagcggttcgccgccggccctatcaggtcgtgttgttcgatgagatcgaaaaagcgcatccggatgtcttcaacgtcctgctgcaggtgctggatgatggccgcctgaccgatggccagggccgcaccgtcgatttcaagaacaccatcatcatcatgacctcaaacctcggttcggaattcatgacgcagatgggcgacaacgacgatgtggattcggttcgcgaacttgtcatggaacgggttcggtcgcatttccggccggaattcctcaaccgcatcgacgatatcatcctgttccatcgcctgcggcgtgacgaaatgggtgcgatcgtggaaatccagttgaagcgccttgtctcgcttctggccgatcgcaagatcacgctcgaactggatgaggatgctcgcagctggcttgccaacaagggttacgatccggcttatggtgcgcggccgctgaagcgggtgatccagaaatcggttcaggaccggctggcggaaatgatcctcggcggtgaaatccccgatggttcgcgggtcaaggtaacttcgggcaccgaccggttgctgttcaaggtc

SEQ ID NO: 35081 - DNA, 738 bp, Agrobacterium tumefaciens
agcaatcgattgcaaggtaaaatcgctgtcatcaccggcgcttccaaaggacttggcgcggcaattgcgcgaagtttcgccgcagagggtgcatcagtcgtagtaaactactcgtcaagcaaatctgcggccgaagcagttgttgaggagatcatcgacgctggtggcacagccatcgccgtgaaggccgacatgagtgagcccgcggaagttgaagagctgtttgcggcaacaaacgcagctttcggccgcgttgacatcctggtcaacaacgccggtgtctatgacttccagccgctggaaaacctgtctatcgatctgttccgcaagcatatggagcttaatgtctttggctacctgctcgcgatcaaagaagctgtgaaatacatggcggagggcggcagcattgtgaacatgtcctcgacggtaacgattttcggcccagaaaacgcatcggtctatacggcaagcaaaggtgcaatcgacggtttgacgcgcgcgttgtcaaacgagctcgccccccgcaagattcgtgtcaacgcaatcaagcccggcgtggtcgacactgacggcgtgcaggccggaggctttctccactttgacttcggccccatgatcatggcgcagacgccgctcaagcgtctcggcgttcctgaggacattatacctgcagcgattttcctcgcatcggacgaatcgagctggacgactggcgaatttttcatcctcgccggtggc

SEQ ID NO: 35082 - DNA, 963 bp, Agrobacterium tumefaciens
gaaggcatgaaggcagccgtttacgatcaagcaggacctccggatgttttgacgtacagggacgtcgccgacccgattgtaggtccggatgatgtcctcatcgcagtggaagccatttcgattgaaggaggagacttgatcaatcgtcgatccacgccgcctcctggccgcccgtggatagtcggctatgcagcatctgggcgcgtcgtgggggccggtgcgaacgtgagggaccgcaaagtcggagacagggttactgcctttgacatgcagggttcgcacgccgaactctgggccgtgccagcgatccgaacgtggcttttgccatccggcgtggatgcagcgtcggctgccgctttgccgatatcgtttggtactgcccaccattgtctttttgccagaggtggccttctgcgcaaccagacggttcttgtacaggcagcggcgggtggagttggcctcgccgcagttcagctcgcggctcaagccggcgcaaccgtcatcgccgtctcaagtggagaaagccggctgcaaaggatatcttcccttggggctgatcacgttgtcgatcggtcgatggggaacgttgtcgaggctgtcagacagaacacgggaggcaaaggagtcgatctcgtgattgatcctgtcggtgtcaccttgtccgcttctctgactctcctggcaccagaaggacgtcttgtgtttgtgggaaacgctgggggcggaagcctgaccatcgatctgtggccagccatgcagtcaaatcagactttgctcggagttttcatgggcccgctattagagagacctcaggttcgtgcgacggtagatgagatgcttcaaatgctcgatcgtcgcgaaatccgtgtgatgatcgaaaagacgtttccgctctcggaagcggcagccgctcatgattttgcagaaaatgcgaaaccgcttggccgggtgattatggagccg

SEQ ID NO: 35083 - DNA, 1344 bp, Agrobacterium tumefaciens
tatatcaacggccggttcgtatcgcctgacggccgcaagacgattgccgtctcaaaccccgcaaacggggacaagctggcggagatcgtttgcggcaatgaggaagacgtggatcaggcgatcaaggccgcccgcgcggccttcggaaaatggtcgaagctgtcgggtcatgcgcgtgcccgctacctctatgccattgcccgtcatatacaaaagcgcgagcgcttcctttccgttctggaaacgatggacaacggcaagccggttcgcgaaacccgtgatatcgacattccactcgtcgcccgccacttttaccatcacgccggatgggccgaaatggtggaagacgagttccatggtttctcgcccgtcggtgtttgcggtcaggtcatcccctggaatttccctctcctgatgctggcctggaagatcgcgccagcacttgcggctggcaataccgtggtgctgaagcccgccgatctgacaccgctgacggctatcgcctttgcggaaatctgccacgaggtcggccttccggccggtgtcgtcaacatcgtgcagggcgatggctcaacaggcgctgcgatctgcggccatgacggcgtcgacaaggtcgccttcaccggttcgaccaaggttggccgcgttattcgcgagcagattgccggttcgggcaaaaaactgtcgttggaactgggcggcaagtcacccttcatcgttttcgaggatgccgatcttgatgcggcggttgaaggtgttgttgacgcgatctggttcaaccagggcgaagtttgctgcgccggttcccggctgttggtgcaggaaggcattgccgagaaattttatgcacgcctgaaaaaacgactggaaaccctgcgggtcggcgatccgctcgacaagtcgaccgatgtcggtgccattgtttccgccacgcaggtgaaacgcatcacagatctggtccgcaagggcgtggaagaaggcggtgaactctggcagagttccaacccgttgccgcccaccggcaattatgtcgctcccggcttcttcaccgatgttgatcaggcgtcgacggtttgccaggtggaaattttcggcccgatcgctgcggcaaccacattccgcacgccggatgaagccgtttcgctggccaacaacacccgttacggcctcgccgcctcgatctggtcggaaaacatcaatgtcgcgcttgatctggctgcccgggtcaaggcaggcgtggtctggatcaactgcaccaacatgctggacgccggtgcaggttttggcggctaccgtgaaagcggtttcggccgtgaaggtgcgcgcgaagggctttacgaatat

SEQ ID NO: 35084 - DNA, 894 bp, Agrobacterium tumefaciens
agtaagaaaatcggggtcgtcggctccaacatggtcgatcttatcacctatgtggaccgtatgcctggaccgggcgagacactcgaggcgcccaccttcgaaatggggtgcggcggcaagggtgccaaccaggcggttgctgcggcgcgacttggtgctgaagtgatgatggtcacccgggtcggtgacgatgtcttcgccgataacaccatccgcaacctcgcgagctttggcgttgatacgcgtcatgtggtgaaggtttccggcaaatccagcggtgtcgccccgatcttcgtcgaacaatcgggcgagaattccatcctcatcgtcaaaggagccaatgccgaccttttgcctgttgaggtcgacaaggcggccgctgatctgaaagagtgcggcctgatcctgatgcagatggaagtgccagttgagaccgtctaccatactatcgaatttgcagcccagaacggtatcgagacgatcctcaatcccgcgcctgccgctgccaatctcgatcctgagcgcatccgccaggtaaccttcctcgtaccgaacgagagcgagctcgccttgctgtcggggttgccgaccgacaccgacgaagacatcgtcagggccgcccgttcgctgatcgcacgcggcattcgcaccgtcatcgtgaccctgggcgcgcgcggtgcgcgcatgattacgtcagatgaaatcgtcaacatcgagcccgtcaaggtaacgccgagagacactacgggtgcgggcgatgcctttattggttccttcgcccgcttttacgccgaaacgcgcgaggtcgtatcctccctgaagaaggcatcgctttacgcggcgcattccatcacccgtcccggaacacagaaggcctatgccagcatcgacgag

SEQ ID NO: 35085 - DNA, 1449 bp, Agrobacterium tumefaciens
tttccagccttgcacgaggccattatgactgaaaatctgatcgagctgcgccacatcggtaagcggtttggtggcgtgaaggcgctcgacgacgtatcgctgagcattcgcccgggcgaaatccattgccttgccggtgaaaacggttccggcaaatccaccgtcatcaaaatcatgtccggggtttacacacccgaggacggtgagatcctgatcgacgggaagcctgtcggcaaactcgatccggtaaaatccgttcaccacggtattcaggtgatctatcaggatttttcgctgtttggtaacctgacggtcgccgagaacctggccatcaatacctttctgatggaaggtcgcaaaacggtcgactggcgacatgtccgtgagctggcccaaaaggcgttggaccgcctcggcgtgagcatcgatcttgatacggatgtcgaaaccctgccgacctctggaaagcagatcgtggcgattgcccgtgccgtcatggccgatgcacgcctgatcatcatggatgagccgacgaccgcgctgacgcgccatgaggttgatgccctcttcaagattgtgcgtgatattcaggcgcagggcatcgccgtgctcttcgtcagccacaaaatgcgcgagatgctcgaaatcagcgagcgcctgacagttttccgcaatggcaagaaggtggccgaagggccgatcgccgaattcgatgagccggcaatcacccgcgcgatgacggggcaggagctgaccgcccacagctacaagtgggcaccgcaggaaggtgccgatacaccggtgctggaagtccgcaacctctcggttccggcttccgtggaaaacaccgacctgacgttaaggccaggcgaaatcgtcggtatttcgggtttgatcggttcggggcgtaccgaacttgcgctggcgctgtttggcatgcgccccgattttaccggttcagtgcgcctcgcaggccgcgaggttcacccaaggaccgttcaggagggtattgcctgcggtgtcgcttatgtgccggaggatcgcctgaccgaggggctattcctgacgcaatcgatcgaacggaatatcattgtcacgtcgattgagaaattcgtccgcggtcttttcatcaatcgcaaaaaggcggacgagacgacccgcgaaatgttctcggccatgcagatcgtggcaccaggaccgcacacgccggtcaaccatttgtccggtggcaacgcacagcgcgtcgttctggctcgctggttgttgactggggccaaagtgctgatcctgaacggcccgaccgtcggcgtcgatgtcggttccaaagcacagatccacaccatcatccgcaagctggccgaaaaggaagggctggccgtgctgatgatttccgacgatgtgccggaactggtgcagaactgcaaccgcgtgctggtcatgcatcgcggc

SEQ ID NO: 35086 - DNA, 1350 bp, Agrobacterium tumefaciens
tcggacgtgctggtggtgttcggcgccacgggtgatcttgcctataagatgatctttccctctctctacgccatggtgaaacgcggcgcgctgcaaacgcccatcatcggagtcgctttcgacgattggccgcgtgagcagctgatagcgcgggcgcgcgatgcggtcgccaaccatttggacaagatcgatgaagccgtcttcgaaaaattcgccgcacagctgacctatgtctccggcgattatcgcaacgaagcgacattcgaaaagctgcgcacggcgcttggcgggcaccagcatccgctttattatctcgccattccgccttccctgttcgaaaccgtggtaaccggcctcaacagggcgggcatcgccgcttcggcccggctgatggtggagaaaccctttggccgtgaccttgcctccgccgaagccttaaatgaagcgttgcacgcggttttcgcagaggatgctattttccgcatcgaccatttcctgggcaaggaagccatccagaaccttctttattttcgttttgccaatgcctttctagagcccgtgtggaatcgcgaccacgttgagagcgtgcagatcaccatggccgaagatttcggcatcagggggcgcggcaagttttatgacgaagtcggatgtatccgcgatgtgatccagaaccatctgatcaatgtgctgttgctgctggccatggagccgccagccaccagcgcctcggatgatctcgtcgatgaaaaagtgcagatactgaaagccatgccgccgctcacccgcgatgatgtggtgcgcggacagttcagaggttatctggacgagccgggtgtcgcctcggcgtccaaccgggaaaccttcgccgccgcccgctttcgcgtcgccacctggcgctggaatggcgtgcctttcttcatccggtccggcaagaacctgccggcgcatgcaaccgaagtcgtggtccgcttcaagcggccgccaattgcgctctttggcgatgtcgagacaacgcccgccaattatgtgcgcttccgtctgggcccggatatcgcgatcggaatcggtgcgcgtcgcaaggcagctggcgatggcatgcgcggcgaggccgtagaactcggcgcggtcgatgacggtatcggtgacatggcgccttatgagcggctgatcggcgatgcgatggccggcgagcgtcagctctttacccgccaggatgcggcggaactggcctggaagatcgtggagcctatcctcgatgatcccgccgtgccgcctgtctatgaggtgggaagctggggcccggcggaaatggcagggtttggcccgccaggcggatgggttgatccc

SEQ ID NO: 35087 - DNA, 2064 bp, Agrobacterium tumefaciens
gcacccggcgcacccggcattgacgcacgctggacgtcgagcgccaagaatggcgtgggaaccgcgctgtcgaacacctcaccaatctggttcacgctcagccacggcatcctcaacgaggtctattacccgaggatcgatagtgcctgcatccgcgatctcggtcttgtggtcaccagagatgacggatacttttcagaagagaaacgggactgcacctcccttacccaacctttcgagagtggaattcccgcgttccacgtcaccaatacggcgacagatggagcctatcggattgaaaaacaggtcatcaccgatccggcgcgggcctgtgttcttctgcatgtgtccttctcgcccttgaagggaaagatgggggattaccgtgtaagcgttcttctggcgccgcatctagtcaatgccggtaatctcaactccgcctggataggggattatgaagggcgtcgggtcttgtttgcggtcggccgctcacgatatctcgctctggtctgcgacggtccctggcgcgccgcaagtgcgggatttgttggcgtctccgatggctggcaacaattgcgccggcacggacgcctcattgaggaattccagcgggcggatgacggcaatgtttcgctggctgcggaaatcgattttagcgatgcccatgacaccgcgacgttggcgctcggtttcggccagaccgaatatgaagctgcatcctgtgctgtcgcaagtctgaagtccggcttcagacgcgcacacgatgcctatatcgccaactggcgtggctggcaggacagtctttgccccctcgaccgcgatacccatcacggcgtcaattcctatcgcgtctcgaccgccgtgcttgccgcgcatcgtgccgctgaccggcctggagccgtcgtggcgagcctgtcgatcccgtggggagcctccaagggcgatgacgatcttggcggatatcatttgatatggccgcgggatctggtggaagccgccggcgggtttctagcggccggtgatcacgatgaggctttggccatccttgattatctgcgccaggtgcagcaaccctcggggcggtggccgcaaaatctctggctggatggcaagccctattggccgggcgttcagatggacgaatgcgcctttccgatcctgcttgcggatatgctgcatcggcacggccacctcgaccacgccgcaagggcggattacatgccaatgatccgcagcgctgcggcttatattctggcaaacggcccgacgaccggcgaggacaggtgggaggaagatgcaggctacagcccgtttacgcttgccgtcgagatcgccgcgctgcttgccgctgctgatctgttggatatggagggcgatgcggccgaagccacgcatctgcggcagacagccgattgctggaatgagcagatcgaaaggtggacgtttgccggtgaccagaccatgtgcgcgcagcttggtatttcgggccattatgttcgcatcgcttctcccggtaccaccgatgccgttcagctctcgggcatgacgcctatactcaaccagacaccggatcgcgctttcctgccaacaagcgatgtcatcagccctgatgcacttgcgctggtccgcttcggcctgcgcgcaccggacgatccccacattctcgcaaccgtcaaggcgatcgatcattgcctgcgcgccgagctgccgcaggggccggtctggtacaggtacacgggcgacgggtatggtgagcacgctgatggaacagcatttgacggcacgggtcagggcaggccatggccccttctgaccggcgagcgcgcccattacgaacttgctgcgggcagacgcggggcggcggaagctttgctgaccacaatggaaaaatcggcggggcagagcggccttttccccgagcaggtctgggatcaacccgatcttcccgacagggagctgttttatggctccccgtcgggcagcgcgatgccgctggtctgggcgcatgcagaacatatcaagcttctgcgttcgcttgccgatggctccgttttcgacatgccg

SEQ ID NO: 35088 - DNA, 778 bp, Agrobacterium tumefaciens
ggtcgcctgacgggaaaacgcgcgcttgtgtttggcgcaggatcatcggggccgggatttggcaacggcaaggctgcggccgtgcaatttgcccgcgaaggcgcgcgcgtagcctgtgtcgatctctgcgctgacgcagccgaagagacggctgagatcattcgcggagaaggcttggaggcgattgcggctgccgccgatgtcactgaactacagtccgtatcggccaccgttgaccgcacctgcgaggcctttggtggcatcgatattctgcacaataatgtcggcgtgacccatatgggcgggccggttgagctggatgaggaaagctttcgcgcctcggtcgatctcaatatcggctccgtttatcgcacctccaaggctgtgttgccggtgatgttggcgcaggggcggcggggccattgtcaatatctcgtcgctcgcctccattcgctggaccggctatccatattttgcctattacgccatgaaggcagctgtaaatcaggcgactgtggcgctggccatgcaatatgcccggcagggcattcgcgccaattgcattcttccgggaatgatcgacaccccactgatctacaagcagatcagcaatcaatatgcgtctgtcgaggaaatggtggcggcgcgcaatgcggctgtcccggtgggtcgcatgggcgatgcctttgatattgcccgcgccgccgtttttctcgcatctgatgaggctaagttcatcaccggcgtctgtttgccggtcgatggcgggcaaagctgt

SEQ ID NO: 35089 - DNA, 1161 bp, Agrobacterium tumefaciens
atgagcaaagcgcagatcgtcggctgggcgcattcgcctttcgggaagtcggcccttgaaaataccgagcaactgatggcttcggtcgtggcgccggccatagaccatgcgggcgtcgatgtcagcgatatcgacggcattttcgtcggcgtgatgaacaatggcttctcgaaacaggattttcagggcgccctggtagcgatgggagatgagcgcctcgcctatacgcccgcagtgcgtttcgaaaatgcctgctcaacaggatcggccgccctctacagcgccatggacttcatcgaagccgggcgcggccgcatcgcactcgttgtcggcgccgaaaaaatgacggcgctgccgaccgcagatgtgggcgaaatcctgctctccgcctgttaccgtgcggaggaggccaatattcccggcgggtttgccggccagttcggccgcatcgcacaggcgtattttcaacgttatggcgaccgctcggaagagctggcgatgattgccgcaaagaaccacgccaatggcgcggtcaatccctatgcccatatgcgcaaggatttcggcttcgatttctgcaatacggcttccgacaagaacccctacgtcgcaggcccgctgcgccgcaccgactgctcgctgatttctgatggcgctgccgcgatcattttggccgacgaagaaacggcagccacactcaaccgcgccatcggcttccggggccgcaagcatgtcaacgacatcatggcattgacccgtcgcgatccgttggccttcgaaggcgcgcgccgcgcctgggccggctcgctggaacttgccggcgcaacgctcgacgacctctctttcgttgaaacgcacgactgcttcaccattgccgaacttatcgaatatgaggccatggggcttgctaagcccggtgaaggatatcgcgttgtccaggatggaacggcactgaagaccggacgcctgccaatcaacccatcgggtggattgaaatcgaaaggtcatcccgtcggagcgaccggcgtttccatgcatgtcatggcggcgatgcaattgatgggcgaagcaggcgacatgcaaattcccaattcctcgctggctggcgtgttcaacatggggggcacggcggttgccaattacgtctcgatcatggagcgt

SEQ ID NO: 35090 - DNA, 1449 bp, Agrobacterium tumefaciens
tggagctgggctcaaatggaagcccgcgtcgacgccatggcccatgcgctggagactgaattcggcgtcagaaagggggatcgcattctggtgcagtcctccaacaacaaccagatgttcgaatccatgttcgcatgcttccgcgtgggtgcggtgtgggtgccgaccaattaccgtcaatcgcccgatgaagttgcctatctggcgaaggcaagcggcgcacgcggcatgatttgcgccagtgcttttcccgatcatgcaaaagccagccatgaggcaagcacgatcgatttcagcattgccatcggcacggctgagttcggtgaggattacgatgccatcgtggcccgtcatatggggcgcaaagtcaaaagccaggcagtggatcgggatgacccgtgttggttcttcttcacctcaggcaccaccggccggcccaaggctgcagtgcttacccatggccagatggcgttcgtcatcaccaaccatctctgcgatctgatgcccggcaccggaccggacgacgcctccatcgtcgttgccccgctttcacacggtgcgggcattcaccagctggtgcaggtggcgcatggcgcgaaaaccgtgctgccggcggcggaaaagctcgatgtgcccgccgtctgggcgctgatcgaaaaatggcgtatcaccaacgccttcactgtaccgaccatccttaaaatgctcgtcgaagacccctctgtggatcgtttcgatcactcctcactgcgctatgtcatctatgctggcgcgccgatgtatcgcgcggaccagaaacgggcgcttgcaaagctcggcccggtgctggtgcaatattttgggctgggtgaagtcaccgggaacatcaccgtgctgccgccttcttttcacaacgccgaggacggtccggaaacccgggtcggcacctgcggcttcgaccgtaccggcatggaagtgcagatccagaacgatgcggccgaggaggttggcgccggtgaaaccggtgaaatctgtgtaatcggtcccgctgtttttgcgggctattacgataatcccgaggccaatgccaaagccttccgcaatggctggttccgcaccggagatctcggccatcgcgatgagaacggcttcctctacatcaccgggcgcgcctccgacatgtatatttccggcggctcgaacatctatccgcgtgaaatcgaggaaaaaatcctcatgcatccggatatcagcgagactgcggttctgggtgtgccggacgcggtgtggggcgaggtcggtgtggccgtgtgcgtggcccgcgagggcgcggatatcgccgccatcgatctgaaggcctatctggaaggcaagatggcccgctacaagctgccgaaatcagtggtgttctgggatgccatgccgaaatccgcctatggcaagatcaccaagaaaatgatccgcgaggaa

SEQ ID NO: 35091 - DNA, 576 bp, Agrobacterium tumefaciens
ggcatagtctgcgatgttgcggacgaggcatcgatagagatggctttcgccgccctgacggctaacggtgccgatcatgcggttgatctggtcgccgtcgtcaacagcgccggcatcggtatcgacaagctgtccgtcgacacaagcgtcgaagaatttcgccgtatcgttgatgtcaatctcgtcggcagcttcgcggtagcgcgcgctgccgcacgttactggctagagcgcgatgttgccggctcgatcgtgaatatcagttctgtttccggcatgtgtggaaatcgtggccgcagcgcctatggcgcttcgaaaggcggcgtcaatcttctgacgatggtaatggcaaacgagctggggcaatcaggcattcgtgtcaatgcaattgctcccggtccggtcgatacccccctcacccaggcagttcatactgaaaatgttcgcgaccaatggcatagccgcgttccgatgcatcgctatggcaggacggacgagatcgcctctgccgtggctttcctcgtgtcggatgacgcaagctacatcaacggacaggtgcttgccgtggatgggggc

SEQ ID NO: 35092 - DNA, 1290 bp, Agrobacterium tumefaciens
tcggatcgactgcgccagcgcgcccgcaacatcataccgggcggcgcgcatacctatgcaaagggtgacgaccagtaccctgtcctgtctcccggattcattgaaaggggatatggctgccatgtctgggatgtcgatggaaatgaatatatcgaatacggcatgggtaatcgggctgtcggccttggccatgcctatgccgacgtcgtagaggcggcgcgtgcggaactataccgtggctgcaacttcacgcgcccttcaaagatcgaggtggattgcgcatcgacctttctcgatacggtccagaccgccgaaatggtcaaattctgcaagaacggttccgatgcgacatccgccgcgatacgacttgcacgcgccgttaccggccgcgacctgatcgcgcgctgcagcgaccacccgtttttctcgaccgacgactggttcatcgggacaacggaaatgaatgcgggcattcccgaggcgatccagaatctggtccttggcttcagctacaatgatctggcaagtgcgcgcagtctgtttgaccgctttaagggtcgcatagccgccttcatcctggagccgtcgcgcggtgatccgcctcgggaccagtttcttcacaaactccagaagctttgccacgaaaacggcgcgcttttcattctcgacgaaatgatcaccggcttccgatgggatgcggggggcgcgcagaagacatatgacatcgtccccgatctatcctgtttcggcaaggcgctggggaatggcttttctatttccgcacttgccggcaagcgcgagttcatggaacggggcggtatcgatcaaaccgatgccccccgcgtcttcctgctttcgacgacgcatggtgcagaaacgcatgcgatggcggcggccatcgcaaccatgaaagtttacacgcatgaacccgtggtcccacatctggtccgacagggaaattcgctgcgcgccgccatcagccagatcgcaattgcgcacgggctcgattcctacttcggcatccagggccattctgcctgcctcagctacttcacgctagaccagaccggaaagccgtctcaggcctttcgatcgctgtttctgcaggaaaccatccgtcgcggccttctcgcaccgtctctcgttgtaagctacacgcatgaggacgaggatatagccaaaacgcttgacgccatcgatggagcgctcgtcgtctaccgtaaagcgctggaatacggcgtcgacaaattcctgacgggacgcccatccgatgtcgtcttccggcgtttc

SEQ ID NO: 35093 - DNA, 756 bp, Agrobacterium tumefaciens
atgaaggtcgtcttgttctgtggcggcaggggtacccgcatcagggaatattccgaaagcgtcccgaaaccgctgatcccgctcgggtctcaaccgatcatgcggcatgtcatgcaatattacgcccgttacgggcatgaggacttcatcctctgcctcggctacaaggcgcatgtcataaaagagttcttcctgaacagccggccggagagctatgccgattgcgtcatatcaagccccggacgtgtggaactgcttgaggaactgccgagggactggcgcgtatccctgatcgatacggggatatggcgcaacataggcgagcgtctctgggccgtgcgtcatcatctcaaaggcgagaagatgttccttgccaattatagcgatggactgaccgacgtcgatctcgacgacatgattgcccaattcgaaaagagcgacaagctcgcctgcttcctcgctgtcagaccgcccctcacctaccacctggcggagatcgacgagagcggaaaggtccgggaattccggtcgtcggaaacatccgacatgtggatcaacggcggctatttcctgatgcggccggagattttcgactacatgcgcgagggtgaggaactcgtgctggaaccgttttccaggttgatttccgaagacaaattgatggcctacaagcatgagggcttctggcggtcaatggatacgctgcgcgactggcagacgctggaggcgatggtcgagcgtggtgacatgccatgg

SEQ ID NO: 35094 - DNA, 1023 bp, Agrobacterium tumefaciens
aagagagccttgattatcggcgtaaccgggcaggatggcgcttatctcagcgaattgctgcttgccaagggatatatggttcacggcctgaagaggcggtcttcctcctttaataccggtcggatcgatcatctttaccaagatcccttcgaggaagacctgcgctttcgcctgcacttcggtgacctcacggacgccacgaacctgtgccgggtcattcaggaggtccagcccgacgagatctacaatctaggcgcccagagccatgtccaggtcagcttcgagacgccggaatatacggcaaatgcggatgcgcttggcacgctgaggctgctggaagccatgcgtatcctgaaccttggcgatcgctgccggttttaccaggcatccacatcggagctgttcggggggatgggcacggtcgcccagcacgagggtacgccgttctatccgagaagcccctatgctgcggccaaactctacgcatactggatgacggtcaattaccgggaaagttacggctttcacgcatccaacggcattctcttcaaccatgagagccccattcgcggggagacattcgtcacccggaagatcacgcgtggcgttgcggccatcgagcgcggtctcatgagcaagctgcgtcttggcaatctcgacgcaaagagggactgggggcatgcgcgcgattatgtcgaaggcatgtggcgcatcgtgcagcaggaaatacccgaggactatgtgcttgcgaccggcgaagcacatacggtgcgggaatttgttgagcttgctttcggcgtggttggcaagaccatcgaatggcacggcgatggcagtgacgaagtgggatatgatgccaaaaccggcaattcgatcatcgaaatcgatcccagatattttcgtccggcggaagtggattttcttctcggcgatcccagcaaggcgcgcagaaaactcgactggagtcactcgacgtccttttgcgacctcgttcaggaaatggtcgaagcggatcttcgcctc

SEQ ID NO: 35095 - DNA, 825 bp, Agrobacterium tumefaciens
ttcgtaaagaacaaggacggcgtcgaaatctatttcaaggactggggcccgaaggatgcccagccgatcgtgttccatcacggctggccgctgtcctccgacgactgggatgcgcagatgctgtttttcgttcagaacggttaccgcgtcgtggcgcatgatcgccgcggccacggccgttcgcagcaggtgagcgacggccacgacatggatcattatgccgccgacgcgtccgccgttgccgaacatctcgatctcaggaatgcggttcatatcggccactcgaccggcggcggtgaagtggcacgttatgtcgcgaaattcggccagccgcagggccgtgttgccaaggccgtgcttgtctccgccgttccgccgctgatgctgaagacgccttccaatcccggcggcctgccgatcgaagtcttcgacagcttccgcaagggcgtggccgagaaccgcgcgcagttcttcctcgacgtgccggccggtcccttctacgggttcaaccggccggatgccaaaatctaccccggtgtcatccggaactggtggcgtcagggcatgatgggcagtgccaaggcccattatgatggggtcaaggccttctcggaaaccgaccagactgaagacctcaaggcgatcacggtgccgacgctcgttctccacggcgatgacgaccaggtcgtgccgatcgcagattcggccgaattgtcagtcaaacttctgaagaatggcacgctgaaggtttacaagggctatccgcatggcatgctgacgacccatgcggacgtcatcaaccccgatctgctggccttcgtgaag

SEQ ID NO: 35096 - DNA, 1425 bp, Agrobacterium tumefaciens
ctgcatcgacgcgatttgatcgaagaccgtgcgtttgtgaatggggcatgggtggagcgcgatcagatgttcgccatcgttgatcccgcgggaggcgatcacctcgccgacgtggcgtcctgcacgctcaatgatgtcgattttgcgatagacgcagccagcaaggctttcgccggctggcgcgatatgctgcctgttgatcgcggcgacattttgcgcaactggagtgcgcgcatgcgggagaatgcgcatgacctcgccacgatcatcagcgccgaacagggcaaaccgctggcggaatcacgcggcgaaatcgcctacgccgccaatttcctcgactggttcgcgagtgagggggagcgatcttacggcgaaacaattccaacccatctgaagggcagcaatctttccgtgcggatgcagccgatcggcgttaccgtcgccatcacgccatggaactttccctcagcgatgatagcgcgcaaggccggtgctgcacttgctgccggctgtacgatgatcgtcaaacctgctcccgaaacacctctgtcagcgctggcgctggcaagacttgccgaagagtccggcgtaccacctggcgtattgcaagttctgccgggagaagccgcaccccttgcgcgccgccttctggaaaataccgaggtgcgggcattttcctttacgggttcgaccgaggtgggacgaattcttctgacgcaatctgcggcgacggtgaaaaaagcatccttggagcttggagggcacgcacccttcatcgtcttcgcagatgcagatctcacagaggccgtcaaaggctgtctgggcgcaaaattcgccacttccgggcaggactgtcttgcggcaaaccgcatctatgtgcagcgcagcctttatccgcgatttgttgagcggtttgccgaggcgacgtccaggctgactgttggtcatggcctcgaaaccggtgtcgatatcggccccatgacgcggccgtccgtcgccgaaaagtgccgccagcaggttgcccaggcgctgtcggcgggtgcacggctcgtctgcggcggacaggacagtccgctcggcggcaacttcgtcacccccaccgtgcttgccgatgttaccgacgacatgctgatcgcccgcgaagaaaccttcggcccggtggccgccatcttgccgttcgatgacgaggcggaggtgatccgccgcgccaatgcaacagagatgggactggcggcctatctctacaccaacgatctcggccgggcgatgcgcctgaccgaccagctcgaatacggcatggttgccgtcaacacgccgaaattcaccggagcgcccattccattcggcggctggaaacaatcaggccttggccgcgagggctcgcgtcatggcctcatggaatatctcgaacccaaatatgtctgc

SEQ ID NO: 35097 - DNA, 1401 bp, Agrobacterium tumefaciens
atgaccatcgacatcaaaaatatcgcggaaatggatcgaaacgccgttctgcatcccttcacgcagctcaaggattttgccagcggtaaactcggcgaacccaccatcgttgaaaccggcaagggcatccgcattcaggacgcgcacggcaagcaattgatcgatggatttgccggtctttattgcgtcaatgtcggttatggccgcaccgaggtagctgaggcgatttcgcgacaggcctaccgcctcgcctattatcattcctacgccgctcacacgacggatgaactggccatcctttccgaccgcctcgtcaggatggcaccgggcaaaatgagcaaggtgttctacggcatgtcggggtccgacgccaacgagacgcaggccaaactcgtctggtattacaacaatctgcgtggcaagccgcagaagaagaagatcatctcccgcgagaggggatatcacggctgcagcgtcgtcgccggctcgatgacaggcatgagtttttatcacgaccacatggaccttccacgggtcggcatcctccataccggcgttccgcatcactattggggcgcggaagccggtgaaaccgaactggaattctcaaaacgacgcgccgccgaactggaagccctcattctgcgcgaaggaccggacacgatcggagcattcatcgccgagccggtgcttggaacgggcggtatcacaccgccgccggaaggttactggccagccatccaggaggttctcaaaaaatacgatgtgctgttgattgcggatgaggttattaccggcttcggccgcacgggttccatgtttggttcacagcattacggcatcgaaccggatctgatcaccgtcgctaaaggcctgacctcggcctatttcccgctttccggcgccatcgtaggggagaaagtctacacggtgatggaggacggcgcggatcgcgtcggcgccttctcccacggctacacctattccggccatcctatcggcgcggcggcggcaaacgccgtgctcgacatcgtcgaaaaggaagacctgccgggcaacgcacaggccgttggcagctatttccaggaacagctgaaggcgaagttcgcccagcttcctatcgtcggcgaggtgcgcggtgtgggactgatgggcgctatcgagttcgtcgctgatcgggaaaagaagacccgttttgcccctcatctgacggtcggcgcacgcgtttcaaaggcggcgcgcaacggcggcctcattgcgcgcgccatgccgcacggcgatattctcggctttgcaccgccgctcgtcacaacgaaggcggaggtggacgaaatcatcgccatcgcggaagccgccgtgcgcaccgtcatggacgatctggtccaggccggcgagaaaatc

SEQ ID NO: 35098 - DNA, 1068 bp, Agrobacterium tumefaciens
ggagaaaacatgcgcgcgctcagatttcatgcagccaaggatttgcggatcgaagacattgccgagccgaaacggcctggcccgggacaggtcctcgtccgcaaccgtttcgtcggcatctgcggcaccgatctgcatgaatatagctacggcccgatcttcattcccaccgaaccgcatccttttaccggcgcccatggcccacagattctgggccacgaattcggcggcgtggttgaggcgatcggcgacggtgtgacctccgtcaacgtcggcgaccgcgtctccatccagccgctcatcatgccgcgatccggcgattatttcgctgatcgtggccttttccatctcagcacgcaactggcactggtcggcctcagctgggacggcggcggcatggcggaagccgcacttgtcaacgaatacaacgtccagaaaattccggacgagatgaccgacgaagaggccgcactggtggaaccctcggccgttgccgtttatgcctgtgatcgcggtggcgttaccgccggtaatagcgttctggtcacgggtgccggcccgatcggcatgttgacgcttctggcggcccgcgccgccggcgctacccagctttttgtctccgatctgaatgacgcccgcctcgagcttgcccgcaatgtcatccgtgatgtcatcaccatcaaccccaagcgcgataatgtcggtgatgtcgtccgctcggcaaccgaaggcaaggtcggctgcgacgtggcgatcgaatgcgtgggtaatgaacatgcgctcaaggcctgcgttgacgccgtgcgcaagcagggcgtcgtcgtgcaaaccgggctgcacccgcatgaaaacccgatcgactggttccaggtgacgttccgtgatctggagatcaagggctcctgggcctatccgacccattactggccgcgcgtcatccggctcattgcctccggcctgctgccggcgacgaagatcgtcaccaagcgcatcacgctggatacggccgtgaccgagggcttcgatgccctgctcgaccccgccggcacgcatctgaaaatcctgatc

SEQ ID NO: 35099 - DNA, 1749 bp, Agrobacterium tumefaciens
gatgcctatcgccatgtgctcggctttgttttcaaccattggagccaccgaaaggcgctcgtgggtttcatcatcgtgctggtggttgccagcacgctcgccgaagtgatggtgccggtcttttccggccggatcgttgatgccatcgctggtgacaatgggggtgccaatgcgggtgatggcgctctgcgcgctttcgtcatcgtggttgcgcttggctttaccagtgttgtgctgcgctggttcatcttcaacggcatcatccggctgacgctgaagaccatggctgacgtcaccaataacggcttccacaaggtgcagcgtttctccaccgactggcacgccaacagcttcgccggctcgacggtgcgcaagatcacgcgcggcatgtgggcgctggattcgctcaacgacctgctgctcgttgcgctcctgccctccatcgtcatgctggtgggcgccaccgtagtgcttggcagttactggccggtcatgggcctgatcgtcggcctcggctcgctgatctatatcggtgtcacggtcgggctttcgatgggttatgtgtcgccggcggcgcggcttgccaatgcctgggacacccggcttggcggcgcgctggcggatgcgatcagctgcaacgcggtggtcaaagccttcggtgccgaaacccgtgaagaaacgcggcttggtcatgtgctggtgaaatgggacaatcggacgcgcagaacctggaaacgtggaacgctgaacggcactatccagagcttcatgatggtatcgatgcaggcgggcatcctcggcaccggcctcatcatgtggcagaagggtctggcgacagcgggcgacatcaccttcgtgctggcgatgtttttcgtgttgcagggctatctgcgcgatgtgggccaggatatccgcaacctgcagcgcgccgtcaatgacatggaagagctggtgctgctcgacaagatgccgctgggtgtcgaagacaggccggacgccaagcggatcaatatcggcaagggcgagatcgtcttcgatcatgtcaccttccagtatggcgcgcatgcaaccccgctttatgaggacttctcggtcaccatcaagccgggcgagcgtgtgggtctggtcggtcactccggttcgggcaagacaaccttcgtcaagctcatccagcgcctttacgacataaaggcgggggctatccgcatcgacgggcagaacatcgccgatgtcacgcaggcgagcctgcgcggccagatcgccatcgtgcagcaggaacccatcctgttccaccgcacgctggcggaaaacatcgcctatggccggccggatgcctcgcgtcgtgagatcgagcaggcggcgaaacaggcgagcgcccatgatttcatcatgtccctgccgaagggttatgagaccatggtgggcgaacgcggtgtcaagctgtcgggcggcgagcgccagcgcgtcgccattgccagggcgttcctggcggatgcgccggtgctgatcctagacgaagcgacgtcaagcctcgacagcgaaagcgaagtgcagatccagcaggcgatggaacggctgatggatggccgcaccacgctcgtcattgcccaccgtctttccacggtccgggcgctcgaccggctgctggtgttcgacaagggcaggattgtcgaggagggcgaccatcaggcgctgatccgcctccatgacggcatctaccgccggctgttcgagcggcaggcgctggaa

SEQ ID NO: 35100 - DNA, 2907 bp, Agrobacterium tumefaciens
atggcccttgtaaccgaattcgactacggcaccccgaaatccaacgcgacggatatggtgacgctcacgatcgacggtcggcaggtcaccgttccgacgggaacctcgatcatgcgcgcctcgcgcgaagctggcatcgatgtcccaaaactctgcgccaccgacatggtggatgccttcggttcctgtcgcctctgtcttatcgaggtggagggccgcaacggcacccccgcctcctgcaccacgccggttgctgccggtctcgtcgtgcatacccagaccgagcggctgaagcagatccgcaagggtgtgatggaactttatatctccgaccacccgctcgactgtctgacctgcgccgccaatggcgattgcgaattgcaggacatggcaggtgccgtgggccttcgcgatgtgcgttacggttacgagggcgacaaccacgtcaagtcccgcaccggagggggcgatatcaatgcccgctggatgccgaaggacgaaagcaatccctatttcacctatgatccgtccaaatgcatcgtctgttcccgctgcgttcgggcctgcgaggaagtgcagggcacctttgcgctgacgatcgaaggccgtggtttcgagagccgcgtatcgcccggggcgcacgaggcgtttctcgattccgactgcgtttcctgcggcgcctgcgtgcaggcctgtccgaccgcgacacttaccgaaaaatcggtgatcgagatcggccagccggaacattcgatggtgaccacctgcgcctattgcggcgtcggctgctccttcaaggcggaaatgcgtggcgaggaattggtgcgcatggtgccgtggaaggacgggcaggcaaaccgcggtcattcctgcgtcaagggtcgcttcgcctatggttatgcgacccacagggatcgcattctcaacccgatgatccgcgagaatatcggcgatccctggcgggaagtgagctgggatgcggcctttgcctatgttgcttcggagtttcggcgcattcagggcaagtatggccgggagtccattggtggcatcacctcgtcgcgctgcacgaatgaggaaaccttcctcgtgcagaaactcgttcgcgccggcttcggcaataataacgtcgatacctgcgcccgcgtctgccattcgccgacgggttatggtcttggccaggccttcggcacctccgcaggcacgcagaatttcgacagcgtcgaacaatccgacgtggtgcttgtcatcggtgccaacccgaccgacggccatccggttttcggttcgcgactgaagaagcggctgcgtcagggcgcgaaactgatcgtcatcgatccgcgccgcattgatcttgtgcgcacgccgcatgtggaggccgctttccatctgccgttgctgccgggaacaaacgttgccgtcctgacagcactggcgcatgtgatagtcacggaagggttgttcaacgaggccttcattcgcgagcgttgcgactggtcggaattcgaggactgggccgcttttgtcgccgagccgcagcatagcccggaagagacggaacgtttcacgggcgtaccggctgaagatctgcgtggtgcggcccgcctttatgccaccggcggtaatggcgcgatctattacggtcttggtgtcacggaacacagccagggttcgaccaccgtcatggcaatcgccaatcttgccatggtcacgggcaacatcggccgccccggtgtcggcgtcaacccgctgcgcggtcagaacaatgtgcagggctcctgcgacatggggtctttcccgcatgagctgccgggctatcgccatatctccgacgatgcgacacgcgacgtgttcgagaaactctggggcgtgaagctcaacaacgaaccggggctgcgtattcccaacatgctggacgccgccgttgatggcagcttcaaaggcatctacatccaaggtgaggacattctccagtccgatccggacaccaagcacgtatccgccggcctagctgccatggaatgtgttgtcgtgcacgatctcttcctcaacgagacggcgaattatgcccatgtgttcctgccgggttccaccttcctcgaaaaggacggcaccttcaccaatgcggagcgccgcatcaaccgcgtgcgcaaggtcatgtcgccgaagaacggttatgctgactgggaagtgacccagaaactggcgcaggccatgggccttacctggaactacacgcatccctccgagatcatggacgaaatcgcggcaacgacgccaagctttgccagcgtttcctacgcctatctggaagagaaggggtcggtgcagtggccctgcaacgaaaaattccctgaagggtcgccgatcatgcatgtggacggtttcgtgcgtggcaagggtaagttcatccgcaccgaatatgtggcgacggatgaacgcaccggtccgcgtttcccgctgctgctcaccaccggccgcatcctgtcgcaatataatgtcggcgcgcagacacggcgcaccgaaaacgtcgtctggcacgaggaggatcgcctggaaatccatccgcacgatgccgaacagcgcggcgtgaaggatggcgactggatcaagctcgtcagccggtccggcgatacgacgctccgggcgctgatcaccgaccgtgtggcaccgggtgtggtctatacgaccttccatcaccccggcacgcaggcgaacgtcatcaccaccgacttctccgactgggcgaccaattgtccggaatacaaggtgacggcggttcaggtgtcgccctccaacgggccgacggaatggcaggaagaatatgatgcgctcgcgcgtcagtcccgccggatcgccggcaagctcgaagctgcggaataatcgggggccgggccagtcccggcc

SEQ ID NO: 35101 - DNA, 711 bp, Agrobacterium tumefaciens
atgacggccagcattttttccggcgtaatccccgccttgatgaccccgtgcagacaagaccgcacccctgatttcgatgcgcttgtccgcaagggcaaggaactgatcgccgacggcatgtccgccgttgtttattgcggttcgatgggcgactggccgctcctgacggacgagcagcgcatggaaggcgtggagcgcctggtcaaggccggcattcctgttatcgtcggcactggcgcggtcaacacggcatctgccgtagcgcacgctgtccatgcccagaaggttggcgccaagggcctgatggttattccgcgcgttctgtcgcgcggttcggtcatcgccgcccagaaggctcacttcaaggccattctctctgccgctcctgaaattccggctgtcatctacaacagcccctattacggtttcgcgacccgcgccgatctgttcttcgcgctgcgcgccgaacacaagaacctcgtcggcttcaaggaattcggcggcccggccgatatgcgttatgccgctgaaaacatcaccagccgtgatgatgaagtaaccctgatgatcggcgtcgataccgccgttgtgcatggcttcgtcaattgtggtgcaaccggcgccatcaccggcattggcaatgttctacccaaggaagtcattcatctctgcaagctgtcgcaggctgcggccaagggtgatgcggatgcc

SEQ ID NO: 35102 - DNA, 1338 bp, Agrobacterium tumefaciens
atggcaagagatcccaagatcacatttatcggcgcaggctctacggtgttcatgaagaacatcatcggcgacgtgctgcagcgtccggccctttcgggcgccaccattgcgctgatggacatcaatcgcgagaggctggaagaaagcgccatcgtcgtcaacaagctgatttcgacattgggggcaaaggcgaaagccgagacctataccgaccagaaaaaggcgcttgccggtgccgattttgtcgaggtcgccttccagatcggcggatatgaaccctgtacggttaccgatttcgaggtgccgcgcaaatatggcctgcgccagaccattgccgatacgctcggcgtctgcggcatcatgcgtggtcttcgcaccgtgccgcatctgtggaaaatctgcgaggatatcctcgccgtctgccccaacgccgtcatgctgcaatatgtgaacccgatggcgatcaacacctgggcgattgccgagaaatacccgacgatccggcaggttggcctttgccattccgtgcagggcacggccatggaactcgcccatgatctcgatatcccttatgaggagatccgctatcgttcggccggcatcaaccacatggcgtttttcctcgaattcgagcatcgccagcccgacggcagctataggaacctctatcccgatctcgtgcgcggctaccgcgaaggccgtgcgccaaaacccggctggaacccgcgttgccccaacaaggtgcgttacgagatgctgacgcgactcggttatttcgtcaccgaaagctcggaacatttcgccgaatatacgccctatttcatcaaggaggggcgcgacgacctgatcgagaaattcggcatcccgctcgatgaatatccgaagcgctgcatcgaacagatcgagcgctggaaggggcaggcggcggcctatcgttcggccgagaagatcgaggttaagcaatcgaaggaatatgcctcctccatcatcaactccgtctggactggcgaaccctccgtcatctatggcaaccagcgcaacaacggctgcatcacctcgctcccatcggattgcgcggcagaagtgccctgccttgtcgaccataacggcgtgcagcccacctttatcggcgaattgccgccgcaactcaccgccctgatgcgcaccaacatcaacgtgcaggaactgacggtgcgggcgctgatgagcgaaaaccgtgcccatatcttccacgcggcgatgatggacccgcacacggcggcggaactggatctcgaccagatatggtcgctggtagacgacctactgctcgcacaccgcgactggttgccggaatgg

SEQ ID NO: 35103 - DNA, 1467 bp, Agrobacterium tumefaciens
agtttcaaaatcgctattattggcgcaggcagcgtcggtttcacgaaaaaactgttcaccgatctcctgtgcgtgccggaatttcgtgatatcgaagtcgcgctgacggatatcagccagcacaatctcgatatgatcaaggcgatcctcgaaaagatcgtcgaggccaatggttttccggtgaaggtgacagcggataccgatcgccgccgggcgctggagggggcgaaatatatcatcagctgcgtgcgggttggtggtctcgaagcctatgccgacgatatccgtattccgctgaaatatggcatcgaccaatgcgtgggcgatacgatctgcgccggcggcatactctatggccagcgcaacattccggtcattctggatttctgcaaggatatccgcgaagtcgccgcaccaggcgcaaaattcctgaactatgccaaccccatggccatgaacacctgggcggccatcgaatatggcaaggtggatacggtcggtctctgccacggcgtgcagcacggcgcggaacagatcgccgaaattctcggtgcggaatccccgtccgagctggattacatctgctccggtatcaaccaccagacatggttcatcgatctgaggctcaacggccgcagaatcgaaaaggacgagctggtcgctgccttcgaggcgcatccggtcttttcgcagcaggaaaagttgcgcatcgatgtgctgaagcgcttcggtgtctattcgaccgagagcaacggccatctctccgaatatctgccgtggtatcgcaaacggccggaagaaatcgcccgctggatcgacatgtccgactggatccacggcgaaaccggcggttatttgcgccactctaccgaaacgcgcaactggttcgaaaccgagtttccgcaattcctggcctccgccgccaagcccatcgagccggcgaaacgctctaacgaacatgcgagccacattctggaagcgcttgagaccgggcgtgtctatcgcggccatttcaacgtcaagaacaacggcgtcatcaccaaccttccttccgacgcgatcattgagtcgcccggtttcgtcgatcgtttcggcatcaatatggtgtcgggcatcacgctgccagaagcctgtgccgcgacctgcatggcttcgatcaatgtgcagcgcatgtcggtgcatgcggcggtgagcggcgatatcgatctcctgaagcttgccgtgctgcatgacccgctcgtgggtgccgtcgccaccccggaggaggtctggcagatggtggacgagatggtcgtcgcgcaggcacgctggctgccgcaatatgccgatgccgtgccggctgccaaggagcggctggcgaaatccaccgtcaagacgcgtgactgggcgggggctgcgcgccgcaacgtgcgctccatcgaggaattgcgggccgaaaaatcggctctgaaaaaggctgtctgagga

SEQ ID NO: 35104 - DNA, 1308 bp, Agrobacterium tumefaciens
gaccgcgcccatctggtcatgctgcgcgagaccggcattctcgatgccgaaacggcggccaaaatcgccggtgcgcttgaggatatcgacaggaccatcgaaccatcggagcttgtttataccggcgaggtcgaggatttcttcttcctgatcgagaaggagctgaaagcccgcatcggcgtcgatgtagccggccgccttcacacggcgcgttcgcgcaacgatatcgatcacaccctgttcaagatcggcctcaaggacaagatcgacacgctcaccgccaaggcgcgcgttctcttaaaagcgctgatcgatgccgccgagcgcaatcaatccaccctgattgtcgcctatacgcatgggcagccggcccagcccaccaccttcggccactacctttccgccgccatcgaggtgctgatccgcgatatcgagcgttttaccgaggcccgccatatcgtcgatctttcgccgatgggtgctgctgccatcaccacctcgggctttcccattgatcgagcccgcgttgccgaattgctgggctttgccgcgccgctgcgcaattcctattcctgcatcgccgctgtcgactataccacggcgacctatggcgcgatcgagctgatgttcctgcatctcggccggctcattcaggacttccagttctggacgagtttcgaagtcggtcagatctatgtgccgaattcgctggtgcagatttcctccatcatgccgcagaagcgcaacccggtaccgatcgaacatctgcgccaccttgccagccagacattcgggcgggcacggaccatgctcgatgtgatgcacaacacgccctttaccgacatgaatgacagcgaaggcgaaacccagagcatgggttacgaagccttcgcttcggcgggccgggtcctcgatcttctcgccagcctcgttggccagatcagcatcgaccctgaacgggtcgaccagaacattcgccgctcctgcatcaccatcacggaactggcggattcgcttgtccgcatcgaagacctgtctttccgccaggcgcatgaaattgccgcgaccgtcgccaaaagcgttgtcgctctgaaaggcgatctgcccaatgacggttaccaaccgttccttggggctttcagtggactgacaggacgcgagaccggcattgacgaagaaaagttcaggcagatcgtctcgccggagcacttcgtcgcggtgcgcagccgtttcggcggcccggcgcctgaaccgatgcgagaggcgtttgcagcctatcgcggcaagcttggtgcatttgaggctgag

SEQ ID NO: 35105 - DNA, 834 bp, Agrobacterium tumefaciens
ggccggatctattgcgacctcatcttcaccgggctcgaggaattgccggtgctcggtcgggaactgtttgcccgcgacatggaaattgccgccggcggcggagccttcattgccgccgcacatttcgcccatatcggccgccccgttgcgctgctggcaaggctcggcaccgacacgttttcgcgcgatatcggtgagaaaatggcacaaagtggtgtggacctgcagtttctggaacatgcaacagatgccggacctcaagtcacggtagcaaccgtggtcggtcaggaccgggcgtttttgacacgccgcgccggtgccgcccggccttcgacgctggatgccgcctttgcttgggacaaggcacggcatctgcacatcgccgaattcgctactctgcaagagattcccgatctggtctcacgcgccaaggcaagcggattgtccgtttcgctcgatccgagctgggatgcagcgctgatctacgacaaaggcctgctcaaggcctgtgccggtgtcgacgtgtttttgcccaatctcgaggaggcggaagcgatcacgggacgttcagaaccggaagcggccatcaggacactggcggaggcttttcccatcgtcgcgctcaaaggtggtgcggaaggtgcatgggtatcttctgcggccgggcttcaccatagagcggcccaaaaagtcccggtcatcgacacaactggcgcaggcgatgcctttaatgccggttttctggatgcctggcttcagcggcaggacgaacagcagtgtctcaaagcagggatcgctgcgggcagtcttgccgtacaggcggcaggcggtgca

SEQ ID NO: 35106 - DNA, 1503 bp, Agrobacterium tumefaciens
cgtcccaatatcctgatcctgatggccgaccagttcaacgggacgttttttcccgatggtccggccgattttctccacgcgccacatctgaaagcattggcggagcggtctgtccgcttcgccaatacctatacggcaagcccgctttgcgcgccggcccgtgcgtccttcatgtccgggcaattgccgagccggacgcgggtctatgacaatgccgccgaattcgcctccgatatcccgacctacgctcatcatctacgggcggcgggttattacaccggtctttcgggtaagatgcattttgtcgggcccgatcaactgcatggcttcgaggagcgcctgacgacggatatctatcccgccgatttcggctggacacccgactataccaagccgggtgagcggatcgactggtggtatcacaatcttggttcggtgactggcgcgggtgtcgccgaaatcaccaatcagatggagtatgacgacgaggtggcctatcacgccacccgcaagctttatgacctgtcgcgccgtctcgatgaccggccgtggtgcctgacggtcagcttcacccatccgcacgacccctatgtggcgaggcgcaagttctgggatctatacgaggattgcgccgcgcttgatccgcagtcgaaggcgattgccttcgaggagcaggacccgcattccaagcggctgctggaagcttgtgatcatgaggcattcgagatcacaggcgagcagatacgccgggcacggcgtggttatttcgccaatatctcctatatcgacgaaaagatcggcgaaatcctcgacgtcctgaacgcgacgcggatggaggacacgatcattctcttcctgtccgatcatggcgacatgctgggtgagcgtggcctatggttcaagatgtgtttcttcgagggctccgcccgcgtgccgctgatgatcgccgcacccggctggcagccggctttgatcgatgcccctgtctcgacactcgatgtaacgccaacgctgtgtgggcttgccgggctagatatcacctcgctcaaacgctggaccgatggcgaagatcttgcggcgctggccgcgggaaccggcgggcgcggcccggtgccgatggaatatgccgctgaaggctccatcacgccgctcgtcgccatccgtgacggccgctacaagctgtcggtctgcgaggccgatccgccgctgctttacgatcttgagactgatccgcaagagctcaccaatcttgcccacgatcccgctttcagcgatgtgctctcatcgctttcggcagagatgggtcggcgttggcaattgccggtgttcgacgccgccgttcgcgaaagtcaggcgcggcggtgggtggtctacaaggcgctgcgcaacggcgcctattatccgtgggattaccagcctctgcaaaaggcctcggaacgctacatgcgcaaccacatggacctcaacgtgctggaggaaaaccagcgttttccgcgcggggaa

SEQ ID NO: 35107 - DNA, 1431 bp, Agrobacterium tumefaciens
cttttcatcggcggcgatcattgcgcggccgcgaacggcaagcgcttcgaacggaacaacccgatcaccggcgatgccgtaacgagtgccgccgccgcttcggttgaagatgcgacgaacgcggccgatgctgccgctgccgctttcccgaaatggtccgccaccacgcccggtgaacgccgccgccacctgcttgcggctgccgaggcgctgcgcgcggcgggcccgcaaatcattcaggcgatgatggaggagatcggcgcgacggaggcctgggccggttttaacgtcatgctcgccagcgatatgctggtggaggcggccagtctaaccacgcacatcacgggcgaagtcatcccatcgaaccgcccgggaaccatggccatggcgctccgtcagccggcaggggtcgtgctgtcgatggcgccgtggaacgcgccggtcattctcggcgtgcgctccatcgccaccccgcttgcctgcggcaatacggttgtcatgaagacctcggaactttgcccgcggacccacgccctgatcatcgaagcggttgcctccgcaggactgccgaaaggcgtgctgaacgccatttccaacgcgccggacgatgcggcgaagatcgttgaaacgctgattgcccatccggcggtcagaagggtgaacttcactggctccacccgtgtcggccgcgtcattgcggaaacggcgggccgctacctcaaacccgccctgctggagcttggcggtaaggcgcccttcatcgtgcttgacgatgccgatatcgacgcggcggtcgctgccgctgcattcggcgcctacatgaaccaagggcagatctgcatgtcaaccgagcgtatcatcgtgcttgacagcattgccgatacattcgtcgaagctttcgcgaaaaaggccgccagcctgacggcgggcgatccgcgcgagggcaagacaccgctcggctcactggtcagtgccgaagcagcctcgcgtatccgggtgctggtcgatgacgccgtctccaagggtgcaaggcgggttgccggtggcggtggcgatggcacgatgcttgacgcgatcgccgtcgatggcgtcaccccggccatgcggctttattcggaggagagcttcggcccggtcgtatccatcatccgggccggcagcatcgatgaggccgtgagcatcgccaatgaaagcgaattcggtctttccgccgccgttttcggcagggaccaggcgcgggcgctttccgttgccgcgcggattgaaagcggcatttgccatgtcaacggcccgaccgttcatgatgaggcccagttgcccttcggcggggtcaaggcttccggttatggccgtttcggcggcacagcgggtatcgccgaattcaccgaattgcgctgggtcacgctgcaggacgggccgcttcactacccg

SEQ ID NO: 35108 - DNA, 2175 bp, Agrobacterium tumefaciens
gagggcgaaatggacgcaacttcaaaaccggctggcaagtgtcccgtcatgcatggaggcaatacggcctccggcaaatcggtgaccgaatggtggccgaacgcgctaaacctcgacatcctgcatcagcacgacaccaagaccaatccgctcggcacctccttcaactaccgcgaagcgctgaagacgcttgatgtcgaagccctcaaggccgatctgcgcgcgcttatgaccgacagccaggaatggtggccggccgactggggcagttatgtcggcatgatggcccgtgttacctggcatgccgccggttcctatcgtgtcacagacggtcgcggcggcgccaataccggcaaccagcgttttgcaccgctcaattcctggccggacaacgtcaacaccgacaagggccgccgcctgctgtggccgatcaagaagaaatacggcaacaagatttcctgggccgaccttatcgcgctcgccggcacgatcgcctatgacgtcgcgggtctgaagaccttcggcttcgccttcggccgcgaagacatctgggcgccggaaaaggacacctattggggtgacgaaaaggaatggctggcgccgagcgacggccgttatggcgacgtgagcaagcccgagacgctggaaaacccgcttgccgccgtgcagatgggcctgatctacgtcaacccggaaggtgtcaacggcaagtccgatccgctggcgacggcggcgcagatgcgcgaaacctttgcccgcatggggatggatgacgaggaaaccgttgccctgacggccggcggccacaccatcggcaagtcccatggcaatggcagtgctgccaatctcagccccgatccggaagctgctggcccggaatatcagggtctcggctggatcaataccaagggccgcggcattggccgtgacaccgtggtgtcgggtatcgaaggcgcatggacaagcgaaccaaccaagtgggacaacggcttcttcgacatgctgttcaagcacgagtggaccctgacgcacagccccgcgggtgcatcgcaatgggcgccgattaccatcgccgaagaagacaagcctgttgatgtcgaggatgcgtcgatccgcaccatcccgatgatgaccgacgccgacatggccctgaaggtcgatccgatctaccgcgagatttcgctgaagttcaaggacgatcaggaccatttctctgatgtcttcgcccgcgcctggttcaagctgacgcatcgcgacatggggccgaagtcccgttacgtcggcccggatgttccggctgaagacctgatctggcaggatccgatcccggcaggctccacgagctacgatgtcgctgccgtcaaggctaagatcgctgcctccggcctttctgtcgccgatctggtttcaaccgcatgggacagtgcccgcaccttccgtggttcggacaagcgcggcggcgccaatggcgcgcgtattcgtctcgcaccgcagaaggattgggaaggcaatgagcccgcccgtctttcccgcgtgctttcggttctggagccgattgcccgcgaaaccggtgcaagcatcgccgatgtgatcgttctggctggcaattacggcgtggagcaggcggcgaaagcggctggtttcgatatcgccgtgcccttcgcggccggtcgtggtgacgcttccgccgagcagacggatgccgacagctttgcgccgcttgagccgctggcggatggtttccgcaactgggtgaagaaggactatgtcgtcagccccgaagagctgctgctcgatcgggcacagcttcttggcctcaccgcgccggaactcaccgtcctcatcggcggcctgcgcgtcatcggcgccaattacggcggtgcggcgcatggcgtcttcaccgataagccgggggcgcttacaacggacttcttcacgacgttgacggacatggcctattcctgggtcccgaccggcaacaatctctatgagatccgtgatcgcaagaccggcgcagccagatattcggcaacccgcgtcgatctcgtgatcggctccaactccatcctgcgcgcttatgcggaagtttatgcgcaggacgacaacagggaaaaattcgcccgcgacttcattgccgcctggacgaaggtgatgaacgccgaccgtttcgatctg

SEQ ID NO: 35109 - DNA, 858 bp, Agrobacterium tumefaciens
caagacccgcgcagccagtatccccgcccgccgttttcaaccccgacccaggaaatgccgggtctggtgacgaatatgacgcctttccctgatcatggtgaaaagagctacaagggcaccggcaagcttgcggggcgcaaggcactgattaccggcggcgattccggcatcgggcgcgcagtcgcaatcgcttttgcgcgggaaggtgccgatgtcgcgatatcctatctgccggaggaagaatcggatgccgaggaagttgttgcactgatcgaggcggaaggccgcgtggcggtagcgctcccgggcgatattaccgacgaggcatggtgccgtgaactggtcgagaaagccgtcagcgatctcaatgggcttgatattcttgtcattaacgccgcaaggcagcaatatcgcgaagacatcgaagagctctcgaccgatgatttcgaccgcaccatgaagaccaatctttatgcgttgcactggattgcgcaggcggctgttccatatctgaagccgggtgcgtctgttatcaccaccgcgtccatccaggcctatgaaccatcggccatccttctcgattacgccacgaccaaggccggtatcgtcgcttataccaaggcgctcgcaaagcagctgatcgaaaagggcgtgcgcgccaatgcggtagcgcccggtccgttctggacggttcttcagccgagtggcggccagccggatgagaaggtgaagaacttcggcaaggacagcgatttcggccgtccgggacagcctgtggaactggcacctgtttatgtgctgctcgcctcgcaggatgcgagtttcatcaatggtgaagtatatggcgtgaccggtggg

SEQ ID NO: 35110 - DNA, 1962 bp, Agrobacterium tumefaciens
gttgcctatctggacaagttgaacgagcagcagcgcaaggcggtggaacacggtgtcggcctggcggatggagagacggccggtccgctgctgatcattgccggcgccggttccggcaagaccaatacgctcgcccaccgcgtcgcccatctgatcgtgaatggcgccgatccccgccgcattctgctgatgacgttttcgcggcgggctgcctccgaaatgtcgcggcgtgtcgagcggatctgcaagcaggttatcggggcaaattcggcaatcatgaccgatgcactggcctggtcaggcacgtttcacggtatcggcgcacgcctgttgcgcatctatgccgaacagatcgggctcaatatcgatttcaccatccacgaccgcgaggacagcgccgacctgatgaaccttgtccggcacgaactcggtttttccaagacagaaagccgctttccaacgaaggggacatgccttgcgatctattcgcgcgccgtgaattcccagacgccgttaaaagacattcttcgccaacactatccatgggtcgccgactggcagagcgaactgaaggaactgtttgcagcctatgtcgaggccaagcagatccagaacgtgctcgattacgacgatctcctgctctactgggcgcagatggtcagcgatcccattctggctgatgatatcggcaaccgtttcgaccatgtgatggtggatgaatatcaggataccaaccggctgcaggcctcggtgctgatggcaatgaaacccggtggccgcggcctgaccgtggtgggcgacgatgcgcagtcgatctattcgttccgggccgcgacggtgcgcaacatcctcgattttccggcgtgcttcaacccggcggccgatatcatcacgctggatcgcaactatcgctcgacgcagcctattctggccgccgccaatggcgtcatcgacctggcgcgtgaacgttttaccaagaacctgtggacagagcggcagtcgctcgagcgcccgaagctcgtgacggtgaaggatgaaaccgaacaggcgaatttcatcatcgaccagattcttgccaatcgcgaaaccggcacgacgctgaaacagcaggccgtgctgttccgcacctctagccacagcggcccgctcgaagttgaactcacccgccgcaatatccccttcgtcaaattcggcggcctgaaattcctcgacagcgcccatgtaaaggacatgctggcggtgctccgtttcgcccagaacccgcgcgaccgcgtcgccggtttccggctgctgcagatgctgccaggcatcgggccgaagaaggccggcaatatcctcgatacgatagccccggacccggagcccctgcttgcccttgccgaaattccaccgccgccgaagaccggtgacgactggacggctttcacgcaattgctagtggggctgcggcggggcccgaacggctggccgggcgaaatcggcttggcgcgcctgtggtacgagccccatctcgaacgcatccatgaggatgccgacacccgcaaggccgatctgcagcaactcgagcagatcgccggcggctatccttcacgcgagcgttttctgaccgagctgacgcttgacccgccggacgccaccagcgatcaggccggcgtcccgcttctcgacgaagactatctcagcctctctaccatccattcggccaagggccaggaatggcgttccgtgttcatcctcaacgtggtcgatggctgtataccctccgacctcggggtcggcaccagccaggaactggaggaagagcgccggctactctacgtcgccatgacccgcgccaaggacaacctgtcgctgatcaccccgcaacgtttcttcactggtgggcagagttctcagggcgaccggcatgtctacgctgccagaacccgcttcataccggcgacattgctgcagttttttgag

SEQ ID NO: 35111 - DNA, 852 bp, Agrobacterium tumefaciens
aagggcatcattctggccggcggcagcggcacgcgcctccaccccatgacactggcggtctcgaagcagattttgcctgtctacgacaaaccgatgatctattatccgctgaccaccctcatgctggccggtattcgtgagatactgatcatctcgacaccccacgacatgcctcttttccaaaaccttctgggcgacggatcgaaatggggactttcaatcgaatacgccgttcagccgagcccggatgggctggcgcaggcatatatgatcggcgcggactttgtggccggctcgccatcctgccttatcctgggtgacaacatctattacggtcacggcctgcccgacttgcttgagagcggtaccagcgttaacgacggcgcgaccgtgtttgcctatcacgtcaacgacccggaaagatatggcgtggtccacttcgacagcgaaatgcgtgctctttccatcgaagaaaaaccgctcaaaccgaaatcaaactgggcagttaccggtctctatttctacgacgcagatgtagtcgacatcgcagccaatctcaaaccgtcgccccgtggcgaatacgagataacggatgttaatcgtgtgtatctcgaccgcggcaagttaaaggtatcgatcatgggccgcggctatgcttggctcgatactggcacccctgacagtctccttgaagccggcgagttcgtccgcacgcttgaaaagcgacagggattcaagatcgcctgcccggaagagattgcgatgactaagggtttcattacacacgcagattttgcgttgctagcagaaaacgcgggtaaaggcgattacggcgtttatttaagaaagctt

SEQ ID NO: 35112 - DNA, 1611 bp, Agrobacterium tumefaciens
ctcagcgcgtggatcatgcgtgacattgtcaacagcgtctatttgaaacaaggtttcgatgtcgttcttgagattgcctttgccgttgcagccatcttcatcgtcaaggggctcgctaccttcgtgcaaagctactatcttagcaaagcggggaacagcatcgttgccgaacaacaacgcaagatctacgatcggcttctgaagcagggcgtgtccttcttccagaacctgccatcttcagaactccttgtccgcgttacttacaacgctcaggctgcgcgcagcgtgatcgacacgatcgtgacatctttcgtccgcgacctattttcccttcttggcctgatcatcgtgatgtttgcccagaatttccttctgagcgcgatttccatgattatcggccctgtggcgatatttagcgttcgtctcgtgctgcggcgcgttcgaaagatcatggaggcggaacttgcttcactgggcgaaatcgtcaacgtcgtgcaggaaacgagtattggcgttcgcgttattaaggcattttcgcttgagaaactaatgcgccagcgcatgaacaaggccgtgtccgacgtcgagcatcgtgcaaacggcattgcgaagcttgaagcagcaaccagcccgatcatggagaccctgtctggcctcgccattgcagtcgtcatcgccgtttccggttataccgtgcttgaaaaaggcggatcaccgggtgacctgatggcctttatcaccgctttgcttcttgcttacgaaccagcaaagcgtctggcccgcatgcgagtccaaattgaaggcggcatgatcggcgtgcgcatgatgttcgaggttttggacgctccattgacacttgccgagaaaaaggatgcccagccgctccccaaggcaagcggcaatgtggaactcaagaacgtcagcttcgaatatgttgctaaccagcctgttctgaaggacgtcagcgtcctcttcgaaggtggtaagatgactgcgctggtcggaccttccggcagcggcaagtcgacgatcatcaacctcatgatgcgtctttatgatccgcagagcggttccgtcgagatcaacgggatggatttgcgcgacgtgtccttcgccagcctgcgcgagcatgtttcttacgtcggccaggaaaccttccttttctctggaacggtgaagcacaatatttccgtcggtcgcgacaacgctaccgatgaggaaatcatcgccgcggccaaggcggcaaacgcacatgatttcatcatgaacatgcctgatggttacgacagcaagcttggcgaaaacggctccggtctgtctggtggccaaaggcagcgcgttgcaatcgcccgcgcgatgctaagagacgcagacatattgatcctcgacgaagcaacaagcgcgctcgattcggaatccgaagcgcttgtccgggacgcgcttgagcgtttgacgcttaacaagacatccattgtcattgcccaccggctctctacaataaaccgggccgacaagattgtcgttatggataatggtcaggttgtggagcaaggaagccgtcgcgagttgctcgccacggatggtctctacaagcgcctgcacagcatccag

SEQ ID NO: 35113 - DNA, 1050 bp, Agrobacterium tumefaciens
gtcgcgaccattgccgcaaagcatgcggatgacgtggatgtcaccggccgcttcccgcaggaagccgtcgatgccttgcgccgcgaacgtctcctcggcattcaggtgccctcctcactcggcggcgaaggcgcctccattcaagagatcgccgatatctgcgcccggctcggccaggcctgttcggcaaccgcaatgattttcgccatgcaccacatcaagctgtccagcctggtggaacatggggtcgacagcacctggcatccgggttttatgcgccgcgttgccggcgaacagctactgctcggctccgcgaccaccgaaggcggcattggcggcaatctgcgcaactctatctgcgcgatcgaggtcgaaggagacagctgtcggctggaaaaggatgccaccgtcatttcctacggcagcaatgccgatgcgatcctcatcacctcacgcgcccacaaggatgccgcacccgccgatcaggtgatgaccgtcttcctgaaaaatcagtacacgcttgaaaagacccatgtctgggatacgctcggcatgcgtggcacctgttcggacggtttcctgtttcgcggcgaagcgccggcggcacagattttcccgaagcctttcgcggaaatcgccgcgcaatccatgcttgcaagctcgcatctcctgtggagcgccgtctggtatggcatcgcctcggacgccgtgctgcgcgcgcaatcctttgtcagagccgcggcgcgcaaatcgcccggcaccgcccctcccggcgcaatccgccttgccgaggtttccaccaaactgcaggtggtcaaatccaacatcatcgccggcatcaaggcctacgaggacaccaagagcgatcccgaaaagctgatgtccatggccttcgcggtggcgatgaacaatgtgaaaatctgctcttcggaaaccattcttgagatcatcgatcacgccatgctggtctgcggcatcatgggctacaagaacggcacgccctatagtctcggccggcatctgcgcgacgcgcattccgcccggctaatg

SEQ ID NO: 35114 - DNA, 1314 bp, Agrobacterium tumefaciens
accctgctttccagcatcgaaaacaaaagcgccaaagcgggggtgatcggcctcggctatgtcggcctgccgcttgccatgacggtcgctaaggccggtttcaaggtcgtcggtttcgacatcgaccccggtaaaattaccgcgatcgaagcgggccgcagctatatcgaggcggtttccgatgaggtgctggcaagtgtgcggcaggatgacggtttcgttgccaccagcgattttttgaggctggccgaatgcgatgtgatcgccatttgcgtgccgacgccgctgacgaaatatcgcgagccggacctttcttatgtcgaaaagacctgccgggatattgccgcacatctgcgcaaggggcagctcgtggtgctggaatcgaccacctatcctggcacgaccgacggggtggtgaagaccattctggagagcaccggcctcgtctctggcgtcgatttcttcatcggcttttcgcccgagcgggaagatccgggcaatcgcgatttcgagacctcgaccattccgaaggttgtcgccggtgacggcgaggctgccggaaagctgatggccgccttctacggctcagtggtgaagaagatcgttccggtttcgaccaatgccacggccgaggcggtgaaaatcaccgaaaacgtcttccgtgccgtcaatatcgcgctcgtcaacgaactcaaggtcgtctacgaggcgatgggcatcgacatatgggaagtgatcgacgcggcaaaaaccaagccgttcggtttcatgccgttttatcccggtcccggtctcggcggtcattgcataccgatcgaccctttctacctcacctggaaatcgcgcgaatatgaattgccgacgcggttcatcgagcttgccggcgaaatcaataccggcatgccgcgccatgtcgtcgggcgggttgctgaagcgctggatatccattcggggaaggcgctcagccgctcgaaagtgctggtcgtcggtctcgcttacaagaaaaacgtgcccgacattcgcgaaagtccgtcgctgaagctcttggagcttattcaggagcgcggtggcgatgcggcctatttcgatccctatgtggcggaaatcccgaaaacccgggaatatagccaccttatgggcatgaaatccatatcctgggacagggagaccatcggcagcttcgatgccgttcttgtcgcgacggatcacgacaatgtcgactatgccgcgcttagcgactgggcgccgctgatcatcgatacacgaaatgtcttcgcgcgccgggatatcgccgcaaaacacatcatcaaggcc

SEQ ID NO: 35115 - DNA, 1833 bp, Agrobacterium tumefaciens
ttcaccttcacgctggtcaatctatcccacgaaccactgaaggattttcgcatcgtttatacgtcgctcacgcgcacagtggacaagccggtgtgcggcaacgccatctatctgcgtcgcaacgccaatttccatgaatttgcacccccatccggtttcgtgctggagccgggcaaatcctggcgcttcaccgtcgatggcctgttgagacctgcccggcatcgcacggatggtgcaaaatccgcctatgtcagccttgccgatggcacacatcgcgccgtggatgtgggtgacctgatgctggatgggcgccacagcgagccggcgccggtgctgcttcccgaaggcaagctcgatctgcccttcgccatccagccctggccagctgaaatcgatgccgaaccgggtgaaggctttcccgtagcacttttcccgatggaggacgccagggcggaggaagcgcttgcggtggaaaccgtgctgtcgctgttccgcaggctctttgccgtcgggcatgtgcctttcagccttgcgccggtgcatgagggaaaaccgctgcgtttcaagcagcatagcgggctcgaagcggaaggttaccgcatcgctttttccaacgaagccgtcaccgtggaatattccgccgctgccggcctgcaatatggcctgacggttctggcgcagctgctgcatggcgcgcgcattgatccgaagttccgtttcccggcctccggcaccatcagcgatgcgccgcgttacagctggcgcggctgccatctggatgtctcgcggcaattttatccgaccgatgatgtgctgcggctgatcgatattctcgcatggctgcgcatgaaccgcttccattggcacctgacggatgacgaggcgtggcgtctcgaaatcaaggcttatcccttgttgaccaccgtcggcgcgacgcgcggtccggatgggccgcttctgccgcagctcggcaatggcgcggaaccggtttccggctattacacgcaggataatgtgcgcctggttgtggcgcatgcggcggcactgaatgtcgaaatcgtgccggaggtggatattcccggtcacagcaccgcggctcttgttgcctatccggagctgacggacgggcaggaagcgccggacagctatcgctcggtgcagggatatcccaataacgcgctcaacccggccatcgagccgacctatgagttcctcggcaagattttcgacgagatggtggagctgttcccatcgcggctcatccatatcggcggcgacgaggttgcggatggctcgtggctcgcttcgccactggccaaggcgctgatggacaaggaggggctggacggcaccttcggcatccagtcttatttcatgaaacgcattcaggggatgctgcatgagcgcggtcgccagcttgccggctgggacgaggtttcccatggcggcggcgtcgatcccgctggaacattgctgatggcatggcagaagccagaagtcgggcttgagcttgcaaggcagggttatgacgtggtgatgacgccgggtcaggcctattatctcgacatggtgcaggacgaagcctggcaggagcccggcgcaagctgggccggcacggttccgccgtcgcatacctatgcttatgaggcggtcggcgatttccctgacgaattgaaggagcggatgaagggtgttcaggcctgcatctggtccgaacattttctcaaccgtgcctatttcaaccatctggttttcccaaggctgccggccattgccgaggcggcatggacgccaaaggcgcagaaggactggctgcggttttccgccatcgtt

SEQ ID NO: 35116 - DNA, 762 bp, Agrobacterium tumefaciens
cagctcgccatcgtaaccggtgcggcaggggatattggccgggcgattgctgcggcactttctgaaagccataaaaaggtggtgctggtcgatatcgatgccgacgccctgtccgatgcgctttacaagctttccggtccgggcttcgttgccaagacctgtgatgtcactgatccgcaggatcttgcgcggctggccgccgaggtcgcggagtttggcgaagtcgccaccctcgtcaataatgccggtgcggcacgggccgtcagcctgcacgacacaacggctgaaatctggcgcaaggacaatgcgctcaatctggaagcgccgtttctctgcttcagggctttcgaggaggcgttgaagcgcacccagggctctgtcatcaatatcacatccgtcaatggcatggctgtgttcggccatccggcctatagcgcggcaaaggccgggttgatccatctgaccaagctgatcgccgtcgaatacggcaaattcggcatccgcgctaacgcagtcgcgccgggcaccgtccgcacgcaggcatgggaggcgcgcgctgccaccaatccccaggtcttcgaggaagccaagcactggtatccgctgcagcggatcgtcagacccgaggatgtggccaatgcggttgcttttctcgctggcccgcaggctgccgccatcagcggcgtgtgcctgccggtcgattgtgggctgacggcaggccaagcgccactcgcccggacattttcgcaatccgaacactac

SEQ ID NO: 35117 - DNA, 1011 bp, Agrobacterium tumefaciens
ctgatgcgccaggaaatcgatgagattcccgatgctgtcgcccgcctgctggacaatgccaagaccgacttcctggaggcaggcagcaagttgaaggcccgtgacccggcagtcgtcgttaccattgcccgcggctcctccgatcatgccgcacatttcctgaaatatgccatcgaattgcagaccggtctgccggtcgcctcgctcgggccttccctcgcctccatctatcagacgaaactgcggctggaacgggcagcagccttcgccgtttcgcaatccggcaagagccctgacatcgttgccctcgcacaaagcgcccgcaagggcggcgcgctcaccttctcgctcgtcaacaccctgccatccccactgggtgaggcggccgaccacgccatcaatatccaggcggggccggaaaaggcggttgcagcgaccaaatccttcgtcaattccatcgttgccggtctggctatccttgccgaatggacggaagacagcctgcttgccagggccgtcagcgccctgccgcagaatttcgccaaggccatcgcgctcgattggagccacatcggcgaggcggtgaagggcgaagaatcgctttacatgctgggccgcggtccggcgctcgccattgccgcagaagctgcgctgaaatgcaaggaaacctgcgagctgcatgccgaagcctattcctcggccgaggtcatgcatggcccggtctcgctggtggcgccgcaattccccgtcatcgcctttgccgcccgcgaccgtgccgagacgtcggtcacggatatcgccgcaagccttgccaataaaggtgcgaatgttttcgtcacctccacaaagggcagcccggccaagcccctgcccttcgtggagaccaaccacccgctgaccgatgcattgctgctgattgcgccgttttacggctttatcgaacaattatcccgcgcacgcggcttcaacccggatgcacccgtggcattgaagaaggtaacggaaacccaa

SEQ ID NO: 35118 - DNA, 1209 bp, Agrobacterium tumefaciens
atggacttcgaggcattttttacgacggaactgcaaagcctgcattctgaggggcgttatcgcgtttttgcggatatcgaacgccagcagggcaattttccccgcgcgacacggtacaatgccaatggcgatcgcaaggacgtaaccgtctggtgctccaacgactatctcggcatgggccagaacccgaaagtcatcgaagccatgaaagccgccatcgatcactgtggcgcgggtgcgggaggcacccggaacatttctggcaccaaccattatcatgtcctgctggagcaggaactcgccgatctgcacggcaaggaatcagccctgattttcacgtcgggttatgtttcgaactgggcaaccctcggcactctcggccagaaaattccgggcctcattatcttctccgacgcgctcaaccacgcatcgatgatcgagggcattcgttacggtcgttgcgagcgggtgatctggaaacacaacgatctcgaagatctcgaagcgaagcttaaggctgccgatcccaatgcgccgaagctgattgcctttgaatccgtctattcgatggatggcgatatcgcgccgatcagggaaatctgcgatctggccgaccgttacggcgccatgacctatctcgacgaagtccatgccgtcggcatgtacggcccgcgcggtggcggcattgccgagcgcgaaggcctgatggatcgtctgacgatcatcgagggtacacttggcaaagccttcggcgtgatgggcggttatatcaccggctccaccgcagtctgcgatttcatccgttctttcgcatccggcttcatcttcacgacggccctgccaccgtcgcttgccgccggcgctatcgcgtcgatccagcatctgaaggctagcccctttgagcgcgcgcgccatcaggatcgggtccgcaagctgcgcggtcttctcgatgcccgcggcattccgcatatggacaatccaagccacatcgtgccggtcatggtcggcgatgccgccaagtgcaagtggatttcggatatcctgctcgacaatcacggcgtctatgtgcagccgatcaattacccgaccgtgccgcgcaagacagagcgcctgcgtattacaccgacaccgctgcacactgatgccgatatcgagcagcttgtcggtgcgctgcatcagctctggtcgcattgcgcactggcgcgtgcg

SEQ ID NO: 35119 - DNA, 1426 bp, Agrobacterium tumefaciens
gcagcggtgaacggcgcgggcaaggttacccaggttatcggcgctgttgtcgacgtggcgttcgaaggcgaactgcctccgatcctgaacgcgctcgaaacacagaacaatggcaaccgcctcgttctggaagtcgcgcagcatctcggcgaaaacgtcgtgcgcacgatcgccatggactcgaccgaaggtctggttcgcggtcagtccgttgctgacacgggcgcaccgatcgaggttcctgttggtctggaaacgctcggccgcatcatgaacgtcatcggcgagccggttgacgaagccggtccgatcgtaacggccaagaagcgcgccatccaccaggacgcaccgtcttacgtcgagcagtcgacggaaggccagatcctcgtcaccggcatcaaggtcgtcgaccttctcgctccttacgccaagggcggcaagatcggcctcttcggcggcgccggcgtgggcaagacggttctcatcatggaactgatcaacaacgtcgccaaggcgcatggtggttactcggtattcgccggcgtgggtgagcgtacccgcgaaggcaacgacctttatcacgaaatgatcgagtcgaacgtcaacaagctcggtggcggcgaaggctccaaggctgcgctcgtgtacggccagatgaacgaaccgccgggcgcccgcgctcgcgtcgctctgaccggtctgacgatcgctgaaaacttccgtgatgaaggccaggacgttctgttcttcgtggacaacatcttccgcttcacgcaggctggttctgaagtgtcggctctgctcggccgtattccttcggccgtgggttaccagccgacgctggcaaccgacatgggccagatgcaggaacgcatcaccaccacgaacaagggttccatcacctcggttcaggcaatttacgttcccgccgacgacttgaccgacccggcgccggcaacctcgttcgcgcatcttgacgcaacgacggttctgtcgcgttcgatcgctgaaaagggtatttacccggctgttgacccgctcgactccacctcgcgcatgctcgacccgatgatcgtcggcgaggagcactacgaagttgcccgtaaggttcagtcgaccctgcagcgctacaagtctctccaggacatcatcgccatcctcggcatggacgaactgtcggaagaagacaagctgacggttgcccgcgcccgcaagatcgagcgcttcctgtcgcagccgttcttcgttgctgaagtcttcaccggttctccgggtaagcctcgtcgcgctcgaagacacgatcaagggcttcaagggcctggtcaacggcgaatatgacagcctgccggaagcagctttctacatggtcggttcgatggaagaagccatcgaaaaggcaaagaagctgactgctgaagccgcctga

SEQ ID NO: 35120 - DNA, 876 bp, Agrobacterium tumefaciens
atgccttcactaaaggatctgaaaaaccgcattgcctccgtgaaggcgacgcagaagattaccaaggcgatgaaaatggtcgccgcggcgaagcttcggcgcgcccaggaagctgcggaggccgcccggccttattctcagcgcatgagcgccgttcttgccaacatcgccacggcggtcgaggcggacgttgctccggcgctgatgaccggcaccggcaaggacgacgtgcatctgctcgtcgtctgcacggctgaacgtggtctttgcggcggtttcaactcgcaaatcgcccgttttgcccgcgatcaagcccgcaagctgatttccgaaggcaagacggtcaagatcatcacggtcggcaagaagggttacgacagccttcgccgcgaatttgcatcgctcatcatcgagcgtatcgaactgcgtgacgtgaagaaggtcggctttgaaaacgccgaccagatcgccaagaaggtgatctcgctcttcaacgcgggtgaattcgacgtctgcacgctgatctactcggaattcaagtccgtcatcagccagatcccgaccggcctgcagctcattccggccgcaacgcctgttgtggaagcggctgagacgacgcagaccgccgtctacgaatatgagccggatgcggcttctattctggaagaccttattccgcgcaacatttcggttcaggttttccgggctctgctcgaaaacgttgccggtgaaatgggcgccaagatgagcgcgatggacaatgcaacgcgcaatgccggtgagatgatcaacaagctgacgctttcctataaccgtcagcgtcaggctcagatcaccaaggaactcattgaaatcatttcgggcgcggaagcgctc

SEQ ID NO: 35121 - DNA, 1515 bp, Agrobacterium tumefaciens
cgcgccgcggaaatttccgcaattctgaaagatcaaatcaaaaatttcggcaacgaggcggaagtctcggaagtcggtcaggtgctttccgtcggtgacggtatcgcccgcgtttatggcctcgacaatgttcaggccggcgaaatggtcgagtttcccggcggcattcgcggcatggcgctcaacctcgaagccgacaacgtcggtgtggttatcttcggctcggaccgttccatcaaggaaggcgacaccgtaaagcggactggcgctatcgttgacgttcccgtcggtccggaactgcttggccgcgtcgtcgacgcgctcggcaacccgatcgacggcaagggcccgatcaatgccgccaagcgttcgcgcgttgacgtcaaggctcccggcatcattccgcgcaagtcggtccatgagccgatgtcgaccggcctcaaggccatcgacgcgctcatcccggttggccgcggccagcgcgagctcgtcatcggcgaccgccagaccggcaagaccgccatcattctcgacacgatcctgaaccagaaggccattcacgacaatggtcctgacggcgacaagctttattgcgtctacgtcgctatcggtcagaagcgttcgaccgttgcccagttcgtaaaggttctggaagaacgcggtgcgctgcagtactcgatcatcgttgccgcaacggcttccgatccggctccgatgcagtacctcgctccgtttgccggttgcgccatgggcgaatatttccgtgacaacggcaagcacgctctcatcggttacgacgacctttccaagcaggccgttgcctatcgtcagatgtcgcttctgctgcgtcgtcctccgggccgcgaagcttatccgggcgacgttttctaccttcactcccgtcttctcgagcgcgctgcaaagctctccgacgaaatgggcgctggttcgttgacggcactgcctgttatcgaaacccagggtaacgacgtttcggccttcattccgaccaacgtgatctcgatcaccgacggccagatcttcctcgaaaccgacctgttctatcagggtatccgtccggctgttaacgtcggtctgtcggtttcgcgtgttggttccgccgctcagatcaaggcgatgaagcaggttgccggttcgatcaagggtgaactcgcccagtatcgcgaaatggctgcttttgctcagttcggttcggaccttgacgcttccacgcagcgcctgcttaaccgcggtgcccgcctgacagagcttctgaagcagccgcagttctctccgctcaagacggaagagcaggttgcggtgatcttcgctggtgtcaacggttaccttgacaagattccggtcgcacaggtcggcaagttcgagcagggtttcctctcctacctccgctcggaaggtaaggcgatcctcgacaccatccgcacggaaaaggctatcagcgacgataccaagggcaagctcaagggcgctcttgataacttcgccaagtctttc

SEQ ID NO: 35122 - DNA, 540 bp, Agrobacterium tumefaciens
ggaacatccggtgtagcggaaaggtatgcgtcgtcgcttttcgagcttgctttggaagcgggtacggtcgaagcggttcaggtcgaactggacaagttcggcgcacttctcgacgaaagcgacgatttgaagcgtctggttgcgagcccggtgttttctgccgaggatcaattcaaggcaatcagcgcgatttgcgaaaaggccggcatcgctggtctcgctgttaatttcctcaaggttgttgcgaataaccgccgtctctttgccgttcccggcatgatccgcgcctaccgcaccattgccgccgcccaccgcggcgaaatcaccgccgaggtcacctcggcacatgcgctcgacgaggcgcaggaaactgaactgaaagcggcgctgaagagcgttaccggcaaggatgtggcgatttccgttaccgtcgatccttcgatcctcggtggcctgatcgtcaaggtcggttcgcgccagatcgatacgtctcttcgcaccaaactttccacccttaagcttgcactgaaagaggttggc

SEQ ID NO: 35123 - DNA, 1395 bp, Agrobacterium tumefaciens
gatgtagttgtaatcggaacgggtcccggtggttatgtttgcgcggtcaaggcggcacagctcggcctcaaggtcgcagtgatcgaaaagcgcgcgacctatggcggcacctgcctcaatgtcggctgcattccttccaaggcgttgctgcacgcctccgaaaccttcgcgcatgtggcccacggcgttgatacgcttggtatcgaagtcgccgctccgaagctgaacctcgagaagatgatggggcacaaagacggcgtggtgaaagccaatgtcgacggcgttgctttcctgttcaagaagaacaagatcgatgctttccagggcactggcaaggtggtttccgccggcaaggtttccgtcaccaacgacaagggtgagacccaggagatcgaagccaagaacatcgtcatcgccaccggttccgatgttgccggcattccgggtgtcaaggtcgatatcgatgaaaccgtcatcgtgtcctccaccggtgcgattgctctttccaaggttccggaaaaactcatcgtcgttggcggtggtgtcatcggtctcgagcttggttcggtctggtcgcgtcttggcgcgaaggtgaccgtcgtcgaatatctcgacaacattctcggtggcatggatggcgaagtttccaagcagtcgcagcgtctgctcgccaagcagggtctcgatttcaagcttggcgccaaggtgacggccgttgaaaagaccgctgccggtgcaaaggtcgtattcgagccggtcaagggcggcgcggctgaaacgctggaagctgatgtcgtgctgatctccacggggcgcaagccctacaccgaaggtctcggccttgcggaagccggtgttgtgctcgacagccgcgggcgtgtcgagatcgacggccactacaagaccaatgtcgatggcatctatgcgatcggcgatgtggtgtagggcccgatgctggcacacaaggcggaagatgagggcgttgcgcttgctgaaatcctcgccggccagcgtggccatgtgaactacgacgtcattccggccgtcgtttatacgcagccggaaatcgcttccgtcggcaatacagaagaggaactgaaggccgctggcgtcgcctacaaggtcggtaagttccccttcaccgccaatggccgcgcccgcgccatgcaggtgacggatggtttcgtgaaaatccttgccgacaaggaaaccgaccgggttctcggcggccatatcgtcggcttcggcgccggcgaaatgatccacgagatcaccgtgctgatggaattcggcggttcttcagaggatcttggccgcacctgccacgcgcacccgaccatgtcggaagccgtgaaggaagcagcacttgccaccttcttcaagccgatccacatg

SEQ ID NO: 35124 - DNA, 1230 bp, Agrobacterium tumefaciens
atggccactgaaatccgcgtaccaaccctcggcgaatccgtcagcgaagcgaccgtcggcacctggttcaagaaggtcggcgataccgtcaaggccgacgaacctctcgttgaactcgaaaccgacaaggttaccgtcgaagtcccggcccctgcgtcaggcgttctcaccgaaatcgttgcgcagaacggcgagaccgttggtctcgacgcgcttctcggccagatcgccgaaggtgctgccggcgctgcgacttctgcacctgcggcaaagcctgctgcgcccgccgccgcaccggcacctgccgcagccgtagccgccgctccgggtggcagcgccatgccaccggcacctgccgctggcaagctgcttgccgaaaacaacctgtctgccgatcaggttgacggttcgggcaagcgtggtcaggttctgaagggcgacgttcttgccgctgtcgccaagggcgtttcggcacctgccgccgcaccggcaccggttgccgccccccgtccggtttcggccgagcaggatcaggttcgcgaagagcgcgtcaagatgacccgtctgcgccagacgatcgcccgccgcctgaaggacgcgcagaacaccgccgccatgctcaccacttacaacgaagtggacatgagcgcggtcatggaccttcgtaaccgctacaaggacgtgtttgaaaagaagcacggcgtcaagcttggcttcatgggcttcttcaccaaagccgtgacccacgcgctgaaggagctgcctgctgtcaacgctgaaatcgacggcacggacatcatctacaagaactattgtcacgtcggcatggctgtcggcaccgacaagggcctcgtcgttcctgttatccgtgatgccgaccagctctccatcgccggcgtcgaaaaggaactcggtcgccttgccaaggcagcccgtgacggttcgctcggcatggcggacatgcagggcggcaccttcaccatcaccaatggtggcgtctacggttcactaatgtcttcgccgatcctcaacgcaccgcagtcgggcattctcggcatgcacaagatccaggagcgcccggtcgccatcggcggtcaggtcgtcatccgcccgatgatgtatcttgcgctctcctacgatcaccgtatcgttgacggcaaggaagccgtgaccttcctcgttcgcgtcaaggagagcctcgaggatccggaacgtctggttctcgatctc

SEQ ID NO: 35125 - DNA, 2988 bp, Agrobacterium tumefaciens
atggcaaggcaagaagcgaacgagcagtttcagatcacgtcgtttctggacggcgcgaatgcagcctatatcgagcagctctatgcccggtacgaagaggatccctcttccgtgtcgccggagtggcagagcttcttcaaggcactgtccgataatccggaagatgtgaagaaggcggccaagggcgcctcctggaagcgtgccaactggccgatcccggcgaatggcgaactggtctccgcactcgacggtaactgggccacggtcgaaaaggccattgagaaaaaggtccaggcgaaggctgaagccaagagcgccgatacaggcaagcccgtcagcgaagcggaagtgctgcaagcgacccgtgacagcgttcgcgccatcatgatgatccgcgcctaccgcatgcgcggccacctgcacgccaagctcgatccgctcggcatcgccagcgccgtcgaggattacaacgagctttcgccgaagtcctatggcttcgaggaaagcgactacgaccgcaagattttcatcgataacgtgctcggcctcgaatatgcgaccgtgcgcgaaatggtcgagattctcgagcgtacctattgctcgacgctcggcgtcgaattcatgcacatgtccaacccggaagaaaagggctggattcaggaacgcatcgaaggcccggacaagggtgtggatttcacgccggaaggcaagaaagccattctgtccaagctggtcgaagccgaaggttacgagcagttcctcgacgtgcgtttcaagggcaccaagcgtttcggcctcgatggcggtgaatcgctgatcccggcactcgagcagatcatcaagcgcggcggccaggacggactggaagaagtcgtgctcggcatggcccaccgcggtcgcctgaacgttctgaccaacgtgatgggcaagccgcaccgcgccgtgttccacgagtttaagggcggttcgttcaagccagacgacgttgaaggttcgggtgacgtgaagtaccatctcggtgcctcctccgaccgcgaattcgacggcaacaaggttcacctgtcgctgacggccaacccgtcgcaccttgaaatcgtcaatcctgtcgtcatgggcaaggcccgcgccaagcaggaccaactggccaagacatgggacggcgacatcattccgctgtccgaacgcgccaaagtgctgccgctgcttctgcacggcgatgccgcttttgcgggtcagggcgtggttgccgaaattctcggtctttccggcctgcgtggccatcgcgttgccggcaccatgcacttcatcatcaacaaccagatcggcttcacgaccaatccggccttctcgcgctcgtcgccttatccgtccgacgttgcgaagatgatcgaagcgccgatcttccacgtcaacggtgacgatccggaagcggtggtctatgcggcgaaggtcgcgaccgaatatcgcatgaagttccacaagcctgtcgtcatcgacatgttctgttaccgccgcttcggccataacgaaggcgatgagccggcgttcacgcagccgaagatgtacaaggtcatccggggccacaagaccgtcgcccgtatctatgccgaccgcctgatcgcggaaggcctgatcaccgagggcgatttcgagaaggtcaaggccgactggcgcgctcatctcgagcaggagttcgaggcaggccagtcctacaagcctaacaaggccgactggctggatggtcagtggtccggcctgcgcgccgccgacaatgccgatgagcagcgtcgtggcaagaccggcgtgccgatgaagcagctgaaggaaatcggcaagaagctgtcgaccattcctgaaggtttcaccgcgcatcgcacgatccagcgtttcatggaaaaccgctcgcagatgatcgaaacgggcgaaggcatcgactgggctatggcggaagcgctggctttcggttcgctcgttgttgacggccacaagatccgtctttccggtcaggattgcgaacgcggcaccttctcgcagcgccactcggttctttacgatcaggagaccgaagagcgttacatcccgctggcgaacctcgccccgacgcaggcccgttacgaagtcatcaactcgatgctttcggaagaagccgttctcggtttcgaatacggctattcgcttgcccgcccgaatgcgctgacgctctgggaagcccagttcggcgacttcgccaacggcgcgcaggtggtgttcgaccagttcatctcctcgggtgaacgcaagtggctgcgcatgtccggtctcgtctgccttctgccgcatggttatgaaggccagggcccggaacattcgtccgctcgtctggaacgctggttgcagatgtgcgccgaagacaatatgcaggtcgccaacgttacgacgccggctaactacttccatatcctgcgccgccagatgaagcgtgacttccgcaagccgctgatcctgatgacgccgaagtcgctgctgcgtcacaagcgcgccacctcgtctctggcggaactggccggcgagtcctccttccaccgtctcctgtgggacgatgctgaagtcatcaaggacggcccgatcaagctgcagaaggatgcgaagatccgccgtgtcgtcatgtgcaccggcaaggtctattacgatcttctcgaagagcgtgaaaagcgcggtatcgacgacgtctacctgctgcgcgtcgaacagctttatccgttcccggcaaaggcgctcatcaacgagctttcccgtttccgccacgcggaaatggtctggtgccaggaagagccgaagaacatgggttcgtggtcgttcatcgatccttacctggaatgggttctggcgcatatcgacgccaagtaccagaaggtccgttacacgggccgtccggcggccgcctctccggcgaccggcctgatgtccaaacatctggcgcagcttgctgcgttcctggaagacgcgctg

SEQ ID NO: 35126 - DNA, 897 bp, Agrobacterium tumefaciens
atgtctattcttgttaataaagacaccaagatcctcgttcagggtctgaccggcaagaccggcaccttccacaccgaacaggcgcttgcttattacggcacgcagatggtcggcggtattcacccgaagaagggtggcgaaacctggaccggttccaagggcgaaagcctgccgatcttcgcaacggttgccgaagccaaggaaaagaccggtgcagatgcatccgtgatctatgttccgccggcaggtgcagcagacgcgatcatcgaagccatcgaggctgagatcccgttcatcacctgcatcaccgaaggcatcccggtcatggacatggtgcgcgtcaaggcccgcctcgaccgctccaagtcgcgcctgctcggcccgaactgccccggcatcatgacgccggaagaatgcaagatcggcatcatgccgggctccatcttccgcaagggttcggtcggtatcgtttcgcgctccggcacgctcacctatgaagccgtgttccagacctcgaacgaaggcctcggccagacgaccgctgtcggcatcggcggcgacccggtcaagggtaccgagttcatcgacatcctggaaatgttcctggccgacgacgccacccagtcgatcatcatgatcggcgaaatcggcggttcggctgaagaagatgcggcgcagttcctgatcgatgaagccaagaagggccgcaagaagccgatggccggcttcatcgcgggccgtacggctccgaagggccgcaccatgggccatgccggcgctgtcgtttctggcggcaagggcgacgcagagtccaagatcgcagccatggaagcggcgggcatcaaggtttcgccttccccggcgcgcctcggcaagacgctggttgaagtcctcaag

SEQ ID NO: 35127 - DNA, 1185 bp, Agrobacterium tumefaciens
atgaatattcacgaatatcaggctaaggctcttctgaagggctacggcgcgccggttgctgaaggcgtcgccatcctcaaggtcgaagaagccgaagctgccgcaaagcagcttcccggcccgctttacgtcgtcaagagccagattcacgctggcggtcgcggcaagggcaagttcaaggagctcggccccgacgccaagggcggcgttcgcctagcgaagtcgatcgaggaagtcgtttctcattccagggacatgctcggcaacacgctggtaacggcgcagacgggcgacgccggcaaacaggtcaaccgcctctacatcgaagacggtgcggacattgcccgcgaactctattgctcgcttctggttgaccgttcggtcggtcaggtcgcattcgtggtttccactgaaggcggcatggatatcgaagctgtcgcccatgacacgccggaaaagatccacaccatcgccatcaacccggaaaagggcgtgagcgacgctgacgttgccgcaatctccaaggctctcgagcttgatggtgttgcagccgaagacgccaaagcgctgttcccgatcctctacaaggccttcaacgagaaggacatggctctcctcgaggttaacccgctgatcgtcatggaaaatggccatctgcgcgttctcgacgccaagatgtccttcgacggcaacgcgctgttccgccatgaagacgtcaaggcgctgcgcgacgagaccgaagaagacgccaaggaaatcgaagcctccaagtgggacctcgcttacgtggcgctcgacggcaacatcggctgcatggtcaatggtgccggtctcgccatggcgacgatggacatcatcaagctttacggcaaagagccggcaaacttctgtgacgtcggcggcggcgccggcaaggagaaggttgcggcagctttcaagatcattacggctgacccgaaggtcgagggtatcctcgtcaacatcttcggcggcatcatgaagtgcgacgtcatcgccgaaggtgttatcgccgcggtgaaggaagtcggtttgcaggttccgctcgttgttcgcctcgaaggcaccaacgtcgaacttggcaagaagctcctgaacgaatcgggccttgcgattacggctgctgacgacctggacgacgcagccaagaagatcgtcgcggcgatc

SEQ ID NO: 35128 - DNA, 957 bp, Agrobacterium tumefaciens
atggctcgcaaaaaaattgcacttattggttctggcatgatcggcggcacgctggcgcatctcgccagcctgaaggaactgggcgatatcgtcctcttcgacatcgccgacggcatcccgcagggcaagggtctggatattgcccagtccggcccggttgaaggcttcaatgcaaagctctccggcgcttccgattacgccgccatcgaaggcgcagacgtctgcatcgtcaccgcaggtgtcgcccgcaagcccggcatgagccgcgatgatcttcttggcatcaacctcaaggtcatggaacaggtcggcgccggcatcaagaaatatgctccgaacgctttcgtgatctgcatcaccaacccgctcgacgccatggtctgggcgctgcagaagttctccggcctgccgaagaacaaggtcgtcggcatggctggcgttctcgacagcgcacgcttccgcctgttccttgccgaagaattcaacgtttcggtccaggacgtcaccgccttcgttctcggcggtcatggcgacaccatggtgccgctcgcccgttattccaccgttggcggcgttccgcttaccgatctcgtcaagatgggctggttgaccgccgaacgtcttgagcagatcatccagcgcacccgtgacggcggcgcggaaatcgtcggcctcttgaagaccggctcggcctattacgcgccggccgcttcggctatcgaaatggccgaatcctacctcaaggacaagaagcgcgttctgcccgctgctgcccacctttcgggccagtatggcgtagacgacatgtatgtcggcgtgcccaccatcatcggtgccggcggtatcgagcgcgtcatcgagatcgaactgaacaaggaagaagaagccgccttccagaaatccgtcggcgctgtcgctggtctttgcgaagcctgcatcaacatcgctccgtcgctg

SEQ ID NO: 35129 - DNA, 771 bp, Agrobacterium tumefaciens
atggttgaactcgctctccccaagaattcccagatcagcgaaggcaaggtctggccgaagcctgacggtgccaagaatgtgcgcgaataccgcatctatcgctggaacccggatgacggtcagaacccgcgcatcgatacctattacatcgatgtcgatgattgcgggccgatggttctcgatgcactgctttacatcaagaataatatcgacccgacgctgacgctgcgtcgctcctgccgcgaaggcatttgtggttcctgtgcgatgaacatcgacggcaccaatacgcttgcctgcaccaagggtatggaagagatcaagggtacggtaaaggtttatccgctgccgcatatgcctgtcgtgaaggacctcgttcccgatctgtcgaacttctacgcccagcaccgctccatcgagccctggctgaagacggtgtctccgacgcccgccaaggaatggaagcagagccatgaggatcgtctgaagctggatggtctttacgagtgcatcctgtgcgcctgctgctccacctcctgtcccagctactggtggaatggcgaccgttatctcggccccgccgttctgctgcaggcctatcgctggctgatcgacagccgcgatgaggcaaccggtgagcgtctcgacaatctcgaggacccgttccgcctttatcgttgccacaccatcatgaactgcgcacaggcttgcccgaagggcttgaacccggccaaggcgatcgcggaaatcaagaagatgatggtcgagcgt

SEQ ID NO: 35130 - DNA, 1803 bp, Agrobacterium tumefaciens
gcctacacctatgtcgatcactcctatgacgtgatcgtggtgggcgccggtggcgccggtctacgcgcaacgctcggcatggcggaacagggtttccgcacggcctgcatcaccaaggttttcccgacccgctcccacacggtcgcggcgcagggcggcattgccgcatcgcttaccaacatgacgcccgactgttggcagtggcacctttacgacaccgtaaagggctccgactggctgggcgacgtcgatgcgatgcaatatctcgccatggaagcgccgaaggcggtctatgagctggaacattacggcgtgcccttctcgcgcaatgccgagggcaagatttaccagcgcccgttcggcggtcacatgcagaattacggcgaaggcccaccggtacagcgcacctgtgctgccgccgaccgtaccggccacgccattctgcacacgctctatggccagtcgctgcgcaacaatgcggaattcttcatcgaatatttcgcgctcgacctcatcatggcgccagatggtcgttgcacgggcgtcgttgcctggaacctcgatgacggcacgatccatcgattctccgccaagatggtggtgctggcgaccggcggttacggccgcgcctatttctcggcgacctctgctcacacctgcaccggcgacggcggcggcatgattgcccgtgccggcctgccgcttcaggacatggaattcgtacagttccatccaaccggcatttatggcgcaggctgcctcatcaccgaaggcgcgcgtggcgaaggcggttacctcgtcaactcagaaggcgaacgcttcatggagcgttatgcgccatcggcgaaggaccttgcctcccgtgacgttgtctcccgctgcatgacgatggaaatccgtgaaggccgcggcgtcggcaagaacaaggatcacatcttcctgcatctggatcacctcgatcctgcgatcctgcatgagcggcttccgggcatttccgaaagcgccaagatttttgccggcgtggacgtgacgcgcgagcccatcccggttctgccgacggttcactataatatgggcggtattccgaccaactattggggtgaagtgctgaaaaccgatgccaataacccggaacgtatcgcgcccggtctgatggccgtcggcgaagccggttgcgcctcggttcacggtgccaaccgcctcggctccaactcgctgatcgacctcgtggtcttcggccgcgccgccgctattcgtgcagcacaggtcatcgaccgcgatgcgcccgttcctgcgctcgacattgcggcctgcgacaagatcatggagcgcttcgacagcctgcgttacgccaatggctcgacgccgacggcggtgctgcgcgacaagatgcagcgcgccatgcaggacgatgcggccgttttccgcacgcaggaatcgctggagagcggttgccagcgtctttccgccatctggaaggagctgccggacgtcaaggtcaccgaccgttcgatggtctggaactccgatctggtcgagacgctcgagctacacaatctgatggccaacgcgatcaccacggtctatggcgctgaagcgcgcaaggaaagccgcggttcacacgcccgtgaggatttcgtcgatggtcctttcggcggtcgcgacgacgtgaactggcgcaagcacacgctcgcctgggtcagccccgaaggggacgtcaaactcgattatcgcccggttcacaccgacctgatcgccgacggcatcgatcccaaaaagatcgagccgaaggcgcgcgtctac

SEQ ID NO: 35131 - DNA, 903 bp, Agrobacterium tumefaciens
cctttccgaatcggcacacgcggcagcccgctggcgctcgcgcaggcttatgagacccgcagccggctgatggcggcacacggtcttccggaagagatgttcgaaatcgtcgtgctctccaccaagggcgaccggatcaccgaccgcgccttgtcggaaatcggcggcaagggcctgttcacggaggaactggaaaaccagctcctgtccggcgaactcgatattgccgtgcattcctccaaggacatgccgacggttttgcctgagggcttgcatctttcagctttcctgccgcgtgaagacatgcgcgacgccttcattggtcgcacggcaccgaagcttctggagctgccgcagggcgccgttgtcggctccgcctctctgcgccgccaggcactgatccgccgcctgcgcccggatctcaacgtcatcgttttccgcggtctggtcgacacgcgtctgcgcaagctcgaagaaggccaggcggatgcgacgcttcttgcctttgccggcctgaagcggctcggcaaggacaacgtgccgacggaaattctcgatccaaaagaattcccgcccgctccggcccaaggcgcgatcggggtcgagagccgcatcggtgacgcccgcatggataaattgctggctcccataaacgacaggcccacttatgacgccgtgacctgtgagcgtgcctttctggcagcgcttgacggttcctgtcgtacccccattgccggttacgccacctgcgaaggtgataacctgcatttttccggcctgatccttacccccgatggccagacaagccacggcgtcgaaatctccggcaaccgcagggacgccttgatactggggaaaaaggccggcgaagaggtgcgcgccaaagcgggcagcaatttcttc

SEQ ID NO: 35132 - DNA, 1173 bp, Agrobacterium tumefaciens
aagaaagtcgttctcgcctattccggcggcctcgacacctcgatcatcctgaaatggcttcagacggaactcggcgccgaggtcgtgaccttcaccgccgatctcggccagggcgaagagcttgagccggcacgcaagaaggctgagatgctgggcatcaaggaaatctttgtcgaggacgttcgcgaagagttcgtgcgtgatttcgtgtttccgatgttccgcgccaatgccgtttatgaaggcgtctatctgctcggcacgtcgattgcccgtccgctgatttccaagcacctgatcgagatcgccaagaagaccggcgctgacgccatcgcccacggcgccaccggcaagggcaacgaccaggtccgcttcgagctttcggcctatgcgttgaaccctgacatcaagatcattgcgccctggcgcgactggacgttcaagagccgtaccgacctcctgaacttcgccgaacagcaccagatcccggtcgccaaggacaagaagggtgaagcgcctttctccgttgacgccaacctcttgcactcctcctccgagggcaaggtgctggaagacccggcggtggaagcacctgaatatgtgcatatgcgcaccatttccccggaagcggctcccgacaaggcgaccgtcatcaaggtcggtttccgcaagggcgatgcctgctccatcaacggtgttgaaatgtcgcccgcgacgcttcttgccacgctcaacaactacggtcgcgaaaacggcatcggccgcctcgatctggtcgagaaccgtttcgtcggcatgaagtcacgcggcgtttacgagacgcccggcggcacgatcctgctggcagcgcaccgcgccatcgaatccatcacactcgaccggggtgccgcgcatctcaaggacgatctgatgccgcgttacgctgagcttatctattacggcttctggttttcgccggagcgcgaaatgctgcaggccctgatcgacaagagccaggaacatgtcgaaggcgaagtgacgctgaagctctacaagggcaatgtcatggtaaccggccgcgagagcgagaagtcgctgtattccgacgcgctggtgaccttcgaggacgaccacggcgcttacgaccagaaggatgctgctggcttcatcaagctcaatgcgctgcgtcttcgc

SEQ ID NO: 35133 - DNA, 2683 bp, Agrobacterium tumefaciens
aagtcactcgacagttttcaatgtcgttccgtccttaccgttgatggtaaggactatgtctattttagccttcccaaggctgaagccaatggcctgaagggcgtttccaagctgccctattccatgaaggttcttctggaaaacctgctgcgtttcgaggatggccagtctgtcaccaaggcgcacatcattgcggtttccgaatggttgaataacaagggcctgaccgaaaccgaaattgcctaccgccccgcccgcgttctcatgcaggactttaccggcgttcccgccgtggtcgaccttgccgccatgcgtgatggcctcaaggctctcggcggcgatccggaaaagatcaatccgctcgttccggtcgacctcgtcatcgaccactctgttatcgttgatgaattcggcacgccgaacgcctttgcccgcaacgtggaactcgaatatgagcgcaacggcgagcgttaccgcttcctgaagtggggccagcaggcgttcaagaacttccgcgtcgttccgcccggcaccggcatatgtcaccaggtcaacctcgaatatctcggccagaccgtgtggacgaaagaagaggaaggcgaaacgatcgcttatccggacacctgcgtcggcaccgacagccacacgaccatgatcaacggtctcggtgttctcggctggggtgttggtggtatcgaggctgaggcggccatgctcggccagccggtttccatgcttctgcccgaggtcatcggcttcaagctgaccggcaaggtgaaggaaggagtcaccgcgaccgacctcgtgctgaccgtcgtgcagatgctgcgcaagaagggcgtggtttccaagttcgtcgaattcttcggtcccggccttgattcgatgtctctcgccgaccgtgcgaccatcggtaacatgggcccggaatatggtgcgacctgcggcttcttcccggttgatggcgaaaccatcaattacctgacgatgtccggccgtgccaaggaccgtatcgccctcgtcgaagcctattcgaaggcacaggacatgtggcgcaccggcgatggttccgacctcgtcttcaccgatacgctggaactcgatcttggtgacgtcgtgccctccatggctggccccaagcgtccggaaggccgcctgccgcttgaaaccatcgcgcccaacttcgcgacggcacttgaaaacgactacaagaagcccggccagctcaacagccgctatgcggttgaaggcgaagctttcgatctcggccatggcgatgtggcgattgccgccatcacctcctgcaccaacacctccaacccctcggttcttatcgctgccggccttctcgcccgcaatgcggtcgccaaggggctgaagtccaagccatgggtgaagacctcgctggcaccgggaagccaagtcgttgccgaatatctcgacaagtcaggtctgcagaaggatctcgatgcgatcggtttcaacctcgtcggtttcggctgcaccacctgcatcggcaattccggtccactgccgcctgcgatctccaagacgatcaacgacaagggcctgatcacatcaggcgttctctcgggcaaccgcaacttcgaaggccgtatttcgcctgacgttcaggcgaactatctggcatcgccgccgctcgtcgtggcctatgcccttgccggcacggtccagaaagatctgacgaaggagccgatcggcgacgaccagaacggcaatcctgtttatctcaaggatatctggccgacctcgaaggaaatccaggaattcatcctgaaatacgtcacccgcgagctttatgaaacgaagtatgccgacgtgttcaagggtgatgcgaactggcaggccgttcaggttccgccgggccagacctatgcctgggatgaccagtcgacctatgttcagaacccgccttatttcgtcggcatgggcaaaaagggcaccggtctcaagaacatcaagggcgcgcgcgtcctcggtctcttcggcgacaagatcaccaccgaccatatttctccggccggttcgatcaaggctgcatcgcctgccggcgcttatctgacggagcatggcgttgccgtggccgacttcaaccagtacggcacgcggcgtggcaaccatgaagtgatgatgcgcggcaccttcgccaatatcccgcatccgcaaccacatgcttggtccgaacggcaaggaaggtggctacaccatccactatccgtccaaggaagagatgtcgatctacgacgctgccatgaaatacaaggcggaaggcgtcccgctcgtcatctttgccggcgtcgaatatggtaacggctcatcccgcgactgggcggcgaagggtacaaacctgctcggcgtgaaggctgtgattgcgcagtcgttcgagcgtatccaccgctccaacctcgtcggcatgggcgtcgttcccttcgtcttcgaagagggaacgacctgggcgagtctcgatctcaagggagacgaagtcgttgagatcgatggtctcgaaggcgaaatcaagccgcgtgagaagaagatcgccaagatcacctatagcgacggttcggtgaaggaagttccgcttctttgccgcatcgatacgctggacgaggtaatctacatgaacaatggcggcattctgcagaccgttcttcgcgatctggct

SEQ ID NO: 35134 - DNA, 834 bp, Agrobacterium tumefaciens
gacacggtcgaatttgcgaagatgaacgggcttgccaacaagatcctcgttgtcgatatgcgcggccgcaaggatatggtcacgccagcggctgccatcgccctcaattccaatcccgccacgcagttcgaccagatcatggcgatccacgatccgcgtgtcggcggcacggatgctttcatcgatattctcaattgcgatggcaccaaggcacaggcttgcggcaacggcacgcgctgcgtggtgcaggcgctgtcttccgaaaccggcaagaccagcttcaccttccagacggtcgctggcattctgaacgccgtcgagcatgaagacggcatgatatcggttgatatgggcctgccgcgtttccgctggagcgacattccgctgtctgaagaattccacgatacgagccgcatcgaattgcagatcgggccgatcgatgcgccgatcctgcattcgcctgcggtcatgtccatgggcaacccgcatgcgattttctgggttgatcgcgatccgatgacgtttgatctcgaacgtttcgggccgcttctcgaaaatcatccgatgtttccggaaaaggccaatatcacgctggcgcaggtgatttccgacagcgcacttcgcacccgcacctgggagcgcggcgcggggttgacgcttgcctgcggttccgccgcctgtgcgtcggctgtttccgctgcccgcaccggccgcaccggccgaaaggtcaccatcgatgtcgcctccagccccgtgcgcgtgccgctgaccatcgactggcgcgaggataatcacgtcgtcatgaccggcccggccgaatgggaatggtcgggt

SEQ ID NO: 35135 - DNA, 714 bp, Agrobacterium tumefaciens
tttgccgttgcgctggataagatcaggctacggctcggaacgcagaacttcgatctcgattgcacctttccgcaaggtcaggtgactgcggttgtgggtgcctccggttcgggaaaatcgacgctcctcaatctcgttgccggtttcgaggtgccagattttggccgtgtggttatccacggacaggacatggcggcatcggacccttcggaaaggccggtttcatcgatctttcaggacaataatcttttcgcccatctcgatattttcaccaatgtcgctctcggagtcagtcccggcctgaaattgcgggcggaagaccggcagaggatcgaggtggcgctggcgcgcgtcggtcttgcgggtttcgacaagcgcctgccgggcacgctttccggcggcgaaagacaaagggcggcgctggcgcgtgcgctggtgcggcaaaaaccggtcatgctgctcgatgagcccttcgccgcgcttgatccgggactgcgggcgggcatgacggctctgcttctcgacttgcacgccgaaacaaaaaatacggtgattattgtcacgcatcaccccgacgacataaaaaagctggcgcaacgggtggtttttcttgatcgcggccgcgttgtctatgcaggctcgaccgcagatttcttcgccacacaaaatgtgaaggcggtagacagttttctgaatggctgatcgccttatttt

SEQ ID NO: 35136 - DNA, 783 bp, Agrobacterium tumefaciens
ctgctagaggccatgcgccatggcgtgctgaacggcggcaaacgcctgcggccttttcttgtcatcgagagtgtcgcccttctgggcggagatgccgaagccggcctccacgtcggcgcagcactcgaatgcctccattgttattcgcttgtccatgacgatctgccagccatggacgacgacgacctgcgccgtggccagccgaccgtgcaccgcaaattcgacgaggcaaccgccatcctcgccggtgacagcctgctgacgcttgctttcgacataatcgcctcggatgacaatccgctggcggccgagcgcaaggccgccctcgttatctcgctcgcgcgtgccgccggtattggtggcatggctggcgggcaggcccttgatctcgctgccgaaaagaaagcgcccgacgaggatggcattattacattgcaggctatgaaaaccggtgccttgctgcgtttcgcctgtgaggccggcgcgatcattgccggcagcaatcaagccgaaaggcagcgactgcgcctcttcggcgaaaagattggcctttccttccagcttgccgacgatcttctggatctgaccgccgatgccgccaccatgggcaaggcgaccggcaaggatgccgcacgcggcaagggcacgctggtggccttacgcggcgaagcatgggcacgcgaaaagcttcaggagcaggtggcggaagccagcgaactcctcgccccctacggcgaaaaggccgcgattctcatcgcggccgcaagattcatcgccgaacgg

SEQ ID NO: 35137 - DNA, 3441 bp, Agrobacterium tumefaciens
atatcgaaaatacttgttgccaaccgatccgaaattgcgatccgcgttttccgggcagcgaacgagcttgggatcaaaaccgttgcgatttgggcggaagaggacaagctgtctttgcaccgcttcaaggcggatgaatcctatcaggtcggcaggggtccgcatctcgccaaggatatgggaccgatcgagagttatctttcgatcgaggaggttatccgcgtggccaagctctccggagcggatgcgatccatcccggttatggtcttctgtccgaaagccctgagttcgtggaggcctgcaacaaggccggcatcaccttcatcgggccgacaccggacacgatgcgccagctcggcaacaaggtcgccgcccgcaatctggcgatttcggttgatgtccccgttgttcccgccaccaatcctctgcctgacgatatcgcggaagtggagcgtatggccgaggaaatcggttatcccgtcatgctcaaggcctcctggggcggcggtggccgcggcatgcgcgccattcgcaaaaaggaagatctcgcccgtgaggtgacggaagccaagcgcgaggcgaaggccgccttcggcaaggacgaggtttatctggaaaagctcgtcgagcgcgcccgccatgtcgagagccagattctcggcgatacgcatggcaatgtcgtgcatctgttcgagcgggattgttcgatccagagacgcaatcaaaaggtcgtcgagcgcgcgccagcaccgtatctgtccgaagcgcagcgccaggaactggccgcctattccctgaagatcgcagccgcgaccaactacatcggcgccggcactgtcgaatatctgatggatgccgataccggcaaattctacttcatcgaggtcaatccgcgtatccaggtggagcataccgttaccgaagtcgtgaccggcatcgatatcgtcaaggcgcagatccatattctcgaaggagcggccatcggcacggcggaatccggcgtgcccaagcaggaagatatccgcctcaacggccatgcgctgcagtgccgcatcacgacggaagacccggaacacaatttcattccggactatggccgtattaccgcctatcgctcggcttccggtttcggcatccgtctggatgggggcacgtcctataccggcgccgtcatcacccgttattacgatccgctgctcgtcaaggtcacggcctgggcgccggagccggatgaagcgatcagccgcatggatcgcgcgttgcgcgaatttcgtatccgcggcgttgcgaccaacctgaccttcctcgaagccatcatcggtcacgacagtttccgcaacaacacctatacgacgcgcttcatcgattcgacgccggagttgttcgcgcaggtcaagcgtcaggaccgcgccaccaagcttctgacctatctggccgatgtgaccgtcaatggtcacccagaaaccaagggtcgtgcgaagcctgcggacaaggcggcaaagcccatcgtgccctatatcgatgcgccgacgcctgacggcaccaagcaattgctggacaagcttggccctaagggctttgcggactggatgcgcaacgaaaagcgcgtgctggtcacggatacgaccatgcgcgacggacaccagtcgctgctggccacccgcgtccgtacccatgatatcgcccgcgttgccagcgtttattccaaggcgcttccgcagcttctgtcgctggaatgctggggcggtgcgaccttcgacgtctcaatgcgcttcctgaccgaagacccgtgggagcgcctgtcactcattcgcgaaggtgcgccgaacctgctgttgcagatgcttctgcgtggtgccaacggcgtcggttacaagaactatcccgataatgtcgtgaagtatttcgtccgtcaggcggcaaggggcggcgtcgatctttttcgcgtcttcgactgcctgaactgggtggagaatatgcgggtgtcgatggatgcgattgccgaggagaacaagctctgcgaggcaaccatctgctacaccggcgatctcttgaattcggcacgtccgaaatatgatctcaaatattataccaacctcgcggtcgagctggaaaaggccggcgcccatatcatcgccgtcaaggatatggcgggcctgctgaaaccggccgccgccaaggttctgttcaaggcgttgcgcgaggcgaccggtctgccgatccacttccacacccatgatacgtcgggcatttccgccgcgaccgttcttgcggccgtggatgccggcgtcgacgccgtcgatgccgcgatggatgccttctccggcaatacgtcgcagccctgcctcggctcgatcgtggaggcgctctccggatcggaacgcgatacgggtctcgataccgaatggattcgccgcatttccttctattgggaagccgtgcgcaatcaatatgcggcgttcgagagtgacctcaaagggcctgcctcggaagtctatctgcatgaaatgccgggtggccagttcaccaacctcaaggaacaggcacgttcgctgggtctcgaaagccgctggcacgaggtggcgcaggcctatgccgatgccaacaggatgttcggcgatatcgtcaaggtgacgccgtcctccaaggtagtcggcgacatggcgctgatgatggtgagccaggacctgacggtggccgatgtcgaaaaccctgaccgtgaagtgtccttcccggactcggtggtatcgatgctgaagggcgatctcggtcaatcgccgggcggctggccggaagcgctgcagaagaaggcgctgaagggtgaaaagccttacacggttcgtccgggttcgcttctggaagatgccgatctcgatgccgaacggaaggtgatcgagaccaagctggagcgcaaggtcgatgacttcgagtttgcctcctatctgatgtatccgaaggtgttcaccgatttcgcgctgaccgccgagacatacggcccggtctccgtgctgcccacccatgcctatttctatggcatggaggatggcgaagagctgtttgcggatatcgagcgcggcaagacgcttgtcatcgtcaatcaggcttcgtccggcattgacgataagggcatggtgacggtgttcttcgagatcaacggccagccgcgccgcatcaaggtgccggatcgcgcccatggcgcttccggctctgcggtgcgccgcaaggcagaacccggcaatgcgtcccatatcggcgcgccgatgcctggtgtcatcagccgcgtcttcatcaaccagggtcaggaggtcaaggccggcgacgtgctgctctcgatcgaggccatgaagatggaaacggcgctgcatgccgaacgcgacggcaagatcgctgaagttctggtgaagcccggtgaccagatcgacgccaaggatttgttgatc

SEQ ID NO: 35138 - DNA, 1758 bp, Agrobacterium tumefaciens
ttgaccttgtttcaggtttacacacgcgctctgcgctatctgaccgttcataaatggcgtgtggccgttgtcgtcatcgccaacgtcattcttgcagcgatcaccatcgccgaacccgtgctgttcggccgtatcattgacgccatttcctccggcaccaatgttacgcccattcttattctgtgggcgggtttcggcgtctttaataccgtcgcttatgtcgcggtcgcccgcgaggcagaccgtctggcccatggtcggcgcgcaacgctgctgacggaagctttcgggcgcatcatttcgatgccgctctcctggcatcatctgcgcggcacgtccaatgcgctgcacacgctgctgcgcgccagcgaaacgctgttcggcctgtggctggaattcatgcgcacgcatctcgccaccttcgtggcgctggtgctgctcatcccgaccgccatggccatggacctccgtcttagcttcgttctgatcggcctcggcattgtctactggttcatcggcaagtgggtgatgggccgcaccaaggacggccaggcctcagtcgaggagcattatcacagcgtttttgcccatgtcagcgattccatcagcaacgtgtcggtgctgcacagctacaaccgcatcgaggctgaaacgaaggcgctgaaatccttcaccgaaaagctgctgagcgcgcaatatccggtgctcgactggtgggccttcgccagtgcgctgaaccggacggcctccaccgtttcgatgatgattatcctcgtcatcggcactgtgctcgtcaagaacggcgaattgcgcgtaggagatgtcatcgccttcatcggtttcgccaatctcctgatcggccgtctggaccagatgcgccaattcgtgacgcagattttcgaagcccgcgccaagctcgaggacttcttcgtgctggaggatgccgtcaaggaacgggaagagcccggcgatgcccgcgagctctcgaatgtctcgggcaccgtggagttccgcaacatcaatttcggtttcgccaacaccaagcagggcgttcacgacgtctcgtttacggccaaggccggcgagaccgttgcgatcgtcggaccgaccggtgccggtaagaccacgctgatcaaccttctgcaacgtgtctacgaccctgattccggccagattctgatcgacggcaccgatatttcgacggtgacgaaaaactcgctacgcaactccatcgcgaccgtgttccaggatgccggcctgctgaaccgctccatccgcgaaaacatccgcctcggccgagaaacggccaccgatgcggaagtggtggaagcagcagcagcggcagcggcaacggatttcatcgacagccgcatcaacggctacctgacgcaggtgggcgagcgcggtaaccgcctttccggcggcgagcgccagcgtatcgccattgcccgtgcgatcctgaagaacgcgcctattctggttctcgacgaggcgaccagtgcactggacgtggaaaccgaggcccgcgtgaaggccgccgtggacgcgctgcgaaagaaccggacgaccttcatcatcgctcaccgcctttccacggtccgcgatgccgatctcgtcctgttcctcgatcagggccggatcatcgagaagggcactttcgatgagctgacccagcgcggcggccgcttcacctcgctgctgcgcaccagcggcctgctgacggaagacgaaggtcagcagccgcgaccgaaggccata

SEQ ID NO: 35139 - DNA, 1407 bp, Agrobacterium tumefaciens
gaattgagcgaacacgatatcggggaattgcggttctcgttgaagaacaggctgggtgaggctctactgttgacctctcaggaagacatgctgcgttattgccgcgactggcacggcgacgtcaccagctcggccgtggccgtcatccgcccccgctcaaccaaggaagtgtccgatacggtgatcgcctgcgccgaactcggcctcgccatcattccccagggcggaaataccgggctggtgctcggcggcattcccgatgcgcccaaacatcaggtggtgctaagccttgagcgtatgaacgcgatccgcaccatagacagcgatgatttttcggccgtagtcgaagccggctgcatcctctcggaattcaaggatgcagttcaggacaagggcatgtttttcccgctgtcgctcggcgcgcagggcagctgccgcattggcggcaacgtctccaccaatgccggcggcatcaatgtcctgcgttatggcatgacccgcgaactggttttgggtcttgaagtggtcctgccggatggcaccatctggaatggcctgtcgaccctgcgcaaagacaatcgcggcatcgacctgaagcagcttttcatcggtgcggaaggaaccctcggcatcatcaccgcggttgccgtcaaactttaccccaatcccgaacatgtcgagacggcgctgctcggcctcaattcgcttgatgacgccatcaagctttaccgccgcgcccgccgcgaatgctgcgacctcatgtccgcattcgaattcatgccgcccgtcgccttcacgctggcgatcgaggctattcccgatctgaagatgccgatcgccggcgattatcccgcctatgtgctgatggagatttccggctcagggctggtggatacggccgaccttatggggcgtttcctcgagggcgtgatggaagatggcctggtgctggacggcgtcatcgcttcctcccgcgcgcaggcgcagtcgctctggctgttccgcgagggcatgaacgaaggccaggcgctgcgcggcagccatatgcgcaccgatatctcggtgccgctctccaaactcgcggctttcgtggccgaggcggaagccgaactggcggaaaaactccccgaatgccttgcggtttcctacggtcacgtcggagacggcaatgtccacctcaacgtgctgccgcccaacggtgcaacactggaggagcgtgaggcctttatctacaagtccaagacactcgtgaacgaagtcctcgaccgttacgtcggcagcatcagtgccgaacacggcattggccgcctgaaacgctccgatttcgaaagccggctatcggatgtgcagcgtcggatgatcacgggtttgaaaaatgccttcgatcccgatttgcgaatgaatccc

SEQ ID NO: 35140 - DNA, 1956 bp, Agrobacterium tumefaciens
gaggagttcatgtctgccaaaatctacccggtgctcaaatcggcgaaagcccgcacgctcatcgacaatgagcgttaccagaaatggtatcaggagagcgtcgaggatccggaaaaattctgggacaagcacggccggcggatcgactggttcaagccctataccaaggtcaagaacacctcattcaaggggcgtgtgccgatcaaatggttcgaagacggcctggaccaacgtctcctataactgtatcgaccggcatttgaagacgcatggcgagcgcacggcgatcatctgggaaggcgacaatccctatatcgacaagaagatcacctataaccagctctatgattatgtctgccgtctggccaatgtgctgaagaagcacggcgttaagaagggtgaccgcgtcaccatctacatgccgatgattcccgaggcggcctatgccatgcttgcctgcgcccgcatcggtgccgtgcattccgtcgtctttggcggcttctcgcccgaagcgctggccggtcgtatcgttgactgcgaatcgaccttcgtcatcacctgcgatgaaggcgttcgcggcggcaagccgatcccgctcaaggaaaataccgacaaggcgatcgatatcgccgccaagcaatatgtcatcgtcaacaaggttctggtcgtgcgccgcaccggcggcaagaccggctgggcgccgggccgcgacatctggtatcatcaggaaattgcgaccgtgaagccggattgcccgccggtgaagatgcgggcggaagatccgctgttcatcctctacacttcaggctccaccggcaagcccaagggtgtgttgcacaccacgggcggctatctcgtctatacgtcgatgacgcatgaatatgtgttcgattacaaggatggtgaagtcttctggtgtacggccgatgttggctgggttaccggccattcctacatcgtctacgggccactcgccaattgtgcgacaacgctgatgttcgagggtgttcccaacttcccggatcaggggcgtttctgggaggtcatcgacaagcacaaggtcaatatcttctataccgcgccgacggcgctccgatcgctgatgggggcgggcgaccagttcgttcagcgctcgtcgcgcgaaagcctgcggcttctcggaacggtgggtgagccgatcaatccggaagcgtgggagtggtattaccatgtggtcggcgaggacaagagcccgatcgtagacacctggtggcagacggaaacgggcggcattctcatctcgccgttgccgggtgcgaccgatctgaagccagggtcggcaacaaggccgttcttcggcgtgcagccgcagcttgtcgatgccgagggcaatgtgctggaagggccggcggacggcaatctctgcatcatcgacagctggccgggccagtcgcggtccgtttatggggatcaccagcgattcgtcgacacctacttctcgacctacaagggcaagtacttcaccggtgacggctgccggcgcgacgaggacggttattactggatcacaggtcgcgtcgatgacgtgctcaacgtctccggccaccgcctaggcacggccgaggtagaatcggcactggtctcgcatcatcaggtttcggaagcggcggtggtcggttatccgcaccccatcaaggggcagggcatttattgttatgtcacgctgatggcggggcagagtggcgattatgcgctgcgcgaggagctggtaaagcatgtgcgcaacgagatcggaccggttgcgacgcccgacaagatccagtttgcgcccggcctgccgaagacccgctcaggcaagatcatgcggcgcattctgcgcaaaatcgccgaggacgatttcggtggcgcttggggatacgtcgacggcttgccgatccggcggtggtggaagatctcatcgccaaccgccagaaccgc

SEQ ID NO: 35141 - DNA, 789 bp, Agrobacterium tumefaciens
ataaccacctggaacatcaactcggtcaggctcagaatgccaatcgttgagcagtttctggtgcgttacaaacccgacattctctgcctgcaggaaacgaaatgcccgaatggcgagtttccgatgaaaccgctaaaagcactcggttacgagcacgtcatcatccatggtcaaaaaggctatcatggtgtggcgatcgcttcgaaaatcccgctgaccgaagaccaccggcaggattattgcggcatcggcgatgccaggcatatttccgcgattttccaggtcggatcgcgccgcgtgcggctgcataatttctacgttccggctggcggcgacgagccggatcggtcgatcaatccgaaattcggccacaagctcgatttcatcgaggaaatgaaggcactgcgcgccgatggcgtgcccgggacctcctccattctcgtcggcgatctcaacattgcaccgcttgaaaatgacgtctggtcgcacaagcagcttctgaagatcgtcagccacacgcctgtcgaaaccgaaggcatgctggatatcatgaagaagggcaactggctcgatctgatgcgcctgaacgtgccggagacggaaaagatctatacgtggtggagctaccgcgccaaggattgggaagccgctaaccgcggccgccgtctcgaccatatctggtcctcacaggacctcggttcctcgcttgaaaaaatcgagatattgcgtgaagcccgcggctggaaccggccatcggaccacgtccccgtcacggctcatttccgcttc

SEQ ID NO: 35142 - DNA, 1179 bp, Agrobacterium tumefaciens
atgaccctgccttcaatcgtgattgccagcgccgcgcgcaccgccgtcggctctttcaacggccacttcgccaacacgcccgcccacgaacttggtgccaccgtcattagtgcggtgctggaacgtgccggcgtcgcggccaatgaagtggatgaggtcattctcggccaggtgctcatggcaggcgaggggcaaaacccggcgcggcaggcagcaatgaaggccggcattccgcaggaggcaaccgccttcggcatcaatcagctctgcggctctggcttgcgcgccgtggcgctgggcatgcagcagatcgtgacgggggatgcggccatcatcattgccggcggccaggaatccatgtccatggcgccgcattgcgcccatctacggggcggcgtgaagatgggcgacttcaagatgatagacacgatgatgaaggacggtctgaccgacgccttttacggatacccgatgggcatcactgccgaaaacatcgctcgccaatggcagctttcccgcgatgagcaggaccagttcgcagtcgcatcgcagaacaaggccgaagccgcgcagaacgccggtcgcttcactgacgagatcgtggctttcacggtaaagggccgcaaggccgatatcgtcatcgatgcggacgaacatatccgtcatggcgcatcgctcgaaaccatggccaagctgcgtcccgccttcgacaaggaaggcacggtcacggccggtaacgcctccggcctgaatgacggcgcagccgccacgcttctcatgtcggaacagcaagcggcaaagcgcggcatcaaaccgctagcgcgcatagcctcctgggcaacggccggcgttgatccgcagatcatgggcaccggtcccatccccgcctcccgcaaggcgctggccaaggccggctggtcgatcaacgatattggccttgtcgaggccaacgaggcctttgccgcccaatcctgcgcggtcgtgcgcgagctgggccttaaccctgacatcgtcaacgttaatggcggagcgattgccatcggccatccgatcggcgcttccggcgctcgcgtcctgaacacgctgattttcgaaatgcgtcgccgcaacgtatcgaggggtctcgcaacgctctgcatcggcggcggcatgggtgtcgccatgtgcatcgaggcgctc

SEQ ID NO: 35143 - DNA, 723 bp, Agrobacterium tumefaciens
atgagccgggttgcgttgatttccggcgggacgagcggcataggtgccgcaatcgcccgcgcccttcaggcagccggctaccgcgtggccgtcaactacgccttcacgacggacagggccgaagcattccagaaagaaaccggcatcccggcgtttcagtgggatgttcgcgattatgacgcctgcgtcgacggcataacgaaggttgaggaaaccttcggaccggtcgaagtgctcgtcaataatgcgggcatcacccgcgacgcgatgtttcacaagatgtcgccgcagcaatggcgagaggtgatcgacaccaacctcaccggcgtcttcaacatgacacaccccgtctggccgggcatgcgcgagcgcggcttcggccgcatcgtcaacatttcctccatcaacggccagaaaggacaggcgggacaggtcaattattccgcctcgaaagcgggtgatatcggcttcaccaaggcgcttgcccaggaaggcgccagccgtaacatcaccgtcaacgccatctgccccggctatatcggcacggagatggtgcgggcgataccggaaaaggttctggcggaacggatcgtgccgcaaattcccgtcggacgcttgggtgaaccggaagaaatcgcgcgttgcgtcctgtttctggtgtcggacgaggcgggtttcatcaccggctccacgatgacagccaatggcgggcaatatttcgcc

SEQ ID NO: 35144 - DNA, 2404 bp, Agrobacterium tumefaciens
cggatcgtcatcaagatcggttcggcgcttctggtggaccggaaaagcggcctgaagaaagactggctggatgccatctgcgaggatatcgcggcgctgaaaaaaaacggcgcggatgtccaggtcgtgtcttctggcgccattgcgcttggccgcaccgtgctcggcctgccttccggtgcactgaagctggaagaaagccaggcggcggcggcagtcggccagattgcgctggcgcgggcatggtcggaaagcctgtcgcggcatgagatcgtcgccggtcaaattctattgacgctatccgataccgaggagcgtcggcgttatctcaacgcgcgtgccaccatcaatcagcttttgaagatcggcgccattccgatcatcaatgaaaacgacacggtggcgaccactgaaatccgttatggggacaatgaccgtctggccgcgcgcgtggccacgatgacgggtgccgatctcctggtgctgttgtcggatattgacgggctctacaccgccccaccgcatctcgatcccgatgcgaaatttcttgagacgattgccgatatcacgcccgaaatcgaagccatggcgggtggggcggcctccgagctttcgcgcggcggtatgcgcaccaagatcgatgcgggcaagatcgcgaccgctgccggttgtggtatgatcatcgcttccggcaagacgctcaatccgctgaaggcaatcgaaaacggcgcacggtcttcatggtttgcaccctccggcacgccggtgacggcccgcaagacctggattgccgggcaattgcagccggccggcgaaatccatgtggatgccggggccgaaaaggcgctttatgctgggaaaagcctgcttcccgccggtgtgcggcaggtgaagggcaatttcggacgcggcgatgccattgccatcatcggcgtcgaaggccgtgaagtggcgcgcggtcttgcgggttacgatgcagaggaagcgcgcctgatcatcggccacaagtccaacgagatcgagacgatcctcggttatgtcggacgggcggcgatgatccatcgcgacgaccttgtgatgactggcgctgccgtcaaagtgaaacatgcaaagaaggatgaggtccatgcctgaacaggccgtgaagcagagccatgatatcgatgcgctgatgatgaccatcggcgctcaggcgaaagctgcttcgcgaccgttgtccatcgccggcacggaccagaagaaccgtgcgctgcttgccatggcatctgccattgaggcttcgaaggaggcgatccttgccgccaaccgcaaagatctggcggctgcggaaagcgccggccttgccgcttcgttcgtcgacaggctgacactcaacgatgcgcgcatcgccggcattgccgaaggcatccgctcggttgccgcgctggccgatccggtgggtgaagtcatcgccgcctgggatcgccccaacgggctgaaaatcgagcgcgtgcgcacgccgctcggcgttatcggcgtgatctacgaaagccgcccgaatgtgacggcggatgcgggcgcgctgtgcctcaaggccggcaacgccgtgatcctgcgcggcggctcggattcgcaacattcatcgcgtgctatccatgcctgtctcgtgcagggcctgaggatcgccggtcttccggagaatgccattcaactcgtgccggtaaccgaccgcgcggctgtcggcgctcttctcagcgggcttaaaggtacggtcgatgtcatcgtgccgcgcggcggcaaaagcctggtggcgcgggtgcagtctgaagcccgtgtgccggtcttcgcgcatctggaaggcatctgccatatctatgtcgacaaatccgctgatctcgacatggcaaaagccatcgtcgtgaatgcgaagatgcgccgcaccggcatttgcggggcggccgaaaccctgctggtggatgcgtctgccgtctccagtcatctcgagccagtcgtcaaagccctgcttgacgcgggttgcgaagtacgtggttcgcagccggttcgtaatgtggttgaggggctggaggccgctacggaagaggactggcgcaccgaatatctcgatgcgatcatttcggtcgccgtggtggatggcatttccggcgcgatcgagcatatcggcacctattcgtccaatcataccgaggcggtgatcgccgaggacccggatgtggtcgcgcggtttttcaacgaactcgattcggccattctgctgcacaatgcctcgacgcaatttgccgatggcggcgaattcggcatgggcgcggaaattggcatcgccaccggcaagatgcatgcgcggggccctgtcggcgtcgagcagctcacctcgtttaaataccgtgtgcatggcaccggccagaca

SEQ ID NO: 35145 - DNA, 1095 bp, Agrobacterium tumefaciens
cgttcgcttttcctgctgcccggtgatggtatcggccctgaagccatgactgaggtccgcaagctgatcgaatatatgaacagcgcgcacaatgccggctttaccgtttctgagggcctcgtcggcggttccgcttacgacgcgcatggcgtcgcgatttccgatgcggacatggaaaaggcgcttgccgccgatgcaatcctgttcggtgccgttggcggcccgaaatgggatggcgtgccgtatgagcatcgcccggaagccggactcctgcgcctgcgcaaggatctcgaacttttcgccaatctgcgcccggccatctgctatccggcgctcgctgccgcctcatcgctaaagccggaactggtcgagggtctcgatatcctcatcgttcgcgaactgaccgccggcgtttatttcggtgaaccgaagcagatcatcgatctgggcaacggccagaagcgcggtatcgacacgcagatctacgacaccttcgagatcgagcgcatcgccagcgtcgctttcgaactggcccgcagccgcgacaaccgcgtttgctcgatggaaaagcgcaacgtgatgaaatcgggcgttttgtggaaccaggtcgtcaccgaaacccacgcggccaaatacaaggacgtgcagctagaacatatgctagccgatgccggcggcatgcagctggtgcgcaagcccaagcagttcgacgtgatcgtcaccgacaacctcttcggcgacatgctgtccgacgtggccgccatgctgactggctcgctcggcatgctgccatcggcctcgctcggcgcacctgatgccaagaccggcaagcgcaaggccatgtatgagccggtgcacggttctgcccctgacatcgctggcaagagcattgccaacccgatcgccatgatcgcgtccttcgccatgtgcctgcgctactcgttcaacatggtggacgaagccaccaagctcgaggcggcgatcgccaatgtattggacaagggcatccgcaccgccgacatcatggccgacggttgccgtcaggtcggcacgtctgacatgggtgacgcggttctcgccgaattcaaggcgctt

SEQ ID NO: 35146 - DNA, 1308 bp, Agrobacterium tumefaciens
cgccgtggtctgtgcccggccttgtccgcccccatgcaaaccggcgacggttttttgtcgcgggttgctttcgaggcggatatttcgccccatgtgatggtgacgctttgcggcctcgccgagcgccacggcaatgggttgatcgacattacggcgcgcggcagcctgcaatttcgcggcctgacgccggaaagcgcctgcgccctcgcaaaagatgttctggcgcttgatctgccactacgcgaagggcttgcggtcgagacttcgccgcttgccggccgggatgatgcggaaatcgcggatggccgttttctcgccgaggagattagaaaaggcgctggcgccctggcgctgcatgacaaactcgcggccaaaacttctgttgtcatcgatggcggcggacgcctcgcaatgggcgatttgctggccgatattcgtctgaaagcaatccggctggaaggtcggactttctggcaactgcttgttggcgggccggaaagcaaggcgttgaaggcggggctggttgagccggttgcggcggccggtgtggttctgtcacttcttgtttttctggctgaaaagggaccgtttgcccgcggccgcgatgtggatcagcaaacggtgacggcgatttgcggtgagcgtctgctgggttggggaagcgggggcgaagcccggaccccttcgttgcccctgggtttgatgatgacgggagagagccgcttcgccgttggtgtcgcgcctgctttcgggcagattcgaagtgccgacttggcgcatctctgcgagcgggctgacacgttcggtatcgatgccctgcggccatcgctaaaccatagcctgctattttttggatcgtcgtcggcctgtgaggctttgcgtgaggctgcggtggcatccggcttcgtcacgacggcaggcgatgcgcggtcctccatcgcggtctgttccggcgcgccgggctgtgcctcggcttttcttcacacgcacgacctggcggcttttgctgccgaagaatgtgccgcgttgctggacggttccttcacgctgcatgtttccggctgcggcaagggctgtgcacatcccgccccttcgctcttcactctcgcgggtacttcggatggcctggcattctcgatttccggccgcgccggtgacccgccagccgggattttgcctttcgagcaacagcagaccgcgctttcgcggcttgcccgtctttacgaaaaagaacataagcccggtgaaaacgccgccatcttttttgcccgtctgggccgggaggaaatcggtgcggcgcttcgacag

SEQ ID NO: 35147 - DNA, 3312 bp, Agrobacterium tumefaciens
atgcatattctcgccaccacatcctcgtctctggacgacctgatcgagccggttgatctcaaccagccgcgttcggatgtggtggtgctgtctttttcggcaagcgatcttgccgggcttgagcgggcgtggggaaaggcgggagagaccctcccctccctctctgccgcgaacctctccgaacttcggcacccgatgtcggtcgatctctggatcgaaaaaacggcggaacatgcccgcgttattcttatccggattctcggaggcgcggagcgctggcgctatggggtcgatcagctggctattctggcgcgcaggcggggcatcaagcttctgcttttgccgggggagtgcagtgaaagggatgaaaagctcgaggcggcctcaactgtcgataagccgatgctggcctccgttctctccttcttccgcgaaggtggaagggagaatatgggccgccttgccgctggcctttctgttctggcgggcggtggagaatggccggatataaaggctgaccccctgccgaaagccggcttctatcggccggatctgggtgtcgttgggcaggacgaggcttgtgccgggttccctgccggtgcgtccgttctgcccatcctcttttaccgctccatgcttctggcggaagatgctgcacccgtcgatgcgctgtttcaggcgctctctgcgcgcgggtttgcacccctgccgattttcgtcagcgggttgaaggatggggaagcgatccgttttcttgaaacggtgctgcccgctctccagcccgccgccatcatcgccgctacggcctttgccagccatacggatgataggggcgagacgttgttcgaccgtctcggcgttccggttttccaggcggtgatggcgaccacccggcgcgtcggctgggtggaaaacgcgcgcggcctcaatccgtccgatcttgccatgcatgtcgtcttgcctgaactggacgggcggattctcaccggggcgatttcgttcaaacaggcgcggacagatggcggtgtcagtcttgtgaatgtgccggaggcggatcgtatcgagcaggtggcgaaccgcatcgcggcctttctgcgactgaaatctgcgccaccgcgggatcgccgcatcgtcattctgatgccggattatcccggtgccgcgccggggcgcaccggttatgccgttggtctcgatgtgccgcaaagcgtgctcgaaatgctgcgcgatctcgccgaggccggttatgcggtggaggatattcctgaaacggcgcgggcgctgctcgatcgtatcgagagccaggaagcgaccgtcgatctttccacctatcgggatttttttgcaggtttgactgagaccgcctccagctcgatgaatgcgacgtggggagctgcggaacaggacgacgcttttgccgatggcgctttccattttcgcgttgcccgcttcggccaggtcttcgtcgcgctcgcgccggatcgggggcggaacgaggatcggcgggtggattatcacgaccctgccctgccgccacgccacgcgctcgtcgccttcggcgcatggatgcaaagtgttgtggcgacgcatgccatcgtgcatgtgggcgcgcatggcacgctggaatggttgccgggcaagacggttgcgctttcccgcgattgtttcccggaaatcgtcaccggcccgctgccggtggtctatccattcatcgtctccaaccccggtgaggcggcggttgccaagcggcgcatcgcggcggttaccatcggccatgtgccaccggtgcttgtcaatgccgggctttcgccggaacagttggcgctggaacagctggtcgatgaatatgcgcaggcggatggccttgatcgtcgccgccgtgaccggctggcgaagctgatcgttgaaaaggcgctggaaaccgggctggcggccgaggcgggcgttggcgcgaaggatgatgccgatgcggccctttcacgcattgatgcctttctctgcgacctcaaggattttgccatcaaggacggtcagcatgttttcggtcgttcccccgaaggcgaggccgatcctctccgtcttcagagcgcgaaggccgagaaagccgcgctgcttgcggcgctcgatggccggcacatcgcccccggtccttccggtgcacctgcgcgagggcgtctcgacgtgctgcccaccggccgcaacctttatgctgccgatccccgtaccatgccgacgccgacagctttcgatctgggccgcatggcgggcgaggaagtgcttcgccatcatctgcagtcccatggtgattggccgaaacatctggtgttcgatctctggggcagtgccagccttcgcaacggcggcgaggatgtggcgcaggcgctgcatctgatgggggcaaggccaatccatgatcctgccacgggccgggtcaccggcatcgaggttctgccaccggcgagcctcggccgcccgcgggtcgatgtgacgtttcgcatttccggccttttccgcgacatgtttccggcgctcatcgcgcttctcgatgcggccgccaaggcggttgcgcggcgggacgaagcgccgggcgacaatccgctggcggaagaggcggcagcgcttgggcatattcctgcgcgcatcttcggttctgcgcccggcacctatggcgccggtatcgaggaaaagctcgccagcggcacctgggacgaacgcgaggagctggggcaggcctatctcgatgcagcgaaccatgcctttggcggcgccgatgggctcgagattttcgaggatgccggctttacggaactggtgcgccgggctgatcttctggttcataccggcgacgatcccggtcgcgatcttctcgacggctcttccgacgtcgcctttatcggcggtttctccgctgcgaaggccgtacttggcggcatcgccgatatcgtcgcgctggatacgaccgatccggcacgtccgcgggccagatcgatgacacaggcgctgacgcgggtggtgcgcgcccgcgccgtcaatccgcgtttcattgccggccagatgcggcacggcccacgcggggcggcggaatttgcagaaacggtggaccggctggtcggctttgccgaaaccacccatgtggtatcctcctcgctgatcgaggcgctttacgatgcctatttcggcaatgaggaagtccgcgatttcatcctgcgggaaaatccgaaggcggcagaggtgatggccgcgcgctttttatccgcccgccgccgtggcttgtggcacagccgccgcaatgcggtggatgcggagctggaa

SEQ ID NO: 35148 - DNA, 990 bp, Agrobacterium tumefaciens
atccgtcacggcggcaatctcggcaaggcgcgcctgatgtttcggcaagcacctgaaccgtggatcgacctttcgaccggtatcaatccgcactcctacccgcattcgcccattcccgccagcgcattcgcccgcctgccggaacccggcgccgccgaggagctgaaacagctggcggcggcccatttcggcgcgccttccgcgcagcatgtcacgctttctcccggcacccagatgttgatgccgctgctggcgcagatcgccatcaatcgtggagcccaaagcggtgccgtgctttcacccgcctatgcggaacatgcccgcaccgcccgcatggcggggctgaccgtcaccgaagtggaaaacatcggcgatctctcagcttacggctatgcggtggtggtcaatcccaacaatcccgatggtcgcatcacggaccgcgaagctttactcgcgctagccggaacgataggccgcaaaggcggtctgctcgtcgtggatgaagccttcatcgaaacgggcggggccgaaagcctggcggttgcaaccaatggcgaagcgctggtggtcctgcgatccttcggaaaattttacggcatggcgggcgtgcgcctgggtttcgcaattgcgcatcccgagatcgctgccgaactggaagcgaggcttggcccctgggcggtttccggtccggcactgcatatcgcgacagaagctctggcggacagggagtggcaatcatccatgcgtctacggctcgcggaggaagcgaggcgcatgaacgagttgctggaaaaggcaggactgaaaatcgccggcggcacttccctgttcacgctggtgcgggacgagcgcagcagggcactgttcgggcatctcggccgtcgcggcattctggtgcgcatctttgacgaaaggcctgatgacatgcgtttcggccttcccggcagcgaagcggattggcagcgcgtcgaagaggcgctgcgatctttc

SEQ ID NO: 35149 - DNA, 999 bp, Agrobacterium tumefaciens
atgctggcgattttctgtgacactcccggtcaattaaccgccaaggatctgccgaaccccgtgcgcggcgaaggtgaagtcctggtacgtattcgccggattggcgtttgcggcacggatctgcacatctttaccggcaaccagccctatctttcctatccgcggatcatgggtcacgaactttccggcacggttgaggaggcacccgctggcagccacctttccgctggcgatgtggtgaccataattccctatatgtcctgcgggaaatgcaatgcctgcctgaagggtaagagcaattgctgccgcaatatcggtgtgcttggcgttcatcgcgatggcggcatggtggaatatctgagcgtgccgcagcaattcgtgctgaaggcggaggggctgagcctcgaccaggcagccatgacggaatttctggcgatcggtgcccatgcggtgcgtcgcggtgccgtcgaaaaagggcaaaaggtcctgatcgtcggtgccggcccgatcggcatggcggttgctgtctttgcggttctcgatggcacggaagtgacgatgatcgacggtcgcaccgaccggctggatttctgcaaggaccacctcggtgtcgctcatacagtcgccctcggcgacggtgacaaagatcgtctgtccgacattaccggtggcaatttcttcgatgcggtgtttgatgcgaccggcaatccgaaagccatggagcgcggtttctccttcgtcggtcacggcggctcctatgttctggtgtccatcgtcgccagcgatatcagcttcaacgacccggaatttcacaagcgtgagacgacgctgctcggcagccgcaacgcgacggctgatgatttcgagcgggtgcttcgcgccttgcgcgaagggaaagtgccggaggcactaatcacccatcgcatgacacttgccgatgttccctcgaagttcgccggcctgaccgatccgaaagccggagtcatcaagggcatggtg

SEQ ID NO: 35150 - DNA, 1014 bp, Agrobacterium tumefaciens
atgagcgaacgcaaggttatgactgttttgaacgggaagacggttacgccgccgccaatatggctgatgcgccaggctgggcgttatcttccggagtatcgggaaacgcgtaagagtgccggaagtttcctggatctctgttataatcccgagctggcgagcgaagtgacccttcagcccattcgccggttcgggctggatgcggccatcctcttttccgatattcttgtcattcccgacgcgcttcatcgcaatgtgtccttcagcgaaggcaagggcccggccatggatccgatcgatattagcggtatcgaaaagcttgatgcatctgatgtcatggcgcatctttcgcccgttttcgaaacggtgtcgcggctgcgcacctcattgccggatgaaacgacgcttctcggtttttgcggtgcgccttggacagttgcgacctatatgatcgccgggcatgggacgccggaccaggcgccggcgcggctgttcggttatcaggaaccggccgcgatggaaaagctgctggctctcctcgctgaggtctcagccgattatctggtggcgcagatcgatgccggcgccgacgcggttcagatcttcgattcctgggctggcgtgctcggcgaaaaggaattcgaggaatatgcgatcaagccggtcgccaggattatcgcgtctgtgcgcgcccgccgaccttcggcaaagatcatcgctttcgccaagggcgctggttatctgctgagggattatcgccgcaagacgggtgctaacgccattggcctcgattggtccgtgccgttgagcttcgcccgggatttgcagaaggaaggcccggtgcagggtaatcttgacccgatgctgatggtggccggtggcaaagccttgcaggatggcatcgatgctgtgctgcagtcgcttgggcagggtccgctgatcttcaatctcggccatggcatcaccccgcaagcagacccggaaaacgtcacccggctggtgcagcgggtgcgc

SEQ ID NO: 35151 - DNA, 798 bp, Agrobacterium tumefaciens
gttgtcggttacccgatcaaacattcccggtcgccgatcatccattcctattggctgaaaaaattcggtatcgccggttcctatacggcagttgaggtctccccagacgatttcccgaagttcattgcaacgctgaaggaaggcaagccgggtgcagcggtgggcggtaacgccaccattccgcacaaggaagcggcttaccggttggccgatcatcccgatgccttggcggaagaactcggcgccgccaacaccatctggatggaggagggtaaactccacgcgaccaacacggatggttacggtttcgtctcgaacctggacgagcggcatccgggctgggataagacccagcgcgcggtggtgttcggcgccggcggtgcaagccgggccgtcattcagtcgctgcgtgatcgggatgttgcggaaattcacgtcgtgaaccgtacggtcgagcgcgctcgcgaactggccgaccgctttggcccacgggtcttttcccatccccaggcagcgcttcaggaggtcatgcacggcgcggggttgttcgtgaatacgacatcgctcggaatgaatggaaccgaagcgccgcatcttgatttttcgcatctcgcggccaatgcggtggtgaccgatatcgtctacgtgccgttgaaaacgccgatcctcaacatggcgcaagagcagggcatcgcaaccgtcgatgggctcggcatgttgcttcatcaggcaaaacctggtttcaggcgatggttcggcaggattccggaggtggatgaaacccttcgttccctgatc

SEQ ID NO: 35152 - DNA, 630 bp, Agrobacterium tumefaciens
gtcgcgggtatgaaaccggatatcaagatttgcggattgaagacaccggaaacgctggagcgcgtcgtccggcgcggtgcgtcccatgtcggttttattttctttgaaaaaagcccccgctatatcgagccggaccttgccggccggttggccgaagccgcccgtggcgccgccaaagtggttgccgtcactgtcgatgctgataatgattatctcgatgaaatcgtcgatcttgtcaggccggatattctgcaattgcatggcagcgaaagcccggagcggctgctgcatatcaaggcgctttacggcctgccggtgatgaaggcgatttccattcgcgatgccgcggatcttgccaaaatagagccttatattggcatagccgaccgtttcctgctggatgccaaggcgcctgccggttctgatctgcctggcggcaacggcgtctcgttcgactggacgatcctgcgctcacttgacgaaagtgtggattacatgctttccggggggctgaataaggacaatgtcgccgaggctctggcggaaacccgggcgagcggattagatttgtcgtctggcgtcgaaagcgcgccgggcgtcaaggatttgtccaagattgatgcttttttc

SEQ ID NO: 35153 - DNA, 1383 bp, Agrobacterium tumefaciens
gactacatcgtcgccgacatcaaccttgccgcattcggccgcaaggaactggacatcgccgaaaccgaaatgccgggcctgatgtcctgccgcaaggagttcggtgaaagcaagccgctgaagggcgcacgtatcaccggctctcttcacatgacgatccagaccggtgttctcatcgaaacgctcaaagaactgggcgcggaaatccgctgggcctcctgcaacatcttttcgacccaggaccatgcggcagcggccattgcagcagccggcattccggtcttcgccgtcaagggtgaaagcctgacagaatattgggaatataccgacaagatcttccagtggaccgatggcggcctctccaacatgatcctcgatgatggcggcgatgccaccatgtatatcctgcttggcgcacgcgccgaagccggtgaggatgtgctttccaatccggggtcggaagaagaggaaatcctcttcgcgcagatcaacaagcgcctcaaggcttcccccggctggttcaccaagcagcgtgatgcgttgaagggcgtgacggaagaaacgacgaccggcgttcatcgtttgtacgatctcgccaagaagggcctgctgcccttcccggccatcaacgtcaacgacagcgttaccaagtcgaagttcgacaacaaatacggctgcaaggaatcgctcgtcgacggcattcgccgtgcaaccgacgtgatgatggccggcaaggttgccgtggtctgcggttacggcgatgtgggcaagggttccgcggcctcgctgcagggtgccggcgcccgcgtgaaggtcacagaaatcgaccctatctgcgcacttcaggccgcgatggacggtttcgaggtggttcgcctggaggacgtggtttcctccgccgatatcttcatcaccaccaccggcaacaaggacgtgatccgcatcgagcatatgcgcgagatgaaggacatggccatcgtcggtaacatcggccacttcgacaatgaaattcaggtcgcctcgctgcgtaacctgaagtggacgaacatcaagccgcaggtcgacatgatcgagttcccgaagggcaaccgcatcatcctgctttccgaaggccgcctgctgaaccttggcaacgctaccggtcacccgtccttcgtcatgtcggcatccttcaccaaccaggtgcttggccagatcgagcttttcaccaagccgggtgaatacaagaacgaagtttacgtgctgccgaagcacctcgatgagaaggtcgcgcgcctccacctcgagaagctcggtgtgcggctaaccgaactttccgaccttcaggcagattatatcggcatctccaagcagggtccgttcaaggctgaacactacagatat

SEQ ID NO: 35154 - DNA, 1608 bp, Agrobacterium tumefaciens
atgaacgagcttggggttcataatcctgccaatggagttgcggaactcggactgggcgaggcctcccgcgtcttttataacctcaatgagagcgaattatacgaacacgcgatccgtaacggcgaagccgaactgaccatcgacggcgcgctgcgcgccgtcaccggccagcatacgggccgctcgccgaaggataaattcgtcgttcgtgatgcttccaccgaaaacaccatctggtgggacaacaacaagccgctgtcgccggaaaatttcgagctgctgcgtcaggacatgctggcccatgccgccggcaagacgctttacgtgcaggatctgatcggcggtgccgatgaggaaaatgcgctgccgacccgcgtcgtcaccgagcttgcctggcattcgctgttcatccgcaatctactgatccggccgaagcgggagacgctttcgggcttcagccagaagctcaccatcatcaacctgccaagcttcaaggctgatccggcccgtcatggcgttcgctcggaaacggtcattgcctgcgatctgacgaatggcctcgtgctcatcggcggcacgtcctatgccggtgaaaacaagaagtcggtcttcacggtgctgaactacctgctgccggccaagggcgtgatgccgatgcattgctcggccaatgtcggtcctgagggtgattccgccgtgttcttcggcctctccggcaccggcaagaccacgctctccgccgacccggcacgcacgctgatcggcgatgacgaacatggctggggcgaacacggcatcttcaacttcgagggcggctgttatgccaaggcgatcaagctttcgtccgaggccgagccggaaatctacgccgcgaccaatcgtttcggcacggttctcgaaaacgtcgtgctggatgaaagccgggttcctgatttcaacgacaactcgctgacggaaaacacccgcagcgcctatccgctgcacttcattccgaatgcatcggaaacgggcattgccggccatccgaagacgatcatcatgctgacggcggatgccttcggcgtgctgccgccgatcgcgcgtctgacgccggaacaggccatgtaccacttcctctccggttacaccgccaaggttgccggcacggaaaagggcgtgaccgagccggaagccacattctccacctgcttcggcgcacccttcatgccgcgtcatccggcggaatacggcaacctgctgcgtgagctgatcggcaagcacggcgtcgattgctggctggtcaataccggctggaccggcggcgcctatggcatcggcaagcgtatgcccatcaaggcgacgcgcgcgcttctgaccgccgcacttaccggcgacctgaagaatgcgcaattccgcaccgatgcgaatttcggtttcgccgtaccgctgtcgctcgacggcgtcgatggtgcgatccttgatccacgttccacctgggccgatggcgcagcttacgacgcgcaggcgaagaagctggtatcgatgttcgtttcgaacttcaccaagttcgaagatcacgtcgacagcaaggttcgcgacgcagccccgggccttctgctcgcggctgaa

SEQ ID NO: 35155 - DNA, 780 bp, Agrobacterium tumefaciens
ctcaaagcccgcattattccctgcctcgacgtgaaagacggacgtgtcgtcaagggtgtgaacttcgtcgacctgatcgatgctggcgacccggtcgaggcagcaaaagcctatgacgcggcgggagcggatgaactctgcttcctcgacatcaccgcgtcctcggacaatcgcgacaccatcttcgatgtcgtctcacgcactgcggaccattgcttcatgccggtgacggtcggtggcggggttcgtagcgtcgcggatattcgtaagctgcttctttgcggtgcggacaaggtctctatcaactccgcagctgtcaaggatcccgacttcgttgcgcaggcggccgacaagttcggcaaccaatgcatcgtcgtttccatcgacgccaagcgggtttccaaagatggcgaagctgaccgctgggaaatttttacccatggcggacgccagccaactggtatcgatgccgtggaattcgccatcaagatggttgaacggggtgccggcgaattgctcgtcacctcgatggatcgcgacggcaccaagagcggttatgatatcggcctgacgcgcagcattgccgatcaggttcgcgtgcccgtcatcgcctcgggcggcgttggtacgcttgatgatctggtggcaggtgttcgcgatggccacgcgacggcagtgcttgccgcttccatcttccacttcggcacctattcgatcggtgaagccaagagctacatggccgaacatggcattgccatgcgtctcgactgattgcaggaa

SEQ ID NO: 35156 - DNA, 588 bp, Agrobacterium tumefaciens
cgtaaaggcgagattatccgcaagaccaacgaaacctcggtttcggtgcgcgtggatatcgacggcaccggcaaatcgaaaatttccaccggcgtgggatttttcgaccatatgctggaccagctcagccgccattcgctgatcgacatggacatcgaagttcagggcgatctgcatatcgatgaccaccacaccgtggaagacaccggcatcgccatcggccaggcaattgccaaggcgctgggcgaccggcgtggcattacccgttacgcctcgctcgatctggccatggacgaaacgatgaccaaggctgccgtcgatatttccggcaggccgttccttgtgtggaacgtcaatttctccgcgccgaagatcggcaccttcgataccgaactggtgcgcgagttctttcaggcactcgcccagaatgccggcattacgctgcatatcctgaaccattacggcgccaacaaccaccatatcgccgaaacgtgcttcaaggccgttgcccgcgttcttcgcacggcaaccgagatcgacccccggcaggcaggccgcgttccctcgaccaagggtatgctggcctga

SEQ ID NO: 35157 - DNA, 2448 bp, Agrobacterium tumefaciens
ttgcccgaacttcccgtcagcgccgtattgggggatattgcccaggtgttggccgcaaagaagcgcgcagttctttcggctccgccgggggcgggcaagaccacgctcgtgccgcttcgtcttttacacgaggactggcggggcgacggcaagatcattcttcttgaaccacgccggctcgctgcccgggctgcggccggacgcatggccgagctgcttcgtgagaatgtcggggaaaccgtcggttatcgcatgcggctcgacaaccgcgtctcctcgaaaaccaggatagaggtggtgaccgaaggtgtgtttgcccggatggttctcgatgaccccgagctatcaggcgtttccacggtaattttcgacgaatttcatgagcgctcgctcgacggcgatttcgggctggcgctggcgctcgacgtacaggcggggttacgggaggatctgcgcattctcgtgatgtccgccacgctcgatgtggagcgtatcggcgcgctgatgggcgacgcgccggtcattcagagccttggccggacgttcccgatcgacattcgatatgaagaacggtggcaaggtatccatgtcgatgaaaaagtcgccaaggcgattaccgaggcccacgcatccgaaaccggttcgattctggccttcctgcccggccaggcggagatcacccgcacagcctcgcggctggagggacgttttcctgatgatacggacattatcccgctttacggcaacctgtcgcaaaaggagcaagatgccgcgatcaagccggcaccgggcggacggcgcaagatcgtgcttgctacgtcaatcgccgagacatccattaccatcgatggcgtgcgggtggttatcgacagcgggctgcagcgattgccggtctttgaaccggcgaccggaatcaccagattggagaccgtgcgggtgtcgcgggcttccgccgaccagagggccggccgcgccgggcgaacggaacccggcattgcgatccggctttggcatcaggggcaaacggcggcgctcaatgcctttacgccaccgcaaattctggcgagcgatctttccggtctcgccctcgatctcgcccactggggcgttcacgacccttccgcgctcgcatttctcgatgcgccgcctgaagctgcactgaaagaatcggtggcgcttctcaaaaacctcggtgccctcgataacagcggcgggctgacgcgacagggccatctgatgcgtggcctttcattgccgccgcggcttgcggccatggtgattgcctcggcggaagaaggtgccgggaaaaaggcggcgatgctcgccgtcatgctgacggaacagggactgggtggcaacgacatcgacctagatgaaaggctgcggcgctttttttccgagagaagtgagagggcacaggcggcgcgcaagcttgcatcaaggctgctcgacgcgatcggcgacaagaccgcgaaggctgaaacgccgagcgaggtcggtgctctgttgctgcacgcctatccggacaggattgcgcttcaacgcggcgcgcgggggcgttacgtgatggccaatgggcggggcgcggagctggccgagaccgaacggctggcggcaagcaaaatgctcgtcgtggccgatattaccggacgggcggcgcagccacgtgttcttgcggcggcggctatcgaaagggctgatatagaagagcggatgccgcatcttatcgtccagcaggaacagttgctgttcgacaaggcgagcggtcaggcgcgggcgcgaaaagtgacacgccttggtgccatcattctcgacgagacacccttgcccagacccgatggcgaacaggcggcgcgggcacttgccaatggcgtcagggaattcggcctcgacattcttccattttcgaaagaaaccctgcagctgcgtgacaggatcggttttctgaatgccagcatcggcgatccgtggcctgacgttagcgatgcggcgctgcttgcacggctggaggaatggttcgttcctttccagaacggcgcccgcagccttcaggacatccggcccggcagcctctccgagggaatcctgtcgctggtgccgcatgaggtggcacgagatctcgggcggctggcaccgacgcatttcgaagcgccgacgggtcagcggcaccccatccgttacgacgccagcgaaccgacgctttccattcgcgtacaggagcttttcggactgaaggcccaccccgccattgcgcaggggcgcctgccgctgctcctggaattgacctccccggcgcacaggccgatacagacgacacgcgatcttcccggtttctggacgggctcgtggaaggatgtgcgggcggatatgcgcgggcggtatccgcgccatccctggccggaggatccggcctcggccctgccgaccagccgtgcgaaaccgcgcggg

SEQ ID NO: 35158 - DNA, 1203 bp, Agrobacterium tumefaciens
atgaccgaagcctatatctgcgattatatccgcacgcccatcggccgcttcggtggcgcgttgtccccggtgcgggccgacgatctcggcgcgctgccgttgaaggcgctgatggagcgcaacgcttccgtcgattgggaggccgtcgaggatgtgatcttcggctgcgccaaccaggcgggcgaggacaaccgcaacgtcgcgcgcatgtcgctgctgctcgccggcctgccggtttccgtgaccgggacgaccatcaaccggctgtgcggctcgggcatggatgcggttatcgcggctgcgcgcgccatcaaatcgggcgaggcggaactgatgattgccggtggtgtggaaagcatgagccgcgcgcccttcgttttgccgaaggccgaaagcgccttttcgcgcaatgccgaaatctacgataccaccatcggctggcgtttcgtcaacccgctgatgaaggcgcaatatggcgtcgattccatgccggagacgggcgacaatgtcgcggtcgattatcaggtctcgcgtgaggatcaggatgcatttgccgtgcgcagccagcaaaaggcggcggatgcgcagaccaacggccgtctcgccagggaaatcgtcccggtgacgatcccgcagcgtaagggcgacccgcttgttgtcgccaaagacgaacatccgcgcgcgaccagtctcgaagcgctggcgaagctgaagccggtcaacaagcgcgatggcgcaacggtgacggcgggtaacgcgtcgggcgtcaatgacggcgcggccgccctcatcatcgcttcagcggaagcggcgagaaaatacggtctgacaccgattgcccgcattctcggcggtgccgccgccggcgtgccgccgcgcgtcatgggcatcggcccagcgccggcctcggccaagcttctggcacggctcggcttgaatcaggaacagctcgacgtgatcgaactgaacgaggccttcgccagccagggccttgccacactgcgccaactcggtattgccgatgacgatgagcgggtgaatgccaatggcggcgcgatcgcgctcggccatccgctcggcatgtcaggtgcccgcattgccggcacggcggcgctcgaactctcgctgagcggcaaacggcttgcgctcgccaccatgtgcatcggtgtcgggcagggtattgccgtggcgctggagcgggtc

SEQ ID NO: 35159 - DNA, 846 bp, Agrobacterium tumefaciens
atgacagaaaaaaccgcctacaaggtcggcctgataggcgccgacatccagctttccaaatcgcccgcgctgcatatgcgtgagggtgcggcccatggcctcgactattcctacgagcttgtggatgtcaccgcccgcaaactgccgcagagtagccttcccgctcttctcgacgagctggaggcgcgcggttttgccgggacgaacatcacccatcctttcaagcaggccgttattccgcatctgcacgaactctccgacgacgcccgcatgttgggcgcggtcaacaccgttgtcttccgggatggacgccgcatcggccacaataccgactggtacggtttttacgaaagcttcgtgcgcggcctgccggatgcaaaacgcgaccgggcacttctggtcggcgcaggtggcgccggcgttgcggtggcccatgccgcgttgaagctcgatattatcaggctggatatcttcgaccgggattttccaagagccgaacgtctcgccgacgagctcaatgcccgttttggtgaaggccgcgccttcgcggtgaaggacccggccgactcgctgccctttgccgatggcctgatccatgccacgccgatgggcatgcccgcgcatcccggcatgccggttgcggccgagctgatcgaacaaaagcactgggtcgccgatatcgtctatatgccgctggtgaccgagcttctggcgactgcggccagcaagggatgccgaaccctgcccggcggcggcatgaccgtgttccaggccgtcggcgcatttcgcctcttttgcggccgcgagccggatgcgaaacgcatgacggcgcatttcacagaactt

SEQ ID NO: 35160 - DNA, 435 bp, Agrobacterium tumefaciens
atcctcaatggtccgaacctcaatttgctcggccagcgccagccggagatttacggctacgagacgctcgccgatgtcgaggccgattgccgtgccatcgctgaagccgccggccacgagctgttttttgcccagagcaaccgggaatatgagctgatcgactggatccacgaagcccgcggcaagtccgcgggcatcgtcatcaatccgggcgcctttacccatacgtcggtggcgatcctcgatgcgctgaacgccttcgaggcgccggtaatcgaagtccatatttccaacatccacaaacgcgaggtcttccggcaccattcctatgtgtcgacccgtgccgaaggcgtgatcgccggtcttggcatcgaaggttatggggtggcgctacgccacctcatcaaccttttttcccgatcctcgtaatatgct

SEQ ID NO: 35161 - DNA, 972 bp, Agrobacterium tumefaciens
aaaaaacttgatcttatcacgatcgggcgctcgtctgtcgacctatacggttcgcaggtcggcggccgtctggaggacatggcctcctttgccaaatatattggcggctctcccaccaatatcgcagcgggtgctgcgcgccttggattgaacagcgccgtcattacccgcgtgggtgatgagcatatgggccgcttcatccgcgagcagctggtgcgcgaaggcgtcgatgtgcgtggcgtgaagacagacccggagcgactgaccgcgctggttctgctcggcattcgtgaccagaaccagttcccgctgatcttctatcgcgagaactgtgccgacatggcgctcagcgaagacgatatcgacccggccttcattgccgacgccggctgcatctgcgccactggaacgcatctgtcgcatccgaacacggaagctgccgtactgaaggcgctgaagctcgcccgtgaaaacggtgcaaagaccgcactcgatattgattaccgtcccaatctctggggtgttgccggccatggcgatggcgaaagccgtttcgtcgaatcgcagaaggtcactgccaagctgcaatccaccctgcatctctttgacctgatcgtcggcacggaagaggaattccacatcgccggcggctccaccgatacgctgaccgcgctcaacgccgtccgcaaggtctcgaatgcgacgctggtgtgcaagcgcggcccgatgggcgcttcggtcttcaccggcgatattcctgatagcctcgacgatggagaaacgggcgaaggtttcccgatcgaggtcttcaatgttctcggtgcgggcgatggtttcatggccgggctgttccgcggctggctgcgcggcgaggactggccgacgacactgaaatatgccaatgcctgcggcgctttcgcggtctcccgccatggctgcacgcctgcctatccgagctgggaagagctgcaa

SEQ ID NO: 35162 - DNA, 1431 bp, Agrobacterium tumefaciens
atgtatctcggtctcgatcttggcacgtcaggcgtcaaagccctgctgatggacggcgatcagaaaatcatcggctcggccaacggctcgcttgatgtttcgcgcccgcaccacggctggtccgagcagaacccggcggactggattgccgcgacgaaaactgccgttgcaggcttgaagcagaagtttgcgaaagagcttgccgccgtgaaaggcatcggcctttccggccagatgcatggcgcgacgcttgtggatgccgaaggcaaggtgctgcgcccctgcatcctgtggaacgacacgcgctcccatgccgaagccgccgcgctcgatgccgatccgcgtttccgcaagatcacaggcaatatcgtcttccccggctttaccgcgccgaagcttgcctgggtggcgaagaacgaaccagacatcttcgcgaaagtcgccaaggtattgctgccgaaggattatctgcggctatggctgacgggcgaatacatctcggaaatgtcggattccgcaggcacctcctggctcgataccggcgcgcgcaaatggtccccggagctgcttgccgccaccgggcttgatgaaaaacacatgccgtcgcttgtggaaggcacggatgaggcgggcgttcttcgcactgagctggcttccgaatggggcatttccggccgtgccgtcgtcgccggtggtgccggcgacaatgcggcgtcggcctgcggcatgggcacggtgaaggaaggccatgccttcgtgtcgctcggcacatcaggcgtcctcttcgccgccaatgcctcctatctgccgaagccggaaagcgccgtgcatgccttctgccatgcgctgcccaacacctggcaccagatgggcgttatcctctccgccacggatgcgctgaactggtattcgcgcctcaccgggcaatccgctgccgatctgaccggcgaactcggcgagacgcttctcgcaccgaccggcgtcactttcgcgccttatctttccggcgaacgcacgccgcataatgatgctgccatccgtgggtccttcatcggcctgtcgcatgaaagcgaccgcaaggcgctgacccaggccgtgctggaaggcgtgactttcgcgatccgggataatctcgaagcgctgaaatccgccggcacgtccatctcccgcgtcaccgccatcggcggcggctcgcgttcggcctattggctggcatcgatcgccacctcgctaggcgttcccgtcgatattccggctgagggcgatttcggtgcggcctttggtgcggcccgtctcggcctgattgccgcgaccggggccgatccggtggccgtctgctcgcagccggagacggcgcggacgattgagccggtggcagcgcttggcgatgcttatgaagaggcttaccggcggtatcatgcgctttatccg

SEQ ID NO: 35163 - DNA, 1425 bp, Agrobacterium tumefaciens
tccggcgttcgcgtccgcatcgcaccttcccccaccggcgagccgcatgtcggcaccgcttacatcgcgctgttcaactatctcttcgccaagaaacacggcggcgagttcatcctgcgcatcgaggataccgacgccacccgctcgacgctggaatatgagcagaaggttctggaggcgctgcgctggaccggcctcacctggtcggaaggccctgacgtcggtggcccctacggtccctaccgccagtccgagcgcaagccgatgtactggccctacgccgaagaattgctggaaaaaggccatgccttccgctgtttctgcacgcccgagcggcttgagcagatgcgcgaagcgcagcgcgccgctggcaagccgccaaaatatgacggtctctgcctccacctgaaggctgaagaagtgaccacccgcgtcgccgccggcgaagccaacgtcgtgcgcatgaaaatcccgaccgaaggttcgtgcgatttccatgacggcgtttacggcgatgtctcgatcccctgggattcggttgacatgcaggtgctgatcaaggccgacggcatgccaacctatcacatggcaaacgtcatcgacgaccatctgatgaagatcacccatgtggcgcgcggcgaagagtggctggcttcagtgcccaagcacatcctgctttaccgttatttcggctgggaccagccgacgttcatgcatctttcgctgatgcgcaacgccgacaagtcgaagctttccaagcgcaagaacccgacgtcgatctcctattattccgcgctcggctacctgccggaagcgctgatgaacttcctcggcctgttcttcatccagatcgccgaaggcgaagagctgctgaccatggaagagctggccgcgaagttcgatccggaagcgctttcaaaggctggcgccatcttcgatatccagaagctggactggctgaacggccgctggctgcgcgaaaagctcacgcctgaggacttcattgcccgcacgctggaatgggcgatggaaaattcccgcctgaccgaaggcctgaagcttgcccagagccgcatttccaagctcggcgaattgccgaacctcgccggcttcctggtgtcgagcgatgttggcctgacaccggcttcgtttgccgggttgaagagcaaaccggaggaaatccacgaaatcctcaccacggttgccgccgacctcgaaaaaatgccggattggaacgttgaagccatcgaggccgaactgcgcgacattgccgaacgcacgggcaagaaactgcgcgtcgtcaccccgccgctcttcgtcgccgtctccggttcctcgcgctcgctgccgctgtttgacagcatggcgctgctcggccgctccgtggtgcgccagcgcctgaaagtggcgattgccgttgtggcc

SEQ ID NO: 35164 - DNA, 948 bp, Agrobacterium tumefaciens
atgacgtccaaactcgaacaacttcgcgccatcaccacggtcgttgccgataccggcgacatcgaggcggtagcacgcctgaagccggtggattgcaccaccaacccgaccatcgttctcaaagcgctcggcacgccggcctttgccgatgcggtgaaggaagctgtcgcctggggcaggaagcagggcggccagtccgacgccgtcgttgccgccgttgccgaccgtctggcgatttccgtcggtgcagctcttgccggtctcgttcccggccgtgtgtcgaccgaggtcgatgccgacctgtccttcgacacgcaggcttccatcaccaaggcacgccacatcatcgcctcctataaggagcgcggcatcgagcgtgaacgcatcctcatcaagctggcctccacatgggaaggcatcaaggctgccgaagttctgcagtccgaaggcatcgactgcaacctgacgctgctgttctcgcaggcacaggcgattgcctgcgccgaagccaaggctttccttatctcgcccttcgtcggccgtatcctcgactggtacaagaaatcgaccggcgagacctacactgccgagacagatccgggcgtcgtttcggtgcgcagcatctacaattattacaaggcgaatggcatcggcaccgttgtcatgggcgcctccttccgcaatgttggcgaaatcgaagcgctggccggttgcgaccgcctgacgatcagcccggcgctgctcgaagagctggacaaggacaatggcaagctcgagcgcaagctttcgcctgacaatgtcaaggccgaggcgctgcagtcgctcgatgaaaaggcgttccgctgggcgatgaacgaagacgcgatggcaaccgagaagctttccgaaggcatccgcctgttcgccaaggatctggttacgctgcgcgagatggtccgcaaggagctg

SEQ ID NO: 35165 - DNA, 1569 bp, Agrobacterium tumefaciens
cgtcaaaatctcgtcgctgtcgatgtcggtacggcgagcgcccgggccgggattttcgatccagccggccggctgctcgcgcgctccattcatcccatcctcatgcagcggccgcgtgaaaaccacgccgagcacgattccaccgatatatggaatgccgtctgcattgccgtgaaggcggcgcttgccgatgccggcgtgctgccgcaaagcattgccgccattggttttgacgccacctgctcgctggtcatccgcgatgagcggggggagccggtttcggtttccacgaccgatgacgaccgtttcgacaccatcgtctggcttgaccaccgcgccatcggcgaggccgaccggctgacggcctcgggccatcgggtgctcgatttcgccggcaacagcgtctcgccggaaatgcagatgccgaagctgatgtggctgaagacgcatatgccgcaaagctggtcgcgcatgtccttcgccttcgatctcgcggatttcctgacctggaaggcgaccggctcggcacagcgctccaattgcacgcagacggcgaaatggaacttcctggcgcaggaacatcccggctggcaggcggattatctggcctttgccggactggacgacctgaaggagcgggcaggcctgcctgaaactaccgtcatgccgggcggcgccatcggcccgctttcgcccgaggccgccgcagaacttggtctcgataccggctgccaggtggcggcgggcatgatcgatgcctatgccggtgcgctcggggctctgggtggatgccttgccgaggatgtcggtaaacatgtcgcgctgatcgccggcacgtcgagttgccttgtcgccatgtccacgcagccgatgcccggccgcagcctgtggggaccctactggcaggcggtgctgcctggccactggctggtggagggtgggcaatcggctaccggcgcgctgctcgaccatatcgtgcgcatgcatgcggcgggtggcgagccggatacggcgttgcatgcccgcatcgttgcgcgcgtcactgaattgcgcgaactggagggggaggcctttgcggaccggctgcatgttctgcctgacttccacggcaaccgttcgccgcttgccgatccgcatgcggtcggcgtcgtcagcgggctgacgctcgatacctccttcgacagtctctgccgtctttattggcgcaccgcgatcgcgatcgcgctcggcgcgcgccacgtgctcgatgccatggagcgtttcggttatgcggtggaaacgctgcatgttaccggcgggcatgtgaagaacccgctgttgatggagctttacgccgatgtgacgggcaagcgcatcgtggttcccgcgaccgccgatgcggtgctgctcggcacggcgatgacggcggcgacggccgggggcgtgcatgcgagcctggcggcggcaggggccgccatgtatccgggcaatgcggaaatctcgggcaatccggcgctggcggcgcattacgagcgggattatcgccgtttcctcgccatgtaccggcatcgccaggaactggaaagtctt

SEQ ID NO: 35166 - DNA, 1596 bp, Agrobacterium tumefaciens
agtgtgacgtcgctgtccatcatgcggctgctcgataggaaaacgagccgcattgagggcaaggtcatgctcggcgggcgcgacttgctggcgctgccggaagaggagatgcgcaaggttcgcggcaaggacatttcgatgatcttccaggagccaatgaccagcctcaacccgatcttcccgatcggcaagcagatcgccgaagcgctcaccgtgcatcaggatatctcgtcatccgccgcaaaggccgaggtcatccgtcttctggaaaaagtccgcattcccaatgcggcgagccgtttcggtgattatccgcaccagttttcgggcggcatgcgccagcgcgtgatgatcgccatggcgcttgcctccaagccgaagcttttgatcgccgacgagccgacgacggcgctcgacgtcaccattcagggccagattctcgacctcatcaagcaattgcaggaagaggagggcatgtcggtcctgttcatcacccatgatatgggtgtggtggcggaagtggcggaccgtaccatcgtcatgttccgtggcgatgtggtagaaaccggcacgacggatgacatcttccatcgcggccagcatccctatacgcgcgccctgctttcggcggtgccgaagttgggctcgatgaggtcgcggttgctgcccgcccgtttcccgattatcgacatcaagaccggcgagagcccgccggtggtggagacgaaggacacggtgtcaggcggcaagacgcccattctctcggtcaaggacctgacgacgcgtttcgatatccgttccggccttttcggccgcaaatccggcgccgtgcatgcggtggagaaggtttcctttgatctcgcagaaggtgaaaccctgtcgctggtcggcgaatccggttgcggcaagtccaccacgggccgatcgatcacccggctgatcgagccgacatcgggtaatgtcacgcttgatggttacgaggtgctgaaactcgaccgaacgacgctgcggaccatgcgccgcagcgtgcagatggtctttcaggatcccttcgcttcgcttgatccgcgcatgagcgtcggcaccgcgatcatggaacccttcatggagcaccgcctcggacagaaagcgcaggcgcgcgaaaaggcggcggatttgctggaaaaagtcggcttgagccccgacatgatgaagcgtttcccgcatgagttttccggcggccagcgccagcgcatcgccattgcccgctcgctgatgctcgatcccaaggtcatcgtcgccgacgaggcggtttcggcgctcgatgtctcgatcaaggcgcaggtctgcaacctgctgctcgacctgcaacagagcctcaatctggccttcctgttcatttcccatgacatggcggtcgtggaacgcgtcagccatcgcgttgcggtgatgtatctcggcgagatcgtcgaaatcggcccgcgcgcagccgtcttcgacaatccgcagcatccgtacacgaaaaaactgatgtcggccgttccggtgccggatccggcccgacgccagatccgccgcaacatggcgacggacgagatcaagagcccgatccgtcct

SEQ ID NO: 35167 - DNA, 1200 bp, Agrobacterium tumefaciens
aggcatacagtgagcgaacgcgcagcatttcattggcaggacccttttctgctcgaagaccaactgaccgacgacgagcgaatgatccgcgacagcgccgaggccttcggcaaatccgaactgctgccgcgcatctcggaagcctatctttccgaaaccaccgaaccggaactcttccgtctgatgggacgcaccggcctgctcggcgtcaccctgccggaagaatacggcgcagccaatgccagctatgtggcttacggcctcgtcgcccgcgaggtggagcggatcgacagtggttaccgctcgatgatgagcgtgcagtcctcgctcgtcattcacccgatcttcgcttacggctcggacgaacagaagaagaaatacctgccgggcctcgtttccggtgaactgatcggctgtttcggcctcaccgagccggatgccggctccgatcccggcggcatgaagacccgcgccgaaaagatcgagggcggttatcgcctgcgcggttcgaaaatgtggatttccaacgcgccgatcgccgatgttttcgtcgtctgggcgaaatcggaagcgcatgacaatgagatccgtggtttcgtgctggaaaagggcatgaaaggtctttccgcccccaagatcggcggcaagctttcgctgcgcgcctccattacaggcgaaatcgtcatggatggcgtggaagtgggcgaagatgcattgcttccgaatgtttccggactgaaaggcccgttcggctgccttaaccgcgcccgttacggcatttcctggggcgtgatgggggctgcggaagattgctggttccgttcccgccaatatggcctcgatcgcaaacagttcggcaagccgctcgccggcacgcagctttaccagaagaagctcgccgacatgcagaccgaaatcgcgctcggccttcaggcatcgctgcgcgtcggccggctgatggacgaacataagatggcgccggaaatgatctccatcgtcaaacgcaacaattgcggcaaggcgctggatatcgcccgccaggcccgcgacatgcatggcggcaatggcattcagatcgaatatcacgtcatgcgccatgcccagaatcttgaaacggtgaatacctatgagggcacgcatgacgtgcacgcgctgatcctcggccgggcgcagacgggcattcaggcgtttttctgaggt

SEQ ID NO: 35168 - DNA, 2502 bp, Agrobacterium tumefaciens
atgagcagcgaactgacgcggcgtaatctattgaaggcgcatgctgccggcattgcggcggcaacggcgggcattgcgctgccggccgccgcccagccggtgccgggcggtgtttccgcattgcagatcaaatggtccaaggcgccctgtcgtttctgcggcacgggttgcggcgtcatggtcggcgtcaaggaaggcaaggtcgttgccacccatggcgacatgcaggcggaggtcaatcgtggcctcaactgcatcaagggctatttcctctccaagatcatgtatggcaaggaccgcctcgagaccccgcttctgcgcaagaaaaacggcgtctacgccaaggatggcgagttcgagcctgtcagctgggacgaggccttcgacgtgatggcgcagcaatgcaagcgcgtgctgaaggaaaagggaccgacggccgtcggcatgttcggttccggccaatggacgatcttcgaaggttatgccgcgaccaagctgatgcgcgccggcttccgctccaacaatctcgaccccaatgcccgccactgcatggcgtcggccgcttatgccttcatgcgcaccttcggcatggatgagccaatgggctgctacgacgatttcgaacatgccgatgccttcgtgctctggggctcgaacatggcggagatgcaccccattttgtggacccgcatcgccgaccggcgtctgggtttcgaccatgtgagggtggcggtgctttcgaccttcacccatcgcagcatggatcttgccgatatccccatggtcttcaagccgggcacggatctcgtcatcctcaattacatcgccaaccacatcatcaagaccggccgcgtcaacgaagacttcgtgaggaaccacacgaaattcgtgcgcggcgtcaccgatatcggttatggcctgcggccagacgatccggttgaggtgaatgccgccaattctgccgatccgaccaagacggaagcgatcgatttcgagaccttcaaggaatttgtctccgaatacacgctggaaaaaaccgccgccatgaccggggtggaagccggcttcctggaggaactggccgagctttatgccgacccgaaacgcaaggtcatgtcgctctggaccatgggtttcaaccagcatgtccgcggcgtctgggccaaccagatggtctacaacatccatcttttgaccggaaagatttccgagcccggcaacagtccgttctcgctcaccggccagccctcagcctgcggcacggcgcgtgaagtgggaaccttcgcccaccgcctgccggccgacatgacggtgaccaacccggaacaccgcaaacatgccgaggaaatctggcgcattccgcatggcatcatcccggaaaagccgggttaccacgccgtgcagcaggaccgcatgctgcatgacggcaagctgaatttctactgggtgcaggtcaacaacaacgtccaggccggccccaacaccaagaacgagacctatctgggttatcgcaacccggaaaacttcatcgtggtttcggatgcctatccgaccatcaccgccatgagcgccgatctcatcctgcccgccgccatgtgggtggagaaggagggggcctatggcaatgccgagcggcgcacccatgtctggcaccagctggtggaggcctcgggcgaggcgcgttccgacctctggcagctggtggagttttccaagcgtttcaccaccgacgaggtatggccggccgaaatactcgacgccaatcccgcctatcgcggcaagacgctttacgaggtgctctacaaggacagcgatgtcggcaagttcccgctgagcgaaatcaacgccgactacaagaaccaggaatccagtgatttcggcttctatctgcagaagggcctgtttgaggaatatgctgctttcgggcgcggccacggccacgatctggcgccttacgatgcctatcacgaggtgcgcggcatgcgctggcctgtcgtcgatggcaaggaaacgctgtggcgttaccgcgagggttacgacccctatgtcaaacccggcgagggtgtgaagttctacggcaacaaggacggcagggcggtcatcatcgccgtgccttacgagccgccggcggaatctcccgaccaggaattcgatacgtggctggtgacgggccgggtgctggagcactggcattccggttccatgaccatgcgcgtaccggaactctacaaggcgtttcccggcgcccgctgtttcatgaatgccgatgatgcgcgcaagcgcgggctcaatcagggcgcggaaatccgcatcgtctcgcggcgcggggaaatccgctcgcgggtggaaacgcgtggccgcaaccgcatgccgcccggcgtcatcttcgttccctggttcgatgccagccagctgatcaacaaggtgacgcttgacgcaaccgatcccatctccaagcagacggatttcaagaaatgcgcagtcaagatagagccagtcgca

SEQ ID NO: 35169 - DNA, 771 bp, Agrobacterium tumefaciens
atgacagatcattccctcaagggcaaaaccgtcatcatcgccggcggagcaaaaaatctcggcgggttgattgcccgcgattttgctgcccagggtgcgggcgccatcgcgatccattacaacagcgcggcaagcagggccgatgccgatgcaaccgttgccgccgtaaaggccgcaggcgctgaggcaatcgcccttcaggccgatctcaccacggcaggcgccgtcgaaaagctatttgccgatgccgtcgccgccattggccgcccggatatcgctatcaataccgtcggcaaggtgttgaaaaagccgatcctcgaaacatcggaagccgaatatgacgaaatgaccgccgtcaacgccaagtcggccttctttttcctgcaacaggccggccgccacgtcagtgacaatggcaagatctgcacgctcgtgacgtctctcctgggcgctttcacaccgttttacgccagctatgccggcaccaaggccccggtggagcattttacccgcgctgcggccaaggaattcggcgaacgcggcatctccgtgacggcgattggtcccggaccgatggatacgccgttcttctacggtcaggaaacgccggaggcgcagggctatcacaagaccgcggctgcactttccgccttctcgaaaaccggtcttaccgatatcgaggacattgttccctatattcgctttctcgtaacggacggctggtggatgaccggccagaccattctcgtcaatggcggttacaccacgaaa

SEQ ID NO: 35170 - DNA, 2568 bp, Agrobacterium tumefaciens
atgtcgcatatcgatctcaatcgcctcgttggagcgcttgagccagacctgcgcgttaccctcgaagctgcggcttccgttgcggtgcgtatggggcacaggtacgtggatataccgcattggctgctggcggttgtagatgccggtatctatgcggaaacattcgacgaattaaaaattccacttccggtattgaaggctgaaatcggccgcagtctggaagaggccattatcggcgacggggaggccttgtcgctctcccagaacatcctcacggcagcccgggaggcatggattcttgcgtcgctggaggctggccgtgaccgcgtgacgctttgcgatctcctgttggcgatggatgaggaaacctcacttcgctcctttgtccgctcggcatttccgtctctcaaggcgatggatcgcggtgcgcttgagcgtcttcgcagctcggccgagaacggcgcaggcgtggatgttccttccgcgctgacaagttcaggagaggcaggctcggcacaggccgccggccagaatgatttcttgcgcctttacacccacgacatgaccaccgatgcccgcaacggcaaggtcgatcctgttatcggccgcgatgatgagttgcgccagctcgttgatattctgacccgccgccgacagaacaatcctattctggtgggcgaggccggcgtgggcaagaccgcggtcgccgaagcgctggcgttggaaatcgcctccggcaacgttccggagaaactgcgcaatgtctgcctgctgaacctcgatatttcgctgctgcaggccggtgccggcgtgaaaggtgagttcgagcggcgcctgcacggcgtgatcgatgcggtcaagcgttcggccgaaccggtcatcctgttcatcgatgaggcccatggccttgttggcgcgggtggtgcggcgggccagggtgatgcggcgaatattcttaagcccgcactcgcacgaggcgaggtgcggaccgtcgcggcaacgacgtggagtgaatacaagaaatatttcgagaaggatgcggcgctgacgcgtcgtttccagccagtgcatgtgcgcgagccggacgaggcgactgcgatacggatgttgcgcggtgtggcggatactttcgtcagccatcacaacgttaccgttcgtgatgaggcgatcgtggctgccgtgcaattatccgcgcgctacatgcccgctcggcaattgccggacaaggcggtcagcctgctcgataccgccgccgcggccgtttcgctggcgcggcagacgttgccagagcggttacgtgccatggaaagcgagcgacaccttctgtctgacgaactgaactggcttctgcgtgaaccgcaggatgaggacatgcaaaaccgcatccagtcgatacgcgacgagcttgaacggcttgaggccgggatcgatgatctgcgcggccgttatgacgcggaaatggctgaactggcggcgctcagtgaagagcagccggccgaaaccggcgcgtcgaatgtttcgcacctgcggcctgccacggagatgcggcccgcaaatgccgaaagacttgttccgacagtggttgatcgtgaagcgatcgccgccgtcgtctcgcgatggaccgggattccgctcggcaaacttctggcggaccagatcgaaagcgcccgcactctggatgtgcgcatgcggcagcgcgtggttgggcaggatgccgcaattacccggattgccgatgccatgcgcaccgcccgtgccggattgtccgatccgcgccgtccgccggcggtgtttttccttgtcggcatgtccggaacgggcaagaccgaaacggcgctgtcgctggccgatcttctctatggcggcaacagccatctgacgacgatcaacatgtcggagttcaaggaggagcacaaggtttccctgcttctcggctcaccgcctggctatgtcggtttcggcgaaggtggggtgctgacggaagcggtgcgccgccggccgttcggcgttctgcttctcgatgaaatcgacaaggctcaccccggcgtccaggatattttttatcaggtgttcgacaagggcgtgcttcgcgatggcgaaggccgcgacgtcgatttcaagaacaccacgatcttcatgacggccaataccggttcggaattgctgtcggcgctttccgccgatcccgacactatgccggaaggtgaggcgctggaagcgcttctgatgccggagcttaccaaacagttcaagcccgcattcctcgggcgcacgatcatcctgcccttcatgccgcttggcgcggaggagcttgcaagtgtcgtggacatgcagattggcaagatcagggaccgtgtgctcgcaacatatggcaccgacctgagattgtccgatgcggcgcgcgatgccttggtggcgcgcgccggtgcaagtgaaatcggcgcacgcgccatcgaaatcatgatcggcaaggatctcctgccgcctctttccagctttttcctcgagaaggtcatcgcgggagaacgcgtcgggaagatcgttgtcgattttggtgaaaacgggttc

SEQ ID NO: 35171 - DNA, 714 bp, Agrobacterium tumefaciens
ttttccggaaaatccgtcatcatcaccggcgcgggcaaaggcatcggccgcgcctgcgcgcaactgatggccgcgcgcggtgcggaagtggtggcgatcagccgcacccagtccgatctcgacagcctgaaaagcgaaatcggtggacgttcgatccgtgtcgacctcgcagacatcgccgccacccgtgccgccatggcggaagctggcccgtgcgattttctcatcaacagcgccggcatcaacgtgctggaaagcgtgctagacatgagcgacgccggatatgaggcggtgctcggcatcaacctgcgtgctgcgctcgtcacctgccaggaatttgcccgcggccgcgtcgcaaatggcggcggcggtgccatcgtcaacatcacctcgattgccggccatcgcggttttcaggatcatttgtgctatgcggcatcgaaggccgggctcgaaggtgcaacccgcgttcttgccaaggagcttgggccccatggtatccgcgtcaacgccgtcgcgcccaccatcacgctgacggaactcgccgccgaagcctggaacgatcccgaaaagagccagccgatgatggttcgccatccgctcaaccgctttgcggaagcggaagaggtggcgcagagcatcgcgctgctgctatctgacgacagcaagatgatttccggcgccgtattgcctgttgatggcggtttcctcgcc

SEQ ID NO: 35172 - DNA, 1590 bp, Agrobacterium tumefaciens
tcctatcttgttggcgtcgatgtcgggaccggctcggcgcgggccggtgtctttgatgtcgcgggcaagcttctcgccaccgccaagcgcccgatcagcatgcaccgggaggatggcggcattgccgagcaatcgagcgcagaggtgtggcaggcggtttgtgatagcgttcgcgacagcgtttcacgcgccggtatcgatccggcggaggttaccggcattggcttcgacgcgacctgttctcttgtggttcgcggacccggtgacgtgaccctgccggtaggtgctgccgatcatcccgaacgtgatatcatcgtctggatggaccaccgtgctgtcgagcaggctgaacgcatcaacgccggcaagcatgccgtcctgaaatatgttggcggccgcatttcaccggaaatgcagacgcccaagctgttgtggctcagcgaaaacaggccggatatctatgcccgtgccgaacacttcttcgacctgacggattttctgacctggaaggcctccggggcgcttgatcgctccgcctgcacggtcacctgcaaatggacctatctcgcccacgaaaaccgctgggatgcggaatatttcaccaagatcggccttggcgatctggcggagcagggctttcgccgcatcggtgaaagcgtggtccatcccggcacggcactgggtaatggcctgaccgaagaggccgccaaggccatgggtctggtcgcaggaaccgccgtcgccgctggcctgatcgacgcccatgccggcggtgtcggtacggtggctgcgggtggtgatgcatcacgatgcctcggttatgttttcggcacctcgtcctgcaccatgacgaccaccactgagcccgcctttgtgccgggtgtctggggtccctattattccgcaatggttcctggcgcatggctcaatgaaggcggccagtccgccgccggtgcggccatcgattaccttgtgcagttgcacccggcctttgccgaggcaaaagcgcttgccgacaaggacggcaaagcattgccagtctggcttgccgaccgcgcgctcagcctcgccgcatccgcttccgccgcagtgaagcttgccgaagattttcatatggtgccggaattccttggcaatcgcgcgcccttcgccgatccccatgctcgcgccatcattgccggttatggcatggagacgggcgtggattccctcgtcgcgctctatgtggcggggcttctcggcctcggttacgggcttcgccagatcatcgaaacacaggcccgcaacggcgcgccggtggaaaccatcagcgtcagtggcggagcaggcgctcatccgcttgccaggcagttgctggcagatgcgaccggcctcccggttgaactgaccgaatgcgaggagccggtgctgcttggatctgccatgctcggcgccgttgccgctggaacctatccggacctgatggctgccatgccggcgatgtcgcgtatcgacagcagtgcaatgcccgatcccgattttcagaagattcaccaggcgcgttacgacgcgtttctggcgctgcagaatgcggcgcgtgccattcgctcc

SEQ ID NO: 35173 - DNA, 723 bp, Agrobacterium tumefaciens
atgtctgaatcgctgcaaggcaagatcgcggtcatcaccggcgccgcatccggcatcgggcttgcaaccacagaagcgctcttggaacagggcgcaaccgtggtcatggtcgactggaacgagaaagccttgaatgatctggccgccaagctcggcgagcgcgccattccgcaggtgaccaacctgctcgatgccgacagctgcaacgcgatgatcccggaaatcctggggaaggtcgatcatatcgacattctctattgtaatgccggcacctatatcggtggtgatctcaccgaaacgacgcctgaagccatcgacaagatgctgaacctcaacgtcaacgccgtgatgaagaacgtgcaggccgtcgtgccgcacatgtcggagcgcaagaccggtgacatcatcgtcacctgctcgatcgccggccactttccgacctattgggagccggtctattcgggctcgaaatgggcgatcaccagcttcgtgcagggcatgcgccgccagatgatcccgcacggcgtgcgcgtcgcgcaggtctctcccggcccggtcgtctcggcacttctggccgactggccggaggaaaatctccgcaaggccaaggaatcgggcagcctcatcgatgcgagcgaagtggctgatgccgtcgtttatatgctgacgcgcaagcgcaccgtcaccatccgcgacatgctggtcttgccgaccaacttcgac

SEQ ID NO: 35174 - DNA, 1008 bp, Agrobacterium tumefaciens
atgaaggcactggtgctggaagaaaaaggcaaactctcgctcagggattttgacattcccggaggcgccgggtccggtgaactcggaccgaaggatgtgcgcattcgcacccatacggtcggcatctgcggctcggacgttcattattatacccatggcaagatcggccacttcgtcgtcaacgcacccatggtgctcggccatgaagcctccggtacggtgatcgaaaccggttccgacgtcacccatctgaagatcggtgaccgcgtctgcatggagcctggtatccccgatcccacatcgcgggcctcgaaactcggcatctataatgtcgatcccgctgtccgcttctgggcaacaccgccgatccatggctgcctgacgcctgaggtcatccaccccgcggccttcacctacaagctgccggataacgtctcctttgccgaaggggcgatggtcgaacccttcgccatcggcatgcaggcggcactgcgggcgcgcatccagcccggcgatatcgccgtcgtcaccggtgccggtcctatcggcatgatggtggcgcttgccgcattggcgggcggttgcgccaaggtcatcgttgccgatctcgctcagccgaagcttgatatcatcgccgcttatgacggcatcgagaccatcaatatccgcgagcgcaaccttgccgaagcggtttcggccgccacggatggctggggttgcgatatcgtcttcgaatgctcaggtgcggcacccgccatactcggcatggcgaaactggcgcgaccgggcggtgccatcgtgctcgttggcatgccggttgacccggttccggtcgatatcgtcggccttcaggccaaagagctgcgggtggaaacggtattccgttacgccaacgtctatgaccgcgcggtggccctcatcgcctccggcaaggttgatctcaagccattgatttcggccaccattcccttcgaagacagtatcgccggtttcgaccgtgcggtggaa

SEQ ID NO: 35175 - DNA, 816 bp, Agrobacterium tumefaciens
gagataaccggctccttcgccatgccggccggagagaacccgacggtcgccatgatcgaggctgcctatcagcatcacggcctgaactggcgttatatcaatctggaggtcagccccgaaaacctgaaggatgccgtggcgggtgcacgtgcgatgggctgggccgggttcaactgctccattccccacaaggtcgcggtcatccagcatctcgacggcctgggggaatccgccgagatcatcggcgccgtcaacaccatcgtccggcggggcgacaggctgatcggcgaaaacaccgatggcaagggtttcgtcaaggcgcttcgcgacgtcatcgacccgaaggacaagaaggtcgtgctgttcggcgccggcggcgcggcgcgcgcggtgtgtgtcgaggtggcactcgccggtgccgcgcatatcaccgtggtcaaccgcaaccgggaacgtggtgaaaccgtggcgcggctgattgacgaaaagacgccggccaccgccaccttcgccgcatgggaagacgccttcgccattcccgaagagacggatatcgtcattcacgccacctcggtaggcctttatcctgatatagacggcttgcccgacatcgatctgaagacgctgcgtccctccatggtcgttgccgacggcatccataatccgccgcgcacgcggctgatccgtgccgcagaggccgcgggcagcaagacggccgatggtctcggcatgctggtcaatcagggcgtcataggcatcaaatattggaccggggtcgatgttgacgcctatgtaatgcggcaggccctcgtcgat

SEQ ID NO: 35176 - DNA, 792 bp, Agrobacterium tumefaciens
attccggccctcggcttcggcactttccgtatacccggttccgatgttctcaggatcgttccgcatgcgctgaaggttggcttccgccatgtggacaccgcgcagatctatggcaatgaagcggaagtcggtgaagccatcgccaactccggcgtcgcccgcggcgatatcttcctgaccaccaaggtctgggtcgagaactacgggcatgatgccttcatcaaatccgtcgacgagagcctgaagaagcttaagaccgattatgtcgatctgcttctgctgcattggccgaatgaagcggtttcgcttgccgagcagatcggcgcgctgaacgaggtgaaggaagccggcaaggttcgccacatcggcgtttccaacttcaacaccgagttgatggctgaatcggtcaagctctccagggctccgatcgtcaccaaccagatcgaataccatccttatctcagtcaggacgtggtcatcgccgcggcaagaaaggccggcatgtcggtcaccggctatttcggcatggccgatggcaaggtctttaacgacccggtccttagggatatcggtgcccggcatggcaagtcggtcgcgcaggtggtgctgcgctggctcgttcagcaggaaggcgtcatcgcgctgtccaagacggtcggcgaggctcgcgttctcgaaaacttcgcgattttcgacttcgcactctcggccgatgaaatggccgccatccatgctctggctgttcccggcggccgcatcgtgtcgccggatggtcttgcgccggtctgggac

SEQ ID NO: 35177 - DNA, 1074 bp, Agrobacterium tumefaciens
tacgccaccagcaggccgcttgcgatcgaatagattgagcttgccccgcccggccccggcgaagtcctcgtccgcatccgcgccgcaggcctttgccattccgatctttccgtcaacaacggcgaccggccccgcccgatgccgatggcgctcgggcacgaagcggcgggcgtcgtcgaggcattgggcgaaggcgtgcgcgatcttgagcccggcgatcatgtggtcatggtcttcatgcccagttgcggacattgcctgccctgtgcggaaggcaggcccgctctgtgcgagccgggcgccgccgccaatgcagcaggcaggctgttgggtggcgccacccgcctgaactatcatggcgaggtcgtccatcatcaccttggtgtgtcggcctttgccgaatatgccgtggtgtcgcgcaattcgctggtcaagatcgaccgcgatcttccatttgtcgaggcggcactcttcggctgcgcggttctcaccggcgtcggcgccgtcgtgaatacggcaagggtcaggaccggctcgactgcggtcgtcatcggacttggcggtgtgggccttgccgcggttctcggagcccgggcggccggtgccagcaagatcgtcgccgtcgacctttcgcaggaaaagcttgcactcgccagcgaactgggcgcgaccgccatcgtgaacggacgcgatgaggatgccgtcgagcaggtccgcgagctcacttccggcggtgccgattatgccttcgagatggcagggtctattcgcgccctcgaaaacgccttcaggatgaccaaacgtggcggcaccaccgttaccgccggtctgccaccgccgggtgcggccctgccgctcaacgtcgtgcagctcgtcggcgaggagcggacactcaagggcagctatatcggcacctgtgtgcctctccgggatattccgcgcttcatcgccctttatcgcgacggccggttgccggtgaaccgccttctgagcggaaggctgaagctagaagacatcaatgaagggttcgaccgcctgcacgacggaagcgccgttcggcaagtcatcgaattc

SEQ ID NO: 35178 - DNA, 729 bp, Agrobacterium tumefaciens
ccattttccgattacaagaccgcattggtcactggcgcttcgtccggtatcggcgctgcagtcgtcgagcggctgcgccgcgaaaacattgaagtccacgccatcgcccgcagtgccgatgcattgaaggagctggccgatcggactgggtgtgtcgcgcatgtcatcgacgtaaccgatcgtgctgcgattgccgacctcgcaagccgggtgcagtttgatattctggtcaacaatgccggcgtggatcgcccgaagaaatttctcgaggcggatgaagccgatatcgatcttctggtcgacgtcaatctgcgtgccgtcctccacatctgccggctgatcgttccaggcatggtggagcgcgatcgcggccacgtcatcaatatctcatccatcgccggaaattataatttcggcggcaattccacctatcacgccgtgaaggctggcgtcgccatgctctcgaaccagcttcggatcgatgcattcggcaagcgcgtgcgcgtgacggaaatctgtcccggccgcgtggcgacggatattttcagccacgttcacggcaatgatccgagcgtgcgcgagcgtttcatcgacggtttcgaattgccgaaggcggaagacattgccgatgcgatcggttttgccattgccgcgccggttgccgtcaatattggccatatggaaatcaccccgacattgcaggtcatgggcggccttcaaactgccaag

SEQ ID NO: 35179 - DNA, 1332 bp, Agrobacterium tumefaciens
gttctcattgccaacaggggtgaaatagcagcgagaatccagcgggcctgccatgaactcgggctaaaaaccgttgcaatatgctccgaggcggacaggggcgcatcctatgtccagactgccgatagttttctttgtatcggcccttccgctgcgggcaaaagttatctcaacaaggatgccatcctgctcgcggcgcggttgacatcttcaggagcgatccatcccggttacgggtttctatcagaaaataccgccttttcggacgccgtcgaaaaagccggccttgttttcatcggaccgggcgcatcgtcgattgcgacgatgggcgacaagatcgctgctaaacgggcgatgattgctgctgctgtgccgtgtgttcccggccctgatacggcattgccggatgatccggctgccgtcgaaagcattgcgcaggaaatcggttatcctgtcatcgtcaaggctgccggtggcggcggcgggcggggtatgcgggttgtgccggatgccggatctctgcatgaggcgattcccacgacacgcgaggaagcccgtcaggctttcggctcgccggcgctctacatggagaaattccttcagcatccccggcacattgaaatacaggtgctgtgcgacacccacggacatgccgtttggctgggacatcgcgactgctccatgcagcgtcgccaccagaaggtggtggaagaagcgcccgcgcccggcatttcgcctgacgtgatccggtccgtcggacaagcctgcgtcgaggcctgccagcagatcggttatcgtggagtcggaacgtttgaattcctctacgagaacggggccttctatttcatcgagatgaacacgcgtctgcaggtcgagcatcccgtcaccgaaatgaccagcgggatcgatatcgtccaggcgcagatcagggcggcacagggggaggaactggttctacgccagcaggatgtaaaatgcgaaggccacgccttcgagtgccgcatcaacgcggaagatccgcagacgtttctgccttccgccggggtcgtgacgggtcttgcctggccgcaggggcaaggtattcgtgtcgatacccatattcatgggggttacagggtttctccctattacgattcccttgtcgccaagctcatcgtccatgcgccaacccgcagcgaggcgatggcgaagatgcgcgaggcacttgccgggacatcgattgaaggcatttcgaccaatctgccgttcctgcgcgcgctgtttgaggacgacgctttcgtgtgtggtgaaacggacattcattatctggagaaatggctcaagcaacggaga

SEQ ID NO: 35180 - DNA, 1440 bp, Agrobacterium tumefaciens
atgcatctgaatgaccccacgcttttctgtgaaaaagtgcccgtggccggccgctggatcggctgcgatgaccgcgagacggcgacgatccgcaatcccgcgacggggaaaatcgtcgggcaagttcccgaacttggcgcaacggaaacgcaagcggctatcaccgctgccgtgattgcccagaaagcatgggcgcgccgcacagccggcgagcgtgcggcgatcctgaaggcgtggcaccggctcgtcatggaaaaccgggacgatctcggcatgatcctgacgctggaacagggaaaaccgctcgcggaagccaaaggtgaaatcgcctatggggcaagcttcatcgagtggtttgcctgaagggcgcgccggatcaatggtgagacggttcccggtcatcaggccgacaagcgcatcctcgttctgcgccagccggtcggcgtcgtcgcggccatcacgccgtggaatttccccaatgccatgattacccgcaaggtcggcccggcgctcgctgccggctgcgcggtggtgctgaaacccgcaccgcagacgccgttttcggccatcgccctcgccattctcgccgagcgcgcgggcctgccgctcgaacttttcagcatcgtgacgggtcctgccgcagaaatcggcggcgtgctgaccgcaagcccggatattcgtctcctcaccttcaccggctcgacacgcacgggagaacatctttaccgccaatgcgcgccgacgatcaagaaactcgggctggaactcggcggcaacgcgcccttcatcgtatttaatgacgctgatctcgacgcggctgtcgaaggggcgctgattgccaagttccgcaacaacggccagacctgcgtctgcgccaaccggctttatgtgcagagcggtgtttatgatgcctttgctgaaaaattcgcgcgggcggtatcggggctgaaggtcggtaacgggttggaagagggaagcattctgggtccgctcatcgatggtaacgccgttgccaaggtggaagcgcatatcgccgatgcactctcaaaaggcgcgcaaattgccgcgggcggtagcaggtatgcactcggcggcaattttttcgagccgacgatcctgcgcaacgtgactgccgacatgcaggtcgcgcgcgaggagacatttgggccgctcgctccgcttttccgtttcgaagacgaagaggatgtgatcgcgcaggccaacaataccgatttcggtctcgcttcctatttttatgcgcgtgatctttcccgtgtgttcagggtcgccgaggcgcttgaatatggcatggtcggcgtcaatacgggggctatctccaccgccgaggcgccctttggcggcgtcaagatgtcaggtctcgggcgcgaaggttcccgccatggcatcgaggaatataccgaactcaaatatgtctgcatc

SEQ ID NO: 35181 - DNA, 1413 bp, Agrobacterium tumefaciens
cagtgctatatcgacggacgtttcgaggatggtgaggccagcttttccagcctcgatcccgcaaccggccagccctgggccgaaatgccggaaagtcgcgaggcggatatcggccgtgtggtcgaggccgcgcatcgggcgctttacgaggatactgtctggtcgaaactgacggcgacgcagcgcggcaagctcctctacaggctggccgatctcgtcgcggaaaatgcgaagacgctcgctgaactcgaaacccgcgataccggcaagatcatccgcgaaacgtcggcgcagatcgcttatgtcgctgactattatcgctattatgcgggcctcgcggacaagatcgaaggcgcctacctgcccatcgacaagccggatatggatgtctggctccggcgcgaaccggtcggcgttgtcgcggcgatcgtgccgtggaacagtcagctgtttcttgccgccgtgaagatcggtccggcgctggccgccggctgcactatcgtcgtcaaggcatcggaagatgggccggcaccgcttctggaatttgcccggctggtgcatgaggccggttttcctgccggtgtcgtcaacgttgttaccggtttcggcgcgtcatgcggcaacgccctcaccacgcatccgaaggtcgcccatatcgccttcaccggcggcccggaaacggcccgacatatcgtccgcaactcggccgaaaaccttgcctccacatcgctggaactcggcggcaaatcgccgatcctcgtttttgccgatgccgatctcgaaagtgccgccaacgcccaggtggcaggcatttttgcagcgaccggccagagttgcgtggctggttcgcggctgatcatcgaaaaaagcgtcaaggaccggttcctccagattctggcggcaaaggccgaggcgatccgcatcggttcgcctttggatatggcgacggaagtggggccgcttgcaacggagcgtcagaggaagcacatcgtttcgctggtttccgcctcggtagatgccggcgcgaaggtggtgacgggcggtgagcctgtggagggtgaaggctatttttaccggccgaccattctcgattgtgacggcattcgctcgccttccttggaaaaggagtttttcggccctgttctttcggtcgtttccttcgaaaccgaagcggaagccatttcgcttgccaatgacacggtctatggccttgcgtcgggcgttttcacgcagaacctgacacgggctcaccggctgatgaaggcgatccgcgcgggcatcgtctgggtgaatacctatcgcgctgtttcgccgattgcgccctttggcggcttcggcctttcgggcgacggccgtgagggcgggcttgcggcggcgctcgattacacacgcaccaagaccatatggctcaga

SEQ ID NO: 35182 - DNA, 1137 bp, Agrobacterium tumefaciens
ctgatgccccgcgaaatgcttatcggcggcggcagccgatttcgattacccgccgtggtaaaatcgcttggcgtccatcgccccctgctggtctgcgatcccgtattgcagaagctcggccatgccgatgcgcttttgcaggcgctggccgaggaaggcatcgaggccgccgtgttctcggacgtcgtggaagacccgacggatatatccatcgccaccctggtgaaacgcatttccgatggcggccatgacagtctcgtcgcacttggtggcggcagcgccatggatacggccaaggcgggcgccatcgttgcaacgagcggggaggatttgcgcgccctgaaagtgccgcggatcgtggatttcgccgtcatgccggtgattgccattccgacgacggccggtaccggttcggaagtgacccgcgccgccgtcgtcaccgacacggctgccagcgaaaaaatgctgatcctcggcaccgccgctttgccggtcgcggccatcatcgattatgagctgacgctgacatgtccttaccgtgtcacggtcgataccggcatcgatgcgctgacccatgcgctggaagcgctggtcaaccgcaatggtaacgcccattccgaggcgctggcgctttccgccctgaagctgatcggcgccaatcttgaaaaagtggctgataaccctgatgaccgggatgcgcgtgaagcgatgatgctgggcgcgacccatgccgggcttgccgtctccaatacatcgaccgcactgatccatggcctcagccgtccagtcggcgcgtttttccatgtaccgcatggcatgtcgaatgcgatggtgctgccgctggtcacgcagttttcgctgaattccgctcttccgcattatgctgcggccgcgcgggcgctcggctccgccgccgcgacagatagcgatcaggtctccggtgcgaagctggtggaggctttcctcggcctgaacaggcggttgaaggtgccgaccccacaagagttcggtatcgacaggagccgctatctcgatcttgtgccggaaatggtgcggcagggccttgcttcgggtacgccggcaaataacccccgagtgcccacagttgccgaaatgacgaggctatatgaactcgcc

SEQ ID NO: 35183 - DNA, 738 bp, Agrobacterium tumefaciens
agacgagccctcatcacgggcgcatcgagtggccttgggatcgaatttgccgagctgctggcagcgcagaagatgaacctcgtgctcgcagcccgtcgaaaggagccgatggaaaaacttgccgaggaccttcgccgaagacatggcgtcgacattcttgtcgagcctatcgaccttgccgcacccggagccgccgctcgcctgaaagacagcctgaacgagagggcgatacagatcgacatactggtgaacaatgccggatacgggctacagggtgagtttctgaaaaccccgatcgagcgcaccaccgacatgattcagctcaacatcacggcgctgactgaactcagctatgttttcggccgggacatggccgccaggggatcgggagagattcttctgatagccagtctactggctttccagcctgtccctacctatgccgcatatgcggccacgaaatcttacgtgctgtcatttggtgaggctttgcacgacgaacttcgcacgcaaggcgtggtcgtcaccagcctttgcccggggcacactgaaacaggatttgatgccgctgccggcgctcaggtctcgccaatgttgcgcctgctcaccatgaaaccccgtcccgttgcagaagccggacttgaagctctcgccaaaggcaaggcgtccgttattgccggtttcatgaataaggtggttgcgttttcaactcgtctgaccccgcgttccatgcagcgg

SEQ ID NO: 35184 - DNA, 1254 bp, Agrobacterium tumefaciens
cgtcgtatcgttgtaacaggaatgggagccgtcagccctcttggcgcgaatgtggatatctcatggtcgcggctccttgctggccaaagcgggatccggcgactgaccgacgatgtcgtcggagatcttcctgcgaaagtgggaggcgttgtcccttctctcgccgaagacccagaaagaggattcgatccggacaggatcattgcacccaaggatcagcgcaaggtcgaccgcttcatcatcttcgcgctggcggcggcggaagaagcgctcgtgcaggcaaactggaagccggtctcgaatgaagacaggttgcgaaccgcgacaatcatcgcatccggcatcggcggtttccctgccatcacggaagccgtgcgaaccgttgatcaacgcggtgtacgccgcctctctcccttcacgataccgtcgttcctcgtcaatctcgcagccgggcaagtctcgatccgccacggtttcaaaggtccgctgggagcacccgtaacggcgtgtgctgccggcgttcaggcgatcggcgacgctgcacggcttatccggtccaatgaagccgacattgcggtttgcggtggaacggaagcttgcatgaacatcgtcagcctcggcggcttcgcggcggcaaggtcgctttccaccggtttcaacgagacgccgaccaaggcgtcgcgtcccttcgataccgcgcgtgacggcttcgtcatgggtgaaggcgcgggcgtactcgtcatcgaggcactcagccacgctctcgcccgcggagccaccccgattgccgaactcgttggatacggcacgacagccgacgcccaccacatcacgtcaggccccgaggatggaagtggggcacgcagggccatggagattgccatcgcgcaagcgggcatcgcccctcatgagattggtcatctgaacgcgcatgcgacatcgacgccggttggggacctcggagaaatcagggccatcaagagtgtgtttgggcaacgaaagtcggttgctgtcagtgggaccaagtcggcgacggggcacctgcttggcgcggccggcgggctggaagccatcttcacgattctagcgctcaaaaatcggatcgcccctccgacactgaacctgaacgcgccggatacggaatcggacgggatcgattttgttgcaaacctggcacgatccctggacgctgaatatgccatatccaacggcttcggttttggcggcgtcaatgccagcgttcttttccgacgt

SEQ ID NO: 35185 - DNA, 756 bp, Agrobacterium tumefaciens
attcgcacacttatcgacacaccgctgcgggtgggcgagtctccgacatgggacgagcgaaccggcgacctgtggttcgtggacattctggcgcctgcaattttttgcctatcaccaagcggaaaactccagcgtttcgacatgccggcacagatcggctgtcttggcctctgccaaagtaacctgatcgtcgcggcattgaagacaggcgttcatctgctcaatccgcagaatggtgaactcgagcttctctgcgatcccgatgaggggagagccgacagccggttgaatgatggaaaggttggcccagatggtcacttctgggtgggcacaagagatgaggcagacgttcccaccggcaatgctcgcctctatcgcgtttcttccagcggtcacgtcgagcgcttcatagacggcgatatgttgacgtccaacggtctcgcctggagcccggacgagacacggatgtaccattcagatagcagcgggctgctgcttcaggttttcgacttcgatgttcaaacgggcaggcttgggcccgccaaacgcctccatgattttcagccggacgaaggcaggccggatggtgctgcgacagacagcgaaggttgttactggagtgccggtgtgcaggcgggcagattgaaccgcttcacccccgatggcgaattgtttgaaatctacaagatgccattcaagggtccgaccatgccctgcttcggcggtcccgaactcaagacactctacgttaccagc

SEQ ID NO: 35186 - DNA, 894 bp, Agrobacterium tumefaciens
ttaatgacgacatttgatattcgccaggcgctgcacggcatctccggcgttcccgttacggcatatgacgccgatggagagatcagtttcgacatcaccgccgaggcctacgcccgtgtggccagggccggcattcacaacatcgtcgcggctggcaatacaggcgagttttacgcgttgacgcccgctgaaatcctgacggtttacgaggccgcaatcaaaggcgtggacggcattgctcccgtcaccgcagccattggacgctcgcagcgcgaagcaattgcgatggcgcggaccgcaaaggaactcggcgcatccgcagtgatgtctcaccaaccggttgatccgttcgccgctcctcaatctcaaatcgcctatttcctggggctggctgaagacagcgcgcttcctcttgtcgcctatgtacgggccgatggatttgcggtggacgatatggtgaggctctccagccatccaaatgtcgcgggcatcaaattcgccacgacagatatcatgctgctgtcgcgcgccatcgccgcctccgacgcagacggagccttgtatatttgcggccttgcagaaagctgggccccagccttcgccgcagtcggagcgcgtggcttcacctccggtctcgttaatgtcgccccgcatttttcaatgcaggtacacgaggctctcatggcaggcgatttcgacagcgcccgaaagatcgttgagaagatcgaattgttcgagcggctgcgcacgcgctaccgaaacggcgccaatgtgactgtagtgaaagaagctatggaaatcatggggctcgccgtcggtccggtgcgcgcccctgggctcgtgcgcttggatgcgcctgaccgcgctttgctcgaaaacctgctggccagctgg

SEQ ID NO: 35187 - DNA, 1530 bp, Agrobacterium tumefaciens
accatcacgcttcatcccggcgccgtgacgcttgccgatcttgccgccatctactgggaaaacggcacggcaaagctcgaccgttccttcgacgccggcattgaaaaagccgccgcccgcatcgcggaaatcgccgccggcaatgcgccggtctacggcatcaataccggtttcggcaaactcgcttccatcaaaatcgacgccgccgatgtggcgacattgcagcgcaatctcatcctgtcgcattgctgcggggtcggcgtgccgctgcctgaaaatgtcgtgcggttgatcatggcgttgaagctggtttcgctcggccgcggcgcatccggcgtgcggctggaactggttcggctgatcgaggccatgctggaaaagggtgtcatccccgtcattcccgaaaagggttcggtcggcgcttccggtgatctcgcgccgctcgcccatatggccgccgtcatgatgggggaaggcgaggccttttatgagggtgcgccgctgcccgccggcgaggcgctcgccaaagccgggctgacgccggtggtgcttgcggcgaaagaggggttggcgctgatcaatggcacgcagacttcgacagctctggcgctggccgggctgttccgcgcccatcgtgccgcacaggcggcgctcattaccggtgcactttcgacggacgccgccatgggctcatccgcgcccttccatcccgatattcacagcctgcgcggccacaagggccagatcgatgcgggagcggcgcttcgtaacctgctggaaggttcggaaatccgcgtcagccatatcgagggcgacgagcgcgtgcaggatccctattgcattcgctgccagccgcaggtcgacggcgcctgcctcgatcttctgcgccaggtggcgcgcacgctggaaatcgaagccaacgcggtgaccgacaatcccttggtgctctcggataattccgtcgtttccggcggcaatttccatgccgagccggtcgccttcgccgccgatcagacggcgcttgccatttgtgagatcggcgcgatcgcccagcggcgtgtagcgctgctggtcgatccggcgctttcttatggcctgccggctttcctttcgaaaaaaccgggcctgaactccggcctgatgatcgccgaagtcacctccgccgcgctgatgagcgagaacaagcaaatggcgcatccggcctccgtcgattcgacgccgacctcggccaatcaggaagaccatgtctccatggcctgccatggcgcgcgccgcctgttgccgatgaccgacaatctctttgccatccttgggatcgaggcgctctcggccgttcagggtgtggaactgcgcggaccgctgaaaaccagtcctgaattgcaaaaggtgattgctgtgctgcgtgttgtagtcccttcgctggaagaggaccgctatatggcgccggatttgaaggctgcggcggagctgattgcctccggcgcgctggtctcgacgatttcgggcggcattctgccgaagctggaggct

SEQ ID NO: 35188 - DNA, 726 bp, Agrobacterium tumefaciens
ctcaaaagcaagcgggcgctcatcaccggtggcaccagcggcatcggacttgagacagcacgtcaatttatcagtgagggtgcacgggtagcagtcacgggaaccaaccccgagacgctggatgctgcacggcgggagcttggcccgagtgcattggtcatcaaggcagacgctgccgacgtggatggccagaaggtcgtcgctgaaacgatcagggaggcgttcgggggcctggacgtcgtcttcatcaacgcaggcgtcgcccttctcaagcctttggaagcatgggacgaaaaaggctttgatagggtcttcaacatcaacgtgaaaggtccgtattttttgctgcaggcactgctgccgatactggccaatccggcttctatcgtgctgaacacctcggtaaatgcccacatcggcatgcctaactcgagtgtctacgccgcctcgaaagcggcactgcagtcattcatccgcaccttgtccggcgaactgatcgcgcgcggcatccggctgaatgcggtgagcccaggtcccatctctacaccgctctatggtaagcttggtttcactgagactgacctgaaaaatgtcgctgaaagcattcaaaatctggtcccggccggccgctttggcgaaccgtccgaaattgcaaaggcagtagtgttcctggcatcggacgaagccgcctacacggtcggtagcgagatcatgatcgacggtggc

SEQ ID NO: 35189 - DNA, 1263 bp, Agrobacterium tumefaciens
atcgttggggcggcgactttcttcgacggttacacggttatcgctatcgcctatgcgatgccggttctcgtccgggagtgggggcttactccatctcagacaggtatgatcctgtcgatgggatatttggggcagctcatcggcgccatcctgttcggctggctcgcggaaaggattggccggctcaaggtcctcctgttcaccattctcctgttcgtcagcatggatgtcgcctgcctgttcgcggctggtgcaggaatgatgatggcgttccgctttgtgcagggaattggcactggcggcgaagtgcccgtcgctagcgcctacatcaacgagctgatcggctcgaaaggtcgcggacgcttttttctgctctatgaagtcatgttcctgctcggcctcgttggcgcgggtctaatcggctacttcatggttcccctctacggctggaaagcgatgttcatcgttggcctggtccctgccatgctgatgatcccgctgcgttggtttctgaaggaatctccacgctggctggcagcaacaggccgatacgatgaggccaacgtcatcgtaaaacgcatggaagaaagcgctcgggcggccgggaaggcgcttcccgaaccaaggatcattgcaacgccggccaaacgcgtgtccgactggagagaactcttccaggggatctacctgaaacgcaccctgtcgatctgggctatgtggttctgcgcctatatggtggcgaacggcacgatcacctggctgccaacactctatcgccagacgttcaatctgccgctcgaaacaagcattctctatggcttcatgacgtctgcggcaggcgtggtcgctgccgtcatctgcgcgcttctgatcgacaaggtcggtcgcaaacgctggtacgcaggggcattgcttctggctcctgtgccgcttgccattctggcatggcttggcgcaacatcgccaatgcaggtcctgatctttgcaggccttgcctatgccatcgtgcagactgtgaccttctctctgtatctgtattcggccgaaatctacccgacccgcatgcgagcaatagggacgggtgctggcagtgcctggctgcgcttgggttcctctgccggtccgatgcttgtggggttcgtgatgtcatcgatgggtattcagtacgtgtttgcgaccttcgccttcattctgatcatcggcgctgttgtgaccatgctgtttgccgtggaaaccaaaggcaaggtcctggaagagctctca

SEQ ID NO: 35190 - DNA, 720 bp, Agrobacterium tumefaciens
atgagtagcaaggttgccctggtcgtcgggggtgccaagggtatcggcttggcaattgcagagcggctttcagaggaaggggcgaaggtcttcatcaccagtcgtcgaagcgaagatgccgaaaaggcagcaacggctattggtcatggcgcgatcggtatcgccgccgatgccgcgatccccgaagatatggtggcgactgtcgaaaaagtgcgaaaggcacacggccgtatcgacgcgctcgtcttgaatgcgggtctttctgagcctgcgcagatcgccgagataactcctgaacatttcgaccgccacttcgacgtcaacgtccgcgggatggtcttcggcttccaggcggctctgcctgcaatgacggaaggcgggtcagtcgtccttgtcggatccattgctgatagtggcggctacgcttcctacggaacctacgctgctaccaaggcagccgtgcgttcctatgcccgaacctggacggcagagctcgcatccgtcggcatccgcgtcaacgtcgttgcacccggccctacagatacagaaatgatggctgcggttcagccagacatgcgcgcggccattgtcgctcctatcccgatggggcggatggcgcggccttccgaagtggctgcagccgccttgttcttattgagcgatgacgcgagttacatcgctggtgctgaattgtgcgtcgacggcggcttgcggcaggtc

SEQ ID NO: 35191 - DNA, 753 bp, Agrobacterium tumefaciens
ctgattaccggcgcctccacgggcattggcgccacctatgccgagcggttcgcccgacgcggacatgatctcgtgttggtcgcccgagacatggcgcgcatggaggcgctcgcgagtcgtctgagccaggaaaccggtgtaaggatcgatattctaccggccgatctcacccaggcgacggatcttgtaaaggtcgaaaccaggctgcgtgacgatgagcgcattggcattctcgtcaacaatgcaggaacggccatcggcggaacctttgtcgaccagagcgtcgatgacatgaccaggctcgttgcgctcaacgcgaccgcgctcgtccggcttgccggtgccattgctccgcgtcttgccaaggccggcgagggagcaatcgtcaatatcggttcggtcgttggcctcgcgcccgagttcggcatgacggtttacggcgcgaccaaggcttttgttctgttcctgtcgcaggggcttgcgcacgaactcggaccgaagggcgtctacgtccaggctgtgcttcccgcgacgacccggaccgagatatgggatcacgtcggtgccgacgtcaacaccctgaacaacgtcatggaagtaggcgatctcgtggatgcggccctggtcgggttcgaccgccgcgagccggtcaccatcccgccgcttccggacgccggccagtgggaggcattcgatctcgcccggaagaccatgatggccaacttcggcaatgcactgcctggcgaacgttac

SEQ ID NO: 35192 - DNA, 984 bp, Agrobacterium tumefaciens
gccttcgtcgtcgacaagtacaagaagaagggcccgctgcgtctggccgacatgcccaatccggtcatcggcgccaatgatgtgctggttcgcatccatgccactgccatcaatcttctcgactccaaggtgcgcgacggggaattcaagctgttcctgccctatcgtcctcccttcattctcggtcatgatctggccggaacggtcatccgcgtcggcgcgaatgtacggcagttcaagacaggcgacgaggttttcgctcgcccgcgtgatcaccgggtcggaaccttcgcagaaatgattgcggtcgatgccgcagaccttgcgctgaagccaacgagcctgtccatggagcaggcagcgtcgatcccgctcgtcggactgactgcctggcaggcgcttatcgaggttggcaaggtcaagtccggccagaaggttttcatccaggccggttccggcggtgtcggcaccttcgccatccagcttgccaagcatctcggcgctaccgtggccacgaccaccagcgccgcgaatgccgaactggtcaaaagcctcggcgcagatgtggtgatcgactacaagacgcaggacttcgaacaggtgctgtccggctacgatctcgtcctgaacagccaggatgccaagacgctggaaaagtcgttgaacgtgctgagaccgggcggaaagctcatttcgatctccggtccgccggatgttgcctttgccagatcgttgaaactgaatccgctcctgcgttttgtcgtcagaatgctgagccgtggtgtcctgaaaaaggcaagcagacgcggtgtcgattactctttcctgttcatgcgcgccgaaggtcagcaattgcatgagatcgccgaactgatcgatgccggcaccatccgtccggtcgtcgacaaggtgtttcaatttgcgcagacgcccgacgccctggcctatgtcgagaccggacgggcaaggggcaaggttgtggtt

SEQ ID NO: 35193 - DNA, 837 bp, Agrobacterium tumefaciens
gcgcagctgggggaaagtccggtctggcacgagggcgaagatgcgctctattgggtggatattctccatcctgccgtacaccgtttcgatcccgccactggccgcaacgaaacctgcgagaccggcaagctggtcagcgccgtcataccggtcaccggcggacggttgctggtcgcgtcgcaggatggcgttgaatggctggatttcgcctccggccggctgaccccgttcgtcagcccggaggccggcatcgccgacaaccgcctgaacgatgccaaatgcgggccggatggcgcgatctgggtcggctcgatgcgcatcgatgcctccaagcccacgggtgcgctttatcgtatcaacgccaacggcgcatccgagcgcaaggaaggcggcatcatcgtctccaacggtctcggctggagcccagatggcaggaccttctatttcgtcgataccgtgcccggcctcatccatgcctatgattgcgatccggcgacgggtgcgctgtcgcagcgccgtgaattcgcccgcattccggtggccgatggccggccggatggtctcgccgtggatgcggaaggcggtgtctggtgcgcgatctgggatggctggtgcgtgcgtcgctatcttcctaacggcaagctggaccaggtgatcgacatgccggtgccgcgcccttccagcattgcctttggcgggccggacctgtcgacgctattcatcaccagcgcccgcacacgactgcctgcatccacacttgccgacgcgccgctgtctggcggcctgttttcatgccgcccgggaatttccggcgcgcgcattgccatgtttgaagga

SEQ ID NO: 35194 - DNA, 732 bp, Agrobacterium tumefaciens
ttgagaggccgtacggcactcgtcaccggttcaagccgcgggataggagcggcaatcgccgagggtctcgccggcgctggtgcgcatgtcattctgcatggcgtaaagccgggctccacggcggccgtacaacaacggattatcgcgagcggcggtacagcgcaggaactggcgggcgatctctccgaagccggcgctggcaccgatctgatagagcgcgccgaggcgattgcacccgtcgatattctcgtcatcaacgcgagtgcacagatcaatgcgacgctttctgcgttgacgccgaatgatctggcgtttcagctggctgtcaatctgggttcgaccgtcgatatgctgcaatctgcgctgccgaaaatggtggcgcgcaagtggggcagggtagtttctataggctcaatcaatcagctgaggcccaaaagcgttgtcaccgcctacgctgcaacaaaggctgcgcagcacaatttgatccaaagccaggcgcgagacttcgctggcgataacgtgttgctcaacactcttgctcccggccttgtcgatacggaccgcaacgccgaccgacgcgctcaagatccggagggctgggatgaatatgtgaggacattgaactggatggggcgtgctggacgaccagaggagatggtcggggcggctctgttcctggcgtctgaggcttgcagcttcatgacgggagagacaatctttctgacgggtggc

SEQ ID NO: 35195 - DNA, 2109 bp, Agrobacterium tumefaciens
atggccagaaaaccaaattccacctcgtccattaccgccaccatccatgaccagcagcttatccggggagcaggtggcgagctgcaccagattgccaccggcgacgaacccgttttgacgaccgctcaaggggctccagttgcagacgaccagaattcgcttcggatcggtcctcgcgggccgctcgtggtggatgacttccattttcgcgagaagatcttccatttcgatcacgagagaattcccgagcgcgtcgtccacgcccgcggatatggcgcgcacggctatttcgagacttatgattcccttgccacccataccaaggcggatttgtttcaacgggcaggggaaagaaccccggcctttgtgcggttctcgactgttgccggcaacaagggctcggccgatctcgcacgggatgtccgcggttttgccgtgaagctctataccaaggagggcaactgggatctcgtcggaaacaacatcccggtatttttcattcaggatgcgatcaagtttccggatctcgtccatgcggccaagcaggagcccgatcgcgcctttccacaagctcaaacggcacatgacaccttctgggatttcatcagtctcacgcccgaaagcatgaacatggtgatgtggatcatgtccgaccgcaccattccgcgttccttccgcttcatggaaggcttcggtgtgcacaccttccgcttcatcaatgcgaaggagcaatcaacctttgtgaagtttcactggaagccaaaacttgggttgcagtcggtggcgtggaacgaggcggtcaagatcaatggtgccgatcccgattttcaccggcgtgatctctggaccgcaatccagtcgggaaatttcccggaatgggagttgcaggtccagctcttcgatcaggatttcgccgacagcttcgatttcgacgttcttgatcctaccaagatcattcctgaagagatattggctccgaagcctgtcggccggctcgtgctcgaccgtatgccggacaatttcttcgccgagacggaacaggtggcgttcatgacacaaaacgtcccgccaggcatcgatttcagcaatgacccactgctgcagggtagaaatttttcctatctcgatacgcagttgaagcgtcttggcggtcccaacttcacgcatttgccgatcaatgcgccaaagtgtcctttcgcgcatttccagcaggacggtcacatggcgatgcgaaatccgacaggacgggccaattatcagccgaattcattcggggaaggccagcgggaatcgccgacgcgtggtttccagcatttcgcggctgaggagcagggggtcaaggcaaggttgcggccggaaagttttgccgatcactatagtcaagcacggcagttctacatcagccagacgccacccgaacaacgtcatatcgcatcggccctgactttcgaactcagcaaggtcgaaacggtggagattcgagagaggatggtttcacatcttcttaatatcgacgaaaccctcgctacgacggtggcgcagaagctcggccttcagacaatgccggagccggcgaatacggccattcctacccgtcaggatctggagccgtcgcccgcgctcagcatcgttgaacggggtcccaaacgcttcgaaggccgaaagcttggcattctcatcacggatggcgtggacgcaaaactgctgaaggggctgacccaggcagtaacagccgaaaaagccgtcttcgagttcatcgcgcccaaggtcgggggcgtaacggcgtcgaacggcacccttatcgaggcacatcacatgattgatggaggcccttcggtgcttttcgatgcggttgctctgctgacatcggaggcggccatcgctgagctgaccgaggaggcaactgcccgggatttcgttgcagacgcgttccagcactgcaaattcatcggatacgaccggtcagcgttgccgttgctggaaattgccggaattgccgacgccatggatgaaggcgtgctgcccttgcccggcgaggaagggcttgcggccttcgtggcagaacttgggaaattgcgtgtctgggctcgggaaccctcgctgaaactc

SEQ ID NO: 35196 - DNA, 1188 bp, Agrobacterium tumefaciens
ccgcggccaaccgagcgcgcgcacatcatcaggagtgatgccgaggcgatcgaagtcgcgaagattgtggccgccgaaatcgcgccgggcgctgcccttcgtgaccgcgaccgtatctggccggtgaaggaacttgatgcgttttcgcaaagcggcctctggtcgatcaacgtaccgaaaaaattcggcggtccggaggtctcctatgcaacactggccaaggtgatcgagattgtctctgcggccgattcctccattggccagattgcgcagaaccatctcggcgtcgttgcggcgatccgcacggtttccgacgaggcccagcaaaagttgctgttcgcagaggtgctgcgcggtacgcgcttcggtaatgccttttccgagttcggctccaagcgggccgcggatttcgagacgaagttcgtggatgccggcgaccatgtgatcgtcaacggacagaaattttattcctccggcgcacttctcgcccatctcgtgccgatcgtcgcgctcgatgatgaagggcgtgcatggtacgctatcgccgagcgggacgcacccggattgaccgtcatcgacgactggtcgtcctttggccagcgcacgacgctatccggcacggtgatcctcaacaacgtcaaagtgccgaagacctatctggttcccggctacaagggttatgccgagccgacggcggatggcgcgatcttccagatcatccaggtcgcggtcgatacggggattgcgcgggcggctattgatgaaaccgtctcttttgtccgcaccaagagccgtgcctgggtggatagcggtgtcgatcatgcctgggatgatccctacacgatccaggccgtcggcgatctgacgctacgcctgcatgcggctcaggcgttgcttgagaaagccggttatgccatcgaccgcgccatccagaacccgaatgctgaaacggtcgccgaggcgcaggtcgttacggcggaggcgaaaatcctcgcgaccgagatcgcgattgcggccaccaacaagctcttcgagctagctggcacccgctccacgcttgctgagcatcatcttgatcgccattggcgcaatgcccgtacccacaccctgcacgatccggtccggtggaaatattcgatcctcggcaagtatttcctcaatggcgagaagccacctcttcacgcctgg

SEQ ID NO: 35197 - DNA, 765 bp, Agrobacterium tumefaciens
gtgaagctcgctacctacaacgtcaacggcatcaacggtcggctggaggttttgctccgctggctcgccgaggcaaagcctgatgtcgtgtgcctgcaggaattgaaggcgccaaacgacaaattcccgcgccgcgagatcgagcgcgcgggctacggtgcgatctggcgcggccagaaatcctggaatggcgtggcaatccttgccagggatcaggaaccgcgtgagacacgacgcggccttcccggagatcctgacgacagccacagccgctatatcgaggctgccattgatggcatcgtcattggctgcctgtatcttccgaacggcaatccagcacctgggccgaagtttgattataaacttcgctggttcgagcgcctgtactcctatgccgcggaactgttcgaactcgatgttcctgtggctctggtcggcgatttcaatgtgatgccaaccgatctcgacgtctataaaccggagcgctggcgggatgacgccctgtttcggcctgaggtgcgcgcagcttatgccgaactcattgccatgggctggacggacgccgtcaggctgctgcatccggaagagcggatctatacgttctggaagtatttccgcaacgccttcgcacgcgatgccgggctgcgcatcgaccatttcctgctgagcccatcgctgcgggaacgactgcaaacctgcggcgtagacaagttcgcgcgggcctgggagcacaccagcgatcatgcgcccgtctggattgaactg

SEQ ID NO: 35198 - DNA, 813 bp, Agrobacterium tumefaciens
atgtcgcgtttcaccaccactgacggtacccgcctcttttataaggactggggcgcagggcagccgatcctctttgcccacgggtggccgctgtcatccgatgcatgggaccagcagatgctgttcttcagccagaacggcttccgcgtcatcgcccacgatcgccgcagccatggccgctcggatcagacatttgacggcaacaacatggaccagtatgccgacgatctcgccgaactgatcaatgcactcgacctgtcggacctgatcttggttggccattcgaccggtggcggcgaggtctcgcattatgtcggccgtcatggcacggctcgtgttgccaaggtggttctggtgggtgcggtgccgccggtgatgctgaagaccgttgacaacccgaacggtacgccgatggaggtattcgacagtatccgcgaaaacaccgcgaagaaccgttcgcagtttttcttcgatctgacggtgcctttctacggctttaaccgggaaggtgtcgcgaccaatgacggcatgcgggaaaacttccgccgcataggactgcaaggcggcgtcaagggccagtacgattgcatccgggagttctctgaggtcgattacacccgtgatctgaagagtattgaccgcccgacgctgatcatccatggcgatgacgaccagatcgttccgatcgatgcatctgcccatcgggctgcggacctcgtggccgatgccacgctgaagatctattcgggcggctcccacggactggcagagactgaggctgatcgtttcaacgccgacgtgctcgcctttatc

SEQ ID NO: 35199 - DNA, 864 bp, Agrobacterium tumefaciens
ttcgtcgcgatcgtgacctgctttaacgatgacgagaccatcaactacgaagccacccgcgcgcaggttcgccgtcaggtgacggctggcaacaacatcatgtgcgcaggcaccaacggtgattttaccgctctcacccattccgaaaaaatcaggattctggaagaggttgtcgatgaagtcggcggaaaggtcgatgtcatcgtcaatgcgggcatgccggcaacattcgagacgctgcaacttgccaaggaattcgaccgcatcggcgtcaagggcattgccgtcatcacaccattcttcatcgcctgcacgcaagatggtctgattcgccacttttctacggtggcagatgaggtgaacacgccggtctatctttatgacattccagcgcgcacccagaaccacatcgaacccgaaacggcacgaaagctggcgacccatggcaatattgccgggatcaaggattccggcggcgcgcaggagacattggaagcttacttgcaggtctcaaaggaggtcgatggcttcgaggtctattccgggcccgatcatctcgtcctctgggcactgcaaaatggagccgcgggctgcatctccggtctcggcaacgcgatgcccgacgttctcgcaggcatcgtcaatggcttcaactctggagatatcacgtacgccgaacgccaacagtccgtctacacagctttccgcaccgatctctacgcccacggctttcctccagccatggtcaaacgcgcgctttatttacaggacccctctgtcggagccagtcggcagccagcattacttcccgatgcagaacaggatcaaaagattgaggaaatcctcagaaaatatggccttcta

SEQ ID NO: 35200 - DNA, 969 bp, Agrobacterium tumefaciens
aaactgcctggtaaagtcgccttgttcgatgccattcctggcgagcctgagatatccacgctcgatgcagcgctggcagcggcacgcgtggccaaacctgatgtcgttatcggtctcggtggcggttcggtgatggatgtggccaagctggtcgccgccctctgggatggcgaacagacacttgccgatgtcgcaggccccaacaaagtggcaggccgccgaacccggctggcgcagattgcgacgacagccggcaccggctcggaagcgggcatccgctcgctgatcaccgatccaatcaagggcaacaagatcgcggtcgaaagcccgcatctgatcgccgatctcgcggtgcttgaccctgaattgacctattccgtgcctcctacggtaacggccgcaacgggcgtggatgccatggcgcattgcgtcgaagccttcaccagcaaacgctcgcatccgatgatcgacggttttgcccgcatggggtttcacctcgtcggtaaatttctgggtcgcgcggtacgtgacggatcggatcgtgaagcacgcgaaggcctgatgctggcttcctattacggcgggatctgccttggacccgtcaatacggcggcaggtcatgccatcgcctatccgcttggaacgctgctgcacctgccacatggattggccaatgcaatcgtgttcccgcatgtactggctttcaatcagcccgttgtttcggccaaaacggcggaagttgccgaagcgctcggtcttggggctggtctgtcgcagacacagttgcaagatagcgctcgtggcttctgttccgatcttgggatcgagatgtcacttgcgaaacatggtgcggccgaggctgatttgtcgcgctacgctgccgatgcgcatgccatccgtcgcttgatggacaataatccggcggatatgagcgttgatgacgtcctcgacgtctacaaggccagcttc

SEQ ID NO: 35201 - DNA, 744 bp, Agrobacterium tumefaciens
agccgagtcgcagtggtcgccggaggcacgtccggtatcggactgtcggttgcacgacatttactcggtattggccacaaggtcgcggtttttgggcagacagaaagcgcggcgaaggccgcgcgctcgtccttcgaggctgagataacatctaaccagctattggtcggttgttgcgacgtcagaaatccaggcgaggttgccgatttctttcgcgatgtcgaaaccttgtggtcgtccactgcgctactggtttattgcgcgggcatttcgccgaaagcaacggacggtgtggccaagcgatttacctcggttgacctggacgagtggaatgatgtgctggacgtgaacttgacgggcgccatgctctgctgtcaagcagccttaccaggtatggtcgacaagggatttggccggattgtcctcatcggctcgcttgcaggacgaacacggcctatgatcgccggtgcggcatatgcagcatcaaaagccgggctcgctggcctggcccgtgcgctcgtcagcgaattttcagccgacgggattacaatcaatgtcgccgctccgggtcgcatcttgacgccaatggcgggaaccgcagcgacgtcagtcaatctcgaggcagtaaaacgaatacccaccaggagactaggagaggccgaagaagtggcacggctggtcggctttttagtctccgatgaagccgctttcatcaatggagcgatcatagacatcaacggcggc

SEQ ID NO: 35202 - DNA, 1080 bp, Agrobacterium tumefaciens
ttctttgaacgcgcctccaccgtttttccaggcggtgtcacacgcgcgacaattgagctggatccccacccgatctttgttgcctacggggaaggcgcgtttgtgaccgacgtcgacgggcaccgtatgctggatctaaacaataacttcacaaccctgatccacggacatgcctatcccccaataactgaagcgattgccggactactaagaacaggcagttgctttgctaatccgatgaaccatgaaatcgatctggccgaattgctagtaggcaggattccggctgttgagcaggtccgcttcgtcgcgagtggaacggaagccgttatgtttgccatcaaagccgctagagcaacgaccggccgggtcgcaatcgctcgggtggagggtgcgtaccacggcgcatatgactgggcggaggcgggccagcacgcatcgtcgaatacgccctgcgccgcctatccaggaatgccagcaagcgtcatagatgacgtcgtgctcctccaatttaactgccccgcagagttggagcaacagatcgcgatgaatgccgggcgccttgcggctattcttatcgatccgatgcccagccgggcaggcctcatagagccaacagaggagttcatcgcaactatcaacaaggtggcgaagcaacatgggatcgtcattatcgcggatgaagtcctgaacctccgccagggcttcgctggagcttcagcgcgctacggtctgaagccggatctcgtcacaatggggaagatcatcggcggtggctttccaataggggcagtcggtggacgtcgggagatcatgtcggcctttggcaagcaaggaagtaaggcgccattgacgcaaggcggaacctttgctgcaaatcccgtgtcgatggtcgctggccgtcttgcgatggaagccctgacgcaagatgctttccaacgtctcgaacatatgggcaacctggttcgcgaggggttgaggtcacgcatcgaacgtcacggcgcaaatctgagcgtgacgggagcggcttcgctttttcgaatacacgccaagaaagtggcgccggtttcttatcaggac

SEQ ID NO: 35203 - DNA, 1437 bp, Agrobacterium tumefaciens
atcaagctaaaaaatgcggcgctgttgcgtgatgcctgcctggtgaatggtcgctggctgaaagccgcggatggcaagacgattgcggtggaaaatcccgccaactcgatgatcatcggtcacgttccttcattgtcggcagatgaggttaaagctgcagtcgagtcagcaggcaaggcattttccgagtggagccgccgttctgcgaaggaccgcgctgccatattgcgtcgatggtttgatctcatggtggcgaacgctgacgatcttggtgcgttgatgactgccgagcagggaaagccgtttgcggaagcaaagggcgaagccctttatgcggcatctttcgtggaatggttcgcggaggaagccaaacgtgtttatggcgataccattccttcgccgaccacggacaagcgcattaccatcctgaagcagccgatcggtgtctgcgccgcgatcacgccatggaacttcccggccgcgatgatcacccgcaaggcggccccggcacttgccgcaggctgcgcgatgatcgtcaaaccggctgagcagacccctctcaccgcacttgctctgggtgttctcgccgaagaagcgggcgttcccgccggtgtcttccaggtggtgacgggcgccgcacgcgatatcggcaaggtgtttaccgaaagcgacacggtgcgaaagatctcctttaccggatcgactgaagtcggtcgtctgctgatggcgcaatcggccccgacgatcaagaaactgtcgctggaacttggtggcaatgcgcctttcatcgtctttgatgatgccgatctggatgcggccgttgagggcgcgatcgtgtcgaaataccgcaatgccggacagacctgcgtgtgctccaaccggatctatgtccaggatggtgtttacgacgcattcgcggaaaagctggtcaaaagggtcgaaagcctgtccgtcggtgagggcacggaacctggtgttctgataggtccactgatcgaccaggaggccgtggcaaaggtcgaggatcacgttgctgatgcccttggcaagggagcaaagatcgtcatcggtggaaagcgtcatgctcttggaggcacattctacgaaccaacggttctgactggtgcaacccaggccatgaaggttgcccgtgaggagacctttggacccgtcgccccgctctttcggttcgggacggaagacgaagcggtcgccatggcgaacgataccgaatttggtctggcggcctatttctacaccgagaatgtccgccggacatggcgtgtcgcagaagcgctcgaatacggcatggtgggccacaatacaggcctcatctccaacgaagtcgcaccattcggtggcgtgaagcagtccggcttgggccgcgaaggctcgcactacggcatcgatgaatatcttgaaatcaaatacctgtgc

SEQ ID NO: 35204 - DNA, 1158 bp, Agrobacterium tumefaciens
atgaccatcaaccctttcgaattccgcaccgttccctccatgcaggttgcctggggtggcgcccatcgcctcggagagattctttccggcaggtttcaggcgcgcaaggcgctgctgattaccgatgcaggtctcatcaaggccggcctcatcaagccgattgctgacgcccttgcggccagcggctttaacgtcacgatcttcgacaaggtcgttgctgatccgccagagcacatcgttgccgactgcgtcgagtccgcaaggcagatcggcgtcgatatcgttattggtcttggcgggggctcatcgctcgacatcgccaagctcgtggctgtccttctggtttccgaccagacgcttgccgacatgtacgggatcggaaacgttaagggatcacgcctgccgctcgtgctggtgccgaccacggccggtaccggttcggaagtcacaaacatctccatcatcaccacgggagaaaccaccaagatgggggtcgtttctccgcagctttacgctgatttcgttcttctggatgctgaactgacggtgggactgccgcaggtccatacggctgccaccggtatcgatgccatggtgcatgccatcgaggcttacaccagcaaacacaagaagaacccgctatcagatgctctggcgcgcgaggcactgcggctgctcggtgcaaacctgatcgccgcctgcaggaacggggccgaccggaaagcccgtgaaggcatgcttttgggtgcgacattggcaggtcaggctttcgccaactcaccggtggccgccgtccacgcgctcgcttatccgctgggcggccattatcacgtgccacacgggctttccaatgccctgatgctggggccggttttacgctttaacgcgaaggctgcagcgtcgctttatgcggagcttgccgacgtgctgggtgttccgggtgaaggggatgcggcaacccgttcggatgcgttcgttcagcatatggaaacgctgatggacgaaagcggcgcgccgcggcgtctgcgcgatgtcggcgtgacggacaacacgctcgccatgcttgcgtccgacgcaatgaaacagagccgtctgttggtcaataatccggtcgaagtccgcgaagaggatgcgcttgcgctctaccgcgaggcgttc

SEQ ID NO: 35205 - DNA, 624 bp, Agrobacterium tumefaciens
atgaaactctactacatgcccgccgcttgctcgctctcaccacacatcgttgccaacgaactggagttggatatcgaatttgtcagggtgaacttcaaagatcataagactgaagggggccaagattattacgacatcaatcccaatggctacattccggccctggacgtggggaacggcgcgatgcttttcgaggggccagccatcgtccaatacatggccgatctgaagcctcaatccggcctcgctcccgccaacggcactttcgagcgttacaagctgcaggagatgctgagtttcctatcgaccgaaatccacaagggcttcattccacttctttatgcgaaacaggcgggtgcatatctcgaaacagcaacgccgaagctggaaaagcgctacgcatggatcgacaatttgctggcatcgcagcgttttttgatgggcgagaatttcacggtcgccgatgcatatctgttcgctctcacaagctggggacaagcgtcatggctgaagtcatactatggtgcagatatccatttcgacgatcttctcaacctcagaggctggtatgaacgcgtaaaagaacgggatgcggtgaagcagtccatacttgaagaaggctta

SEQ ID NO: 35206 - DNA, 723 bp, Agrobacterium tumefaciens
atgagtgaactagcaggtaaacgtgcgctcgtgactggtgcgtcccgcggcattggagccgcgattgcgatcgctctggccgagaaaggcgccgacgttgcgatcacgtacgaacgcgccgctgatcgggcagcgcaagttgtcgcaacgatagaaggcaaaggacgcaaggccttggctatccaggctgatagcatggacccagaggcggtcaagcggtcggttgatcaagcggcgcaagcgttgggcggcctcgacatattggtgaacaatgcggctatcgcgatctacaaggacgtggcggatttcaccgtcgccgagatcgacgcgctttttgctgtcaacgctcgttccccaatcttggcatcacaagccgcgatgccttatcttggcaaaggtggtcggatcgtcacaatcggctccgcaggcgcggaacgcattgtcgggccatcgacggtttattcaatgaccaaatcggcacttcaatcatttacccgcggtctggcgcgagaacttggcccccgtgacatcactgtcaacctcattcagccgggatcaaccaacaccgaaatgaatccggccgagggcgagttcggagatttccagcgtgccctaataccgctcggccggtacggcgagccggaggatgtcgcggcagcggtagcgttcctcgcatctggcgcggcccgacaaatcaccggaaccatcctgaccgttgatggc

SEQ ID NO: 35207 - DNA, 720 bp, Agrobacterium tumefaciens
ctgaacggaaagatcgcacttgtcacgggtggatcgcgatctattggcgcatcaattgcccagcgtctcgcagcggatggcgctcaggttgccttcacctatcgtggatcacctgcgaaggctgaggaagttgctgtcgccatagaaaaaacgggcgcgcgcgcgctggctattgccgcggatgccgctgatccggacgcgatacgcgctgccgttgccgcgacggtcgataagttcggcggcctcgacattttggtgaacaatgccggtattgcctttgccggtccgatcgacgaaatcgccttcgatgactatcaggcaatgctcgcaatcaacgtaaccggcgttttcgttgccacgcaggaggccgtacgccatatgaaggatggcggccggatcatacatattggcagttcgatcacgaaatatgccggggttcctgggctgtcagcatacggcctcaccaaaggggcagtcgccggtttcaaccgcagtttggctcatgacctcgggccacgcggcatcacagtcaacaccgtgcatccaggcccaaccgacactgatatgaaccctgttgatggtgagtttgccgctatgcagatctcgcgtatcgcggcgggccgctatggaaagccccgggaaattgcgaacgtggtggcattccttgcaagtccggaagcctcgtttgtaacaggtgccgacatccgggccgatggtggt

SEQ ID NO: 35208 - DNA, 1008 bp, Agrobacterium tumefaciens
atcatgcaaatgcgcaagctgggtgaaagcgggttgttcgtgtccgaattgtgtttcggcgccatgacattcggcggaactgacgggctatggggaaaggtggggagacttgaccaggaggatgccgatgcactggtcaaggccgctctcgaggccggcataaacctgttcgatacggcaaacgtctatgcgcacggacgcagcgaagaaatactgggacgttcactgaagaaccttggagtgtcgcgcagcgatgtcgtgatcgccaccaaagtcgcctccgccatgggtgacggaccaaaccatcgcggcgcgtcgcgggggcacataatttccgaatgccgggcaagcctcggccggctgggtctggaccacatcgatctataccagatccacgcattcgattccgcgacaccgatcgaggaaacgctggaggcgctcgacacactcgtgcgggccggcgacgttcgctacatcggcctttcgaactgggccgcgtggcagatcatgaaggcgatcgggataacacgcgccagagccctcgcaccaatcacgtcactgcaggcatactacacgcttgtcgggcgcgatctcgagcgcgagatcggcccgctgctctcatcggaacgtgttggcctcatggtctggagtccgcttgccggcggctatctcaccggaaagtattcagctgggggcaatgccgcaggcggtcgacagacggaattggattttccacccatcgatcgcatacggggagagcccctgatcgcggtcctgaaagctgtcgcggagaaacacggctccagcccggcgcaaatcgcgatcgcctggctgctgaagcaaaaggtcgtctcgaccgtcatcatcggtgcgaagcgcgtcgagcaattgcaggaaaacattcggtccgcatcgattgagctggacgataacgacatggcgaagctcgatgaggtcagtcgtctacccgtcgagtatccgggttggttgctgaatgacggaaacgga

SEQ ID NO: 35209 - DNA, 1086 bp, Agrobacterium tumefaciens
atgtcggataagaaatttcgtgtgggtattattggagcagacactcacgcaagttgggcaggcgcatcgcatgtgccagctctggcgtcacaagctcacctgacgctggcggcagtcgcgacccggcgcgaggaaagcgccagggcggcggctgaagcattcggcgcagagctatggtttgccgatccctacgcgatgatcagtgataaaaccattgacgtcatcacggtcgccgtgaaggtgccggcgcacaagaatctcgtgatggccgccttgcacgcgggtaaagccgtctattgcgaagcgcctctaggcgcaacgctggcggaaacaaacgagatggccgcagcggtcgggtctttgcataccgcgatcggcttgcaaggtcggcataatcctgccgtccgacgagcggcggaactagtcgcgtcaggaaagctgggtcgcttgatgtccgcccgtgtcggcgcaaccacattcggctacggtccgcaatctccgagcatgtacgactatttcaacaaggccgcttctggcgccagtttcatgacgatcacggcaggccacgtgctggacgtcatcgaggctgtgctcggcaacattaccgaggtcgatgcgcgcacggagttgctctggccggagatcgagatcgtcgatacaggcgaaacttcacagcgagaaattccggatcatctcgatctgatcgccaagacggcaagcggtgcgcctgtatctgtgcaggttctggcgggcgtgcctgcagatgaggcgagtgttgtattcgagatccgtggttcccggggctggctgaagctaaccggcaatcatctggcaggcgtacaagtcggagacattttactttcatcgagcgtggaattcgctgcgcccgatagaccggtcgccaacggtgtcggtccgaccgcggccgaattctggtcaggcgccgctatcaatgtcggggaggtctatgcgtccctggggcgcgatttgaggaatggtacatataccactcccggtttcgaccatgcccgccataacagccgtttgatcgcggccgtcgagcttgcggcaagaactggcgaacgg

SEQ ID NO: 35210 - DNA, 1404 bp, Agrobacterium tumefaciens
tggatcgacggcacctttgtctcgtcttccaaacgcggccgctccatcgatccggcgacatatgagacgatcggagattatccggacgatggcggagcggccgcgcagtctgccatcgaagccgcaaaacgcgcattccgcggaaccgcttggcgcgacgatgctgagcttcgggcaagggtgctcgaccagatggcttcggcaatcgagcgaaatcgcgagcgcctgatcgacatcctctcgcttgagaacggcaaactgctcggcgaggcggcgctggagatcgacggtagtccgagcaagcttcgatactgggctgctatggcgcgtacggaggcagggcgagcgaaatcgcccaagcccggcagcctctccgtgattctgcgacagccgatgggagtggcggggatcatcgtcccttggaattctcccgtcatattgtcggttcgttcattcgctccagcgctcgccgccggctgcacggtcgtcgtcaagatgcccggtcagacggcgcaggtcggcagtgttataaccgaggtccttgcggaagcgacagacctgccggaaggcgtcgtgaacatgttcgtcgagagcggtgcggacggcgctgcgcttctggttgaaagtcccgatgtgccgacgatcagcttcactggaagcacacagaccgggcgaaccatcggggctatcggtgcaaagagaatgaaacggttcgggctcgaactcggcggcaagaccccaatgatcgtgtttgacgatgccgaccttgaagccatgctgcctgttctcgaaaaggctctcaccatctttgctggtcagttctgcatgaccggctcacggctactggtgcacagttcgatctacgaactggtgcgcgaccgcctcgccgaaaggctgcgtgccgtcaaagtcgggccggcatcggacccagcgagcgatatggggccactcattgacaaggagaacgtcgcccgtgtcgacagcgtagtgaaagatgcgctgtcgaagggtgcaactgtggtcgttcgaggcggtcccgtgccagaaggccctttggcaaaaggtgcttttttccgtccttcgatgctggaggtattcgacaacagccttccgatcgtgcagcaagaaacgttcggtcccgtcataacgatccagcggttctcagatgagcgggaagccgtcgtgctagcaaacgataacgactatggcctgtccgcctcggtctggacgcgggatctggatcgctcgttacgggtcgcacaggcgcttgaagcgggaagcgtattcgtcaacgactgggccaaggtgtacgacgggacagaggagggtggctttaagcaatccggtctcgggaggctgaacggcgttgccgccatcgaggactttatcgagtacaagcaagtc

SEQ ID NO: 35211 - DNA, 747 bp, Agrobacterium tumefaciens
acgctgcagggccgtcgcgccctcatcactggcggcacttcgggggccggcgctgcaaccgtggcgctgttcaaggatctcggtgccagcgtattgaccaccgctcgtaagaagcctgccgacttcgcgggagcggcgttcgtcgaggccgacctgaccaccacggcgggggtaaagactgtcgtcgatgcggtgcagagagaactcggcggcctcgacattctcgtcaacgtgctgggcggctcttcggcgccttcaggtggttttgctgccctcacggacgaggaatgggagaaagagttcaaccttaactttttccccgcggtccggttggatcgggctctcgtccccggaatgatcgctcagggaagcggtgtcgtcatccacgtgacttcgatccagagaaaccttccgctaccggaggcgacgactggctatgcttcggccaagggagccctcaacacctacagcaaaagcgtctccaaagaggtttctccgaagggtgtgcgagtggtgcgcgtctctcccggctggatcgccgatccgggggcaaacggtctggcgctgcgcatcgccgaggaagcgggtatcgactacgccgccgcagtgcaggtgatcatgaactcgctcggcggcataccgctcggacgaccggcaaaaccggaagaggttgccgatctgattgcgtttcttgcatcggatcgagcagcgtctatcaccgggaccgagcatgtgattgatggcggg

SEQ ID NO: 35212 - DNA, 753 bp, Agrobacterium tumefaciens
atgaccaacagacttcaaaacaagatcgccgtcgtcaccggagcaaccagcggcatcggccttgcaacggccaaacttttcgctgtcgaaggtgcacgcgtctacatcaccggccggcgcaaggatgccctggacaaggcggtggccgagatcggccatggcgctgtcggcgtacaggccgactccgcaagtaacgaaaatctcgacaagctgttcgcccaggtgaaggcggagcaaggccgcctcgacgccctcgttgtgaacgccggtggcggcagcatgcttccgctcggccagatcaccgaggagcagatcgaccacaccttcggccgcaacgtgaaggctgtcatcttcacggtgcagaaggcgcttccgttgatgggcaagggcgcatccatcgtgctgaccggttcgaccgcaggcaccgaaggcacggccgccttctccgtttactccgcctccaaggccgccgtccgcaacctggcccgctcctgggcgcttgacctgaaaggcaccggcatccgcgtcaacgtcgtctcgcccggtgcgacacgtacgcctggcctcgtcgagcttgccggtgacgacaaggaacagcagcagggcctgctcgactatctcgcctcgcgcatcccactcggccgcgttggtgaatccgaggagatcgccaaggcaaccctgttcctcgcctctgacgacgcgagcttcgtcaacggcgccgaactcttcgccgacggcggccaggcccaggtc

SEQ ID NO: 35213 - DNA, 1440 bp, Agrobacterium tumefaciens
aagggcaaacgccttggcctgttcattgatggccgtttcgtcgagccccgaagcggcaaattcgtcgatagctacgatccaaccacgggcgaagcctggtaccaatttgcagaaggcggtgccgacgacgtcgatctggcgatatcctctgcacagcgtgccttccgtgatccgtcctggcggcgcatgacgcagaccgcccgcggtaagctagttcgccggctggccgatctcgtgctggaacatgctgaagatctcgctttgctcgagacgcgcgacaatggcaagctgatcaaggaaatgcgcgcgcaaatgcgggcaattccagactcctacctctattttgccggcatggccgataagctgcagggcgacacgatccccgtcaacaagctcgaccagctgaacttcaacatgcgcgagccgctcggtgtcatcggcatggtgaccccgtggaactcacctttgatgctgcttaccggaacgctcgccccgtgccttgcaatcggcaacacggtggtaatcaagccttccgaacacgcgactgcctccacactcgcgcttgcggaactgatcgtagaggcggggttcccggccggtgtggtcaatgttgtcactggcggtggcgcggtaaccggtgaggctttgacccgccacaacggtattgccaaattcgtcttcacaggtagcaccgcgactggtcggcgcatcgccgcgaacgcggcggccaacctggtgccatgccagatggaactgggcggcaaatctccgcatgtcgtgttctcggacgtcgacattgaaaagacggttaacggggtcgtctcgggtgtcttcgctgcagctggacagacctgcgttgcgggatcacgctgcttcgttgaagccaatatctatgatcggttcatcgaagcgctggtggagcgcacccgcaacatcaagctcggcgacccgatggatgacgcgaccgacatcggcccgctcgcactcgaaagccagctatcaaagctcgaggggtacgttgcctccggcgtccgcgaaggttcgcgcatcgcaatcggtggcaaacgtccgcaatcggaggaactgtcgaggggctggtacttcgagccgacggtgatggcggatgcaaccaacgacatgagcttcatgcgccatgagttgtttggcccgatggtcggggtcatgcccttttcctccgaagaggaaatgatctcgcttgccaacgatacgaattacggcctggcatcgggcatctggacgcagaacatcgatcgcgccatgcggttcgccaaccagatcgacgccggcaccgtgtggatcaacacctatcggtcggccgcttacatgtccgccaatggcggcttcaaggaaagcggttacggccgccgcggcggcttcgacgtgatgcgcgaattctctcgcgccaagaatgtcgtcatc

SEQ ID NO: 35214 - DNA, 1005 bp, Agrobacterium tumefaciens
atgaaagctgttgtcatgaccggggcgaaccagccttgggaggttcaagaggttcccgttccgaaggcagagccaggacttgtccttgttaaaatccacgcctccggcatgtgctacacggacgtgtgggcgacgcagggtgccggtggcgacatctatccgcagacccccggccatgaggttgtcggcgagatcatcgaggtcggcgcgggcgttcatacgcgcaaggtgggagaccgggtcggcaccacctgggtgcagtcctcttgtggacgatgctcctactgccgccagaaccgtccgttgaccggccagacagccatgaactgcgattcacccaggacaacggggttcgcgacgcaaggcgggcacgcagagtacatcgcgatctctgctgaaggcacagtgttattacccgacgggctcgactacacggatgccgcacccatgatgtgcgcaggctacacgacctggagcggcttgcgcgacgccgagcccaaacctggtgacagaattgcggtacttggcatcggcgggctggggcacgtcgccgtgcagttctccaaagccttggggtttgagaccatcgcgatcacgcattcacccgacaagcacaagttggccaccgatcttggtgcagacatcgtcgtcgccgatggcaaagagttattggaggccggcggtgcggacgttcttctggttacgaccaacgacttcgacaccgccgaaaaagcgatggcgggcgtaaggcctgacgggcgcatcgttctttgcgcgctcgacttcagcaagccgttctcgatcccgtccgacggcaagccgttccacatgatgcgccaacgcgtggttgggtccacgcatggcggacagcactatctcgccgaaatcctcgatctcgccgccaagggcaaggtcaagccgattgtcgagaccttcgccctcgagcaggcaaccgaggcatatgagcggctatccaccgggaagatgcgcttccggggcgtgttc

SEQ ID NO: 35215 - DNA, 717 bp, Agrobacterium tumefaciens
aagaccgtcatcgttaccggcgcaagccgaggaattggcaagggcatagcactgcgcttcggggaggccggcctgaatgtcctcgtcgtgtcgcgcagccaggtcgatgccgacagggtggcatccgaaatcggagtaaacggttcggggtttgcggcggatgtcagtacagaggagggctgcaaggcgatggtcgatgctgccgtaacccgctatggcggggttaacgtgctgtgcgcaaatgccggaatcttcccggcggcgaagctgggggaaatgtcggcggccgatttcgaccacgtgatctcaaccaatctcaaaagtacctttctcagcgtttccgcggtgttgccggcgatgacctcggccggtgcgggccgtatcatcatcacctcgtcgatcactgggccgatcaccggttatccgggctggtcgcattatggggcaagcaaggccggccagcttggcttcatgcgtactgccgcgattgagctggcgccaaagaacattacggtcaatgccgttatgccaggcaatatcatgactgaggggctcgagggcaacggtccagattatatcgccacgatggaggcctccgtgccattgcgtcgtctgggtatgccggcggacatcgcgaacgccgcgctgttttttgcatcggaggaggcagcctatatcaccggccagtcgatcgtcgtcgatggcggtcagatcctg

SEQ ID NO: 35216 - DNA, 1209 bp, Agrobacterium tumefaciens
gagcgcgttgccaagcgccaggcaacttttggagcttcctccgtactcttttatgagcagccgatcgagatggtgagcgcgcagggcgcctatctgtatgacgccggcggacgcaagtatctcgacgtctacaacaacgtaccgtcggtcggccactgccatccacgggtggtcgaggccatcgcccgacaggtcggcgaactcaacatccacacgcgctatctcaaccgcgtcgtcgaggcttacaccgaaaatctgctatccaaattcccggcaggcctcagcaatgtcgttttgacctgtacgggcagcgagagtaacgacctcgccctgcgcatcgcccgcattgggaccggggccgaaggcttcatcgtcaccgaggcagcctatcacggcaacactgcgctggtgacggaagtctccccctcgtcgctgcgcaagcgcaaacccgccgcatttgtggcaatcattccagcgcccgccgctcgtgatggcatgagcgtggcctcaaacttcgccgcgtccgtggaacaggcaatcaacgagctcaattcacgaggcattaaattcgctgcgttgatcgttgacacaatcttttccagtgacggcatctatgccgatcctgcaggtttcctgaaggaggcggttgacgtggtgcaccgagccggcggcctgttgatcgccgatgaggtccaaccgggcttcggccggacgggaggcagcctttggggcttcgagcgtcacggtgtcacgcccgacattgtcacgatgggtaagccgatgggcaatggcttccccatgggcggcgtcgtaacacgacctgacctgctccagaggttctgcgaggaaaccggttatttcaataccttcggaggcaatccggtagctgccgccgcaggccatgccgtgctgcgagtgattgaggaggaaggtctgatcgaacgctcggccactgtcggcggttacttcaagcagtcgctccaggctttgcaaagtcggcattcggaaatcggcgatgtgcggggcgccggccttttcatcggtcttgattttgtcgaccccgccacgggggagccggacagcacacgcgctacccatgcgatcaatcagttgaggcacaacagtatattgatcggggcagcgggcaaatatggcgcgacgctgaagatccggccgccactgtgtttttcgaacgaggatgtcgacctc

SEQ ID NO: 35217 - DNA, 1709 bp, Agrobacterium tumefaciens
ctgctcgacaagcctgttcagatgacaggtgggaaaatcctgttcaaagggcgggacctgcgaagcgcatcgcagaaagaattacggtcgatccgcggcaaccggatcgcgatgatctttcaggatccgatgtcgacactcaatcccgtgcttcgcatcgatacgcaaatgatggaagttgtgcatgcgcacgaaaacgtcagcaaacaggtcgcgcgggagcgtgcacgcgacgccttgggcatggtcggcattccaagtccggaggagcgcctgagcgcctatccgcatcagttctccggcggtatgcggcagcgagtggctatcgccatcgcgcttctcatgtcaccagacgtgatcattgcagatgagccgacgactgcgcttgatgtgacgatacaggcgcaaatcctctccatcgttcagaagcttgcgcgggaaaaggggacggctttgatatgggtcacccatgacctgtccgttgttgctggcctggccgagaaactgtcggtcatgtatgcggggcgtatcgtcgagcaaggcttaaccgccgatctactgagacgtcctctgcatccttataccaatggcctgatcgcaagcctgcccgcccataacaagcgaggtgaaaggctaaggcagatatcggggaccacgccctccgtcgccaatatgcccaaaggatgtgcgtttcacccgcgttgctcctttgccaccgaaatttgtctcaattctccggcgcttgagccgacagaagggcgtcttcttcgctgttttcaccccgtcatggaaggagcgccatcgtgagcaatcgtttggaagtgcgcaacgttagcaagcgcttcagccgtaaatccggcgtggttgaacgcggtgcggaactgatgggcctgaaagctccaaatcctgtcgtcggagcactggatgatgtcagccttaccgtttcagaacgcgaagtcgtgggcatcgttggtgaatccggctgcggaaaatcgacactgggtcgcgtagtggccgggttgctgcaagcttccgaaggttcggttctgtttcgcggcaagcaattggcggagatggacggcaaggcagcagaagacgcgcggctgaaagtccagatgatctttcaggacccatcgtcatcattaaacccgcgacagcgcgtgcgcgagatcatcggggcagcgccgcttcaccacaagatgacgagcgcccgtgagctggatgattatgtcagccagcagatggagcggtcagggcttgatccatccatggccagctggtttccgcatcagttcagcggcggccagcgccagcgcatcggcattgcgcgcgcgttggctgttcagcccgatatgttgatctgcgacgaatccgttgcagcgctcgatgtctcgatacaggcgcagatcctgaacctgttcctcgatttaagagagcaacttgatctcacctatctgttcatcagccacgatctctccgtggtcgagcacatatccgaccgcgttgtcgtcatgtatctcgggcgtgtcgtggaagaggcgccagttgcagaactgtttgcgcaccccaaccacccatacacgcgtgcgcttcttcaggaaagaccaagcctagatcccgttcaacggcgcttttcatccatagagggcgaaatcccaagcccgctttcgccgccgtcaggctgccatttccacccgcgctgtccgttt

SEQ ID NO: 35218 - DNA, 846 bp, Agrobacterium tumefaciens
cgacaccctaccccgccctatccggaacaacagcaggagccaccgggcaagacagccgagatgaaacccatcccggatcatggtgaacagtcctacgtgggtgacggtaagctgaaaggcagggttgccctcatcaccggagccgattcaggaattggcaaggctgtcgccattgcttttgcgcgagaaggcgccgacatcgtcatttcctacctcaacgaggacgatgacgcccgcgacactgcaaagtgggtaaaggaagccggccaaggagctttgttggtacccggcgacatcaagtctgaggaacattgcaagaatctcgtacatcgcgccgtcaatgagctcggtgctgtcgacattctcgtgaacaacgcagcgttccagcgaacctatgacgatatagccgacatcaccgccgaggagtgggacgaaacttttcgcaccaacatctatgcacctttcttcctgtcgaaagcggccgctccccacatgaaaccgggtagctcgatcatcaacacgacctcaattcagtcgcggcagccctcgcctcaacttctcgcctacgcttccacaaagggcgcgatatccaacttcactgcgggtctggcggaaatgctggcggaaaaaggtattcgcgtgaatgcggtcgcaccggggccgatctggacccctctcattccctcgaccatgcccgctgaaaaggctgccaagtttggagagaataccctcattggccgtgccgggcagccggcagagctcgcaggagcctacgtcctgcttgcttcggatctgggaagctacatgacgggagccgtcattcccgtgaccggcggcgagatcatg

SEQ ID NO: 35219 - DNA, 1419 bp, Agrobacterium tumefaciens
atgcggattcttgccgttacggccgaaatgtttcccttcgtcaaaaccggcggattggccgatgccacgagcgctttgccgcaggcgctggaacgaaaaggggctgacgttcggacattgctacccctctaccgcgggctcacgccgcttgtccgcggccggaagccggtcctggttgccaatattctggagcagccggtatcagtttattacgttgtttccgatggtcacaagcttctgcttcttgaagcggcaagcctgttcgacagagacggacatccctatggcgtaaaaggcgagccttttgctgacaacgatcttcgctttgcggttctgtccaaagtagcggcggaaatagccctcggcgcgattgacggctggcagccggatgttgtccatgtccatgattggcacgcggctctgacctgcgtctatctcgcggattcgacgccctcggtagcctccgttctaacccttcacaatctcgcatttcagggtcagtatccgctggagagggcgggtatgcttggactaccctcgcacctctgcactgtcgattgccttgaatattacgatgacatgtcatttttgaagggcggtctgacgaccgcgtcggcggtaacgacggttagtccaacttatgcaagagaaatccttacgccggaaatggggatgggaatgcatggcgtgctcgccaggcggcgaggggacctgcgcggcatcgtcaacggtgtcgatcacgacgtctggaatccggcaacagatccgtacattctcgcaaatttcacggctgccacggcgacaagacggagcctcaacaaatatgccttgcttcaggcccttggcctagcccctacccagggccctgtcttcggcgtggtcagtcgcctgacctggcaaaagggaatcgatctcctccctcacgtcgtaccccttataatagaaaggaaaggcaggctgatcgttcacggagagggagatacggcactggaagacagcttgcaggcgctggcaaagcgctatccggaactagtctgcgcccatatcggctatgacgaacggctggcgcacatgatccaggccggctcggatttcatcatccagccgtcacggttcgaaccctgcgggctgacgcagctttacgcgctgcgatacggcgcgctgcccatcgtcagccgcacgggcgggctggcggaaaccattatcgacgcgaatgacgcggccattgaagcgggcgtagcaacaggctttcaattcgagccggcgaatgaagacgatctgcgcgccgcgctggagcgtgccattagcgcctataacgaccgggaacttttccgacggcttcagacgcaggccatgcaggccaatttttcctgggacaagagtgccgcacaatatatggcgcttttcgagagccttgtc

SEQ ID NO: 35220 - DNA, 915 bp, Agrobacterium tumefaciens
atgacaaagtggaccgaagccaacatcccaaatcagcgcggacgatccgccgtggtgacgggaacaggtggattgggtctggaaacggccctggcgctagcccgcgcaggatgcgacgtgaccatagccggccgcaatcctgaaaaaggtagcgacgccgtatcgcgcattcaacgtgccgctccccatgtaactgtaagcttcgagaagctcgatcttgcggatctcacctctattgccttgttcgcacagcggatggagaacgacagggagagtctggatctgctggtgaacaatgccggcatcatggtgccaccgaagcggcaggaaactcgtgacggcttcgagttgcagttcggtacgaactaccttggccatttcgcgttgaccgctcatctgatgccactgctaaaaaaaggaacggacgcgcgcgtcgttaccgtgtctagcgtcgcagctcgcgctgggaagatcaatttcgccgacatcaattcggaaaagaactatcatccaatgcgggcctacagccagtcgaaactcgcatgcttgatgtttgcgctcgagctgcaagatcgaagccgagcagcagggtggggtgtttcaagcatcgcggcacatccgggagtctctcggaccgatctcctgcacaatgcacccggccgaaatagcttgcagggtttggcgcgaacttttctctggtttctgtttcagcccgtcgcacaaggcgcgttgccgcagctattctccgccacgtcgaaggaggtgaaatcaggcggttattacggtcccgatcgccttggtgagacacgcggacatccgcaaccggcacgcatcccgccagaggctctcgatcgcgtcgccggtaagcaactttgggagatctcccaacgcatgaccggactctaggaatatcct

SEQ ID NO: 35221 - DNA, 1296 bp, Agrobacterium tumefaciens
gtgtctctcaacaacgaacagagcttctggaatcaagcaaacaggcacctgacgcgatacgggccaagcttcgagagcatcatcgtcgagcgtgcgagcggaagctacgtctatgacgccaacgaccgccccatattggactttacgtcgggacagatgagcgccctcctcggccatacccatccggacatcgttgcgacagtcgatcggcagatgcgctcggtcgcacatctcttcagcggcatgctctcgcgtccggtggtggaactagcgtcgcgccttgcggcgctcgcaccaggtctcgatcgtgtgcagctgctgacgacgggagccgagtccaacgaggctgccattcgcatggccaaacttgtgaccggcggccatgaagtggtcgccttcgcgcagagctggcatggcatgaccggcgccgccgccgccgcgacctatagcgcggggcgtcgcggatatgggccggtggctgcaggttctctggtgatccccgcacccaactcttatcgtcctcgcttcgcaaagccggatggcacgaacgattggcaaaccgaactggatgatgctttcgcgctcatcgataatcagtcgactggtagcttggcagcgttcatagccgaaccgattctctcgagcggtggaatcctggaacttccggcaggttatctggctgcgctcaaactaaaatgcgaggagcggggcatgcttctcatcctagatgaagctcagaccggcgtgggcagaaccgggcacatgttcgcgttccaaagggatggcgtcactcccgatattctgacgctctcgaaaacactcggtgccggcttgccgctggctgcggtgatgacgaccgaggctatcgagcagaaggccttcgagaagggatatctgttctacaccacgcacgtctctgatccgcttctggccgcagtcggcgtcactgtcctggacgttgtcgagcgagaaggccttctcgctgctgcaatcgggcgtggcgcaaggttgcgggccggacttgtctcccttcaacagagattcgaatgcgtgggcgatgtgcgcggccgcggccttctgatgggtctggaaatcgtcgcggaccggcagacgaaagcgcctgggttcgctctcggtgctaaaatcatggaagaggcgatgcggaggggactgagcatgaatatcgtcaagttgcccggaatgggcggtgtgtttcgcatcgcgccgccactgacagtttcagacgaggaaatcgaccacggtatcgagatcatgtccgattccattcaggctgcc

SEQ ID NO: 35222 - DNA, 891 bp, Agrobacterium tumefaciens
cctcaggttctcgccttcatccgcaaaacagaagccagctatccagcgcaggccaacacggcgagcgccgcggaaaaccgcgcctactacgatgcgatgtgcgctgatttccgagcacctcgaccagagaatgtcatcgtcgttgatcggtcgatcagcggcgtggcttgtcggttatacggtttggcatcacctgtttgcgtcctctatctgcatggcggcggccttgtcgtgggcgggctggacagccatgatgacgtctgtgtggaaatcgctgatgcaaccggcttgcagatcatttcggtcgattaccgtcttgcgccggagcaccggtggccggcacagataaacgacgttgaagcggtttggcgcgcagtggatcagcctgttgttgtcgtcggtgacagtgccggcggcttgctcgctgcagcactttgcctttcgcagaaaggcaagaggcagccgctgggccaggtcctcatctaccctggcctgggtggtgacggagatgcagcgtcctatcgcgaaaacgctgaagccccgctgttgcgcgcgagcgacgtgctgacctaccgggactttgtcttcggtggccagcccgcaaccgatcccatcgcccgacctttaaaggctccggatctttcagacctcgcgcctgcttttgtcgttacagcggatgtggaccccttgcgtgacgacgggtgggcttatgccgagcggctggcggcggcgggtgtcccggtaacgttgcgcaacgaggctcaattgcctcacggtttcttgcgcgcgaggatcatgagcgaccgtgcgcgccggagttttcaagccgtgattgcggcgatcagccggttcgcatctaatgaggtccctttagcaaattttccccatgag

SEQ ID NO: 35223 - DNA, 951 bp, Agrobacterium tumefaciens
atgcaacccatggatcttcgcggcctgagcccggcacccgtcaccgcgttcacgcgggatggcgaggtcgactatgcagccaatgccaaaatcgctagatggctcgcctcgatggaaggcgtaaagagcctggtcattctcggccacgccggcgagggcacgttcctgaccgaagacgaacgcctcgaactcatccgcgtttacgtcgatgccgttggcggttctctccccatcatcgccggtattaccggtgaaggaacccgcgtggctgctgcagaggccaagaagtgcaaggccgctggtgccaccggtgcgcttgtttatccaaaccacggctggcttcgtttcggtttccagagaggcgctccgcaggaccgctacaaggcgatctgggaagaatcgggcctgcaggaaatcctgttccagtatcctgacgtgaccaaggcgtcatatgaccttgatacgcagcttgcaatcgcaacccagcccggcgtcgttgcgacgaagaacggcgtgcgcaacatgaagcgctggtatgtggaaatcccggaactaaagaacgccaatccgaacctccaggtcctcagttgccatgacgagtggctgctgccgacgatgtttgatgtcgacggtctacttgttggctatggcaatatcgcgccggagcttctgattgatctgatcaaggcgggtaaggctcaggactatccgcaggcgcgaaagattttcgaacagctgctgccagtcacccgtgcggtctaccaccgcggctcgcatatggagggcacagtcgctctcaaactcggccttgttcaccggggtgtcctcgatcatgcgacgatccgcgagccgctgaagaacctcggcgagaaggcggaacaggaaatcttcgcagccttcgacgccgcaggcattggccgggtcgaggagttgctggccgccgccgaatga

SEQ ID NO: 35224 - DNA, 1383 bp, Agrobacterium tumefaciens
atgtaccagttcgatctgattgttgtcggcagcggtccggcgggaagacgggccgccatccaggccgccaagctcgaaaagaaggttctggtcatcgagaaaggcagccgtgtcggcggtgtttccgtgcataccggcaccatcccgtccaagaccctgcgcgaaaccgcgctcaatctcaccggctggcgcgagcgcggtttttacggccgtgcctatcgcgtcaagcaggagatcgacgccgacgatctgcgccgccgtctgctcatcacgctcgatcatgaagtcgaggtgctggagcatcagttcgcccgcaaccgcgtgcagcacattcgcggcacggcaagcttcatcgacgccaacacgatgaaagtcgtgaagagcgacggtgaagtcatgaccgtcactgccacctccattctgctcaccatcggcacccggccctaccggccgccgcatattcccttcgatggccaggcggtgctcgattcggatgagattctcgagatcaaggaattgccgcgctccatggtcgtcgtcggtgccggcgtcatcggcatcgaatatgcgacgatcttcagcgcactcgacacacaggtaacggtggtggaaccacgcgagaccatgctggaattcatcgataaggaaatcgtcgaggatttcacctatcagctgcgcgaccgcaacatgaagctgatcttcggccagaaggcggaaaaggtggagcgcgacgaaagcggcaaatgcctcgtttcgctcagcaacggccgcgtcctgaaagccgagaccgtactcttcgccgccggccgcgtcggcgccaccgatacgctcaatctttccgcctgcgggctggaggccgacagccgtggccgcctgaaggtcgatcccgagaccttccagacctcggtgccgaacatctatgccgccggcgacatcatcggtttcccgagccttgcctccacgtcaatggaacagggccgcatcgccgcccgccatgccgtcggcgcaccggccggcgagccgccgcaattcttcccctacggcatctatgccgtgcctgagatctccacctgcggcctgacggaagaggaagttgttgaacgcggcattccctatgaatgcggcatcgcccatttccgcgaaacctcgcgcggccacatcatgggcctcgacagcggtctgttgaagatgatcttctcgctgaaaacccgccgcctgctcggcgtccacatcgtcggcgaaggcgcgacagaactggtgcatatcggccaggcggtgctaaacctcaaaggcacggtggaatatttcgtggagaatacgttcaactatccgacgctggcagaagcctacaagatcgccgggctggatgcgtggaaccgcatg

SEQ ID NO: 35225 - DNA, 1125 bp, Agrobacterium tumefaciens
atggacgttcgcgccgccgttgccattcaggcaggaaaaccgctcgaggtcatgaccgttcagcttgaaggtccccgcgccggtgaagtgctgatcgaagtcaaggcgaccggcatctgccacaccgacgatttcaccctctctggcgctgacccggaaggcctgttcccggcaatcctcggccatgaaggtgcgggcatcgtcgtggatgtcggccccggcgtcacctcggtcaagaagggcgaccacgtcattccgctctacacgccggaatgccgcgaatgctactcctgcacctcgcgcaagaccaatctctgcacctccatccgcgccacccagggccagggcgtgatgcctgacggcacctcgcgcttctcgatcggcaaggacaagattcaccactatatgggttgctcgaccttctcgaatttcaccgtcctgccggaaatcgcgctggccaagatcaacccggacgcgcccttcgacaaggtctgctacatcggctgcggcgtcacgaccggtatcggcgccgtcatcaacaccgccaaggtcgagattggctccacggcgatcgtcttcggtctcggcggcatcggtctcaacgtgctgcagggcctgcgtcttgccggtgcggacatgatcatcggcgtcgatatcaacaacgaccgcaaggcctggggcgaaaaattcggcatgacccacttcgtcaatccgaaggaagtcggcgacgacatcgtgccctatctcgtcaacatgacgaagcgtaatggcgacctcatcggcggcgcagactatacgttcgactgcaccggcaataccaaggtcatgcgccaggcgctggaagcctcgcatcgcggttggggcaagtcggtcatcatcggcgtcgccggcgccggccaggaaatctccacccgtccgttccagctggtcaccggccgtaactggatgggcaccgccttcggcggcgcgcgcggccgcaccgatgtgccgaagattgtcgactggtacatggaaggcaagatccagatcgacccgatgatcacccacaccatgccgctcgaagacatcaacaagggcttcgagctgatgcacaagggtgaatcgatccgcggcgtcgttgtttat

SEQ ID NO: 35226 - DNA, 1167 bp, Agrobacterium tumefaciens
accccgtgttttctctatgataacagcgccatgcgccaagcctatcgcgatctcgaaacggcgctttccggttttgccgatatctattattcggtgaaggccaatcccctgcccgccatcatctcacttttccgcgaagaaggcgccggcgcggaaatcgcctccgttggcgaatatcgcgccgctgtaaaggccggcgtcgcgcctgataacatcatcttcgccggccccggcaagagcatggccgaattgcgcgaagtgatcgagggcggtatcggtgaaatccacatcgagagtgcggaagaaatcgcccgtatcgaggcgatcaacaggccggtcaaggcgtcgatccgcatcaatccggtgccggatgcgcaggcgggcgccatgcgcatgggcggcaaggccacggccttcggtttcgacgaggaggaactggaaaacgtcctgaagctctttgcgaacgtcagacatatcgatctcgttggtatccatatttacggcggcacgcagatcctcgatgccgacatgcttgtctcccaatggcgacacgccatcgctcttgcaggtcgcatggcgcaaatgctcggcaaaccgctcgaaaccatcgatctcggcggcggcctcggcattccctatttcgccggggaaacatcgctcgatctcgccaaggtggctgccgccattcccgatctcaaggcgcttctaaaggcgcatccgctgatcgccgatgcccatgtcatagtcgaacccggccgcttcctcgccggccctggcggcctctatgtggtagaggtcaactcggtaaagacctcgcgcggcaccaccttcgtggtcacggatggcggcatgcaccaccacctggcagcctccggcaatctcggccagatcgtcaaacgcaactaccccatcgtcgcaccggccatgatgcaggcggcacacgatgagacagccaccatcgtcggcccgctctgcaccccgctcgatacgctcgcccgcaatgcgaccctgccgaaactgaacgccggcgatctcctcgccatcctgcaatccggtgcctatggcgcgagcgccagcccaggcggttttctcagccatacggtagcgaaggaagtgctggtggaggatggtgcgtttgaggtgatcgggcgctgagagagttgcgac

SEQ ID NO: 35227 - DNA, 612 bp, Agrobacterium tumefaciens
ctcgttctccgtctgcggggcgaggggatttccgatctcgacctgttgacggcggttgagcagacgccgcgttccaaattcgtgccgccgcaatttgcggccgacgcctattccagccgcacgatcccgatcgactgcggttccttcatggaaggcgccgacatggcggtgaaaatccttgcccgcctgcagctgaaacccggccagcgcgtgcttgagatcggcaccggcagcggttttatgacggcgatcatcgcgcgccgggtggagcgggtgttttcgctggagcgttacaagacgctggtgcagcaggcgcagaactgtctcgacgatctgtccatccgcaacgtcgtcatccgccaggcggatggcagcaatggtctggtgggcgagggcaccttcgaccggattgtttccaccgccgcctttaccaccatgccccgcttctttgccgagcagatcgtttccggcggcatgatgatcgcgccgatcatcctggaagatgagcgttgcgtgatgacccgcttctccaagaccggcagccgcttcgagaaggaagagctgttcgagacgccgtatctgccactcggcagccatattgcgcggcatttg

SEQ ID NO: 35228 - DNA, 762 bp, Agrobacterium tumefaciens
atgaagattgccacctggaacatcaatggcgtcaaggcgcgtatcgaaaacctctgccagtggctgaaggattcctcgcctgacatcgtctgccttcaggaaatcaagtcggtcgacgagggtttcccccgccttgagatcgaggcgctcggttatcacatcgaaacccacggccagaagggttttaacggcgtcgccctgctctcgaaggtgaagccggacgaggtcaatcgtggcctgccgggcgatgatgccgatgaacaggcccgtttcatcgaaggcgtgttttccgtggaaggcggcgcgatccgcgtctgctcgctttacctgccgaacggcaatccgcctgacgatccggtcaaatatccctacaagcttgcctggatggagcgcctgcggcgctttgcggaagatcgccttgcaatggaagagccgctgatcctcgccggcgattacaacgtcatccccgaacccttcgattgccacgacccacgcgtgtgggaaggcgacgcattgttcctgccgaagacccgggcggccttccgcaaactggaaaatctgggcttcactgacgccgcgcgtgcgacgaccgacgcggcaggactttattccttctgggattatcaggccggcgcctggccgaaaaacaacggcatccgcatcgatcatctgatgctgtcagcggaagcagccgacaggctgcaatcggtcgagatcgaaaaacatgtgcgggcctgggaaaaaccgtccgaccatgtgccg

SEQ ID NO: 35229 - DNA, 558 bp, Agrobacterium tumefaciens
gctcgcccaagccaggccgaagcggaagaagccgtgcgcgttctcctgcgctgggcaggagaaaatcccgcccgcgaaggacttctggatacgccgaagcgcgtcgccaaggcctatcgcgagctttttgccggttatgagctgaatgttcaggacgtgcttggcacgaccttcgaggaagtcggcggttatgacgatgtggtgctggtgcgcgacatccccttcttctcccattgcgagcaccatatggtgccgatcgtcggcaaggcgcatgtcgcctatcttccggccggccgtgtgcttggcctgtcgaagatcgcccgcgtcgtcgaaatcttcggccgccgcctgcagacgcaggaaaacatgacggcgcagatcgcaagatcgatcgaagaaacgctgaaaccgcgtggcgtagccgtcatgatcgacgcggaacatatgtgcatgtccatgcgcggcgtaaacaagcaagggtccacgacgctgaccaccagcttcaccggcacgttcaagaacgatccggccgagcaggtgcgcttcatgaccatggtg

SEQ ID NO: 35230 - DNA, 1824 bp, Agrobacterium tumefaciens
atgtgcggaattgtcggaattgtcggaacccagcccgttgctgaacggcttgtcgatgcgctgaagcgcctcgaatatcgcggttacgattcggcgggtgtcgccaccatcgacaatggcgcgatggaccggcgccgggcggaaggcaagctgttcaatctggaaaagctggtttcggaaaagccgctgccgggtgtcgttggcattgcgcatacgcgctgggcgacccacggcgttccgaacgaaatcaacgcccacccgcatttcgttgacggcgttgccgtcgtgcataacggcatcatcgaaaacttctccgaattgcgcgaggaactgagcgccgagggtgcaacctttaccacccagaccgataccgaagtggtggcgcagcttctggcgaaatacacccgcgaggggcttggccatcgcgaagcaatgttgaagatgctgaaccacgtaacgggcgcctatgcgctggtcgtgatgtttcaggacgatcccggtacgctgctttcggcgcgctccggcccgccgcttgcggttggttacggcaggggcgaaatgttcctggggtccgacgcgatcgcgctttcgcccttcaccaacgagatcacctatctggtcgatggcgactgcgccatcgtgacccgggacggcgcggaaatcatcgatttctccggcaagccggtgaaacgcgagcgccagatttcgcaggcgacggcttttgtggtcgacaagggcaatcaccgccatttcatggaaaaggaaatctatgagcagccggaagtcatttcccacgcgctcagccactatgtggatttcgccaccaggaccgtgaaggacgccgataaggcgattgattttgccagcctttccggccttgccatctccgcctgcggcacggcctatctgtcaggcctgatcggcaaatactggttcgagcgttatgcccgcctgccggtggaaatcgatgttgcctcggagttccgttaccgcgaaatcccgcttgttcccacgcaggcggcgctgttcatttcgcaatctggcgaaaccgccgatacgctggcggccctgcgttattgccagcaggagggtctgaagatcggcgcggtggtcaatacccgcgaatcgaccatggcgcgcgaatccgatgcgatctttccgatcctcgccgggccggaaatcggcgttgcctccaccaaggcctttacctgccagcttgcggtgcttgcttcgctggccgttgccgccggcaaggcgcgcggcacgctgaaaccgggtgaagaaaagcagctggtgcagcagctgatcgagatgccgcgcatcatgagcaaggtgttgaacgtcatccagccgcagatcgaggcgctgtcgcgtgacctgtcgcgcttcaaggatgtgctttatctcggccgtggcaccagcttcccgctggcgctggaaggcgcgctgaagctcaaggaaatctcctatatccacgctgaaggttacgccgctggcgagctgaagcatgggcctatcgcgctgatcgacgagaacatgccggttatcgtcattgctccgcacgaccgcttcttcgaaaagaccgtgtcgaacatgcaggaagtagccgcgcgcggcggccgcatcatcttcatcactgatgagaagggtgctgccgcttccaagctcgaaaccatggcgacgatcacgctgcccaatgtcgatgaactgatcgcgccgatggtcttctcgctgccgatccagctgctcgcctatcacaccgccgtcttcatgggcacggatgtggaccagccgcgcaatctggcgaaatcggtgaccgtggaa

SEQ ID NO: 35231 - DNA, 1335 bp, Agrobacterium tumefaciens
ttctctgatcttggcctgagccaaaaagttctttccgctattgcagatgccggctacacgacgccgacacccattcaggccggcgccattccgcccgcgctggaaaagcgtgatatctgcggtatcgcacagaccggcaccggcaaaaccgcgtccttcgttctgccgatgctgacgctgctcgaaaagggccgcgcacgcgccagaatgccgcgcacgctgatcctggagccgacccgcgagcttgcagcgcaggtggcggagaacttcgaaaaatacggcaagaatcacaagctgaacgttgccctgctcatcggtggtgtttccttcgaagaccaggatcgcaagctcgagcgtggcgccgatgtgctgatctgcacccccggccgccttctcgaccattgcgagcgtggcaagctgctgatgaccggcgtggaaattctcgtcatcgacgaagccgaccgcatgctcgacatgggcttcatccccgatatcgagcgtatcgccaaaatgatccccttcacccggcagacgctgttcttctcggccaccatgccgccggaaatccagaagctggctgaccggttcctgcagaacccgacgcggatcgaggtcgccaagccatcctctaccgcaaagacggtaacgcagcgtatcgtcgccgcgcataataaggactatgaaaagcgcgccgtgctgcgcgatctggtccgtgccgaagaagcggaactcaagaacgccatcatcttctgcaatcgcaagaaggatgtcgccgatctgttccgttcgctggatcgtcacggcttttccgttggcgcactgcatggtgacatggatcagcgctcgcgcacgacgatgctgcagaacttccgggatggacagctgacgctgctggtcgcttccgacgttgcagcccgcgggcttgatatccctgatgtcagccacgtcttcaacttcgatgttcccatccatgccgaagactatgtccaccgcatcggccgcaccggtcgtgccggccgttcgggcaaggccttcactctcgtcaccaagagcgacgcgaaatatctcgacgcgattgaaaagctgattgccgaaaagatcgaatggctgagcggcgatctgtcctccctccccgcgcccatggaaagctttgaaagcaattccggccgccggggcaccaaggaacgtagcggcagaggccgcgacagaaaccgtcgcgatgcacctgcatcgccggtggaaaacatcaatcaggacgcacaatccgtagtggatacggacatcgcggctcacggagaagacaaggtgaaggcagaacgcagaccggaaaagacc

SEQ ID NO: 35232 - DNA, 1293 bp, Agrobacterium tumefaciens
atgatccctcgttactcccggccggaaatggtcgccatctggtcgccggaaacaaaattccgcatctggttcgagatcgaggcccatgcctgtgacgcgctggccgagcttggtgtcatcccgaagtcagcagcccagaccatctgggaaaagggcggcagcgccacgtttgacgtcgcccgcatcgatgagatcgaggccgtgaccaagcacgacgtcatcgccttcctcacccatctcgccgaatttgtcggccccgacagccgttttgtgcatcagggcatgacctcttccgacgttctcgacaccaccctcaacatccagctcgtgcgcgccgccgatctgctgctcgccgacatcgaccgggtgctcgcggctctcaagacccgcgccttcgaacacaagaacacggtgcgcatcggccgcagccacggcatccatgccgagccgaccacgatgggcctgacctttgcccgcttctatgccgagatgcaccgtaaccgcgagcgcctcgttaatgcccgtgcggaaatcgccaccggcgcgatctccggcgccgtcggcaccttcgccaatatcgacccgcgcgtcgaggaacatgtctgcgaaaagcttggtctcatccccgagccggtctccacgcaggtcattccgcgcgatcgccacgccatgttcttcgccgttctcggcgtcatcgcctcgtcgatcgaaaacgtcgccatcgaaatccgccacatgcagcgcaccgaggttctggaagcggaagagttcttctctcccggccagaagggctcgtccgccatgccgcacaaacgcaacccggtcctgaccgaaaacctcaccggtcttgcgcgtctggtgcgcatgtccgtcgtgccggccatggagaacgtggcgctctggcacgagcgcgatatcagccactcctccgtggagcgcgccatcggccccgacaccacggttacgctggatttcgcgctgaaccgcctggccggcgtcatcgagaagctggtgatctatcccgacaacatgttgaagaacatgaacaagttccgcggcctcgtacattcgcagcgcgttctgctggcgctgacacaggccggtgtttcgcgtgaagacgcttaccgtctggtacagcgcaacgccatgcgggtctgggaacagggtgccgatttcctggaagaactgctgggcgacgaggaagtgcgcgcagcgctgcctgaagacgtgatccgtgaaaagttcgacctcggttatcataccaagcacgtcgacacgatcttcacccgtgtc

SEQ ID NO: 35233 - DNA, 1209 bp, Agrobacterium tumefaciens
atggcaaagatcaaggtagccaatccagtcgtcgatctcgacggcgacgaaatgacccgtatcatctggcagctcatcaaggacaagctgatcctgccatacctcgatctcgacatcgaatattacgacctctcggttgaaaaccgcgatgccaccaacgaccaggtcaccgtcgatgcggcacacgccatcaagaagcatggcgtcggcatcaagtgcgcgacgatcacgccggacgagcagcgcgtcgaggaattcggcctgaagcagatgtggaagagcccgaacggcacgatccgcaacattctcggcggcgtcatcttccgcgagccgatcatctgcaagaacgttccgcgcctcgttcccggctggaccaagccgatcgtcgtcggccgtcacgcctttggcgaccagtacaaggcaaccgatttcaagttccccggcaagggcaagctgacgatcaagttcgtcggtgaagacggcacggtcatcgaaaaggacgtcttcgacgccccgagcgccggcgtggcactcgccatgtacaacctcgacgaatccatccgcgaattcgcccgcgcctcgatgatgtatggcctgatgcgcaagtggccggtttacctctccaccaagaacaccatcctcaaggcctatgacggccgcttcaaggatatcttcgaagaagtctaccagaccgagttcaaggcaaagttcgacgaagtcggcatcacctacgaacaccgcctgatcgacgacatggttgcctcggcgctgaagtggtccggcggctacgtctgggcctgcaagaactacgatggcgacgtgcagtccgacacggttgcccagggcttcggctcgctcggcctgatgacctcggttctgctgtcgccggatggccgcaccgtcgaagccgaagcggcgcacggcacggtgacgcgtcactaccgccagcaccagaagggtcaggaaacctcgaccaactcgatcgcctcgatcttcgcctggacccgtggcctcgcccaccgcgccaagctggatgacaatgcggaactggcaaagttcgcgacgacgctcgaaaccgtctgcgtcgacaccgtcgaaagcggcttcatgaccaaggatctggccctcctcatcggaccggaccagccctggctctccaccaccgccttcctcgacaagatcgacgaaaacctcaagacggcgatggcg

SEQ ID NO: 35234 - DNA, 906 bp, Agrobacterium tumefaciens
aagaaaatactcgttctgggcggcgcgcatatcgacaggcgcggcatgatcgagaccgagacggcgcccggcgccagcaatccgggctcgtggatggaagaggccggcggcggtggtttcaacgccgcgcgcaatctttcccgcctcggttttgaagtccgcatcatcgccccgcgcggcggcgacgtcaccggcgaagtggtggcggaagcagcaaggcaggcgggggtggaagacacgccgtttaccttcctcgaccgccgcacgccgagctacactgccattctggagcgtgacggcaatctggtgatcgcactggccgacatggacctctacaagctctttaccccgcgccgcctgaaggtacgcgcggtgcgcgaggcgattatcgcaagcgactttctactctgcgatgccaatctgcccgaggatacgctgacggcgcttggcctcattgcccgcgcctgcgaaaagccgctcgccgccatcgccatttcgccggccaaggcggtgaagctgaaagcggcgctcggcgatatcgacatcctcttcatgaacgaggcggaagcccgcgcgctcaccggcgaaacggcggaaaatgtccgtgactggccaaatatcctgcgcaaggctgggctttccggcggcgtcgtcacccgcggcgcaagcgaagtcgtggccttcaacgggacggaaaaagccatcctccacccgcccctcatccgcgaggtgaaggatgtcaccggcgccggcgatgccatggcctccggttatctcgccgccattgccgagggaaaaacaatcagggaggccctgagacagggggcggcggcggcggccattaccgtgcagtcatccttcgccacctcccaggacctatcaaaagacagtgtcgaagccatgttg

SEQ ID NO: 35235 - DNA, 759 bp, Agrobacterium tumefaciens
aaactgttcgatctttccggtcaggtggcgctcgtcaccggtgctggatccggcatcggccagcggatcgccatggggcttgcccagtccggcgccaatgtcgcgctgctcgaccgccgcaccgatgacggtctggcgcagacggccgatttcatcgccagggccggccgcaagtcgatccagatcgccgccgacgttaccagcaagcaggcgctgacggatgcggttgcccgcacgcaagccgaactcggcgcactttcgctcgccgtcaatgcggccggcatcgccaatgccaatccggccgaggagatggaagaaagccagttccagacgatgatggacatcaacctgaagggcgtgttcctgtcctgccaggccgaagccaacgccatgctgaaaaatggccgaggtgccatcgtcaacatcgcgtcgatgtccggcgtcatcgtcaatcgaggcctgatgcagtgccattacaacgcctcgaaggcgggtgtcatccacatgtcgaaatccatggcgatggaatgggtgggtcgcggcatccgcgtcaacaccatctcgccgggctacacggcgacaccgatgaacacgcggcctgaaatggtgcaccagaccaagctgttcgaagagcagacgccgatgcagcgcatggcaggcgtcgatgaaatggtgggaccggcgatcttcctgctgtccgacgccgcgagttttgtgacgggtgtggatctcttggtggatggcgggttctgctgctgg

SEQ ID NO: 35236 - DNA, 1739 bp, Agrobacterium tumefaciens
caggagctagagcgcattgcgcgccagattcgccttcgcgacgtacaggctgtttttgaagcgggtgcgggccatgtcggcggcgaaatgtcggccatcgacatcatgacggccctttatttccgcgtcctgcgcatctggccgaatgatccgaagaaccctgcccgcgaccgtttcgtactttccaagggccacacagcctgcgcgctttacgtgacgctggccaagcgcggtttcattccggaagaggaaatctcgaccttcctgcagccgaattcgcgcctcaacggccatcccaactgcaacaaggtgccgggcgtcgaaaccaataccggcccgctcggccacgggcttcccgtcgccgtcggcatggccacggcggccaagctgtccggcgaggattaccacacctacgtgatgaccggcgacggcgagatgcaggaaggctccaactgggaagccatcatgtcggcggcgcaattcaagctgaacaatctgacgctggtcatcgaccataaccgtttccagcagggcgccgccattgccgacaccaacgatgtcgcgccgcttcgccccaagcttgaggctttcggctgggaagtgactgaaatcaacggcaacgccatggcggaagtcgttccggcgctggagcatcgcggcaaccgcccgcattgcatcgtcgcccacaccaacaagggtcacggcatttccttcatgcaggaccgcgtcgactggcatcacaaggttccgagcaaggaacaatacgagattgccgtcaaagaactttcggaggcattgtaatgaacgcgcccgtaaccgccgccaaactgtatgattgccgcgacgccttcgccgaaacgctggaagcgctggccgccgccaatgacaaggtcgtcgccgtctgcaacgattcggtcggctcctcgaagctcggcggcttcaaatcgaaattccccgagcgcctcgtcaatgtcggtatcgccgaacagaacatggtcggcgtcggcgccggtctcgccaatggcgggcaattgcccttcgtctgcggcgcgtcctgcttcctcaccggccgcgcgctggagcagatcaaggctgaccttgcctattccaacgccaatgtgaagctgatcggcatatcctcaggcatggcctatggcgaactcggtccgacgcaccattccatcgaggatttcgcctggacccgcgtcctgccgaacctgccggtcatcgccccctgcgaccgcatcgaaaccgctgctgccgtcaaatgggcagcggactatgccggcccctgcttcctgcgtctgtcacgcgtcggcgtgccggaccttctgccggaaggccacgtcttcgaactcggccgcgccaatctgctgcgtgaaggttccgacctgacgctgatcgccaacggcacgctgacccaccgcatcgtcaaggccgccgatattctgttgagccgcggcatcaaggcgcgcgttctgaacatggcgaccgttcgccccatcgatgaagcggccattatcgctgcggcgaaggaaaccggcgcaatcctgacggccgaagaacattcgatcttcggcggcctgggttcggccatcgcggaagtcgtggtcgaccattcgcccgtgccaatgaaacgcctcggcgttcccggtgtcttcgcccataccggctccgccgaatggctgctcgatgagttcggcatggcacccacagccattgccgacgcagcgcaggcg

SEQ ID NO: 35237 - DNA, 1407 bp, Agrobacterium tumefaciens
atgcgcgctattctgtccatcgatcagggcaccaccaattccaaggccatactcgtctcggaaagcggagagttgctcgcgcgcggctcatcgccggtcggcattacctatccgcagcccggctgggtggaacaggacccgaaccgtatctgggcctcggtccgtgaagcgatctccgcctgcctcgcagccgcaccctccgacgtcagcgtcgaagccatcgccatctcaaaccagcgcgaatcggtcacaatctgggacggtgaaaccggcgagccgcttggcccggtgctaagctggcaatgccgccgcaccgcacaggactgcgcagacctgatcgcaaagggacaatcagaacgcgtcatggccctgaccggcctgccgatcgacccgatgtttcccggcgctaagatgcgctggctgctggaacgggcgccgaaaggccgcaagcttcgcctcggcaccatagatagctggctcatccattgcttcaccggcggcaaggttcatgcctgcgacgcctcaaacgcagcccgcagccaggtgctcgatctcaaccggcaggtctggagcgacgagctctgtgacctcttcggcatcgatatcaatgccctgccggacctgcgcgacagcagcggcgacttcggcgtgacatcaggcgttcccggcatcaaggatggcacgccgatcctcgcggccatcggcgacagccacgccgccctcttcggccatggcgctttcaaccccggagacggtaaagtgaccttcggcaccggctcgtcggtcatgacgacgctgccgcatttcatcgcgcctgagcgcggcatcaccacaacggttgcatggcggctcggcggcaaaccgaccttcgcctttgaaggcaatattctcgtttcggcagcctccctgccatggatgacggacattctcggcctgccggatgtcgccgcgctggtggaactcgccgccacggccgaaccggaggggccggggtttgtgccggcctttgtcggccttggcgcgccctattgggataccaacgcgcgcgcgctgttttcgcaaatcaatttcagcaccacccgcgcccagatggcccgggcggtcaccgattccatcgcctttcaggtccacgacgtcttcgccgccatgcgcgcgcagtcgccttccggtttcgggcgcctcttcgtggatggcgggccgagccagaaccgtttcctgatgcaatgcgtcgccgatatgctggaacaccccgtcattcagcgcgatgcgccggaagcctccgccctcggcgctgcctatctcgccggcctggccctcggtgtctggagtgatcttaatgccatcgcagcgttgaatagcaacgggaacaccatcgcgacttcaaccggtgaaagccgtcagcggctc

SEQ ID NO: 35238 - DNA, 771 bp, Agrobacterium tumefaciens
tttgaaggtcaatccgtattcgtgaccgggggcaacaagggcatcggttacggcatcgcccgccgttttgccgaagaaggcgcgaaagtcgccatcgcctctgtcgacaaagacacacatgacgccgctaaaaaactggcggacgaaaccggcaccgtcacccatggcgtcatcctcgacgttagggatgcggcggcggtgcgtgacgcctatggcgctgcggaagacgcgatcggcgcgctttccatctccgtccagaacgccggcgtcatcactatctcaaagatcgaggatctgacgcaagaacagtgggatttgaacctcgacgtcaacaccaagggcgcgttcctctgctgccaggaggcaatccgtcgcttccgcgcaagcggcaccaagggccgcctcgtcaacaccgcctccggccaagcgcgtcagggcttcatctacacgccgcattatgctgcgtccaaattcggcgttatcggcctgacgcaaagcctcgccaaggaacttgcacctgagggcatcaccgtcaacgccatctgccccggcatcatccacaccgaaatgtgggattacaacgaccgcgtctggggccagatgctgggcgaatacaagcccggcgagttgatggccgaatgggtgcgcaacatccccatgcgtcgcgccggaacgcccgccgaagtggcggcgctggtggcatttctggcatcagaggatgcggcctatatcacggcccagacgatcaacgtcgatggcgggttgatcatg

SEQ ID NO: 35239 - DNA, 891 bp, Agrobacterium tumefaciens
atacggaatctgacaaaatcctacgcaaatggctttcaggcgctcaaaggcgtcagcctcgatattaaagagggggaaatccttgcccttctcggcccgaacggtgccggcaagacgacgctgatttccatcgtctgcggcctcgtcaatccgggggaaggttcggtgcttgtcggcggccacaatgtggtgaaggattttcggcagacccgcgcgcttatcggcctcgtgccccaggaactgacgacggacatgttcgagactgtgtggaacacggtcagcttctcgcgcggcctgcacgggcagaagaagaacccggcgctgatcgaaagcattctgaagtccctgtcgttgtgggacaagaaagacaacatgctgcgggaactttccggcggcatgaagcgtcgtgtgttgatcgccaaggcgcttgcgcacgagcctaaggtgcttttcctggatgagccgaccgccggcgtggatgtgaccttgcgccgcgacatgtggaatgtcgtttccgagctgcgcgccaagggcgtcaccatcattctgacgacgcattacattgaggaggcggaagaaatcgccgaccgggtgggtgtcatcaacggcggcgaattgctcctcgtggaagaaaagaccgcgctgatgaagaagctcggccgcaaacagctctttcttgaactgacgcaaccggtggaacggttgcctgacagtctcgccccctttgccctgacgctttcggacgaccgcagcacgatcacctacgaaatcgagggaaatggcgagcagggacgcatcgccgatctcctgggcgctctttctgccgccaacatccatttcaaggatatttcgacgcggcaaagctcgctcgaggatatcttcgtttcgctg

SEQ ID NO: 35240 - DNA, 825 bp, Agrobacterium tumefaciens
atggcattgaaaagtttcaatccgaccacgccgagccagcgtcagctggttatcgtggaccgcgcttcgctctacaagggcaagccggtaaaggctctcacccagggcctcagctccaagggtggccgcaacaaccagggccggatcaccgtccgtttccagggtggcggtcacaagcggacctatcgtctggtagacttcaagcgtcgcaagtttgacgttgaaggtaccgttgaacgtctggaatacgaccccaaccgcaccgcgttcatcgcgctggttacgtataccgacggcgaacaggcttacattctcgcgccacagcgtctcgctgctggtgacaaggtgatcgcctccgacaaggcagtggacgtgaagcccggcaacaccatgccgcttcagtacattccggtcggttcgatcatccacaacgtcgagatgaagcctggtaaaggcggtcagattgcccgctccgccggtacgtatgtccagctcgtcggccgcgatgccggtatggccatcctgcgtctcaactcgggcgaacagcgtctggtacacggctcgtgccttgcatcgatcggcgctgtttctaactcggaccacggcaacatcaacgacggcaaggccggtcgttcccgttggcgcggcaagcgtccgcacgttcgcggcgtcgtcatgaacccggtcgaccacccgcacggtggtggtgaaggtcgcacgtcgggtggtcgccacccggttactccgtggggcaagcccacgaagggcaagcgcacccgttcgaacaagtcgaccgacaagttcatcatgcgctcgcgccatcag

SEQ ID NO: 35241 - DNA, 4104 bp, Agrobacterium tumefaciens
gtcatgaatcttttcaatcctcaggtgcctgcgcagcatttcgattccatccggatttcgatcgcttcgccggaaaaaatcctgtcgtggtcctacggcgagatcaagaagccggaaaccatcaactaccgtacgttcaagcctgagcgtgacggtcttttctgcgcgcgcatctttgggccgatcaaggactatgagtgcctgtgcggcaagtacaagcgcatgaagtacaagggcatcatctgcgaaaagtgcggcgtcgaagtgacgctgtcgcgcgttcgccgtgagcgcatgggccacattgagctcgcagcgccggttgcccatatctggttcctgaagtcgcttccttcgcgtatctcgaccttgctcgacatgacgctgaaggatgtcgaacgcgttctctatttcgagaactacatcgtcaccgagcctggcctcacttcgctgaagcagaaccagcttctgtctgaagaagagtacatgatcgccgttgacgagttcggcgaagaccagttcaccgccatgatcggcgctgaagccatctatgagatgctggcttcgatgaacctcgaaaagatcgccggcgacctgcgcgccgagcttgctgaaacgacttctgacctcaagcagaagaagttcatgaagcgcctgaagatcgtcgagaacttcatggagagcggcaatcgtccggaatggatgatcatgaaggtcgttccggtcattccgccggacctgcgtccgctggttccgctggatggcggtcgttttgcgacgtccgacctcaacgatctctatcgccgcgtcatcaaccgtaacaaccgtctgaagcgcctgatcgagcttcgtgcgcctggcatcatcatccgcaatgaaaagcgtatgttgcaggaatccgtcgatgcgctgttcgacaacggccgtcgcggccgcgtcatcacgggtgccaacaagcgtccgctgaagtcgctctccgacatgctcaagggcaagcagggccgtttccgccagaaccttctcggcaagcgcgtcgactattccggccgttcggttatcgtgaccggtccggaactgaagctgcaccagtgcggcctgccgaagaagatggcgctcgaactgttcaagccgttcatctatgcccgtctcgacgctaagggttactcctcgaccgtcaagcaggccaagaagctggttgaaaaggaaaagccggaggtctgggatatcctcgacgaggtcatccgcgaacatccggttcttctgaaccgcgcaccgacgctgcaccgtctgggtatccaggctttcgaacccatgctggtcgaaggcaaggccatccagctgcatccgctcgtctgcacggccttcaacgccgacttcgacggtgaccagatggctgttcacgttccgctttcgctggaagcccagctggaagcgcgcgtgctgatgatgtcgaccaacaacatcctgcatccggcaaacggccacccgatcatcgttccgtcgcaggacatggttctcggcctgtattacctgtcgatcatgaaccagaacgagcccggcgaaggcatggctttctcggatatcggcgaattgcatcacgcgcttgaaaacaaggtcgtgacgctgcatgccaagatccgtggccgcttcaagaccgtggatgccgacggcaagccggtttccaagatccatgaaacgacgcctggccgtatgctcatcggcgaacttctgccgaagaacgtcaacgtgcctttcgacacctgcaaccaggaaatgaccaagaagaacatctccaagatgatcgacacggtctaccgtcattgcggccagaaagacacggtcatcttctgcgaccggatcatgcagctcggcttcagccacgcctgccgcgccggcatttcgttcggcaaggacgacatggtcattccggacagcaaggtgaagatcgtcggcgacaccgaagctctcgtgaaggaatacgaacagcagtataatgatggtctcatcacccagggcgaaaagtacaacaaggttgtcgacgcgtggggcaaggctaccgaaaaggtcgccgaagaaatgatggcgcgcatcaaggctgtcgagttcgatccggaaacgggccgccagaagccgatgaactctatctacatgatgtcccactcgggtgctcgtggttctccgaaccagatgcgtcagctgggcggcatgcgcggcctgatggccaagccctcgggcgaaatcatcgagacgccgatcatctcgaacttcaaggaaggcctgaccgttaacgagtacttcaactcgacccacggtgcccgtaagggtcttgcagacaccgccttgaagaccgcaaactcgggttacctgacccgtcgtctcgtcgacgtggcgcaggattgcatcgtcaactccgtggattgcggcaccgacaagggcctcaccatgaccgccatcgtcgatgccggtcagatcgtggcctcgattggcgcccgtatcctcggccgcacggctctcgacgacatcgacaacccggtcactggcgagaacatcgtcaaggccggcacgctgatcgacgaagccgacgttgccatcatcgagaaggctggcatccagtccgtccgcatccgttcggctctgacctgcgaagtgcagatcggcgtctgcggcgtctgctatggtcgtgaccttgcacgcggtacgcctgtcaacatgggcgaggccgttggcgtcatcgccgcacagtcgatcggtgaaccgggcacgcagctcaccatgcgtaccttccaccttggcggtacggctaacgtggtcgaccagtcgttcctggaagcatcgtatgaaggtacgatccagatcaagaaccgcaacatcctgcggaactccgaaggcgttctcatcgccatgggccgtaacatgtccgttacgatccttgatgagcgcggcgtcgaacgttcctcgcagcgtgtcgcttacggttcgaagatcttcgtggacgatggcgacaaggttaaacgcggtcagcgtcttgcagagtgggacccctacacccgtccgatgatgacggaagtggaaggtaccgttcacttcgaggacctcgtcgacggtctctccgttctggaagccaccgacgaatccaccggcatcaccaagcgtcaggttatcgactggcgttcgacgccgcgtggttcggacctcaagcccgctatcatcatcaaggatgcttccggcgcggttgccaagcttagccgcggtggcgaagctcgcttccacctgtccgtggatgcgatcctctcggtcgaacctggttcgaaggtctcccagggtgacgtgcttgcacgttcgccgctggaaagcgccaagacgaaggacatcaccggtggtctgccgcgcgttgccgaactgttcgaagcccgtcgtccgaaggaccacgccatcatcgcagagattgatggtacgatccgcctcggccgcgactacaagaacaagcgtcgcgtgatgatcgagcctgcggaagacggcgtcgagccggtcgaatacctgatcccgaagggcaagcccttccatcttcaggaaggcgactacatcgagaagggcgaatacattctcgacggcaacccggcaccgcacgacattctggcgatcaagggtgtagaggctctggcttcctacctcgtgaacgaaatccaggaagtctaccgactgcagggcgttgtgatcaacgacaagcacatcgaggtgatcgttcgccagatgctgcagaaggtcgagatcaccgatgctggtgacagccagtacatcgttggcgacaatgtcgaccgtatcgagatggaagacatgaacgaccgtctcatcgaagagggcaagaagcctgcttatggcgagccggttctgctcggcatcaccaaggcttcgttgcagacgccgtccttcatctcggccgcatccttccaggaaaccaccaaggttctcacggaagctgcgatcgccggcaagacggacacgctgcagggccttaaggaaaacgtcatcgtcggccgtctcatcccggccggcaccggcggcaccatgacgcagatccgccgcatcgccacctcgcgcgacgac

SEQ ID NO: 35242 - DNA, 4071 bp, Agrobacterium tumefaciens
tcgtttaacggtcgcaggcgcgtacgcaagtttttcggcaaaattccagaagtagcggaaatgccgaacctcatcgaggttcagaaggcttcgtatgaccagtttctcatggttgacgagcccaagggtggccgtcccgacgagggattgaatgccgtattcaaatccgtattcccgatcaccgatttttccggcgcctccatgctcgaattcgtgtcttacgaattcgaagcgccgaagttcgacgtcgaggaatgccgtcagcgcgatctgacctatgcagcgccgctgaaggtgacgctgcgcctcatcgtgttcgatatcgacgaagataccggcgcgaagtccatcaaggacatcaaggaacagtccgtctacatgggcgacatgccgctcatgaccaataacggcacgttcatcgtcaacggcaccgagcgcgtcatcgtttcgcagatgcaccgttccccgggcgtgttcttcgaccacgacaagggcaaaagccattcttccggcaagctgctttttgctgcccgcgtgatcccgtatcgcggttcttggctcgacatcgagttcgacgccaaggacatcgtctatgcgcgtatcgaccgtcgccgcaagctgcccgtgacctcgctgctgatggcgctcggcatggatggcgaagaaatcctgtcgaccttctacaccaaggcgacctatgagcgctccggcgatggctggcgcattccgttccagcctgaagcgctgaagaatgccaaggtcatcaccgacatgatcgacgccgacaccggcgaagtcgttgtcgaaggtggcaagaagctgaccccgcgcctcatccgccagctcgtcgacaagggcctgaaggcgctgaaggcgaccgacgaagatctctacggcaactacctggccgaagacatcgtcaattactcgacgggtgagatctatctcgaagccggcgacgaaatcgacgagaagacgctcggcctcattctgcagtccggctttgacgagattccggtactcaacatcgaccacgtcaatgttggcgcctatatccgcaacacgctgtctgcggacaagaaccagaaccgccaggaagcgctgttcgacatctaccgcgtcatgcgtcccggcgagccgccgaccatggattcggcggaggcgatgttcaactcgctgttcttcgatgccgaacgttacgatctctcggctgttggccgcgtgaagatgaacatgcgtctcgacctcgacgcggaagacaccgtgcgcacgctgcgcaaggaagacatcctcgcggtcgtgaagatgctggtcgaactgcgtgacggcaagggcgaaatcgacgacatcgacaacctcggcaaccgccgtgtccgttctgtcggcgagctgatggaaaaccagtatcgtctggggcttctgcgcatggaacgtgcgatcaaggaacgtatgtcctcgatcgaaatcgacaccgtgatgccgcaggacctgatcaacgcgaagccggcagccgccgccgttcgcgaattcttcggttcctcgcagctgtcgcagttcatggaccaggtgaacccgctttcggaaatcacccacaagcgccgtctttcggctcttggaccgggtggtctgacccgtgagcgcgccggcttcgaagtccgcgacgttcacccgacccattacggccgtatttgcccgatcgaaacgcctgaaggcccgaacatcggtctgatcaactcgcttgcaacctttgcccgtgtgaacaagtacggctttatcgaaagcccgtaccgcaagatcatcgacggcaaggtgacaaccgacgtgatctacctctccgccatggaagaggccaagtactacgtcgcacaggccaatgccgaactcgatggcgaaggcgccttcacggaagagttcgttgtttgccgtcattcgggcgaagtcatgctcgcaccgcgcgacaacatcaacctgatggacgtttcgccgaagcagctcgtttcggtcgcagcggctctcattccgttcctggaaaacgacgacgccaaccgcgctctcatgggctcgaacatgcagcgtcaggccgttccgcttctgcgcgccgaggcaccgttcgtcggtaccggcatggagccgatcgttgcccgtgactccggcgctgccattgcagcccgtcgtggcggtgttgtcgatcaggtggatgcgacccgtatcgttatccgggctacggaagatctcgatgccggcaaatccggtgttgatatctaccgtctgcagaagttccagcgttcgaaccagaacacctgcgtcaaccagcgtccgctggtttccgtcggtgacgccatctccaagggtgacatcatcgcggacggtccgtcgaccgacctcggcgatctggcactcggccgtaacgcgctcgtcgcgttcatgccctggaatggctacaactacgaagactcgattctgatgtcggagcgtatcgtttccgacgacgtgttcacctccatccacatcgaagaattcgaagtgatggcgcgtgacacgaagcttggtccggaagaaatcacgcgcgacattccgaacgtttcggaagaagcgctgaagaacctcgacgaagccggtatcgtctacatcggtgcggaagttcagccgggcgacatcctcgtcggcaagatcacgccgaagggcgaaagcccgatgacgccggaagaaaagcttctgcgcgccatcttcggtgaaaaggcttccgacgttcgcgacacgtccatgcgcatgcctccgggcacgttcggtacgatcgtggaagtccgcgtcttcaaccgtcacggtgtggagaaggacgagcgcgcgatggctatcgagcgcgaagagatcgagcgtctggcgaaggaccgcgacgacgagcaggcaattctcgaccgtaacgtctacggccgcctgatcgacatgctgcgtggccacgtttccatcgctggtccgaagggcttcaagaagggcgtcgagctttccaacgccgtcgtctccgaatatccccgctcgcagtggtggatgttcgcggtcgaggacgagaaggcccagtccgaactggaagcacttcgcggccagtacgacgaatccaagtcgcgccttgaacagcgcttcatggacaaggtcgaaaaggtccagcgcggcgatgaaatgcctccgggtgtcatgaagatggtcaaggtcttcgtcgctgtgaagcgcaagatccagccgggcgacaagatggccggccgtcacggtaacaagggcgtcgtctcgcgtatcgttccggtcgaggacatgccgttcctcgaagacggcacgcatgtcgacatctgcttgaacccgcttggcgtgccttcgcgcatgaacgtcggccagatcctcgaaacccacctcgcatgggcatgcgcaggcatgggcaagaagatcggcgagatgctcgaagagtatcgcaagacgatggacatcagcgagcttcgtagcgagctgacggaaatctacgcgtccgaggctaatgatgaggttcagcgtttcgatgacgactcgctggtgaagcttgccgaagaagccaagcgcggtgtttccatcgcgaccccggttttcgacggtgcgcatgagcctgacgtcgccgcgatgctgaagaaggcaggtctgcatgaatccggtcagtccgtcctttatgacggtcgtaccggtgagccgttcgaccgcaaggtcaccgtcggctacatgtacatgatcaagctgaaccaccttgtcgacgacaagatccacgctcgctcgatcggtccttactcgctcgttacccagcagccgctgggcggcaaggcgcagttcggcggacagcgcttcggggaaatggaagtctgggctctggaagcatacggcgcggcttacacgctgcaggaaatgctcaccgtcaagtcggacgacgttgccggccgcaccaaggtctacgaagcgatcgtccgtggcgacgacaccttcgaggccggtatccctgagagcttcaacgttctcgtcaaggaaatgcggtcgctcggtctgtcggtcgaactggagaac

SEQ ID NO: 35243 - DNA, 1038 bp, Agrobacterium tumefaciens
atggctattgcaagaggttatgctgcgaccgacgcgtcgaagccgcttaccccgttcaccttcgaacgccgcgagccgaatgatgacgacgtcgtcatcgatatcaaatatgccggcatctgccactcggacatccacaccgtccgcaacgaatggcacaatgccgtttacccgatcgttccgggccacgaaatcgccggtgtcgtgcgggccgttggttccaaggtcacgcggttcaaggtcggcgaccatgtcggcgtcggctgctttgtcgattcctgcgttggctgcgccacccgcgatgtcgacaatgagcagtatatgccgggtctcgtgcagacctacaattccgttgaacgggacggcaagagcgcgacccagggcggttattccgaccatatcgtggtcagggaagactacgtcctgtccatcccggacaacctgccgctcgatgcctccgcgccgcttctctgcgccggcatcacgctctattcgccgctgcagcactggaatgcaggccccggcaagaaagtggctatcgtcggcatgggtggccttggccacatgggcgtgaagatcggctcggccatgggcgctgatatcaccgttctctcgcagacgctgtcgaagaaggaagacggcctcaagctcggcgcgaaggaatattacgccaccagcgacgcctcgacctttgagaaactcgccggcaccttcgacctgatcctgtgcacagtctcggccgaaatcgactggaacgcctacctcaacctgctcaaggtcaacggcacgatggttctgctcggcgtgccggaacatgcgatcccggtgcacgcattctcggtcattcccgcccgccgttcgctcgccggttcgatgatcggctcgatcaaggaaacccaggaaatgctggatttctgcggcaagcacgacatcgtttcggaaatcgaaacgatcggcatcaaggacgtcaacgaagcctatgagcgcgtgctgaagagcgacgtgcgttaccgcttcgtcatcgacatggcctcgctc

SEQ ID NO: 35244 - DNA, 831 bp, Agrobacterium tumefaciens
attcctgccgtcaccctgccctctggaaatgaggttccagccctcggacttggcacctggaatatgggcgagacgagatcatcggcagacgacgagattgaaagcatccgcaaggcgatcgatctcggcatgacgttggtcgacaccgcggaaatgtatgccgacggccggtcggaagaagtggtcggcacggcaatcgccggccgccgcgacgaggtgtttctggtcagcaaggtctatccctggaatgccagcgcgagaggcactgcggaagcgtgcgagcgcagcctcgcaaggctcggcaccgaccacatcgacctctatctgctgcactggcgcggcgagcacccgcttggcgaaaccgtggccgcgttcgaaaggctgaagagcgacggcaagatcggcaactggggcgtctccaatttcgataccgacgatatggaggagcttttcaccgttccagagggcaaaaactgcgccgccaatcaggtgctctataacctctcccggcgcggacctgaattttcccttctgccctggtgccaggagcacggcgtgccgctgatggcctattcccccatcgagcagggccgtatcctgaagaaccacgaactcattcgcatcgccaaggcttatcaggcaaccccggcgcagctggccttggcctttcttttggatagggacggcgtcatcgccattccaaaatccgccagcgtgtcccgtatcgtggaaaatcgcggcgccaccgatcttgaaataaccgaggaagactggaccgccctcgacgccgccttcccgccgccgacgcgcaagacgtccttggaaatgctc

SEQ ID NO: 35245 - DNA, 723 bp, Agrobacterium tumefaciens
aaggttgctatcatcaccggcgcgtcatccggcatcggccgggcgacggcgatgctgtttgtcacgcaaggcgcggcagtcgtcatcaatgcgcgcggtgaaaaggcgctgcaggaggttgcagccgacattcgtgatgccggcggccgtgtccatgcggttgcgggcgacgccggtgttgcggaaacccattcccggttggcggatgcggccgtgggcgttttcggtggcctcgatatcgccatcaataatgccggggcggtgggggctatgaagccgctggcggagatttcgcccgaggagtgggatcatgtcctcaacgtcaatctcacctccgcctttctgggggcgcgttaccagattccgccgatgctgaagcggggcggcggttccatcgtctttacgtcgagcttcgtcggcaccagcgccggcattcctggcatgtcggcttatggaactgcgaaggcagcgttaatggggctggtgaagggcattaccgccgattatgcgatcaatggcattcgcgccaatgccctgctccccggcggggtcgatacaccggccgcaggagacccggcgcagaaggaatgggccgccggcctgcatgcgatgaagcgcattgcccagcccgaggaaattgcgcaggccgctcttttcctcgcaagcccaatggcaagcttcgtcgccggggccgcattgtttgccgatggcggcaatgccgcg

SEQ ID NO: 35246 - DNA, 501 bp, Agrobacterium tumefaciens
gtcaccatcatcgttgcggtctccgagaacggcgtcatcggccgcgatctcgacatgccatggaagctgtcgaccgatctgaagcgcttcaaggcgatgacgatgggcaagccgctcatcatgggccgcaagacgtttctgtctgtcggcgaacgtcccctcccgggccgtccgcatatcatcgtcagccgaaatgccgattaccggcctgaaggcgtcgacgtcgtttcgtcgctggacgaggccgtgaagcttgcaaaaacgaaggctgtggaactgggcgtggacgaggtttttgtcgccggcggtggcgagatttaccgtcaggccatgccctttgccgatcaactttccgtcacccatgtggcggtaaaactcgatggcgacactttttttccggaaattgatcccgccgtttttgagaaaaccgaagaaaaggccgcgtccgcaggggaaaaggacaattatccggttctgtttaccacttatgtgcgacgagcc

SEQ ID NO: 35247 - DNA, 1218 bp, Agrobacterium tumefaciens
agcgccgatgatgtgaaggccgtggtaaaggcctgcgcgcaatacaaggtgccggtcattcccttcggaacgggatcttcgctcgaagggcaggtcaacgcgcccaatggcggaatatgcatcgatttcagccggatgaatcgcatcattgaggtgaatgccgaagatcttgacgtgacggtggagcccggcgtgacgcgcgaggatctgaatgtctatctgcgcgataccggcctgttctttccgatcgatcccggcgccaatgcttcgattggcggcatggcctcgacgcgcgcttccggcaccaatgccgtgcgttacggcacgatgaaggacaatgttctggccgtcaccgccgttgtcgccaatggtgaggaaatccgcactgcgcggcgcgcccgcaagtcgtccgccggttacgacctgacgcggcttttcgtgggggccgaaggcacgctcggtgtcatcacctcggtgacgctgcggctgcagggcattccggaaaagattaccggcggtgtctgcaccttcgacagtatcaaggcggcctgcgatgccgtcatcatgacgatccagatgggcgttccggtcgcccgcatcgaattgcttgacgaggtgcaggtgcgcgcctgcaatgcctattccggtctgaactatgcggaaaagccgacactcttcgtggagttccatggcaccgaggagacggcggcgctgcaatcgcagcagttcgccgagattgcagccgaatgcggcagcgtcgatttccgctggacgggcgatgcggcggagcgcaacaagctgtggaaggcgcgccacgacgcctattgggcgtcgcgggcgctggcaccacatctcgacgggctttccaccgatgtctgcgtgccgatttcacggctggccgattgcgtcgtggaaacgcagcgggatattgccgagaacggctttctggcgccgatcgtcggccatgcgggtgatgggaacttccatgtgcttattctgtttgatggcaaggacgccgaaagcgttgcgaaaacagaggcctttgttgcccgtctcaaccgccgcgccattgccatggacggcacatgcaccggcgaacatggcattggccagggcaagatgagttttcttgccgaagaggcaggaaatgcactggatctcatgcgcgccatcaaaacgtcgctcgaccccgataacatcttcaatccgggcaaattg

SEQ ID NO: 35248 - DNA, 1974 bp, Agrobacterium tumefaciens
cgcgaccaggtgcggccggcacacgattatctttccggcctcaacccggaacagcgcgaggccgtggaaacgcttgacggaccggttctcgttctcgccggcgccggcaccggcaagacccgcgttctgacgacccgcatcgcccatattctcgccaccggccgcgcctatccaagccagatccttgccgtgaccttcaccaacaaggcggcccgcgagatgaaggaacgtatcggcgtcctcgtcggcggcgctgtcgagggcatgccgtggcttggcaccttccactccatcggcgtcaagcttctgcgccgccatgccgagctcatcggcctgaaatcggatttcaccattctcgacacggatgatgtggtgcggctgatcaagcagctcattcaggccgaaggtcttgatgacaagcgctggccggcaaaacagttcgccggcatgatcgacggctggaagaacaaggggctgacgccaccggatattcccgagggtgacagccgcgcctttgccaacggcaagggccgcgaactttacgccgcctatcaggcccggctgaaaacgttgaacgcctgcgatttcggtgatctcttgctgcacccgatcagcatcttccgccgccatacggatattctgaaagagtatcaccagaagttccgttatattctggtggacgaatatcaggacaccaacacggcgcaatatatgtggctgcggctgcttgcccagcgcgccaaggacgagccgcagaatgtctgctgcgtcggtgacgacgaccagtcgatctatggctggcgcggcgcggaagtggacaatatcctgcgcttcgacaaggattttcccggtgccaaggtcatcaagcttgagcgtaactaccgttccaccgaacatattctcggcgctgccggccatctgatcgcccacaacgagggccgtctcggcaagacgttgtttaccgagcgcagcagtccggacgatgaaaaggtcgtggtgcacgccgcctgggattcggaagaagaggcccgcgcggtcggagaggaaatcgagcaactccagcgtaagaactacaagctgaacgacatggccatcctcgttcgcgcttccttccagatgcgcgaattcgaagaccgcttcgtgacgcttggcctcaattaccgcgtcatcggcggcccgcgcttttatgagcgcctcgaaatccgcgatgccatggcctatttccggctggtctgccaaccggccgacgatctcgccttcgagcggatcgtcaatacgccaaagcgtggccttggcgatacgacgatccgtaacctgcacgactatgcccgcgcccgcgatatcccgatgctggcagccgccgccgacatcatcgagaccgacgagttgaagccgaaagcgcgcaaggcgctgttcgatgtggtgcaggatttccgccgctggcagggcctgctggaaaacaccgaacacaccacgcttgccgaacagattctcgacgaaagcggctataccgccatgtggcaggccgacaagacggccgaagcaccgggacggcttgagaacctgaaggaactcatccgctcgatggaatccttcgaaagcatgcgtggatttctggaacacgtcgccctggttatggatgcggaacagaatgccgagctggatgccgtctccatcatgacgctgcattccgccaagggtctggaattcgacaccgtcttcctgcccggttgggaagaaggcctgtttccccaccagcgggcgctggacgaaggcggtcgctccggtctggaggaagaacgtcgtctggcttatgtcggcatcacccgcgccaagaagctctgccatatctggttcgtctcgaaccggcgcattcacgggctgtggcaatccaccctgccctcgcgtttcctcgacgaactgccgcccgcccatgtggatgtcgcggcttccgacagcaattatggcggttat

SEQ ID NO: 35249 - DNA, 882 bp, Agrobacterium tumefaciens
ctggaagccccttccggcgcatcgatcgccttccgtcatcaaccttccgctctatcccccgcccgtggcgtgctgatgatctgccacggccttgtcgagcacgccggccgctaccgccgttttgccgatgtcatggcgaaacagggtttcgaggtctatgcccatgatcatcgcggccacggccgcaccaaagcggcggatgcgcctctcggccgcttcgcctggaaggacggcgcggaaaaggtcgtttccgatgtcatggcgatacgcgtcatggtcggtgaaagacatcccggcctgccggtcattctgttcggccactccatgggcggcctcgtggcactcaacgccgccgtcaaccacccggatgccttcgatggtctgtcgatctggaattccaatctcaatcccggcgtcatgggccgcatcgcacaggtcgtgctccggcttgaaaagatgctgaagggatcggacgtgccgagcgccatcctgccgaaggcgaccttccgcgcctggaatgcaaaaatgccggaaaaacgcacccatgccgactggctgagccacgacaaggcggccgtggatgcctatgtggaagacccgctctgccagttcgaggccagcgtttcgctctggcaggatgttttcgacctgtcctatcgcgcgccaaaactcatcgagcgcctaccaaagaccttgccgcttctcctcgtcagcggcgatcaggatgcagccaccaatgatggcagggagatcgtgtggctggccgaacgttttcgccacgcgggcttcagtcatgtcgaacacacgatctacaagggaatgcggcacgagacgctgaacgagatcggctggcaggccgtagcggcggatttcgccgcctgg

SEQ ID NO: 35250 - DNA, 1121 bp, Agrobacterium tumefaciens
atgaatatcgtcgccaactggagttatcccaccgccgtcaagcttggccgtggccggatcaaggaactggcggaagcctgcaaaacgctcggcatcaggaagccgctgctcgtcacggatcgtggccttgccaatatggcgatcaccgcgcatgcgctggatgtgctggaagaggcgggtcttggccgggcgatctttgccgatgtcgatccgaaccccaacgaaatcaacatggaagccggcgtcaaggcttaccgcgatggcggtcatgacggcgtcgtcgcctttggcggcggctcgggcctcgatctcggcaagatgatcgccttcatggccgggcagacacgtccggtctgggatttcgaggatatcggtgattggtggacacgcgctgatgcgtcgaagatcgcgcccatcgtcgcagtcccgacgacggctggcaccggttcggaagtcggccgcgccagcgtcatcaccaattcgcagacgcatgtgaagaagatcatcttccatcccaagctgcttcccggtgtcgtcatctgcgatccggaactgacggtcggcatgccgaaggtcatcacggccggcaccggcatggatgccttcgcccattgcctcgaagcgtattcgtcaccgttcttccacccgatgagtgctggtgtcgcgcttgagggcctgcgtctcgtcaaggaattcctgccgcgcgcctataaggatggcacggatatcgaagcccgcaccaatatgatggcggcggcggcgatgggggcggttgccttccagaagggtctcggggccattcattcgctctcgcatccgatcggggcggtctacaacacccatcacggcatgaccaatgccgtcgtcatgccggcggtgctgcgtttcaaccgtcctgccatcgaagacaagatcgcgcgtgctgccgcctatctcggcatttccggcggttttgacggtttttatgactacgtgctggatcttcgcagggaactcggcgtgccggaaaacctgaccgccatgggcatcaagcctgatcgtatcgacgagctggcggcagaagcgatcaaggatccgagctgcggtggtaatccggtgccgatgacgcttgagaataccaa

SEQ ID NO: 35251 - DNA, 1341 bp, Agrobacterium tumefaciens
tcgcccattgacggctcggtttatgccgagcgggaggcgatgtcgctggaagcggcgcgcgccgccgtttcgaccgcgcgcagggcgcagaaagactgggcgcgacggccgcttgaggaccgcgttcagctggttctcaaaggtgtggcgcgccttaacgaaatggtggccgaggtggtgccggaactcgcgcatatgatgggccgtccggttcgttatggcggtgagtttaggggattcaacgagcgttccaactatgtcgcctccattgcggcggacgcgctggcgccgctcgttatcgaagaaagcggcaatttcgaacgccgcatcgagcgcgaggcgcatggcgtggtcttcgtcatcgccccctggaattatccttacatgaccgcgatcaacacggttgctccggcgctgatggctggcaatacggttgtcatcaaacatgcggcgcagacgcttctcgtcggcgagcgcatggtgcgggcctttgtcgaggctggcgtgcctgaggatgtgttcatcaatgtcttccttgatcacggcacgacctcgacgctcatctccgaaggcctgttcaatttcgtcaatttcaccggttcggtggaaggtggccgggccatcgagcgcgccgctgccggcaccttcaccggtctcgggctcgagctcggcggcaaagaccccggttatgtgatggaggatgccgatctcgacgccgccgtcgatacgctgatggacggcggcacttataattccgggcaatgctgctgcggtatcgagcgcatctacgtcaatgaaaacctctatgacgaattcgtcgagaagtcggtggcgtgggtttcgaactacaagctcggcaatccgctcgagcaggaaacgacgcttgggccgatggccaacaagcgtttcgccaaggtggtgcgggcgcagattgcggacgcggtttcgaagggtgccaaagcgctggtcgatccgaagcttttccccgctgacgatggcgagagtgcctatgtcgcgccgcagatcctcgtcaatgtcgatcattccatggaattcatgaccgaagagactttcggtcctgccatcggcatcatgaaggtcaagaacgacgacgaagccattgcgctgatgaatgacagcaaatacggcctcaccgcttcgctgtggacgcaggatgcggcgcgggctgcccggatcggccgggaaatcgagaccggaacggtgttcatgaaccgcgccgattatctcgacccggcgctttgctggaccggcgtcaaggaaaccggccgtggcggttcgctctccgtcctcggtttccagaatctgacccgcccgaaatcc

SEQ ID NO: 35252 - DNA, 870 bp, Agrobacterium tumefaciens
atgcgcgcgctttattacgaacgattcggcgagacccctgtagtcgcgtccctgcctgatccggcaccgagcgatggcggcgtggtgattgcggtgaaggcaaccggcctctgccgcagcgactggcatggctggatgggacatgacacggatatccgtctgccgcatgtgcccggccacgagttcgccggcgtcatctccgcagtcggcagaaacgtcacccgcttcaagacgggtgatcgcgttaccgtgcctttcgtctccggctgcggccattgccatgagtgccgctccggcaatcagcaggtctgcgaaacgcagttccagcccggcttcacccattggggttccttcgccgaatatgtcgccatcgactatgccgatcagaacctcgtgcacctgccggaatcgatgagttacgccaccgccgccggcctcggttgccgtttcgccacctccttccgggcggtgacggatcagggacgcctgaagggcggcgaatggctggctgtccatggctgcggcggtgtcggtctctccgccatcatgatcggcgccggcctcggcgcacaggtcgtcgccatcgatattgccgaagacaagctcgaactcgcccggcaactgggtgcaaccgcaaccatcaacagccgctccgttgccgatgtcgccgaagcggtgcgcgacatcaccggtggcggcgcgcatgtgtcggtggatgcgcttggccatccgcagacctgctgcaattccatcagcaacctgcgccggcgcggacgccatgtgcaggtggggctgatgctggcagaccatgccatgccggccattcccatggcccgggtgatcgctcatgagctggagatctatggcagc

SEQ ID NO: 35253 - DNA, 1242 bp, Agrobacterium tumefaciens
gcggcccgtcccctcaacagccaggatttcagaacgctcggtctttcggcccttggcggcgcgctcgaattttacgacttcatcattttcgtatttttcgccaccgtcatcggccatctgtttttcccgccggaaatgccggactggctggtgatgattcagaccttcggcatcttcgccgccggttatctggtgcggccgctcggcggcatcgtgctcgcccattatggcgacaggtatggacgcaagcgcgtcttcgccttctccatcctcctgatggcgctctccacactcggcatggcgctgatgccgacctatgccaccatcggcgtggcggccccgatcctgctcatcatcctgcgcatgctgcagggcgccgccatcggtggtgaagtaccgggagcctggacatttgtcgccgaacatgtgcccttccgccgcgttggcctcgcctgcggtttcctcacctccgggctttcgttcggcatcatgctggggtcgctgatcgcctttgcgatcaactcgctcttcacaccggaagacgtggccggctacgcctggcgcatcccgttcctgcttggcggcgttttcggcctcatcgccgtctatctgcgccgttggctggaagagacgccgatctacatggagatgaagaagtcgaagtccctcacggacaagctgccgcttggcctcgtgctgaagcatcacaggcgtggcgtgatcatttccgccctgctgacctgggttctgtcagcggccatcgtcgtcaccacgctgatgacggccaccttcctgcagaagctctacggttacaccccgacgcaggccttagccggtaccagcttcggcacgctgttcctgatcttcggcgtcatcatcgccggagcgctgatcgaccgcgtcggctccggcatctttttcatgggcgccagcatcttcttcggcatcgccaccttcaccttctacagctatgccggcacctcgctcgaaaccatgttcgtgctttatggcgtgatgggcctttcggtgggcatggccggcgccgtgccctatgtcatggtgcgggccttcccggcatcggtccgcttctccggcctctccttcgcctacaacgtctcttatgccgtcttcggcgggctgacaccgattggcgtaacgacggcgcttgccatcaatccgatggcccacgcctggtatctggtcttcatcgccttcctcgccttcgcgatcggcctctacctc

SEQ ID NO: 35254 - DNA, 1113 bp, Agrobacterium tumefaciens
gtgattgaaggaacaggcatcggtgcaaccggcaaggttcaggccgaagtctgcttcaacacggcgctgacgggttacgaggaaatcctcaccgacccctcctatctcggccagatcgtcaccttcaccttccctcatatcggcaatgtcggcaccaatgaggaagacatcgaagacctgacgcccgccgcccgtcgcggcgccgtcggcgtcatcttcaaggccgatatcaccgacccctcgaacttccgcgccgtcaagcatctggatgcctggctgaaggcgcgtggggtcatcggcctctgcggtatcgatacacgcgcgctgacggcctggatccgcgaaaacggtgcgccgaacgcggtcatcgctcatgacccgaacggcgtctttgacatcgaagcgctgaaggccgaagccaaggcatggagcggtctcgtcggcctcgacctcgccatcgaagcgacgtccggccagtcctccacctggacggaaacgccgtgggtatggaacaagggttacggcacgctcggtgaagccgatgcgaaataccacgtcgtctgcgtggatttcggcgtcaagcgcaacatcctgcgcctgtttgccggcctcgattgcaaggtgacggttgttccggcgcagacctcggctgaagatattctggcgctgaagccggatggcgtctttctctccaacggtccgggagatccggccgcgacgggcgaatatgccgtgcctgttatccagaacctcatcaagagcgaactgccgatcttcggcatctgcctcggtcaccagatgcttggcctcgccgttggcgcgaagaccgaaaagatgcatcagggccatcacggcgccaaccatccggtcaaggacttcaccaccggcaaggtggaaatcgtctctatgaaccacggctttgcggtcgacaccaaatcgctgcccgagggcgtcgaggaaacccacacgtcgctgttcgacggcaccaattgcggcctgcgcatcgtcggcaagccggtcttctccgtccagcaccatccggaagcatcgcccggcccgcaggacagccactatctcttccgccgcttcgtcaacctgctgcgcgaaaacaag

SEQ ID NO: 35255 - DNA, 3435 bp, Agrobacterium tumefaciens
atgccgaagcgccaagatatcaagtccatcctcatcatcggcgcgggaccgatcgttatcggtcaggcatgtgaatttgactattccggcacgcaggcgtgcaaggcgctgaaggaagagggttaccgggtcattctggtcaactccaacccggccaccatcatgaccgatcccggtcttgccgatgccacttacgtcgagccgatcacaccggaagtcgtcgccaagatcatcgccaaggagcgcccggatgcgcttctgccgaccatgggcggccagaccgcgctgaacactgcgctttctctcaagcgcatgggcgttctcgatcgctacaatgtcgaaatgatcggcgccaagcccgaagccatcgacatggctgaagaccgcgctttgttccgcgaggcgatggcccgcatcggccttgaaacgccgaagtcgatgctcgccaacgccactgaaatcaaggacgccgaccgcaagacgcacgaagccgcccgcactgaactcaaggcaaaactgtcaggcgcagagctggacaaggctctcgacaacctcgaaaaccagtggaacctcggcgagacggaccgcaagcagcgctatatcagccacgccatggccattgccgcgcaggccatcgacgtcgtcggcctgcccgccattatccgcccttccttcaccatgggcggcacaggcggcggcatcgcctataaccgctcggaattcttcgaaatcatcggcggcggtctcgacgcatcgcccaccaccgaagtgctgatcgaagaatccgttctcggctggaaagaatatgaaatggaagtggtccgcgacaaggcggacaactgcatcatcatctgctccatcgaaaacatcgacccgatgggcgtgcacaccggcgacagcatcaccgttgcccctgctttgacgctgaccgacaaagaataccagatgatgcgcaacgcatcgattgcggtgttgcgcgagattggcgtcgagaccggcggctccaacgtgcagttcgccgtgaacccgaaggatggccgtctggtcgtcatcgaaatgaacccgcgcgtttcccgctcctcggctcttgcttccaaggcaaccggcttcccgattgccaaggtcgccgccaagctcgctatcggctatacgctggacgagctggaaaacgacatcaccggcggcgccacgcctgcgtccttcgagccctccatcgactacgtcgtcaccaagatcccgcgtttcgccttcgagaaattcccgggcgcctcgccgatcctcaccaccgccatgaagtcggtcggtgaagtcatggccatcggccgtacctttgccgaatcgctgcagaaggcgctgcgtggcatggaaaccggcctcaccggtctcgatgaaatcgaaatccccggttacgaggaaggcgaaggttccaagaacgccatccgtgccgccatcggcacaccgacgcccgaccgcctgcgcatggtcgcacaggcgatgcgcatgggaatgagcgaagaagaggtccacgaaaactcgaagatcgatccgtggttcatcgcccagcttaaggccatcgtcgacatggaggcccgcattcgcgagcatggcctgccgcaggatgccgaaaacctgcgcatgctgaaagccatgggcttctccgacgcccgcctcgccagcctgacgtccaagcgcccgaaggaagtggccgagctgcgtaacagcctgaacgttcgcccggtcttcaagcgcatcgacacctgcgctgcagagttcgcttcgcccactgcctacatgtattcgacctatgagacgcccttcgtcggcgctgcccgctcggaagcgcaggtttccgaccgcaagaaggtcgtcattctcggcggcggtccgaaccgtatcggccagggtatcgagttcgattattgctgctgccacgccgccttcgccctgaaggatgccggcttcgaagccatcatgatcaactgcaacccggaaaccgtttcgacagactacgacacctccgaccgcctctatttcgagccgctgacggccgaagacgtgatcgagatcatgcgcgccgagcaggaaaagggcgagctggtcggtgtcatcgtgcagttcggtggccagacgccgctgaagctcgccgaagcgctggaaaagaacggcatcccgatccttggcaccgcgcctgacatgatcgaccttgccgaagaccgcgaccgcttccagaagctgctgatgaagctcgatcttgcccagccgaacaatggcatcgcctattcggtcgagcaggctcgcctcgtcgcctcggaaatcggtttcccgctggtcgtgcgtccgtcctacgtgctgggtggccgcgccatgcagatcatccattcggaaggccaactccagacctatctgctcgacaccgttcccggtctcgtaccagaggatatcaagcagcgttacccgaacgacaagaccggtcagatcaacaccctgctcggcaagaacccgcttctgttcgacagctacctgaccaacgccgtcgaagtcgacgtcgatgcgctgtgcgacggcgaaaacgtcttcgtctcgggcatcatggagcacatcgaagaggccggcatccattcgggcgactcggcctgctcactgccgtcccgttcgctcagcaaggaaaccctcgatgaactggaacgccagacgacggcgcttgccaaggcactcaaggtcggcggcctgatgaacgtgcaatacgccatcaaggacggcacgatctacgttctcgaagtcaacccgcgcgcctcgcgtaccgtgccttttgttgccaagaccatcggcgcgccgatcgccaagatcgccgcccgcgtcatggccggcgagaagcttgatgcggcgattgccgcttatggcgagaagcccgatccgcgcaacctgaagcacatcgccgtcaaggaagccgtcttccccttcgcacgcttccccggcgtcgacatcctgctcggaccggaaatgcgctcgaccggcgaagtcatcggcctcgacaccgatttcgcactggccttcgccaagagccagctcggcgccggcgtcgacctgccgcgctccggcacggtcttcgtttcggtgcgtgacgaggacaaggaaggcgtgctttccgccatccgcattctcgtggaaagcggcttcaaggtgctggcaaccggcggcacccagcgtttcctcgccgaacagggcatcaacgccgaaaagatcaacaaggtgcaggaaggccgtccgcatatcgaggacgccatccgcaaccgtcaggtccagctggtcatcaacaccaccgacagcaacaaggcgatctcggatagcaagtcgctacgccgcgcaacgctgatgcagaaggtgccttactacacgacgatggccggtgcggaagcagcagcgcttgccatcaag

SEQ ID NO: 35256 - DNA, 1200 bp, Agrobacterium tumefaciens
atggccttccttgccgacattctctcccgcgtaaagccatccgccaccatcgccgttacccagaaagcccgtgagctgaaagccaagggtcgcgatgtgattagccttggcgccggcgagccggatttcgatacgcccgataatatcaaggaagcggccattgacgccatcaagcgcggcgaaaccaaatacacgccggtttccggcattcctgaactgcgcaaggcgattgccgacaagttcaagcgtgaaaacggcctcgactacaagccggaacagacaatcgtcggcaccggcggcaagcagatcctcttcaacgccttcatggcgacgctgaaccccggtgatgaggttgtcattcccgcgccttactgggtcagctacccggaaatggtggcgatctgcggtggtacgccagttttcgtcaacgccacgctcgaagacaatttcaagctgaagccggaagcactggaaaaggcgatcacgccgaagaccaagtggttcgtcttcaactcgccttccaacccctcgggtgcggcctattcgcatgacgagctgaaggcgctgacggacgtgctggtcaagcatccgcatgtctgggtgctgacggacgacatgtatgagcacctgacctatggcgatttcaaattcgtcacccctgtggaagtcgagccttcgctctatgaccggacgttgacgatgaacggcgtttccaaggcctatgccatgactggctggcgtatcggttacgctgccggcccgctgccgctgatcaaggccatggacatgatccagggccagcagacctcaggcgcaagctcgatcgcacagtgggcagctgtcgaagctctgaacggcacccaggatttcattccggaaaacaagaagatattcgaaggccgccgcgatctcgtcgtttccatgctcaatcaggctaaaggcatcagctgcccgtcaccggaaggtgcattctacgtctacccgtcctgcgccggcctgatcggcaagaccgcgccttcgggcaaggtcatcgagacggatacggatttcgtttccgagcttctggaagccgaaggcgttgccgtcgtgcagggatcggctttcggccttggcccgaacttccgcatttcctacgccacgtcggaaactcttctcgaagaggcctgcaagcgcatccagcgtttctgcgccgattgccgc

SEQ ID NO: 35257 - DNA, 816 bp, Agrobacterium tumefaciens
agcatggtgtacaaggcttccggtccgctcgtcctcgtgggggccggcaatatgggcggcgccatgctttcgggctggctgaaaaagggtgtgccgggatcgaaggtcatcgtcatcgaccctcgcccctccgacgccatgcgcacgacgatagcggaagccggcgcgacccacagcgaaagcgtgcctgagggcgtcaaggccggcattcttttcgtggcggtgaagccgcagatgatggatgccatattgccgtcgctgaagcccctgctgggtccggaaacggtcgttgtctccatcgcggccggtaccaccatcgccactttcgtttcgcatttcggtgcggtcgctgccgtgcgcgccatgcccaatacgcctgccatggtcggccgtggcgtcaccggcgcttatgccaacgatcttgtcacagccgagctgaaaaccgttgtggacgggttgctgaaggtcagcggtccggtcgaatgggttgaggccgaaagcgacatcgacgcggtgaccgcggtttcgggaagcggcccggcctatgtcttctatctggtggaatgcatggcggaagctggccgcaaggccggtctgccggccgacgtggccatgcgtctggcgcgcgaaaccgtggccggtgccggtgaactcctgcatcagtcccccgaggaggccgcgcggctgcgccagaacgtgacctcgccgggtggcaccacggccgcggcgctgtccgtgctgatggccgaagacggcatgcagcccctgttcgacagggccgtcgccgccgcgaaaacgcgcgccgaagaactggcg

SEQ ID NO: 35258 - DNA, 927 bp, Agrobacterium tumefaciens
atgaaggttttcgcaggcaattcgaaccggcacctcgccgaagcgatctgcaagtatctgaacgttcctctcggaaatgccactgtaaagcggtttgctgaccaggaaatattcgtagaaatcagcgagaacgtgcgcggcgaggacgtttttatcgtccagtccacctccttcccggcaaatgatcatctgatggaactgctcatcatgatcgatgccatgcgccgctcttcggcaaaacgtatcaccgcggtgcttccctatttcggttacgcccgccaggaccgcaaagccggtccccgcaccccgatttccgccaagctcgttgccaacctgattaccgaagccggcgccgaccgcgttctaacgctcgatcttcatgccggccagatccagggttttttcgacatccccaccgacaacctcttcgcagcgcccattctcgcccgcgacgtgaaggaccattacgacaccaacaatgtcatggtcgtttcgcctgatgtcggcggcgtggttcgcgcccgcgccctgtcgaagcgcctcgactgtctgctggcaatcgtcgacaaacgccgtgaccgtcccggtgaatccgaggtcatgaacgtcatcggcgatgtctccggcaaggattgcatcctgatcgacgatatcatcgattccggcggcacgctctgcaacgccgccgaagcgctgctgaaaaaaggcgcgaccagcgttaccgcctatatcacccacggtgtgctttccggcggcgcggttgcccgcgtggcctcctcgaagctgcgcgaactcgtcatcaccgacagcatccagccgaccaccggtgtgcaatccgcgcacaatatccgcgtggtcagcaccgcaggcctgcttggcgaggcgatcaaccgcaccgcgcaggaacagtcggtctccggcctgttc

SEQ ID NO: 35259 - DNA, 1485 bp, Agrobacterium tumefaciens
gaagcgcccttcaagctgaaatacggcaattacatcggcggcaaatgggtggagccgaagtccggccgctatatggacaatctctcaccggtgacgggccacaagatctgcgaagtaccgcgctcggatgcatccgacatcgagttcgcgctcgacgctgcccacaaggcgcgcgaaaaatggggcaagacgagcatcacggaacgctccaacatcctgctcaggattgcccagcggatcgaagacaatctcgacctcatcgcccgggctgaaacctgggacaatggcaagccgctgcgcgaaactaccaatgcggatattccgctgacgattgaccatttccgttatttcgcaggctgcatccgcgctcaggaaggcacgatcggcgaaatcgataatgacacggtcgcctatcatttccatgaaccgctcggtgtcgtcggccagatcattccgtggaacttcccgatcctgatggctgcgtggaaactggcacctgcgcttgccgctgggaattgcgtggtgctgaagccggcggaacagacgcctgcctccattctcatcgtgatggaactgatcgaagaccttctgccgcccggcgtcctcaacatcgtcaacggcacggggcttgaagccggcaagccgctggctcagagcaaccgcatcgccaagatcgccttcaccggttccacctcggtcggcaaggaaatcatgcgttatgcggctgacaatgtcaccaacatctcgctggagctcggcggcaagtcgccgaacatcttctttgccgatgtgatgaacgaggacgatgccttcctcgacaaggcgctcgaaggtttcgccttctttgcgctgaaccagggcgaggtctgcacctgcccctcgcgtgcgctggtgcatgaatcgatctatgaccgcttcatggaaaaggcgatcaagcgcgttcaggccatcagccaggacgatccgctcaacccgtcgaccatgctgggcgcacaggcctcgcaggaacagttcgacaagatcatgagctatctggagatcggcaagaaggaaggcgcgaaggtcctgaccggcggcgaccgcaagacgctgacgggcgacctgaaggacggctactacatccagccgaccgtattcgagggcaacaacaagatgcggattttccaggaggaaatcttcggtcctgtcgtttccgtcaccaccttcaagacggtggaagaagcgctcgaaattgccaatgacacggtttacggtctgggcgcgggcgtctggagccgcgacacgaatatcgcctaccgcgccggccgcggcatcgaggcgggccgcgtgtggacgaactgctaccacgtctatccggcgggtgctgcctttggtggttacaagcagtcgggcatcggtcgcgagacccacaagatgatgctcgatcattaccagcagaccaagaacctgctggtttcctacagcccgaacaaggtcggtttcttc

SEQ ID NO: 35260 - DNA, 558 bp, Agrobacterium tumefaciens
attttaactggaaataccatgaccgttatcgcttcggagctttccgctgccatccgttccattcccgactatccgaagccgggcatcatcttccgggacatcacgacgctgctcggcaacccgcgcgcatttcgccgcgccgtcgatgaactcgtgcagccctatgcgggaacgaagatcgacaagatcgccggcatggaagcgcgcggcttcattctgggcggggcggtggcgcatcagctttcggccggtttcgtgccgatccgcaagaagggcaagctgccgcacaccaccgtgcgggtcgcctacagcctggaatatggtgtcgacgaaatggagatgcatgtggatgccgtacagccgggcgagaaggtcattcttgtcgacgacctgatcgccaccggcggcaccgccgaaggtgccgtgaagctcttgcgacagatgggtgcggaaatcgtatccgcctgcttcgtcatcgacctgcctgatctcggcggccgcaagaagctggaagatcttggcgtcgacgtgcgcacgctggtagaattttctggccat

SEQ ID NO: 35261 - DNA, 1848 bp, Agrobacterium tumefaciens
atcttcgagtatttcgagaactggataaagcccttcgcccgcaaggacgatttgcggccgcctgaaagcacattcgccttcatctggttttatatctcgcaggccaaggcaccgtttttcgcgatgctggtgctcggcgggctgacggcggccatcgaggcggcgctgttctggttcgtcgggcggcttgtcgatattctctcgacggtgaaaccggatgagggctgggcggggctgcttgcggcgcatggcggggaactcgtcggcatgctggtgctgatcggcgttgtgcggtttatcgtcactatgatcacggcactggtggaccagcagatcattacgcccggtttctacaatctggtgcgctggcaatcctatatgcatgtggcgcggcaatcgctgacctttttccagaatgatttttccggccgcatcgtcaccaaggtctggtccggcgggcaggcggcgggcgatctcgtcacctcgctgatggaaagtgtgtggttcgtcggtatctattcggtttcaatgctgttcctgatcggcgggctggactggcggcttgcggttctcgtcgtcgtctgggtagcgatcttctcgctgctggcgcggtatttcgtgccgcgcatccgccatcattcaaaggagacggcggaagccgcctcgatgctgtcaggccgcatggtggatgcctatagcaatatccagacgctgcggctgttcgggcgcgacgacgccaatgatcgctacatgcgtcagggcttcgatattttccagacctcgacgatgaagtttacgcggttcatcaccggcgtgcgcgcctccatggcgctgctatcgggcgtgatgatcacctccatggcggcgctctgtatcgatttgtggctgtccggcaagatcagctccggtgcggtggctttcacgctggcgctggtactgcgcctcaacttcctgctcgggcggttgatgacgcagttcaacggaatcatgcgcaatttcggcacggtgcagaatgccgccgaattgatctcgcagccgatcggtctcgttgatgcgcccgacgcggcggtgcttgaggtcaagaagccgagcatccgttttgagaatgtcagcttccattacgggcgggcgaatggcgtcatcgacaatctcaacctcgagatcagggccggtgaaaaggtcggcatcgtcggccgctccggcgccggcaaatccacgctcgtcaacctgctcctgcggttttacgatgtcgagaaaggccgtatcctgatcgatgggcaggatatagcccgtgtcagccaggaatccctgcgcgcccatatcggcatggttacgcaggatacatccctgctgcatcgttctatcagagacaacatcatgttcggccgcacggatgccacagaagcgcaattgattgaggcgacgcgtcgggccaaggcggatgatttcatcacaaggctggaggaccagcgcggccgcacgggttttgacgcgcatgtgggcgaacgtggcgtgaagctctccggcggccagcgtcagcgcatcgccattgcccgcgtgatgctgaaggacgcgccgatcctcgtgctcgacgaggcgacctcagcgctcgattcggaggtggaggcggcgatccagagcaatctggacgagctgatgcagggcaagacggtgctggccatcgcccatcgcctgtcgacgattgccgctctcgaccggctgatcgtgatggatcaggggcttatcgtggaagaagggagccacgctgagcttgtcgcacagggggggctttattcggagctttgggcgcggcaatcgggcggctttctcgacgcggaagacgtgaag

SEQ ID NO: 35262 - DNA, 1818 bp, Agrobacterium tumefaciens
atgtttggctggtttgaaaaacgcctcgatccttttccctcttcgacgcctgatgtgccgccgaagacgcttttgtcgttcatctggcattatgtgaaacccgcctggccgtggctgctgctgctcggcctgatgtccatgggcatcgccattgcggaagccatgctctacaaattcctcggcaatatcgtcgactggctttccacggccaatcgcgagacgttttttgccgatgaaggctggcatctgatcgtcatggcggggctggtgctattcctgctgccgctgatgggcgcgatccacaccatgacgatgcaccagacgcttgccggcaatttcggtatgatcgcgcgctggaaaatgcaccgtttcctgctgcgccactccatgaactttttcgccaacgagtttgcgggccgggtttcgaccaaggtaatgcagacggcgctggcgatccgcgaagtggcgctgaaggtgatcgacgtcttcgtctatgcgatcagctttgtcgtctcgatgctgttcatggtcgcggcggcggactggcggttggtgatcccgctgctgatctggctcggtatctatatggcgatccttgcctatttcgtgccgaaactcggccggctggcgcaagaacaggccgatgcacgctcgatgatgacgggacggatcgtcgacagctacaccaatatctcgacgatcaagctgttttcccatgcggggcgtgaggaaagatatgcgcgtgagggcatgaatgtgttcctcggcacggttcaccgccagatgcgcaagatttccggcttcaacatcctgatcgacctcaacaatgccgtggtgctgttttccacggcaacgcttgggctgtatttctggatgcagggttcggtgacggccggttcggtcgccatcgccatcagccttgccatgcgcgtcaacggcatgtcgcagtggatcatgtgggaagtcacgtcgctgttcgaaaatatcggcactgtctatgacggcatgtcgatgatgacgaagcctcatgatattgtcgacgttccgaaagcgcctgagcttgcagcgccgcagggtgcaatccattatgacaacgtccgcttccactacggcaagaacaagggcgtgatcgacgggctgacgctcgacatcaagccgggcgagaaggttggccttgtcggccgttcgggtgcgggcaagacgacgctgatgaacctgcttctgcgcttctatgatctagaaggcggcaggatcacgattgacgggcaggatatttccaaggtgtcgcaggacagcctgcgcgagctgatcggcgtcgtgacgcaggatacctcgcttctgcaccgttcgatccgcgacaacatcgcctatggccatcccgaggccaccgacgagcaggtgatcgcggcggcgaagcgggcaaacgcctgggacttcatcgaaacgcttgtcgacatgcatggtcgtcagggtctcgatgcccaggtgggcgaacgcggtgtcaagctgtccggtggccagcgccagcgcatcgcgattgcccgcgtcttcctcaagaacgcgccgatcctggtgcttgatgaggcgacctcggcgctcgatagcgaagtcgaggcggcgatccaggagaacctgttctcgctgatggagggcaagacggtgatcgcgatcgcccaccgcctttcgacgctgaccgaaatggaccggctcatcatcctcgacaagggccggatcgtggaggcgggcagccatgcggaactggcggcgatgggcggcatctatgccgacctgtggcggcgtcagtccggcggcttcatc

SEQ ID NO: 35263 - DNA, 861 bp, Agrobacterium tumefaciens
gacaagaaggccgttgcccaggcgtggttccagcatctgcgcgacaccatcgtcgcctccttcgaaaccctagaagacgaactcactggcccgctttccgatcaggagcctggtcgcttcgtgcagaaggactggctgcgcgacaatggcgagggcggcggcggcaagatgtcgatgatggaaggtcgcgtcttcgaaaaggtcggcgtgcacacctccaccgtctatggcgaattctcgcccgagttccgcaagcagatacccggtgcggaagaagacccgcgcttctgggcctccggcctttcgcttatcgcccatccggtcaatcccaatgtgccggccgtgcacatgaacacccgcatggtcgtcaccaccagccattggttcggcggcggtgcggatctgacgccggtgctcggccgcaggcggacacagcaggacccggatacccagctgttccaccgcgccttcgagattacctgcaaccgtcatccgatcgccgattatccgcgatacaagagctggtgcgacgagtatttcttcctgaagcaccgcgacgagccgcgtggcaccggcggcatctttttcgactggctgcaccctgacgaggagaaaggtggctgggacgccaatttcaccttcgtgcaggatgtcggccgcgccttcaacctcgtctatccgaaaatcgtccgcgccaatttcaaccagaactggacggaagaggaccgcgacgagcagctcatccgccgcggccgctacgtggaattcaacctgctttacgatcgcggcacgatcttcggtctgaagaccggaggtaacgtcgaatcaatcctgtcatcgctgccgccggtggtgcgctgg

SEQ ID NO: 35264 - DNA, 1314 bp, Agrobacterium tumefaciens
gagcatatgacggcaatcaccatgaacgatgcgctggaacgcgcgggtgcgggcgcctatcaacggcggctgatgggcatattcggcctcgtctgggcggcggatgccatgcaggttctggcggtcggcttcacagccgcctcgattgccgcgacctttggcctgacagtgccgcaggcgctgcagaccggaacggcgttctttttcggcatgttgctgggtgctgccggtttcgggcggttggcggaccgctatgggcgccgccgggtgctgatcgtcaccgtggcctgcgatgcgctgttcggcgtgctttcgatattttcacccgatttcaccattctgctcgtcctgcgttttctcaccggagctgcggtgggcggcactttgccggtggattatgcgatgatggccgaattcctgcctgccaaaaatcgcgggcgctggctggtttttctggaaggtttctgggcggttggcacactgatcgtggcactggcggcttggggtgccagtcttgcgggcgtggctgatgcctggcgctatatttttgcggtgacggctttcccggccgttcttggtctcgggcttcgctttctggtgccggaatcgccgctctacctgctgcgcacggggcgatccgaagaagccaaggccgtcgtcaaccgcatgctggtggtgaacggccgtgcaccgctcgatgccggaaccgggcttttccagcctgacgtgaccaaggggcaggggatattttcgccggcgctccggcagcgcagcatgatgatcctcgccatctggtttctcgtctccgtttcctattatggcgtcttcacctggatgccggcgaaactggcaggggacggtttcggtttcgtgcgcggttacgggtttctggtgctggtggcgctggcgcagatccccggttatgcaattgctgcctatggcgtcgagaagtggggtcgcaagccgacgctgatcggtttctgcctgctgtcggcgctcggctgcctgctcttcacgctcgcctctgccggtgcgatgattgccgcctcgcttctcatcatgagcttcgcgctgctcggcacctggggtgcgctttatgcctttacgccggaactttacccgacggagtcgcgggcgaccggcatgggcgctgcgggtgccatggcaaggctcggcggcctgctggcgccgtcactgcttggttatgccattgcgcagggttttggggtcgcgattggcatctttgccgggctactggtgctggccgccattgcggcgaccatgatcaatgcggaaacacggcaggtggcgctg

SEQ ID NO: 35265 - DNA, 1662 bp, Agrobacterium tumefaciens
atgacgctaccccatgccccggtccacaaacctcaagcgcaatcggactggtggaaaggagcggtgatctatcaggtctatccgcgctcgtttcaggatacgaccggcgacggatatggcgatctggccggggtgacgaaacgtctgccctatatcgcctcactcggtgtcgatgccatctggctctcacccttcttcacctcgcccatggccgatatgggttatgacgtttccgattattgcaatgtcgatccaatgttcggcacgctcgccgatttcgacgccctgatggccgaggcgcaccggctggggctgaaagtcatcatcgatcaggtgatttcgcatacgtctgacaaacatccgtggttcgtggacagccgcgcgagccgtatcaacagcaaggcggactggtatgtctgggccaatcccaaaccggatggcacggcacccaccaactggctttccgtgttcggcgggccggcctgggagtgggacggggtgcggaagcaatattatatgcacagcttcctcgcctcgcagccggacctgaatttccacaatcccgaggttcaggatgcggtgctggaaaccgtgcgtttctggctcgatcgtggcgtggacggttttcggctcgataccgtcaaccactatttccatgacaagcttttgcgcgacaacccgccgcttgttgacgacgaaagttttggcctcgatgcgtccgacgtcaatccctatggcatgcaggaccatctctacgacaagacacggccggaaaacgtggctttcctcaagcgctttcgtgcgctgctcgacgactatgagggccgcgccacggtgggtgaggtgggggatggggctcgctccctgaaaacggtcgcggcctatacatccggcaatgacaaactcaacatgtgttacacattcgatctgctgggaccggatttcagtgcaaaacacctgcgcggctcggtcgagacattcggcaaggtggtgacggatggctgggtgtgctgggccttttccaaccatgatgtggtgcgccatctcagccggttttccgaaggccccgaggagcagacgcgcgttgcgaaactcgccatctgtgttctcgccagcctgcgtggctccatatgtctctatcagggcgaggagctggggctgacagaggccgaacttgccttcgaggatctgcgtgatccctatggcattcgtttctggcccgccttcaaggggcgcgacggatgccgcacaccgatggtgtgggaaacgggcaagccgaatgccgggttctcaactgccgaaaagccttggctgccggtgccctacgtgcatgccatgcaggccgtggatgcgcaggagcgcaagccggattcggttctcaaccattatcgggccgtcctgtccttccgcaaaacccatggtgcgctgcgcgacggcgacatgcatttcatcaagaccaatctcgatgtgctggccttcacccggcagaggggtgatgaaaaactgctgttcgttttcaacctgacccgtgagccggtggaatttcccgtgccaaaggccatgagtgttacggatatcctgcagatgccgggttttgcgccgctctatgatgctggcatcgtgaagctcgaggggctggatgtattttgcgggatcgttgca

SEQ ID NO: 35266 - DNA, 774 bp, Agrobacterium tumefaciens
atgcatcggacagttatcgtgacaggctccacaagcggcatcggccttggcattgcgcaaagatttgcgcgggagggcgccaatatcgtgctgaacggttttggcgacgacgacgagatcgaaaaactgcgccttctgctggaagccgaaagcggcgggcgggtgctttaccatcccgccgatatgacgaaaccggacgagatcgccgatctcatccagtcctcacacgaaaaactcggctcggtggatgtgctcatcaacaatgccggtattcagcacatcgcgcccatcgaggagttcccgacggaaaaatgggactggatcatcgccatcaatctgaccagttcttttcacaccatgcgtgccgcgataccgctgatgaaaaaggcaggcaaaggccgcatcatcaacatttcctcagcccacggccttgtcgcctcgccgttcaaatcggcctatgtggcggccaaacacggcatcatgggcttgacgaaaacggcagcgctcgaacttgcgcaaacgggcgtcaccgtcaacgccatctgtcccggttacgtgctgacgccgctggtggaaaagcagataccggaaatggccaaggtgcgcggcatcagcgaagcggcggtgaagaacgacgtgatgctggaattgcaggcgaccaaacaattcgtcaccgtcgatgacgtcgccgccgctgcgatatttctggcaagcgacgccgcaagcaacatcaccggcacccatatttccgtagacggcggctggacggcacaa

SEQ ID NO: 35267 - DNA, 2505 bp, Agrobacterium tumefaciens
gacgtcagcctgttgcaggaccgggaaaaggcgctgatcgccgcgcaggccgaggccgaggcgttgcaccggcagctccaggcggttctgcgcgccctgcccgtgggcgtgcttttgctcaacgccgatctcgtcatcgaatatgtcaatccgttcttctaccaggtctggggtgagatcggcggcgagaagtcgcttgtcggcaagagctatcgcgaattcatggagatgaatttcgacagcggcctttatgactatggcgacagaccttttgatgacgtctatgaggagcgggtgcagcggcttctgaaagcggacgccttcgccccccgcgaggtgcgcagcaaaagcggcaaggtcaccgtgatctcgaaaacccgtctcgaaggcgggaagatcctcagcacctatgccgatgtgaccgatgtgcgcatgcgcgacgccgagatcagcaaggccagggcggaactggaacgcgtcggcgaatatatgcagggcgccacacgcgccatggcgcaggggctggtgctggtcgagcagggcacgatcatcatgtccaacgaggcgatggcgaggatgttcgatgtgccgccgcatctcctggaaaagggccgcaactgggccggcttctttgcccattgcgcggggcgcggcgatttcggcacggccgcggaggctggcgagacgctgcggatctggagagagaatatcgcggccaacaggccgttttcctggcttgtccacgttgccggcaaaagctggctcaacctggaggccaccaacagttccggcaattactggctgatcatcgtcacagatgtgaccgagatgaaggtgcgcgaggaggagttgcagcggctgctttcgcgtgcggaggccgcggacagggccaaatcggaatttctggccaatatgagccatgaaatccgcacgccgatgaacggcgtgcttggcatggcggagcttctggccaagtccaagctcgacacgcgccagaagacctttaccgacatcatcgtcaagtcaggcaatgcgctgttgacgatcatcaacgacattctcgatttctccaagatcgaggcggggcagatgaagctgcgcagcgtgccttttgatcccgctgaggcagtggaggatgtggtctcgctcctgtcctcggcggcgctggaaaaggacatcgagctgatcgttcgcattgatgcctcggtgtccggcaaggtcatcggcgatgccggccggttccgccagatcgtcaccaatatcgtcggaaatgccgtcaagttcaccgaaaccgggcatgtgctggtcgagctttcggcgcagtcggcggaggcgtcggaaagcattttttcactgcgtgtcgaagacagcggcatcggcattccggtcgacaagctggaaacgatctttgacaagttcagccaggtcgatggttccgcgacacggcggcacgagggaacggggctgggcctagcgatcacggtaggcctcgtcggcctgttcgacggcaagatcaatgtcgtcagcgaggtcggcaggggctcggccttcgaggtcgatattccgtttcaggtgatggagcgacggcgggacgtgccgctgctttccgtggcgatcgatgatatccgggtgcttgtcatcgacgataatgacgtcaaccgccgcatcctgaccgagcagcttcgcagctggggtatagatggccacgcggtggagaatgggccttccggcatcgccgtgttgcaggaagcggcgtctctcggctttgccatcgacgccatcatcctcgattatcatatgcctgtcatgaacgggctcgacgtggtggagcgtatccgggctgataagcgctttgacgatattgccattgttttcctgacctcgatggatgtggtgggcgacgagacgctgtttaccgatctcagcgtgcaggcgcatctgatgaaaccggcgcgggcccggctgctgcgctccaccctgttcgacgtggtgcgcgatgtgcggctgaagcgcatccgtcagcatccgcttgcgcaggggacgggtggagagaaagcccggccggaaagccggcccgccgaaaagaagcaacgagctgaggctccggccacggttcccgaacgtagccggccgtgccttctcgatgtgctggtggccgaggataacgacgtcaaccagattgttttcagccagattttgcagcaggcaggcctgcgcttcctgatcgtcggtaatggcaagagggccgttcaggcatgggaggagtataatcccgccctcattctgatggatgtatccatgcctgtcatgaacgggcaccaggcgacacaggccattcgcgctgccgagcaggcggccggtgatagccggcatgtgcctgtcatcggcgtcaccgcccatacgcaggaggcggaccgggagcgctgcctggaggcgggcatggatgattatctgtcgaagccgatcagccccgaaagcctcgaagacaagatcgcgcaatggctg

SEQ ID NO: 35268 - DNA, 1387 bp, Agrobacterium tumefaciens
agttttaacgaactcggcctctccgaaaagattgtggccagtgttacccagcttggctatacgacccctacccccattcaggcgaaagccattccgctgctgctcgaaggccgtgacctgatcggcctcgcacagaccggcaccggcaagacggccgcctttcgggctgccgatcatcgaaatgctgatgaagcaggcggatcgtccggcaaatcgcaccacccgcacgctgatccttgcaccgacccgcgaactggtgaaccagatcggcgacaacctgcgttccttcgtgaagaagacgccgttgcgcatcaaccaggttgttggcggcgcgtcgatcaacaagcagcagcttcagctcgaaaagggcactgacaccctcgtggcgacccccggccgcctgctggacctcatcgcccgcaacgccatctcgctctcgaaggtgacgtatctcgttctcgacgaagccgaccagatgctcgatctcggcttcatccatgatctgcgcaagatttcccgcatggttccgcccaagcgccagacgctgctgttttcggccaccatgccgaaggccatttccgagcttgccagcaacttcctgaccgacccgatcaaggtcgaggtgacacctccgggcaaggctgccgacaaggtcgagcagtacgtgcatttcgtcgccggcaagaacgacaagaccgatcttttgaagaagtcgctcaacgagaacccggatggccgctccatcgtgttcctgcgcaccaagcacggcgcggagaagctttacaagcatctcgaacatatcggcttcaaggtcgcctccattcacggcaacaagagccagggccagcgcgagcgggcactgaagggcttcaaggacggtgagatcaaggttctggtcgcgaccgacgtcgctgcccgcggcatcgatatcccggccgtaacgcacgtcttcaattacgacctcccggaagtgccggatgcttacgttcaccgcatcggccgtaccgcccgcgccggccgcgacggcatcgccatcgctttctgcgcaccggacgaaacccgcctgctgcacgacatcgaaaagctgatgaagatcgatatcccggttgcgtctggcgaacgtccggctggtcttgcaagccccacacgccccaataacaaccgtggcggtcgcaacaacaatggcggccagccgcgcggcccgcgtgaaggtggacgtcacaacggcgaatcccgcccgtcccgcaaccacgcgccgcgtgatgcggacaacgatctggaagtaacctccgacttcaagcgcgttaagcaggctgaaggcgacgcaggccgcccggccggcccgcgcaagcagcgccgccccgcccgcaagcccggcggcagcggc

SEQ ID NO: 35269 - DNA, 828 bp, Agrobacterium tumefaciens
tggggttttgacggctcctccacccagcaggccgaaggccactcatcggattgcgtgctgaagcccgttgcgatctacccggatccggcccgcaccaacggcgcgctcgtcatgtgcgaagtcatgatgcccgatggcgtcaccccgcacgcttccaacagccgcgccacgatcctcgaagacgaagacgcatggttcggtttcgaacaggaatatttcttctaccaggacggccgcccgctcggtttcccggaacagggttaccccgctccgcagggtccgtattacaccggcgtcggcttcaagaacgtcggctcggttgcccgcgaaatcgttgaagagcacctcgatctctgcctcgaagccggcatcaaccatgaaggcatcaacgccgaagtggccaagggccagtgggaattccaggtattcggcaagggctccaagcgcgccgccgaccagatctggatcgcccgttacctgctgctgcgtctttgcgaacagtacggcatcgacgtcgagttccattgcaagccgctcggcgataccgactggaacggctccggcatgcattgcaacttctcgaccaagttcatgcgcgaagttggcggcaaggactatttcgaagccctcatggccgctttcgccaagaattggcaggagcacatcgacgtttacggtccggacaaccatctgcgcctgaccggcaagcacgaaaccgctccgtggaacaagttctcctatggcgtggcagaccgtggcgcctcgatccgcgttccgcactccttcgtcaacaacggttaccgtggttacctcgaagaccgtcgtccg

SEQ ID NO: 35270 - DNA, 750 bp, Agrobacterium tumefaciens
ttctctctcgaaaaccgcaccgccatcatcaccggcagcggtcgcggcctcggtttcgaaatcgccaaaggcttcgccgaggcgggcgcccatgtctggctgaccggccgtaacgccgagacgttgcaacaggcggtcgacacgctgcgcaaggcgggcggaaaggccgattatgcagccttcgatattgccgacacggctgcaggaagcgcgcttgtccgccgcatcatggatgaggccggccatctcgatatcctcgtcaacaatgtcggcgcgcgcgaccgccgcccgcttgccgaatttaccgacgacgacgtgctggagctcatccgcaccgacctcacctcctccatctcgctgtcgcgtgatgcggctgaagccatgaatgccaacggttacggccgcatcatcaccatcacctccattctcggccatatcgtccggccgggtgatgcgatctatcccgtcgccaaacaggggctgaccgggctgatgcgggcgattgcagtggaatatggcgcgcgcggcatcaccagcaacgccattgcccccggcatgttcgccaccgaaaccaatgccgcccttgccgaaaaccctgacatggtggcctttgccaagctgcgcgtaccgctggagcgctggggcagacccgatgaaatcgccggggctgccctgtttctcgccagcgacgcggcctccttcgtcaacggccacatattgacggtggacggcggcatgtcggtgcggctg

SEQ ID NO: 35271 - DNA, 1219 bp, Agrobacterium tumefaciens
atgacgaatgttgtggtggtcggctcgcaatggggcgacgaaggcaaaggcaagattgtcgactggctgtccgagcgggcagatgtcgtcgtgcgatatcaaggcggccataatgccggccacacgcttgtcatcgacggcatcagctacaagctttcgcttctgccgtccggcgtcgtgcgtcccggcaagctcgccgtcatcggcaatggcgtcgtggtcgatccgcatgcgctgattgctgaaatcggccgtctggaagtgcagggcgtcaaggtcacgccggaaaacctgcgcatcgccgacaatgccacgctcattctttccctgcaccgcgaactggatggcatgcgcgaagacgccgcctccaacagcggcaccaagattggcaccacccgtcgcggcatcggcccggcttacgaagacaaggttggccgccgcgccatccgcgttatggatctcgccgacatggaggcgctctccgccaaggtcgatcgcatcctgacgcatcacaatgcacttcgccgtggtttcggcgcgaccgaggtgtcgcatgaaaccatcatggaagagctgggctcgattgccgagcgcatcctgccgttcagcgaaaccgtctggctgctgctcgacaagaagcgccgcgccggtgcgcgcatcctgtttgagggcgctcaaggctcgctgcttgatatcgaccacggcacatacccttatgtgacctcgtccaacacggttgccggtcaggccgctgccggttcgggcatgggtccgggatcgctcggttatattctcggcatcaccaaggcttacaccacccgcgtgggcgaaggcccgttcccgaccgagctgcatgacgaaatcggccagttcctcggtgaaaagggtcatgaattcggcaccgtcaccggccgcaagcgccgctgcggctggttcgatgcggcactggtgcgccagtcggtcgccaccaacggtattaccggcatcgcgctgaccaagcttgacgttctcgacggtctcgacgagctgaaaatctgcgtcggctacaagcttgacggtcaggaaatcgaccatcttccggcaagccagggtgcgcaggctcgtgttgagcctatctatgtcacgttggaaggctggaaagaatctaccgtcggtgcccgaaaatgggcggatttgcctgctcaggcaatcaaatatgtccgtcaggtcgaagagctga

SEQ ID NO: 35272 - DNA, 651 bp, Agrobacterium tumefaciens
gacagctggaagcacgttctctcgggcgaattcgccagcccctacatgcagaagctgaaagagttcctgcttgccgaaaagaccgccggcaagcgcatctttccgaagggcgcggaatatttccgcgctctcgacctcacgcctctcgacgaggtcaaggtcgtcattcttggccaggatccctaccatgggctcggtcaggcacatgggctctgcttttcggtgcagcccggggtgcgcattccgccctcgctcgtcaatatctacaaggaattgcagagcgacctcggcattcgcccggtcaagcacggttttctggaaagctgggcaaaacagggcgtgttgctgctcaacagcgtgctgacggtggaagaggcgcgggccgcctcgcatcaggggcagggctgggaaaaattcaccgatgcggtcatccgcgccgtgaacgacgaatgtgaccatgtggtctttctgctctggggttcctatgcccagaagaaggcggccttcgtggaccagcgcaaacatctcgtgctgcgctcgccacacccgtcacccctttcagcccataacgggtttttcggcaacggccatttttctaaggccaacgctttcctcgtttcgcatggccgtgatccgatcgactggcaattg

SEQ ID NO: 35273 - DNA, 1011 bp, Agrobacterium tumefaciens
atgggtttcaaagttgcaattgtaggcgctaccggcaatgtcggtcgcgaaatgctcaacatcctggccgaacgtggttttccggcagatgaagtcgtgccgctcgcttcctcccgctcgcagggcacggaagtctcctatggcgatcgcacgctgaaggtttccaacctcgaaaactacgatttttccgacacggatatttgcctgatgtcggccggcggcgagatttccaagaagtggtcgccgaagatcggtcagcagggttgcgtcgtcatcgataactcgtctgcatggcgctatgatcaggatgttccgctgatcgttccggaagtcaatgccgatgcgatctcgggcttcacgcgcaagaacatcattgccaaccccaattgctccacggcccagctcgttgtcgcgctgaagccgctgcatgatttcgccaagatcaagcgcgtcgttgtgtccacctatcagtcggtttccggcgccggcaaggaaggcatggacgagctgttccagcagacccgcgccgtcttcgtggccgatccggtcgaaaccaagaagttcaccaagcgcatcgccttcaacgtcatcccgcatatcgacgtcttcatggaagacggctacaccaaggaagagtggaaggttctggccgaaaccaagaagatgcttgatcccaagatcaaggtcacctgcacggccgtgcgcgttccggtcttcatcggccattcggaatcggtcaatatcgagttcgaaaacgagatcactgccgatcaggcgcgtgacatcctgcgcgaagcgccgggttgcctcgtcatcgacaagcatgaagatggcggctacatcacccccgttgaatccgccggtgaagatgcgacctatatttcgcgtatccgcgaggatgcgacggtcgagaacggcctcaacatctgggttgtttcggataatctgcgcaagggcgctgccctcaatgccatccagatcgccgaactgctggtcaatcgtggtctcatc

SEQ ID NO: 35274 - DNA, 852 bp, Agrobacterium tumefaciens
tttggcctttcggcagccctgacgacccctttcaaaacggacggaacggtcgacatcgatgccatgatcgcccatgcgcgccgctgtttgtccaacggctgcgacagcgtgacactcttcggcacgacaggtgaaggctgctccgtcggcagccgcgaacggcaggcgatcctctccagcttcattgcagcaggcattgcgccgtcgcgcatcgtcaccggtgttctggtggattccatcgaggatgcggcagaccagtcggccgaagccctgaatgccggcgcgcggaatattctgctcgccccgccctcctatttcaagaacgtcagcgatgacggcctgtttgcctggttctcggctgtcttttcaaagatcggcaaggatgcgcgcgacattctcgtctacaacatcccctccgtgaccatggtaacactgtccgtcgagctggtgggacggctgaaggccgcatttccgggcatcgtcaccggcgtcaaggattcctccggcaactggagccataccgagcgtctcctcaaggaacacggtgaccttgccatccttatcggcgacgagcgtgatctcgccaggggcgttcgcctcggtggccagggtgccatctccggcgttgccaatttcctgacgcaggaagtgcgcgccatggccgtcgatggcaaggacgatccgcgcatcgtcgatcttgttgtggaacttctgaaattcccggttacgcctgccgtcaaggtgctggtatcacacacgacaggggaaactatctggtcggatgtgcgtgcaccactcgtcgccatttcaccggaagaccgccggcagatcgaaggcgcattcgacgcgctg

SEQ ID NO: 35275 - DNA, 864 bp, Agrobacterium tumefaciens
atggcaccggtgaatattcagaacgtccagaagcgcttcggctccgtcaacgtcattcatggcatcgatatcgacatcaaggatggcgaattcgtcgtgcttgtcggcccctccggctgcggcaaatctaccctgctgcgcatgatcgccggacttgaagagctgagcgacggcgaaatccacatcggcccgcgcgaggtcagccacctgcctgcccgtgaccgcgatatcgccatggtcttccagaactacgcgctttatccgcacatgacggtgaaggataatatgggcttcgcgctgaagttgaagaaggtgagcgcggacgaaaccaaggccaaggtggacagagccgccgccattctggggctggaaaaactgctcgaccgttatccgcgccagctctccggcggccagcgtcaacgtgtcgccatgggccgcgctctggtgcgcgatccgcaggtcttcctgttcgatgaaccgctctccaatctcgacgccaagctgcgcgtgcagatgcgcggcgagatcaaggccatgcaccagcgcatcggcacgacgaccatttacgttacccacgaccaggtggaagccatgaccatggccgacaagatcgtggtgctgcatgatggcatcatcgagcagatcggcgcgccgctggagctttacgacaatcccgcaaacctcttcgttgccggcttcatcggttcgcccgccatgaatttcattcgtggccgggtggaggaaggcgtcttccgcaccataaaaggcctcagcctgccgctgcccgcccatgccgatatcggcaagctcggcggccgcgacctcgtctatggcgtacggccggaacatatccgcgccgccgag

SEQ ID NO: 35276 - DNA, 873 bp, Agrobacterium tumefaciens
gtgctctgcgtgggtgccgccgtgctcgacaccctgtttcgcgtggcagacatgccgaagggcgaaggcaaggtcctgccctatgaggtgctgcagatcgccgaaggcatggcgtcgagcgccgcttatgccgttcatcgcatgggcggccgcgccagcctctggggtgcggtgggcgacgacgaaaccggtacccgcatccttcgcgatctcagtgaaagcggcatagacacatcaggcatgacggttgcgcccggcgcgcgctcggccctgtcgacgatcattatcgataacaggggcgaacggctgatcgtgcctttctacgatcatcgccttcacgagaaaaaacgcgcctgcacgccggaggatattgctctctttgatgcggttctggttgatgtgcgctggccggaactggcgctcgatgtgctcaccgtggcgcgtgcgcttggcaaacccgccattctggatggcgacgtagcaccggtggaaacgctggaggggctcgcccccgccgcgacccatatcgtcttttccgaacccgccgccacccggctgaccggacttgaaacggtgaaggacatgctgccggtactgcatgcccgttatccgcagaccttcatcgccgtcaccgccggaccagcgggctgctggtggacggaagccgacgatccgacagtgcatttccagacgacgatgcaggtcgaagcggtggacacgctggcggcgggcgatatcttccacggcacctttgcgctggcgatggctgaaggcatgcaaagccgcgcggccgtccgcctctcctccgttgccgccgcgctcaaatgcacggtcttcggcggtcgcatcggcgcaccgacgcgcgaagagacc

SEQ ID NO: 35277 - DNA, 1017 bp, Agrobacterium tumefaciens
gtacccgtcttcgacggccacaacgacgtgcttctgcggttatggcgttccggcaatacctcccctgaaacgcttctgatcgagggtgacacggttggccacatcgacctgccgcgtgccagaaagggcggcctcgccggcggcctctgcgccatctacgtgccctcgcccagcatggaaaaggacgcaaacggtgatttctcgacaccgaccgaagccgacgctctgaaggcgacgcttggcatggcggccctgctgttccgcgccgaaaagcaatccgcaggcgcactcaaggtctgccgcaccgccgccgatatccgcagtgccatggcagagggcgccttcgcctcggttttccatatcgagggcgcggaagcgatcggcgacgatctggatgcgctgcacgttctgcacgaggcgggtctgcgcacgctcggaccggtctggagccgcccgaacatcttcgcttacggcgttcccttccgtttcccctccacgccggatatcggcccgggtctgaccgataccggcaagcggctggtaaaaacctgcaatgagctgaagatcatggtcgatctctcgcacatgaacgaacagggtttttgggatatcgccaagatctcagacgcgccgctggtggcgtcgcattccaacgcctacgcgctgtgcaatcacagtcgtaacctcacggaccgccagctggacgccatccgcgatacgggcggccttgccggcatcaatttcggcgtgctgttcctgcgtcaggacggcgtgaagaacccgaataccgacctcaacgaacttgtccgccatgtggattatatcgtcaaccgcatcggtatcgaccacgtcgcgctcggttcggatttcgacggcaccaccattcccgccgccatgaaggatgcgggcgacctgcaattgctggtcgaagccctgcgcaagggcggttatgacaacgaggcgctcgccaggatctgccacggcaattgggtccgcgttctggaaaagacctggggc

SEQ ID NO: 35278 - DNA, 1725 bp, Agrobacterium tumefaciens
tcgatgaaaaaagtgctgattgccaatcgcggcgagatcgcggtgcgcatcatccgggcctgtcgcgattacggcctgcaatcggtcgccgtttatgccgaccccgatcaggacgcgcttttcgtccggctggcggatgaagcctatgcgctggagggcgtgcgtcccgccgagacctatctcgatatcagcaagctgatcgcgattgccaaacgcgccggtgctgatgccgtgcatcccggttatggtttcctgtccgaacgcgccgaatttgcccaggctgtcatcgatgccggactgatctggatcggtcccgaccctgatgtcatcgaggcattgggcgacaaggtcatggcgcggcgcatcgccaccggtgttggcgcaccgctggttgccggcagcgatggccccgtttcttccgccgccgaagtcaccgcctttgccgaacagcacggcctgcccgtcgccatcaaggcggcccatggcggcggtggacgcggcctgaaagtcgcgtggaagatggaagagatcgcagagctctatgaatccgccgtgcgcgaggcgaccgtcgccttcggccgcggcgagtgttttctggaacgtttcctcgatcggccgcgtcatatcgaggcgcaggttattgctgacaagcacggcaatgtgctggtgctcggcacccgcgattgctcgctgcaacgccggaaccagaagctgatcgaagaagcacccgcccccttcctgtcggatgaacaacggcagaagatccatgatgccgccaaggcgatctgcgctgcagccggttattccggcgccggcaccgtcgaattcctgctcggtgtcgatggcacgatttccttccttgaggtcaatacccgcctgcaggtggaacatcccgttaccgaggaaaccaccggcattgatctcgtcatcgagcagtttcgtattgccgaaggccataagcttcgtgtgcttgaaacgccggaaccgcgtggccattcgatggagttccgtatcaatgccgaagatccgggccgcggctttctgccgacaccaggcttgatctcggttttcgatgcgccttccggtccgggcattcgcatggatagcggcgtcatcagcggctcaagcattcccggcgtgttcgattcgctgatggcaaagctcatcgtcaccggggttgaccgcgatcaggttctgcgccgtgcccgccgtgcgctgagggaattccgcatcgagggcatcgctaccgttctgccgttccaccgcgccgcgatcgagacggaggatttcatcggtactgacgggttcaaggttcacacccgctggatcgaaaccgatttcgccgccatgcccgatgcgatggagcgaccggcaccggccgacgacccttctatcacccgcacctatctcgagatagacggcaagcgtgtttcggttggcctgcccagcattctgctctccagcctcggcactgtcagcggtggcaatgcatccgctcccagtgctgcggtcgagaaaaaggaaggcgaaatgaccgcccccgtttccggcaccctgcaatctttcaaggtgaaggacggtgaaacggtttccgaaggtgatcttctggccgtcatggaagccatgaagatggagacgcagattgtcgccaccagggccggaaaggtccgcttgatcgtcaaggaaggcgattatctgcaggcgggagcaacccttatcgatata

SEQ ID NO: 35279 - DNA, 2115 bp, Agrobacterium tumefaciens
tgcccggcagggcagaggggggtaagcgtcatacgccgagagggcaactcgatgcccgctgaaaccaaaaccacctgcccctattgcggcgtcggctgcggcgtcatcgccaccgtcaatgattccggcgtcgtttccgtcaagggcgacccggaccaccccgccaatttcggtcggctatgctccaagggttcggctctcgccgaaaccatcgatctcgacggccgcctcctccacccggaaatcgccggcaggcgggcggcatgggacgaggcgctcgatctcgtcgcttcccgtttttccgacgccattgccgaacacggcccggattcggtcgccttttacgtttccggccagttactgacggaagattattacctggcgaacaagctgatgaaaggtttcatcggctcggccaatatcgacaccaattcaaggctctgcatgtcgtcctccgtcgccggccaccgccgcgccttcggcgcggatacggtgccgggaacctacgaggatatggagcttgccgatctggtgatcctcaccggttccaacctcgcctggtgccatcccgttctttatcaaaggctggcggcggcgaaggcggcgcggccggggatgaaggtcgtcgtcatcgatccgcgccggacgatgagcgctgatattgccgatatgcaccttgcaatccgcccggatggcgatgtggcgctgtttaccggcctgctggcgcatcttttcgccagcagcgcaatagaccgcggttacgttgaaaaccacacggccggtttcgaggccgccacgcaggccgcaagtgagcatagcctgccggaaattgccgaggccaccggcctgaccatcgccgaactgattcccttttatgaattgttcgagcgcacggaaaaaaccgtcacctgttacagccagggcgtcaaccagtcggagagcggcaccgacaaggtcaacgccatcatcaattgccacctcgccaccggccgcatcggcaggccgggcatggggccgttttcgctgactggtcagccgaacgccatgggcgggcgcgaggttggcgggctggcaaacatgctggctgcccatatgtccatcgaaaatgctgacgaccgcgaccgcgtgcagcgcttctgggcctcgcccgccatcgcgcagaaacccggtctcaaggcggtggatatgttccgggcggtggctgatggccgcatcaaggcgctgtggatcatggccacaaacccggtcgtctccatgccggatgccggtgccgtcgaggtgacgatcaaggcctgtcctttcgtcgtcgtctccgatgtcatggccaatacagacacggcccgccatgctcatgttcttctgccctcgctcggttggggcgaaaaggacggtacggttaccaattccgaacgacgcatttcccgtcagcgcagctttctcgatgcacccggcgaagcgaaagccgactggtggcagatggcggaagtggcccgacgcatgggcttcgacgctgcttttgcttaccagcagccctcggagatttttgcagaacatgcagccctttcgggtttcgagaatgcggggcgtcgggattttgatatcggcggaatcgaacgcgattcctacgagacgatggcacccgtccagtggccgaaagccggggccggcgaggccgaggtgacgcgcttttttgcaaatggccggttttatcatgccgatggcaaggcacgcttcatcgccaccgccctgccggagacggacagaacatcggcggactatccgctgacgctaaataccggccgcattcgcgatcaatggcacacgatgacgcgcaccggcaaaagcgcgcgtctcaccgcccatattgccgaaccttttgcagaaattcacccgcgcgatgcgcaggcgctcggcataaaaagcgccgatctggtggagctggaaagcccgcacggcaaggtcctgctgcgggcgctggtcagtgaaaggcaggcgcggggatcggtctttgcgccgatgcactggaacgaccagttcgcgtcgcgggcgcggatcgatgtcgttgtcgcgccggtcacggacccgcattccggccagcccgcttcgaaaaacgtg

SEQ ID NO: 35280 - DNA, 1341 bp, Agrobacterium tumefaciens
ttgccggtcttctgggggctcgagggtaagcgcgtcgttctgacaggcggatcggacggagcagcctggaaggcggaactgttgttggcctgcggggcgcagcttgatctttattgcgaggaaagcgggctttcggaaagcctcgcgacgctcgtcgcaaaaagcccgatgctgacatggcatgaccgttgctgggatgcagatattttcaaaggggcggaactggcgctggcagattgcgaagctgaagaggaagccggaagattttatcatgccgcgcgggcagcaggcgtgccggtcaatgtcatcgacaagccggaattctgccagttccagtttggttcgatcgtcaatcgctcaccggtggtggtgtcgatctccaccgatggtgccgcgcccattctggcgcaggccatccgccggcgcatcgagacattgctgccgctttcgctcaaggactggggcgctcttgcccagacaattcgagagcgcgttaatctgcggcttgcgcctggcgcggcacggcgctctttctgggaaaagtttgtcgaccgggcttttaccgaaagactggacgagggtagcgaagaacggctgctgaaagatgtagcgacgcggacggggctggcagaatcgggacgtggttttgtgacgctggtgggcgcagggccaggtgatgccgagcttttaaccctgaaagcggtgcgtgccctgcaggcggccgatgtcatcctgttcgacgatctcgtctcagcggaggtgctggaactggcgcggcgggaggccaagcgcatgctggtcggcaagcgcggcggccgcgaaagctgcaaacaggaagacatcaacgacatgatgatccgcttcgccaaggccggtagacgggtggtgcggctgaaatccggcgatccgatgattttcgggcgcgccggcgaggagatcgcggcgctggaagccgaaaatatcccggtcgaggttgtgcccggcatcaccgccgcaagcgccatggcctcacgtctcggcgtttccctgacccatcgcgaccatgcccaatccgttcggttcgtcaccggacattcgcggcagggaaagctgccggaaaatatcgactggcagtccctgtcgaacccttcggtgaccacggtgttttacatgggcgggcgaaccgccgcggacatccagtcttgcctgctcgcccacggcatgcccgcctcgacccccgtggttgtgatgatttccgtcagccgggtgaatgaacaacgctggtgcggttcgctcgcgcaactggttgctgcagtcgagaggctgggcgtgaacgaacccgtgctgatcggtgtcggggat

SEQ ID NO: 35281 - DNA, 1497 bp, Agrobacterium tumefaciens
atgtctgacgaggcaattcacgatattttcgtgatcggcggcggtatcaatggctgcggcattgcgcgcgacgccgtcggcagaggctattccgtcgcacttgcggaaatgaacgatttcgcctccggcacgtcatcggctgccacgaagctcatccacggcggtttgcggtatctcgaacattatgaattccgcctcgtgcgagaggccttgatggaacgcgaggtgctgtgggccatggcgccgcatatcatctggcccatgcgtttcgtgctgccgttccagaagggcggggtgcgcccggcctggctcgtgcgtctcgggcttttcctttacgatcatctcggcggccgcaagcttttgccggccacccgttcgctcgacctgcgccgcgatcccgccggaaaaccgctaaagccgatttttgcccgcgccttcgaatattccgatggctgggtggatgatgcccgtctggtggtgttgaacgcccgcgatgcggccgatcgtggcgccgtgatccttaaccgcacgcaggtggtttccgcgcggcgcgagggtgccttctggcgggttgaaacgaaaaatgccgccggcgaaagcaagacctaccgggcgcgcatgctggtaaatgccgcaggcccctgggtagacaaggttctggctgcgacatttggcaagaacaatgttcacaatgtccgcctcgtgcagggcagccacatcatcgtgcgcaagaagtttgccgatccgcgcgcctattttttccagaatccggacggccgcatcatcttcgctatcccctatgagcaggattttaccctgatcggcacgacggatcgcgactataccgccgatccccgggctgttaagatcagcgatgaggaaatcagctatctctgcaatgccgcgagtgaatatttcgctgaaccggtaaagcccgccgatatcgtctggacctattctggtgtgcggccgctttttgatgacggcgcatcgaaagcacaggaagcgacccgcgactatgtgctgaaaaccgaaggggcggaaggtgaagcgccgctcctcaatatcttcggcggcaagctcaccacctatcggcggcttgccgaacatgctcttgaaaaaatcggcgatgcgctgggtgaaaagggcacgccctggacagcgggttcgcatttgccgggcggaaatttcggtgccgaggcctatgcggaagaggtcaaggccttacggtcgcgctatcccttcctcgataggcgtcatgccgagcggctggttcgttgttatggaacggatgcggtggccataattggcgcagctgcggatacgacggcgttgggtcggcatttcggtggcacgctttacgaggccgaggttcgctggctgatggcgcgggagtgggcgctgacggcggaagatattctctggcgccgcaccaagcaggggcttttcctgacgcctgaagaggtgcttgggctgacggattatatcgatgacatt

SEQ ID NO: 35282 - DNA, 1488 bp, Agrobacterium tumefaciens
atgggcggttatattctggcgatcgatcaggggacgacatcgacgaggtcgatggtctttgatcgcgacatgcgggtgatcggtgtcggccagcgagaatttccgcagcatttcccggcctccggctgggtcgagcacgatgccgaagatatctggaaaagcgtgctcgaaaccatccggctggcgcttgccgatgccggcatcgccgcatccgatattgcagcaatcggcatcacaaaccagcgtgaaacaaccgtgctgtgggaccgcaacaccggcgaggccgtgcatcgcgccgtggtctggcaggatcgtcgcgccgcgccggtctgcgaggacctgaagcgccgagggctggagccgctgttttcgaaaaagaccggactgctgctcgatccctatttttccggcaccaagctgaaatggcttctcgatagcgtcagcggccttcgcgaaaaagccgtgaagggagaaatctgcttcggcaccgtcgacagtttcctgatctatcgcctgactggcggccggcgtcatgtgactgacgccactaatgcctcccgtaccttgatctacaacatcgaagacaacgcctgggatgacgaattgctgtctatccttaacattccccgcgccatgctgccggaggtgctggactgcgctgccgatttcggcgtgacggataaggcgcttctcggtgcggaaattccaatcctcggtgtggccggcgatcagcaggccgccgttatcggcaatgcctgcttcgagccgggcatgatgaaatctacctatggcacgggctgctttgcccttctcaataccggcacagaccgggtggcatccaccaaccggttgctaacgacgattgcttaccgcctcgatggcgtgacgacctatgcgcttgaaggttcgatcttcattgccggcgccgccgtgcaatggctgcgtgacgaacttggtttcatctcggttgcgtctgaagtcagcgcgctcgccgaaaaggccgatcccaagcagcgggtttatctcgtgccggcctttaccggccttggcgcgccttattgggatgccgaggcccgcggagcgattttcggcctgacgcgcggtacgggacctgcggaatttgcccgcgcggcgctcgaaagcgttgcctaccagacgttcgatctcctggacgccatgcgcaaggactgggcgggtgacaatggcaagacggtgctgagggtggatggcggcatggtcgcttccgattggaccatgcagcggctggcggatattcttgccgccccggtcgatcgtccggtctttctggaaacgaccattctgggcgcagcctggcttgcggcctcccgcgccggcatctggccggaccgcaaggcctttgccgaccattggcgccgtgaccgccgcttcagccccgacatggaagaaagcgagcggaagaacgcgatcgcgggctggcgtgacagcgttggccgttgcctctcgaaa

SEQ ID NO: 35283 - DNA, 864 bp, Agrobacterium tumefaciens
tttaccggccacggcggcaaacagcttcgttatgcgatctttcgcgccacccgctccattgcccgcggaacagtggttctgctgcacggcaggaacgaatgtatcgagaaatatttcgaaacggtcgccgatctgacggccatgggcttctgggtcgcgacattcgacacgcgcgggcagggcggttccgaaaggctcctgaaaaagcccggcgtcgggcatgtgcggcgcttttccgattatcagcgcgatatcagcctgtttctcgagcaggttgtcctgccggatacgcggctgcccttcttcatgatcgcccattccaccggcgcgcttgcggccctcgcggccgcgcccggcctgtcgaaccggatcgaccgtctggcgctgtgttcgcctttcatcgagctggatagtcagcaatcggttccacggtccgtcatccggctggttgcgacggccttgagccttgtcggcctgggcagggttcagctcggcagggaccagcgcgagcgggatttcgacggcaatccattgacctcggacgccagacgttttgcaaggaatctgaccctgcaccgacagtttccggaactgttcatcggcgcgccgacggcgcgctgggtctatgaagcgctgaagaccatggggcgagtgacccgccaggatcacctgacgaacatcaccgttccgaccctcattctggcgccgatgctggatacgattacgccctataaggcgcaggaagagctttcgcgcaatttccgggcagcacagcttcttccgataaccggcgcgcgccacgaattgctgcatgagcgcgacgttttccgcaaacaggcgctggcggccatcgacgcgtttttc

SEQ ID NO: 35284 - DNA, 1617 bp, Agrobacterium tumefaciens
ttcgacgccgtcgtcatcggtggcggtatcaacggcatcgccgcctatcgcgatctcgccctgcaggggttgcgggtgctgctggtcgagcgcaatgatttttcctccggctgtagcgcagcgccctcgcgcatgatccatggaggcctgcgttatctcgaaaatggtgaattcggcctcgtggcggaatccctgcgcgagcgcgatgcgcttttgacgcttgcgccgcatatggtgcagccgctgccgacgacgatcccgattttttcgatgttcagcggcctgttcaacgcggcggcgacgtttttcggctccggcggcaaacccgctagccggggagcgctcgccatcaaggcgggccttaccctctatgacttcgttacccggaagaaccgcctcctgccccgccacgagtttcgcggcgccggcaagacattgaagcgctggccgggcctgacgcctgacatcagatattcggccacctattacgatgcgtggataagccagccggagcggcttgcactggaattgctgatcgatacctcggccgacgcgccgcaaagcatcgcgctcaactatgcggagcttgtccgcaacggcgacgaatatcatatccgggcagaggaaacggacgaaacactgcccatccggccgcgcatcatcgtgaatgccacgggcgcatggatcgacgaaacgatcggcacgctttccgccggcccggccgcggaaaagcagaaaccaacggtctccggcaccaaggggtcacatctcatcattgccaatgatgggctcctcaaagcgctgaacggtcacatgattttctttgagaacgcggataaccgcgtttgtattctctttccttatctcggccgtgtgctcgcggggtcgaccgacatcaaggtggatcgccccgagcgggtgcgatgcgagcccgatgagcgggattacattctggacgcgatcagacaggtctttccggacatcaccgtcgatcattcagacattgtctttagtttcagcggcatacgcccgctgccgcgcagtgatgccgcttttaccgggagaatttcccgcagccattttatccaccgtgtcgccggcgatccgccgcagctttgcatgatcggcggcaagtggacgaccttcagggccttcggcgaacaggtgagcgatgaggttctggcctttcttgggcgcaagcgattgaccggcacgatgaaccgtccgatcggcggcggcaggaattttcccactggtgcaggacgcctgcccgctttgctgtcggaacagttttcaatcgaccggcgccgggcgcagcatctggccctggcttatggctcccgtgccttcgaattgatgggcttttgccggggacgaccggatgacgcgccgctttcgcaaaagtcgccgataacggccgctgaaatcctttggctgatccgctgcgaacatgtgcggcacctgacggacctcattctgcggcgcacgacactcgccatcgccggtctcatcgatgccgatcttatagacgccatcctcggcgtcgccgcgcgcgaattgggctggacacccacccgggccgccgtggaacggcagcagctcacccaggagctggaa

SEQ ID NO: 35285 - DNA, 1473 bp, Agrobacterium tumefaciens
ttgggtctcgatgtcggcaacacggtcatcaaggccgtgttgttcgacacggcgggacggcagatcgcccagcacgccatagacgggcattcgacatacccacagcccggctatgtggagcgcgatctcgaggaattgtggcgcaacggctgtgaggcgatccgccagcttctggtcaaatcggcggtcgatcctaacagcattgcgggtgtgggctgtgccggccatggcaatggtctctatcttctggataaagaacagcagccgctgctcggcatccagtcgctcgatagccgcgccgccgatatggcggccgagcttgaccggaaaagcggagacctgctgcaggcgcgttgcctgcagcgcccttggcccgcgcagacgcccacgcttctcgcctgggtgaaacggcacgcgctcgatctctatgcgcagaccagcaccgtgctgttctgcaaggacttcatcaatttccgcctgacgggctgccttgccaacgatatttccgacctcagcggcgcggggctgcttgccctgccagaagtgctgctcgaccgcgagcttctgtcactctatggccttgaggatgccttcgcgttcttcccccgttgcgtggaatcggctgacattgtcggccaggtgacgcgggaggctgccggcctgaccgggctttcggaaggcacgccggtcattggcggcttcttcgatgtcgtttcgagtgccatgggttcgggagtcatcaatccgggtgaagcctccgtcattgccggtacctggagcatcaatcaggtgtttgcggacaaaccggtcgtcagccccgatgtcttcatggtcacgaccttcggccgcgaccgctatgtcaatatcgagtccagcgccacctccgccgccaatctggaatggtacgtgcatcgtgtccgcgccgaccatggcgaccatgcctttgagcgctgcaacgaactggtcggttccgtgacgccgcgcgcagacgatccattttttcacccgttcatctttggctcacggctcggagcggagtttcgtggcgggttttatggtctcgccggctggcatggtgaaggccacatggtgcgcgccctgttcgagggcgtgtgtttcgagcaccgccgccacatcggcgtcctgagagaggcggggctgccggtcgaaagcgcggtcatgtccggcggcggttcccgcagtcagcactggccgcagatcatggcggatgttctggagattccccttcgcgtcgccgaggcccgagaaacgggcgcgctcggtgcggcgctcggtgcagccgtggcgacggggctctacccgaactacgaggaggccgttgctgcgatgacgcgggttcagaattcctatcagccggatacggcgcgggtctcgcactacaggcggcgttacggactctatcaggaattgaccggacagttgcggagcttctggagcgcgttgcggttaccg

SEQ ID NO: 35286 - DNA, 843 bp, Agrobacterium tumefaciens
acactcgaccagtctggaacttttcaccttgcaggccgcaatatcaggcggctgggctatggcgcgatgcagttagccggtaaaggcgtcttcggccctccgaaagatcgcgaggaagcgatcgcggtagttcgggaagccgtggatagcggcgtcaatcatattgatacgagcgatttctacggcccccatattaccaatcagattattcgcgaggcactgcatccctatgcagacgaccttctgatcgtcacaaaggtcggtgcgacccgtggtgaggatgcctcctggaatgcggctttctcgaaggaggagctgacccaggcagttcacgacaatcttcgcaatctgggtaaggaggtactcgatgtcgtcaatctccgggccatgttcgacgttcacggccccgccgagggatcgctcgctgcaccgcttgaagttctggcagacctgcaacggcaggggttgatccggcatatcggtgtatcgaacgtgacgccgcgacagatcacggaagccggtgaaatcgtggagatcgtctgcgtgcagaaccaatataatctggcgcatcgacaggacgatgccctgatagacacgctcgcagcacagggcatcgcctatgttccattcttcccgctcggtggcttttctccgctgcaatcgacagtgctctcagacgtcgctacgcaactggacgcgtcgccgctgcaggtggctctcgcctggctcctgaagcgatccagcaatattctggttattcccggaacgtcttcgcgcgcacatctgcgccagaaccttgcggctgcatctcttgatcttccggacagtgccatgaccgctctt

SEQ ID NO: 35287 - DNA, 1176 bp, Agrobacterium tumefaciens
ggtgccgtcaagcccccggtattcctgacgtcgaccttcgtcttcaaatcggcagaggatgggcgtgacttcttcgactacgtttccggccgcaaggagccgccggcgggcaagggtgcgggtctcgtttactcccgttttaaccaccccaacagcgagattgtcgaggatcgccttgccgtttacgaacgtacggagagttgtgcgcttttctcgtccggcatgtccgccatttccacgacgcttttcgccttcgtccggcccggcgacaccgtgctccattcccagccgctgtatggtggcactgagacgctgctggcaaagaccttccataattttggcgtctcggcggtgggttttgccgacggtgtcagcgaggcatcggtgatggccgccgcagagaccgcgatggcgaagggcagggtgtcggtcattctgatcgaaacgccggccaacccgacaaatagcattgtcgatgttgcgatgatgaggcgtgtcgctgacgtgatcggcgaaaaacaaggccacagaccgatcatcgcctgcgacaacacccttctcggcccagttttccagcagcccatcgagcacggcgccgatatttcgctctattcgctcacgaaatacgtcggcgggcattccgacctcatcgccggggcggcgctcgggcggaaggatgtcatgaagcaggtgaaggccctgcgcggagcgatcggcacgcagctcgatccgcactcctgctggatgctcggacgttcgctcgagacgctgcaaatccgaatggagcgggcaaacagcaacgcgaaaatcgttgcggaattcctgaaagcgcatccgaaggtcgagaaaattcattatttgccgttcagcgatccggcatctgcagtcggcaaggtgtttgccgctcaatgctccggtgcgggatcgaccttctcgttcgacattgttggcgggcagccggcgtctttcaaattcctcaatgcgctgaccatattcaaacttgccgtgagcctcggcggtacggaatccctcgcgtctcaccccgcaacgatgacgcattcaggcgttcccgccgatgtccgccagcgcattggtgtactggattccacgattcgcctgtcgatcggcatcgaacatcccgatgatcttatcgccgatctgacccttgctttggac

SEQ ID NO: 35288 - DNA, 1380 bp, Agrobacterium tumefaciens
gtgagtgtgacgcgcagggagcatgatttgctcgggacgaaggaaattccggctgatgtctattggggcgtgcacaccgcgcgcgccgtggaaaacttcaagatcaccggggtaaccattggccataacccttatctcgtcaggggactggcctatgtgaaggaggcagccgcacgcgcaaatcacgaactcggcctgctcgacaaggagcgcatggaagcgatcgcggaagcctgccgcgaaatccgcgccggcgcgctgcacgagcaattcgtggtcgacgagatccaggggggagccggcacttccactaacatgaacgccaacgaggtcatttccaaccgtgcgctggaactgctcggccacgaaaaaggcgattattcccgtcttcacccgaatgaccatgtcaatctcagccagtccaccaacgacgcctatccaacggcgatcaatgtcgggctgatcgaggcgatcgacgatctggcggtctccatgggcgtgctgaaagacgctttcgaccgcaaggcgcaggaatttgccggcttcatcaagatcggtcgcacccagctgcaggatgccgtgccgatgacgctcggccaggaattccgcactttcgtggtgatgctcggcgaagatcaggctcgcctgatcgaatccgccgcactgctgcacgaaatcaatctcggcgccaccgccatcggcaccggtctcaatgcgccgcgcggttatgccgagcttgcctgccagcatctggctaagctgaccggacggccactggtgacggcagcagacctgatcgaagccacacaggatcccggtgccttcgtgcacctttccggcgtgctgaagcgcgttgccgtcaagctgtccaagacctgcaacgaccttcgcctgctctcctccggtccgcgcgccggcatcggcgagatcaccctgccctccgttcaggcgggttccagcatcatgcctggcaagatcaacccggtcattcccgaagtggtcaaccaggtcgcctatgcggtgatcggcaacgacatcaccatcaccatggcggccgaagccgggcagctgcaattgaacgcctttgaacccatcatcgtgcgggcattgtcgcagagcatcagccagctcagcgccgcctgccgcacattggcggaacgctgcgttgagggcatcgtcgcaaaccccggcatcatggcgcagcgcgtggaagaatcgatcggtctcgccaccgcgctcaatccgctgatcggttattacgccgcgacggaagtggcgaaggaagcgcttgccagcggccgcaccgtgccgcaggtcgttctggaacggggttatctgacggaaacgcaattgcagcaggcgctcagcccgcgtcatctt

SEQ ID NO: 35289 - DNA, 1434 bp, Agrobacterium tumefaciens
atgcattctggaaaaacggcacccgccgaacgtgaggtcttcgtcgaagaggatctcggttaccataaagccctgaagccgcgccaaatccagatgatcgccatcggtggcgccatcggcacggggctctttctgggtgccggtgggcgtctcgcgcaggcaggcccggcgctggttttcgtttatgcgctctgcggtttttttgcgtttctggtgctgcgcgcgctcggcgagctgatcatgcatcgcccgagctccggttccttcgtctcctacgcccgtgaattctacggcgagaaaatggcctttgcggccggctggatgtattggctgaactgggccatgacctcggtggctgatgtgaccgccgtcgcgctctacatgaatttcttcaagcaatatgttccgtggcttgcaggcattgatcagtgggtattcgccatgaccgcgctcgtggtcgtgctggcgatgaacatgctgtcggtgaaggtcttcggcgaactggagttctggttcagcctgatcaaggttctggctctcgccattttcctcgtcgttggcgtctatttcgttattttcggcacgcccattgaaggccatgtcaccggcttcagcctgattacggacaatggtggctttttcccgaacggcattcttcccgccttcgtgatcatacagggtgttgttttcgcttatgcctcgatcgagctgatcggcacggctgccggcgaaaccgaagacccgcgcaaggtcatgccgcgcgccatccgcgccgtggttctgcgcctcgtcgtcttttacgtcggctccgtgctacttttcacgctgcttctgccctacaccgcctacaaagcgggggagagccccttcgtcaccttcttcggctccatcggtgtagagggcgctgacgtgatcatgaacctcgtggttctgaccgccgtattgtcctcgctcaatgccggcctttattccactggtcgcattctccactccatggcggtctccggctcggcgccggcagcgctcgcgaagatgaacaagaacggtgtgccctatggcggcattgcggtcaccgctgttgtcacggttctcggcgtggccttgaacgcggtcgttccctcctccgccttcgagatcgcgctcaacctttcggcgctcggcatcatctgcgcatgggccgtcatcgtgctctgccagctgaagctctggcagctgtctcagcgcggcgagatcgtgcgtccggatttccgcatgttcggcgcgccctataccggcatcctcacgctcatcttcctgttcggcgtgctggtgctgatggccttcgattatcccgtcggctcgtggacgatcgcctcgctgatcgtcatcataccggctctggtcatcggctggtatctgctgcgcgaccgtatctatcgactggccgctgaacgg

SEQ ID NO: 35290 - DNA, 861 bp, Agrobacterium tumefaciens
aagaaaattcggaaggccgtatttccggtcgcaggtctcggtacacgtttcctgcccgccaccaaggcagttccgaaagaaatgctcaccgtcgtcgacaagccggtcattcagtacgttgtcgatgaggcggcggaagcgggtatcgagcattttgtatttgtcaccggccgcggcaaggcagtgatcgaagattattttgatattcaatttgaacttgaacagatgctgcgcgagcgcaacaagaatgccgagctgacattgctggccggccttctgcccaaggcgggcacggcaagcttcacgcgccagcaggtgccgctcggtctcggccatgcggtttggtgtgcgcgtgatatcgtcggcgatgagccttttgccgtgcttttgcccgacatgatcatgcattcgcaaaaaagctgcctgaagggcatggtcgaactttacgaccagacccagggcaacgtcatcgcggtgcaggaatgcgctcccgaccagacgcataaatatggcattgttggcgtgggaaatgccgtcggcgaaggcttcaagattaccgaaatggtcgaaaagccagccaagggtacggcgccgtcgaatttctacatcaacggtcgttatatcctgcagccggaaattttcgatattctcgaaaatcaggaacgcggcgccggtaacgaaatccagttgacggatggcatgctgacgctcgccaagtcgcaagaattctccggctatcatttccgtgggcagaccttcgattgcggcgccaaggatggtttcatcctggcaaacgtcgctttcgcactggagcgcggcgatatccgtccggcgatcgaggagccgatcaaggctttgatc

SEQ ID NO: 35291 - DNA, 1019 bp, Agrobacterium tumefaciens
ccgcactccccgcaaaccatccccgcgtaacttttggcaaggtcggcgtcctgctcgtcaatctcggcacgcctgacggcacggattattggccgatgcgccgttatctggcggagtttctaagcgacaagcgcgtgatcgaatggtctcgtctctactggtatccgatcctctacggcatcgtcctcaacaagcgtccgcagaaggtcggcaaggcctatgaggaaatctggaaccacgagcgcaacgaaagctatctgcgcacctatacccgcagccagggcgagctgatggctgcggcgctgaaggactttccgaatgtcgtggtcgactgggcgatgcgttacgggcagccttccatcgcatccaggatcgatgccctgaaggaacagggttgcgaaaaaatcttgctcttcccgctttatccgcaatatgccgcctcgaccacggcaaccgtgaacgacaaggctttcgagcatctgatgaagctgcgctggcaaccggccatccgcaccgtgccgccctatcatgacgatccggcctatatcgaggggctcgccgcctccgtgaaaaaccatctggcgacgctggactgggagccggaaatgctgatcacctccttccacggcattccgcaatcctatttcaaaaagggtgatccctattattgccattgccagaaaaccgcccgcctgctgcgggaggctctggggcggaccgagaagaatttcatgatcaccttccagtcccgcttcgggccggaagaatggctgcagccctataccgacaagaccgtggagaagctggcctcggagggcatcaagcgcattgccgtcatgaatcccggcttcgtatcggattgtcttgagacgctggaagaaatcgccggtgaagccggggagattttcctgcataatggcggagagaaatttacccatatcccctgtctgaatgacagcaccgaaggcatgaacgttctcgaaaaggttgtaagacgggagttgcaaggctgggtgtaa

SEQ ID NO: 35292 - DNA, 1575 bp, Agrobacterium tumefaciens
atgctgagcgtttcggcgatcacgctttcggccggagcggctcttgccgattacgagctcaacattcttcacatcaacgattttcactcccgtattgaatcgatcaacaaattcgattcgacttgctcagcggaagaggaaggcaaaaacgagtgcttcggcggcgccgcgcgcctgctgaccgcaatcaaccagacgcgtgacgcgctgaaggcaggcgggaaaaatgttctcctgctcaatgccggcgacaatttccagggctcgctgttctacaccacctacaaggggacggtggaagcggaagtgctgaacgccatgaagttcgacgccatgactgtcggcaaccacgagttcgacgatagcgaagacggtctcgccggcttccttgacaaggtgcagttccccgtcgtaaccgccaatgtggtggccaccgccgcctcgaaaatcggcgaccgcgtcaagccctccatcgtgcttgaagtcggcggccagaaaatcggcatcgtcggcgccgtcgccaacgacacggcggaactggcaacacccggtcccaatatcaccatcgcagaagatgtcgccaagatcggcgaacaggtgcagaagctgaagcaggacggcgtcaacaagatcatcgcgctcacccatgtcggttatccgcgtgacctcgaattcattgccaaaatccctgatgtcgacgtcgtggtcggcggccactcgcatacgctgctgtccaataccgaccagaaggccgaaggcccctacccgacgctcgttgacaatcccggcggctataaggttccggtggttcaggccggtcagtacagcaaatatctcggtgacctcaaagtggtcttcgacgacaatggcgtggtcaaggaaagcaagggcgaccccatcctgatcgactccaccttcaaacctgacgaagccacgctgaagcgcatcgatgagctgaaggcaccgatcgaggcgttgaaatccaaggtcgtcggcacctcggaaggtccgatcgaaggcgaccgcaaggtttgccgcgtgaaagaatgctccatgggcaatctggtggccgatgcgacactggcgcgcgtcaaggatcagggcgtcaccatcgcttttgcaaacagcggcggcctgcgctcctccatcgatggcggcgacgtctcgatgggtgaagtgctcacggttctgccgttccagaacaccgttgcgacctttcagctcaagggcgaggatattcgcgccgccctcgaaaatggcgtcagccagatcgatgatgtcgcgggccgcttcatgcaggtttccggcatgaaatactccttcgaccgttccaagccggccggcagccgcatcgtttcggtcgacgtcaaggaaggcgacggcttcgtgcccctcgatcccacaaagacctatactgtcgcagccaataattacgtgcgcaccggtggtgatggcttcaaggtctttgcgaccaacgccatcaacgcctatgacttcggccccaatctcgaagacgcagttgcggcctatatcaccgccaacagcccctacaagccctataccgacggccgcatc

SEQ ID NO: 35293 - DNA, 1413 bp, Agrobacterium tumefaciens
atgaagcgtaaccgcaaagtcaaaattcttgcaactctcggcccggcctcttccgaagaggccatgatcgaaaagctgcatcttgctggcgctgatcttttccggatcaacatgagccatgcgagccacgacgtgatgcggacgctcattcagcgtatccgctctgtcgaaagccgcaacggccgtcccatcggcattctggccgacctgcagggtcccaagctgcgcgtcggaaaattcgccgagacgaaggtcgatctggttccgggccagaccttcacgcttgataacaacgacacccccggcgacaacacccgcgttttcctgccgcatcctgaaattctcgaggcggtcaagcccggccaccgtctgctgatcgatgacggcaagctgcatctgcgcgctgaaaagagcgacggcaagagcatcgtcaccacggtcgtttccggcacccggatttccgaccgcaagggcatcagcctgcccgacaccctgctcggcgtcggcgttctgaccgacaaggaccgcgtcgacctcgatgccgttctcgagaccaacgaagtggactgggttgctctttccttcgttcagcgccctgaagacctggcagaagtgcgcaagatttcccgcggccgcgttggcctgatgtccaagatcgaaaagccgcaggctgttgaacgcatcgaggaaatcatcgagctttccgatgcattgatggttgcgcgcggcgatcttggcgtggaaatgccgttggaagccgttccgggcatccagaagcagctgacccgtgcctgccggcgcgccggcaaacccgtcgtcgttgccacccagatgctggaatcgatgataacggcaccggttccgacccgcgcggaagtatcggacgttgcaacggccgtattcgaaggcgccgacgccatcatgctctcggctgagtccgcttccggcgattatccgatcgaagccgtatcgaccatggcgtctatcgccagcacggtggaacaggacccctattattccaacatcatctacgcgcagcgtccgcagccggaagcaaccggtgccgacgccatttcgcttgccgcccgccagatcgctgaaacgctgaagcttgcggcgatcgtcacctatacgtcctcgggcacgaccggcctgcgcgccgcgcgcgagcggccgcaggtgccgatcattgcactgtcaccgatcatccagaccgcacgccgcctgtcggtcgtctggggcctgcactgcgtcgtcaccggcgatgccagcgatctggacgacatggtgaaccgcgcttgtcgcatcgttgtttccgaaggtttcggcaagcccggtgatcgcatcatcatttccgccggcgtgccgctcggcacccccggcgcaaccaacatggtgcgcatcgcctatatc

SEQ ID NO: 35294 - DNA, 1704 bp, Agrobacterium tumefaciens
tatctcaggcggtatcgtggcctgatggcggcggccctttttgcgcttgtactttcctccgccacaacactggctctgccgcttgccgttcgccgtatcatcgatcacggtttccagacgccggatggtggcatgatcaacagctatttcgccatgcttctggcgattgccgttgtcctcgcgctcgccagcgccatgcgctattattacgtgatgaccataggcgaaagggtcgtcgccgatctgcgccgcgatgtatttgcccacctcaccacgctgtcacagcaatttttcgatagcaatcgatcgggcgagctcacttcgcggctgaccgccgatacggtgcagattcgttccgccttcggctcctccgcctcggtcgcgctgcgcaacatcatcatgtgctgcggtgctgtggcgatgatgatctataccagccccggcctttccggccttgcgctgcttgccattcccttcatcgtttttccgctgatcgccttcgggcggtccgttcgcgcccgctcccgcaccacgcaggatacattggccaattccgccgcctatgcttcggaaacgatcgcggcgagccgcaccgtgcagtccttcaatgccgaggtgctggcgaatgcccgttacggcgcctccgtggaagccgcctatcagggcgcacgcgcggcgatcggcgcgcgctccgtcctgactgccgtcgcaatcgctctcgttttcggcagcgttgtcggcattctctggtatggcgcgcagaacgttctggcgggcagcatgaccgcgggtacgcttggccagttcgtgctttattccgtcatcgcagccagtggcctcggccagctttcggaagtctggggtgaactcgcccaggcgggcggcgcggctgaaaggctttccgagcttctgaatgaacgctcacccgttgcagagcccgcagcccccgtcgccatgccgcaaccaccgcggggcgaggcggagttcgacaatgtcgacttcgtctatccactcgcaacagggcggccgattgtctccggcctctccttgaaggtcgccgccggcgaaaccgtcgccatcgttggaccttccggcgccggcaaaagcacggtcttttcgctgctgatgcggttttacgatccgcagcagggccgcatcaccatcgatggcgtggatatccgcaacgtcagccttgccgatcttcgcgcacggctctccatcgtgccgcaggatgtcgcgatcttcgcctcctccatccacgataatatcgcatttggccggcccgaagcgacacgcgaggacgtgcgcgccgccgccatcgccgcgcaggccgacggcttcatcgagcgtctcggcgatggttacgatacgcaggtgggcgagcggggtgtgacgctgtcgggtggccagcggcagcgcatcgccatcgcccgcgctattctgcgcgatgcaccaatcctgctgcttgatgaagcgacctcggcgctcgatgcggaaagcgaaacgctggtgcagaaggcgcttgatgagctgatgaaaacccgcaccaccatcgttattgcccatcgcctcgccaccgtgctgaaggccgatcgcattctggtgatggatgaaggccgtatcatcgaggaaggcacgcatcagagcctcattcgccagaatggcctttatgcccgcctcgcccggctgcaattccagaccgga

SEQ ID NO: 35295 - DNA, 1116 bp, Agrobacterium tumefaciens
caaatgaccgaacgtctcgaagacatcgccatcaaaatggttgccgacggcaagggcctgctcgcagccgatgaatccacaggaacgatcaaaaagcgtttcgacagcatcaacctggaatccaccgagaccgcccgccgcgattatcgcgaaatgctgttccgctctgacgacgccatgaagaagtacatctccggcgtcattctttatgaagaaacccttttccagaaggctgccgatggcacgcctttcgttgatatcatcaaggccgccggcagcctgccgggcatcaaggtggatatcggcgccaagccgatggctttccacccgcatgaattcatcaccgaaggccttgatggcctttatgagcgcctgcgcaagtatcatgaagccggcgcgcgtttcgccaagtggcgcggcgtcatcaccatcggtgagcagcgtccgagctggggctcgatcaaggcaaactcccagtctcttgcccgttatgctgccctctgccagcaggccgatatcgtgccgattgttgagccggaagtgctgatggacggcgagcctggcacgcatgacatcgaccgctgcgccgaagtcacgcaatgggttctccagaccgtgtttgcggatctgttcgatgcccgcgtcaacctcgaaggcatgatcctcaagccgaacatgatcatcgatggcaagaacgctcgcaaggcttcggtcgaggaagtggcggaaaagaccgtcaaggttctgaaggcgacggtaccaactgccgttccgggcatcgccttcctttccggcggccagtcctccgaagaagctacggcgcatctctccgccatgaatgccggttacgacctgccctggtcgctgacctattcctacggccgcgctcttcaggataccgctctcaagacctggggcggcaaatcggaaaacgtcgccgccggccagcgtgccttcacgcaccgcgccgccatgaacagccttgccgccaagggcaactggaaacaggagctcgaaaaggcagcctgagctatcgctcacaggcaaattgtgcaattgaagccgccccgatgggcggctttttctttacggccgcagaagcagcgtcgccgacca

SEQ ID NO: 35296 - DNA, 1182 bp, Agrobacterium tumefaciens
gctttcaagaccatcgacgaccttaacgacattgccggaaagcgcgttctcgtccgcgttgatctcaacgtgccggtcgcggatggcaaggtgacggacgcaacccgtatcgaacgcgttgcgccgaccattctggaactctcttcaaagggcgcaaaagtcattctgctcgcccatttcggccgcccaaagggtgaacccgtcgctgagatgtcgctttcccagattgtccccacggtcgaggacgtgctggatcacgccatttccttcgcaacggactgcatcggtgcccctgcagcggatgcggtcgcaaaaatgaatgatggcgatattctgctgctggaaaacacccgcttccacaagggcgaggaaaagaacgatcccgccttcgtcgaagaactggccgcgaatggcgatatctatgtgaacgacgccttctccgccgctcaccgtgcccacgcctccaccgagggcctggcgcggcatctgcccgcttatgccggccgcaccatgcaggccgagcttgaggcgctggaaaaaggcctcggccagcccgttcgcccggtcgtcgccatcgtcggcggtgccaaggtttcgagcaagatcgatctcttgatgaacctcgtcaagaaggtcgatgccctcgtcattggcggcggcatggccaacaccttcctcgccgcccgcggcaccaatgtcggcaagtcgctctgcgagcacgatctggcagagaccgcaaagcagatcatgatcgaggcagcgacatccggttgcgctatcgtcctgccggaagacggcgtcgtcgcccgcgaattcacggccggcgcggccaatgaaattgtcgatatcaacgccattcccgccgacgccatggttctcgatgtcggtccgaaatcggttgaaagcatcaaggcctggatttcgcgggcggaaacgctggtctggaacggcccgctcggcgccttcgaaatcgaacccttcgatgcggcaaccgtggcggcggcaaaacacgctgcggaatgcaccaaggccggcaagctcgtttccgttgccggtggcggcgacaccgtcgctgcactcaaccatgccggtgtttcggacgatttcacctatatttcgacggcgggcggcgccttccttgaatggatggaaggcaaggaattgccaggcgttgccatcctg

SEQ ID NO: 35297 - DNA, 975 bp, Agrobacterium tumefaciens
aaagttgccattaacggcttcggccgtatcggccgcaatgttctgcgcgccatcgtcgaatccggccgtaccgatatcgaagtcgttgccatcaacgatctcgggccggttgaaaccaacgctcacctgctgcgctacgattcgatccacggcaagttcccggctgacgtcaaagtcgaaggtgacaccatcatcgttggcggcggcaagccgatcaaggtcacggctgttcgcgatccggcaaccttgccgcacaaggaactcggcgttgacatcgcgctcgaatgcacgggcatcttcaccgcccgcgacaaggctgccgctcacctgacggccggcgccaagcgcgtcatcgtttcggcaccggctgacggcgctgacctgaccgtcgtcttcggcgtcaacgacgaccagctgacgaaggaccatctggtcatttccaacgcttcctgcaccaccaactgcctcgtgccggtcgtgaaggttctcgatgacgtcattggcatcgatcatggcttcatgacgacgatccactcctacacgggcgaccagccgacactggacaccatgcacaaggatctgtatcgcgcccgcgccgcagccctgtccatgatcccgacctcgaccggtgcggccaaggccgttggcctcgttctgccgcaccttaagggcaagctggacggcacgtcgatccgcgttccgaccccgaacgtttcggtcgtcgacttcaagttcatcgccaagcgcgacacgacggttgaggaagtcaacgaagcgataaagtccgcttccaacggcaagctcaagggcatcctcggctacaccgaggagccgctggtctcccgcgacttcaaccacgacagccattcctcgatcttcgcgatcgaccagaccaaggtgatggaaggcaatttcgtgcgcgttctgtcctggtacgacaacgagtggggcttctccaaccgcatgtcggacacg

SEQ ID NO: 35298 - DNA, 1953 bp, Agrobacterium tumefaciens
tctcgcgacaaacacaaccggatggccaatgcgatccgctttcttgccatggatgcagtggagaaggccaactccggccatcccggactgccgatgggcgccgccgatgtcgccaccgttcttttcacccgctacctgaaattcgatccgaaggcgcctctgtgggcggaccgcgaccgcttcgtgctgtctgccggccatggctccatgctgctttactcgctgctttatttgacgggctacgaggacatgacgatcgacgagatcaagcggttccgtcagttcggctccaagaccgccggccatcctgaatatggccatgccaccggcatcgaaacgaccaccggtccgctcggccagggcattgccaacgccgtcggcatggcaattgctgagcgcaagctggaagaggagttcggctccgacctgcagagccacttcacctatgtgctgtgcggcgacggctgcctcatggaaggcatcagccacgaagccatcgcgcttgccggccatctgaagctcaacaagctcgttctcttctgggacgacaacaacatcaccatcgacggtgaagttggcctgtccgacagcaccgaccagatcgcccgcttccaggccgttcactggaacactatccgtgttgatggccatgatcccgacgcgattgctgccgccatcgaggcagcgcagaaatccgaccgcccgaccttcatcgcctgcaagaccgtcatcggtttcggcgcccccaacaagcagggtacccacaaggtgcacggcaacccgctcggcgcagaagaaatcgccgctgcccgcaagagcctgaactgggaagccgaagccttcgtcattccggaagatgtgctcgatgcatggcgcctcgccggcctgcgctccaccaagacgcgccaggactgggaagcccgtctcgaagccaccgagacggccaagaaggccgaattcaagcgccgctttgccggcgacctgcccggcaacttcgacagctccatcgatgccttcaagaaaaagatcatcgagaacaacccgacggttgccacccgcaaggcctcggaagattcgctcgaagtcatcaacggcatcctgccggaaatggtcggcggttcggctgacctgacgccgtccaacaacaccaagaccagccagatgaagtcgatcacgccgacggacttctccggccgttacctgcattacggcatccgcgagcacggcatggctgcggccatgaacggtatcgctctccacggcggtctcatcccctatgccggtggcttcctgatcttctcggattattgccgtccgtcgatccgccttgcagcactgatgggcatccgcgtcgtccacgttctgacgcacgattccatcggcgtcggtgaagatggtccgacccaccagccggtcgagcagatcgcagcgttgcgcgccattccgaacctgctcgtcttccgcccggcggatgaaaccgagacggcggaatgctggcagctggctctcgagcaaaagcaccgtccgtccgcactggcgcttacccgccagaatctcacgccttcgcgcaaggaatatgaagagaagaacctgtccgcttacggcgcatacgaactcgtctccgccagcgacgccaaggtttcgatcttcgcttccggttcggaagtcgaagtggcgctgaaagctgctgcgacgctgaaggacaagggtgtttccgcccgcgtcgtttccgttccctgcttcgaactcttcaaggaacagccggaaacctatcgcaacgccatcatcggcaaggctccggtcaagatcgcggtggaagccgccatccgccagggctgggattacttcatcggcaatgacggcgctttcgtcggcatgcactcctttggagcctctgcaccggcgaaggatctcttcaagcacttcggcatcacggcggaagccgtcgtcgcc

SEQ ID NO: 35299 - DNA, 1896 bp, Agrobacterium tumefaciens
atgaacccaaatttcagaaatttcgccttgtgggccgtgatcgccctgttgctgatcgcgctgttcagcatgttccagacgtcgccgacgcaaacgggttcacgggagattccgtattcccagtttattcgtgacgtggattccgggcgagttcgcgacgtgaccgtcaccggtaaccgggttctcggaacctataccgaaaacggcacggcctttcagacctattcccccgtcattgacgacagcctgatggagcgcttgcagagcaagaacgtcaccatcgtggcgcgtccggaaagcgacggctcctcgggtttcctgagctatctcggcacgcttctgcctatgttcctcatcctcggcgtctggctgttcttcatgcggcagatgcagggcggttcgcgtggtgcgatgggctttggcaaatcaaaggccaagcttctgacggaagcccacggccgcgtgacgtttgacgacgtcgcaggcgtggacgaagccaagcaggatctcgaggaaatcgtggaattcctgcgcgatccgcagaagttccagcgtcttggcggtaagattccgcgcggcgtgctgctggtcgggcctccgggcaccggtaagacgcttctcgcccgctccgtcgccggcgaagccaacgtgccgttcttcacgatttccggttcggacttcgttgaaatgttcgtcggcgtcggtgcaagccgcgtgcgtgacatgttcgagcaagccaagaagaacgcaccctgtatcatcttcatcgacgaaatcgacgccgtcggccgccatcgtggcgccggtcttggtggcggtaacgacgaacgcgaacagacgctgaaccagctgttggtcgagatggatggctttgaggcgaatgaaggcatcatcctcatcgccgctaccaaccgtcctgatgttcttgaccccgcgcttctgcgtcccggccgtttcgaccgtcaggtcgtcgtgccgaacccggatattgtcggccgcgagcgcatcctcaaggttcacgttcgcaacgtgccgctggcgccgaatgtcgatctcaagattctggcccgcggtacgcccggcttttcgggtgcggatctgatgaacctcgtcaacgaagccgccctcatggccgcccgccgcaacaagcgcgtggtcaccatgcaggagttcgaagacgccaaggacaagatcatgatgggtgcggaacgccgctcctccgccatgaccgaagccgaaaagaagctgaccgcctatcatgaggccggtcatgcgattactgcgctgaaggttgccgtggccgatccgctgcacaaggcgacgatcattccgcgcggccgtgcactcggcatggtgatgcagctgccggaaggcgaccgctattccatgagctacaagtggatggtatcgcgccttgtgatcatgatgggtggacgcgttgccgaggaattgaccttcggcaaggagaacatcacgtctggcgcgtcttctgacatcgagcaagccaccaagcttgcccgcgccatggttacgcaatggggcttctccgacgctctcggtcaggtggcttatggtgaaaaccagcaggaagtgttccttggtcattccgtctcgcagtcgaagaacgtctccgaggcaacggcccagacgatcgataccgaagtccgccgtctgatcgacgaggcttacaccgaagcacggcgtatcctcacggacaaccacgatggctttgtcgcaattgcagagggtcttctcgaatatgagaccctgacgggtgaagagatcaaggcgttgctgaggggcgaaaagcccgctcgtgatctgggtgacgattcgcccggcagccgtggttcggctgtgccgaaagctggcgccaagaaggacggcccgagtgaa

SEQ ID NO: 35300 - DNA, 1329 bp, Agrobacterium tumefaciens
cgccgttatttcggaaccgatggtatccgcggacaatcgaacgtctttcccatgacacctgacctagcgatgcgcgtaggtatcgccgtcggaacgattttccgccgcggccatcatcgccatcgtgtcgtgatcggcaaggatacgcgcctttccggttatatgctggaaaacgcgctggttgccggtttcactgcagccggtctcgatgtcttcctgctcggccctatcccaacgccggccgttgccatgctcacccgctcgctgcgcgcggatatcggtgtgatgatctccgcctcgcacaacccattctccgataacgggattaagcttttcggtcccgatggctataagctctccgatgagctggagctggagatcgaggatcttctcgacaaggatatttatgcccagctggccaagccggccgaaatcggccgcgccaagcgtgtcgatggcgacatctaccggtatatcgaattcgtcaaacgcaccctgccgcgcgatgtgacgctgagcgggttgaggatcgccatcgactgcgccaatggtgccgcctacaaggtggcacccgcagcactctgggaactgggtgctgaagtcgtcaccatcggcaatgagccgaatggcatcaatatcaatctcgaatgtggctccacccatcctgaagcactgcagaaaaagctgcatgaggtccgcgccgatatcggcatcgcgctcgatggcgatgcggaccgcgtcatcatcgttgatgagcgcggcgagatcgtcgatggcgaccagttgatggctgtcatcgccgatagctgggccgccgacaacacattgcgcggcggtggcatcgtggcgaccgtcatgtccaatctcggtctggaacgtttcctcggcgataagggcctcacccttgcccgcaccaaggttggcgaccgctatgtcgtcgagcatatgcgcaaccacaatttcaacgtcggcggtgagcagtccggccatatcgtgctttcggattacggtacgacgggagatggtctggtggcggccttgcaggttctcgccaaggtcaagcgctccggcctcacggtcagcgaagtgtgtcgcaagttcgagcccgtgccgcagcttctgaagaatgtgcgtatttccggcggtaaaccgctggaaaatcccatcgtgctgcaggcgattgccgatgcggaaagcgcgctggccaataatggccgcctcgtcatccgcccttccggcacggagccgctgatccgcgtcatggcggagggcgacgatagcgcaaaggtggaaaagatcgtcaacgatctcgtcggcgtcatctccagt

SEQ ID NO: 35301 - DNA, 1140 bp, Agrobacterium tumefaciens
atgaagccggacctccgtccgggcaatacgcatttctcttctggtccctgctcgaagcgtcccggttggtcgctagatgctctctccgatgcgccgctcggccgctcgcatcgcgccaaggttggcaaagccaagctgaagcaggccatcgatctcacccgtgaaattctcaatgttcccgctgattatcgcatcggcatcgttcccgcatccgacaccggcgccgttgaaatggcgctctggtcgctgctcggtgaacgcggcgtcgatatgctcgcctgggaaagcttcggtgccggctgggtcaccgacgtcgtcaagcagctgaaactgaaggacgtccgcaagttcgaggccgattatggcctgctgccgaacctcgccgaggtcgattttgaccgtgacgtggttttcacctggaacggcacgacgtctggcgttcgcgttgccaatgccgatttcattcctgctgaccgcaagggcctgaccatctgcgacgccacctcggcggccttcgcacaggatatggactttacgaaactcgacgtcgtcaccttctcctggcagaaggttctgggcggtgagggtggccacggcgtcatcattctgtcgccgcgtgccgttgagcgcctgctgagctattcgccggcctggccgctgccgaaaatcttccgcatggtctccggcggcaagctgatcgaaggcatcttcaccggcgaaacgatcaatacgccctccatgctctgcgttgaggactatatcgacgccctgctgtgggcgaagaacctcggtggtctcaaagcgctgatcggccgtgccgatgccaatgccaaggtcatctacgacttcatcgagaagaacaactggatcgccaatctggccgtcaagccggaaacccgctccaacacctccgtctgcctgaagatcgtcgatcccgaggtgcaggcgctggacgcagccgcgcaggccgatttcgccaagggcatcgttgccctgctcgaaaaggaaaatgtcgccctcgatatcggcgcttaccgtgacgccccgtccggtctgcgcatctgggccggcgccaccatcgagacggccgatatggaagctgtcatgccttggcttgcctgggcttaccagacgcagaag

SEQ ID NO: 35302 - DNA, 8138 bp, Agrobacterium tumefaciens
atgcggggtgaaaccctctcggagcggctgcgcgcctttcttgccggaaaactccccgcttatatggttccgcgcgaattcgtgatcatggagcgactgcctctcagcgccaatggcaaggttgaccgccaggccctgcccgcgccgggcggaagggcacgccaaaccgttgccccggcaaccgaaaacgagagcgcacttctggcgatctggcacgaactcctgtccagcgacagcgctggcgtggaggacaatttcttcgaagccggcggcgattcactgacgatcatgcagctgctgtcgcgcatcaggcaggaattttcggttcacctgacgcttgcccagctctttggcgccaccaccgtcaaagcccagtcggaattgctcggctcactttcaccgtccctgccggacgaagcggaaaccggtatctccccgatcgttgcgccgacatccgtgaatgacctttccgatgatgacgtggataagatgctggagcagctgctctccggccaaaaggaccagtagacgtgaacacaatggatatttcccgactgaccccggaggaaaagcggcagcttctgcagcgcctgatggctggacagcaggcatccgaaaagaagaacttccgcctgagccatgcccaggaacgtatctggttcgtcgagcagatgcagcccggcacaggcgcatattcgatacccgtggccatcaggctggaaggcccgctcgaccgcgacaggcttaggatctgcttcgatatcgtggtgcagcgccatgaaagcctgcggacagttttcgaggttcaggacggcgagccgtttcaggtcatcgtttcgcaaacaacggcagacttcagttttcatgaaccgggcgatgacgaagccgcacgcgatgtcgccatcggccgcttcgcgcaggaaccgttcaatctctcgcagggtccgctgtttcgcgtcggcctgttctccgtcgcacctgacgagcatactctcgtcatggtgatccatcatatcatttccgactacgcctcgttgcagatcctgatcgatgaggtctacaggctttatagcgcagcagaagctccagccatcggccagctgccggcactcgatatccagtatcgcgattatgccgaatggcaacgcaacggcaccgcggcgctttcaggccagatcgactactggcgcgaacagcttcgtgacgcaccgctgctgcttcaactcccgttcgatttcgcccggccggtgacgcagtcgttccaaggcgcccggcacaaattccgccttgggccggccctctccagcgccgtcaaggatctggcgaaaagccggaaactgacgacattcatggtgctgctggcggcctatcaaattctgctcgcccgcctttcgagatcggacgatatctgcatcggcacgacggcatcgaaccggaaccgggcgcagacccgcaatctcatcgggttgttcgtcaacaatctcgtcttgcggacgcgtctacagccaaatgacaccttcgatacgctcctcgacagggttcgggatacgacccttgaggcgctgtccaaccaggatgttccctttgagcaggtggtggatgcactgaatgtcgagcgtgacatcggccataacgccctgttccaatcgactttcgtgcttcacaatgcgtccggtgcagctttcgatctcggcgacatcaaggtcacgccgatcgcgctcgattccggcgcctcgcgtttcgatctcagcctcgacatgcacgagggacggggaaacgaaggtttcagtggggttttcgagttcaacacggaactcttcctgcctgaaacggtgtcgcgcttctctgcctatttcctgagactgctcggcgggctcgtatcgaaccccggcggccgcatcgccgaaatcgacctgctggacaagacggagcatgcggctatagcgactgcgaaccggacaaccattgcctttccattgagagatttcgcatcgctgctggaagagacggcacaggtgcgcggctcgtccgtggccgtgcgctgcggcgaccggcaatattcccacggcgatctcaacgaagccgccaaccgggtggcatccggtttgcgtgatcgcatcggcaacagcaaacctcatccccgcatcgccatctgcctgccgcgttccgaaaacctcgtcatcgccatcctcgcggtgctcaaactgggcggccattacgtgcctctcgaccccggacacccggcggagcggcgcgcactcattctcgaggactgcaagccagacatcattctcatcagcgagggtgaggatacggcatatccatgcggctgcatggcgattgaacccctgctgcgtgcaaccggctccttcggtaacccgcatcgcgagacgctacccgacgacctggcctatatcatctatacctcaggctcgacgggcaggccgaaaggcgtcccgatcagacagaaaagcctggtcaaccttctcaccagcatggcgcggcggccgggcatgtcggctgaagatcgtttccttgccgtcaccacaccggcttttgatatcgccacgctggagctgctgatgccgcttatggtcggcggcctgctgattattgccgaagccgatgacatctatgacgatatggcgctttcagagcttatccggaaccacagcgcgacgatgatgcaggcgacacctgcgacatggcggctgatggccgatgcggactggaaggctccggcgggtttcaggatgctttgcggcggcgaagcgctcgagcccggccttgcccgccgcctgctggcagccggaggcgaattgtggaacctctacggcccgaccgaaacaaccatctggtccacatgcacccgcatatgcgcggaacatctggagcttcccgccctgccggtcggcgagccgatcgccaatacgcagcttcatctgctcgacgacgcgctgatgccggtgccggcaggcgttgtcggagagctgtatatcggcggcgaaggtctgagccccggctatttcaaccgggacgacctgacgtcgcgtgcattcgtcgaagggccggccgcgggctcgaacggcggaggcgagagatcgagactctaccgaaccggtgacctgatgcggcgttccgccgccgggcaccttctttatgttggtcgcgccgattttcaggtcaagcttcgaggattccgcatcgaacttagcgagatcgaggcgatccttgccgcacagccatccatcgagcaggccgtggttgcgctttttcaggacgaggaagggtctggcaccctcgtcgcctattgccgccgcggaacaagcccagtggacgaggacgcactccgcgcagcgctcgcctcacagcttccctcctacatgcttcccgccgcctatgtctggatggaccgctttccgttaaacgccaatggcaagatcgatcgcaagcggcttgagcgaccaaaacagatcgtatcgtcaaccgcctacaccgctccgctcgaagggaccgaacaaattgtcgccgccatatggcgtgagttgctcggcgcggaaaagatcggccgtgacgacaatttcttcacggtgggcggccattcgctgctggcgacgcggatgcttgcgcgtttgcgggcgtcattcgccatcgacctgccgctgcgcaccttttttgagagaccccggcttgcggattttgccggtgctgtcgatgctctggtggccatgaccgaacgcaggccggaagcggtttcgtccgcgctgtccaagcgcgagcatactggcccaacaccgctgtcccatgcacaaaacagacaatgggcgcttgcgcagctggaaccggacagcccgctctacaacatcccgtttgccctgaagatcaggggagcgctcgatttcgaaatcctctcgcatgcgctggaactgacggcacaaagacaggatacgctgcgcagccgcttcgtctccgtcgatggcaagcccttcgtcgagaccgacccggagatgatattcaagatcgtgccggaagagatcggcgaccgggaactcgaggctgccctgctcgattgcgcgcgccggccattcgatcttgccgttgcacccctcctgcgcattcacgccttccgcaccggtccgcaggatcatgtcctgcttttcctattgcaccacattatcggtgacgccctttcagccgaaattctgctgaacgacgttgcgacgttttacgcgtccctctcgaagaaagaagcaccgccaaacggggcgctaccgctgcaatattcggattttgcaatctggcaacgggaacaggacacgacgaatgaggttgattactggcgcaggacgcttgccggcgctccgccactgctggaattgcctaccgattttgtgcggcccgccatacagggcttctccggcgagagcatccgcttctcgctcaatgcggatttgctcgcaagattgcgccaactctgcgaccagcaaggcgctaccctttttatgggaatgctgacagcgttctcgacgctgctccagcgcgtgagcggcatgcgcgatatcgtcatcggcacaccggtctccgagcggttccatcccgatctggaaaacgttatcggcatgttcgccaatacgctggcgatccggttgcagacgcagggcggcgaaaacttcaacgaagcactgaaggcagcccgcgacacggcattaagcgctttcgccaaccagaccgcaccgtttgagaaagtggtggatgcgctgtcgcttccgcggacatggagccacaacccgctgttccaagccatgctcgtctcgaccgtcgaaacccggcgcggcgccatctcgctcgccggcatggagtgggaccgactggcgcttcccgacacgtcgtcgcgcgtggacctgacattgttcatccatgaaacggcagaggaactgtcgtgccgcctcgaatatcgcagcgatcttttccgccgggcaactatggaatcgcttggcgaagccctcgtcgccctgctcgaaaaaatcgttgagcgacctgaactgccactcgacaggcagtcactggtatcgggcaaccatcagaaaaggctgcggcaatggaacgagacggatgcggaatttcagccgcagcggcgctgcctgcacgactttgtgacagcaagtgccgagaccagcccacaggcgatagccgttaccgatcaggaccggagcctgtcctatgccgaacttgactggagagccgaccggcttgcaagcgggctcgtcgcagccggcataggcaggggaaagcgagtcggcatccgcctcgaaaggagcgtggagctggtggttgccatattggcagtgcttcgcaccggcgcggcctatgtgccgctcgacccgcgttaccccgcagaccgcatagaattcatcgccgcggacgccgatctcgcgctcattctggtcacgaccgagaatgatatttcaacgatcggacagaatttccgctgcatgacgcccggtatggtggaaaatctggcaggtggagccgttcccacgccggtgacgtcaggagccgatcttgcctacctcatctacacatcaggttcgacgggcaggccgaagggcgtggccatcgaacatcgcaacgccgttgctttcatgcaatggtgcatgcacgcctttacgaaggatcagctgtccggcgtgctcgcttccacctcgatctgctttgatctttcgatcttcgaaatatttgcgacgcttgcagcgggcgggcgcatcttcatggtcgatgatctcttcgctttcccaagcgcgccatttgcaggtgaagtaacgctggtgaacaccgttccgacgccgatgtcggaactgctcaaactcggccctctgccgcagaacgtgaaaacagtgtgtctggcgggagagccgctgccgcgtgaacttgtcgcgcggatttacgccaacgaccaggtggaatgcctctataacctctacggtccctcggaggacaccacctattcgacggtggccccggtgcctccatcgggcgaatggttcggcatcggcgtgccgattgccaatacccgcgcctatgtgctcgacggcgagatgaacgaggtgccggttggggtgcccggcgaactgttcctgtccggcagcggattggcgcgcggctactggaaccggcccggccagaccgccgagcgttttctgcccaatccctttgccgactgcagccagcaccgcgtcatgtaccagaccggtgatatcgtgcgcaggcgcgatgatggcggtctcgattacatgggacgcgccgaccggcagctgaagctgaacggttttcgcatcgagccgggtgaaattgaggccgtattgctgcagcaggaaggggtacatgaggcggttgccgggctctggcgcgacgccgccaatcatccgcggctggcgatgtggattgccggcgatcccgcactggagatcaccaaacttgtcgcaaccctcaggcaacgcttgcccgagcacttcattcccgtccttgcaaccaggctcgatgcgcttccgcgcctgccgaacggcaagctggaccgatccgcattgccggatcccgcagcctatggcgaacgcgccacggaaaccgcaagtctgctcaatgaccaggaggacgtgctggcgcagatatggcaaggcttgctcggctgtggagacatccggcgaaacgacaatttcttctcgcttggcggcgattccatccttgccatccagctggtttcacaggcccgccagaaggggttgaagatgaccccgcgcgacgtcttcctgcatcccacgctcgcatcgctcgcggaagtgacacacgtggaaagcactgtgacagtcgggaccggtcatgccgatgatgaagctacgctcggggcgatacagcactggctgctggatcaggacctgcccgatcttgcccactggaaccagggattgatcctgaagcttacccgatctctcgatcccgaccggctcgaaaaggcgatttcaaggctactcgaggagcatcagtcgctgcgcgcccgattcttgcgcaaaaatgggcaatggcaacagaaattcgcccctctttcggcaatgccgccgatgcagcaactggccgccacagatgagaacgacgtcacagattttgccagaaagcttcatgccggtttcgatcttggtgccgggcctctcttcggcgcgatcctggcgacattgcctgatggctccggccgccttatcctcgcagcccatcacctcatcgtcgatggcgtgtcctggcgaatgatcgttgcggatatcgagcggcattatctggaggccagcaccattcggtccggcgcagtcgcggctggcagctggaacagccggctttcacggtcggcgctttttgacggcgaggaggaatattggcgcggcgtctgcgaggaagacgtccgggcgctgccgctcgacaacgagagtggaagcaatactcaatcggatgcggtgacgtaccgacagacgatcgatgccgagacgacgaggcaactgcttcgggatgtaccggaatgcttcagcatcgcctcgaacgaggttctggtcgcagccctttatctgacgctgcggcagtggagcggccagccacgcctgcggctagaaatggaaagccacggcagactgaacctgttcgaggatatcgacgtttccgaaacggtgggatggctgaccgcgctttatcccgtgttgttcgatacgccggatgacgcaacaccagaccgcctgcttctcgacgtcaaggatacgttgcggcgaattcccaataacggcgtcggtttcggtgttctgaaatatctccgcaacaaggctgagcatttggactatggcaaaccgcagctccgcttcaactatctcggccagatggatgccatgttcgcaatagatagcctgtttgcgccttcaggcatcacatccggcccgatgtacggtgccgccaacccgcgtgatacgatcctcgagatcaacgccatggtcgtgcgcggtgagttgcaattgcagtgggtctatggggcgcaactgcattccgaagacactatcaggacgctggcggaccatttccgggacaatcttgaaacgctgatccagcattgc

SEQ ID NO: 35303 - DNA, 1519 bp, Agrobacterium tumefaciens
cagtctacttcctctgcacgaagattgccggcgaccgcgcgggacaggaagtcacaaaggaggccgtcgaatgaatattcacaataattccggcacggctacccaccctgcaactgaccctgtcaccgccatcgttaccggcttcaacctcaagacgccgggttcgaagcgcgccgccgcctataaccgcgatttcctttcggacaaaagctcgatcggccttcccttcacgatgcagaccaaggaggcgctgtatcccattgtcgctacccatgccgaaggggcttatttgcaggacgtcgacaacaacagatatgtcgatattctcatgggcctcggcaccaatctcttcggccataatccgtccttcatccgcacggcaatcgaagcgcagctgaccaaaggttttgcgctcgggccgcaatccgatctggccggcgagaccgcggaactgttttgctgtatcaccggaaaagaccgcgtcacattcagcaacaccggaaccgaagccgtacagacggccatgcggatcgcccgtgccgcaacggggcgcgacaagatcgtcctgtttacaggctcgtatcatggccattccgacccggccctgcacaaggcgaccaaactggaatatatccgcaggggcgcgttgctgcggtctcatccggcatggctcgtggcgctgaaaccgcttctgaaacgcatggtcctgacgaaagcagttcccggtttttcaggcgtggcaccctcctccgcccgcgatatcgtgctgctggaatacggcaatccccgctccatcgattacatcaggcgtcacggcgacagccttgccggcgtgcttgtcgaacccgttcagagccggaacccggaactgcagccccgcgaatttctgcatgagttgcgaagcgtgaccgaaaagaccggaagcgcgctgatattcgacgagatgatcactggcttccgcgtcgcacccggcggcgcgcagtcccatttcggcatcgatgccgacattgccacctatggcaagatcgccggcggcggattgccgctgtcgctcatcgccggcaaggggcggttcatggatttcgtcgacggcggagcctgggcttacggcgacagctccttcccgaaggtggctccgacattttttgccggaacctattgccgccatccgctggcgctcgcagccgcaaaggcggtcgcgacgcgattgctggaagacggcccaaccttgcaagagggcctcaacgccaggacccaggcattcgtggaacggctgaacggtgcgctgaagggtgccgggttgcccgtggcgttcatgagcttcggttcgttcttcgccatatccgctgcccgcagccgcatctcgccgcaggctgtgaccatgctttccttccttcttctgacctccggcgttcaccttcgtgccggggatcgtggcggttttctttccaccgcccatagcgatgacgacatcgcctttgttcacgacgctgttctgcaaagcctgacggctctggcg

SEQ ID NO: 35304 - DNA, 738 bp, Agrobacterium tumefaciens
aaggaaacccccatgaaaagactggaaggcaaggttgcgatcgttaccggggctggccgcggaatcggccgcgccaccgccaaactcctcgccacggagggcgcaaaagtcgcggtgctctcgctcacgcccgcgaatgttgacgcggtcgtagccgacatagaagctgcgggcggtacggcgttgggcattgcgatcgatgtcagcgatgccgacgcgatcaagccagcgatcgacacggttgtggcgacctggggcggcatcgatatccttgtgaacaacgcctttgacccctcagtggtgcaatcgtctgttctcgatctatcggtcgaacaactgcagcgcaatttcgatacgggtccgatcgcctttttacggatgatgcaggccgcctatcctcatctgaaaacaagcggcgagggacgtatcatcaatttcggttcgatggcgggcgttacgggtatggtgccatatgcgccgtacaacatggcaaaggaggcaatccgtgccctgacacgggttgcagcccgtgaatggggtgctgacaagattaccgtcaacaacgtcctgccgattgccgatacctggggtgcggcggctgccaatattccagctccggccaacgcgcttgcccggcatggctctcccgaagacgacatcgctcccgtggtgctgttccttgccagcaaagatgcacagttcatcactgggtatagcctgacgcctgacggtgggatg

SEQ ID NO: 35305 - DNA, 495 bp, Agrobacterium tumefaciens
cggcgcaacatcgtcttcgtggggctgatgggggctggaaagtcggcggtgggccgcatggtcgcccagcagctcaaggtgcctttcattgatacggatgtcgaaatcgagcgcgtatcgcgcatgacgatatcggagcttttcgccacctatggcgaggaggaattccgggcgctggaaacgcgggtcatcaagcggttgatgcgcggcggtcccaaggtcgtctccacgggcggcggcgcatttatcaacgacactacccgaggccatatcaggcgcggcggcatttcgctgtggctgaaggccgatctcgaggttctgtgggagagggtcaacaagcgcgaccaccgcccgcttctcaagactgaaaaccccaaggcaacgctcgctgccctgatggagaaacgttatccgatctatgcggaggcggacgtcaccatcgaatcccgtgatgtccgcaaggagatcatcgcgaccgaagtgctgacggcttta

SEQ ID NO: 35306 - DNA, 1053 bp, Agrobacterium tumefaciens
cgtcttgtccatgtgccgctcggcgagcgcgcctatgacattctgatcgggccgggactgatcggcagggcgggcggcgaaatctcggcgcggctgaagggcagacgcgcggcgatcatcaccgacgagcatgtcgcgccgctttacctcgaaggcctgatggacggtttgcagacggatggcattgaggccgtttctctgacgctgccggccggagagaagaccaagagcttcgagcatctcgtcaccgtctgcgatgcggttctctccgcacgggtggagcgcaacgatgcggtgatcgcactcggcggtggcgtcatcggcgatctcgccggtttcgccgcaggcatcgtgcgccgcggcgtgcgcttcgtgcagataccgacctcgcttctgtcccaggtcgactcctccgtcggcggcaagaccggcatcaacacccgccacggcaagaaccttgtcggcgttttccatcagcctgatctggtgttggcggatacggcggtgctcgatacgctgagcccgcgggaattccgcgccggttatgctgaagtggtcaaatacggtttgatcgacaagccggatttcttcttctggctggaaaagaactgggatgacatccgcactggcggcccggcccgcatcgaggcgatcgccacgagctgccaggccaaggccgatgtggtggtggccgacgagaaggaaaacggcgtgcgcgcccttctgaacctcggccacaccttcggtcacgcgctggaggcggcgacgaattacgacagcaagcggctggtgcacggcgaaggtgtcgccatcggcatggtgctggcgcaccagttctccgcccgcctcaacctcgccagccccgatgatgccgcgcgtgtcgaggcgcatctgaaggccgtcggtctgccgaccacgatgaaggatattcccggcgaattgccgccggtcgaaaccttgatggcggcgattgcgcaggacaagaaggtcaagggtggcaagctcaccttcatccttacccacggcatcggccagtccttcgtggccgacgat

SEQ ID NO: 35307 - DNA, 822 bp, Agrobacterium tumefaciens
ggaaagtcaggcaggcgaatgcgccggttttggccggcaaatggagaggatacgatgaaacctttggaaatagacgtctttctttgccgcagcgacaatttcggggttttgttgcacgatcccgaaagcggggcgacggccgccatagacgcgccggaagaaggccctatcctgcgcgcccttgatggccatggctggaagctcacacatatcttcaccacccaccaccatcaggaccatgtggaagccaatctggtgctgaaggacaagttccgttgcgaggtgcacggcccctacgacgaggcgattgcgataccgggcctcgaccgttcgcaggccgatggcgacgaattcgaatttgccggccgccgcgtgcaggtgattgccacacccggccatacggcagggcatatctgttattacctgccggatgacgggctgctgtttgccgccgatacgctgtttgccatgggctgcggtcggctgttcgaacggccggcggcggatatgtggcactccttccagaagctgatggccctgccggatgacacgcgggtctatttcggccacgaatacacgctttcgaatgcccgttttgcgctgaccgtcgatccagacaatgctgtgctgcgcgagcgcgcggcacgtgtcgagaccgcgcggcaggccaatgaattcaccattcccaccaccatcgggctcgaaaaacagaccaatccctatatgcgggtggcggatgccggtatccgcagacatctcggccttgaaggcgctgccgatgccgatgtcttcgcggaaatccgcacgcgcaaggataatttc

SEQ ID NO: 35308 - DNA, 1053 bp, Agrobacterium tumefaciens
atgagtgcagagcttaaccaacctgttccgcgtccgggtattctggatatcgccgcttatgttcccggcaaggaacatgtggatggcgtcgcgaaggtctataagctctcctccaatgaaacgccgcttgggccgagcccgaaggcgatagaggctttcagtgctgccgccagccacctggaaatctatccagacggtcaggcgatcgcattgcgtcaggcgattgccgacgtgcatggcctcaacatcgcaaacatcctgtgcggcaacggttcggacgagcttctcggtctgctttgccacgtctatctgggtgccggtgatgaagcgatcatcaccgaacatggtttcctcgtctacaagatccagatcatgggtgcgggtgcgaccccggtgacggtgaaggaaaaggattgcgttgtcgatgtggatgcgatcctcgccgctgtgacgccgaagaccaagatggtttttctcgccaatccgggcaaccccaccggcacctatgttcccgtcgcggaaatccgccgcctgcaggccggactgccgaaacatgtcgtgctggtgctggacgccgcttacgccgaatatgtgcgcaagaatgattacgaagccggactggaactggtctccggtaaccgcaacgtggtgatgacccggaccttctccaaggtttacggtctggcggcactgcgtgtgggctggatgtatgccccggtggatatcatcgatgcgctgaaccgcgtgcgcggcccgttcaacatgagcgcgccggccattgcggcgggtgccgctgcgatccgcgatcaggcattcgttcaaaaggctgtggcacataatgccctgtggatggaaaagctggtcacgacctttaccggtctcggcctcaccgtcacaccatccgttgccaacttcatcctcatccatttcccggatcaggacggcaaacgcgcgacggatgcggatgagttcctgagccgccgtggttatattctgcgtgcggtgcggggttatggtttcccgaatgcattgagaatgaccgtcggttctgaa

SEQ ID NO: 35309 - DNA, 498 bp, Agrobacterium tumefaciens
gagccgctctacaccgccgagcagatcgccgagcgcaatcgcgatatggccaagcacattgccggtggcccgaccaaggatttgctggtcattgccgtactcaagggatcgttcattttcgcggccgatcttatccgcgcgctgcatgatagcggccttgctcccgaagtcgaattcatcacgctttcgagttacggcgccggcacggtttcccaaggggtgcggatcgtcaaggatatcgacagcgatgtgaaggaccgcgatgtcctgctgatcgacgacattctcgaatccggccgaacgctgcgtttcgccaaggaactgctttacgagcgcggcgcgcgcaacgtcaccattgccgtgctgctcgacaagaaggtcaagcgcaaggaagatctggaggccgactatgtcggtttcgaatgtcctgactatttcgtcgtcggttacggcatggatgtggcttatgccttccgcgaactgccttttgtcggcgtc

SEQ ID NO: 35310 - DNA, 1245 bp, Agrobacterium tumefaciens
gtgaaccattttggctatatcgacggcgtgctgcacgccgaaaacgtgcccgtgcccgagatcgccaaggcggtcggcacgcccttctacgtctattccacagcaacgctggagcgccactacaaggtgttctcaggcgctttcgcggatgtggacgccatggtctgttacgccatgaaggccaattccaaccaggcggtgctgaagacgctggcgaaactcggtgccggcatcgacgtggtctccggcggcgaattgcgccgtgcactggctgccggcgtgcccgcaagccgcatcatgttctccggtgtcggcaagaccgtggcggaaatggattacgcgctggaagccggcatctattgcttcaacatcgaatccgaaccggaactggaagtcctcaacctgcgcgccgtcaaggccggcaagcgggcgcatgtctccttccgcatcaatccggatgtggatgcgcgcacccacgccaagatttccaccggaaaaaaagaaaacaagttcggcatttcctatgagcgggcgcgtgcggtctatgcccatgccgccaccctgcccggcatcgaagtcaccggcatcgacatgcatatcggcagccagatcaccgaattgcagcctttcgaagatgccttccggctgctgcgcgaactggtggaagtgctgcgtaccgatggccatgcgatcagccacgtcgatattggcggcggcctcggcattccctaccgcgacgacaacaatccgccgccgctgccggatgcctatgctcatatcgtcaagaacgagctgaagagcctcaactgcaagatcgtcaccgagcccggccgcctgattgtcggcaatgccggcattctggtgacggaagtgatctatgtgaaagatggcggcgacaaaaccttcgtgatcgtcgatggcgccatgaacgaccttattcgcccgacgctctacgaagcctatcacggcatccgcccggtggtgcagccttcagagaacgcgccgcgcatcaaggccgatatcgttggtccggtctgcgaaaccggcgattatctggcgctcgaccgcgagatggcggcaccgcagccgggtgatctcatcgccgtcagttcagccggcgcctatggcgcggtgcaggccggcacctataattcgcgtctgctggtgccggaagtgctcgtcaagggcgacaggttccacgtcatccgcccgcgcggtacctatgaggaactgatcgccctcgat

SEQ ID NO: 35311 - DNA, 1359 bp, Agrobacterium tumefaciens
aaccagatgtggggcggacgttttgcttccgggccatcagccatcatggaagagataaatgcctccatcggcttcgacaagaagctttatgcccaggacatccgcggctctatagcgcacgccaccatgctggcggaaaaaggcattatttcgcaggaagataaagagaagatcgttcacggcctgaacacgatcctgtcagagatcgaagccggcaccttcgaattctcgcgcaagctcgaagatattcacatgaacatcgaggcgcgccttgcaaccctcatcggcacggcggccggccgcctgcacaccgcgcgctcgcgcaacgaccaggtggcgctcgatttccgcctgtgggttaaggaagaattgcagaagaccgagggcatgttgacagccctcatcgccgccttcctcgaccgcgccgaggaaaatgccgataccgtgatgcccggcttcacccatctgcagacggcgcagcccgtcaccttcggccaccattgcatggcctatgtggaaatgttcggccgtgaccgtgcccgtgtgcggcacgccatcgagcatctggacgaaagcccgatcggcgcagccgcgctggccggcaccggctaccccatcgaccgccatatgacagccaaggcgctcggtttccgcgagccgacccgcaactctatcgacaccgtctccgaccgcgatttcgcgctggaattcctgtcgatcgcttcgatctgcgccacgcatctgtcgcgtctcgccgaagaaatcgtcatctggtcgacgccgcaattcggtttcatccgcctctcggatgccttttccaccggctcttcgattatgccgcagaaaaagaaccctgacgccgccgaactggtgcgcgccaagactggtcgcatcaacggctcgctggtggcgctgctgactgtcatgaagggcctgccgcttgcctattccaaggacatgcaggaagacaaggaacaggttttcgactccgccgaaagcctggaattggcgattgccgccatgaccggcatgatacgcgacctcgaggtgcgcaaggaccgtatgcgtgcggccgccggttcgggttattccacagccaccgatctcgccgactggctggtgcgcgaggcgggcctgccgttccgcgatgcccaccatgtgaccggcaatgccgtggcgctggcggagaaaaagggctgcgatctggccgatctttcgctggaggaattgcaggccatccaccccgacatcaccaacggtattttcgacgttctctcggtcgaggcatcggtcgccagccgcacaagctttggcggcaccgctccttcggaagtcaggaagcagatcgcctggtggcgt

SEQ ID NO: 35312 - DNA, 864 bp, Agrobacterium tumefaciens
aaaaacatcggtgtcatcggagccggtcagatgggatgtggcattgcgcatgtttccgccattgccggctaccgggtccatatctacgatctttcgaaagaaggcatcgaggccggccttgccacgatcaacggcaatctcgcccgccaggtgaccaacaacaagctttccgatgatgcccgcaagcaggcgctggcgctcatcagtggatcgaccgacgtcaatgatctggcgccgatggatatcgtcatcgaggcagccacggaaaacgaagagatcaagcgcaagatttatgcgcaggtctgcccggtcctgaaacccgaggcgctgctcgccaccaatacgtcttcactttccatcacccgacttgcttccgccactgaccgccccgaacagttcatgggcatccatttcatgaacccggtgcccgtcatgaaactggtcgagctggtgcgcggcatcgccaccaacgaaaaaaccttcgacgcggcgaaagcctatgtgcggacgcttgaaaaggcgatcaccgtcgccgaggatttcccggccttcatcgtcaaccgcatcctgctgccgatgatcaacgaggcgatctacacgctgtatgagggcgtcggttcggtggaagccatcgataccgccatgcggctcggcgcgaaccacccgatgggtccgctgcaacttgccgatttcatcggtctcgatacctgtttgtcgatcatgcaggtgctgcatgacggtctctccgacagcaaatatcgcccctgcccactactggtcaaatatgtcgaggccggctggctcggccgtaaatccggccgtggcttctacgattaccgcggcgaaacgccagttccgacgcgt

SEQ ID NO: 35313 - DNA, 801 bp, Agrobacterium tumefaciens
atcatcatcaccggatgttcctctggcatcggcgcctattgcgccggcgcgcttcagcgggacggctggcgggtttttgccaccgtgcgccgcatcgtcgacatggccgcgctcgaaaatcagggcatcgaaaccctgatcatggattacaccaagccggaaaccatcgccgcgctggtggacaccgttgcagcccggaccggcggccgcatcgacgcgctcttcaacaacggcgcctatggccagccgggcgcggtggaagacctgcctgtcgaagcgctgagagcccagttcgaaaccaatgtcttcggttggcacgatctgactcgacgggtcattcccttcatgcgcaagcgtggttcgggccgtatcgtgcattgctcctccattctcggcctcgtgccctatcgctatcgcggcgcctataccgcctcgaaattcgccatcgagggcctgggcgtcacgctgcgcatggagcttcagggcagcggcattcatgtgagcctgatcgaacccggtccgattacctcgaaattcacggcaacggcgcttgcccacgtcaaggacaagatcgatctggaaaattcggcccatgcggcggaatataaacgccaactggcgcgcatggatgggtcaggccccgtcaaccgccacaaactcggccccgaggccgtttatgccgtactgaaacatgccctgaccgccgccagaccgaaaccgcattatcccgtcacggttccagccaaacaggggctgttactgaaacggctcttgcctgccggactgttctatcgtctgctg

SEQ ID NO: 35314 - DNA, 807 bp, Agrobacterium tumefaciens
cgttttgcaccaagcccgaatggcccgctgcatctcgggcacgcgctttccgccttcctgaaccatgatatggcgcaggacaatggcggccgcttcctgctgcgcattgaggatatcgaccagacccgctgcacgccggaactggagcaggcgatctatgatgatctcgactggttgggtctcgactgggaaaaaccggtgcggcggcaatcggaccatttcgacgcctaccgcgtgtcgctggacaggttgatcgatgcgggccttgcctatccggcttttctcagccggggtgaaacaaaaaccatcgtcagggccttcgaggccgatggcgggctctggcctcgcgatccggatggcgcgccgctctatccatccatggaccgcgaaaggcccgacgcggaacgggcagcgctgcttgcctccggtcggcaccacgcatggcggctcgacatggaaaaggcgatccgcgccgttggcagctccctgttctggcaggagagcggcgatggcgagacgggacgcatcgaggcacttcccgggctctggggcgacgtggtgctgtcgcgttccgacgcgccttcgagctatcatctttccgttgtggtggatgatgcgctgcagggcatcacccatgtggtgcgcggcatggatctgttccacgcaaccgccattcaccggctgcttcagcatctgctggacctgccgcaaccgacctatcaccatcaccggctgctcctcggtgcggacggccgcaaactttcgaaaagcgaaggaagcacggggctctccacccttcgtgcagaa

SEQ ID NO: 35315 - DNA, 1998 bp, Agrobacterium tumefaciens
atgatcaagaaaatcctcatcgccaatcgcggcgagatcgcctgccgggtgatcaagacggcgaagaagatgggcatcgccaccgttgcggtctattcggatgcggatgccaatgcgctgcatgtgaaaatggcggatgaagctgttcatatcggtccagcgccctcgtcgcagtcctatatagtcatcgataaaatccttgaggcgattcagaagaccggggcggatgcggtccatcccggttatggtttcctgtctgaaaatgccgccttcgctcaggcgctagagaaggcaggcgttgtattcatcggcccgcccgttggtgcgatcgaggcgatgggtgacaagatcacctcgaagaaactggccgcaaaagccggcgtttccaccgtgcccggccatatggggctgatcgaggatgcggatgaggcggtgaagatcgcgtcgcagatcggttatcccgtcatgatcaaggcctctgccggcggcggcggtaagggcatgcgcatcgccttcaacgaagccgaggcgcgggaaggcttccagtcctcgaagaacgaggcgaaatcctcctttggcgatgaccgtatcttcatcgaaaaattcgtcacccagccgcgccatattgaaattcaggtgttgggcgacaagcacggcaccattctttatctcggtgagcgcgaatgctcgatccagcgccgcaaccagaaggtcatagaagaagcgccgtcgccctttctggatgaggcgacgcggcacgccatgggcgagcaggccgtggcgctggcgagagcggttggttaccattcggctggcacggtggaattcatcgttgatggcgagcgcaatttctatttcctcgaaatgaacacccgcctgcaggtggaacatccggtgacggagcttgtcaccggcattgatctggtcgagcagatgatccgtgtggcatcgggcgaaaaactctctctcgcgcagggggatgtgaagctgaacggctgggcgatcgaaagccggctttatgccgaagacccctatcgcaacttcctgccctccattggccggctgacgcgttatcgcccaccgggagagggtgcacaggacagtggcaccgtcatccgcaatgataccggcgttttcgaaggcggcgaaatctcgatgtattacgatccgatgatcgccaagctgtgcagctggggcaaggatcgggagaccgccatcgatgccatgggagaggcgctggatcgtttcgaggttgagggtattggccacaatttgccgttcctgtccgccgtcatgcaacatgaacgttttcgctccggccggctgacgacaggctttatcgcggaagaatttccggaaggcttttccgggatcgagccggacgagaccgctgcacgcaagctttccgcaattgccgccatagtcaatcaacgcttgcagagccgcgcggttgaaatttccggcaccatcggcaatcaccgtcgcatcgtcggccatgactgggtggtttcgtttggcgcattccgccacgggatcagcgttgaaaccgttgcggatggcacggcggtccgttttgaagacggaatggccttgaccattgataccggctggcgtcccggccagagccttggcctcttcacggtggcgggcgaggtcatcgccgccaaggtcgatcttgccggcgcagcggttcgcctgcgctggcgcggcatggatattcttgcccgggtgcgcagcccgcgcgtggcggaactggcactgctgatgccggaaaaactgccgccggatacctcgaaactgctgctctgcccgatgccgggcgtcattaccggcatttcggtgggtgagggtgaggaggtggaggccggccaggcgctggcgacggtggaggccatgaagatggaaaacatcctgcgcgcggaaaaacgtggtcgtgttgtaagagtggcggcaaaaccgggcgacagccttgcagtggatgaggtcatcctcgaattc

SEQ ID NO: 35316 - DNA, 1485 bp, Agrobacterium tumefaciens
aacaacattttcgatctttttgtcatcggtggcggcatcaatggctgcggcattgcccgcgatgcggtgggcagggggtattccgtggcgcttgcggaaaagggcgattttgcctctggcacctcgtcagcggccaccaagctcatccatggcggcttgcgttacctcgaacattatgaattccgcctcgtacgcgaggcgctgatggaacgggaaatcctctgggccatggcgccgcatgtcatctggcccatgcgtttcatcctgcccgtgcagaagggcggcgtgcgtccatcatggatggtccggctcggcctgtttctttatgacaatctcggcggccgcaagctcttgccgccgacgcggacgctcgatcttcgcaaggacccggctggcaaaccgctgaagcctgttttcgccaaggctttcgaatattccgacggctgggtggatgatgcccgtttcgtggttctcaatgcacgcgatgcggcggatcgtggcgcgacgatcatgaaccgcacacgggttgtttcggcgcggcgcgaaggcaggctgtggctcatcgagacgctggacgaaaaaaccggccggccggccatgcacaaggcccgcatgctggtcaatgccgccggcccgtgggtggacaatgtgctgtcaggtgtgttcggccgcaatgacgtgcacaatgtccgcctcgtgcagggtagccacatcatcgtgcgcaggaagttttccgatccgcgcgcctatttcttccagaatccggacaaccgcatcatcttcgccattccctatgagcaggattttacgctgatcggcaccacggaccgcgactataagggcgatccggccaaggtgcgcatttccgaggaggaaatctcctatctctgcaatgcggcgagcgactatttcagcgagccggtgcgtcccgaggatatcgtctggacctattccggcgtgcggccgctctttgacgatggcgcttcgaaagcgcaggaagcaacccgcgattacgtgctgaaggtggagcaagccgaaggcgaagcgccgctcctcaatattttcggcggcaagctcaccacctaccggcggctggcggaacacgcgctggaaaagatcggcgcggcgatcggcgaaaaaggcaagccatggacagcgggctcccacctgccgggcggcgatttcggcgttcaacgatttgacgcgcaggtgaagacgcttctctcgcgttatcccttcctggacgaacgccatgcctaccggctcgtcaaaaactacggcacgaaagcagcgaacctgctcggcgctgccaccgatatttccggcctcggccggcatttcggcggcaccgtctacgaatgtgaagtgcgctggctggtggagaatgaatgggccttttcggccgaggatattctctggcgccgcacgaaacagggcctgcgtttgagcaaggacgaagctgccgctctcgacgaattcgtggct

SEQ ID NO: 35317 - DNA, 1707 bp, Agrobacterium tumefaciens
aagaagctcatcaacgatccatccaccgttgtccgggacatgctggagggcatcgtggcgctcagccccgaaaccattctgcttcaggatgagaacgtggtcataaggtccggcctgcctgaagcggaaaagcgcaaggttgcagtgctttcgggcggtggcagcggacatgagccggcccacgccggttatgtcggcacgggcatgttgacggttgcggtggcgggcgatgtcttcacttcgccgagcaccgacgcggttctcgccggcatcagggccgcggccggccctgccggtgcgctggtcatcgtcaagaactataccggcgaccggctgaatttcggcttggcggcggagctggcgagggccgaaggaatccctgtcgagatcgttgtcgtcgccgacgacgttgccttgaaggatacggttcccgccgagcgccgccgcgggattgcggggacggtgctcgtgcacaagctcgcgggggccgcagcggaaaagggccttcctcttcaagaggtggcccgcatcgcccgggacgctgccgccaagctatcttccatgggtgtctcgctgggatcctgcacgctgccggctgtcggcaagccgggcttcgtgcttggcgagaccgaaatcgaagtcgggctcggtatccatggcgagcagggcgtgcagcggatgcccattgcctcggctgacgcgctcgtgcagctggtgatcgaaacgatcgaagccgacggcaagctcgccggcggcaatcgcgtcgctctgctggtcaacggcctgggggcaacgccgccgatggaactcgccatcgtcgcacggtcggcagtcgcgcggctggaggcgaaaggcatcgtcgtggaacgtgcctgggccggcaccttcctttcagccctcgatatgcccgggttttcgttgtcggtcatgcaggttgacgacgcagcgctcagcctcatcgacgcgccaaccgaggctggcgcatggccgcgcggcggtgcggtgaaccgcaagcgggttctgccttcggcaaacgccgaaaagaccgtggttgcgacaaacaagatgacggcggccggcgagcggcttcgttcgggcgcggaacggtccgcgagagccctgatcgctgcggagcccaggctgacgcaactcgatagcgttgcaggtgacggcgacctcggcgccagcatggtgcgtggcggcgaggcgatccttgcgctgccgaaagagagtttcggcgacgtctccgatggattgatggcgatggccaatgcgatgcgcaaggccatcggcggaagctcggggccgttctatgcgacaggcctcatgcgcgcttcgcgacagctggcagggatcgatgagccagcggcccagcagatggcggaagcattcgtggcggctgttgcggcggtctcggaacttggcggtgcgaaaccgggcgatcgcacgatgatcgatgcgctttatccggcagcgaaaaccttcagggacaagcttgtgacaggcgcttcggcagaagaagcctggcaatccgcggtggcggcgggcgaggtgggcgcagaggcgacagcgtccatgaagccacggctcgggcgcgcaagttacctcggtgagcgggccgtcggccatcccgatgggggcgcggtcgccgttggcatctggctcaaagctatcgaggctgcgatctcgtgaaagtctgaccgggct

SEQ ID NO: 35318 - DNA, 729 bp, Agrobacterium tumefaciens
atggaactgaaacacaagaccgcgctcgtaacgggcgcgtgcggcggcatcggccgcgccgtggttgcggcgctggtggcgcaaggggcgagggtgatcgccttcgatcgcgatatcgaggctgtaacagcgctcgcgaaggggttcggcagtgcctgcgatccagtcgccgtcgatctcggtgatgcggcggcgctacaggccgtcatgagggatatagccggccgtttcaaggtcatcgacattctcgtcaacaatgccggtgtgctgtctccgcacaagctggccgcgaccacgctcgaagaatggcacaggctgatggccgtcaatctcgatgccgcgctgctgctgacgcaggccgtcgttcccgccatgaaggaaaaccgctgggggcgactgatcaacatctcctcctacgcctggaaatccggcggactgacggcgggtacggcctattcggtctcgaaatcggcactggtcggcctcacctactcctccgcccgtgaactcgcctccttcggcatcactgccaatgcggtcgcgccggcctatgtggtttcgccgatgatcatggagcaattgtcggaggaagatcgtcagcgccagcttgcagccattcccgtcggccgtttctgccagccggaagaggtcgcgcatgcggtgcgtttccttgcctcgccgctgtccggcttcatgaccggcactgtcgttgacatgaatggtggcctg

SEQ ID NO: 35319 - DNA, 1239 bp, Agrobacterium tumefaciens
atgtccgttgccgtttccccgctcgctcccaaatcctatcccgatatgcccgcgctgcgcggcgttcgcatggcgacggctgccgccggcatcaaatacaagaaccgcaccgacgttctcttgatggtgttcgacaagccggcaagtgtggctggcgtcttcaccaaatcgaaatgcccctcggccccggttgatttctgccgcgccaatctcggcagcggcgcggcgcgtgccgtggtggtcaattccggcaatgccaatgcgtttacgggcgtcaagggcaaggctgcgaccgaactgacggcgaagtccgccgccgctgccgtcggctgctccgaaggcgaaatattcctggcatcaacaggcgtgatcggcgagccgctggacgcttcgaaatttgcaggcgttctcggtgatatgaacgtcagggcggaagccgatttctggcaggaagccgccaaggcgatcatgacgaccgacacctatcccaaggtttcgacccgcaccgccgagatcggcggcgtgatcgtcacgatcaatggtatttccaaaggtgccggcatgatcgcgcctgatatggcgacgatgctctccttcgtcgtgacggatgccgacatcgaacccgccgcgctgcaatccctgttgtccgccggtgtcggcccgaccttcaattccgtgacggtcgatagcgacacgtccacgtcggacacgctgatgctgttcgccacgggtgcggcggctgaggacggtcaggtaaaggtgacgagcgccgatgacgagcgcctgtcctccttccgcgccgcgctcaacgatctcctgaaggatttggcgctgcaggtggttcgcgacggcgaaggcgcgcgcaagatggtggaagtcaccgtgacaggtgcggaaaacgatgccgctgccaagaaaattgccctttccatcgccaattcgccgctggtgaaaactgccgttgcaggtgaagacgccaattggggccgcgtcgtcatggctgtcggtaaatcaggcgaaatggctgaccgtgaccgcctcgccatctggtttggcggcgtgcgcgtggccgtgaacggtgaacgcgatccggattattcggaagcggagaccaccgccgtgatgcggctggaagatattacggtgaaggtggatatcggcctcggccaaggcacggccacggtctggacctgcgatctgaccaaagaatatgttgcgatcaacggcgactaccggagc

SEQ ID NO: 35320 - DNA, 1425 bp, Agrobacterium tumefaciens
tatcccgacatcaaacttctcattgatggcgaatggcgagacgccgtttccggcaagacgatcgccgtgtccgatccggcaaccgacgagatcatcggcgcgattgcccatgccgagaaggaagacctcgatctggcgcttgccgccgccgagcgcggtttcaagctgtggcgcgacacctcgccctatgagcgttcgaagatcatgcgcaaggccgccgacatcctgcgtgagcgcaaggacaagatcgcctacatcatgacccgcgagcagggtaagccactggcgcagtccgctaccgaaatcatgggcgccgccgacaccatcgactggttcgcggaggaagcgcgccgcacctatggccaggtcatccccgcgcgcgccaccggtgtgtcgcagcttgccatcaaggtgccggtcggccccgtggcggcgttcacgccgtggaatttcccgctcaaccagatcgtccgtaagctctccgcggcgcttgccaccggctgctccatcatcgtcaaggcacctgaggaaaccccggcatcgccggccgaactcatccgcgccttcgtggatgcgggcgtgccggcaggtgtcatcggcctcgtctacggcgttccgtcggagatttcggaatatctgatcccgcatccggtcatccgcaagatttccttcaccggctccacgcccattggcaaacatctggcggccttggccggcaagcacatgaagcgcgccacgatggaactgggcggccacgcaccagtgatgatcttcgatgatgccgatatcgagaaggcgatcgaggtgacctcgcttgccaagttccgcaatgccggccaggtctgcgtcgcccccacccgcttcctcgtgcaggatggcgtggcggaccgctttctcgagggtttcgtggaagcaacgaaagccatcaaggtcggcaacggtctcgaagagggcgtcatcatgggtccgctcgccaatgagcgccgcattcccgccctggaaggtctcatcaacgacgccgtttcccatggcgcggaactgaagaccggcggccgccgcatcggcaacaagggcaatttcttcgagcccacggttctcgccaatgtgccggtgaccgccaagatcatgaatgacgagccgttcggcccggttgcgatcatcaaccgcttttcgagcttcgatgatgccattaccgaagcaaatcgcctgcccttcggccttgcatcctatgccttcaccggctcggtcaaaaccgcgcatgcgctcggccaacaggtcgaggccggcatgctgaccatcaaccataacggccttgcgcttcccgaagtccccttcggcggcatcaaggattccggttatggcacggaaggcggttcggaagcggttcaggcctatctggagaccaaattcgtcagccagatgagt

SEQ ID NO: 35321 - DNA, 831 bp, Agrobacterium tumefaciens
atgggctttgttaagacgacagacggaaccgaaatcttttacaaggactggggcccgaaggatgcccagccgatcatgttccaccacggctggccgctctcgtccgatgattgggatgcgcagatgctgtttttcctctctaaaggttttcgtgttgtcgcccatgaccgccgtggtcacggccgctccgcccaggttgccgatggtcacgatatggaccactacgccgccgacgccttcgccgtcgttgaggcgctcgatctgaagaatgtcgtccatatcggccattccaccggtggcggcgaagtcgcccgttatgtcgccaagcatggcgaacccgccggccgcgttgccaaggcggttctcgtttccgcggtaccgccgctgatgctcaagaccgaggccaatccggaaggcctgccgatggaagtctttgacggcttccgctcagcccttgccgcaaaccgagcccagttcttccgcgacgtgccgtccggcccgttctacggcttcaaccgcgatggcgcgtccgtgcaggaaggcgtgatccagaactggtggcgtcagggcatgatgggcggcgcgaaggctcattatgacggcgtcaaggccttctccgaaaccgaccagactgaagacctgaagaatatcagcgttccaacgctcgttctccacggtgaagacgaccagatcgttccgattgccgactcggctcacaaatcggtcaagctgctgaagaacggcacgctgaagacttatcccgggttctcgcacggcatgctgacagtcaatgccgatgtgctgaatgcggatctgctggccttcatcaag

SEQ ID NO: 35322 - DNA, 1968 bp, Agrobacterium tumefaciens
aaaatactgatcgccaaccgtggcgaaatcgcctgccgcatcatccgcaccgcagccagtatgggcatccgcaccgtcgcggtctattcggatgccgaccgcgacgccatgcatgtggcgctggccgatgaggccatcgccatcggccccgcacctgcgcgcgcctcctatctcgacggcgaaaagatcattgccgccgcaaaggcaagcggcgcagaggccatccatccgggctatggttttctttcagaaaatgccggtttcgccgaagcctgcgcttctgcgggcctcgttttcatcggccctccaccagaagcaatccgcgccatgggcggaaaaagcgaagctaaggcgctgatggcaacggcaggcgttcccatcgttcccggttatcacggcgatgaacaggccgagaaacgactggcaagcgaggcggacaagatcggttacccggtgctgctgaaagcctcggcaggcggcggcggcaagggcatgcgcgtcgtccggcagaagcacgactttgctgcggagcttgccggcgccaaacgcgaagcactggccgccttcggcaatgaccgcatgctgatcgaaaaatacctggagcggccgcgccatgtggaagtgcaggttttcgccgatggccacggcaattgtgtttcgctttttgaacgcgactgctcgatccagcgccggcaccagaaggtgatagaggaagcccccgcccccggcctgcccgatgacttgcggcaacgcatgtatgacgcggcaaccgccgccgcccgtgccatcgattatcgcggcgcgggaacgatagaattcctccttgatccatccggcttctatttcatggaaatgaacacgcgccttcaggtcgagcatccggtgacggaatatattaccggtctcgatctggtcgaatggcagctgcgcgttgcgaatggagaagccctgcctaaagactgggccgatctccgcatcaacggccatgccatcgaggcacgcatttatgccgaagacccggcgcatgatttcctcccgtcgattggcacgatcagccacctcgtctttcccgatgaaggtcctcacctccggatcgacagcggcatccgcgccggcgacgccatcaccgtgcattacgatccgatgatcgccaagctgatcgtctgggatcatgaccgacccgccgccgtgcggcgtctaaaggtggcgcttgaaaagctggcaatttgcggcgtcaccagcaatgccacctttctggcgcggcttgcggggctcgaaactttcgcagcggccgatctggataccggcttcatcgcccgcaacgaggcagacctttttgctccgcaggccgtgggcgacaatgagatcgcactggcggcactcggcttccttctcagccgtaaaaacgcgagcaccaacccgcaagcgcaggccgaccctcatagtccctggaataccgccaacgccttccgactgaatgcgccggcgcgtgagacgctgcatttcaccatgcagaaccggccgatcgaccttggcgtagcccatgaggcagacagcttttcgctggagatgggcggacacacgatccgcgcttatggcgacctctctgacaacggccgctttcgcgcgaccatcaacgaccggacatggaaaggctatttctttgcagagagtgatagctacgcactttttctgcacggcgaacactatcgcatcagccagccagacccggtcgatatcgcagattcttctggccatacgggcggtctggaggcgcccatgccgggcgttatccgcgccgtgctcagccagagtggcgcggcggtcgagaccggtgatgcacttgtcgtgatggaagcgatgaagatggagcataccatccgcgcacccgcgaaaggcatcgtcaccgccgtcaactgcgccgaaggcgacatggtcgtcgccggtgcggtgctggtggatttcgag

SEQ ID NO: 35323 - DNA, 1119 bp, Agrobacterium tumefaciens
ctcggcccggaaatcgcagcattgcgcgacagcgccagtgcattcgcagatgataaaattgcgccgctcgccaccgagattgatcgcaacgaccgcttcccgcgtcagctctggccgcaaatgggtgagcttggcctgcacggcatcaccgtttcggaagagtttggcggtgccgatatgggttatctcgcccattgcgtggcgatggaggaaataagccgggcttccgcttccatcggcctttcctatggcgctcattccaacctctgcatcaaccagattcaccgctggggaaccgatgagcagaagcacagatatctgccgaaactcgtctccggtgaccatgtcggttcactcgccatgagcgagacggaagccggttccgacgtcgtatcgatgcggctgaaggcggaacgcaagggtgaccgttacgtactgaacggcgcgaagatgtggatcaccaatggccatgaagccgatacgctggtggtttatgccaagacggacatgtccgccggtgcgcgcggcatcaccgccttcctgatcgaaaagggcttcaagggtttccgcccggcccagaaactcgacaagctcggcatgcgcggctcgcccacatcggaactggtgttcgaggattgcgaggtgccggaggaaaacatcctcgggcgtttgaatgacggcgtgacggtgctgatgagcgggctggattacgaacgcgccgtgctggccgccggccctgttggcatcatgcaggcggccatcgatctggtgctgccctatgtccgcgagcgcaagcaattcggcaaggctatcggcgagttccagctggtgcagggaaagcttgccgatatctattcggccatgaatgcatcccgcgcctatgtctatgccgtggcccgcgcctgcgacaatggccgtatcacaagacaggatgcggcgggcgcgattttgtttgccgccgagcgggcgacacaggtggcgctggatgcgatccagcttctcggcggctccggttatgtcaatgaaagcccggccggacggctgctgcgcgacgccaagctttatgagatcggcgcaggcaccagcgaaatccgccggatgctgatcggccgcgaactg

SEQ ID NO: 35324 - DNA, 1146 bp, Agrobacterium tumefaciens
gaccctgtcgtgatcgtcggggccgcccgtactgctatgggtgggttccagggcgaattcaaatcggtggccgcgcccgatctcggggccgcggcgatccgtgcggccgtcgaacgggcggctattccggtttctgacattgatgatgtgctgatgggctgtgtgctcacggccgggcaggggcaggctccggccagacaggcggccattgccgccggtgtcccgaattccgtgggcgcaacgaccatcaacaagatgtgtggctcgggcatgaaggcgatcatgctggggcatgaccagatcgcggcgggaagctcttccatcgtgcttgcgggcggcatggaaagcatgagcaatgcgccttatctgctggatcgcgcccggaacggctatcgtctcggccatggcaaggtcatcgaccatatgtttctcgatggtctcgaagatgcctatgacaagggccggttgatgggcactttcgcggaagattgcgctgaagcctaccagttcacccgcgcaatgcaggatgactatgcgctgacctcgcttgaacgggcgcgacgcgccatagcggaaggcgcattccaagcggaaatcgcgcctgttggtgatgttgccgtggacgagcagccgggcaaggcaaagccggaaaaaattccgcagctgaagcccgcctttcgcgatggcggaacggtgacggcggcgaattccagttccatttctgatggtgcggccgctcttgttctcatgcgcagatcggaagcagaacgacggggccgttcaccgctggcaaccattatcggtcaggcctcgcatgccgatgcacctgccggatatccgaccgcgcccatcggcgcgattaaaaagctgttcgaaaaaaacggctgggccgcgaaggacgtcgatctgttcgaaatcaacgaggcctttgcggtcgtggccatggcagcgatgcgcgatctcgatctgccgcatgagaaggtgaatgtgcatggcggcgcctgcgcgcttggccacccgatcggcgcttccggcgcgaggatcgtcgtcaccttgctggcggcccttcaacgccacgggctgaaacggggcgtggccgccgtctgtatcggcggcggtgaagcaaccgcgctcggtatcgagcgg

SEQ ID NO: 35325 - DNA, 1119 bp, Agrobacterium tumefaciens
ctgaacgaagcccagcagcagatcagggacatggcccgcgatttcgcccgcgagcggctttcccccggcgctgccgcgcgtgaccgggaaagccggttcccaaaggacgaattgaaggaaatgggcgagctcggtttcctcggcatgctcgtctccgaggattatggcggatcggaaaccggtgccgtggcctatgctttagcgctggaggagatcgccgccggtgatggcgcctgttccactatcatgagcgtgcataattcggtcggctgcgtgccgatcctcaaattcgggaccgaggagcaaaagcagcgattcctgccgaagctggctgccggcgaatggatcggcggttttgcgctgaccgaaccgcaggccggttccgatgcctccaacctcaagacccgggcgcggcgcgacggcgatcgctatgttctcgacggcgcgaagcagttcatcacatcgggcaagaacggcgatgtcatcatcgtttttgccgtcacagatgcggcggcgggcaaaaagggtatcaccgccttcatcgtgccgacggatacgccgggttacgaggtcatcagggtcgaagaaaaactcggcctgcattcctccgatacctgccagatcgccttcaccgagatggcggttccagtcgacttgcggctgggcgaagaggggcagggttaccgtatcgcgcttgccaatctggaaggcggccgcatcggcatcgccgcacaggccgtcggcatggcacaggcggccttcgaggcggctcgggactacgcccgcgaacgcaaggctttcgggcaggcgatcatcgagcatcaggctgtggcgtttcgtctggcggatatggcgacgcggattacggcggcgcggcagctggtgctgcatgcggcggcgctgaaggaagcgggtgagccctgtctttcggaggcgtcgatggccaaactctttgcgtcggaaatggccgaacgcgtctgctcggacgccatccagattcacggcggttatggctacatggcggattatccggtggagcggatctatcgcgatgtgcgcatctgccagatttacgaggggacaagcgatgtccagcgcatggtgatcgctcggaacctg

SEQ ID NO: 35326 - DNA, 1227 bp, Agrobacterium tumefaciens
atatcagaaacgccacatctcagcctgcatgttccggaacccgcggtgcggcccggcggggagccggatttctccaatgtgaagatacccaaggccggcaccgtgccgcgcccggaggtggatgcagcgcctgaaagcatgcgtgatctggcctattcgatcatccgcgttctcaatcatcagggcgaggctgtcgggccatgggcagggctgctctcggacgaggatttgctggtgggcctcaaaaacatgatgcggcttcgggctttcgatgcccgcatgctgatggcgcagcggcagggcaagacctcgttttatatgcagcatctgggggaggaggcggtcagttgcgccttccgcaaggcgctttccaaaggcgacatgaatttcccgacctaccggcaggcggggctgctgatcgccgacgattatccactcgtcaccatgatgaaccagatctattccaacgaactcgatccgctgcacgggcggcaattaccggttctctattcctcgaaggagcacggcttcttcaccgtgtcaggcaatcttgccacgcaatatgtgcaggcggtcggctgggcgatggcgtctgccatcaagggtgatacgaagatcgcggccgcctggatcggtgacggttcgacggcggagtcggatttccattcggcgctggtcttcgcctccacctacaaggccccggtcatcctcaatatcgtcaataatcaatgggccatttccacctttcagggcattgcacgcggcggttccggcacctttgcggcgcgcgggctgggcttcggcattcctgcacttcgcgtcgatggcaatgattatctcgctgtttatgccgtggcgcgctgggcggtggagcgggcacgccgcaatctcggcccgacactgatcgaatatgtcacctatcgtgtcggcgctcattccacctcggatgatccaagtgcctatcggcccaagaccgaatccgaagcatggccgctgggcgacccggttctgcggctcaagaagcatctgatcctccgaggcgtctggtcggaggaacggcaccggcaggcagaggccgaaatcgccgatgaggttctggaggcacagcgcgaggcggaaagccacggcacgctgcacgaaggcaaaaaaccgccgaaaaaggatattttcgaaggcgtttacgccgagatgccgccgcatctcgcccgccagcgtcagaaggcagga

SEQ ID NO: 35327 - DNA, 999 bp, Agrobacterium tumefaciens
atgacgatgatcgaagccgtccgcagcgccatggatgtatccatggagcgaagcgacgatgtcgtggtgtttggcgaagacgtaggttacttcggcggcgttttccgcgccacgcaggggctgcagggaaaatacggcaagacccgctgtttcgatgcgccgatcagcgaatccggcattgtcggcacggcgatcggcatggccgcttatggcttgcggccctgcgtcgaaatccagttcgccgattacatgtaccccgcctatgaccagatcactcaggaggcggcgcgtatccgttatcgctccaatggcgatttcacctgcccgatcgttcttcgcatgccgaccggcggcggcatttttggcgggcagacgcatagccagagcccggaggcgcttttcacccatgtctgcggactgaaagtggtcgttccctccaatccctatgatgccaagggcctgctgatcgcctccatcgaagaccctgaccccgttatgtttctggagcctaagcggctttataacgggcctttcgacggtcatcacgaccggccggtgacgccgtggtcgaaacacgaaatgggtgaggtgccggaaggtcattacaccatccccatcggcaaggccgaaatccgtcgccccggaaacgatgtcaccgtcatcgcatacggcaccatggtgcatgtggcattggcggcggcggaggagacgggcgtggatgccgaaatcatcgatctgcgcagcctgctgccgcttgatctcgacaccatcgtgaagtctgtctccaagaccggccgctgtgtgatggtgcatgaggcgacgctgacttcaggcttcggcgccgaagtcgtgtcgctggtgcaggaacattgcttttaccatctcgaggctcccgtcgtccgggtcgccggctgggatacgccttatccccatgcgcaggaatgggactattttccgggacccgcccgcgtcgggcgtgccctcgtagacgtcatggag

SEQ ID NO: 35328 - DNA, 1275 bp, Agrobacterium tumefaciens
atggcggaatttgttatcacgatgcccgatgtcggtgaaggcgtggcggaagccgagctggtggaatggaacgtcaagccgggcgatatcgtccatgaggacatggtgctggccgctgtcatgacggacaaggcgacggtggaaatcccctcgccggtggcggggatcatcacatggctcgccgtgactgtcggaaacacggtgccagtgaaagcaccgctcgtccgtatcgaaaccgatgtcgctgccgctgcacccaatggcagcgcgccggaggcggaggcgccaagccggatgacggaagaggaagcgcctgccgacatgacggaagcgccgccaccagtcgaaacccagccggcggctcgccagaccgaggaggcgccgtctgcgcccgtagccgagccgcatcataaaccgctggcatcccccgccgtccgccagcgtgccgacgatctcgatatcgatctcatcaaggtcaagggaacggggcccgacgggcatatcacccatgccgatctcgatgggtttttaacggtacgggcacggccggaacgtcccgagccgatgacgccgcacgatagcgcggtcgaggaagtgaaggtaacagggctgcggcgcaagattgccgagaagatggtgctctccgtctcgcgcattccccacatcacctatgtcgaggaaatcgacgtgacggagttggaggatttgcgcgcgacgatgaacggtaaccgtcgttccgggcagccgaaactgacgatcctgccgtttctgatgcgtgcgcttgtgaaagccgtagcggatcatcccggcatgaacgcgattttcgatgacgaaaaaggcgtcgtcagtcattacgaagcggtccatatcggcattgctacgcagacgcccgcgggcctgactgttccggtcgttcgccacgcggaaacgctcggcctctgggactgtgcggaagaagtcgcgcgcgtcgcggaagccgcccgcaccggcacggcgcatcgggaagagctgatgggttccaccattaccatcagttcgcttggagccttgggcggtgtggtttcgacgcccatcatcaatcatccggaggtggcgatcatcggcgtcaacaagatcatgacgcggccggtctgggacgggaaccggtttgtgccgcgcaagatgatgaacctgtcttcgagtttcgaccatcgtgtggtcgatggctgggatgccgcggtcttcattcaggccgtcaaagcgctgttggaaaagccggcactgattttcatcgag

SEQ ID NO: 35329 - DNA, 1500 bp, Agrobacterium tumefaciens
actcccaaacccgttgtcctgactattctcgatggctgggggctgaacgaggacacatccagcaatgcgccggttctggcgaatacgccgaccatggaccggcttttcgccacctgcccgaatgcaacgctgaccaccttcggcccgaatgtcggcctgcccaccgggcagatgggcaattccgaagtcggtcacaccaatatcggcgccggccgcatcgtcgccatggatctcggccagatcgatctggcgatcgaggatggcagctttttccgcaatgcggcgatgcttgatttcgccgccacggtgaaggccgcaggcggtgtggcgcatctgatgtgcgtcgtttccgatggcggcgtgcatggtcatatcctgcacggccaggcggcggtgaagctgatggtcagccacggtctgaaggtcgtggtgcatgccatcaccgatggccgcgatgtcgcgccgcaatcggcggaagatttcgtggcggcgcttgtggcaagcctgccgcagggcgcgagtatcggcacagtgatcggccgttattatgcgatggatcgcgacaatcgctgggagcgcgtcgagaaagcctatgacgccatggttctcggtaagggcgaacacgcgcgggatgcggtgagtgccgtggcccagagctacgcgaacaaagtcacggatgaattcatcctgccgacggtgatcgatggctacgaaggcttcaaggctggcgacggcctgttctgcctgaatttccgcgctgaccgtgcccgtgaaatcctgctcgccatcggcgcggatgatttcgacggttttgcgcgcgaaaagcccgtgctttcggcgctgctgggcatggtggaatattcgacgcggcacagtgatttcatgacgacggcttacccgaagcgcgatatcgtcaacacgctcggcgcctgggtggcaaagcagggtctgacgcagtttcgcctggctgaaacggaaaaatacccgcatgtcaccttcttcctgaatggcggcaaggaagagccggaagtgggcgaggaccgcttcatgccgaaatccccgaaggtcgcgacatacgatctgcagccggaaatgagcgctgccgaggtcacggagaaattcgtcgaggtgatcggcaagggttatgacctgatcgtcaccaactacgccaatcctgacatggtcggccataccggtgatctgcaggcggccatcaaggcgtgcgaagccgtggatcgcgggcttggtgccgtcgttgctgctctcgaaaaggtgggcggcgcgatgctcgtcattgccgaccacggcaattgcgaaaccatggtcgaccccgtcacaggtggcccgcatacggctcacaccaccaatccggtgccggtgatcctgtttggcggcccggaaggcgcaaaagtacatgatggcattctcgccgatgtcgcgccgacgctgctgcaactgatgaacgtgccgttgcccccggaaatgacgggcaagagcctg

SEQ ID NO: 35330 - DNA, 753 bp, Agrobacterium tumefaciens
ctcatcaccggcgcatccgatggtatcggcgccgtatatgccgaacgcctcgcaggacgcggccacgatcttatcctcgtggcgcggcgtgccgagaagctgaaggcactggcagcgcagctggaaaaggaccacggcattgccgtcgaggttctcagcgccgatctttccagcgcggaagacctcgaaaaggtcgaggtccggctgcgcgaagaccagcgtatcaccggcctcgtcaacaatgccggcatagccggggaaggcgcgatcacggcactggacccggcctatgtgacgacgatgatcaatctcaacattcttgccgtcacccggctggcggcagccatcgcgccccgccttgccgccgcaggcaaaggcacgatcatcaacatgacttcggtcacggcgctgatgccggcggcattcaccgccgtctatccggccacaaaggccttcgtgctcgccttcaccgaagcactgcaggcgcagctttcgccgtccggcgtgcgggttcaagccgtgctgcccggcatcacccgcaccgcgatatgggaagaggaacggctcgatgccatcccggccgccatggtcatggacgtgcacgacatggtggacgcggcccttgccggtctcgatctcggtgaggcgctgaccattccttccctgccggatacggtcgaccttgaaaatttccttgcagcacgcgcagcgttgaggcccaatctgtcgcatgcacttgccgccagccggtat

SEQ ID NO: 35331 - DNA, 819 bp, Agrobacterium tumefaciens
atgacaacgatcaccaccagagacggaacgcacatcttctacaaggactggggtccgaaagacggccagcccatcatcttctcccatggctggccgctcagcgccgacacctgggatgcgcagatggtgttcttcgccaataacggtttccgcaccatcgcccatgaccgccgcagccacggccgctcggatcaggtctggcacaacaataccatggatcaatatgccgacgatctcgccgagttgatcgaacagctcgatctccacgacatcattctagtcggtcattccaccggcggcggcgaggtgacccgttatatcggccgccacggcacggcccgcgtcgcgaagatcgccctcatcggcgcggtgccgccgctgatgctgaagacggaaagcaataccatcggcatgccgatcgatgtcttcgatggcatccgcaagagcacctatgataatcgcagccagttcttcaaggacctgaccattcccttctacggctacaaccgcgaaggcgccgtgatttcggaaggcattcgcgaggaattctggcggcagggcatgatgggcggcctcaagggccagctcgacagtatccgcgccttctcggaaagcgatttccaccaggacctgaaggccttcgacaaaccaacgctggtgctgcatggcgatgacgaccagatcgtgccggtcggcgcttcagcactttccacggtcaagatcgtcaaacatgcgaccctcaaaatctacgagggcgccgaccatggcctgacgcagacccatcaggaccggttcaacgccgacctcctcaccttcatc

SEQ ID NO: 35332 - DNA, 1128 bp, Agrobacterium tumefaciens
gccgccctccgcgagcgccagcgcgaactgcccttcgacatcttcgcgcttatcaaggaagcaaagatcggtacgctgcgcgttcccgaagccaagggcggaccgggcggctcgattgcggactatattgaggttctgatgatcctcggcgaagccgacagcaatattccgcacgcgctgcgcagccattttaatttcaccgaaaacctcgccctcgcccccatcgagctggaagaccggcggcatctcgaacaggtgcttgccggcaaactctttgcgggcgccagcaccgaacagggcaccaagcgcccgggcgaaatcaccacacggctgagcgccgatggcgaccgctaccggctgaacggccgaaaatggtatgcgaccggcaccgcctttgccgatttcggcactttcagcgcgatcggtgacgacgagcagccaatcggcgtgctcattccgctcgatcgcaccggcatcaccatcctcgacgactgggacagcatgggccagcgcatgacggcaagcggcggcgtgttactcgaaaatgtcgaggtgctgccgcatgaattgacaacccgcaagctcggcagccagatcggccgccacagctccgccatgcggcagttgcatctcgccgcctctgccgccggtgccgttcaaggcgcgctgaatgacggcgtggagtatgttctgcgccaggcgcgcaccacccttcacagcagcgcggaaaccgccaatcaggaccccttcgtgcagaagatgctcggcgaaatcagcgccggcgctttcgccgtcaaaaccctgatccgcgaggccgcccggacgcttgaccgcactgcggctaccttcgccaccggcgatgaagaggtgatcgaggcagccctgctggaaggctcgctcgccaccgcgcgaacccagatcatcgcctcgcagctttcgctgacggtcgccaccaacctttacgaactgggcggcggctcggcgacgtcaagcgagcggaatttcgaccgccactggcgcaacatccgcacggtctacaaccataatccactggcccacaaggcgcgggtgatcggcgattattatctcaacggcaccacgacgcatctcagggaaggtcgggtattt

SEQ ID NO: 35333 - DNA, 1774 bp, Agrobacterium tumefaciens
ctgatcgaagttcatgatctctccgtcagcttcggctcggcccagccggtcaaaggcgtcagtttcgatgtcagccccggcgaaatgctggccatcgtcggcgagagcggctctggaaaatccctgacggcgctcggcctcattggcctgctgccctcacacgccaagaccggtgggcgagttcagctcgagggccgcgacctgctgccgctttccgaacggcaatggcgcggcattcgcggccgcgatatcggcatgatcttccaggagccgatgacctcgctgaacccggttctgacggtcggcgaacagattatcgaagtcctgcgcatccatgaaaaaatcgaccggcgtcaggcgcgcaaacgggccatcgagcttctcgaccttgtcaatattcccgatgctgcccgacgggtggatgattatccgcaccagctttccggcggcatgcgccaacgcgtgatgatcgccatcggcgtcgcctgcaatccgaaactgctgatcgcagacgaagcgacgacggcgctcgacgtgacgatacaggcgcagatcctgcaattgctcgacaatctgcgccgcgatctcaatatggcggtgatcctcatcacccacgatctcggcatcgtggcgcaatgggcggaccgggtgatggtcatgtatgccggccgcaaggtggaagagggtttgccggaaccggtgttctccaacccctaccatccctatacgcgcgggctgcttgccgcttcgccacgcgcggaagacggccagcattatcgtgacgggccgctgatcgaaattccgggctccatcgtctccgccaccggcgagcgcggctgcgccttccggccacgctgtccgagcgcccgtggtttctgcgggcagttcgtgccgccactgaggccgatttcggaaggccgctacgccgcctgtcccttcgtattcccgacatcacaggagatatccgatgacgctcttgtcagtgcatagtctctccacccattatacgggcggacgcggcaccgtgcgcgccgtcgatgatgtctcgctcgacattgaggcgggcgagacggtggcgctggtgggcgaatccggctgcggcaaatcctcgctcggcaagtcactgatgcggctggtcgaaccctcttccggcaggatcaccttcaagggcgctgatgtcacggcgatgacgtcgtcgcagctgcgcggtatccgccgccgcatccagatgatctttcaggatcccttcgcttcgctcaatccacgccagacggttcgcaccatcctcaccgcgccgctcaaggtgcacggcatcggcgacagggcgcgccagcgcgaaatcgtcgaagccatcgtcgcgcaggtgggcctgccgccggacgcgctcgaccgttatccgcatgaattttccggcggccagcgccagcgcatcggcattgcccgcgcgctggttctggaaccggaactggtggtgtgcgacgagcctgtctcggcgctcgacctttcgatacaggcacagatcctcaacctgctggtggagatgaagaagcggctgtcgctctcctatctcttcgtctcccacgacctttccgtggtacgttatttctccgaccgcgtgctggttatgtatctcggcaagatcgtggaaagcgcgccgaccgcagagctctgggcctcgccgaagcacccttacacccgcgcgctgctcgccgccgttccggatcccgcccgccgcaaacaggcggcaccgatttccggtgatctgccaagcccg

SEQ ID NO: 35334 - DNA, 1089 bp, Agrobacterium tumefaciens
ctggccgaagatttcagccagacggcggctgaccacgacaaaagcggggaattcgccgccggcaatttcgaagcgcttttcaagtcgggtctgctcggcctggtgacggctgtgaaggatggaggctggggcgagggcatggaaacggcgcatgccgtcattacggccattgccaagggcgatccgtccaccgcgctcattctggccatgcactacagcgttcacgccgcgatccggcgcggcaaatggccggctgctctctcggcaaaggtattggtcgccaataatagggagccggcgcttctgaacaatgcgcaggcggagccgggtgtcggttcacccgcccatggcggcctgccggaaacgacggcgcggatcgaaggcgatgtctgggtggtcaatggccgcaagagcttcgtcaccggcctgccggggctgaaatgggcgatcgtgcttgcggtgacgacggaagagacgccgcgtctcattcagcttctggttccactcgatgctgctggcatcgcccaggaaaaggcatgggaggcgaccggcatgtatgccaccgccagccatgatcttgtgctggaggatgtaagagtgccgcttgcagacatcgttgccgaacagccagcggatgagccgctgcggcgcgatgaggccgatggctataattttttcgcgcttctggcgtccgtttatcatggtgtagcactttcggcgcgggatgatctgctgcgccatctgacgggccatgcaccagtaagcctcggtgcgccgctctcctccattccgcgtattcaggaaggtcttggccagatcgaggtgcttctcgcagcaaaccggcgcctgcttctttccgttgcccgtgatatcgatgcgggagagcgggtgggaacggatgcgctggccgttcgccatgtggtgatcgacaatgcggtgacggtgaccgatctggcgctggagcttggtggcaatcgcggcctgcggcgggactacaatctcgaacgccatcaccgcgatgccatcacggcaagggcgcatgcgccgcaaagccacatgatccgcacgattctcggccgtcaaagcatc

SEQ ID NO: 35335 - DNA, 1314 bp, Agrobacterium tumefaciens
ctggaccgcgcccatctggtgcaccctgtctcctccttccgcggccatgaaaagctcggcgtgcgggtgctgaaatctgcaagcggcgccaccgtcaccgatatgaccggccatcagctgatcgatggttttgccggcctctggtgcgtcaatgccggttacgggcacgacagcatcgttgaagcggcggcaaagcagatgcgtgaattgccctatgccaccgcttatttcgacattggcagcgaaccggcgatccggctggcctcggaacttgccgaccgcgcgccgggtgatctcaaccacgtctatttcacgcttggcggttccgatgccgtggacagcaccatccggttcatccggtattactggcatgcgaaaggccagccgcagcgcgaccagttcatttccatcgaacaggggtatcacggctccaccaccgccggctccggcctcactgcgctacccgctttccacgcgggtttcggcgtgccctatgactggcagcacaaaattccgtcgcattatgcctatcgcaatcccgccggcagcgatccggccgccatcatcgcatcctccctgcaaattctgaaggacaagatcgaggccatcggcccggaccgcgtggccgccttttatgccgaacccatccagggatcgggcggcgttctggtgccaccgccgggctggatcaaggccatgcgcgagctctgcagttcctatggcattctcttcgtcgccgatgaagtcatcaccggcttcggccgcacgggaccgctctttgcctgcgccgacgaggacatcgtgcctgatttcatcacggccgcaaaaggcctcacgtcaggttatgtgccgatgggcgccgtcttcatggccgaccatgtttatgatacaatagccgacttcgcgggcgaggccgccatcgggcacggatatacctattccgcccaccccgtcagcgccgctgtcggtctggaagtgctgaaactttatgaaggcggactgctggagaacggccgtcgcgccggtcaacggctgatggccggccttgaaggattgagaaaccacccgctggtgggtgatgtgcgcggccggggcatgctcgccgccattgaactcgtgaccgacaaggacaagaaaacgcccttgccggccgcagccgcccccgcgcgaaaagttttcgaccgcgcctgggaaaacggcctcatcgtacgcgccttcgcgaacggcatcctcggttatgcgccgccgctctgctgcaccgatggcgaaatcgacgccatcgtcgagcggacgctgaagacgctcgatcagacg

SEQ ID NO: 35336 - DNA, 1422 bp, Agrobacterium tumefaciens
ttgaaggacaaggaactctttcgccagaccggtttgatcggcggcgcatggaaagcggcggcatctggcaaggtggtggatgtcatcgatccggcgacacaggcggttatcggcaccgtgcctgatatgggcggcgcggaaacccgcgcggcaatcgaggcggctaacgccgccttcggtccatggaagaaaaagacccatgcggagcgcgccgcccttctcgaaaaatggtttgcgctgatgatcgagaacatcgatgatctccgcctgatcctgaccatcgaacagggcaagccgcttgacgaagccaagggcgaaatccgctacggtgcgtccttcgtcaaatggtttgcggaagaggcccggcgcatcggcggcggcaccatcccctcaccgacgccggaccggcggatcgtggtgctgaaggagccggtcggcgtctgcggcatcatcacgccgtggaacttcccgaatgcgatgattacccgcaaggtcgcgccggcgctcgccaccggctgcaccgtcgtcatcaagccttcggaattcacgccctattcggcgctggcgcttggcgtgcttgccgaacgggcgggtattcccgccggcgtcatcaacatcgtcaccggcatgccgactgaaatcggcaatgaaatcatggccaacgagacggtgcggaaaatttccttcacaggctccacccgcgtcggctcgcttctgatgcggggtgctgccgacagcgtcaagcggctgtcgctggaactcggcggcaatgcgcccttcatcgtttttgatgatgccgatctcgatctcgccatcgaaggcgcaatcgtttcgaaattccgcaatggcggccagacctgcgtctgcgccaaccgtattctcgtgcagtcgagcgtttacgacgccttcgcgaaaaagctggcggatcgcgtcgacgccatgcgggtcggccctggaacggaagcaggcgtctccatcggcccgatgatcaacaaaccggccattgcgaaaatccgcgcccatatcgacgacgccgttgccaagggtgcaacgatcatcaccaggccgcgcgatctgccggaaggcccgcaatataccgcacccgtggtgctaacgggcgcgacgacggcaatgcagctggctagcgaagaaaccttcggaccggttgcgccgctcttccgcttcgagacggaggaggaggcgctcgccatcgccaatggcacgcccttcggccttgccgcctatttctacaccgagagcctcaagcgcgcctggcgcgtcggtgaagcgctggaattcggcatggtcggcctcaacaccggtgcgatctccaccgaggtcgctcccttcggcggcgtcaagcaatccggtctaggccgcgaaggagcgcaggtcggcatcgaagaatatctggaaacgaag

SEQ ID NO: 35337 - DNA, 1029 bp, Agrobacterium tumefaciens
ttgaaaacgcatcgcatcgcactcatccccggggacggcatcggccaaagcgtgacggacgcggcgtggcaggtcctcaatgccgtcgccaaaacctccggttttgtgctcgaaggaaccgaattcccctggtcctgcgccttctacaaggaaaccggggcgatgatgccgaaggacggcatcgaaacgctgcgcggattcgacgccatcatgctcggcgcggtcgggtggccggcggaggtgcctgactcggtgtcgctgcacggtctgctgctgccgatccgcaaggctttcgtgcaatatgccaatatccgcccgcaccggctactatcaggcgtacaagggcccttgaaggccgacggcttcgatattctctgcatccgcgaaaacacggaaggcgaatattccggcgccggcggccgcgtgcatcaaggcacggaggacgaggtggccgtcgaaacctcgatcttcacccgcaagggcgtggagcgaatcttgcgcttcggtttcgaacaggcgcaaaaacgtcgcggcaagctcgcctccatcaccaaatccaatgcccagaaatattcgatggtgttctgggacgaagtgacccacaagctcgcggcggaatatcctgacgtggaggtctcaagctatcacatcgacgccatggcggcacgtatggtgatggcgccggaaagcctcgatgtcgtcgtcgcttccaacctcttcggcgatattctgaccgatctcggcgccgccattcagggcggcctcggttttgccgcttccgccaatatcaatcccgaccgcagcgccccctcgatgttcgagccggtgcacggctcggcacctgacatcgcccatctcggcatcgccaacccgatcgccgccatctggtccggcgcgatgatgttcgagcatctcggcgaaaaggatgcagccgcgaaaatcatggcggccctggaaacggcgaccggccgcggcatcggcaccgtgccgggcaaggacaagactgacaccatcaccgccgcggttctc

SEQ ID NO: 35338 - DNA, 1361 bp, Agrobacterium tumefaciens
atatgccggctgccccagggcgaatgccgcgctggtcgatgaagcggtgcagaccgccaaggccgccctgaaaagcagcaactggggtggcgtgcgcccgcgcgaacgcacgaaaatcctgcagcgctgggcagacctgatcgagcaggaagccgagacgctggcgaaaatcgaggccctgtcctctacgcggcccgtcggccagctgatcgccggcgacatcgccgtgaccgccgaacagatccgtttcttcgccgaattcgccgacaaggaaggcggcgatctcgtgccaaccgacgatgccagcctcggcatgatcatgaccgaaccctatggcgtagtcggcgcgattacaccgtggaatttccccgtctcgatggccggctggaaactcggcccggcgctcgcggccggtaatgccgtggtgctgaaaccatcggaaatgacgcctttttccagcattttcatggctgaactggccatcaaggccggcctgcccgccggcctcatcaacgtcgtgctcggcgacggtcccgtgacgggcaacgccatcaccggccatcccgagatttccaaggtcagttttaccggctctaccgcggcgggcgccgccatcatggccaatgtcgcccgcaccggcatcaagcccatgacgctggaattgggtggcaaaagcccgcaactggtctttgccgatgccgatatcgaaaaggcggcagcggcgatcgccggcaatattctctcaaatgcgggacaggcctgtgtcgccggctcgcgcatcatcgttgaggaaagtgcggccgacgccctttccgccgcgatcatcgcccgcatgaagacggtaaagcccggccctacttgggacgaggccacccaatattcgccgatcatctccgaagtgcagcgccagcgtatagacggtatcgtgcaggcagccgtcgcccatggcggcgaatgcctgacgggtggcgcaatcatggatggtcccggttatttctaccagccgacgctgatcgccaatgtcgaccagacctcgcccgccgtcaccgaggaaatcttcgggccggtgctgacactacagaccttccgcacggaagaagaggctctggcgcttgccgatcatccgacatacggtctggcggcgggtcttttcagccgggacgtctcgcgtgtcctgcgcctgtcgcgcgctatccaggcgggaacgatctgggtcaatcgctatggacgttcgcgcgaccacatcctgccgaccggcggttacaagcgttccggcatcggcaaggatcttggacgggacgcctatctcgccaaccgcaagagcaaaagcgtcctcatcggactgtaacaggggaattctc

SEQ ID NO: 35339 - DNA, 2376 bp, Agrobacterium tumefaciens
gtcatcatcgctgcgggcctgttctttgccattggcggctggcagctcgtcgccctcggtggcagcccctatttcatcatcgcaggtctttcgctcatcgtttcgggcctgctgatcctgctgcgcaagccggcaggcgcgcttcttttcggtcttgttttcatcctcaccggcgtctgggctgtatgggaagcgggccttcatttctggccgctgatttcccgtctgctggccatcggggttggcgcaaccgtcgttgccctgtcatacccgctgctgcgccgtgcagccggcaaaacgccggcatatggctcttctttcgcggtagccgctgttctcgccatcgcttccggggccggttttgccggcatgttcgtggcgcatccgaccgttgccttcaatggcgagccggcggcgctgacgccggtcaagccggaaacggagcagaagaactgggaacattacggcaatacgtccggcggcagccgtttcgtggcgcttgatgaaattacccgagacaacatcaagaacctcgaagtcgcctggacctaccacaccggcgataccccgatcagccccggcgccaacggtgcggaagaccagcagacgccgctgcaggtaggtgacaccgtgttcctgtgcacgccgcacaacaatgtcatcgctctcgatgccgataccggaaccgagaagtggaaggcggaaatcaattcgaaatcctccgtctggatgcgttgccgcggccttgcctatttcgatgccaaggcgccgctgaagcaaccgactgcgccgggctccacgcccgtcacggccgcggttgtggccgaaggcgcactttgccagcgccgtattctgatgaacaccatcaatgcggaactcatcgcgcttgatgcggacacgggcgcgttttgccctgacttcggcacaaatggccgcgtcgatctgaagatcggtatgggagatgcaccggacccgcaatatgtcctgacctcggcacccacgctggccggcacgaccgtcgttgtcggcggccgtatcgccgataacgtgcaggtggacatgcccggcggtgtgatgcgcggtttcgacgtggtcacgggcgagcttcgctgggcttttgaccccggcaatcccgatatcaccaagctgccgcctccgggccagacttacacacgttccacgccgaacgtctgggcatccatgtcctacgatccggacctgaacacggtcttcatgcccgtcggcagcccttcggtcgatctttatggcgcgacacgcacgccgctcgaccataaatatggtgcctccatgctggcgctcgatgccacgaccggccgcgaaaagtgggtataccagacggttcataacgacctctgggacttcgacgtgccgatgcagccgagcttcgtcgatttcccgaaggctgacggaaccagcgttccggcgctggtcttcggcaccaaggcggggcagctctacgtgctcgaccgcgcgacgggacagccgctgaccaaggtggaagaggtttccgtcaaggctgccaatattcccaatgagccctacgcccccacgcagccgcgttccgtcggcatgccgcagatcggtgcgcagacgctgacggaagccgatatgtggggtgcgaccccgttcgaccagcttttgtgccgcatcgccttcaagggcatgcgttatgaggggctgtatacggcgcccggcacggacctctcgctcgccttcccgggttcgctcggcggcatgaactggggcggtctgtcgaccgatccgaccaccaacactatcttcgtcaacgatatgcgcctcggtctctggatcgagatgaaggaagccgcccccaccaaggccgttgccagcggtggcgaaagcgtcaataccggcatgggcgtcgttccgatgaagggcacgccctatgcggtgaacaagaaccgcttcctgtcggctctcggcatcccatgccaggctccgccctatggcaccatgaccgcgatcgacatgaagacgcagcagatcaagtggcaggtgccggtcggcaccgtcgaggatacgggtccgctcggtatcaagatgggtctgccgatcccgatcggcatgccgacgctcggcggcacgctcgccacccagggcggcctcgtcttcatcgccggtacgcaggattattatctgcgcgccttcgatacggcgaccggcaaggaagtctggaaggcccgccttccggtcggcagccagggcggaccgatgagctacaagtctccgaagacgggcaagcaatatgtcgtcatctcggccggcggtgcccgccagtctcccgatcgcggcgactacgtcatcgcttatgcattgcccaactgatccttttgg

SEQ ID NO: 35340 - DNA, 357 bp, Agrobacterium tumefaciens
ctgatgtttcgcatcaccaaggagtttcacttctccgcctcgcatcagctgaaaagcctgccgtcagatcaccagtgcaaccgcctgcacgggcacaattacatcgtcgaagtggaactatcaggcgaagagctgaacgagcatggtttcgtgcgcgattatcacgagctggcgccgctgaagcgctacatagacgatcatttcgaccatcgccacctgaacgacgttctcggccatgaccaggtgacggcggaatgtctggcaaagcatttctacgactggtgcaagaccagcctgccggaaaccagcgccgttcgagtgagtgaaaccaccaagacctgggcggaataccggcca

SEQ ID NO: 35341 - DNA, 501 bp, Agrobacterium tumefaciens
ctggatgtggcccgcgcactcatcggtgcggaatttcgcgtcggcaaagccggcggcattattgttgaaaccgaagcctaccatcccgacgatccggcatcccacgccttcaatgggcagaccccacgcaacagggcaatgttcggccctgccggccatctctatgtctaccggtcctacggcatccactggtgcgccaacttcgtctgtgcccccggctccgccgtgcttctgcgcgccatcgagccgctgaccggtatagatatgatgaaactgcgccggggaaccgataagctcaaacttctctgctcgggcccgggcaagttgtgccaggcgatggcgattaccggagagatggatggagcaccgctcaacgcaccaccatttctgctgcgtctgccaaaggaagccgccgcgatcagcaccggcaggcgcatcggtatcagccgtgcagtggattatccctggcgtttcgggctggaaggctcagctttcgtcagc

SEQ ID NO: 35342 - DNA, 768 bp, Agrobacterium tumefaciens
gtgacattggcttatcgcaaagttgctctcgtcaccggtgcaggttccggtatcggtcgcgccgccgccctccatctggccgcggcaggcttttcggttggcctgctcgggcgcaccgaatccgaattgcagaccgtggctgctgagatagaggccgcatccggctcttcgagacttcttctcgccgatgtctcggatgaggcggccatgcgtcatgcggtagcaacgcttgtggacgatttcggtcggctggatgtcgtggtggcgaatgccggggtgaacggagtctgggcgcccatcgatgagttgaagccttccgactgggacgacacgatccgcatcaacctgcgcggcacctatctcaccgtccacgccagcgtgccgcatctgaaagcggccggcggcgggtccatcgttatcgtgtcgtccatcaacggcacccgcacgtttacctcgcccggtgcgaccgcctattccgtgacaaaggcgggacagcttgccatggcccagcaactggcgctggagcttggccgccaccggatccgcgtcaatgcggtgtgcccgggcgagatcgaaacggcaatcaatgagaacaccgacatccgcgggagggaaaggaccgaagtgccggttcgttttccggcgggcgacattccggtgacgggcggtgtcgccgggacgagcgaggatgtcgccgaactcatcggttttctcgcctcggatgcatcgcgtcacattaccggcacaccggtatggatcgacggcggt

SEQ ID NO: 35343 - DNA, 1314 bp, Agrobacterium tumefaciens
ccgagccgatccaattccacctcactcgatagctactggatgccctttaccgccaaccgccagttcaaggccaatccccggctgctgacgagtgccgagggcatgtattacaccagcaatgacggccgccaggttctcgacggcacggcaggactttggtgcgtcaatgccggccatggccgccagcagattgcctccgccgtcaagcatcagctttcgaccttggattacgcaccatccttccagatgggccatccagtcgcgtttgaatttgccgaacggctggcggaaatcgcgcccgggccggaaggcggcaagctcgaccgtgtgttctacaccgggtccggttcggaatcggtcgatacggcgctgaagatcgccatcgcctatcagcgcgccatcggtcagggcacccgcagccgcctcatcggtcgtgagcgcggttatcacggcgtcggtttcggcggcatctccgtcggcggcctcgtcaacaaccgtcgggttttcccgcagattcccgccgatcatctgcgccatacccatgatcttgccagaaacagcttcgtgaagggtcagcccgagcacggcgcggagcttgccgacgatctggagcggctggtcgcgctgcatggcgcggaaaccatcgccgcctgcatcgtggaacccgtggccggctccaccggcgttctggtgccgccgaagggttatctggagcgcctgcgtgccatttgtgacaagcacggcatcctgctgatcttcgatgaggtcatcaccggtttcggtcgcatgggctcttccttcgccagcaactatttcggcgttacgcctgatatcgtcaccacggccaagggcctgaccaatggcgccatccccatgggtgccgtcttcaccagccgcaaggtacatgatgccttgatgcacggcccggaaaaccagatcgaactgttccacggctatacctattccggccacccggtcgcctgcgccgccggcattgcgacccttgatatctaccgcgatgagggtctatttacccgcgccgccgaattgcaggatgcctggcacgacgccatccattcgctgaagagcgcggcgaatgtcatcgacatccgtaccatcggtttcattgccggcattgaactgcagtcgcgggaaggtgctgtcggcgcacgcgcctatgatgtctttgtggattgcttcgagcgcggcctgctcatccgcgtcaccggcgacatcatcgccctgtcgccgccgctgatcgccgagaaatcccatttcgacgatatcgtatccattctgggcgacgcgctgaac

SEQ ID NO: 35344 - DNA, 1198 bp, Agrobacterium tumefaciens
atggacactggcgaccgcgccgacttcagcggaacttctagatggcatgcaggctatgacgcgggaaaaccgctggcgcgacgtcaccgggcgtgtcgccgcttacgatgccgcagccgaaaagatcgaaacggtggaagtggaacggcctaatctttatgccacccgggcattttcactctcgaactggaggctgatcgccgccaactggctgtcttccaacgttctttcctattcgctggcattcattggttttgtgtcgctgctcggttttgccaccttcgtaatgctgcgcatgatggggcggcatcgatgaagagcgggatttcgaaaattgccggtattgtctgcctgtcggccatgatgctgtttgccggcctctccctcagccgcgcggcttcgatcccgacggacgcatgggctgcctataagggcgcgtttctcgatcccggtggccggatcatcgataccggcaacagcaatatcagccacagcgaagggcagggctatggcatgtggctcgccgtgcttgccgacaacctgtccgacttcgagctgatctggagcttcacccgcaccgaattgctggtgcgcgatgacgggctttccgcctggaaatgggatccgcgcaccagaccgcatgtcaccgacatcaataatgcgacggatggcgacatcctgatcgcctatgcgctggcgctggcggccgggcagtggaaccggcaggattatgccgaagcatcggcggccatcgcctccgtcatcctcaaaaagaccgtggtgcagcgtggcgggcgcacgctgcttctgccggccgccagcggttttggcgagggcgatcgggccgatgggccggtggtcaatccgtcctatctgattttcgaagcctttccggtgctcaatctcgtcgcgccgtcgccgctctggaaagcggtggcagatgatggggtggcgcagatcggcgccttcgccttcagtgacagaaaactgcccgccgactgggtatcggtgaagacgaagccgcagccggcatcgggatttcagccggaattcggatataatgcggtgcgcataccgctttatcttgcaagggcgaatatgggcgcgcccgagctgctttcccggctgaaagacggcatgacgctggaaagcggtgctgccggcaccttcgatctgaagagcggcgcggtgaaggacg

SEQ ID NO: 35345 - DNA, 1209 bp, Agrobacterium tumefaciens
ctggtgatcgaaagcggcgagggcatctatgtgaccgacagcagcggcaagcgctacatcgaggcgatggcgggcctatggtcggtggcgctcggttttggcgaacagcggctggtggatgcggcaacgaagcagatgcagaagctgccctattaccacaccttctcctacaagacccatggcccgtccgttgatctcgccgaactgctgatcgagctttcaccggtgccgatgtccaaggtgcacttcacctcctccggctccgaggccaacgacctcgttgccaagatggtctggtatcgctcgaatgcgctcggcaaaaaggacaagaagaagattatcggccgcatcaagggctatcatggcgtgacgatcgcatccgcctccatcaccggcctgccgcgcaatcatgagagcttcgacctgccgctggaccgcatgctgcacaccgcctgcccctcctatgtccatttcggaaaggatggggaaagcgaggcggaatttaccgcgcgtatcctcggtgaattggaagagctgatcctgcgcgaaggtcccgagaccgtcgctgccttctggggcgagccggtcatgggtgccggtggggttctgttgccgccggaagggtattgggaaggcgtgcaggcgatcctgaagaaatacgacatcctgcttgtcgtggatgaggtaatctgcggttttggccgcaccggcaagatgtttgcctgcgagacctatgacatcaagcccgacgtgcttgtcgtctccaagcagatttcgtcgtcctacatgccgctttcggcaatcatcatgaacgacagtttctaccagccgattgccgatgaatcagatcgtatcggctcctttggccatggctacaccgcctccggccaccctgtcgcgaccgcggtgggcctcgaaaacctgaagatcattcaggagcgcgatctggtcggcaatgtcgcccggctggagggtaaattcctcgatcatctgaaggcgcttgccgatcacccgctcatccattcctcgcgtggcatcggccttctcggtgcgctggaggtaaaaccttgggatggcacgaaaccgggcgatacgacgctggcgctggccgcggctatcgaaagtgaaggtgtcatcactcgaccgatcggtgaatcgatctgcttctgcccgccgctgatcatcacggccgagcagctggatgagctg

SEQ ID NO: 35346 - DNA, 1354 bp, Agrobacterium tumefaciens
atgatcgacagcacagccgtggccgcaggccacgccaagcagccattctacaagcacctgtattttcaggttctggtggccatcatcgccggtatcgcactcggccatttttacccgaccttcggcgaacagctgaagccgctcggcgacgagcttcatccggcctcgtcaagatgatcatcgctcccgtcatcttcctcaccgtcgcaaccggcattgccggcatgaacgacatgaagaaggttggccgcgtggccggtaaggccatgatctacttcctggcttctccacgctcgcgctcatcgtcggcctgatcgttgccaacaccgtgcagccgggcgccgggatgaacatcgatccggcgaccctggatgccaaggctgtcgcgacctatgccgacaaggcccatgagcagaccatcaccggcttcctgatgaacatcattccgaccaccatcgtcggtgcgtttgccagcggtgatatcctgcaggtgctgttcttctccgtgctgttcggcatcgcactcggcatcgtcggcgaaaagggcaagcccgtcaccgatttcatgcatgccatgatgtacccgatcttcaagctggtcgcgatcctgatgaaggccgcccccatcggcgctttcggtgccatggcatttaccatcggcaaatacggcatttcctccgtcaccaatctcgccatgctgatcggcaccttctacatcacgtccgcgctcttcgtgttcgtggttctcggcgcggtctgccgttataacggcttctccatcgtcgcgctgatccgctacatcaaagaagagctgctgctggttctcggcacctcttcatcggaagcagccctgccgggcctgatgagcaagatggaaaaggctggctgcaagcgctccgtcgtcggcctcgtcatccccaccggttactccttcaaccttgatggcaccaacatctacatgacgctggccgccctcttcatcgcgcaggcaaccggtatccacctgtcctttggcgaacagatcctgctgctgcttgtggccatgctctcctccaagggcgctgccggcatcactggcgctggcttcatcacgctggccgcaaccctctcggtcgtgccttcggttccggtcgccggcatggcgctgatcctcggcatcgaccgcttcatgtcggaatgccgcgcgctcaccaacttcgtcggcaatgctgtcgccaccatcgtcgtcgcccgctgggaaggcgaactcgaccaggagcagctcgcgcgcgtcctcagcggcaaggaagaattcaccagcattgccgatgtggacgccctgccggcatcggtgcagcccgccgaataatacgac

SEQ ID NO: 35347 - DNA, 1005 bp, Agrobacterium tumefaciens
gatatccgcgtcgaaacgcaggacgttgcgccccccggccccggcgaagtgttgcttgccatggcggcaggtggcatttgcggctccgatctgcattattatcaggatggcggtttcggcccggtgcgggtgcgcgagccgatcatctgcggtcatgaggcatccggccatatcgcggctttgggtgcgggtgtcagtgggcttgccatcggccaactcgtcgccgtcaatccctcgcagccctgcggccactgccagttctgcctgaagggccagccgatccattgcctcgacatgcgcttcatgggcagcgccatgcgcctgccgcatgagcagggcatgttccgcgaccggctggttgttcccgcaaaacaatgcgcgacattttcggacgctacctcgcccgccgaggccgcctgtaccgagccgcttgcggtgtgcctgcatgccgtcgcacaggctggcgatctggcaggtgcgaaggtactggtgaccggtgccggccccatcggcctcctcaccatagccgctgcccgccaggccggcgcaggcatcatcgtcgccaccgatctcaccgatgcggcgctggaacgggcccccgccatgggtgcggaccgcaccatcaatgtcgcaaaggacgccgatgcgcttttgccctatcaggacaacaaaggttatttcgacgtcattttcgattgttcagccgccggtcccgcgctccgctccgccttcgcctgcgtccgcccgcgcggcaccatcgtgcaggtgggggtgacaggcgacgtcaccattccgcttaatgcgctggtgggcaaagagattgtctggcgtgggtcgcagcgtttccatgacgaattcgccatagccgccgggctcatctcgtcgcgcaaaatcgatgtgcgaccgatcatttcccacagcttcccgcttggcgacgccaaagcggcattcgaacaggccggagaccgctccgccgcctgcaaggtgcagctgacattttccgca

SEQ ID NO: 35348 - DNA, 645 bp, Agrobacterium tumefaciens
acccagatattttcgcaagagttcgcggccttcctgttcgacatggacggaacgctggtcaattcgattgccgttgtcgagcgcgtctggcgggagtgggccgttgcaaacggtatcgagccgaacgcatttctgcaacgtatccatggcatgcgggcttccgaggtaatacgccgcgaggcggttcccggcctggacgtggatgccgaggccgacatgatcttgcgcgccgagatggatgacgtggagggcatcattccgataccgggcgccgcagactttcttgcgtctttgcccgcgggaaaatgggctatcgtcacctccgccgtgcgtgaactggcggaaaaacggctcgcggcggccggcatcacaccgccacccgtgatgatctgcgccgacgatgtggtcaacggcaagcccgatcccgaaggttaccggaaggccgccgaaaggctcggcgttgcgccggaaagctgcgtcgtcttcgaagatgcgcccgcgggcatccaggccggcgaacgcatgggggctgcggtggtggtcatcaacgtgacccattcccacccgatcgagacgccgcatcttgccatcggcagttacggtgaactggatgtggtgatcgacgggaatggtggcctgaagctg

SEQ ID NO: 35349 - DNA, 921 bp, Agrobacterium tumefaciens
ggcaccgatgaggaaacggccgatgcggcgacccgcgccatgatgcacggcacaaggctcggcgtggacagccatggcgtgcgcctgcttgcccattatgtcacggcccttgaaggcgggcgcctcaatcggcggccgcagatcagccgcgtgtccggtttcggtgccgtggaaacgatcgatgccgatcatgcccatggcgcccgcgccacctatgcggccatggagaatgccatggcgcttgcggaaaaattcggcattggcgcggtggcgatccgcaactcctcgcatttcggcccggccggcgcttatgcgctggaagcggcccggcagggttatatcggccttgccttctgcaattcggacagtttcgtgcgtctgcatgatggtgccatgcggtttcacggcaccaacccgattgccgtcggtgtgccggcagcggatgacatgccctggctgctggatatggccacaagcgccgtgccctataaccgtgttctgctataccgcagcctcggccagcaactgccgcaaggcgtcgcctcggatggcgacggcgtcgatacgcgcgaccccaatgccgtcgagatgcttgcccccgttggcggtgaattcggtttcaagggggcggcgctggcgggagtggtcgagattttcagcgcagttctcaccggcatgaggctcagtttcgatctcgcccccatgggcgggccggatttttcaacgccgcgtgggcttggagccttcgtgctggcgctgaagccggaggccttcctggagcgggacgtgttcgacgagagcatgaaacgttatctcgaagtgctgcgcggatcacccgcccgcgaagattgcaaggtcatggcgccgggcgaccgggaatgggcggttgcggcaaaacgggagagggaaggcgcgccggtc

SEQ ID NO: 35350 - DNA, 1059 bp, Agrobacterium tumefaciens
ctcgtggttgatctcgacgtcgtgcgcgacaatttcaacgcgttccggcattccctgccgaacagcgcgatctattatgccgtcaaggcaaacccggctcccgaaatcctgaagctgctcgcttcgctcggctccaacttcgattgcgcctccgtggctgaaatccagatggcgctcgatgccggtgcaacgtccgaccggatttccttcggcaacaccatcaagaaggaacgcgacgtcgcccgtgctcacgcgctcggcatcgatctcttcgccgttgatagccatgaggaagtcgagaaggttgcccgtgccgcccccggcgcgcgtgtgttctgccgcgtgctgacggatggcgaaggtgctgaatggcctctgtcgcgcaagttcggctgcgtgccgcagatggctgtcgatgttctggtttatgcgcatcagatgggtctggaatcctacggcgtttccttccatgtcggttcgcagatgatgaatctcgacgcatgggatgcagcacttgccgatgccaagcgcgtctttgcgtcgcttgccaagcagggcatccacctgcagatggtcaacatgggcggtggtttcccgaccaagtacctgcgcgacgttccggctgccgaagaatacggccaggcgattgacacggcgctgcgcaagcactttggcaaccagatcccgaagacgatcatcgagccgggccgcggcatggtcggcaatgccggcgtcatcaaggcggaagtcgttctcgtgtcgaagaagtccgacaacgacaaccaccgctgggtgttcctcgacatcggcaagttcggcggtctcgccgagacgatggacgaggcaatccgttacccgatccgcaccgagcgtgatcaggacgagatgcagccctgcgttctggccggcccgacctgcgacagcgccgacgtgctgtatgaaaagaacatgtatccgctgccggtctcgctgaccatcggcgatgaagttctgatcgaaggcacgggtgcttacacgacgacctattcggcggttgcctttaatggcttcgagccgctg

SEQ ID NO: 35351 - DNA, 1104 bp, Agrobacterium tumefaciens
gacgagacccacgctttcgaagccgtggtgccgcctctcgtgcagacctcgcttttcaccttttccagctacgatgaaatggtctccacctatcgcggtgaaaaggtgcgaccggtctatacgcgcgggcttaacccgacggtgcgcatgttcgaagaaatgctggccagactcgaaggcgctgaagacgcgctcggttttgccagcggcatgtctgctatctcttccaccgtgctgtccttcgtgtcgccgggcgaccgcattgtcgcggtgcgccatgtctatcccgatgccttccgcctgttcggcaccttcatgcagcgcatgaatgttgaggtcgtctatgtcgatggtcgtgatgaggcggcggttgaaaaggcgatgccgggcgcaaagctgttctacatggaaagcccgacgagctgggtgatggaagcccatgatgtcggtgcgctggccgccatcggcaaacggcatggcgcggtcaccgtcatcgacaattcctgggcaagcccggtcttccagcagccgatctcgcttggcgtcgatctcgtcgtgcattcggcctcgaaatatctcggcggccatagcgatgtggtctccggcgtggtggccggttcgaaggcgatgatcgaccgcatccgggaggaaacctatccctatctcggtggcaagatgtcgcctttcgatgcgtggctgctcattcgcggacttcgcaccctgccgctgcgcatgaaggcgcatcaggcttcggcgctcgacatcgcaacccgcctgcaggcgctggatgtggtggagaaggtctgccatccggggctggcgaaccgcctgccgcccggccttcacggcacgtcgggcctgttttcattcatcttcaaggaaggcgtggatgtgcgggcttttgccgaccgcctccagcttttcaaactgggcgtttcctggggcgggcatgaaagcctgatcgttccgggcgaagtggtgctcgaacagaaggcgcagccaaactccgcccacacgttcggcatcagcgcgcgttcggtgcgcctgcatgtcggactggagggcacggaagcgctctggaacgatctcgaacccgcgatcaag

SEQ ID NO: 35352 - DNA, 930 bp, Agrobacterium tumefaciens
gtcacggctggcgaaatcctcgtggagatcatggcgacgacggtgggcgacggttttctggagccgcagacgctgatcggcccctttccgagcggcgcgcccgccatcttcatcgatcaggtggcgcgttgcggcggaaccgccggcatcatcgcggctgtcggcgacgatgatttcggccgcctcaacatcgagcggctgcgccgcgacggcgtcgatgtctcggccatcaccaccatagcggaccgcccgaccggcagcgccttcgtgcgttaccgggaaaacggcgcgcgggatttcgttttcaacatcgcccattcggcggccagcgaaacacggatgacggatgaggcgcaggcgctcatcgaaaaggcgggccatgtgcacatcatgggatcggccttcgcgattgccggcattggcgcgatcattctcgaggccgttaaaagcgtcaaagcgcgcggcggttcggtatcattcgatccgaatatccgcaaggaactggcgcagggcgatgaaggccgcagactgatagacgatctgcttgccgtcaccgatctcctgctgccgtcaggcgaggaacttcaggccgcctccggtctggacgatgaggaagcagcgatagaaaagctgctcgccgccggtatcggcgagatcgtgctgaaacgcggtgcaaacggcgcaagccatttcagccgcgcccatgggcgcatcgacgcccccggccttgaagtggaggaaatcgacccgaccggtgccggcgactgtttcggcgcaacctacctcacctgccgccgcctcggcatgcgtccaggaaaagcgcttgtctatgccaacgcctccggcgcgcacaacgtcacaaagcgcggcccgatggagggcgctgccagccttgccgaactcgacgccttcatggccgcgcaattgtcg

SEQ ID NO: 35353 - DNA, 768 bp, Agrobacterium tumefaciens
atgagattgaacaacaaggtcgcgctgatcaccggcgccgcccgcggcatcggccttggtttcgcccaggctttcgctgctgagggcgcaaaggtcatcatcgccgacatcgatatcgcccgcgcaactacctcggctgcggccatcggtcccgcagccaaggccgtgaagctggatgtgaccgaccttgcccagatcgacgcggtggtaaaggcggtggatgaggaattcggcggcatcgacattctcgtcaacaatgcggcgatcttcgatatggcgccgatcaacggcattaccgaagagagctatgagcgggtgttcgacatcaatctcaaggggccgatgttcatgatgaaggccgtctccaatgtcatgatcgcccgcgcacgcggcggcaagatcatcaatatggctagccaggccggccggcgcggcgaggcgctggtgacgctttattgcgcctccaaggcggcgatcatttccgccacgcaatcggcggcgctggcgctcgtcaagcatggcatcaatgtcaacgccatagcgccgggtgtggtggatggcgagcattgggaagtggtcgatgcgcatttcgccaagtgggaaggtttgaagccgggtgagaaaaaggccgcggtggccaaatccgtgccgatcggccgttttgcgacgccagacgacatcaagggactggcggtgttcctcgcctccgccgacagcgactatattctcgcccagacatataatgtcgacggcggcaactggatgagc

SEQ ID NO: 35354 - DNA, 933 bp, Agrobacterium tumefaciens
atgcatgccattcaattcgtcgagaagggacgcgccgtgctggcggaactccccgtcgccgatctgccgccgggccatgcgctcgtgcgggtcaaggcttcggggctttgccataccgatatcgacgtgctgcatgcgcgttatggcgacggtgcgttccccgtcattccggggcatgaatatgctggcgaagtcgcagccgtggcttccgatgtgacagtcttcaaggctggcgaccgggttgtcgtcgatcccaatctgccctgtggcacctgcgccagctgcaggaaagggctgaccaacctttgcagcacattgaaagcttacggcgtttcccacaatggcggctttgcggagttcagtgtggtgcgtgccgatcacctgcacggtatcggttcgatgccctatcacgtcgcggcgctggctgagccgcttgcctgtgttgtcaatggcatgcagagtgcgggtattggcgagagtggcgtggtgccggagaatgcgcttgttttcggtgctgggcccatcggcctgctgcttgccctgtcgctgaaatcacgcggcattgcgacggtgacgatggccgatatcaatgaaagcaggctggcctttgcccaggacctcgggcttcagacggcggtatccggctcggaagcgctctcgcggcagcggaaggagttcgatttcgtggccgatgcgacgggtattgccccggtcgccgaggcgatgatcccgctggttgcggatggcggcacggcgctattcttcggcgtctgcgcgccggatgcccgtatttcggtggcaccgtttgaaatcttccggcgccagctgaaacttgtcggctcgcattcgctgaaccgcaacataccgcaggcgcttgccattctggagacggatggcgaggtcatggcgcggctcgtttcgcaccgcttgccg

SEQ ID NO: 35355 - DNA, 729 bp, Agrobacterium tumefaciens
ttttcgcttgagggccgcaaggcgctcgtaacgggcgcgaatacggggcttggccaggcgattgcggtgggtcttgccgctgccggtgcggaggtggtctgcgccgctcgccgtgcgccggacgaaacgcttgatatcatcgcaaaagacggcggcaatgcgagtgcgctgctcatcgattttgccgatccgctggcggcgaaggatagctttaccgacgccggtttcgatattctcgtcaacaatgccggcatcatccgccgcgccgattccgtcgagttttccgaactcgactgggacgaggtgatggacgtcaatctcaaggcgctgtttttcaccacgcaggccttcgcgaaggagcttttggcgaaaggtcggtccggcaaggtggtcaatatagcctcgctcctgtcgtttcagggcggcattcgtgtgccgtcctacaccgcggcgaaacatggcgttgcaggtctcaccaagcttctggcgaatgaatgggcggcaaagggcatcaatgtgaacgctattgcacccggttacatcgaaaccaacaataccgaggcgctgcgcgccgatgcagcccgcaacaaggccattctggagcgtattccggccggccgctgggggcattcggaagacattgccggggcggcggttttcctgtcatctgcggcggcagattatgtgcatggcgctattctcaacgtcgatggcggctggctggcgcgc

SEQ ID NO: 35356 - DNA, 888 bp, Agrobacterium tumefaciens
atgaaccctgaacaaatcaagacggcgctcggctccggtcttttgtctttcccggtcacccatttcgatgccgagggtcgttttgcggcagatagctacagggagcatgtcgaatggctcgccggttacaaggctccggtgctgtttgccgctggcggcacgggcgagttcttctcgctgaagccggatgaaatcccaacgatcgttgccgccgccaaggaagtggccggcgaaacggccatcgtgtccggctgtggttacggcaccgagatcgccgtcgatatcgcccgctccgtcgaaaaggtcggtgccgatggtatcctgcttctgccgcattacctcatcgatgcgccgcaggaagggctttacgcccacatcaagaaggtttgtcagtcggtcggcatcggcgtgatggtttataaccgtgacaattccgtgctgcaggccgatacgctggcgcgtctttgcgacgaatgcccgaacctcgtcggcttcaaggatggcaccggcgatatcggcctcgtgcgccagatcaccgccaagatgggtgaccgtctgatgtatctcggtggcatgccgacggcggaattgtttgccgaagcctatctcggcgctggtttcaccacctattcctcggccgtgttcaacttcgtgccgggtcttgccaatgagttctacgccgccctgcgtgccggcgagcgcgccacctgcgaacgcattctcgttgatttcttctatccgttcatggcgatccgtaaccgcgccaagggttatgccgtctccgccgtcaaggccggtgttcgcctgcagggcttcaacgccggtccggtgcgcgcgccgctgaaggatctgacgaatgaggaaatcggcatgctcgaagccctgatc

SEQ ID NO: 35357 - DNA, 950 bp, Agrobacterium tumefaciens
atggctctggcgacaagggcgactggtggagctggccgaaggaaacccgtgagggcgcgcgccggccacgcggcctgcatctcgtgtcctgccacaaaacacagcttttggggttcacgatccgcaatgccgcctcgtggacgatccatccgcagggctgcgaggatctgacggccgccggcctcaccatcatcgcgccgcatgacagtcccaataccgatggtttcaaccctgaaagctgccgtaacgtgatgatatcaggcgtgcgcttttccgtgggtgatgactgcatcgcggtgaaggcgggaaaacgcgggcctgatggtgaggacgatcatttggcggagacacgcggtatcagcgtgcgccattgcctgatgcagcgcggccatggcgggctggtcatcggttcggaaatgtccggcggggtccatgatgtgacggtggaagattgcgacatgatcggcacggatcgcggcctgcgtctcaagacgcggcgcggtcgcggcggtatggtcggcaacatcaccatgcgccgggtgttgctggacggtgtgcagactgcactttccgccaacgcccattatcattgtgatgccgatgggcatgatgactgggtgcagtcgcgaaacccggcgccggtcaatgacggcacgccgttcgtcgacggcatcaccgtggaagatgtcgaaatccgcaatctcgcccatgcggcaggtgtctttctcggtctgccggaggctcccatccgcaacatcgttgtccgcaacctcaccatcgtctcgcatgatccttcggctgttgcgacgccgccgatcatggccgaccgcgtgcgccccatgcgccatgaggcgatcgtcttcgagcaggcggatgtcgtctgcgatgatccggcgcttctgaatgacgcccccgtttccatttcgtcatatttcgattgagaaaagcca

SEQ ID NO: 35358 - DNA, 1497 bp, Agrobacterium tumefaciens
aaagcgcgggtttcagtccaccgggacttccggattgggcgtatcgacgatcgcctatattccgccttcatcgaacatatggggcgtgcgatctatggcgggatttacgagcccggccatccgcaggcggatgcgaacggctttcgcaaggacgtcctgaaattcgtgcaggacctgaaaatcccggccatccgttatcccggcggcaacttcgtctctgcctatcgctgggaagacggcatcggcccgcgcgaccagcgtcccatccgtctcgaccttgcctggcgctcgaaggaaaccaaccagatcggcatcaatgagtttgccgactgggcgcagatggccggcatcgagatgatgcttgccgtcaatctcggttcccgtggcctggatgatgcccgcaactttctcgaatatgtgaattttccaggcggtacggcgctcagcgatctgcgccgcagccacggcaccgaaaagccgcatggcgtgaaaatgtggtgcctcggcaacgagatggacggcccctggcagatcggccacaagacggcagtggaatatggccgtctggccaacgaaaccgccaaggccttcaagggcttcgatcccaccattgaagcgattgtctgcggcagttccaatgacggcatgccgacctatcccgaatgggagcgcgaggtgctggaggagtgctacgagaatgtcgatcacatctcgctgcacaaatatttcggcaataacagccgcgacacgctgaattatttcggcaagatcgaggaaaccgggcgttacatccagaccattgccggtgtcatcgattacgtgaaggcgaagaagcgcgccaagaacgacgtgtccatctgctttgacgaatggaatgtctggtatcacatccgcgaagacgacggcaaacgcatcaagagctgggactggccggaagcgccggcgctgctggaagagacttacaacttcgaggatgcgctgtttgtcgccggcctgctcaacgaattcatccgccgttcggatcgcgtgcgcatcgcctgcatcgcccagctcgtcaatgtcatcgctcccatccgggcggaaaagaacgggcccgcctggcgccagacgatctattacccctatcagttcgcctcgctttatggccgtggcgttgcgctgaatgtcgcggtcgattgcccgacttatgattgcaacgcggccgatgacgtcaaatatctcgacgtcgccggtgtttatgatgaagccgaaggtatggtgacgctgttcgtcctcaaccggcatctcaccgaggcggccgatatcaatgtcggcctcaccgggttctcgtcggccacgctcgacctgcatcttgccatggcgggatatgatctgcgcgtcggcaacggcccggatcagccggatcgcgtcgtgccggtgccgggcagcggcgttggtgtcgaggatggggcgctgaagggttccgtgtcggcactgtcctatcacgtgctgcggctg

SEQ ID NO: 35359 - DNA, 750 bp, Agrobacterium tumefaciens
ctgtcgaacaaagtcgccctcataacgggaagttcaaggggcatcggccgtgccgccgccctggcatttgccaaggagggcgcaggtcttatcggcgtccattatggcgcaaaccccgatgccgcgcaggcgacgatccgcgagatcgaagccctcggctcgaaggcgatcgccctcaaggccgatctacgcgatgggaaagcggcaacagacaacctgtgggatcagttcaagcaagcgtccatcgctttcaccggcacgccatcgctcgacattctcgtcaataatgcgggcatcgcgccggcgacaccgttgaaagacatgaccgaggccgcgttcgacgagttgatgacgatcaacttcaaagcgcccttcttcctcatccaggctgtcgccgatcatctccgcgacaatggccgtatcatcaatatctcgaccggtttcacccgcatcgcggcaccgacccatccggcttatgccgcttccaagggggcgcttgaaacattgacgctggcgcttgcaccggaattcggccggcgcggaattactgttaattcggtgcttccgggcgtgactgaaaccgacatgaacgccggatggctggcagcgcctgaagcgcgtgccggtgccgaagccctgtcggtcttctcacggatcggccgcgccgaggacatcgctgacgtcattacgttcctcgcctccgatgatgcccgctggacgaccgggcagatgattgacgcgacgggtggt

SEQ ID NO: 35360 - DNA, 885 bp, Agrobacterium tumefaciens
cgcgcctttgttatcggcaatatcgcacttgatgaaacctattccattgccgcactgcctcaggcaggcgcttcaatcttcggcgagcaggcctcgcgcagtctcggtggcaaaggctgcaaccaggccattgttcttgcacggtgcggcgtcgaaaccaccttggtcgccgccgtcggcacggatgaccgcgccattgcgatcggtaaatcgctcacccgcgagcatctgacaccaaagctcattcccgttgatagcgccaccagcgatatttccatcattctgacgacccctgacggtgaaaactcgatcatcaccacccggtccgcagccgcagcgcttgatagagacgcagccctggacgcacttggcgacactgtctccggcgacctcgtcatcctgcagggcaatctctcggaagagacaaccctcgtcatcctcaatgcggcgagatcgaaggggctgacgacggccttcaatccttcaccgctgcagccgtggtttgcaagcattctgccgctcatcgacatcgccgtcctcaatcgcatcgaggcagaggcgctgaccggtgagagcggcgccggggcgggcgcttttctgctgcgtgccggcgtcggcctcgtcatcatcacactcggcggacagggctgcgtgctcgtgtctgccaatggtgcaatcgaggtcgcggcagcgcccgctacaatcgtcgataccacgggtgccggcgattgctttacgggtgttgcgcttgcctccgccatacgtcgcggcgtcgctatcgatgcgcgcgcgctggaggatgcttcgagagcggcagccatcaccgtcggccgccgtggcacgcaggatgcctttcccagccatgaggagatgatggccattctg

SEQ ID NO: 35361 - DNA, 675 bp, Agrobacterium tumefaciens
gttgctctcatctcgggtgccagccggggtatcggagatcacattggtgcagcgcttctgcagcaaggttggctggtgtcactcggcatgcgtacgcctgtcctgccgtcctgggctgttggtcgcgagaaagacgttcatctgttcagctatgatgcgaacgatgccgctgaaacgcgctggacggaagacgctctccggcatttcggtcgcatcgatgcgatcgtcgcgaacgccggcatcatgatcccgaagacggtgatcgaggcgaatgacgacgatatcgacgccatgctttccgtgaacgtcaaggcgccgcgaagactggtgaaagccgcttggaacgccctgtgcgaaagcggtcgtggccgcgtgatcatccttgcctccctttcgggaaagcgcgtcaagtcggcatcggcgggcagttattcgctctccaaatttgccgctgtcgcccttgcccatgccattcggcaggcgggctttgagaaaggggtgcgtgctacggcggtttgcccgggatttgtcgcaaccgatatggctgccgctttgtccgagcggccggccgagcagatgacccagcccacggatctcggccgcatcattgccatgctgctctcccttccgaacgaggcttccgtcgccgaattcgccatcaattgtcagcttgag

SEQ ID NO: 35362 - DNA, 726 bp, Agrobacterium tumefaciens
tttaccaacagaaccatcgttgtcgccggggccggccgggatatcggccgggcatgcgccatccgtttcgcacaggaaggcgccaatgtcgttcttacctataatggcgcggcagagggcgcggccacagccgttgccgaaatcgaaaagcttggtcgttcggctctggcgatcaaggcggatctcacaaacgccgccgaagtcgaggctgccatatctgcggctgcggacaagtttggggagatccacggcctcgtccatgttgccggcggcctgatcgcccgcaagacaatcgcagaaatggatgaagccttctggcatcaggtcctcgacgtcaatctgacatcgctgttcctgacggccaagaccgcattgccgaagatggccaagggcggcgcgatcgtcactttctcgtcgcaggccggccgtgatggcggcggcccgggcgctcttgcctatgccacttccaagggtgccgtgatgaccttcacccgcggacttgccaaagaagtcggccccaaaatccgcgtcaacgccgtttgccccggtatgatctccaccaccttccacgataccttcaccaagccggaggtgcgcgaacgggtggccggcgcgacgtcgctcaagcgcgaagggtcgagcgaagacgtcgccggtctggtggccttcctcgcgtctgacgatgccgcttatgtcaccggcgcctgctacgacatcaatggcggc

SEQ ID NO: 35363 - DNA, 750 bp, Agrobacterium tumefaciens
atgacgccgaatgttcgaccgcttgttgccggaaactggaagatgaacggcacccgtgcctcgctcgatcagatcaaggccatggcagagggcgttaagggcgcgctgtccgagaaggtggatgcgctgatctgcccgccctcgacattgctctacgtagcaacggcgctctgcgatgacagcccgctgctgatcggcgcgcaggattgccaccagaatgataccggcgcccataccggcgatatttccgccgagatgattgccgattgcttcggcacccatgttatcgttggccattccgagcgccgcaccgaccacgccgagaccgatcacctggttcgcgccaaggcatccgctgcccatcaggtcgaccttatcgccatcgtctgcatcggcgagactgcggatgagcgcaaggcgggacagacgctggatattctcaagcgccagttggccggctccctgccggatgaagcgactgctgaaaacaccgtcatcgcctatgagcctgtgtgggcgattggcaccggtcttaccccgaccacgcaggacgtgcgcgaagcccatgccttcatgcgcgacgagctggtcaagcgcttcggtgacgccggcaagaccatgcgcattctctatggtggttcggtgaagcccgccaatgcgctggaactgatgggcgtcgagaatgtcgatggcgcgctgatcggcggcgccagcttgaaagccgcagacttcctttccatctatgcggca

SEQ ID NO: 35364 - DNA, 1416 bp, Agrobacterium tumefaciens
aggaaaacgagtaaaaaggcaagattgatgacagccacacggacagaaaccgatacatttggccctattgaagttcaggccgatcgctactggggcgcgcaggcgcagcgctcgctcggcaacttcaagatcggctgggaaaagcagcccgcctctgtcgttcgtgcgctcggcatcgtcaagcaggccgctgcccgcgccaacatggcgcttgcaggtctcgaccccaaggtgggagatgccatcatcgccgccgcgcaggaagtcatcgacggcaagctgaccgagcatttcccgctcgtcgtctggcagaccggctccggcacccagtccaacatgaatgccaacgaggtgatttccaaccgcgcgatcgaaatgctcggcggcgaaatgggcaccaagaagcctgttcacccgaatgaccacgtcaatatgagccagtcctcgaacgacacctacccgacggcgatgcacatcgcctgcgtggaagagatcgttcaccacctgttgccggccctcaagcacctgcacacggcgctggaagccaaggtcaagcagttcgaaaagatcatcaagatcggccgtacccacacgcaggacgcgaccccgctgacgctcggccaggaattctccggttacgccgctcaggtcgcctcggcgatcgccaatatcgaactcacactgcccgcactgtcgaagctcgcccagggcggtacggcggttggcacgggcctcaatgcccctgttggttttgccgaaaaggtcgccgaggaaatctctgagattaccggcctttccttcgtcaccgcgccgaacaagttcgaagcgcttgcctcgcatgattccatggtcttctcgcacggcgcgatcaacgccgctgccgctgcactcttcaagatcgccaacgacatccgcttcctcggttccggcccgcgcgccggtctcggcgaattgtcgctgccggaaaacgagcccggctcgtcgatcatgccgggcaaggtcaacccgacgcagtcggaggcactgacgcaggtttgcgcccatatcttcggcaacaatgcagcgctttccttcgcaggctcgcagggccacttcgaactcaacgtctataatccgatgatggcctacaactttctgcagtcggtccagcttctgggcgatgcggccgtgtccttcaccgacaactgcgtcgtcggcatcgaggcgcgcgaagacaatatccggaagggcgtcgagaactcgctgatgctcgtcacggcgctcaacggcaagctcggctacgacatctgcgccaagatcgccaagaccgcccacaagaacggcacgacgctgcgcgaagaagccgttggtggtggatacctcaccaacgaggaattcgaccagtatgtgcgccccgaaaacatgatcggcccgaag

SEQ ID NO: 35365 - DNA, 1344 bp, Agrobacterium tumefaciens
cagaattggacccccggcagctggcggcagaaaccgatccagcaggttcccgaatatcctgatgcggccgcacttgcggctaccgaagccacgcttgcgacctatccgccgctggtttttgccggtgaagcccgtcgcctcaaaaaacagctcgccaatgtggcggaaggcaacgccttcctgctgcagggtggcgactgcgccgaaagcttcctcgagcatggcgccgacaatatccgcgacttcttccgcgctttcctgcagatggccgtggtgctgacctatggcgcacagctgccggtggttaaggtcggtcgcattgccggccagttcgccaagccgcgctcttccaacgtggaagtgctcgatggcgtgacgctgccgtcctaccgcggtgacatcatcaacggtatcgaattcaacgaggcctcgcgcattccgagcccggagcgccagctcgacgcctatcgccagtcggccgcgacgcttaacctgctgcgcgctttcgcgatgggcggttacgccaaccttgaaaacgtccaccagtggatgctcggtttcatcaaggacagcccgcaggcggaccgctaccgcaagctggccgaccgcatttccgaaaccatgaacttcatgcaggcgatcggcatcagcgcggaaaacaatccgagcctgcgcgagaccgatttcttcaccagccatgaagcgttgctgcttggttacgaagaagcgctgacccgtatcgattccacctcgggcgactggtacgcgacgtcgggtcacatgatctggatcggtgaccgcacgcgtcagctcgaccatgcgcatgtggaatatttccgcggcatcaagaatccgatcggcctgaagtgcggtccgtcgctgacgcctgacaatctgatcgagctgatcgatgcactgaacccggcaaacgaagccgggcgcctgacgctgatctgccgtttcggccatgacaaggtggcggacagcctgccgaagctcatccgtgcggtggagaaagaaggccgtaaggttgtctggtcctgcgatccgatgcatggcaatacgatcacgctcaaccactacaagacgcgtccgttcgagcgcatcctgtcggaagtcgaaagcttcttccagatccatcgcgccgaaggcacgcatccgggcggcatccacatcgagatgaccggcaaggacgtgacggaatgcacgggtggcgcgcgcgccgtgacggcggattcgctgtccgaccgttaccacacccattgcgatccgcgcctcaacgccgatcaggcgctggaactggcgttcctgctgtccgagcgtatgaagagcggtcgcgacgaa

SEQ ID NO: 35366 - DNA, 385 bp, Agrobacterium tumefaciens
tttcagatgatcgacaaggtcgaatccgtggatatggcgacgcgcacgctgaaggcgcagtcggtcgttccggaccatagcccggttttcgaaggccactttcccggcatgccgctggttccgggtgtactcctgatcgagaccatggcgcaggcttccggcatgatggttctggcattttccgattttgcgtccatgccgttcctgatgtcggtcgatggcgccaagatgcgcaccttcgtggagccgggcgccgttctcgacatcgaggcggtgctggagcatgacggttcgggctttgccgttaccaaggcgaagatcacctctgccggcaagaaggtctgcgacgcgcaactgaaactgcgcaccatgccgttcagcgaaa

SEQ ID NO: 35367 - DNA, 1233 bp, Agrobacterium tumefaciens
gttgccgtgaccggcatgggcatcatcacctcgctcggtcagggacttgccgacaactgggcagcgctgacatcaggcaagtcgggtattcacaagatcacccgcttcccgactgaagggctttcgacccgcatcagcggcacggtggatttcatcgatatcccggttcccaactccgtcgagcgttcttatgctttcgcgcgtgaaaccaccatcgaggcgctggcgcaggccggtatatcgggtgatttcgatgggccgctgtttctcgcagcgccaccgattgagccggaatggagcgcccgtttcgagcttgccgaccggtctccgccagccgcaaagccgggtgacgcctatgagcggttcatgacggcgttgcgccagcgtcccgatccggcattccaggaagccgcattgttcggcgcgatttccgaacgtctttccgaccgttttggcacgcgcggcctgccggtcacgctgtctacggcctgtgcttcgggtgcgactgcgatccagctcggcgtcgaggcgatccgccagggccgcacggagcgcgctctgacggttgcgactgacggttccgtcagcgccgaagccctgatccgcttctcgcttctgtctgcgctttcgacccagaacgatccgcccgaaaaggcctccaagccgttcagcaaggatcgcgatggtttcgtgatcgctgaaggtgcggcgacgctggtgttggaatcgctcgaagctgccgttgcccgtggcgccaaggttctcggcatcatcaagggcgccggcgaaaaggccgacagcttccaccgcacgcgttcttcgcccgatggcggcccggcgatcgcgacgatccgtgcggcacttgccgatgcgggcgtggccgaaagcgatatcggctatatcaacgctcacggcacctcgacgcctgagaatgacaagatggaatatggctcgatgctggccgtcttcggcgaaggcctgaagaatattccgctgtcgtctaacaagtcgatgattggccatacgctgacggccgcaggcgccgtggaagcggtgttctcgctgcagaccatgctgaccgggaccctgccgccgacgatcaactacaacaatcccgatccgaccatcaccctcgacgtggtgccgaatgtgaagcgggatgcgcaggtgggtgcggttctctccaactccttcgggtttggcgggcagaatgcaagccttgtcatgacgcgg

SEQ ID NO: 35368 - DNA, 981 bp, Agrobacterium tumefaciens
gacctgcctgaacccgatgctccgggtccgggcgaggtgacgctgcgcgtcaaggccgtggcgctcaaccacatcgacgtttggggctggcgcggcatggctttcgccaagcgcaagatgccgctcaccatcggagcggaagcctccggcgtggtcgaggccattggccccggcgtttcgaatgtgctgccgggccagctcgtttcggtctatggcgcgcgcacctgcgggctctgcaagccctgccgtgaaggccgtgacaatctgtgcgaacatgtccagggcgtacacggtttccatctcgacggtttcgcgcaggaaaagatcaatattcccgcccgccagctcgtgccggccccgcacggcattgacgccgttgctgcggcgctcgccccggtgactttcggcaccgtcgagcacatgctgttcgacaatgccaagcttgagcccggcgaaaccatcctcatccatgccggcggttccggcatcggcacggcggcgatccagcttgccaagaagatgggctgcaccgtcatcaccacggtcggttccgacgacaagatcgaacgggcgaaggcgctcggggccgatcatgtcatcaattaccggaccgatcgtttcgaaggcgtcgtgcgcaagctgacgaaaaagaagggtgtcgacgttgtcttcgaacatgtcggcaaggataccttcgtcgcctcgatgttctcgctgaagcgcggtggccgtctcgtcacctgcggctccacctcgggcgtttccaccgaaatcaatctgatgatgctgttccagcagcagttgaagctgctcggctccttcggctgccgcatggaaaacatggccaatgccatgcagaagatggcgcgcggcatcgttcatcccgtcatcgacaccgaagtcaccttcgacgatatcgaccgggcactggagcgcatggaaacgcgccaggtgttcggcaagatcgtcctgcggatggat

SEQ ID NO: 35369 - DNA, 1290 bp, Agrobacterium tumefaciens
ttgagaatcggcatagcggggctcggcactgtcggcgcttcgctcgtgcgcatcctccagcagagaagcaacgaacttgcgattacctgcggacgcgcgattgagattattgcggtgagcgcgcgcgaccgttcgcgcgaccgcggcatcgatctcaagggtattacctggttcgacacgcccgagcagatggcgagcgaagccgatatcgatgtgttcgtcgaactggtcggcggtgcttccggacaggcagaaaatgcggtgcgggcagcgctttcgcgtggtctccatgtagtgacagccaacaaggcactgcttgccaagcatggcgtcgaactggcgaccattgccgaggacaagggcgcgctgctcaatttcgaggcggcggtggctggcggtatcccggtcatcaaggcgctgcgtgaatccttgaccggcaaccatgtgtcgcgcatctacggcatcatgaacggcacctgcaactacatcctcaccaagatggagaaggaaggcctgtcgttcgaggtgtgcctgaaggaagcgcagcggctcggttatgccgaagcggatccggccttcgatatcgaaggcaacgacaccgcgcacaagctctcgattctgaccacgcttgccttcggcaataagatcgctgccgacgacatctatctcgaaggcatcaccaatatctccatcgaggatattcaggcggctgccgagcttggttaccgcatcaagcttctcggcgtggcgcaggtgacggactccggcatcgaacagcgcgtgcacccgaccatggtgccgctcgactccgttatcgcccaggtggatggcgtgaccaatgcggtggcgatcgaatccgacattctcggcgaattgctgatggtcggcccgggtgccggcggcaacgccacggcgtctgccgtacttggtgacatcgccgatatcgccaagagccgtccaggcacccagcaggtgcccgtactcggccgtccggccaagtcgctgacggagtaccgccgcgccaagatgaagagccatgagggcggttatttcatccgtctgacggtgaaggatcaggcgggcgtcttcgcctccatcgccacccgcatggctgacaataacatctcgctggaatccatcgtgcagcgccagcgcgtgcatgtggaaggcgcgccgcagaccatcatcctggtcacccatgcgacgatggaagatgcgatccgcaaggccgtgaaggcgatcaagaacgagaaatatctcgtcagcgaaccgcaggtcatccgcatcgag

SEQ ID NO: 35370 - DNA, 1077 bp, Agrobacterium tumefaciens
gtcaatcctcccatcgtgcgtggctcgaccgtgctttttcccgatgcggagacgctttcgaccgaagaccagaaatacacctatggcacccatggtacgccgacgacggacgcgctctgcaatctggtcaacgagctggaaggttctttcggaaccattctcgtcccgtcgggccttgcggcgattaccgtgccgttccttgcctatctcggtgctggcgatcatgcgctgatcgttgattccgtctatttccccacccgccgtttctgcaacaccatgctgaagaagctgggcgtggaggtggagtattacgatcccgcgatcggggctggcatcgaggcgcttatccgaccaaatacgaagctcgtgcatctggaagcgccgggttccaacaccttcgagattcaggatgtccggctgatcactgacatcgctcaccggcatgattgcgtggtgaccatggacaatacctgggcgacgccgctttatttcaagccgctcgatttcggcgtcgatgtctccattcacgccgccaccaaatatccctcgggccattccgacgtgctgatgggcttcgtttcggccaatgaaaagtactggaaagcgctttatcaggccaacaccaatctcggcatctgcgtcacccccgacgatgcctatcagatcctgcgcggcatgcgcaccatggggatcaggctggaacaccatcagaagagcgcgctggatatcgcgcaatggctcgagggtcgcgacgacgttgtgcgcgtgctgcatccggccttgccgagctttgccgggcatgaactctggaagcgtgatttcaagggcgcgagcggtgtcttctccttcgtattgaaggcggaagagggcaaatacaaacagacggcatctgccttccttgatgcgctgacgttcttcgggctcggctattcctggggcggctacgaatcgcttgccgtatcggtatcgctcgtcgacagaacgattgcgaagggcccgtcggaaggaccggtcatccgtctgcagatcgggctcgaggatgtcgccgatctcaagaaagacctcgaggccggtttt

SEQ ID NO: 35371 - DNA, 1005 bp, Agrobacterium tumefaciens
ccgatgaagctcgcgaccatcaggcgccgcgatcccggtccgcgcgatgtcgaaatcgagatagaattctgtggcgtctgccactcggacatccatacggcccgcagcgaatggccgggctccctctacccttgcgtccccggccacgaaatcgtcggccgtgtcggtcgggtgggcgcgcaagtcacccggttcaagacgggtgaccgcgtcggtgtcggctgtatcgtcgatagctgccgcgaatgcgcaagctgcgccgaagggctggagcaatattgcgaaaacggcatgaccggcacctataactcccctgacaaggcgatgggcggcggcgcgcatacgcttggcggctattccgcccatgtggtggtggatgaccgctatgtgctcaatattcccgaagggctcgatccggcggcagcagcaccgctactctgcgctggtatcaccacctactcgccgctgcgccactggaatgccggccccggcaaacgcgtcggcgtcgtcggtctgggcggcctcggccatatggccgtcaagctcgccaatgccatgggtgcgactgtcgtgatgatcaccacctcgcccggcaaggcggaggatgccaaaaaactcggcgcacacgaggtgatcatctcccgcgatgcggagcagatgaagaaggctacctcgagcctcgatctcatcatcgatgctgtcgccgccgaccacgacatcgacgcctatctggcgctgctgaaacgcgatggcgcgctggtgcaggtgggcgcgccggaaaagccactttcggtgatggccttcagcctcatccccggccgcaagacctttgccggctcgatgatcggcggtattcccgagactcaggaaatgctggatttctgcgccgaaaaaggcatcgccggcgaaatcgagatgatcgatatcgatcagatcaatgacgcttatgaacgcatgataaaaagcgatgtgcgttatcgtttcgtcattgatatgaagagcctg

SEQ ID NO: 35372 - DNA, 2214 bp, Agrobacterium tumefaciens
atgagctgctgcgcaccgggaacggaaggttcgctggagctcggcgaaccgcttaatccgccatcgtcggaggagttgctgctggcgagccgcgatctggggcaggggttgcgccagaccgatcttagcgtgcccggtgtttattgcggcgcctgcatcaccaccatcgagaccgcgctcggccgtctcggccaagtggagcgggcgcgggtgaacctgtcttcgaaacgtgtggcggttgtctggaaagaagaggtcaatggcgtcaggaccgatcccgccgacattgcccgcgccatccttgcgacgggatatcgcatacatcttttcgccagcgggcaggatgcttcatacgccttgcgctcgcagctgatcagggcggtggcgctgtgcggctttgcttccgccaatatcatgcttctgtcggtctccgtctggtcgggggcggatgccgcgacgcgtgacatgttccactggatatcggcgatgatcgccgcgccggcgctgatctatggcgggcgtttcttttaccagtcggcctggaacgcgctgaaacacggccgcaccaacatggatgtgccgattgcgctcgccatcacgctctcctatgccgtttcgctgtgggagaccattcatcacggcgaacatgcgtggttcgatgcgaccgtgtcgctgctgttcttcctgctgatcggccgcacgctggaccatatcatgcgcgacaaggcgcgctccgccattgccggattggcccggctttcgccgcgaggggcaacggtgatcgatgcagacggggtccgggactaccggccgcttgcggatatcgaacctggaatgtcgattgcgattgcggcgggtgaccgggtggcggtggatgccgtggtggtctgcggcagcagcgatctcgacatgtccatcgtcaatggtgaaagcgcgccgcgccgcgtcgtggccggcgacagcctgcaggccggcacgctcaatctcaccgggtcgcttgtcgcccgggtaaccgcgtccgcaaaggattctttcctgtcggaagtgatcgggttgatggaggcggccgaaggcgggcgcgcgcgttaccggcgtatcgccgaccgtgccgcgagctattattcgcccgtggtgcatcttctggcgctggtgacgtttctcggctggggcattttcggcggtgactggaaacaggcgatgctgatcgccattgctgttctcatcataacctgcccctgcgcgctcggccttgctgttccagtcgtgcaggtggtggccgcaggaaggctttttcggcgtggcatcatggtcaaggaaggctcggccatggagcgtctttcggagatcgataccgtgctgttcgacaagaccgggaccttgaccgtcggcaagcctaggctggtcgagaccgcagatgtgaagccggccatcatggcgattgcggcggggctcgctgcccattcgcgccatcctctctcgaaagccctgcatgccgcctataatggtgccttgccagcctatgaggcggtgcgggaaattccggggtcgggtgtcgaggccgagacggaagccggcacttaccggctcggcaatcgccgtttcgcctgcccggatgagacacggatcaacaatggcgatgcgcggtcggaagtggtgctgtctctcgacggccggcatctggcgagcttcggcttcgaggacaatccgcgcgcgggtgctattgcggcattgcgcagcctgtctgtgcggggccttgcgcaggaaatcgtctcgggtgaccgggccgccgccgtcagtgcgatggcgcagcggctggggatcggcaactggcgcgcggacctgtcgccgaaggacaaggcggcgcgctgtgccgcgcttgccggcgaggggcacagggtgctgatggtcggggatggtatcaacgacgcgccagcgcttgccgccgcccacgtatctatggcgcccgccaccgccgccgatattggccggcaggccgccgatttcgtgtttatgcaggaagatctcgatgccgtacctttcgcgatcgagacgtcgcagcgagccggcaacctcatccggcagaactttgcgcttgccatcggctacaatatcatcgccgtaccgattgcgattgccggttatgcgacgccgatgattgcggccattgccatgtcgacatcttcgctgatcgtcgttgccaatgcgctgcgcctt

SEQ ID NO: 35373 - DNA, 1392 bp, Agrobacterium tumefaciens
atcggtttgatcggtctcggcgtcatgggctcgaacctggcgttgaacatcgcagaaaagggcaacaagattgccgtattcaaccgaaccccggaagttacacgaaaattctacgctgatgcgggcgaactgcagggtcagatcattccctgcgaaaccatcgaggaattcgtcgccgccattcgtcctccgcgcccgatcatcatcatgatcaaggcaggcgatccggtcgaccagcagatggaaatcctgaaaccgcatctggccaacggcgacatcatgatcgatgccggcaatgccaacttccgcgatacgatccgccgtttcgataacctcaaggatagcggcctgacctttatcggcatgggcgtttccggcggtgaagaaggtgcgcgccatggaccgtcgatcatggttggcggcaccgaggatagctggaagcgcgtcgaaaaggttctgacctccatttccgccaagtataatgacgatccgtgcgtggcatggctcggcaatgacggtgctggtcatttcgtcaagaccatccataacggcatcgaatatgccgacatgcagatgattgccgaaatctacggcatcctgcgtgatggcctgaaaatgagcgccgtcgagatcgccgacgtgtttgccgaatggaacaagggccgcctgaattcctacctgatcgaaatcaccgagaaggttctgcgcgctgccgatccgatcaccggcaagccgatggtcgatctgatcctcgacaaggccggccagaagggcacaggcaagtggtcggtcatcgaagcccagaacatgggcgtcgctgcaaccgccatcgaggcggccgtggctgcccgtatcctgtcgtcgcagaaggatgagcgtgaagctgccgagaagatcttcggcctgccgaccctcgcagcggcccccgccgacaaaaaggccttcatcgccgatctggaaagcgcgcttctggccgccaaggtcggtgcttacgcccagggcttcgccatcatgtcggctgcttcgaaggagttcaactggaacctgccgatgccgacgattgcccgcatctggcgcgccggctgcatcatccgctcggaattccttgatgagatcacctcggcctttaccaaggatccgcatgtggccaacctcatcgtgacgccggccttctccgccatcgtcaaggataccgacgcgccgctgcgccgtgtggtgtcttacgccgtgctctccggtctgccggtttcggcgcttgcttcggcgctcggttatttcgacgcctatcgccgtggtcgcggcagcgccaacctcattcaggcacagcgcgatttcttcggtgcacatggttttgaacgcaccgatggtgtggacaagccgcacggcccatgg

SEQ ID NO: 35374 - DNA, 1026 bp, Agrobacterium tumefaciens
atggtttggcaaccggccgaaaaccgatacgcatccatgaaatacaatcattgcggcaagaccggcctgaaactgccggcgatttcgctcggcctctggcacaatttcggcaacgacacgccgcaccagacgaaacaggctatttgccgccgggccttcgatctcggtatcacccatttcgatctcgccaacaattacggcccaccgcccggtagcgccgaaaccgccttcggtgaaatcctgaagacggatttcagaggctaccgtgacgaaatgatcatctcgtccaaggccggttacaacatgtggcccggcccttatggcgaatggggcagccgcaaatatctgatctcatcctgcgaccagagccttaagcgcatggggctggactacgtcgatatcttctattcccaccgtttcgaccctaacacaccgcttgaggaaacctgcggcgcgctggaccagatcgtgcgctccggcaaggcgctctatgtcggcatctcctcctacaactcgaagcgcacccgcgaggccgccgctatcctgaaggatctcggcacgccctgcatcatccaccagccgagctattcgatgatcaaccgctggatcgaggaagacggtcttgtcgatacgctggaagaactgggtatcggctccatcgtcttttcgccgctggcgcagggcatgctgacgacgaaatatctgggcggtgtgccggatggcagccgtgcctcacagagcaagtcactcaacccggccttcctcaacgagcgcaatgtcgaaaacatccgcgcgctgaacagcattgccgagcggcgtggccagacgctggcgcagatggcaattgcctgggttctgcgcggcggccgcattacctcagcattgattggcgcaagccgtgtcgaacaggtcgaggactgcgtgaaagcactcgataatgccgagttctctaccgaggagctggccgaaatcgaccgttacgccaaggatgcggatatcaacctctgggcaaaatctgccgaacgc

SEQ ID NO: 35375 - DNA, 651 bp, Agrobacterium tumefaciens
atgagcctgcgtatcaacgatatcgcccccgacttcaccgccgagaccacccagggtccggtgcgttttcacgactggatcggcgatggctgggcagtcctgttttcccatccgaaaaacttcacgcccgtgtgcacgacggaactcggcgccatgggcggcctgcagccggaattcgaaaaacgcggcgtcaagatcatcggcatttcggtcgatccggtcgaaagccatgaaaaatggaaagccgatattcgcaccgcgaccggcttcaatgtcgattatccgctgatcggcgacaaggacctgaaggtggcgaagctctatgacatgctgccggcgggtgccggcgacagctccgaaggccgcacgcctgccgataacgccaccgtgcgctccgtcttcgtcatcggccccgacaagaagatcaaactggtcctcacctacccgatgaccaccggccgcaatttcgatgaaattctccgcgccatcgattccatccagctcacctccaaacaccaggtggcgacgcccgccaactggaagcagggagaggatgtcatcatcaccgccgccgtctccaatgaagatgcgattgcccgtttcggctcctacgacacggttcttccgtatctgcgcaagacgaagcagccc

SEQ ID NO: 35376 - DNA, 360 bp, Agrobacterium tumefaciens
atgctgaaatttaccgcagaacacgaatggctgaagttcgaaggcgatatcgccaccgtcggcatcaccagccacgccgctgaacagcttggcgatctcgtttttgtcgagctgccggaagtgggcgcaaccttcgccaaggatggcgatgctgcgaccgtggaatccgtcaaggcggcgtccgacgtctattgtccgctggatggcgaagtggtcgaaatcaaccaggccatcgttgatgacccctcgctggtcaattccgatccgcagggtgccggctggttcttcaagctgaagctttccaatgccgcggatgccgagacactgctcgatgaagcagcctacaaggagctgatcgcg

SEQ ID NO: 35377 - DNA, 1653 bp, Agrobacterium tumefaciens
atgtaccgttacgacgaattcgatcacgcatttgttgaaggccgcgtggcgcagtttcgcgatcaggtcgagcgccggttatcgggcgagttggccgaggacgcattcaagccgctgcgcctgatgaatggtgtctatcttcagctccacgcctacatgctgcgcgtcgccattccctacggtacgctgaattcgcaacagatgcggatgcttgcccatatcgcccgcaaatatgaccggggttatggccatttcaccacccgccagaacatccagtacaactggccgcgcctctcggacacgccggatatcctctctgaactggcaagcgtggaaatgcacgcactgcagacgtcgggtaactgcattcgcaacgtgaccgccgatcatttcgcgggtgctgccgcagacgaagtcgccgatccgcgtccctatgcggaaatcctgcgtcaatggtcttccgtgcatccggaattctcgttcctgccgcgcaagttcaagatcgcggtgacgggtgccgagcgcgaccgcgccgccattcaggtccacgatatcggcctgcatctgaaaaagaacgacaagggtgagatcggttttgccgtttacgtcggcggcgggcagggccgtacgccgatgatcgccaagaagattcgcgacttcctgccggaagaggacctgctgtcctataccacggccgtcatgcgcgtttataacctgcacggccgccgcgacaacaaatacaaggcgcgcatcaagattctcgtacatgaaaccggcgcagaagaactggcccgccaggtcgaggttgaattcgcggagctgaaaaacaccgaattgaagctgccggatgccgatattgccgccatcaccgcctatttcgccccgccggcgctgaaagaccgccctgaaggctgggaaagcctggcgcgctggaagcgtgcggatgaaggttttgcccgttttgtcgagcagaacgtcgcgccgcacaagcacccggactacggcatggtgacgatttcgctgaagccgatcggcggcattccgggcgacgcgaccgacgagcagatggaactcgtcgccgacatcgccgccgaatatgcctttgacgaaatccgcatcagtcacgagcagaacatcatcctgccgcatgtggcgctggccgatctcgagccggtctatcgtgcgctcgtgggcgcgggactggcgactgccaatgccgggctgatcaccgatatcattgcctgtcccgggctggactattgcgcgcttgccaatgcccgctccattccggtggcgcaggagatctccacccgtttcggcgcgcccgaacgtcaggccgagatcggcgagctgaagatcaagatttccggctgcatcaacgcctgcggccaccaccatgtcggccatatcggccttctgggcgtggagaagaagggtgccgaactctaccagatcacgcttggcggatcgggtgatgaaaacacctcgattggtgaaatcattggccgcggtttcgagccggaaaaagtgaccgacgcggtggaaaccattgtcgacacttatctgggcttgcgcctttcgaaggaagaaaccttcctcgaagcctatcgccgcgtcggaccgcagccgttcaaggacgcgctctacggttcc

SEQ ID NO: 35378 - DNA, 1415 bp, Agrobacterium tumefaciens
tctgctgctggcgaccgcctttcaaccttccccgctttcttccgggtcgagggacggcaggtcgctgttttcggaaatggcgatgaagccttcgcgaaggtgaggctgctcgccaataccaacgcgcatatcgttgcctatgccgatcacccggaagcggattttgcgcgttacatcagcgaaaacagtatcgatcaccgtgctctggccttcgccagcccgttggttgacgacgccaccctggtgttcgccgcaacaggcgatgaagcgctggatcgcgaaatcgtctctgtagcgcgcacgaagaaaatccccgccaatgcggtggatcagcccgaattctgcgacttcttcacgcctgcactcgttgcccgcgcgccagttgccattgccattggcacggaaggggcagggccggttcttgcccagatgatccgcgcgcgtatcgaccagatgctgtcgccgtcgctcggcaagctcgcacgtcttgcggtgcaatatcgtgatgcggccgaggagaacgtgccgaagggcgcgttgcggcgcaatttctggcgccggttcttttcgggcgcggttgcggatgccgttgctctcggtgatacctcttccgcccgtcatgccgcagatcgcctgctgcaatcgccggaacgcagcgaaggtcgcgtctggcttgttggcgccggtccaggtgcagaagatctgctgacgctgcgcgcgcagcgcgtgttgatggaagccgacgtgatcgtctacgacgccctggtgccgcaggcgattgtcgatatgggccgccgcgatgctgaaaggctctctgtcggcaagcgcaagggctgccacagcaagtcgcaaaatgatatcaaccgcctgctggtgcgtctaggcctggaaggaaagcgagtcgtgcggctcaaatccggtgatccgctggtctacggccgcgcgggcgaggaaatggcagcgctgcgcgaggctggtgtcgcttatgaaatcgtgccgggcatcacctccgcctttgccgcggctgcggatttcgaattaccactgacgctgcgcggtgtcgcctcttcgctgattttcaccactggtcacgacctgatgggcgacgttctgcctgattgggcacgacttgccgtctccggggccaccattgccgtctatatgggccgcagtgttgccgcttcggtggccaagcggctgattgatgcgggacttggcgtcgaaaccaccgtcgccgtcatcgaaaatgccagccgcgcggatcgccgcctgctgcacggcacattaaacgatttgcccgacctcgaatatcgtgatgaactgatcggcccggtcatggtcatcatcggcgatgcggtggcgggcgctaatttcgacagatccgaggcgcttgcgcttgcagccaagccggcgag

SEQ ID NO: 35379 - DNA, 1422 bp, Agrobacterium tumefaciens
atggctcaatcttatgacgtcatcatcatcggttcgggaccgggcggttatattgccgcgatccgcgcagcccagctcggcatgaaggttgccgtcgtcgagcgcgaacatctggcgggcatctgctccaactggggctgcattcctaccaaggccctgctgcgcaccgccgatgtcatgcacaccgccacccacgccaaggattacggcctgacgctggaaggttcgatcaagcctgacgtgaaggcaatcgtggcgcgctcgcgcggcattgctgcgcgcatgaacaacggcgtcggtttcctgttcaagaagaacaaggtcgatatcatctggggtgaagcgaaaatcaccaagcccggcgaaatcgttgtcggcaagtccaccaagccggtggttcagccgcagggtccggttccgaagaacacgctgggcgagggcacttacaccgccaagcacatcatcgtcgcaacaggcgcccgcccgcgcgcgcttccgggcatcgagccggacggcaagctgatctggacctatttcgaggcgatgaagccggaagagctgccgaagtcgctgctcgtcatgggttcgggcgccatcggcatcgaattcgccagcttctaccgcaccatgggcgtcgatgttaccgtcgtcgagatcatgagccaggtcatgccggtcgaagatgcggaaatctctgcctttgccaagaagcagctggaaaagcagggtatcaagattcatctggagaccaaggtttccaaggtcgagaaggccgcgaattccgttaccgcgacgttggagaagaaggacggttcgtccgagaagatcatcgctgaccggatgatttcggctgtcggcgtcgtggcgaatgtcgaaggcatcggccttgaggccgccggcgtgaagaccgatcgcggtttcatcatcattgacggttacggcaaaaccaacgtgcctggtatttacgccatcggcgatgtcgccggcccgccgctgctcgcccataaggccgagcacgaggccgtcatctgcgttgaaaagatcgctggtctgccgaatgtccatccgatggacaagctcaagatccccggctgcacctattgcaacccgcaggtcgcctcggttggtttgaccgaagccaaggccaaggaacagggccgcgacatccgcgtcggccgtttctcctttgcggcgaacggcaaggcggttgcgctcggtgaagaccagggcatggtcaagaccatcttcgacaagaagaccggcgaactgctcggtgcccatatggtcggtgcggaagtgaccgaactcattcagggcttcgtcgttgccatgaacctcgagacgacggaagaagatttgatgcacacgatcttcccgcatccgaccatttcggaatcaatgaaggaaagcgtgctcgacgct

SEQ ID NO: 35380 - DNA, 1356 bp, Agrobacterium tumefaciens
atgcctatcaacattaccatgcctgccctttccccgacgatggaagagggcaatctgaccaagtggctggtcaaggaaggcgacaaggtcgcccccggtgacgtgatcgccgagatcgagaccgacaaggcgaccatggaagtggaagccgtcgatgaaggcaccgtcgccaagctggttgttccggccggcaccgaagccgtcaaggtcaacgccctgatcgcgatcctcgcagcagaaggagaagatgtggccgaggcggcgaagggcggcgatgccgttcctgccaaggcggaagctcccaagccggaagccgcaaaggctgaagcgccgaaggaagaagctgctccagtcaaggctgaaaagccggtagccgatcaggcggccgcatcttccacaccggccccggttgccaagtccggcgagcgcattttcgcatcgccacttgcccgccgtcttgccaaggaagccggtctcgacctttcggccgtctccggttccggcccgcatggccgtatcgtcaagaccgatgtggaaaaggctgccgcttccggcggtgcaaaggctgctcccgccgctgctgcatccgcaggcgcaccggccccggcactcgccaagggccagtccgacgaagccgttctcaagctgttcgaacagggctcctacgagcttgtgccgcatgacggcatgcgcaaggtcatcgccaagcgtctggtcgaatccaagcagacggttccgcatttctacgtttccgtggattgcgaactggatacgcttctggcgctgcgcgcccagctcaacgccgctgctcccgaaaaggacggcaagccggtctacaagctgtcggtcaacgacatggtcatcaaggcgctggcgctggcgctgcgtgacgttcctgacgccaacgtctcctggacggaaagcgccatggtcaagcacaagcacgcggatgtcggcgttgccgtttccattccgggtggcctgatcacgccgatcatccgcaaagcggaagaaaagtcgctctccaccatctccaacgagatgaaggactacggcaagcgcgcgaaagagcgcaagctgaagcccgaggaatatcagggcggtacgactgccgtgtccaacatgggcatgatgggcgtgaaaagcttctccgccgtcatcaacccgccgcacgccaccattctggctgtcggtgcgggcgaacagcgtgccgtcgtgaagaacggcgagatcaagatcgccaacgtcatgacggtcacgctttccaccgaccatcgctgcgtcgatggcgcgctcggagccgaactgatcggcgcgttcaagcgctacatcgaaaacccgatgggcatgctggtt

SEQ ID NO: 35381 - DNA, 1419 bp, Agrobacterium tumefaciens
atgcctgtagaaattcttatgcccgccctttccccgaccatggaggaaggcacgctttccaaatggcttaaaaaggaaggcgacaaggtcacctccggcgacgtgattgccgagatcgagaccgacaaggcgaccatggaagtggaagccgtggacgagggcgtgatcggcaagctgctgatcgacgccggcaccgaaggcgtcaaggtcaatacgccgatcgccgttctgatccaggaaggcgaaagcgccgacgacatctcttcctctgccaagaaggaagaaccgaaggcagaagctgcaaattccggttcggacgccgccggcggcaagacccgcgaagcggccgaagagccgagcgctgccaaggaagccgctaaggttccggcagcacccaagatcgaagttgctgccgatcccgatattcctgaaggcacggaaatggtgatgacgacggtgcgtgaagcgctgcgtgacgccatggccgaagaaatgcgcgccgacgaaaaagtcttcgtcatgggtgaagaagtcgccgaatatcagggcgcctacaagatcacccaaggcctgttgcaggagttcggcgagcgccgcgtcatcgataccccgatcaccgagcacggttttgccggtatcggcgtcggcgctgcgatgacgggcctcaagcccatcgtcgaattcatgaccttcaatttcgccatgcaggcgattgaccagatcgtcaactcggcggcaaagacgctttacatgtcgggtggccagatgggtgcaccgatggtgttccgtggtccctcgggtgctgctgcccgcgttggcgcgcagcattcgcaatgttacgccgcatggtacagccatattccgggcctcaaggtggtcatgccttacacggcagccgacgcgaagggtctcttgaaggcggctatccgcgatccgaaccccgtcatcttccttgagaatgaaattctctatggccagagcttcgaagtgccgaagctcgatgatttcgtgctgccgatcggcaaggcgcgcattcaccgcaagggcaaggatgcgaccatcgtttccttcggtatcggcatgacctatgcgatcaaggcggttgcggaactcgagaagctcggcatcgacgtcgaactgatcgatctgcgcaccatccgtccgatggacctgcccaccgtcatcgaatcggtcaagaagaccggccgtctggtgaccgtcgaggaaggtttcccgcagtcatcggtcggtgacttcatcgccaaccaggtcatgcgcgccgccttcgactatctcgatgcgccgatcctcacgattgccggcaaggacgttccgatgccttacgcggcaaacctcgaaaagttggctctgccgaatgttgacgaagtcgttcaggctgtcaaaaccgtctgctacaag

SEQ ID NO: 35382 - DNA, 1041 bp, Agrobacterium tumefaciens
atggcgccgcgaaaaccagcgaccgtatccggccgcaagacaacggcaaaggctgcaaccgaattcaccggtaagaacagcccggacttttcgaaggacgaagagcttcacgcctatcgtgaaatgcttttgatccgccgtttcgaggaaaaggcaggccagctttacggtatgggctttataggtggtttctgtcacctctacatcggccaggaagccgttgttgtcggcatgcagatgtcacagaaggaaggcgatcaggtcatcaccgcttaccgtgaccatggccacatgcttgctttgggcatgagcgcgcgtggcgtcatggccgagttgaccggtcgcaagggcggcctgtcgaaaggcaagggcggctccatgcacatgttctccaaggagaagcatttttacggcggccacggcatcgttggtgcgcaggtttcgcttggaaccggtctcgccttcgccaaccgctatcgcggcaatgacaatgtctccgtgacctattttggtgacggcgccgccaaccagggccaggtctacgagagcttcaacatggctgctctctggaagttgccgatcatctatatcgtcgagaataaccgttacgccatgggcacctcgaccgcccgcgccaccgcccagtcgaactactcgctgcgcggccagtccttcggcatccccggcgttcaggtggatggcatggatgtgcgcgccgtgaaggctgccgctgaccaggcgctggagcattgccgttccggcaagggcccgatcattctggaaatgctgacctaccgttaccgtggccactccatgtcggacccggcgaaataccgctccaaggatgaagtgcagaagatgcgctccgaacatgacccgatcgaacaggtcaaggcacggcttctggaccatggttgggcaagcgaagacgaattgaaggccatcgacaaggatgtccgtgatatcgtcgccgacagcgccgacttcgcccagaacgaccccgagccggatgtatccgagctctacaccgacattctgctc

SEQ ID NO: 35383 - DNA, 1269 bp, Agrobacterium tumefaciens
atgactgccattaccgatatcatcgcgcgcgaaattctcgacagccgcggcaatccgaccgttgaagtcgatgtttacctcgaagacggctccatgggccgtgcggccgttccgtccggcgcctccactggcgcgcatgaggcggttgagctgcgcgatggcggcaagcgttatctcggcaagggcgtggaaaaggcggtcgaagccgtcaataccgaaatcttcgacgccatcggcggtttcgacgctgaaaaccagatccagatcgatcagatgatgatcgcgcttgacggcacgccgaacaagtcgcgcctcggcgccaacgccatcctcggcgtctcgcttgccatcgccaaggctgcggctgaagcctccggcctgccgctttaccgttatgttggcggtccgaacgcccatctgcttccggttccgatgatgaacatcatcaacggcggcgcgcatgccgataaccccatcgacttccaggaattcatgatcctgccggttggcgcggaaaacatccgcgaagccgtgcgtatgggttcggaagtgttccacacgctgaaaaaagaactgtccgcacagggccacaacaccaatgtcggtgatgagggcggttttgcaccgggcctcgagagcgcgccggcagccctcgatttcatcatgaagtcgatcgaaaaggctggctaccgtccgggcgaagacatgtatgtcggcctcgactgcgcatcgaccgagttctttaaggacggtaagtacgttctggaaggtgaaggccgcacgctggagcccggcgccatggccgaatatctggccgagcttgtcaataaatacccgatcatctcggttgaagacggcatggccgaagatgactgggaaggctggaagacgctgactgatctcgtcggcaacaaatgccagctcgtcggcgacgatctcttcgtcaccaactccgcgcgtcttcgcgacggcatcaagatgggcgtcgccaactccattctcgtcaaggttaaccagatcggttcgctttccgagacgctggatgcagtcgaaacggcacacaaggccggttacaccgccgtcatgtcgcaccgctctggcgagacggaagattctaccatcgccgatctcgctgtcgccaccaactgcggtcagatcaagaccggttcgcttgcccgttctgaccggctcgcaaagtacaaccagctgatccgcattgaggaaatgctgggtccgcaggctgcctacgccggccgttcgatcctgcgc

SEQ ID NO: 35384 - DNA, 1728 bp, Agrobacterium tumefaciens
gatccgcttggcccctatccgcagaaattgaatgagcgtctccttcactggtgtcgttcggcaccggagcgcacatggatggccgaccgtcagggtcgcgagccatggcgccgggtcagctacgccgaggctctcgacaagatacggcgtatcggccagttccttctcgatcatgacctttcggtcgagaggccgctgctggtgctttctgaaaattccatcgagcatgcgttgatggtgcttgcggcccagcatgtcggtatcgcctcggctgccatcacgccggcctatgccacgtcggccgatctcaccaaactcgccgacatccgcgggcagatcaccccggggatggtttttgccgaggatgcgacgccctttcgccgggcgctcggcgaggttttcgacgacggtacaccgctggtcggcctccgcaacctgccggaagatcgttccaatacgtttcatttcgaaaccctgcttgaaacggagccgaccgaagcggttgatcgtgctttcgatgcggtcgggccggataccgtcgccaaattccttttcacgtcaggcacgactggttcgcccaaagcggtcatccagacgcaacgcatgttgtgctccaatcaggaaatgattgccgattgttatggctactttcgcgaggagccgccggtcgtcgttgattgggcgccatggaaccacacggccgcggggaacaaggtgttcaacctcgtcctctataatggcggtacctattatatcgatcgcggcaagcccagcccggcgcagatcggccagacactggacaatctccgggacatatcgcccacctggtatttcaacgttcccgctggccacgaaatgctggtccaggcaatgcgcaaggacgaggcgctgtgccgcagcttttttcgcgacctgaagatgctgatgtatgccggtgccggcatggcgcagcacacatgggatgcgctgacggagctttccatggcaacggtcggccatgcggttctcatgggtgccggcctcggctcgacggagacggcacccttctcgctgttctgcaccgaaccgcaggacaagcccggcaatatcggtatcccggcgcagggcgtgacgatgaaactcgtgcccttcgatggccggtacgaattacggctgaaaggcccgaacatcacgcccggttactggcgtaatggcgaattgacggcggcagccttcgacgaggaagggttctatcgaatcggcgataccgtcaaatttgccgtcgcggacgatccgcgccgcggcttttatttcgatggccgcatggcggaaaacttcaagctgcagaccggcacctgggtggccgtcgggcctttgcgcgcgcaattagtcaacatgttcgccgggctgatccgtgatgccgtcataacgggcgaaaaccgggccgaactgggcgctctcgtcgtgccattcataccggcgctacgtgagcttgttcgcggttcgcaacatctctccgatgcggagatcatccggcacccgagtgtcagggcgcagattgtcgcgaagctttcggcgcatcaaaaacaggcgagcggttccgcaagccgcgtcatgcgcattctcgtgatggaagacgcgctgcgcttcgagaaaggcgaggttacggacaagggatcgatcaaccagcgcgccgtgcttctgcatcgcaaggagctcgtagagtcactttacggcgacacgccgcag

SEQ ID NO: 35385 - DNA, 771 bp, Agrobacterium tumefaciens
atgaatatcgaaggcgcaggcgcactcgtcacgggtgcggcatccggcctcggggcggccgtggcgcgaatgctcgcggctcgcggcgcggcggtcaccatttttgaccgtaacggcgaagccggcaaaaagctggcggcggagatcggcggtaaggccgttcaaggcgatgtgacaagcgacgccgatgcgcaggcggcaataaaggtagccgcttccgccaaaggcggccttcgtattctcgtcaattgcgcgggcatcggcaccgcgggtcgaattctcggtcgcgaagggccgcaaccgcttggcgatttcgaacaggtcatccgcgtcaacctgatcggcaccttcaacatgatgcggcttgcggccgctcacatggctgagagggaacaggatgaaggccaagacagtcgccaagacaatggtgtgatcgtcaacacggcgtcggttgccgctttcgagggccagatcgggcaagcggcctatgccgcgtcgaaaggcggcatcgtttcactcgccctgcccgcagcacgcgaacttgcccgcttccgcattcgggtgaacaccgtggcgcccggcattttcctgacccccctgcttcagggattgccgcaggaggttcaggagagccttgcgggccagataccccacccttcccggctcggcgatccagccgaattcgccgatacggtgcgctttctcatcgagaacgattacatgaacggtgaagtcatccggctggatggcgcgatccgcatgcagccgcgg

SEQ ID NO: 35386 - DNA, 1248 bp, Agrobacterium tumefaciens
gatgatgccctggtagtggccatcctcaacgaagcggcgcgttttgccgaaaccgtgcttgaaccgctcaatacacccgccgatcgtgaaggctgcaccgtggtcgatggccgcgttcgcgttcccaccggttttgccgatgcttttcggcggcatgcgggcgatggctggctggccatggatgtgccggaacgcttcggcggtcaggctctgccgctggtgttacaggccgcctgcgctccacttttcgaacggggctgcgtggcgctgatgatggcgtcaggctcgacccgcgccgcctgtcaccttcttgccgagaccgcggaaggagccgttgcggacgaatgggtgccgcgccttgcggcgggggaatgggctgccaccatctgcatttccgagcctgatgccggttccgacctcgcccgtctgcgcagtcgcgccgtcttcagggaaggcgcatggcgcatcgagggtcggaaaatctggatatccttcggcgaccatgacatggcgatgcgtatcggccattgtcttctcgcccgcaccggcgaagaaaccgggacgcgcggcctcagccttttccttgtgccggatgagatcgatggcgaacgcaacggcgtcaccgtcgagcggatcgaggaaaaaatggggctgcacggctcgcccacctgcgcgctgcgtttcgacggtgcccgcggcctcttactgggtgaggaagggcgcgggctggcgcagcttttcgccatgatcgaattgatgcggttgcagaccggctgtcaggggctgggactggcctcggccgccatcgatattgccgaaacctatgcgcaggagcgccaacaaggcggcgatccggcaaaacccgccgtcgccatcgcacaccaccccgatattcgccgccagcttcaggaagcccgcctgcgcacggaaacattgcgggcagcaacactggaactcgcaacagtcatggatcttgcccgcatggagccgaaggaagagctgcgcggcgatttgcaggcgctctcgcgctggctgctgccgcttgtcaagaatttcggtgcggatgccggcttcaccgtctccaatcaggccatccagatacttggcggtgcgggttacacccgggaatggccgcttgagcaatatctgcgcgatgcccgggtgatgacgatctatgaaggcaccaccggcatgcaggcgatcgaccttctgacaaggcggctgtggcgggaaggcggaaagggtctc

SEQ ID NO: 35387 - DNA, 1014 bp, Agrobacterium tumefaciens
gtcattcatgcagcaaaagacctgcgggtagaggacgttgctggccagccacttgccgcggacgaggtgcgggtggccgttgccgtcggcggaatttgcggctcggatctgcattattataaccatggcggcttcggcacggtgcgcgtgcgcgagccgatggcgctcggtcatgagtttgccggtacggtggttgaggtgggcagttcggtctcgcatctcgtgcccggcatgcgcgtggccgtcaatccgagcctgccttgcggcacctgccgctattgcgctcagggcaggcagaatcagtgcctggacatgcgcttcatgggcagcgccatgcgctccccccatgttcagggcggtttccgtgaagtcgtgaccgtccattcaacgcaaccggtacagatcgccgacggactttccatgggtgaggcagccatggccgagcctttggccgtgtgcctccatgccgcgcgtcaggcgggatcgcttctgggcaagacggtgctgataaccggtgccgggccgatcggcatgcttagcctgctggttgcccgtcttgccggcgcggcgcatatcgtcgttaccgatgtcgccgatgcaccgctcgatctggcgcgacgtatcggcgcggatgaagccgtcaacatcctgcgcgatgccgacatgcttgaaaaataccgatttgaaaaaggcgtcttcgacgtcctgttcgaagcctccggcaatcaggcggcacttctcccggcgctggatctgctccggccgggcggtattatcgtccagctcggtcttggcggagacttcaccattccgatgaacctcatcgttgccaaagagctgcagctgcgcggaacgttccgcttccacgaggaatttgcccaggcggtgaatatgatgggacgtggcctgatcgacgttaagcctttgatcagcgccacattgccgttcgatcaggcccgcgaggctttcgatcttgccggtgaccgcgcaaaaagcatgaaagtgcagcttgcc

SEQ ID NO: 35388 - DNA, 795 bp, Agrobacterium tumefaciens
cggtccgcgtcagcacgctgtgaggagggcatcatgagcaatcagatcatcttcgatctcggcgggcgcacggcgcttgttaccggttcttcacgcggcctcggccgcgcaatggcagaaggacttgccgtcgcgggggcacgcatcctcattaacggcaccgatccgtcgcgtgtcgcgcaaacggttcaggagtttcgcaatgtcggccatgacgccgaggcggtcgcctttgacgtcacctccgaaagcgaaatcattgaggctttcgccaggcttgatgagcaggggatagacgtcgacattctcgtcaacaatgccggcatccagttccgcaaaccgatgatcgagctggagacggccgactggcagcgggtaatcgacaccaacctcactagcgccttcatgattggccgtgaggcggcaaaacggatgatcccgcggggatatggcaagatcgtcaatatcggctcgctgaccagcgaactggcccgcgcgacggtggcgccctacaccgtggccaagggcggcatcaagatgctgacccgcgccatggcggcggaatgggcgcaatacggcattcaggcgaacgccatcggccccggctacatgctgaccgacatgaatcaggcattgatcgacaatccggaatttgacgcctgggtgaaggcgcgcacgcccgcgaaacgctggggcaagccgcaggaacttgtcggaaccgccgtgttcctgtctgcttcggcctccgactacgtcaatggccagataatctatgtcgatggtggaatgctgtcg

SEQ ID NO: 35389 - DNA, 1287 bp, Agrobacterium tumefaciens
atgacggaaaaaagcgctacagtgacacttggcgaaaagcaggtggaactcccggtcagggaaggcacgattggaccaagcgtcgtcgatatcgccacgctctacaagcacacgggctccttcacctacgacccgggtttcacgtcgacggcctcctgcgaatccaagatcacctatatcgacggtgacgagggcgttctcctgcatcgtggtttccccatcgagcaactggctgaacagggcgacttcctcgaaacctgctatctgctgctctacggcgaactgccgacggctgcgcagaagaaggatttcgacacccgcgtcacgcgccacaccatggtgcatgagcagatgagccgcttcttcaccggctatcgtcgcgacgcacacccgatggccgtcatgtgcggcacggtcggcgctctctcggccttctatcacgactcgacggacatcaccgatccgcaccagcgcatggtcgcttcgctgcgcatgatcgcgaagatgccgacgatcgccgccatggcctacaagtaccatatcggccagcccttcgtttacccgaagaacgatctggattacgcctccaacttcctgcacatgtgctttgccgtgccgtgcgaggactacaaggtggacccggttctggcccgcgccatggatcgcatcttcatcctgcatgccgatcacgagcagaacgcctccacctccacggtgcgtcttgccggttcgtcgggtgcaaatccgttcgcctgtatcgcggctggcatcgcctgcctctggggtccggctcacggcggcgccaacgaagcggcgctcaacatgctgaacgagatcggctctgtcgaccgcatcccggaatatatcgcccgcgccaaggacaagaacgatccgttccgcctgatgggctttggccaccgcgtctacaaaaactacgacccgcgcgccaagatcatgcagaagacgatgtacgaagtgctggaagccaccggcaattccgacgatccgatcatgcaggtcgcgctcgaactggaaaagatcgccctttccgacccatacttcgtcgaaaagaagctctacccgaatgtcgacttctattcgggcatcacgctgaaggcgctcggcttccccaccaccatgttcaccgttctcttcgctctcgcccgcaccgtcggctggatcgcacagtggaacgaaatgatcgaagatccgcagcagcgcatcggccgtccgcgccagctctatacgggcgccggcaagcgcgattacgttccggtttccaagcgt

SEQ ID NO: 35390 - DNA, 414 bp, Agrobacterium tumefaciens
gccgacatcttggaagtcatgaaacttctgccgcatcgttacccgtttttgctcatcgacaagatcatcgagatcgatggcgacagttcggcgatcggcatcaagaacgtgacggtcaacgaaccgcatttcaccggccatttccctgatcggccgatcatgccgggcgttctgatcgtcgaggcgatggcccagacggccggcgccatctgcgcccgtaaccagggcgagggcggtcatctcgtttatttcatgaccatcgacaacgcgcgtttccgcagaccagtggttccgggcgatcgcctcgaaatccatgtggtcaagcagcgccagcgcggcaatgtgtttaagttccattgcgaagcgaaggtcgaaggcgcgctcgtggcggaagccgatgtcggcgcgatgatg

SEQ ID NO: 35391 - DNA, 2250 bp, Agrobacterium tumefaciens
ctcgagaaggcgctgcaccaggcactgacctttgcgaatgagcgtcaccacgaatatgcgacgctcgaacacctgcttctggcgctgatcgacgacgcggatgccgccgccgttatggctgcctgcaatgtcgatctcgacgcgctgcgcaagaccgtcagcgattacgtcgacaatgaactgactaacctcgtcaccggttatgacgaggattccaaacccacatccggcttccagcgcgtcatccagcgcgccgtcatccatgttcagtcgtccggccgcgaggaagtgactggcgccaatgtgcttgtggccatttttgccgagcgcgaaagccatgccgcctatttcctgcaggaacaggaaatgacccgttacgatgcggtcaattacatctctcacggcatcggcaagcgtccgggcacgtcgcagacgcgcgcgccgcgcggtgccgatgagcccgaaagcgaaagcaagcccagccgcggtaatcccgaggaagacggatcgtccgccaagaagcagcaggatgcgctgaaggcctattgcgtcaacctcaacgacaaggcgaggaacggcaagatcgacccgctgatcggccgtcacgacgaggtcaatcgcaccatccagattctctgccgccgctccaagaacaacccgctttatgtgggtgatccgggcgtgggcaagacggcgatcgccgagggcctggccaagcgtatcgtcgaaggtaaggtgccggaggcgctcgccaatgacaccatcttctcgctcgacatgggcacgctgcttgccggcacccgttatcgcggtgatttcgaggagcgtctgaagcaggtcgtcaaggaactggaagagtttccgggcgcggttctgttcatcgatgaaatccataccgtcatcggtgccggcgccacatccggcggcgcgatggatgcatcgaacctgttgaagcctgcgctgtcatcgggtgctatccgttgcatcggttcgaccacctacaaggaatatcgccagttcttcgaaaaggaccgcgcgctggtgcgtcgtttccagaagatcgacgtcaacgagccgtcgatcgatgatgccattgcgatcatgaagggtctgaagccctatttcgaggattatcatcacctcagatattccaacgaggcgatcaaggccgccgttgaattgtcggctcgctatatctccgaccgcaagctgccggacaaggcgatcgacgtgatcgacgagacaggtgccgcacagatgctgctgccagcctccaagcgccgcaagctgatcaccgaacgggaaatcgaggccaccatcgcgacgatggcccgcattccgccgaagacggtttccaaggatgacgagatggttctcgccaatcttgaaaaggaactgcgctcggtcgtttatggtcaggacatcgccatcgaggcgctggcgaccgccatcaagctggcgcgtgccggcttgcgcgagccgaacaagccgatcggctcctatgtcttctccggcccgacgggcgtgggcaagacggaagtggccaagcagcttgccgcctcgctcggtgtcgagatgctgcgcttcgacatgtcggaatatatggagcgccataccgtctcacgtctgctcggcgcacctcccggttatgtcggcttcgatcagggcggtcttttgaccgacggcgtcgatcaacatccacattccgtggtgctgctggacgaaatcgaaaaggcgcatcctgatatctacaacatcctgttgcaggtgatggaccacggctcgctgaccgaccataacggcaagaagatcgacttccgcaacgtcatcctgatcatgacgaccaatgcgggtgcgtccgaaatggcgaaatcggcgatcggtttcggctcttcgcgccgcacgggtgaggatgaagaggcgatcaaccgcctgttcacgccggagttccgcaaccgtctggatgcgatcattccgttctcgccgctgccaacagccgttatacacaaggtggtgcagaagttcgtcatgcagctggaaacccagctctccgaacgtaacgtcaccttcgacctgcatgaggatgcgatctcctggctggcggaaaagggttacgacgaaaagatgggtgcccgcccgctgtcgcgcgtgatccaggaacacatcaagaagccgctcgccaatgaaatcctcttcggcaagctgaagaagggtggcgtcgtcagtgtcaccgttggcaagaaggatgac

SEQ ID NO: 35392 - DNA, 678 bp, Agrobacterium tumefaciens
aaagtggctattgtaacggcaggtggcagcggcatgggggcggccgtggcgaaacgcctggcggcggacggttacaggctcgcgatcctgtcctcctccggcaagggcgaggcgctggcgaaggaactgggcggtatcggtgtcaccggctccaaccagtccaatgacgacctccagcgactgacggatcagacgctcgagaaattcggtcgcatcgacgtgctggtcaatagcgccgggcatggcccacgtgcctccattctcgatattaccgacgagcaatggcacaccggtctcgatgtctacctgatgaacgtcatccgcccaacgcggatcgtcgcgcccatcatggtgaagcagaaggccggtgcgatcgtcaacatctcgacggcctgggctttcgaaccgagcagcatgttcccgacatcggcagtgttccgggccggccttgcctcctacagcaagattttcgccgatacctatgcggccgacaatgtgcgcatgaacaatgtcctgcccggctggatcgacagcctgccggctacggaagaacgccgcgacagcgtgccgatgcagcgctacggcaagagcgaggaaatcgctgccaccgtggcgtttctcgcgtccgaaggggcagggtatattaccgggcagaatatccgggttgatggtgggctg

SEQ ID NO: 35393 - DNA, 399 bp, Agrobacterium tumefaciens
atcatcgtcatcaacggccccaatctcaatatgctgggaaaacgggaaccgggtatctacggtggcaaaacgctgaaagacatagaaaacgattgtgtgaacgccggagccgatctcggcttttcggtggaatttcgccaatccaaccacgagggcgtgctcgtggactggctgcatgaggcgggcgagcgggcggcgggtgtcgtcatcaatcccggcgcttacagccacacctccatcgccctgcacgacgccattcgcgcaatttcgactccggtcgtggaagtgcacatctccaatatccatgcacgggaagaattccgccacaaatcaatggtctcgcccgcagccaagggcatgatctgcggtttcggaccatatggatacgtcatggcgctt

SEQ ID NO: 35394 - DNA, 1326 bp, Agrobacterium tumefaciens
atggtttcgaagatccttatagccaaccgcggcgaaatcgcgctgcgcgtcctgcgcgccgcgaaagagcttggcattccgaccgtcgccgtgcattccacggcagatgcggatgcgatgcatgtgcgccttgccgacgaaagtgtgtgcatcggcccgccgccctcgcgtgacagctacctcaacatccaccagatcgttgcggcctgcgaaatcacaggtgcggatgccgttcaccccggttacggcttcctgtcggaaaacgccaagttcgccgatattctcgacgcccacggcatcaccttcatcgggccgaccgccgaacatatccgcatcatgggcgacaagatcaccgccaagcagacggcacaggaactcggcattcccgtggttccgggttcggatggcgaagtgaagcctgaaaatgcgctggaaatcgcccggacgatcggcttcccggtcctcatcaaggcgacggcaggcggtggcggccgcggcatgaaggtggcgaagaccgaagccgatctggaagatgcagttgcgactgcccgttccgaagcggcagcagccttcggcaacgatgccgtctatatggaaaaatacctcggcaagccgcgccatatcgaagtgcaggttttcggcgatggcgaaggcaatgccgttcaccttggcgagcgcgattgctcgcttcagcgccgccaccagaaggtgctggaagaagccaattcaccggctctcacagtcgaacagcgcatgaaaatcggcgaaatttgcgccgacgcgatgcgcaagctgaaatatcgcggcgccggcaccatcgagttcctgtatgaaaacggcgagttctatttcatcgaaatgaacacccgtctgcaggtggagcatccagtgacggaagcgatcactggcatggacctcgtgcaggaacagatcagggtcgcttctggtcagggcctgtcggtcacacaggctgatatcgaatttcatggccatgccatcgaatgccgtatcaatgccgaagacccgcgcaccttcgttccgtcgccgggcacactgacctatttccacacgccgggcggccttggcgttcgcgtcgattcgggtgcctatcagggctacaagatcccgccctattacgacagcatgatcggcaagctgatcgttcacggtcgcgaccgtgacgagtgcatccgtcgcctgcgtcgggcgctggacgaattcgtcgtcgatggcatcaagaccacgctgccgcttttccaggatctccttcagaacgaggatattctgaacggcgattacgacattcactggctggagaagtatctg

SEQ ID NO: 35395 - DNA, 906 bp, Agrobacterium tumefaciens
cgccatctcctcggcatcaaggggctttcccatcaggatatcaccctgcttctcgataaagccgacgaggcggtgaaaatcagccgtcagcgcgagaaaaagacctcgacgctgcgaggcctgacgcagatcaacctgttctttgaagcctcgacgcgcacgcaatcctccttcgagctggccggaaagcgcctcggcgcagacgtgatgaatatgtcggtcggcaattcctcggtgaagaagggcgaaacgctgatcgataccgcgatgacgctgaacgccatgcgcccggatgtgctggtggttcgccattcgtcggcaggtgccgcagcgctgctggcacaaaaggtcgcctgctccgtggtcaatgccggggacggccagcatgagcacccgacacaggcgctgctggatgcgctgaccatccgccgcgccaagggcgagctttcgggtatcacggtggcgatctgcggtgacgtgctgcattcgcgcgtcgcccgctccaatatcattctgctcaaccagatgggtgcgcgcgtgcgggtcgtcgcccccgccacgcttcttccctccggtatccgcgacatgagcgtggaagtcttcaacgacatgaaggaagggctgaagaatgccgatgtggtgatgatgctgcgcctgcagcgtgagcgcatgtccggctccttcgtgccttcggtgcgcgaatatttccactattacggtctcgacgccgaaaagctgaaagcggcgaaggaagatgcgctggtcatgcatcccggtccgatgaaccgtggcgtggaaatcgcctccgaagtggcggacggtccgcagagcgtcatcgaaagccaggtggaaatgggggttgccgtgcgcatggccgtcatggaaaccctgcttgtctcgcaaaac

SEQ ID NO: 35396 - DNA, 2061 bp, Agrobacterium tumefaciens
atggcaaagctcaaggttgacggtaaagagatcgaggttccggatcatttcacgctgttgcaggcgtgcgaggaggctggtgccgaagttccgcgcttttgttttcatgagcgcttgtcggtcgcgggtaactgccgcatgtgtctcatcgaggtgaagggcggaccaccgaagccggccgcctcctgcgccatgggcgtgcgcgatgttcgcggcggcccgaatggcgaattgcctgaggttttcaccaacacaccgatggtcaaaaaggcccgcgaaggtgtgatggagttcctgctcatcaaccacccgctcgattgcccgatctgcgaccagggcggcgaatgcgacctgcaggaccaggccatggccttcggtatcgccggttcgcgttacgcggaaaacaagcgcgcggttgaagacaaatatatcggcccgctcgtcaagacggtcatgaaccgctgcattcactgcacgcgctgcgtccgtttcaccacggaagtggccggcattgccgaactcggcctcatcggccgcggcgaagatgccgaaatcaccacctatctcgaacaggccatgacgtctgagcttcagggcaacgtcgtcgacctttgcccggttggtgcgctcacttccaagccattcgctttcaccgcccgtccgtgggaactgaacaagaccgaaaccatcgacgtgatggacgcgctcggttcggccatccgcgtcgatacccgtggccgcgaagtcatgcgcgtcatgccgcgtgtcaacgaggcgatcaacgaagagtggatttccgacaagagccgcttcatctgggacggcctgaagacgcagcgcctcgaccggccttacgtccgcaaggatggccggctgcagcccgccacttggggcgaagcctttggcgccatcaagcaggctgtagccgcaacgtcgggttcgaaaattggcgcaatcgccggcgatctgtcctccgtcgaagagatgttcgcgctgaagtcgctgctcgcttcgctcggctcggccaatgtcgattgccgtcaggatggcgcagcgcttgatccgtctttgggtcgtgccagctatatcttcaattccactattgaaggcatcgaacacgccgacgctctgctgatcgttggttccaacccgcgcttcgaagcggccgtgctcaacgcccgcatccgcaagcgctggcgtcgcggcggtttcccgatcggtgtgatcggtgaggccggtgagctgcgctacaattacgaatatctcggctcgggcgcggaaacgctttccgatctcgccaatggctcgcacagcttcatcgacaagctgaaatccgccaagaacccactgatcatcatcggtcagggcgctctggcacgtgccgatggtgctgccgttctcgcggctgctgcaaaacttgccgtttcggttggcgctgtcaccgaagagtggaatggcttctcggtgttgcacactgcggctgcccgcgtcggcggtctcgatatcggcttcgtgccgggcgagggcgctgttgctgccgccgagatggtgacgtccatggacgtcctgttcctactcggcgccgatgaaattgacctgtccaacaagggcgccaagttcaccgtctatatcggcagccacggcgatcagggcgcgatgaacgccgacgtcatccttccgggtgcggcctataccgaaaaatccggtatctgggtcaacaccgaaggccgtgttcaggtgggcaaccgcgccggtttcgcgccgggcgaagcccgtgaagactgggcgatcctgcgcgcgctgtccgacgtgctcggcaaaaagctgccgttcgattcgctgtctgccctgcgcggccagctttatgtcgcgcatccgcatctggcggaaaccgacgagatcgttgccggcaaggccacggatatcgaggcgctggctggtaaaaccggctcgctcacgaagtcggcgtttgcctcgccggtaaaagacttttatttgacgaacccgattgcgcgcgcctcagctgtgatggccgagtgctccgcattggcccgcaacaat

SEQ ID NO: 35397 - DNA, 2415 bp, Agrobacterium tumefaciens
atgacgaacatcacgtctgcggcatctggcggtacctatccggtacttcccctgcgcgacattgtcgttttcccgcatatgatcgttcccctgttcgtcgggcgggaaaaatccattcgtgcgctcgaggaagtcatgggctcggacaagcagatcatgcttgtcacccagatcaacgccagcgatgacgatccggctcccgaggccatccacaaggttggcacggtcgccaatgtgctgcagcttctgaagcttcctgatggcaccgtgaaggtgctggtggaaggcaagggccgcgcccagatcgacagctataccggccgcgaggatttctacgaagcctccgctacaccgctgcaggaacccgctgaagatccggtcgagatcgaggcgctgtcgcgttcggtcgtttcggaattcgagagctatgtgaagctcaacaagaagatttcgcccgaggttgtcggcgctgccggccagatcgacgattattcgaagctggccgatacggttgcttcgcacctgtcgatcaagatcaccgaaaagcaggaaatgcttgaaaccgtcagcgtgaagcagcggcttgaaaaggcgctcggcttcatggaaggcgaaatttccgtgcttcaggtcgaaaagcgcatccgctcgcgcgtcaagcgccagatggagaagacccagcgcgaatattatctgaacgagcagatgaaggcgatccagaaggaactcggcgacggcgaagacggccgtgacgagatggccgaactggaagagcgcatcgccaagaccaagctttccaaggaggctaaggaaaaggccgacgcggaaatgaagaagctgcgccagatgagcccgatgtctgccgaagcgaccgtcgtgcgcaactatctggactggttgcttggcctgccctggggcaagaagtcgaagatcaagaccgatctcaatgccgccgagacgatcctcgatcaggatcacttcggtctggacaaggtcaaggaacgaatcgtcgagtatctggcggtccaggcgcgcgcgaccaagattcgcggacctatcctgtgcctcgttggtcctcccggcgtcggcaagacctcgctcgccaagtcgatcgccaaggcgaccggccgcgaatatgtgcgtatggcgctcggtggcgtgcgtgacgaagcggaaatccgtggtcaccgtcgcacctatatcggctccatgccgggcaagattgtccagtcgatgaagaaggccaagaaggcgaacccgctcttcctgctcgatgaaatcgacaagatgggcatggatttccgtggcgacccgtcatctgcgcttctggaggttctcgatccggaacagaactccaccttcatggaccactaccttgaagtggagtacgacctgtccgacgtgatgttcgtgaccacggccaacacgctgaacattccgggtcccctgatggaccgtatggaagtgatccgcatcgccggctacaccgaagacgaaaagcgcgaaatcgccaagcgtcatctgttgccaaaggcgatcaaggaacatgccctgcgtccggaagagttctcggtcagcgacgatgccctgatggccatcagccagcagtacacccgtgaagccggtgttcgtaattttgaacgcgaactgatgaagcttgcccgcaaggcggtgaccgagatcatcaagggtaaatccacgtcggttgcggtcaccgctgcaaacatcgaggattatctgggcattccgcggttccgccacggcgaggccgaacgcgaggatcaggttggtgtcgtcaccggtctggcgtggacggaagtcggcggtgagctgctcaccatcgaaggcgtgatgatgccgggcaagggccgcatgacggtcaccggcaacctcaaggaagtgatgaaggaatccatttccgcggcggcatcctatgtccgttcgcgcgccgtggacttcggcatcgagccgccgcgcttcgacaagagcgacatccacgttcacgttcccgaaggcgcaaccccgaaggacggaccgtccgccggtgttgccatggcaaccgccatcgtctccatcatgaccggtattccggtctcgaaggatgtggcgatgacaggcgagatcacactgcgtggtcgcgtgctgccgatcggcggcctgaaggaaaagctgcttgcggccctgcgcggcggcatcaagaaggtgctgattccggaagaaaacgccaaggatctggcggagattccggacaatgtgaagaacgagatggaaatcatcccggtttcgcgcatgggcgaggttatcaagcacgctctcattcgccagccggaacccatcgagtgggatggcagcattgagacgcctgttatagcaacggtcgaaggtgtcgacgacggcaaccagacgatcgcgcat

SEQ ID NO: 35398 - DNA, 756 bp, Agrobacterium tumefaciens
atgtctggaatattcagcgggcaagtggtcgtcgtcacgggcggatcgaccggcatcggcttttcagtcgccaaattgtttctggaaggtggggcgtctacggtctatgtgacgggccgcaattcggccaatctcgatgccgccgtcgccaaacttgggaagggggcaatcggcttcgtttccgacgttgcgaagctctccgacctggagcagctcaagagccgcttagaagcagacgggcggaaagtggatgtactggtcgccaacgccggcatcgcggagaataacgatcttggcgagacccacgaggcactttacgaccggatcttcgatatcaacgtgaagggcgtattctacacggtgcagactttgttgcccgtgctgcgcgacggcggttcgatcgtattgacggggtcgatcgtcggcaacaagggcatggaaaggctgagtgcttacaatgcctcgaaagcggcggttcggtcattcgcccgcagctttgccaatgacctgaaggggcgtggcatccgcgtcaatacggtcagcccgggtgttacccgcacgccgatcatggaaaatggactgaagatggacgatgaaaagatcgccggtttcaaggcctatctgaaggatgcggcaccgatcggccggatggccgaccccgacgaaattgccgaggcggtgctgtttctggcgtcttccaaggccagctatattaccggtgtggaactttccgtcgatggtgggctggcgcagatc

SEQ ID NO: 35399 - DNA, 1254 bp, Agrobacterium tumefaciens
acgttggccgttcacgccggtgcgcagcctgatccgaccaccggcgcgcgcgcgacgccgatttatcagacgacggcctatgctttccgcgatgccgatcacgccgccgctttgttcggattgaaagagttcggcaatatctacacccgcatcatgaaccccacccaggcagttctggaggagcgcgtggcggcgctcgaaggcggcacggcggcgctcgctgtcgcttccggtcacgcagcacaattgctggttttccatacgctcatgcaatccggtgataatttcgtcgcggcccgccagctttatggcggctcgatcaaccagttcggccacgccttcaagggtttcgactggcaggtgcgctgggcggacgcggcagacccggcgagcttcgaggcgcagatcaatgagcgcacgcgcgccatcttcatcgaaagcctcgccaatcccggcggcaccttcgtcgatattgccgcgattgccgatgtcgcccatcgtcacggcctgccgcttatcgtcgacaataccatggcgagcccctatctgctgcggccgctggaacacggcgctgacatcgtgctgcattcgctgacgaaattccttggcggacacggcaattccatgggtggcatcattgtcgatggcggcaccttcgactggtcggcgacagacagatttccggcgctgtcgcagccgcggccggaatattccggcgtcctgttgcaccagaccttcggcaatttcgcctttgccatcgcctgccgcgttctgggattgcgtgatctcggcccggcaatctcgcccttcaacgccttccttatcctgaccggcatcgagacgctgccgctgcgcgttcagcgccattccgacaatgcactcgccgtcgcgaaatggctgaaggcacatccaaaggtcggctgggtgcattatgcgggcctggaggacagcgacaaccacgccatccagcagcattattcgccgaagggggcgggctccgtctttaccttcggcgtcaagggcggttatgccgccggcaaggcgctggtggaggggctgcagcttttctcccatctggccaatatcggcgatacgcgctcgctcgtcatccatccggcctccaccacccacgcccagctgacaccggaacagcagacggcagccggcgccgggccagacgtggtgcgcctgtcgatcggcatcgaagacgtcaaggacatcatcgccgatctcgaacagtcatttgccaaggtg

SEQ ID NO: 35400 - DNA, 801 bp, Agrobacterium tumefaciens
atctggggtattccgtttgacgcggcaacctccaaccggccgggtgcgcgcttcgggccgcaggcgatccgccgcgcgtccgcgatcttcgacaatgatccgcaatatcccttcgcgcgcgatcttttcgcccatatgccgaccatcgattatggcgactgcctgctcgactacggcaaccattggaaaacgcctgacacgatcgaaaaggaagcgcgcaggatcatctccaagacggattatctgctgacgctcggcggtgatcacttcatcacctggccattgctgaaagcgcatgtggccaagcacgggcgtctggcgctagtgcagttcgacgcgcatcaggatacatggttcgatgatggcaagcgcatcgaccacggctccttcgtggcgcgcgccgtgcgcgacggactgatagatcctgaccgttcgatccagatcggtattcgcacccatgcgcccgacgatttcggcatccgtattctccacggttacgaggtggaggatatgcgggcgagcgatattgcctcgctgatcgtcaagcacacgggcggcatgcctgcttacctgaccttcgatatcgattgcctcgatcccgctttcgcaccgggaaccggcacacccgtcgccggcggaccgaccagcgccaagattctctcggttctgcgcgggctcggccagcttgatattcgcggctctgacgtggtggaggtggcacccgcttacgatcatgcggatattaccgccattgccggggccaccgttgcaatgtatatgcttggcctgcgtgccgaacgg

SEQ ID NO: 35401 - DNA, 915 bp, Agrobacterium tumefaciens
aagatcttcatcgatggcgaacacggcaccacgggtctgcagatccgcacgcgccttgccggtcgccgcgatatcgagctgctgtccattccagagaccgagcgccgcaacgcggcgatgcgcgaggatttgctcaacaacgccgacatttcgatcctctgcctgccggatgatgcctcgaaggaggctgtctccatggtggccggcaacaataatgtccgcattatcgacacctccaccgcctatcgcgtccatcaggactgggcttacggttttgccgaaatggaccgggaccagggcgagaaggttcgctcggcccgtttcgtcgccaatcccggctgctacccgaccggcgcaatcggcctcatccgtccgctgcgcgctagcggcatcctgcccgacggttatccggtcagtgtcaatgcggtctccggttacaccggcggtggcaagcagatgatcgcgcagatggaggaccaaagccgcgacgatgcgatcagcgccaataatttcctgtatggcctgacgctgaagcacaagcacgtgccggaaatgaccattcacggtcagctcgaccgcgcaccgctgtttgcgccctccgtcgggcgtttcccgcagggcatgatcgtgcaggttccgctgtttgcagcggaccttgcggaaggcaccacgatcgaaaccatccatgcggcgctgaccgcccattatgcgggccaggacatcgtcagcgtcgtgccgcttgccgaaagcaaggggatttcccgcatcgacgctgaggagctggcgggcaaggacacgatgaagctcttcgttttcggtacgccgggcggtgagcatatcaatctcgtggcgctgctcgacaatctcggcaagggtgcctccggcgctgcggtacagaacatggagttgatgctc

SEQ ID NO: 35402 - DNA, 819 bp, Agrobacterium tumefaciens
gtcgtttcggcggactgggtggaaaaacaactcggcacggccgggtttcgtgtcgttgatgcgtcctggtatcttccggcgcacaagcgcaacggcgcggaggaatatgccgccggccacctgccgggtgccgtgttcttcgaccaggacaagatcgccgatcacacgaccggcctgccgcattccctgccctcgccggaattcttcgcgcaagaggccggcgaacttggtcttagcgagaatgatacgatcgtggtctatgacggccccggtttcttctccgcgccgcgtgtgtggtggatgctgcgggtgatgggcgtgcgcaaggcctatgtgctggatggcggcctcgacggctggaagcgcgaaggccggccgcttgaaaccggcacaccggagatcgaacccgccaccttcacacccgatttcaacgacaagcgcgtgacctcgctatcgaccatgcgcggcatcgtcgatagcggtgaaaagcagattgccgatgcccggggtgccggacgtttcaccggcgacgaggccgagccgcgtgccggcatgcgctccggccacatgcccggcgcgcgcagcctgccggcgatggccttttccgacaacggtcacttcaaggatctgaccgccatacgcaagatggtcaccgatgccggcatcgatctttccaagccagtggtgacaagctgtggctcgggcgtcaccgccgccgtcgttacgctggcactggaatcgctcggtcatcacgataactcgctctatgacggctcgtggtcggaatggggtgggctcgaagatacgcccgtcgtcacc

SEQ ID NO: 35403 - DNA, 2430 bp, Agrobacterium tumefaciens
attgcgatcgacggcatgacctgcgcctcctgtgtgggtcgtgtggagaaggcgatcgccagggtgccgggcgttttgaaggcctcggtcaatcttgcgacggagcgtgccgatatctccttttccggaccacctgatgtgcccgccgtgattgccgctgtacggcatgcgggttatggcgtcgaagaaaaaaccgtcgaactcgatattgaaggcatgacctgcgcctcctgcgtcggacgtgtcgaaaaggcgctgaaggctgtttccggcgtttccgatgcaagcgtcaatcttgcgaccgagcgcgccgccattcgtgtggcgggcaatgccgcttccgccgccactctggcggaggcgatcaagcgggcgggctatcaggcgaaagagatcgtcgccgacaaagccggcgatgcggaacaggacaggcgcgcagcggacatgcgcagtctgaaaatcagccttgccgtcgccgttgtcctgacattgccggtcttcgtgctggaaatgggttcgcacctggtgcctgccatccatgatttcgtcatggaaacggtcggcatgcggaaaagctggtatctgcaattcgtactgaccacgctggtcctattcgggcccggcctgcgcttcttcaagaagggcatacccgcccttatgaggctcgcgccggacatgaattcgcttgtggtgctgggcactgccgccgcctggggattttcggtggtcgcgaccttcctgcccgaaatcctgccgcgcggcacggccaatgtctattatgaggccgcggcggtcatcgtcacgctgatcctgctcggccgtttccttgaagcgcgcgccaaaggccgcaccagcgaggcgataaagcggctcgtcggtcttcaggccaagtcggcccgcgtgctgcgcgacggcgaaaccatcgatgtgcctcttcaggacgtgcgaacgggcgatgtgatcgtcgttcgccccggcgagaaagtgccggtcgacggtctggttctcaacggatcttcttatgtcgatgaatcgatgatcacgggtgagccggttccggttaccaagaccgagggttccgaggtcgtcggtggcacggttaaccgcaatggctccttcaccttccgcgccaccaaggtcggcagcgatacgctgatcgcgcagatcatccgcatggtagaagaagcgcaggccgacaagctgcccattcaggcgctggtggacaaggtgaccaactggttcgtgccagccgtgatgctggcggcacttgtcaccttcgccgtctggttcgtctttggacccgatccggccttgaccttcgcgctcgtcaacgcggttgcggttctcatcatcgcctgtccctgcgccatgggccttgccacgccgacgtcgatcatggtcggcaccggtcgcgccgccgaaatgggcgtgctgttccggcgcggcgatgcgctccagacgctgcgtgacgccgatgtcatcgcggtcgacaagaccggcacgctgacactcggcaagccgaaactggtgcattttaatacgacccagggtttcgatgcggatgaggtgctgcggctcgtcgcctcgcttgagaaccggtctgaacatccgattgccgaggcgatcgtcgaggctgcaaaacatggtggcctgacgcttgccgaagctgaagctttcgaggcgacccccggcttcggtgtcgcggcgacggtcgatggtcgcagggtagaggcgggtgctgaccggttcatggtgaaactcggttatgatgtcggggcctttgccacggatgccgagcggatgggcagggaagggcagtcgccgctttatgccgccgtcgatggccggctggccgcgatcatcgccgttgccgatcccatcaagcagacgacacccgaggcgattgcggcgctgcatgcgctgggcctcaaggtcacgatgatcacgggtgacaatcgccgcacggcggaagccattgcccgtcgcctcggcattgacgaggtggtggccgaagtgttgcccgacggcaaggttgaggcggtcaagaggctagccgccggcgggcgacgggtcgcctttgtcggggacggcatcaatgatgcgccggcgcttgccgcagccgatgtcgggcttgccatcggcacgggcacggatgtcgcgattgaaagtgccgacgtggtgctgatgtccggcgatctgcgcggtgttgccaacgcgattgctctctccaaggcgacgatccgcaatatccgccagaatctcttctgggccttcgcttacaatgccgcgcttgttcccgtggcggccggcatattgtatcctgtcaacggcgttctgctgtcgccagtccttgctgccggagccatggcgctttccagcgtcttcgtattgacgaatgcgctgcgtcttaaaagcttccgtgcaccgctg

SEQ ID NO: 35404 - DNA, 966 bp, Agrobacterium tumefaciens
atccgctctatagtccgtggtttcggggcagcgctgccgaagcgtgtcatgaccaacagtgaaatcgaaggggtcgtagagacctccgatgaatggatcgtgcagcgcaccggcatcaggcaacgctatatcgccggcgaaggtgaaaccaccgcgtctctcggcgaggcggcggcgcgtgcggcgctcgacaatgccggtctgacgcccgccgatatcgacctcatcattctggccacctcgaccccggacaatacctttccggcaacagcggtgaacatacagaaccgtcttggcatgacccacggtttcgccttcgacatgcaggccgtctgctccggtttcgtttacgccgtggcgaccgccgatctctatattcgcggcggaatggccaagcgcgtgctggtgataggcgccgaaacattctcgcgcattctcgactggaaggaccgcaccacctgcgttctgttcggtgatggcgctggcgcactcgttatcgaggccggcgaaggcgagggcacttccagcgatcgcggcatcctcacctcgcagctgcgctccgacggttcgcacaaggacaagctctacgtcgatggcggaccttccacaactggcacggtcggccatctgcgcatggaaggccgggaagtgttcaagcatgctgtcggcatgatcaccgacgtcatcgagcaggccttcgaggcgacgggcacgacggcggacgatctcgactggctcgttccgcatcaggccaacaagcgcattatcgacggatcggcgaagaagctcaatatcgatccggaaaaggtcgtcatcaccgtcgacaaacacggcaatacctcggccgcatccattccgctggcgcttgcagtcgcggccagtgacggccgtatcaagaagggcgatctggtgatgctggaggccatgggcggaggtttcacctggggtgcagtgctgctgcgctgg

SEQ ID NO: 35405 - DNA, 966 bp, Agrobacterium tumefaciens
cgcatgcggcgcaatcgcaaggcggattggacgcgccgtctggttcaggaaaatcgcctgaccgttgatgacctcatctggccggttttcatcgtgcctggcagcaatattgtcgagcccattccggctatgcccggtgtcaaccgcatgagcgtcgaccggctggtggaagcggcgaaggaagccgccgatctcggcattcccgcaatcgccacctttcccaatatcgagatggagctgcgcgacgagaccggctcgaatgcgctcgaagccaacaatctcatcaatcaggcgacgatcgccgttaaaaaagccgttccaaatatcggcatgatcaccgatgtcgcgctcgatcccttcaccagccatgggcatgacggcattctgcggggcgacgagatcgtcaatgacgaaaccgtcgagcaggtcgtcacggccgccatcctgcaggcggaagccggttcggacattatctccccctcggagatgatggatggccgtatcggcgccatccgtcgcggtctcgatgccgccgggcaccagaatgtcggcatcatggcctatgcgacgaaattctcctccggctattatggtccctatcgcgaggcgatctccaccgccggcctgctgaagggcgacaaaaacagctattacatcagccccgccaacggcatggaagcgatccgcgatgcggcgcttgacgtcgaggaaggcgccgacatgctgatggtcaagcccggcctgccctatctcgacatctgctggcggctgaaggagaatttcggcctgcccaccttcgcctatcaggtgtccggcgaatatacccagatcaaggccgcggccatgaatggctggatcgacggcgagcgcgtgatgatggaaacgcttctctgtttcaagcgtgcgggttgcgacggtattctcacctatttcgccatcgaggcagcacgcaaactggcaaagcac

SEQ ID NO: 35406 - DNA, 1071 bp, Agrobacterium tumefaciens
atgagccagtcgggcaagaacggtcttacctatagcgatgcgggtgtggatatcgacgccggcaacctgatggtcgagaagatcaaaccggcggtgcgctccacgcggcgtcccggcgcggatggcgaaatcggcggcttcggcggcctgttcgatctgaaggccgcaggtttcaccgatccggttctggtcgccgccaatgacggcgtcggcaccaagctgaagatcgccatcgacgctgactatcacgacaccgtcggcatcgacctcgtcgccatgtgcgtcaacgatctcgtcgtccagggcgcagagccgctattcttcctcgattatttcgccaccggtaagctcgatcccgatcagggtgctgccatcgtttccggcatcgccgccggttgccgcgaatccggctgtgcgctgatcggcggcgaaaccgctgaaatgcccggcatgtattccgatggcgactacgacctcgccggctttgccgtgggcgcggccgaacgcggccagcttctgccggccggcgatattgccgaaggcgacgtcattctcggcctctcctcctccggcgtgcactccaacggcttttcgctggtgcgcaagatcgtatcgctctccggtctggaatggagcgctcccgcaccctttgccgatggtaagaagctcggcgaagcgctgctgaccccgacccgcatctatgtgaagccgcttctgaaggcgatccgcgagaccggcgcgctgaaggcgctggcacatattaccggcggcggttttccggagaatattccgcgcgttctgcccaagcatctcgccgccgagatcgatcttgcagccatcaaggttccggccgtcttctcctggctcgccaagaccggcggcgtcgaagcccatgaaatgctacgcaccttcaattgcggcgtcggcatgatcgtcgtcgtttcggctgaaaatgccaccaaggtcaccgaggcgctcacggcggaaggcgagaccgtcttcccgctcggccgcatggtcgcccgcgaagacggcgcgcacggcacgatctacaagggcactctcggccta

SEQ ID NO: 35407 - DNA, 2117 bp, Agrobacterium tumefaciens
ttgcgaccccgatttccgctgaaaaagccgcctccaaggccgaagtccgtattggccatacggtctgcccgcatgactgtccgagcgcctgcgcgctggaggtcgatatcaatgccgatggccgcatcggccgtgtgcgcggcgccaatgccaatacatataccgccggcgtcatctgcgccaaggtggcgcgttattccgagcgcatctaccatcccggccgcctgctgacgccgaagcgtcgcaagggcgcaaaaggggcgggcgactggcaggagatttcctgggaagcggcgctggacgaggtggcagacgctttcgtcaaggcggaagcccggcacggtgccgaggccatctggccctatttttacgccggcacgatggggcaggtgcagcgggactccattgaacgtctgcgccacgccaaaaaatactccggcttcttcggttccatctgcaccaacatggcctggacgggctatgtgatgggcaccggcgcgctgcgcggccccgatccgcgcgagatcggcaaggccgatgtcgtcgtcatctggggtaccaatgcggtggccacccaggtcaacgtcatgacccatgcggtgaaagcccgcaaggagcgtggcgcaaagatcgtcgttgtcgatatctacgacaatccgaccatgaaacaggcggatatgcgcatcgttgttcgccctggcacggatgcggcactggcctgcgccgtcatgcacatcgccttccgcgacggttatgccgatcgcaattacatggcccgcttcgccgacgatccggcggggctcgaagcgcatctgaagtcaaagacgccgcaatgggcatccgagatcaccggtctttccgtggaagagatcgaggctttcgcgcggctcgtcggcacgacgaaaaagaccttcttccggctgggttacggttttgcccgccagcgcaatggcgcggtcgcgatgcatgcggcgctttccatcgccacggttctcggctcctggcaatatgagggcggcggcgcattccacaataatggcgatatcttccggctcaacaaggcggagctgatgggcacagcctatgccgaccccgacgtgcgccagctcgaccagtcgcagatcggccgcgtgctgacgggggacgcggaagcgttgcgccatggcggcccggtgacggcgctgctcatccagaacaccaatcccgtcaatgtcgcgcctgaacagcggctggtgaaacagggcttcctgcgcgacgatctcttcgttgcggtgcacgagcagttcatgacggagacggccgaggtggccgatatcgttatgcccgctaccatgttcctcgaacatgacgatatctatcgcgccggcggccaaaaccacattctgctcggccccaaactggtggagccgccggaaacggtgcgcaccaacctcttcgtcatcgaggaactggcaaagcgcctcggtgtcgaccatatgcccggcttcggcctctctgcccgcgagcatgtcgaccgtatgctcaaagtcagcggctggggcgatttcgaaagcctggcggaagagaaatggatcgatgcgcagccgcctttcgagatggcgcattatctcgagggttttggttatggcgacggaaagttccgcttcagccccgactgggcaaccggaccgtctccgaacaagccgccgaagaacatcggcgtcatggggccggtttcggagtttccgaaattcccggatcaggtcgatgtcatcgaggttgcggatgcggaccatcccttccggctggcgacgtcaccggcacgcaacttcctgaactccaccttcgccgaaaccaaaacctccgtgcagaaggaaggccgtccggaattgatggtctgtcccgaggatgctgcccgcaacgatattgcggatggtgatatcgtccgtatcggcaatacacgcggcgaagtgcgtctccatgcaaagatcgtggagggcgcacggcccggtgtgctgattgccgagggtctgtggccgaacaaggcacatctggacggcgagggcatcaatgttctgaccggtgccgatgccgttgcgccttatggtggcgccgcgtttcacgacaacaaagtatgg

SEQ ID NO: 35408 - DNA, 711 bp, Agrobacterium tumefaciens
aagacagtcttgataacgggcgccgcccgccggctcgggcgggcaatcgcctccgatctcgcagcccacggctttgcgattgccgtccatgccaatgaatccatggcgcaggcggaggaattcgctaacgaaataaggcaaaagggtggcagagccacggccgttcaggcagatctgacacaatctgcgcccaccatggcgcttgtcgaaaaggccgccgccgcgcttggcccgatcggcgtcgtcgtcaataatgcatcggtttttctcgccgataccgccgaaacgcccgatccggccgttttcgatgcccatttcgcggtgcatgtgcgggccccttccctcatcgccgccgcctttgtcgagcaactgcccgcggagaaatccggcctgatcgtcaatatcatcgaccagcgtgtgcttgcgctcacgccgcgtttttattcctacacgctttcgaaatcgacgctgtggaccgccacacggactatggcgcagagctttgcgccgcgcgtgcgggtcaatgccatcggccctggtcccaccttcaaaagcgaaagacaggcgccccaggactttcaggcgcagatcgacggccttatattaaagcgtggtcccgcgccggatgagttcggccggacgattcgctttctttacgatacgccgtcgatcaccggacaaatgatcgcgctcgatggcggccagcatctt

SEQ ID NO: 35409 - DNA, 420 bp, Agrobacterium tumefaciens
atggcgattgaacgcacattttcgatgatcaagccggacgcaaccaagcgtaatctcacgggcgcgatcaccaaggtatttgaagacaacggtctgcgcatcgtcgcctccaagcgcgtctggatgagcaagcgtgaagcagaaggcttctacgccgttcacaaagagcgtcccttcttcggtgaactggttgaaggcatgacttccggcccgaccatcgttcaggttctggaaggcgaaaatgccatcctcaagaaccgcgaaatcatgggcgctaccaacccggcccaggccgctgaaggcaccatccgcaagtccttcgcgctctccatcggcgaaaactccgttcacggttccgacgctccggaaaccgctgcacaggaaatcgcctactggttcgccgaaaccgaaatcgtcggc

SEQ ID NO: 35410 - DNA, 1260 bp, Agrobacterium tumefaciens
ttggcgatgaggcgtgtcgttatcaccggtaccggcatggtatctcctcttggatgcggaacggaagtgacctgggagcggctgttggccggccagaatggtgcccgtctcgtgactgaattcgaggtcgaagacctgcccgcaaagatcgcctgccgcattcccgtcggcgacggctccaacggcaccttcaatgccgatgactggatggagcccaaggaacaacgcaaggtcgatcctttcattctctacggcatggctgccgccgacatggcgcttgccgacgcaaactggcatccggaaacggacgacgaccagatcgctaccggcgttctgatcggctccggcattggcggtctggaaggcattgtcgaggcgggttacacgctgcgcgacaagggcccacgccgcatttctccattcttcattcccggccgtctgatcaacctcgtatccggtcaggtttccattcgccacaagctgcgtggaccgaatcattccgtggtaacggcctgctcgaccggcgcacacgctatcggcgacgccgcccgactgatcgcgcttggcgatgccgaggtcatggtcgccggtggtgccgaatcgccggtctgccgcatttcgctcgccggatttgccgcctgcaaggcgctctccacccagcacaatgacgatccgcaaaaggcctcgcgcccctatgatcgcgaccgcgacggtttcgtcatgggcgagggtgccggcatcgttgttctcgaagaactcgaacacgccaaggcgcgcggcgcgaagatttacgccgaagtcgtcggttatggcctgtccggcgatgccttccacatcacggcgccgtccgaggatggcgacggtgcgtatcgctgcatgtccatggcgctgaagcgcgctggcctcacgcctgacgatatcgactatatcaacgcccacggcacctccaccatggccgacacgatcgagcttggcgcggtcgaacgtctggtcggcgaatctgctccgaagatttccatgtcttccaccaagtcggccaccggccatcttctcggcgctgccggcgcaatcgaggcgattttcgcgacgcttgcgatccgcgacaatatcgttccgccgacgctcaacctcgacaatcccgatgtcgagacgaagatagacctcgtgccgcacaaggcccgcaagcggcaggtcaatgtggcgctttcgaattccttcggtttcggcggcaccaacgcatcgctcgtgctgcgtcgttac

SEQ ID NO: 35411 - DNA, 234 bp, Agrobacterium tumefaciens
atgagcgatatcgcagaacgcgtaaagaaaattgtaattgatcatcttggcgttgacgccgacaaggttgtcgaaggcgccagcttcattgacgatctgggcgctgattcgctcgacaccgttgaactggtcatggctttcgaagaagaattcggcgttgaaattcccgacgacgcagctgactcgatcctgactgtcggcgacgccgtcaagttcatcgagaaggcccaggcc

SEQ ID NO: 35412 - DNA, 735 bp, Agrobacterium tumefaciens
atgttagatttaacaggccgcaaagccctcgtaaccggcgcgaccggcggcattggtgaggaaatcgcccgccttctgcacaagcagggcgcaaccgtcggcctgcacggcacgcgcgttgaaaagctcgaggctctggcggcggaacttggcgaccgcgtcaagattttcccggctaaccttgccgaccgcgccgaggtcaaggctctcggcgaaaaggccgaagccgagctggaaggcgtcgacattctcgtcaacaatgccggcatcaccaaggacggcctcttcgtgcgcatgagcgacgaggactgggacaacgtcatcgaggtgaacctgacggcgatgttccgcctgacacgtgaactgacgcatccgatgatgcgccgccgtttcggccgtatcatcaacatcacctccatcgtcggcgtcaccggcaaccccggccaggccaattattgcgcctccaaggccggcatgatcggtttttcgaagtcgttggcgcaggaaatcgccacccgcaacgtcacggtcaactgcgtggcaccgggcttcatcgaaagcgcgatgaccggcaagctgaacgacaagcagaaagacgccattatgggcgccattcccatgaagcgcatgggcaccggcgccgaggttgcgtcggccgttctttatctggcttccaatgaggcagcctacatgaccggccagaccctgcacgtcaacggcggcatggcgatgatc

SEQ ID NO: 35413 - DNA, 927 bp, Agrobacterium tumefaciens
atgggtattgcattcacatttcccggtcagggaagccaggccgtcggcatgggcaaggagctggcggacacctacccggaagcgcgcgccgtgtttcaggaagtcgacgacgcgctcgaccagaagctttccgacatcatgtggaacggaccggaagaaacgctgacgctgacggccaacgctcagccggcgctcatggccgtttcgatggcggtgatgcgcgttctggaagcgcgtggcctgaagctgtccgatacggtgtcttatgtggccggccattcgctcggtgaatattcggcgctctgtgccgccggcaccttctcgattgccgataccgcccgtcttctgcgcatccgcggcaatgccatgcaggccgccgtgccggtcggcgagggtgccatggctgcaatcatcgggctcgagcacgatgccgtttccgccatttgcgaggaagccggcattctcggcgtctgccagatcgccaacgacaatggcggcggccagctggtcatttctggtagcaagactgccgttgaaaaggccgcagcgatcgcttccgaaaagggcgccaagcgcgccatcatgctgccggtttccgcccccttccactccgcgctgatggcgccggcggcggaagcgatgcgcgaggcgctggcgaaagttgaaaagcacaatccggtcgtgcctgttgtcgccaatgtgcgcgccgctcccgtttccgacgccaatgagattgccgctttgctggtcgagcaggtgacgggccaggtgcgctggcgcgagacggtggaatggtttgccgccaataacgtgacccagctttacgaaatcggctccggcaaggtgctgacaggccttgcccgccgtatcgacaagacggtgaacggcgttgccgtcaacggtgcggccgatatcgaccagctgcta

SEQ ID NO: 35414 - DNA, 1038 bp, Agrobacterium tumefaciens
atgaaacagaaactattgggtcgcacgggcatctccgtgtctgaaatctgcctcggcaccatgacgtggggcacgcagaacactgaagccgaagcgcatgcgcagatggattacgccatcgaaaacggcgtcaatttcttcgatacggccgagctttatcccaccacccccgtttccgccgaaacgcagggacgaacggaagactatatcggtgcgtggttcgaaaagaccggcaagcgtgaccaggtcgtgctcgccaccaaggtcgccggctcgggccgtgactatattcgcggcggtcgcgacatcgatgccgcctcgatccgcgaggcggtggataccagcctcacgaggctgaagaccgattacatcgacctctaccagattcactggcctaaccgcggcacctaccatttccgcggcgcctggggtttcgatgcttccgggcaggacaccaagcgcacgcttgccgaaatcaccgaaaagctcgagacgctcggcgaactggtgaaggcgggcaagattcgcgccatcggcctttccaacgaaagcgcctggggcacacagaaatatatcgatatcgccgaggccaacggcctgccgcgcgtcgccaccatccagaacgaatataacctgctctatcgcagcttcgacctcgacatggcggaagtcgcccatcacgaggatgtcggcctgctcgcctattcgccgctcgcggcggggctgctgacaggcaaataccagaacggcgcccgcccggcgggctcgcgcggcaccatcaacaaggatctcggcggccgcctgcagccgcatcaggaagcgccggtcaaggcgtatctggaccttgccgccgcacacggggtagacccggcccagctcgccatcgccttctgcctcacccgcccgttcatggcctctgccatcatcggcgcgaccaccatggaacagttgaaggtggatattgcggcggtggatgtggccctgtcggaagacctgctgaagggtattgcggcgatccaccggcaatatccgatgccg

SEQ ID NO: 35415 - DNA, 660 bp, Agrobacterium tumefaciens
ctcaagggccgcatcgctctcgttaccggcgcttcgcgcggcatcggctatttcacggcgctggaactggccaaggccggcgcgcatgtcatcgcctgcgcccgcacggtcggcggccttgaggagcttgacgacgccatcaaggccgttggcggcacggcgacgctggttcccttcgatctcgccgacatgaaagccatcgatgcgctgggcgccaatatctacgagcgctggggcaagctcgatattctggtcgccaatgccggcgttctcggcgtgatttccccggttggccatatcgaggcgaaggtcttcgaaagggtcatgaacatcaacgtcaccgccacctggcggctgatccgctcggtggagccgctgctgttgaaatcggatgccggccgtgcgctgattctgtcttcgggtgtcgcccatagctgtcgccccttctggggcgtctacgccacctccaaggccgccgtggaagcgctcgcccgcacctgggccgcggaaacgcagaagtccccgctgcgcatcaacagcatcaatcccggcgccacgcgcaccgccatgcgcgcccaggccatgcccggcgaggacccggcaaccgtgccgcatccgtccgaagttgccgctgccatccttcccctcgcctcgcccgac

SEQ ID NO: 35416 - DNA, 1443 bp, Agrobacterium tumefaciens
ctcgcctatcgtaccttcgtgcacatgcaccggctttcgctgcgtttccatctggagcgcaagaccggcgggctgtcgcgggtcatcgagcgcggcacgaagggcatcgaaaccattgtccgcttcaccattctcaataccgcaccgaccttcatcgaattcctgctgacggccatcatcttctgggcgtcctatggtttttcctatgtgctggtcaccgtcgtcaccgtctgggcctatatctggttcacggtcagggccagcaactggcgtatcggcatccgccgcgccatgaatgacagcgataccgacgccaataccaaggcgatcgattcgctactcaacttcgagaccgtcaaatatttcggcaatgaggaaatggaggcacggcgtttcgacgtcgccatggagcgttacgaaaaatcggcgatctcgatctggacctcgctcggctggctgaactttggccagggcgtgattttcggcatcggctccacgatcatgatggtgatgtcggcactggccgtgcagcgcggcgagcagaccatcggcgatttcgtgttcgtcaatgcgctgctgctgcagctttccgtgccgctcaatttcatcggcttcgtttatcgcgaaatccgccagggcctgaccgacatcgaacagatgttcgatcttctcgaggtggaggccgaagtcaccgacaggccggatgcgaagccgcttgcggccggtcccggcgcgatctccttccgcgacgtgcattttgcctacgaccctgaaagaccgatcctcaagggcgtttccttcgatgtgccggcgggcaagacggtggcgatcgtcggcccttccggtgcgggaaaatcgacgatctcgcggctgctttatcgtttctacgatattcaggagggcgccgttaccatcgacgggcaggatattcgcgacgtgacgcaaaagagcctgcgctcgatgatcggcatggtgccgcaggataccgtgctgttcaacgacaccctcgcctacaatatccgctacggtcgcccctccgccaccgacgaggagctgaaggcagcggcggatgcagcgcagatcagcgccttcatcggcaaactgccggacggttacgccaccatggtcggcgaacggggactgaagctttcgggtggcgaaaagcagcgcgtggcgattgcccggaccattctcaaggcaccgccgatcctgatcctcgacgaggcgacctcggcgctcgatacgcataccgagcaggaaatccagagcgccctcgacatcgtctcgaaaaaccgcaccacgctggtcatcgcccaccgcctctccacggtcatccacgcggacgaaatcatcgtgctgaaggaaggactgatcgccgagcggggaacgcatgcctcgctgatggcgcatgatggcctctacgcctcgatgtggagccgccag

SEQ ID NO: 35417 - DNA, 648 bp, Agrobacterium tumefaciens
ttgagcggcgtacgccttgccatcgaaggccgctttgaactcgccgtcggtatggtgctcctcgccgcctttctcgacggcgtggacgggcgtgttgcccgcatgatgaaggcgacctccaaattcggcgagcagatggattcgcttgccgatatcgtcaatttcggtgtcgctcctgctctcgtcgtctatatctatctgctcgatcaggcgcgttcgattggctggatcggcgccctcatctatgtcattgccgccggcctgcgcctggcgcgcttcaacgtcatgatcgagcggccggtaaaggcgccttggcagagcgaattttttgtcggcgttccggccccgatgggcgcgatgctggtgcttctgccggtctatctcggcttcctcggcgtggagccggacaagcccttcgcttacgtcgccgccgcctacaccgtcctgatcggttatcttctcatcagccgtctgccggtctggtcgggaaagtccagtacccgcattcgccgtgatctggtgctgccgatgatcctcgtcgtcgtgctctatgtggcgatgctgatgagcttcacctgggaagttctggttctgacggtcgccgcctatctcgtcttcattcccatcagcgcccgcctctggcatcgc

SEQ ID NO: 35418 - DNA, 1179 bp, Agrobacterium tumefaciens
cgccagaccatgccctggctgatcatcgcagccgggtcgctgattgcggtcatgaccttcggtccccgttcggccatggggttcttccagttaccgatgcttgccgataccggctgggatcgttccaccttcggtcttgccatggctttgcagaacctgttctggggtcttggccagccgttcttcggcgcgattgcggataaatacggcacgggccgcgtgctcgttctgtcaggcattctttatgccgcaggtctcgtctgcatgtccttcggcacctcgcccttctggctgcattttggcggcggcgtgcttgtcgggcttggcattgccgccggttccttcagcgtcattctttccgccttcgcgcgccatgtcacgccgcagcagcgctcgcttgccttcggcatcggtacggcggcgggttcggccggcatgttcctgtttgcacctatcagccaagggctgatttccgcctatggatggtcggacagcctcgtctggctggctgccatgatggtgctcgttccgctgctggcatggccgatgcgcggcaattcctcctccggcagccagtcgcaggcgcagtttcagcagacggtgggcgaagcgctgaaggaggcgcttggccacaagagctatctgcttctgaccaccggtttcttcgtctgcggttttcaggtggccttcataacagcacatttcccggcctatctcggcgatatcggcatagaaccacgttacgcggtcatcgccatggcgctgatcggcttcttcaacatcattgggtcgcttgccgccggggttatcgcccagcgttattcgaaaccctatctgctcgcctatatctatattgcccgctcggtcgtggtcacggccttcctgctgctgccgcaatcgccgctttcggtcatcctcttcgcctccttcatgggcattctgtggctttccaccgtgccgcccaccaatgcgctggtggcgatcatgttcggcacccgtcacctcggcatgctgggcggcgtggttttcctcacccaccagatcggctcgttcctaggcgtctggctgggtggcttcctttatgaccggttcggcacctacgatatcgtctggtggctcggcgttggcatggggatttttgcggccatcgtgcactggcccattcaggagcgaccggca

SEQ ID NO: 35419 - DNA, 921 bp, Agrobacterium tumefaciens
atgttcaagggatcaattcccgccctcattaccccgttcacggacaatggttccgtggacgaaaaggcctttgccgcccatgtggaatggcagatcgccgaaggcagcaacggccttgtgcccgtgggcacgacgggggaatccccgacgctctctcacgatgagcacaaacgggtcgttgagctgtgcatcgaggttgcggcgaaacgggttccggtcattgcgggtgctggctccaacaataccgatgaagcaatcgagcttgcgctgcacgcgcaggaggccggtgcggatgccctgctggtcgtcactccctattacaacaagccgacgcagaagggcctgttcgcgcatttttccgctgtcgccgaagcggtgaaactgccgatcgtcatctacaatatcccgccgcgctcggtggtggacatgtcgccggaaaccatgggtgcgctggtcaaagcgcataagaatatcatcggcgtcaaggatgcgaccggcaaactcgatcgggtttccgaacagcgcatttcctgcggcaaggattttgtccagctgtcgggcgaggatggcacggcgctcggctttaacgcccatggcggcgtcggctgcatttcggtcaccgccaatgtcgcgccgcgcctttgttccgagtttcaggcggcaatgcttgccggtgattacgccaaggcgcttgagtatcaggaccgcctgatgccgctgcacagggcgatcttcatggagcccggcgtctgcggcaccaaatatgcgctgtcgaagacacgcggcggcaatcgccgggtccgttcgcccttgatgagcacgctggaaccggcaacggaagcggcgatcgatgcggcgctgaagcatgccggcctgatgaactgagatacgcctgaaaagcttgaaaggcgcgccatggac

SEQ ID NO: 35420 - DNA, 1032 bp, Agrobacterium tumefaciens
gaggccatcgagcgcagccgcggcctgaaggtggaagcgcgcatcggcgccaatgaaagcggcttcggccccgcgccttcagtgcttctcgccatgcgggacgcggcggcggagacctggatgtacagcgatccggaaaatttcgagctgaaggaagcgcttgccattcaccacggcgttgcacgcggcaatatcgccatcggcagcggggttgatggattgctgggggagatcgccaggctgatcgttgagccgggcacgcctgtcgtcacctcgtttggcggctatcccactttcaattaccatgtgaacggttttggcggcaaactcgtcaccacgccctatgtcgatgatcacgaaaatcttgacgggcttctcgatctcgtcatccgggaaaatgcgccgctcgtctatttcgccaaccctgataatccgatgggaagctggtgggaggcgagcgaagtcgtcgccttcgcccgcgcattgccggaaacctgcctgctcattctggacgaggcctattgcgaaaccgggcccatcagcgccgtgccggccatcgacgcgctgatcggccaaccgaatatcctgcgcatgcgcaccttttcgaaagcctatgggctggccggtgcgcgcgtgggttatgccatcggcacgctcggcaatgtcgaagccttcgacaagatccgcaatcatttcggcatggcgcgtatttccgtcgccggcgccctcgcggcgctgaaggatcaggcctatctgcatgaggtggttggcaagatttccgatgcccgcgatcgtatttccgcgatcgcccgcaataacggcctttcgccgctgccgtcggccaccaatttcgtcaccatcgattgccaccgcgacggcgcttatgcccgcgccatcgttgatgggctgatggaccatggcgtgttcatccgcatgccgggcgttgccccgctcaaccgctgcattcgtgtcagcgccggcaccgccgacaagctcgatcttttcgagcaggcgctgccaaaggttctcaag

SEQ ID NO: 35421 - DNA, 1329 bp, Agrobacterium tumefaciens
atgtccaatctcgcggccatcgatgccgcccatcaccttcaccccttttccgacatgggcaagctgaatgccgccggcacccgcatcatcgagcgcgcggaaggggtcttcatctacgacagcaccggcaagaaatatctcgatgcctttgccggcctctggtgcgtgaatatcggttatggacgccgcgagatcgccgatgtcgtgcagcgccagatgaacgagctaccttactacaacgcctttttcggcaccaccaccccgcccgcgacgcttctggcgcaaaagatcgcctcgcgcgccgggccgaagatgaaccatgtgttcttcaccaattccggttcggaagccaccgacacctggttccgcatggcgcgggtctactggaaggcgcttggccatcccacgaagaccagggtgatcgcaagacgcaacggctatcatggctcgacggtagccggcgcttcgctcggtggaatgaaatggatgcatgaacagggcaacctgcccatcgaaggcatcgcccatatcggccagccctattggtatgccgagggtggcgatctctcacccgccgaattcggcctgaaggtggctcgggaactggacgccaagatcgatgaactcggcgaggaaaatgtcgccgctttcgtggccgaacccattcagggcgcaggtggtgtcatcgtgccgccggagacctactggccggaaatcgcccgcatctgcaaggcgcgcaacattctgctggtgtccgacgaggtgatctgcggtttcggccgtctcggttcgtggttcggataccagcattttggcgtggagccggatctcgctcccgtcgccaagggactgtcatcgggttatctgccgatcggtggtgtcatcgtttcagaccgggtggcggaggtgatgctttcagaggtcggtgatttcaaccacggtttcacctattccggccatcccgtctgtgctgccgcggcactggaaaacctccgtatcattgaggatgaggggctggtggagcgggtacgtgacgatatcggcccctatttctccgagggctggaaaagccttgccgatcatgaactggtgggcgaggccgtgaatgttggcctgatgggcggtttgcaactgacggcggacaaggcaacccgcagacgtttcgccaagccggacgatatcggaaccgccgtgcgcaaccattgccttgcaaacggcctcgtcatgcgtgccacgggagatcgcatgctggcctcgccggcgctgaccgtcagccgttccgaagtggacgagatcatcgagacgctgcgccaggggctcaaccacctg

SEQ ID NO: 35422 - DNA, 783 bp, Agrobacterium tumefaciens
atggatttcggcatttccggcaaacgcgccctcgttctcgcctcctctcgcggccttgggctgggcattgccaccgcgctggcgaaagagggcgcaaacgtccttctggttggccgaagcggtgaaaagctggcggaaaattgcaaggcgatcaatgcgctcggcaagggcaaggccgactgggtgtggggtgatcttgccgatgacaatttcgtcgaatccatggttcaggccgtcgaggacaagctcggcggcatcgatattctcgtcaacaataccggtggtccgacgcccggccttgcgcaggaaatgacggtcgacaagctcgacaccttcttccagtccatggtgctgcgggtcatcacgctgaccaacgcgctgctgccgcagatgaaggaacagggtttcggccgcatcctcaccgtcgcctcgtcaggcgtgttcgaaccgatccccaatctcgccctttccaacaccctgcgcggcgcgcttgtcggctggagcaagacgctgtcgtcagaagtggcctccttcggcatcacctccaacctgctgctgcccggccgcatccataccgaccgcatcgacgagctggatggcgccaatgccaagcgtctcggcaagagcattgaggaagtgcgtgaggcctccgtcaagggcattccggccggccgtctcggcacggtggaagaattcgccgccgccggcgctttcctctgctcggtgccggcgagctatattaccggcacgatgctgcgggtagacggcggcgccgcgaagtcg

SEQ ID NO: 35423 - DNA, 801 bp, Agrobacterium tumefaciens
atactcgtgatcggttcgacaggcaccatcggcacaccgctggttaaagcgctggttgcaaggggcgaaagcgtgaaggcggcgtcgcgcagcggtaagccgaccaatggcgcggaaggcgtgcgcttcgattataccgaccacgccactttcgcggatgcatttgacggcgttgatcgcctgttcctcatgctggccggcgggcgtctggataccatcgatgcactgacgccggtcgtcgaggaggccgcacgccgcaaggtgaagatcgtcttcctcagcgttctcggtgtcgacgccgacgattccattccctatcgccagatcgaactgaagatcatcgcgtcaggcacgccttacgtcatcctgcgccccaactggttcgcggataatttccacagctactggaaggccggcatcgagcacggtcagatcgccgttcccggcggcgagggcaagtcgagctttatcgatgtgcgtgatatcgccgacagtgccgccgcggcgcttacctccgacgcctttaatggcaaggctttcaacctaacgggcccgcaggcgtttggttacgccgaggcggctgcgctgatctcacaggcgatcggcaagccggtgtcctatagcgccgtttcggacgacgtcttcatcggcatcctcaccggtgccggcgtgccgcaggactacgcatccttcctcgcctcgatcttctatcccgtgcgtgaaggctggacggccgtggtgaccggcgacgcggaaacgctgaccggccatgctccgcgttcgctggaaacctatattgcc

SEQ ID NO: 35424 - DNA, 1350 bp, Agrobacterium tumefaciens
tatcatttccgcccgcccttcggctggatgaacgacccgaacggctttggccgcttcgagggcaggccacatctgttctatcagcattattcgcacgggctgcgctggaacaccatgcattggggccatgcggtctcctcggattatctgcgctggcggcatctaccgatcttccttttcccctccgaggacctgacgacgcggccggacaaacgcggcggcgcctattccggctcgaccattccgctggtggaaggctcaggcatccgggtctttttcaccgagcaggtgcaggaccgtattcccgagcagcagatccagcttaccgccacctcgtctgatctcatcatggccgggcaggcagacgtcattctcgcccaccgcccggatgggcaggggctgacgcctgacttccgcgacccttacgtgtttcgtggccccgatggcttgtggaaaatgctgctcggcagccagagcgatggcggcggcgtgatcctgctttacgagacgctggaccccacggccgcctccggctggacctatgtgggcaagctgtgggtggagacacgttacaagaccacggccatcgaatgcccctgcctgctgcccctcgatggccccgccaatgcccgttccacaaggtgggtgctgatctacgggctgatgcattcggaagacccggagaccggccgcaagaacctgaccatggccgatgtcggctggtttgacggcaaggtcttcaccaaggaatttggtcaggagctggatttcggcaccgataattacgcctttcaggcctttctggatggcgacagcattatcggcatcggctggctggcaaactgggcggatgccaatccggaaatcgatttccccacctccatgaccctgccgcgccgaattcactacgcgaacggcgaacttctgaccccgccgatcggcgcggcggaaagcctgcgcagccatattctcgaccgcacgcggctggcggccggtgagcgcgtcaccttcatcaacggcgcggtggaaatattgatcgaacttgcctcgtcagacgcggccttcgagctggcgctcgatcatccgaccgtcacgctcggtctcgtctccgacgagacgggcctgtggatccgccatgaggacgggcgcgacggtgcttcgccgcactacattgccaagggcgcgcgcgcatcccgcatccgcattttcctcgactacggctccatcgaggtctttgcaaatcgcggccgttatgtcggtaccaagcgcatcgaaggtttcgaaccggtgcgttcggcgctgctccgcgccgaccccggtgcggtggtgcatgccaccagttgggcactg

SEQ ID NO: 35425 - DNA, 2514 bp, Agrobacterium tumefaciens
gtttccgtgcccgtggaaggcatgacctgcgcctcctgcgtgcggcgtgtggaaaccgccgcggccaaggtaccgggtgtcgcttcgagctcggtgaacttcgccacgaagaagcttaccgtcgagccggccgaaggattctcagccaggacgctcggcgcggccatcaagaaggtcggttacgatatcgcgccggagcggcaggaatttgcggtcgacggcctgcacggcgaggcagaggccgagcgactgaaggccgttctgaacgccgtcgcgaccacagtcaacgtgaaggttgatgctgccgccggcaaggtcgcggtggaaaccatcggcggccggcgggagcgggatgcgctggtggaaacggcgaagcttgccggctttgcgttgaagacaccgaaaccgcacggacattccgcccatcacgatcacggccagcaccatgcacaccatcagggccacagccagatgacggcggccggtgaaagcggcggccatgaccatatgcaacatgccggcgaggagggcgcgctgaaacgcgacctgacgattgccgcgatcctgaccgcgccgcttttcgtgttggaaatgggcggccatatttatgagccgatgcatcactggctgatgggcatcatcgagacacagaacctctattacatctatttcgtgctggcgacggcggtgattttcggaccgggactgcgcttcctcaaggccggttttcccgctttgctacgcggcgcgccggaaatgaactcgctggtggcgctgggtgtcacagcggcctatctctactccgtcgtggcgaccttcgcacccgatctgctgccggcagaggcgcagttcgtctattatgaagcggcaaccgtcatcgtgacgctgatcctcaccgggcggcttctcgaagcacgcgccagcggccgcacgggagacgccatccgcaagctgatgagcctgcaggcgaagactgcccgggtggagcgcgacggtgccaccatcgatatttctcccgatgatctggtggccggcgatatcatcgtcatccgtcccggcgaaaggctggcagtggatggtgaagtcgtcgaaggctcgtcgtatgtcgatgaatcgatgatttcgggtgaaccagtgccggtggaaaagacggtcggcgcaactgttgtcggcggcaccatcaacaagaccggcgccttcaagttcaaggcgaccaaggtcggcgccgataccatgctgtcgcagatcatccgcatggtggaggaggctcagggctccaagctgccgatccagctgctggtggaccgtgttaccgccctgttcgtgcccgtcgtcatcgccattgcggtgcttaccttcatcgtctgggcgatcttcggtcctgagcccgcctatacattcgcgctggtcaatgctgtcgcggtactcatcatcgcctgcccctgcgccatgggtctcgccacgccgacatccatcatggtcggcaccggaagggcggcggagctgggcgtactgtttcgcaaggggcaagccctgcaggaactgcgctcggcgcagatcgtggtggtcgacaagaccggcacggtgaccaagggccgcccggaactgaccgatctggtggttgcggaaggatttgccgataacgaagttctggcgctggttgccgctgttgagggccgctcggaacacccgatagccgaagccatcgtccgggctgcggaagaaaagaatgtggcgactcctgcaggactcgcgcctaccactgtcgagaacttcgaaagcgtgacgggctacggcatcgcggccaccgtcaatggccgcaaggtcgaagtcggcgcggatcgctacatggcgaaactcggccattccgtcgatatcttcgctgaagccgccgcaaggctgggcgacgagggcaagacaccgctttatgccgccatcgacggcaggttggcggctgcgatcgccgtcgccgatccgttgaaaccctcgagcgtcaccgccatcaaggcgttgcaggcgatgggcatcgaagtggcgatggtgacgggcgacaatgaacgcacggcgaacgccattgcccggcaggtcggcatttcccgcgtcgtggcggaagtcttgcccgagggcaaggtgaaggcgatccacgaaatgcgcgccggcggcaaggtgctggccttcgtgggtgacggcatcaatgacgcaccggcgctcgccgaggccgatatcggcatcgccgtcggcaccggcacggatgtcgccatcgaaagcgccgatgtggtgctggtcggcggcgatcttctaggcgcagtcaatgccatcgagatgagccgggcgaccatgcgcaacatcaaggaaaacctgttctgggcctttggttataacgtggcgctgataccggttgcggcgggtgtgctttatcccgccttcggcatcacgctgtcgccgatgatcggcgcgggtgcgatggcgctgtccagcgtcttcgtccttgccaatgcgctgcggttgaaacgg

SEQ ID NO: 35426 - DNA, 864 bp, Agrobacterium tumefaciens
ttcaagggactttcggcttttccgatcacgccggctgacgaggccgggcgagtcgatattgaggccttctccgccctgatcgcgcggctggacgcggcggaggtcgattccgtcggcatcctcggcagcaccggcatctatatgtatctcacgcgtgaggagagacgccgcgccatcgaggcagccgccacgatcctcaggggcaggcgcacgctgatggcaggcatcggcgcgttgcgcaccgatgaagccgtggcgctggcgaaagacgctgaagcagccggtgcggacgcgctgctgctcgcacccgtctcctacacgccgctgacgcaggaagaggcctatcaccacttcgccgccgtcgcgggcgcaacggccctgccgctcgccatctacaacaacccgacgaccacccgcttcaccttcagcgacgagcttctcgtgcggctggcctatatcccgaatatccgcgccatcaagatgccgctgccggccgatgccgattatgccggcgagcttgcacgtctgcgccccaagctgtcggacgatttcgccattggttacagtggtgactggggctgcactgacgccacacttgccggcggtgacacctggtacagcgtggttgccggtctgctcccggttccggcgttgcaactgatgcgggcggctcaggccggcaatgcggaggaggcaaaaaggctcgatgcgaccttccagccgctctgggcgctgtttaaggaattcggcagtatccgcgtgatctatgccgccgccaacatcctgtcgctgacggtcagcgaaccaccccggccgatcctgccgctcaccagcgcggagcgccagcgggtggaagaggcgctg

SEQ ID NO: 35427 - DNA, 792 bp, Agrobacterium tumefaciens
attcccgccctcggtttcggcaccttccgcattccggaagacgatgtcaggcgcattctgccggaagcgctgaaacttggtttccgccatgtcgataccgcccagatctacaagaacgagggtgccgtcggcgaggttatcgcgcaatcgggcatttcccggcacgatatctttctcaccaccaaagtctgggtggaccgctaccgccatgacgattttctcgcctccgtcgatgaaagccttgcgaaactgaagaccgactatttcgacctgctgcttctgcactggccgaaaagtgacgtgccgcttgccgagcgcatgggcgcgttgaatgcggtgcgcaaggccggcaaggcccgcaatatcggcatttccaacttcaacgtggcgctgaccgaagaagcggtgaaactttccgacacgccgcttgccaccaaccagatcgaatatcacccctatctcgaccagacgaaggtgatttcggcggcccgtaaacacggcatgtcggtgacggcctattatctgatggccgatggcaaggtgccgaacgatcccgttctcaaggatatcggcgcgaaacacggcaagaccgccgcacaggtgaccctgcgctgggccgtgcagcagccggatatcgtggcgctttccaagacggcgacggaaagccgcctcaaggagaatttcgacattttcgattttgcgctctcggaagaggaaatgcaggcgatccatgcgcttgccaagccgaatggccgcatcgtcagccccggccacctcgcgcccgattgggac

SEQ ID NO: 35428 - DNA, 711 bp, Agrobacterium tumefaciens
aacaaagtcgttctcatcacgggtgcatcgagcgggatcggtgagggcatcgcaagggagcttgcgggcgccggggcgaagctggtgcttggcgcacgccgcatggaccgtttgcagtccctcgcggaagaactgcgtcggaagggtgccgaggtcgttatccatacgcttgatgtaacggacaggcagagcgtcgaggcttttgccgaggcgggacgcaaggccttaggccagatcgacgttatcgtcaacaatgcggggatcatgccgttgtcgctgatgtcgtcgctcaaagtcgacgaatgggaccgcatgatagaggtcaacatcaagggcgtgctttacggcgtcgccgcggtgctgccggaaatgacggcacgcgcttccggacacatcatcaacatcgcctccatcggtgcgctggccgtctcgccgacggctgccgtttattgcgcgacgaaatttgcggtccgcgccatttcggacgggctgcgtcaggaaaaccgtgacctgcgcgtcacctgcattcaccccggcgtggtggaaagcgaactcgcccacaccatcaccgatccggccgccgcggaactgatgcagagctaccgggccatcgccctgaagcccgacgctatcggccgcgccgtccgttacgccatcgagcaacccgatgatgtcgatgtcaatgaaatcgtcatccgccccaccgctgcc

SEQ ID NO: 35429 - DNA, 2334 bp, Agrobacterium tumefaciens
atcttttcggtcggcggcatggattgcggcagctgcgcggccaagatcgaaaccgcgctttcccgcctgcccggcgttggcgacgtcaaggtctccgtggcccgcgaaaggctgaacctgtcgcttgccgagaacaagaccccggtcgaaaagatcgaggacacgctgcgcaagctcggcttcaaacccgctctgctgccgcaggaaaagaccgcgcgcgaaaagacgcctgagcagaatcacgaccatgaccacgcgacatgcggcggccatcaccacgatcatgaccattccgggcacgaccacgcagcgcatgaccattcgggacacgatcaccagtcctgcaaggggcatgatcatgaccattccgaccatgatcattcaggtcacgaccattccggccacgatcatgctggccaatcgcacgctgccgcacctgccgccgcaagccagagcgccgagatagggcacgcccatggcgcggatgaaaaaggcgcgtggtggcgcagcgcgaaagcacgcaataccttcaccggcaccgtgctggtcgccatcgcctatgcggcggaactgaccttcccggcatggggcagctatgccttcatcgtcgccacgctggccacgcttttcccgatcgcgagaaatgccttcaacgccgcccgtttcggcgcggtcttcaccatcgagatgctgatgacgattgccgccatcggcgcgatcatcatcggcgaggcggaagaggcggccattgtcgtgctgctgttctccgtcggcgaattgctggaaggtttcgcggccgcccgcgcccgctccggcatcaaggcgctcggttcgctgctgccgaaaaccgcgctggtggaagaaaacggctcgctgcggcagatcgccgccgatcaggtgcgcatcggccaggtggtcgtggcccgccccggcgaccgcatcgccgccgatggcgttgtcatggaaggtcaatccagcgtcgacgaatcgccgatgaccggcgaaagcattcccgtcgccaaggaaaagggcgcgcgtgtctttgccggctcgatcaaccatgacggctcgctgcgcatccgtgtcgaccgcgcgccggaagacaacaccattgcccgcatcatcacgcttgtcgaagaagcccaggacgcccgcgccccgacggaacgcttcatccagagcttctcgcgttattacatgccgctgatcgtggcgatttccgcgctcaccatcgtcgtgccgccgcttgtcggcctcggcgactgggatacctggatctatcgcggtcttgccctgctcctgattggttgcccctgcgcgctggtcatctccgttcccgcagccatcgcctccagtctttcggctgcggcacggcacggcatgctggtgaagggcggcgcggtcatcgaaatgctggcgcgcaccgaaaccgtcgccttcgacaagaccggtacgttgacgctcggtgaacccgtggtcacagacgtggtggcgcttgacggcaacgaggccgagctgattgcgcaggccgcgacaatcgagaacgaatctagccatccacttgccagagccatcgtcagccatgccaacaaggcaggcgtaattcccctgcccggctcagagatcaaggcgatttccggacgcggcatgcaggggaatgtcggcggcaagcgcctgttcatcggcgcgccgcgttttgcaaccgacgtcgggaccgtatcgaatgaacttgccgagcgtatttccgcacttgaaagcgaaggcaagaccgtggccgttgtcatggccgagggggtggcaagcggcctcttcgccatgcgcgacgaaccgcgcaaggatgcagccgaaggcatcaaggcgctgaaggatatgggcatttcctctctgatgctgtcgggtgacaatgcccgcacggcgcgtgccatcggcaacaagctgggccttgaagcgcgcggcgaattgctgccgcaaaacaaggtcgaggaaatccgcaagctcgccgaaaagaagaccgtggtaatggtgggcgacggcatcaacgacgcgccggcccttgcggcggccagcgtcggcgtcgccatcggctccggcaccgacgtggcgatggaagccgcggatgcggcgctgatgcgcaacaatgtcggcgatgccgcccgccttatcggcctgtcgcgcgccaccatgagcaacatccgtcagaacgtgacgatcgcactcggcctgaaggctgtgttcctggtcacgaccgtcaccggcgtttctggcctgtggctcgccgtcttcgccgatacgggtgccacggttctggtgaccgccaacgccatgcggctgctc

SEQ ID NO: 35430 - DNA, 1647 bp, Agrobacterium tumefaciens
atgcaagcagattacgtcatcgtcggctccggctctgcgggctccgccatcgcctaccgcctgtcggaagacggccgttattctgtcatcgtcatcgaagctggcggttcggatttcggccccttcatccagatgccggcggcacttgcctggccgatgagcatgaagcgctacaattggggttatctctccgagcccgagcccaatcttgacaaccgccgcatcactgcgccgcgcggcaaggtcatcggcggctcgtcctccattaacggccttgtttacgttcgcggccatgccgaggatttcaaccgctgggaggagcttggcgcgcagggctgggcctatgcggatgtgctgccctatttcaagcgaatggaacacagccacggcggcgaggaaggctggcgcggcacggatgggccgctgcatgtgcagcgcgggccggtcagcaatccgctgttccacgccttcattcaggcgggcgcacaggcgggctttgaactgacggacgactataacggctccaaacaggaaggtttcggcctgatggagcagactatccacaatggccgccgctggtccgccgccaatgcctatcttaaaccggcgctgaaacgcggcaacgtcacgctggtcaatgggtttgcccgcaaggtcatcatcgagaatggccgtgccgtcggcgtcgagatcgagcgcaggggtcgggttgaaaccgtaaaggccaatcgcgaggtcatcgtttcggcctcctccttcaactcgccgaaactgctgatgctctcaggcatcggccccgccgcgcatctgaaagacatgggcatcgaggtgaaggcggatcgtcccggtgtcggggccaatcttcaggaccatatggagttttatttccagcaagtctccaccaagccggtctcgctttattcatggctgccatggttctggcagggggttgccggtgcacaatggctgctgtcgaaaggcgggctcggtgcctccaaccagttcgaggcctgcgccttcctgcgctccgcacccggtctgaaacagcctgacatccagtatcatttcctgcccgtcgccatctcttatgacggcaaggcggcggcgaaaagccatggctttcaggcgcatgtcggttacaacctgtcgaaatcgcgcggcaacgtcaccctgcgctccgccgatccgcatgacgacccggtaatccgcttcaactacatgagccacccggaagactgggaaaaattccgccattgcgtgcgcctgacgcgcgagattttcggccagaaagccttcgacgattttcgcgggccggaaatccagccgggtgaaaacatcgagacggacgaacagatcgacgcctttttgcgcgagcatctggaaagcgcctatcacccctgcggcacctgccggatgggagaccgcaacgaccccatggcggtcgtcgatccggaatgccgggtgatcggcgtggaggggctgcgggtcgccgacagctcgatcttcccgcatgtgacctacggcaacctcaacggcccgtcgatcatgaccggcgaaaaagcggctgatcacatccttggcaaaaccccgctgccccgctccaatcaggagccgtgggtaaacccgcgtgcggccgtcagcgaccgc

SEQ ID NO: 35431 - DNA, 1377 bp, Agrobacterium tumefaciens
cctgcaacgggcgaaatgattgcaaaactgcatgcggcaacgcccgccatcgtcgagcgcgccatcgcctcggccaagcgcgcccagaaggaatgggcggcgatgagccccatggcccgcggtcgcatcctcaagcgcgccgccgatatcatgcgcgaacgcaacgatgcgctttccacgctcgagacgctggataccggcaagccaatccaggaaaccatcgtcgccgatcccacctccggcgccgatgccttcgagtttttcggcggcatcgcaccttccgcgctgaatggcgattatatccccctcggcggcgatttcgcctataccaagcgcgtgccgctcggtgtctgcgttggtatcggcgcctggaactatccgcagcagattgcctgctggaaggctgcaccggccctcgtcgccggcaatgccatggtcttcaagccctcggaaaacaccccgctcggtgccctgaagatcgccgaaatcctgatcgaggcgggcctgccaaaaggcctcttcaacgtcattcagggtgatcgcgataccggcccacttctagtcaatcatcccgatgtcgccaaggtctctctcaccggctcggtgccgaccggtcgcaaggtggcggccgccgctgccgggcatctgaaacatgtgacgatggaactcggtggcaagtcgccgatgatcgtcttcgacgacgccgatattgaaagtgccgtcggtggggccatgctcggcaacttctattcttccggccaggtctgctcgaacggcacgcgtgtcttcgtgcagaaaaaggcgaaggcgcgtttcctcgaaaacctgaaacgccgcaccgaggcgatgatcctcggcgaccccttggattacgccacccatctcggcccgctggtctccaaggcccagcaggaaaaggttctgtcctatatcgaaaagggcaaggcagagggtgcaacgctgatcaccggcggcggcattcccaataatgtcgcgggtgagggcgcctatgttcagccgactgtctttgccgatgtcaccgacgacatgaccatcgcccgcgaggaaatcttcgggcctgtcatgtgcgttctggatttcgacgatgaggacgaggttctcgcccgcgccaacgccaccgaattcggccttgccggcggcgtctttaccgccgacctcgcccgcgcccaccgtgtggtggatgggctggaggcgggcacgctctggatcaacacctacaatctctgcccggtggaaattccctttggcggctccaagcaatccggtttcggacgggagaattccgccgcggcgctggagcattatagcgaattgaagaccgtttatgtcagcacggggaaggtggacgcgccttat

SEQ ID NO: 35432 - DNA, 2643 bp, Agrobacterium tumefaciens
gtttataccttcggcaatggtgctgccgaaggcggggcaggtgacgttgctatattgggcggcaagggcgcgaaccttgccgaaatggcaagtctcggcctacccgttccccccggcctcacgattatagccgatgcctgcgcgctttatcacaagaatggccgcgatcttcccgaagagctgaagctgcaggtcatggccgggctgcacggcatggagattgtcaccggcaagaccttcggcggcagccattcgccactgctgatctccgtccgctccggcgcccgcgcctccatgcccggcatgatggataccgtcctcaacctcggtctcaatgaccgcacggtcgaggcgctgggccatgatgcgggtgatgcccgttttgcctgggacagctaccgccgtttcatccagatgtatggcgatgtcgtcatgggcctcgatcatgaaatgttcgaggaaattctcgaagatgagaaaggccgcctcggccatgaatacgataccgacatgtcggcggtcgaatggcagcacgtcgtttcgctttacaagaagctgatcgaggacgagctcggcgaagccttcccgcaggattgtcatgtccagctctggggcgcgatcggcgccgttttcgccagctggaccaatcatcgcgccgtgacctaccggcatctgcacaatattccgggtgactggggtacagccgtcaacgtgcaggccatggtcttcggcaatctcggttcgtcctcggcaaccggcgtcgccttcacccgcaatccctccaccggtgaggcggagctttacggcgaattcctcgtcaatgcgcaaggggaggacgtggttgcgggcatccgcacgccgcaatccatcacggaagccgcgcggctggtatcgggttccgacaagccttccatggaaaagctgatgccggaggcgttttccgaatttcttgcgatctgcaagcggctggaaacgcattaccgtgacatgcaggatctggaattcaccatcgagcgcggcaagctctggatgctgcagacccgttccggcaagcgcaccacccgcgccgccatgaaaatcgccgtcgatatggtggaagcggggctgatttcgcaggaggaggccgtctgccgcatcgagccgtcgtcgctcgaccagctgctgcacccgaccatcgatcccggcatttcccgccctatcatcggttccggcctgccggcctcgcctggtgcggcgaccggtgagatcgtcttcacatcggaagaggcggtcgccgccgaagccgaggggcgtcgtgtcattctggtgcgcatcgaaaccagcccggaagatattcacggcatgcatgccgccgaaggcattctgacgacgcgtggcggcatgaccagccacgccgccgtggtggcacgcggcatgggcatcccttgcgtcaccggcgccggctccatgcgcgtggacatgcgtaacaaggtgctgatcggcgtcggctgtatgctgaagcgcggcgatgtcatcaccatcgatggctcttccggccgggtgctgaagggcgaagtaccgatgacgcagccggaactgtcaggcgatttcggcaagctgatgcaatgggcggacaatctgcgccgaatgaccgtgcgcaccaatgcagatacgccggccgatgcccgcgccgcccgtgccttcggcgctgagggtattggcctctgccgcaccgaacacatgttctttgaaggcgaccgcatccatgtgatgcgcgagatgatccttgccgaaagcgaaaagggcaggcgggcagcgctcgatcagcttctgccgatgcagcgttcggattttaccgagctgttccagatcatgcacggcctgccggtcacgatccgcctgctcgatccgccgctgcacgaattcctgccgaagagcgatggtgagatcgtcgaggtcgcagccgccatgggcatgccgcagacggtgttccgccaaaggctggatgcgctgcacgaatttaaccccatgctcggccaccgcggctgccggctggccatttcctatcccgaaatcgccgaaatgcaggcacgcgccatttttgaagcggctgtggctgcggcgcgcatcaccggtgcgcctgttgtgcctgagatcatggtgccgctggtcggcctccgctccgaactggattacgtcaaggctgtcatcgacacggtggccgcggaggtggctgaagagaccggcatgagcatcgaatatctgaccggcaccatgatcgagctgccgcgtgcggccctgcgtgcccatgtcattgcagaagcggcggaattcttctccttcggcaccaacgacctgacgcagacgactttcggcatttcgcgcgacgatgcggcgcgtttcatcaatacctatcagcgcaagggcatcatcgaacgcgatccgttcatctcgctcgatttcgacggtgtgggagaactgatccgcattgccgccgaacgcggccgccagacgcggccggaactgaagctcggtatctgcggtgaacatggcggcgatccggcctcgatccatttctgcgaggatgcggatctagactacgtgtcgtgctcacccttccgcgtgcccatcgcccggcttgcggcggcgcaggcgacgctcgct

SEQ ID NO: 35433 - DNA, 3462 bp, Agrobacterium tumefaciens
atgaagttcaacaagctccgcgtcgtcggtttcaagtccttcgttgaaccctccgaattcatcatcgagcccggtctgaccggcgttgtcggcccgaatggctgcggcaagtccaatctggtcgaagcgctgcgctgggtgatgggcgagaattcctacaagaacatgcgcgcatccggcatggatgacgtcatcttttccggctccggcaaccgcccggccagaaacaccgccgaagtcggcctttatctcgacaattccgaccgcaccgcgcccgccgctttcaacgatgccgatgaaattcaggtgacgcgccgcatcgagcgcgaaaacggctccgtttaccgcatcaatggcaaggaagcccgcgccaaggatgtgcaactgctgtttgccgatgcctccaccggcgcccgctcgccctccatggtggggcaagggcgtatcggcgagctcatcaatgccaagccacaagcccgtcgccagctgctggaagaggcggccggcatttccggcctgcattcgcgccgccacgaggccgagcttcgcctgcgcgccgccgagaccaatctggagcgtctggaagacgtgactgcccagctggaaagccagatcgaaagcctgaaacgtcaggcgcgccaggccaaccgcttcaagatgctgtccgccgatatccgcgctcgcgaggcgacccttctgcacatccgctgggtggaggcgaaggaagcggaaggcgaggcggaaagcgcgctcaatcaggcgaccaacatcgtcgccgaaaaggctcaaggccagatggaagcggccaagcagcagggcatcgccagcctgaaattgccggaactgcgcgaggacgaggcccgcgtggccgccgccctgcaacgcctgcagatcgcccgcacccagctggatgacgaggcaaaccgcctgctgcgccgtcgtgacgaactggcccgccgtctctcgcagcttggcgaggatatcgtccgcgaggaacggctggtcgccgataatgcccagatactcgcacggctggacgaagaagaggccgaacttctcgacatcctctccgattccggtcgtcatgcggatgagatgcgcgaagccttcgaggctgcggccgtcaagctggcggaaagcgaagccgttttcacatcaatcaccgccgaacgcgccgaggcggcggccggccgtcagcagttggagcgggcgatccgcgatctttctgaccgcaagctgcggctggagcggcaatcgcaggaagcctctgccgagattgacaccatcgacgaaaaactctccggtcttcccgaccccgcggagcggcgcgaagcggtggaagcggctgagattgccgtcgaggacgcgttgatcgtggcggaggaggccgaggccgccgttgccgaggcgcgttccgccgaagcgctggcgcgcgggccgctggaaacggcgaagaaccggctgaatgcgctggataccgaagcacgcaccatcaccaaaatgctcgccaccagcgctgccgccaatggtagtttcacgccggtggcggaagaaatgacggtggagcgcggttatgaggccgcacttggcgcggcgcttggcgacgatctcgaaagcccgctcgatgcgagcgcccccgcctattggggcggcaatggaaacggtgcggatgatcccggcctgccgcagggcgctaaaccgcttctggactatgcgcaggcgccggatgccctccggcgcgcccttgcacagattggtgtcgttgcagacgtatcggaggcccgacgccttctgccgtcgctgaaagccggccagcggctggtaacgcgcgaaggcgcgctgttccgctgggacggccatatcgccagcgccgatgcgccgggtgctgcggcccttcgcctgtcgcagaagaaccgcctcgccgaaatcgaagccgaactggacgaggcccgctccattctggaagaggccgaagaccagcttgccgcgaaaaccgaggacatcagaagcagtgaattgcggctctcggaggtgcgtgaccggagccggctcgcgacccgtcagcttgccgaggcacgcgaggcgctgacatccgccgaacgggcctcgggcgatctgctgcgccgccgggatgtcgtttccgaagcgcagaaccagatcggcgcgcagatcgacgagatcgccgttcaggaagaaaatgcccgcatcgaaatggaagatgcgccggatctttccgtgcttgatctccggctgcgtgaaagccagctggaagtcgcgaccgaccgcggcctgctggcggaggcccgcgctcgccatgaaggcgtgagtcgcgaggcggaaagccgccagcgcagaattcaggccatagggcaggagcgttccacctgggcatcgcgcgctgcaagtgcggccgatcatatcgccacattgcgcgaacgcgaggaagaggcgcgcgaggaaatcgccgagcttgatatagcgccggaggaattcgacgagaaacgccgcaacctcctcaacgaattgcaaaagaccgaagacgcccgccgcgccgccgccgaccggctggccgaggcggaaaacctgcagcgtgccgccgatcgggtggcggcaacggcgctttccgaactggccgaagcccgcgaaaagcgcggccgtgccgaagaacgtctggtttccgcccgcgagaaacggctggaaaccgaacaccgcatccgcgaaacactgaataccgagcctcatatggcatttcgcctgaccggccttggcccggatcagccgaagcccgatatccgcgatgtcgagcgcgatctcgaccggctgaagatcgagcgcgaaaggcttggtgccgtcaatctgcgcgccgaggaggaacaggcggagctttccggcaagctcgaggcgctgatcaaggagcgggatgatatcatcgatgccgtgcgcaagctgcgcgccggcatccagagcctcaaccgcgagggtcgtgagaggctgattgccgccttcgacgtggtcaattcacagttccagcggctgttcacccatcttttcggtggcggcacggcagaattgcagctgatcgaatccgacgacccgctggaagccggcctcgaaatcctcgcccgcccgcccggcaagaagccgcagaccatgacgctgctttccggcggcgagcaggcgctgacggcgatggcgctgatctttgcggtcttcctcaccaatcccgcgcccatctgcgtgctggacgaggtggatgcgccgctcgacgaccacaatgtcgagcgctactgcaacctgatggatgagatggtggcctccaccgagacgcgattcgttatcatcacccataatcccatcaccatggcgcgcatgaaccgcctgttcggtgtcaccatggccgaacagggcgtctcgcaactcgtctccgtggatttgcagactgccgaacagctgcgcgaagcc

SEQ ID NO: 35434 - DNA, 564 bp, Agrobacterium tumefaciens
ttcgacctcattattttcgactgcgacggcgttctggtcgactccgaaatcatcgccgcccaggtggaatcccgccttttgaccgaggccggttacccgatctccgtcgaggaaatgggcgagcgcttcgctggcatgacctggaagaacatcctcctgcaggtggaaagcgaagccagcattccgctctccgcatcgctgctcgacaagtctgaaaagctgctcgacatgcggctggaacgcgacgtgaagatcatcgacggcgtaaagttcgcgctctcgcgcctgacgacgccgcgctgcatctgctcgaactcctcgagccaccgcctcgacatgatgctgacgaaggtgggcctgaaaccctatttcgcgccgcatatctattccgccaaggatctcggcgccgaccgcgtgaagccgaagccggatatcttcctgcatggcgcggcgcaatttggcgtctcgcccgatcgggtcgtcgtggtcgaggattccgtgcacggcattcacggcgcgagagccgccggcatgcgcgtcatcggcttcaccggcgcatcccac

SEQ ID NO: 35435 - DNA, 1209 bp, Agrobacterium tumefaciens
aatgtgacccggctttcgtccgggttgaccgttgttacggaaagaatgccacatctcgaaagcgttgctcttggggtgtggatcaaatccgggtcccgcaacgagacgactgccgagcacggcatcgcccatcttctcgaacatatggccttcaagggtacggcgcgccgcaccgcccggcagatcgccgaagagatcgaaaacgtcggtggcgaagtcaacgccgcaacatcgacggaaacaacctcctattatgcccgcgtcctgaaagaccatgttcctctcgcggtcgatatccttgctgatatcctgacggaatcgctgttcgacgaagacgagctggagcgcgagaaaaacgtcattctccaggaaatcggcgctgcgaccgatacgcctgacgacgtgatcttcgacaatttctccggcgtcgcctatcgcgaccagaccattggccggccgatcctcggcacgcccgacaccgtgcaatccttcacgagcggtgagatcaggcattatctcgcccgcaattacacgacggaccggattttcgtcgtcgccgccggcgcggtcgatcacgaaagctttgtgaagcaggtggaagagcgttttgcctcgctgccgctcgtgccggcggcaccgcccgtcatggaaaaggcgatctataccggcggggaaatccgcgagacccgcgacctgatggatgcgcaggtgctgctcggtttcgagggcaaggcctatcacgcccgcgacttctattgctcacagattctcgccaatattctcggcggcggcatgtcatcgcgtctcttccaggaagtgcgcgaggcgcgcggcctgtgttattccgtttatgccttccattggggtttttccgataccggcattttcggcgtgcatgcggcgaccggcggcaatgacctgccggaactgatacccgtcatcgtcgatgaattgcgcaagtcttctgagactatccatcaggacgaaatcaaccgcgcccgcgcacagattcgggcgcaattgctgatgggacaggaaagcccggctgcccgcgccggccagattgcccggcagatgatgctttacggccgccccatccccaatgaagaaatgatgacgcgcctcgaggacatcacccgggagcgcctgaccgatcttgcaggccggctatttttcgatacagttccgacattgtctgccattggcccg

SEQ ID NO: 35436 - DNA, 576 bp, Agrobacterium tumefaciens
gcgaccatgctgccttttctgccgcatgccgtggtcttcgacatggacggattgctgatcgaaagcgagacgctctatcgcgattcgtttctggcggcctctgaggaaggcggccatggcatgaaggtcgagacctatcagaaggtttgcggcagcccgtgggatgtcatcaccggcaccatctttgccgattatggcgcggattttccgatggcgaccttccgtgacgcctggctccggcatctcggcctgatgatggcggacggcgtagcgctgaaacccggcgtcgtcgaaatcctcgatcttctcgaccggctcgatatccgccgcgccatcgccacctcgtcgcggcacgattcggtgacgcgccatctcggcccttacgatcttctcagacgtttcgacaccatcgtcgcgcgtggcgattataccgagccgaagcctgcgcccatgccctatctcaccgccgcacgacggctaaggctcgatccgggccgttgccttgcgctcgaggattcctattccggcgtccgctccgcgacatcggcgggcatgatgacgatcatggtgcccgat

SEQ ID NO: 35437 - DNA, 783 bp, Agrobacterium tumefaciens
ggcctcatggctggcaaacgcggcctcatcatgggcgtcgccaataaccgttcaatcgcttggggcattgcaaaggcctgcgcggatgcaggtgcggaactcgcactcacctggcagggtgacgcattgaagaagcgcgtcgagcctctcgcgcaggaactcggcgctttcatggccggccattgcgacgtgaccgatctcgagacgatcgactccgtttttgcctcgctggaacagcattggggcaagatcgacttcgtcgtgcacgccattgcgttctccgacaaagacgagctgaccggccgttatctcgataccagccgcgacaacttcaaccgcaccatggatatttccgtgttctcgctggccgccgttgcaaagcgcgcagagcccatcatgaatgacggcggttcgatcatcacgcttacctattacggcgccgaaaaggtcatgccgaattacaacgtgatgggcgtggccaaggccgctcttgaagccagcgtgcgttatctcgccgtcgacctcggtaatcgcggcatccgcgtcaacgccgtttccgccggcccgatcaagacgcttgcggcttccggcatcggcgatttccgttacattctgaagtggaacgaatataatgcgccgctgaagcgcaccgttaccatcgaggaagtcggcaagtcggcgctctacctgttgtccgacctttcgacggccgtgaccggtgaaatccaccatgtcgattccggctatcacaccatcggcatgaaggcagtggatgcgcctgac

SEQ ID NO: 35438 - DNA, 516 bp, Agrobacterium tumefaciens
cacggacaaacggactggaatgcgatacgccggcttcagggccagaaagacattccgctcaatgatttcggccgccagcaggcggtcggcaatggcaggattctcgcccgccttttgggtgaacgggccacggatttcgattatgtggcaagcccgctcgggcgcacgcgcgagaccatggaactgatgcgcggcgcgatgggtcttgaccctctcgcctaccgcaccgacgaccgtttgatcgaagtctccttcggcgactgggaggggcagaccctgcccgacctcaagaaggaattccccgaccgggtgaaggcgcgcaaggccaataaatgggatttcattccccccggccaggatgctgaaagctatgaaatcctctcctggcgcatcggcgcatggctttcctccgtggaggtgccgacgatatgcgtctgccatggcggcgtcatccgctcgatcttccggcttgtttcaggcatggataaggacgaggcgtcgaggacgcaaattccg

SEQ ID NO: 35439 - DNA, 1117 bp, Agrobacterium tumefaciens
atgtcgcataacagtttcggtcatctttttcgcgttactacctggggtgaaagccacgggccgtcacttggctgtgtggtggatggttgcccgcccggcatccgctttacccttgccgaggtgcagcactggatggacaagcgcaagcccggccagagccgcttcgtgacccagcgccgcgaggatgacatcgtgaaggttctgtccggcgtgatgctggacgaggacggcgagacgatgacgacgacaggcacgccgatttccatgctgatcgaaaataccgaccagcgctccaaggattacggtgagattgccaggcgtttccgcccgggccatgcggatttcacctatgacctgaaatatggcattcgcgattatcgcggcggcgggcgttcttctgcgcgcgagacggcggcgcgtgtcgccgccggcgcaatcgcccgcaaggtggtgccaagcctcaatgtgcgtggcgcgctggtgcagatcggcaaacacaagatcaaccgcgacaattgggattgggatcaggtcgaccagaacccgttcttctgccctgatcccgagatggtgcccgtctgggaagagtatctcgatggtatccgcaagtccggctcctccatcggcgcggtggtcgaagtggtggcggaaggggttccggccggcatcggcgcgccgatctatgccaagctcgatcaggatatcgcctccagcctgatgtcgatcaacgccgtcaagggcgtggagatcggcgaaggttttgcctcggccgagctttccggcgaggaaaatgccgaccagatgcgcatgggcaatgacggcaagccgattttcctctccaaccatgccggcggcattctgggcggcatcgcgaccggtgagcctgttatcgcccgcttcgccatcaagcccacctcctccatcctgacggagcgcctgtccatcgataccgatggcaacaatgtcgatgtgcgcaccaagggccgccacgacccctgcgtcggcatccgcgccgttccgatcggtgaagcgatgatcgcctgcaccgttgccgaccattacctgagagaccgcggccagaccggccgactgaaataaggggatatcgccatggcct

SEQ ID NO: 35440 - DNA, 1902 bp, Agrobacterium tumefaciens
gaaaaggccgaacgattgaccggaatgccacagacaccattgctcgaccgggtgaattttccctccgatctcaaggagatcgatgatcgcgacctgccggaactggcacgggaactgcgcgacgagatgattgacgcggtgtcgaagaccggtggccatctgggtgccggcctcggtgtggtggaactgacgattgccattcacaaggtgttcaacacgccggaagaccggctgatcttcgatgtcggccaccaatgttatccgcacaaaatcctgaccggccggcgtgaccgcatccgcacgcttcgacaggaagacgggctttccggtttcacgcggcgggccgaaagcgaatatgacgattttggcgccggccattcctccacctccatttccgccggtctcggcatggcggtggcggcggggctcgatggcagcgaccgcaaggtcatcgccgtgatcggcgacggttcaatgtcggccggcatggcgttcgaagcgctcaacaatgccggtgcactcgatgcgcggctgatcgtcatcctcaacgataacgacatgtcgattgcgccgccgacgggtgcgatgagcgcctatctggcgcggctggcctccggccgcacctatatgggctttcgcgatttcggcaagaaactgaccgcctatctcggcaagaccatcgatcgcgccattacccgcgccgtgacccatgcccgcggttatgtgaccggcggcacgctgttcgaggagcttggtttctatcacatcggcccgatcgacggtcattccttcgatcaccttttgccggtgcttcgcaatgtgcgcgacaaccagaaaggccctgtcctgatccatgtggtgacgcagaagggcaagggttacgccccggcggaagcggcagcggacaaatatcacggcgtcaacaagttcgacgtcatcaccggcgcgcaggcgaaagccaagccaaatgcgccgagctataccagcgtgtttgccgaagcgctgatccaggaagcgaccctcgacgagaagatcatcggtgtcaccgctgccatgccgaatggtaccgggctggacaagatggccgagcttttcccgtcccgcaccttcgatgtcggcattgccgagcaacacgcagtcaccttcgcggcgggacttgcggccgatggttacaagccgttctgcgcgctttattccaccttcctgcaacgcggttacgaccagctggtgcatgatgtggcgatccagagcttgcccgtgcgtttccccatcgatcgcgccggcttcgtcggcgccgacggaccgacccatgccggctccttcgacacgacgttcctcgccaccctgcccggcatggtggtgatggcggcggccgacgaggcggagctaaaacatatggtccgcacggcggcggcttacgatgaaggcccgatttcattccgttatccgcgcggcgaaggtgtcggcgtcgaaatgccggcacgcggtgagattctccagatcggcaaaggccgcatcatcaaggaaggcaccaaggttgccctcctctccttcggaacgcggcttgcggaatgccttgcggccgccgaagatctcgatgccgcgggcctttcgactacggttgccgatgcgcgcttcgccaagccgctcgatctcgatctcatccgccagcttgccgcccatcacgaggttctggtaacgatcgaggaaggttctgtcggcggttttggtgcgcatgtgctgcatttcatggccagcgccggcctactcgaccatggcccgaaggttcggaccctgaccctgcccgaccagtgggtggagcaggccaagcctgagaccatgtatgccaatgccggcctcgaccgcgccggcatcgtttccaccgtgtttaatgcgctcggc

SEQ ID NO: 35441 - DNA, 1758 bp, Agrobacterium tumefaciens
tatagcgcgccggtggatgatatcgcctttacactcaagcatgtggcgggtcttgaagacgcgctctcacagggtgtgctgggagacctgagcgaagatctcgttgatgccattcttgaggaagccggccgtttcgccaccggagaggtagccccgctcgccgatattggcgaccgtcagggcgcgaagctcgcagacggcaaggtcacgacgccggatggctgggccgatctttaccgccgctgggcggaagcgggctggaacagcctgaccgcgcccgaagaattcggcggccagaacctgccgcacatgctgaatgtcgcggcactcgaaatgtggaattccggctccatggcctttgcgctggcgccgacgctcaccatgggcgcggtggaagccatcgttacccacggcagcaatgatctgaagcgcatctatctgccgaaactcgtatccggcgagtggaccggcaccatgaacctcaccgaaccccatgcgggatcggacctgggcgtgttgaagacccgggcggagcgtaatggtgacggcacctaccgcatcttcggccagaagattttcatcacctggggcgaacacgacgcggcggataatatcatccacctcgttctcgcccgtctgccggatgcgccgaccggtacgcgcggcatctcgctgttcctggtgccgaaattcctgcccgatgaaaacggcgcaccgggcagccgcaacgacctgttctgccattcgctggagcacaagctcggcattcacggctcacccacctgcacgatgatcttcggcgacggcaaattcggtgacgaaaagggcgctctcggctggctgatcggcgaggaaaacaagggcctcgcctgcatgttcaccatgatgaacaacgcccgccttgcggtcggcatgcagggcgtggcgatctgcgaagcggcgacccagaaggcgatcgaatacgcgaaagagcgcacgcagggcaaggcgcccggctggcagggttccggcatgagcccgatcatcgaacatcctgacatcgccaggacgcttctgaccatgaaggcgctgacgcaaggatcgcgggcgatttccttcagctgcgcccatgccatcgacatggcgcatgcgaccgaagacgcctcccagcgcgctcactggcaggaacgagctgcccttttgacaccgattgccaaatccttctccaccgatgccggtgtcgatgtcgcctccatgggcattcaggtgcatggcggcatgggcttcatcgaggagacaggtgctgcgcgttatctgcgcgatgcccgtatcgcgccgatctacgagggtaccaacggcattcaggccatcgatctggtgctgcgcaagctgccgctctccgagggcgcgcaggtgcgcggtttcatcgctgagctgcgtgagattgccgcccggacggccgcgtctaaccgcgatgatcttggcgagaccgcccgttatcttgaagccagcctcaacgatctggaaacgacgaccgactggttgctctcccgcatcaaggcgggcgaaaccgaaaccgcgcttgctggtgccacggcctatcagcggctcttcggtctggcgctcaccggtgcctatctcgccaagggcgcattggtctccgtcgatgatggccggagcgggcatcgcgcagcactttgccggttcacggcggaaaacctgctggcggaaacggcggcgctgaaggatcgcgttatatcaggggcggcaagccttgcc

SEQ ID NO: 35442 - DNA, 1422 bp, Agrobacterium tumefaciens
cccatgaccgccatcccctcctccgatatccttgaccgcttcaccgccatcgttggcgaaaaaaatgcggtgcgcgacctggcggaaatggcaccgcgcctggtggaaaatcgcggactttatcgcggcgcttcccccctgctcctcaagcccggttccgtcgaggaggttgccgccatcctgaagctcgccagcgagaccggcacgcccatcgtgccgcaaaccggcaataccggccttgtgggcggccagacgccgcgcgctgacggcaccgatatcatcctatcgctggagcgcatgaaccgcatccgcgacatcgatcccgttgccaatatcatcgtcgccgatgccggctgcattcttgacgacattcacaaggccgccagctccgtggagcgcatgttcccgctatcgctcggttctcaaggctcctgccgcatcggtggcaatctcgccaccaatgcaggcggaacggcggtgcttgcctatggcaatatgcgccagctgtgcctcgggctcgaagtggtcctgccaaccggcgaaatctggaacgggctgcgccggctgaaaaaggacaatacgggttacgatctgcgcgatctcttcatcggctccgagggcacgctcggtgtcatcaccggcgcggtgctgaagcttttccccaagccgctcggccatcaggtcgcttttgccggtcttgcctccaccgaggatgccctgaaactgttcgaaatggcctccaacctctgcggcacggcgctgaccggctttgaactcatgccacgaatcggcgtcgagttcaccgccaggcacattcccggcgtgcgcgaccctctggggcagccgcatgactggtacgcgctcatcgatatctccacctccgattcggccgagacggcggacacgatgatgcaatcgctgctggagcgtggttttgaggccgggctggtcgaggatgcggtgatcgcctcatcggaagcgcagcgtcaggcgctgtggcacatgcgtgaaagcatgtcggacgcgcagaagccggagggcggatcgatcaagcatgacgtttccgttccggtgtcgaaaataccggaattcatgactactgcggaaaaggccgtgctcgccgccattcccggcgcccgcatctgcgccttcggccatctcggcgacggcaacatccactacaatatctcccagccagtcggtgccgacaaggccgaattcctcggccgctggcgagacatgaacgagatcgtgcacggtatcgtgctgtcgctcggcggctcgatttcggccgaacatggtatcggccagctgaagcgcgacgaactggccgccatccggcccggcattgaaatggagttgatgcatcgcatcaagcacgccttcgaccctgcgggtatcatgaaccccggcaaggttttg

SEQ ID NO: 35443 - DNA, 543 bp, Agrobacterium tumefaciens
atcgcctccatgctgcgcgaaggcgccggcaagaagggtatggtgttcttcccattcgttttctcgctgttcatgttcgtgctgacggcaaaccttctcggcatgttcccgtatttcttcacggtgaccagccagatcatcgtcacattcgcgcttgcctgcctcgtcatcggcacggtcatcgtttacggtttttacaagcatggcctgcatttcttcggcatcttcgccccgtcaggcgttccgaaggcgcttttgccgcttgtcgcgtcgattgaaatgatctcgttcctgtcgcgccccatcagcctttcggttcgtcttttcgcgaacatgctggctggccacatcacgctcaaggttttcgcaggcttcgtcgcctccatgggtgcgctcggcgcactcggcgtcggcggcgctgtcctgcctctcatcatgacggtcgcaatgaccgctctcgaatttctcgttgccttcctgcaggcttatgtgttcgcggtactgacttgcatgtacctgaacgatgccgtgcatggtggtcac

SEQ ID NO: 35444 - DNA, 720 bp, Agrobacterium tumefaciens
ctcgttaccggcggcggttcgggcatcggggcatcgctggtcgaagccttcgcgatgcagggggcgaaggtttcgttcatcgacatcgccgaacagccgagcatagcgcttgtcgagcggcttgcggcgacggtgcctcacccggtccattatttcagggccgacctcagtgatatcgacgcgatcaagcgtacggtggatatggccgcctccgccaccggcggcatcaaggtgctggtcaacaatgccgcctgggacgaccgtcacgacatcgacagcgtcacagaggcctattgggacgccaaccaggcggtcaatctcaagcagatgttcttcacggttcaggctgcccttccccatctgcgacaggcgaaggatgcctcgatcgtcaatttttcgtctatctcgtttttgctgaacatgggcgagttgccttcctatgcagcggcgaaagccggcattatcggtctcaccaagagccttgccggcaggctggggccggaaaatatccgcgtcaacacgctcctgccgggcatgatcgtgacggagcggcagaaggaactgtggctgacggatgagggcattacggccaccacggcgcggcagtgcctgaagcgcacgctcgtcgctgccgatctttccgggccgtgcctgtttctcgcatcatcggcatcgagcgccatcacggcgcaatccattatcgtagacggaggcctgtta

SEQ ID NO: 35445 - DNA, 1500 bp, Agrobacterium tumefaciens
ctgacgatcaccagccggcaacagggggcagaacagggttcggtgatttcggttaccggcggcaaggtgtctgacgtgcgaccggcagcttcgaatgccggcaccatcgtcgaggtgcgcgacctgttcttcgccacaccggcgcggctgaaattcctgaagacggaacgggcggaagcggccgccatcaccgaagtcgtcaaacggatggcgatcgcctttccgcatatccgcttcgtgctctcgggcaccgaccgttcgacgctcgaaattccctcgaccggcgacgaccaccttgcccgcatggcgcaaattctcggcgcggagttcaaggataacgcgatcgaaatcgatgccgggcgcgaggacgtgacgctgacaggctttgccggcgtgccgaccttcaaccgtggcaactcgtcgcatcaatatgtcttcgttaatggccgcccggtgcaggacaagctgcttttatcggccattcgcggcgcctatgccgagaccgtgccgcatgggcgctatccggtcgcggtgctgtccatcacgctcgaccctgcctttgttgatgtaaatgtgcatccggcgaaatccgacgtgcggtttcgcgatcccggactcattcgcgggctgatcgtcggcgcgatccgccaggcgctgacgcgtgacggcgacagggcggcaacgacgggcgccagccagatgatgaacgccttccgccccggctacagcccgtccggtctaagaccctccccctccgcgacatggtccgccgccacctcgccgtcgcggccgctcgccgtttccggggacatgcaatttgccgaagcggcgcaatcgcgcttctccgacatcaccatgccgaccgcacgggcggaacctcgcgaggcttatgaagcttcccagagcccttcgccggaaccggtgctttatccgcttggagcggcacgggcgcaactgcacgagaactacatcatcgcgcagacggaaaacggcctcgtcatcgtcgaccagcatgccgcgcatgagcggctggtgttcgaggaaatgcgcaatgccctgcattcgaggcgtccgccctcacaggtgctgctcatccctgaaatcatcgacctgcccgaggaagattgcgaccggttgatggatcacgcagccggtttcgacgcgcttggcctcgtcatcgaacgtttcgggccgggcgcaatcgcggtgcgggaaacgccggccatgctcggcgaagtcaacgtgcaggggctggtgcgccagctagccgatgagatcgccgaatgggacgccgcttccacgcttgccaacaagctggaatatgtggctgcgaccatggcctgccacggctcggtgcgctccggccggcgcatgcggccggaggagatgaacgcgcttctgcggcagatggaaaacacgccgggttcgggccaatgcaatcacggccgaccgacctatatcgaactgaaactttccgatatagaacggctcttcggccgc

SEQ ID NO: 35446 - DNA, 294 bp, Agrobacterium tumefaciens
atgacaagcaccaatttccgtccgcttcatgatcgcgtcgtcgttcgtcgcgttgagtccgaagcaaagaccaagggcggcatcatcattcccgataccgccaaggaaaagccgcaggaaggcgaaatcgtcgccgtcggttccggcgcgcgcgatgaggccggcaaggtcgtcgctctcgacgtcaaggttggcgatcgcgttctgttcggcaagtggtcgggcactgaagtcaagctcgacggcgaagaccttctgatcatgaaggaagccgacatcatgggtatcatcggc

SEQ ID NO: 35447 - DNA, 1632 bp, Agrobacterium tumefaciens
atggcagctaaagaagtcaaattcggccgctcagcgcgcgaaaagatgctcaagggcgtcgacattcttgccgatgcagtgaaagtaaccctcggcccgaagggccgtaacgtcgttatcgacaagtccttcggcgctccgcgcatcaccaaggacggcgtttccgtcgccaaggaaatcgaactggaagacaagttcgagaacatgggcgcacagctcgttcgcgaagttgcctccaagaccaacgacatcgccggtgacggcaccaccaccgcaacggttctggcccaggccatcgttcgcgaaggtgcaaaggcagttgctgccggcatgaacccgatggacctcaagcgcggtatcgatctggccgttgctgaagtcgtcaaggaccttcaggccaaggccaagaagatcaacacgtctgaagaagttgcacaggtcggcacgatctctgcaaacggcgagcgtcagatcggtctcgacattgctgaagcaatgcagcgcgtcggcaacgaaggcgtcatcaccgttgaagaagccaagactgctgaaaccgaactcgaagtcgtcgaaggcatgcagttcgaccgcggctacctgtcgccttacttcgtaaccaacccggaaaagatggttgcggacctcgaagacgcttacatccttctgcacgaaaagaagctctcgaaccttcaggccatgctgcctgttctcgaagccgtcgttcagaccggcaagccgctcgtcatcatcgctgaagacgtcgaaggcgaagctcttgcaacgctcgtcgtcaacaagctgcgtggcggcctcaagatcgctgccgtcaaggctcctggcttcggcgatcgccgcaaggccatgctggaagacatcgccatcctgaccggtggtaccgtcatttccgaagacctcggcatcaagctcgaaagcgttaccctcgacatgctcggcaagtcgaagaaggtttcgatctccaaggaaaacaccacgatcgttgacggtgccggccagaagtccgacatcgaaggccgcgttgcccagatcaaggcacagatcgaggaaaccacttccgactacgaccgcgaaaagctgcaggaacgtcttgccaagctcgctggcggcgttgccgtgatccgcgttggcggttcgacggaagttgaagtgaaggaaaagaaggaccgcatcgacgacgctctcaacgcgacgcgcgctgctgttcaggaaggcatcgtaccgggcggcggcgttgccctgctgcgttcttccacgaagatcaccgtcaagggtgtgaacgacgatcaggaagccggcatcaacatcgtgcgcaaggctctgcagtctctggttcgccagatcgcagaaaacgctggtgatgaagcttccatcgttgttggcaagatcctcgacaagaacgaagacaactacggctacaacgcccagaccggcgaatatggcgatctgatcgctctcggcatcgtcgacccggtcaaggttgtacgtaccgctctgcagaacgcagcttcggttgcttcgctgctgatcaccaccgaagcgatgatcgccgagcttcctaagaaggaatcggcaatgccgcagatgcccggcggcggcatgggcggcatggacttc

SEQ ID NO: 35448 - DNA, 1377 bp, Agrobacterium tumefaciens
cgcgaccgcatcatcgccgaccttaaggatatcctgccggaggactgtcttgtgcacgagccgcgcgagctcgtgcctttcgaaaccgatgccttcgtctcctatcgccgcctgccgctggccgtagcactgccgaaaacgacggaagaagtggcggcagtgatgagatattgccaccgttacggcattcccgtcgtgccgcgcggcgccggcacctcgctgtccggtggcgctattccgcaagaggatgctgtcgtgatcggcctctcgaagatgagcgcgatcctcgatcttgatttttacaatcgcacggcgcgggtgcaggcgggtgtcaccaatctttccatttccgatgcggccggggctgagggttttttttatgcgcccgatcccagctcgcagctcgcctgcaccattggcggcaatatcggcatgaattccggtggtgcgcattgtctgaaatatggtgtcaccaccaataatctgcttggcgtgaaaatggtgctggtggatggcacggtgctggaactgggcggcaatcacctcgatgccgcaggctacgatcttctcgctctcgtctgcggttcggaaggccagctcggcatcgtcacggaagcgacggtgcggctgatcgccaggccggaaggggcgcggcccgtgctgttcggtttcgagacctctgaagaagcgggctcctgcgtagccgatatcatcggcgccggcatcatccctgttgcaatcgaattcatggacaaaccggccatcgagatttgcgaggccttcgccaaggcgggctatccacttgacgtcggtgcgcttctgatcatcgaggtcgaaggctccgaggcggaaatggacgccatgctggccgatatcgtcaccattgccagaaaacacggtgtgaagacggtgaaagaatgtcagtcggctatggaggctgcggccatctggaagggccgcaaatccgccttcggcgcaaccggccgtatcgcggattacatctgcatggatggcacggtgccgctttcccagctttcctatgtgctgaaaaagaccagcgaaattaccgaccgtctcggcctgcgcgttgccaatgtcttccatgccggcgatggcaacatgcacccgctcatcctgttcaacgccaatgaccctgacgatgcggcccgcgcggaagaggctggcaatgaaatattgaagctctgcgtcgatgccggcggctgtctcaccggtgaacacggtgtaggcatcgaaaaacgcgacctgatgcgccaccaatatggcgaggccgatcttgcccagcagatggcggtgcgggcggcctttgacgagggctggctgatgaacccttccaaggtgtttccgctggaggggaga

SEQ ID NO: 35449 - DNA, 1230 bp, Agrobacterium tumefaciens
atgatcgaactgaccatcaccccgcccggccacccgctttccggcaaggtggagccgcccggctccaaatccatcaccaaccgcgcgcttctcttggccggcctcgccaagggcaaaagccacttgtcaggcgccctgaaaagcgacgatacgctttatatggccgaagctctgcgggagatgggcgtgaaggtcaccgagcctgacgccaccaccttcgtggtggagggaacgggcgtgctgcagcagccggaaaagccgctgttcctcggcaatgccggcaccgccacgcggttcctgactgccgccggggcacttgtcgatggcgccgtcatcatcgatggggacgaacatatgcgcaaacgcccgatactgccgctggtgcaggcgctgcgggctctcggcgtggaagcggatgcgccaaccggctgcccgcctgtcaccgtccgtggcaagggtatgggttttccaaagggcagcgtcaccatcgacgccaatctctccagccagtatgtgtcggcactgttgatggccgccgcctgcggtgacaagcccgtggatatcatcctgaagggtgaggaaatcggcgcgaagggctatatcgacctcaccacatccgccatggaagccttcggagcgaaggtggagcgggtcagcaacgccatctggcgcgtgcatccgaccggttacacggcaaccgatttccacatcgagccggatgcctccgccgccacctatctctggggcgcggagcttctgaccggcggtgctatcgatatcggcacgcccgctgacaaattcactcagccggatgccaaggcttatgaggtcatggcgcagtttccgcatctgcccgccgaaatcgacggttcgcagatgcaggacgccattccaaccatcgcggttatcgccgccttcaacgagacgccggtgcgtttcgtcggcatcgccaatctgcgcgtcaaggaatgcgaccgcatccgcgccgtctcgctcggcctcaacgaaatccgcgagggtctggcgcatgaagagggtgacgacctgatcgtacatgccgatccgtcgctcgccgggcagacggtcgatgcctccatcgatacctttgccgatcaccgcatcgccatgagttttgcactggcggcgctcaagatcggaggcatcgccatccagaatcccgcctgcgtggccaagacctatccgggctactggaaagcgcttgcctcgctc

SEQ ID NO: 35450 - DNA, 927 bp, Agrobacterium tumefaciens
atggaacgggtgaaccagctcatcctttccagggccggttccgatgtccagatgatacccgaggtggccaaccatcttatctcctccggcggcaaacgcctgcggccgatgctgacgctcgcctcggcctcgatgttcggttatgagggagataaccacatcaagctcgccaccagcgtggagttcatgcatacggcgacgcttctgcacgacgatgtggtggatgaaagcgatctgcgtcgcggcaaatccaccgcccgcaccatctggggcaaccaggcgagcgttctcgtcggcgacttcctgctcggccaggctttccgcatgatggtggatgtcggttcgctggatgcgctggatgtgctctccaccgccgcttccgtcatcgccgagggcgaggtgctgcagctttcggtcgccaagaacatggaaacgaccgaggacgattacctgcaggtgattcgcgccaagacggccgccctctttgccgccgcggccgaagtcggccccattgtcgccaagacggacaaggcgagccgcagcgcgctgaaatcctatggcatgaatctcggcctcgctttccagctggtcgacgacgtgctggactatggcggcaagtccgccgatctcggcaagaacaccggtgacgatttccgcgagggcaagatcacgctgccggtcatcctgtcttatcgccgcggcacgcaggatgagcgcgccttctggcgcaacgccatcgaaaagggcgaaagcagcgacgagaacctggaaaaggctcttggtctgatcaccaagtataacggcttgggcgacacgatcggtcgcgccacacattacggcacgattgcccgtgacgcgcttgcgccgttgccgcagagcccatggaaaaatgcacttctcgaggtcatcgacttctgcatcgagcgt

SEQ ID NO: 35451 - DNA, 783 bp, Agrobacterium tumefaciens
gatggctaccatctgcttgaaacgctggtgacattcaccgcagccggcgacatgatccgcattcgcgacgccgccaccgacagtttttccatttccggccccttcggcgatcttctaagtgccggcgatagcggcgataacctcgtcacccgcgcccgagacatcttgcgcgatgctcttgcgtcgacaggccagcccgcccgcccggtcgacattcacttggaaaagaacctgccggttgcttcgggcatcggtggcggctcggcggatgccgctgcaacgctgcgggggcttctgcggcactgggatgccgcgattgcaccggaaaagcttaagtctctcgcactgaaactgggcgcggatgtaccgatgtgccttgcaagccggccgctgattgcgcgcggcatcggtgaggacatcgaagccctcaccgacctgccggaactctccatggttctggccaatccgctgaaggctgtctcaacaccggagattttccggcgattgcagaacaaggtcaatccgcacctgcccacaccttcgacgattggctgggcgacaactggctggatggattttctcgcccaaagccgcaacgatctgcagccgccggctcaggcgctgctgcctgaaatcggggagataaccgggttgctgtctgaggaaggggccacccttgtccgcatgtccggttccggggcaacctgtttcgggatttttcattccttcgatgccgccaaaaacgcggaaacatcacttaggaaaaaacgtcccggctggtat

SEQ ID NO: 35452 - DNA, 1008 bp, Agrobacterium tumefaciens
atgaaggcggcggttgtccgcgcatttggaaaaccgctgaccatcgaggaagtggcaataccggatcccggccccggtgaaattctcatcaactacaaggcgacgggcgtttgccacaccgacctgcacgccgcaacgggggattggccggtcaagcccaacccgcccttcattcccggacatgaaggtgcaggttacgtcgccaagatcggcgctggcgtcaccggcatcaaggagggcgaccgcgccggcacgccctggctctacaccgcctgcggatgctgcattccctgccgtaccggctgggaaaccctgtgcccgagccagaagaactcaggttattccgtcaacggcagctttgccgaatatggccttgccgatccgaaattcgtcggccgcctgcctgacaatctcgatttcggcccagccgcacccgtgctctgcgccggcgttacagtctataagggcctgaaggaaaccgaagtcaggcccggtgaatgggtggtcatttcaggcattggcgggcttggccacatggccgtgcaatatgcgaaagccatgggcatgcatgtggttgccgccgatattttcgacgacaagctggcgcttgccaaaaagctcggagccgacgtcgtcgtcaacggccgcgcgcctgacgcggtggagcaagtgcaaaaggcaaccggcggcgtccatggcgcgctggtgacggcggtttcaccgaaggccatggagcaggcttatggcttcctgcgctccaagggcacgatggcgcttgtcggtctgccgccgggcttcatctccattccggtgttcgacacggtgctgaagcgcatcacggtgcgtggctccatcgtcggcacgcggcaggatctggaggaggcgttgaccttcgccggtgaaggcaaggtggccgcccacttctcgtgggacaagctcgaaaacatcaatgatatcttccatcgcatggaagagggcaagatcgacggccgtatcgtcgtggatctc

SEQ ID NO: 35453 - DNA, 1458 bp, Agrobacterium tumefaciens
gacgctctcacatttgacgatgtgttgctgcaacccggacattccgaagtcatgccgggacagacaaatatcgccacccgcattgcccgcgatatcgatctgaacctgccgatcctctcttccgccatggatacggtcaccgaaggccgcctcgccatcgccatggcccaggccggcggcatcggtgtcattcaccgtaaccttacccccatcgagcaggccgaagaagtgcggcaggtgaagaagttcgaaagcggcatggtcgtcaatccggtcaccatcggccccgacgcgacgcttgccgaagcgcaggcattgatgaaggcgcacggcatttccggcattccggtggtcgaaaacggcggtgccggcggccacaagaatggccgcctcgtcggcattctcactaaccgcgacgtgcgcttcgcctccgatccgcagcagaagatctacgaactgatgacccgcgaaaatctggtcacggtcaaggaaagcagcgtcgatcagcaggaagcgcgccgcctgctgcacaagcaccgcattgaaaagctgctggttgtggacggaaagggcaattgcgtcggtctcatcaccgttaaggatattgagaagtcgcagctaaaccccaatgccaccaaggatgcgcagggccgccttcgcgccgccgccgccatcagcgtgggtgctgatgccatcgagcgcgccgaacgcctcatcgatgccggcgttgaccttctggtcgttgataccgcgcatggccattcgcagcgggttctcgatgccgtggcgcaggtcaagaagatgtcgaactcggttcgcatcatcgccggcaatgtcgccactgccgacggcaccaaggcgctgatcgatgccggtgcggacgccgtcaaggtcggtatcggccccggctccatctgcaccacccgtatcgtcgccggcgttggcgttccgcagcttgccgcagtcatggccgcagtcgaagcggccagcctcgccgatattcctgtcatcgccgatggcggcatcaagttctcgggcgatctggccaaggcgatcgccgccggcgcttccgccgtcatgatcggctcgctgctcgccggtacggatgaaagcccgggcgaagtgttcctgtatcagggccgttccttcaaggcctatcgcggcatgggttccgttggcgccatggcgcgcggttccgctgaccgttatttccaggcggaagtgcgcgatacgctgaagctcgtgcctgagggtatcgaaggtcaggtgccctataagggcccagtctccggcgtcctgcaccagctggccggcggcctcaaggctgccatgggttatgtcggtggcagcaacatcaaggaattccaggagcgcgccaccttcgtgcgcatttccagcgccggcctgcgggaaagccacgcccatgacgtgacaatcacgcgtgaaagcccgaactat

SEQ ID NO: 35454 - DNA, 1434 bp, Agrobacterium tumefaciens
gattgtgtcgttttcggcggcacgggcgatcttgccgagcgcaagcttctgccggccctttatcaccggcaggtcgaaggccagttcacggagccgacccgcatcatcggcgcgtcgcgttcggtcatgacccatgaggaatatcgcaaattcgcgcaggacgccctgaaggaacacctgaaggccggcgaatatgacgatgcgcaggtgaccctgttcctcaaccggcttttctacgtgcccgtcgatgccaagtccggcaatggctgggacgtgctgaagaaactgctcgatgagggcaaggaacgcatccgcgcgttttatctggccgtcgcacccggcattttcggcgacatcgccgacaagatccgtgagcacaagctgatcacccgctcgacccgcatcgtcgttgaaaagccgatcggccgggatctcgcatccgcgcaggaactgaacgacaccatcggtcacgtcttcaaggaagagcagatcttccgcatcgaccactatctcggcaaggagacggtgcagaacctgatggcgctgcgtttcgccaatgcgctttacgagccgctgtggaattccgcccatatcgaccacgttcagatcaccgttgccgaagcggtgggtcttgaaggtcgcgccggttattacgacaaggccggtgcgctgcgcgacatggtgcagaaccacattctccagctgctttgcctcgttgccatggagccgcccgcttccatgaaatcggaggcagtgcgcgacgaaaagctcaaggtactgcgctcgctgaagccaatcgataccagcaatgtcgaaaagctgacggtacgcggccagtaccgcgccggcgcttccgcaggcggccccgtcaagggttatctggaagagctggaaggcggcgtttccaacaccgaaaccttcgtcgccatcaaggctgaaatcgccaactggcgctgggccggcgttcccttctacatccgcaccggcaaacgcctcgcgacccgtgtttcggaaatcgtcgtcaccttcaagcagatcccgcactcgatcttcgacgatgcggctggcaagatcgaagccaacaagctggtcattcgcctgcagccggatgaaggcgtcaagcagtcgctcctcatcaaggatcccggtccaggcggcatgcgcctgcgtcaggtctcgctggacatgagctttgccgaagccttcaacgtgcgcagccccgatgcctatgagcggctgttgatggacaccattcgttccaaccagacattgttcatgcgccgcgacgaggtcgaggccgcgtgggactggatcgaccccatcttgaagagctgggaagagctgggacagagcgtacagggttacactgccggcacctggggcccgagcggttcgatcgcactgatcgagcgcgacggccgcacctggcacgat

SEQ ID NO: 35455 - DNA, 1527 bp, Agrobacterium tumefaciens
acttccatgaccgcttcggtgacttccgctttgacgcctaacaaggactggtggcgtggtgcggtgatctatcagatctacccgcgctcctatcaggactccaatggcgacggcatcggcgatctcaagggcattaccgaccgtctgcatcacatcgccggtctcggtgccgatgcgatctggatttcgccctttttcacctcgccgatgaaggatttcggctacgacgtctcgaactatgtcgatgtcgatccgatgttcggcacgcttgccgatttcgacgggctgattgccgaagcccaccggcttggcatccgcgtgatgatcgacctcgttctgtcgcacacgtctgaccagcatccgtggttcgtggaaagccgcgccagccgcaacaatccgaaatcggactggtatgtctggtcggaagcgaagcccgatggcacaccgcctaacaactggctgtcgatcttcggcggttccggctggcagtgggatcccacccgcatgcaatattacatgcacaacttcctgacctcgcaaccggacctcaacctgcataaccctgaagtgcaggaggaactgcttaatatcacccgcttctggctgaagcgcggcgtcgatggtttccgcctcgacactatcaacttctatttccatgatctggaattacgagacaacccggcgctggcaccggagcgccgcaatgcctcgaccgcgcctgcagtcaatccctacaatttccaggaacatctctacgataagaaccgcccggaaaacatcgccttcctgaagcgcttccgcgcggtgctggacgaattccccgatatcgccgccgttggcgaagtgggcgacagccagcgcggtctcgaaatcgtcggtgaatacacctccggcgatgacaagatgcagatgtgctatgccttcgaattcctcgcacccgatgcgctcaccccccagcgcgttgccgatgtgcaggcggattttgcgcgcgcagcaccagagggctgggcctgctgggccttctccaaccatgatgtcgtgcgccatgtcagccgctggggcgagcatgtcgaggacaaggatgccttcgcgaagctgctgtcggcactgctgatgacgcagcgaggctccgtctgcatctatgagggcgaggaactgggcctcactgaagccgatattgctttcgaggacttacaggacccctatggcatccagttctggccggaattcaagggtcgcgatggttgccgcacgccgatggtgtgggatgcgggccatgcgcaggccggcttttcgacttcggacaagatctggctgcccattccggccgagcacaagcagcgcgccgtcagcgcccagcagggcaacgaggcgtcggtgctggagcattaccgccgcttcctcgccttccgcaaacagcacccggctttcgccaagggcggcatcgaattccagccgcttgagggagacgtgctgagctacacccgcaagctgggcaacgaaaccattctgtgccttttcaatctg

SEQ ID NO: 35456 - DNA, 894 bp, Agrobacterium tumefaciens
atggcagttgtgattgacgggaaggcgaaggcggcttcggtaacggaggcggtccgcaaatcggcagaagcgctcgaggcggagaagggcgtgaagcccggcctcgcggttgtcatcgtcggaaatgatccggccagccacgcttacgtgaactccaagagcaagatggcgaagcaatgcggtttcaactccatccagcacacgctgccggaagaaacgacgcaggcggcactcttgaagctggtcggcgaactgaacaccgatgcgtccatccacggcattctggtacaactgcccctgccgaaacatttcaattcggatgagatcatccagtcgatcctgcccgagaaggatgtcgatggcctcagcgtcctgaatgccggcaagctcgctaccggcgatctcgccaccggtctcatttcctgcacgccagctggcgccatgctgcttgtgcgtggcattcacggtgatgacctttccggcctcaacgccgttgtcatcggccgctcgaacctgttcggcaagcccatgggccagctcctgctgaacgccaacgccacggtgaccatggcgcattcgcgcaccaaagatcttgtcaccgtctgcaagacggccgatattctcgtggctgcggtcgggcgcgcggcgatggtgaagggcgactgggtaaagcccggcgcaaccgtcatcgatgtcggcatcaaccgcattgccgcaccggaaaagggcgaaggcaaatcgaaactggtgggcgatgtcgcctttgacgaggcaagcgctgttgccgccgccatcacgccggtgcctggcggtgtcggcccgatgacgatcgccatgctgatggccaacaccgtcatcgctgcccatcgtgcgctcggcaagaccgcgccgaag

SEQ ID NO: 35457 - DNA, 1104 bp, Agrobacterium tumefaciens
gaagtcgtgcgcgtggaaccggatatctgctatgtctgccctatcgagcccggcgagccgatcggcatccacgacaccgtcatccgcaagggtgccttccgcgtctcgcccgacgagagctggtgcgggcgcaccatcaatgcgcttggcgagccgatcgacggccaggggccgcttgcttccggcatcgtgcgccgttcgatttccaacaatgcgccgccctcgatgacccgtaaaagggtggagacaccgttcaagacgggcgtgcgggctatcgatattttctcaccgctctgccttgggcagcgtctcggtattttcgccggttcgggcgtgggcaaatccacgctgctgtcgatgctcgccaaagccgatgccttcgacaaggtggtgattgcgcttgtcggcgaacgtggccgcgaagtgcgcgaattcatcgaagacacgatgggcgataatatgagcaagtccgtcgccgtcgtcgcgacgagcgacgagagcccgatgctgcgcaagatggccccgctttccgccgtcaccattgccgagcatttccgcgatcagggcgacaatgtccttctcatcatcgacagcgtgacgcgatttgcccatgcgatccgcgaagtggcggtcgcttcgggcgaaccgcccgtcgcacgcggttatcccgcctcggtcttcaccgaactgccgcggctgctggaacgggcaggaccgggcgcggaaggcaccggcaccatcaccgccatcgtctccatcctcgtggatggtgacaatcacaacgatccgattgccgattcgacccgtggtattctcgacggccatatcgtgctggatcgcagccttgccgaagagggccgctatccgccgatcaatccgctcgcctcgatctcgcgtcttgccaagaaggcgtggacgccggatcaggaaaagctggtctcgcgcctgaaggcgctggtgcatcgtttcgaggaaacgcgggatcttcgcctcatcggcggttaccggcccggaaccgaccccgatctcgacatggcggtgaagcaggttccgatcatctatgaaacgctgaaacagctaccggacgaaccggcggcacaggat

SEQ ID NO: 35458 - DNA, 1233 bp, Agrobacterium tumefaciens
ttcctgacaaccaagagagaagtttccgaagacgtcaacgcgacggttcgcgacatcatcaacgatgtccgtcatcgcggcgatgcggcccttgcccattattcccagaaattcgacggcattgattttaccagggtttcgatgcgcgtgacggcggatgaaatcgacgccgcgttttcggcagtcgacagggccgtcatcgaggcgcttgaactcgcagcccggcgtatcgaaaaacaccatgcgcggcagatgccgaaggatgacatctacgaggacgatatcggcgtgggcctcggctcgcgctggaccgccatcgaggccgtggggctttatgtacccggcggcacggcgagctacccgagctcggtgctgatgaatgccgtaccggcaaaggtcgccggcgtggagcgtatcgtcatggtcgtgccggccaatggcggtgcggtcaatcccgcggtactcgctgcggcacgtattgcaggcgtcgaggaaatctaccgtattggtggcgcacaggctgtcgccgcacttgcctatggcacggagaccatcgcgccggtcgccaagatcgtcggcccgggcaatgcctatgtggcggccgccaagcggcaggtcttcggcactgtcggtatcgatatgatcgccggaccttccgaagtgcttgttattgccgacaaggacaatgatcccgactggctggccgccgatcttctggcgcaggcggagcatgatcgcggtgcccaatccattctcatcaccgataatgccgacctcggcaaggcggtgggggcagccgtcgagcggcagctgaagcttctttcgcgttccgagacggcggcggccagctgggccgatttcggcgcgatcattctggtcgaaaaactcaccgacgccattccgctcgccaaccgcattgccgccgagcatctggagcttgccgtcgatgacccggatgccttgatggcccacatccgcaatgccggggcgattttcgtcgggcgtcatacccctgaggtgatcggcgattatgtcggcggttccaaccacgttttgccgacggcacgctcggctcgcttctcctccggcctttcggtgctggatttcgtcaagcgcacgtcgatcctgcggctcgggcccgagcagttgcgccagcttgcgccggcggcgatcacccttgcccactcggaggggctggacgcgcatgcgcgctcggtctccattcgcctcaat

SEQ ID NO: 35459 - DNA, 2145 bp, Agrobacterium tumefaciens
gagacggacgcagacggcattgccctcgtcacctgggacatgccggaaaaatccatgaacgtcttcacggcagaggttcttgaggaactgaacgccattgtcgatgccaccgttgccgatggcgcggttaagggtgtcgtcttcacttcgggcaaaagcagcttttccggcggtgccgatctgtcgatgctgaagtccatgttcgccctttataatgacgaaaaggcgaaaagccccgacgctgccgcggcgaagctgttcgaactcgtcggtcgcatgacgggcctgttccgcaagatcgagaccaatggcaagccgtgggtctcggccatcaacggcacctgcatgggtggcgcatttgagctttcgcttgcctgccatggccgcgtggcctccagtgccaagagcctcaagatcgcactgccggaagtcaaggtcggcatcttccccggtgccggcggtacccaacgcgtatcgcgcctgaccgacgcgcaatcggcgttgcagatgatgacgacagggcaatccctgaccggcgcgcgcgccaaggccatggggctggtgcaccaggtggtcgagccggatcaactggtcgcaaccgcaaagcagatgatcaaggacggcctgaagccggtggcaccctgggatgagaagggcttcaaggcccccggcggcggcatctggacgccggccgcagcccagctctggcctgccgctcccgccatcctgcgccgcgaaagcgccggcaactacccggctgcacttgccatcctgaaatgtgtttatgaaggcctgcaattgcccttcgacacggcgttgaaggtggagcagcgttatttcaccgaaatccttcgctcgaaggaagccttcggcatgatccgctcgctgttcatttccatgcaggaactgaacaagggtgcgcgccgcccggcaggccagccgaagacggagttcaagaaggtcggcgtcgtcggcgcgggcttcatgggcgctgccgtggcttacgtcaccgccgcagccggcattcccgtgacgctggtggatcgtgaccaggacgcggccgacaagggcaagggccattgcgaggagagtgtgaaggccgccatcggcaagggcaggctgacgcaggaagagggtaaggccctgctcgacctcgttaccccgacatccgattacgccacactcgccgatgccgatctcgtcatcgaagccgtcttcgaggatcgtgacgtgaagaaggccgtcatcgaggccgtggaagccgtgttgcccgaaggtgcgatctttgcctccaacacctccactttgccaatcacgggcctcgcgaagaactcgaagcgcccggcggatttcatcggcatccatttcttctcgccggtcgagaagatgatgctgacggaagtgatcctcggcaaggaaaccggtgacaaggcgctggccgtcgcgctggattacgtggcgaagatcaggaaaacgccgatcgtggtcaacgatacgcgcggtttcttcgtcaatcgctgcgtgctgcgctatatggcggaaagctacgacatgctgatcgaaggcgtgcccgccgccatgatcgaaaatgccgcgaaatttgccggcatgccggtcggtccactggcgctgaatgacgaggtggcgatcgatctttcctacaagatcctgaaagccactgtcgccgatctcggcgaaaaggccgtcgatccgcgtcatatggaactggtgaagaagctggtggaaggcgacggccgctttggccgcaagaacgccaagggcttttacgactacccgccaaagcccgccaagaaatccctctggcccggcctgaaggacctctatccgcagcagaagcctgaagacgtggatatggatgtgctgaaacagcgcttcctcgtcaccgtggcgctcgaagccgcccgcacggtggaagaaggcatcgtcaccgatccgcgtgaggcggatgtcggctccatcctcggtttcggcttcgcgccctataccggcggtgcgctgtcctacatcgacggcatgggcgtgaagaatttcgtcgctctggccgagaagctcagcgaagcctatggcccgcgcttccagccgacgccgctcctgaaggacatggcggccaagggcgagaccttc

SEQ ID NO: 35460 - DNA, 1203 bp, Agrobacterium tumefaciens
accgacgtttacatttacgaccatgtccgcactccgcgcggacgcggcaagaaggatggcagcctgcatgaggtgccttccgttcgcctggccgccaaaacgctggaagccatccgcgatcgtaacgggctcgacacctctgctgtcgatgacatcatcatgggctgcgtcgatcccgtcatggatgccggtgcggtgatcccgaaggctgccgccttcgaggccggttactccaacagggccccgggcatgcagatctcgcgcttctgcgcctcgggtctcgacgccatcaatttcgcggccggcaaggtcaaggcgggctcggacgatatcgtcattgccggtggcgtggaaagcatgtcgcgcgtcggcatgggcatgtcgggcggcgcttggtacatggatccctcggtgaacttccccgccttcttcatgccgcagggcgtttcggctgatctcatcgccaccaaatatggtttctcgcgtgacgacgtcgacgcctatgctgtcgaaagccagaagcgtgcggcgcatgcctgggaaaacggctatttcaacaagtccgtgattccggtgaaggaccagaacgggctgacgatcctcgaccgcgacgagcatatgcgccccggcacggacatgcaggcgttggcttcgctcaacccttccttccagatgccgggcgaaatgggcggtttcgaagccgttggcatcatggcgcatccggaagtggagcgtatcaactacgtgcaccatgcgggcaactcgtccggcatcgtcgatggcgctgccgccgtgctggtcggctccaaggcgggcggcgaggcgatgggcgtgaaaccgcgtgcccgcatcaaggctttcgccaatatcggctccgacccggcgctgatgctgaccggcccggtggatgtgaccgagaagcttctgaaaaagaccggcatgtcgattgccgatatcgatcttttcgaactcaacgaagccttcgccgccgtggtcctgcgttacatgcaggctttcgacatcagccacgaccggatgaacgtcaatggcggcgccatcgccatgggccatccgctgggtgccaccggggcgatgatcctcggcacggtactggatgagctggagcggcgcgatctgaacaccgcgctcgtcacgctctgcatcggcgcgggcatgggcacggcgacggttatcgagcgcgtt

SEQ ID NO: 35461 - DNA, 983 bp, Agrobacterium tumefaciens
atgagcggattattttcctctgtcggccgcaagggcctgtttctcatcgatccggaaaaggcgcacgggctctccgttgcggcgctgaaaagcggcttcctgcccacctgcatggtgccgcatgatccgcgcctgcagcagacggtggcgggccttgtcttccccaatccgctcggcatggcggcgggttacgacaagaatgcggaagtaccgggaccgcttctgaggctcggtttcggcttcaccgaaatcggcaccgtcacgccgcgggcacaatccggcaatcccaagccacgcattttccgcctggtcgaggatgagggcgtcatcaaccgtctcggcttcaacaatgaaggccatgccgcagcgctggagcgtctgacacaggcgcgtctgcgcggcatcgtcggtgtcaatatcggcgccaacaaggatagcgaagaccgcatcgccgactatgtgcagggcatcgaggcgttttatgcggtcgcatcctatttcaccgtcaatatttcttcacccaacacacccggccttcgtgatctgcaggcgcgtgaaagccttgcggcccttctcacggccgtgctggaacgccgcaagacggaagcggagcgcctcggcaaacgcatcccgatcttcctcaagatcgcgcccgatctgactgaggaaggactggacgatgttgccgaagaggcgctcgcccacgatctcgatggcctgatcgtctcgaacaccacgctctcacgcgaaggcctgcgccctggtccccacaggggcgaggccggcgggctttcgggcaagccgctctttgagctttccaccacggttctcgccaagatgcgccgtcgcgttggcgccaatctgccgatcatcggcgttggtggtgtttcatctgcggaaacggctttggaaaaggtgcgggcaggggccgatctcgtgcagctctattcctgcatggtctatgaaggtccgggcctgccctc

SEQ ID NO: 35462 - DNA, 1152 bp, Agrobacterium tumefaciens
acccagctcgttcacggcggtacgctacgctcaccctatggtgaaacgtcggaagcgatctatctgacccagggtttcgtttacgaaaactccgaagccgccgaagcccgcttcaagggcgaaacggatggcttcatctacgcccgctacgccagcccgaccaatgacatgttcgaaaagcgcatgtgcctgctggaaggcgcggaagacgcgcgcgcgcttgcctccggcatggccgccgtcaccgccgccatcatgtgccagctgcgcgccggcgatcacatcgttgccgcacgagcccttttcggctcctgccgctgggtggtggaaacgctcgcaccgaaatacggcatcgaatgcacgctgatcgacggacgtgatctcgacaattgggaaaaggcgatccagccgaacaccaagctgttcttccttgaaagcccgaccaacccgacgctcgaagtggttgatattgccggtgtggcgaagctcgccaaccagatcggcgcgaaagtggtggtcgataacgtctttgcgacgccgcttttccagaagccgctcgaactcggcgcccatatcgtggtttattcggccaccaaacatattgacggccagggccgctgcctgggtggcgtgatcctctccgacaagaagtggatcgaagaagagctgcaggactatttccgccatacgggcccggccatgtcgccgttcaacgcctggacgcttctgaagggcatcgagaccctgccgcttcgcgtcaagcagcagacggagaatgccgcgaagatcgccgatttcctcgccgatagcggcaaggtcgccaaggtcatctatcccggccgcgccgatcatccgcaggcggatatcatcgcacggcagatgtccggaggctccactttggtggccttcgaactgaagggcggcaaggacgcagccttcaagttgcagaacgcgcttgagatcgtgaagatttccaacaatctcggcgatgccaagagcctcatcacccatcccggtacgacgacacacaagaacctctccgacgaggcgcgtgccgaactcggcatttccggaggcaccctgcgcctttcctgcggcatcgaggataccgacgatctgctggaagatctcgcaaagggtcttgcggccgtt

SEQ ID NO: 35463 - DNA, 897 bp, Agrobacterium tumefaciens
aaacattttctcgacctgtcggccgttggcccgcaggacctgcggacaattcttgacgatgcgcgcgcgcgcaaggtcgccacgaaggcgggaacggcggaaaagccgctggccggcaagatgctggccatgatcttcgaaaagccgtccacccgcacccgcgtttccttcgatgtgggcatgcgccagctcggcggcgagacccttttcctgtcgggcactgaaatgcagctcggtcgtgcggaaacgatcggcgataccgccaaggtgctgtcgcgttatgtggatgccatcatgatccgtaccacggatcattcgcgcctgctcgagcttgccgaacacgcgacggtgcctgttatcaacggcctgaccgatgatacccatccctgccagatcatggccgacatcatgacgttcgaggaacatcgtggtccggtcaaaggcaagaccattgcctggacgggcgacggcaacaacgtgctgcactctttcgtcgagggctccgcacgtttcggttaccgcatgacgatggcggtgccgatgggttccgaaccgcatgacaagttcatgaactgggcccgcaacaatggcggcgagatcgcgctgtatcatgatgcggacaaggcggtcgcgggtgcggattgtgtcgtcaccgatacctgggtgtccatgaaccaggagcacaaggcgcgcggccacaacatcttccagccctatcaggtcaatgaggccctgatggccaaggcgcagaaggacgcgctgttcatgcactgcctgccggcgcatcgcggtgaagaagtgacggacgccgtgatcgacggcccgcaatcggtggtcttcgatgaggcggagaaccgtctccacgcgcagaaatccgtcatcgcatggtgcatgggc

SEQ ID NO: 35464 - DNA, 1152 bp, Agrobacterium tumefaciens
ttgttcgatacgtttgcaagagcccccctgcgctttgagcgaggcgagggcgtctggcttttcacggaaagcggcgagcgatatctggattttgcggccggcgttgcggtcaactcgctgggccacgcccacccgcacctcgtggaagcgatcaagacccaggccgagaaggtctggcacgtctccaacctctatgaagtgcccggacaggaaaagcttgcaaagcgactgacggaagcgacatttgcggacaaggtctttttcaccaattccggcgcggaagcgctggaatgcgcgatcaagaccgcgcgccgttaccattattccaagggacatccggaaaagttccgcatcatcacatttgaaggcgccttccatggccgcacgctggcgacgatcgccgccggcggccagcagaaatatctcgaaggtttcggtcccaaggtcgaaggttttgaccaggtgccgttcggtgatgtcgatgcgctgaaggctgccatcacggccgagacggccgcacttctgatcgagcccattcagggcgagggcggcatccgcgcgccggccaaggaattcctgcagctgctgcggtcgctttgtgatgagcacgacctgctcctgattttcgatgaggtccagaccggcgttggccgcacgggcaaattttttgcctatgagcagactggtgtcgcgcctgacatcatggcggttgccaagggtatcggcggcggtttcccgctcggcgcgtgccttgcaacggcggatgccgcttccggcatgacggccggcgtgcacggcaccacctatggcggcaatccgctggccatggcggtcggcaatgccgtgctcgacgtcgttctcgctgacggctttctcgaaaaggtccgtgatgtcgcactggttttccgccaggggcttgcctcgctgaaggatcgttatcccgatgtcatcgaggaaattcgcggcgaaggcctgctgcttggcatcaaggccagagttccctcgggtgagctgctgcaggccatgcgtgcggaacatctgctcggcgtaccggcgggagacaacgtcatccgccttctgccgccactcgttacgacggcggaagaggctcgcgaagggttggcacgcgtggaagcggcagccgcatccctg

SEQ ID NO: 35465 - DNA, 1599 bp, Agrobacterium tumefaciens
tccctcattgaccttctcgaaaagagctgcaagcaatttgccgaccgcaaggccttttccagcatgggaaaatccctgacctaccgggaactcgacgctgacacccgtgcggtcgccgcatggctgcaatccagaggactggaaaaaggcgaccgggttgcggtgatgatgccgaacatcctgcaaaatcccgtcgcggtttatgggattctgcgggcgggcatggtcgtggtcaatgtcaacccgctctataccccgcgcgaactggagcaccagctcaaggactccggcgcgaaagccctgttcgtgctggagaacttcgcccatgtggcgcagcaggctgtaccgaaaaccgccgtccggcatgtggtcgtcgcagcaatgggcgatcttctcggcctcaagggacatatcgtcaatctggtggtgcgcaaggtcaagaagctggtgcccgcccatgccattcccggctcgatcagcttcaaggccatgctgaaggaaggccagggggtttccctgaaaccggtcggccttacggcgcaggacatcgccttcctgcaatataccggtgggacgacgggcgtatccaagggcgccgtcctcacccatgccaatctccttgccaacaaggcgcagatcagcctgtggctcgacgctgccttcaacggccgcaaggaccgccccgaggttctcaacttcatctgcgcgctgccgctctaccatatcttcgcactgacggtgaattcactgatgggcattgcgctgggcggccataatctgctgatcgccaatccgcgcgacattcccggcttcgtaaaagagctttcgcattaccagccgcatatcttccctggcctcaccacgcttttcaacgcgttgatgaacaatgaagagttccgcaaacttgacctgtcgtcgctcatcttcgtactcggcggtggcatggcagtgcagaggccggtggccgaacgctgggtttccgtggtcggctgccctatcaccgaaggttacgggctgtcggaaacctcgcccgtcgccaccgtcaatcggctcgatgctgcggaattcagcggcaccatcggcctgcccatctcctccaccgaaatcgatattcgcgatgaggacggcaacagtctgccaacaggcgaagtcggcgagatttgcattcgcgggccgcaggtcatggccggttactggcagaggccggatgaaaccgcgaaggcgataacggcagacggcttcttccgttccggcgatatgggcttcatggacgaacgcggttacaccaagatcgttgaccgcaagaaggacatgatccttgtttccggattcaacgtctatccgaacgaggtggaagaagtggccgccagccatcctggtgtcctcgaatgcgccgcgatcggcgttccggacgaacattccggcgaaaccgtcaagcttttcgtggtcaagaaggaccagtccctgacggaagcggagctcaaggccttctgtgccaagaacctgacgaattacaaacggccgaaaatcatcgagttccgcaccgacctgccgaaatcgaatgtcggcaagattttgcggcgcgaattgcgcaatctg

SEQ ID NO: 35466 - DNA, 1545 bp, Agrobacterium tumefaciens
gatctgcgcgccgcttttgcggccgacgaccagagattcagccgtttcagcgtcaaattcgatgacctgctgatggattactccaaatgtgccgtcaacgaagagatcgtcacgcttctcgaacagctcgcgcgcgaaggcggtgtcgaggccaagcgcgaggagatgttctccggcaaggccatcaacttcaccgaagaccgcgccgtgctgcataccgccctgcgcaatcgttccaacacgcccgttctcgttgatgacaaggacgtgatgcctgatgtgaacggcgttctggcagccatgggcaagtttgccgatgcgatccgttccggctccctgaaaggtgcgaccgggaaaaagattaccgacgtcgtcaatattggtattggcggttccgatctcggccctgttatggcgacgctggcgcttgcgcccttccatgacggcccgcgtgcgcatttcgtttccaatatcgacggcgcgcatattgccgatacgctgaagcttctcgatccggaaacctctctcttcatcatcgcatcgaagaccttcaccaccatcgagacgatgacgaatgccgccaccgcgcgccgtttcatcgccgaaaagctgggcgaaggcgccgtcaagcatcacttcgccgccgtctccaccgcgctggacaaggtcgccgccttcggtatcgaaagcgaccgcatcttcggtttctgggactgggtgggcggacgttattcgatctggtcggccatcggcctgccgctgatgatcgccatcgggcctgacaatttcggcaagttcctggatggcgcgcatgccatggatcgccacttccgcgaggcgccgatccgcgaaaacctgccgatgctactcggcctcatcggcttctataaccgtaacgtgctggactatccgacacgcgcgatcctgccctatgaccagcgcctgtcgcgtttcccggcctatcttcagcagctcgacatggaatcgaacggcaagggtgtgaccatcgacggcacgccggtcgaaggccagtccggtccggtcgtctggggcgagcccggcaccaatggccagcacgccttctaccagctgatccatcagggcacgagcgtcattccggccgaattcatgatcgccgccaatggctttgagcccgaactgcgccatcagcaccagcttcttatcgctaattgcctggcgcagtcggaagcgctgatgaagggacgtacgcttgccgaagcgaaggcccagctcacctccaagggcatggaagacagccaagccgatttcatcgcgccgcaccgtgtcttcaccggcaatcgcccctccatcaccttcgtttacgacaagctgacgccctttgcgctcggccggctcatcgcgctctatgaacatcgcgttttcgtggaaggtgtgctgttccgcatcaactcctttgatcagtggggcgtggagcttggcaaggaactggccaccggcctgcttcccgtcgtggaaggcaaggagagcgccgccggccatgacagctcgacacaagggctggtg

SEQ ID NO: 35467 - DNA, 920 bp, Agrobacterium tumefaciens
atgatcctgtgttgtggtgaagccctgatcgacatgctgccccggcagacgacgctgggtgaggcgggctttgccccttacgcaggcggagcggtcttcaacacggcaattgcgctggggcgtcttggcgtcccttcagccttttttaccggtctttccgacgacatgatgggcgatatcctgcgggagaccctgcgggccagcaaggtggatttcagctattgcgccaccctgtcgcgccccaccaccattgcgttcgttaagctggttgatggccatgcgacctacgctttttacgacgagaacaccgccggccggatgatcaccgaggccgaacttccggccttgggagcggattgcgaagcgctgcatttcggcgccatcagccttattcccgaaccctgcggcagcacctatgaggcgctgatgacgcgcgagcatgagacccgcgtcatctcgctcgatccgaacattcgtcccggcttcatccagaacaagcagtcgcacatggcccgcatccgccgcatggcggcgatgtctgacatcgtcaagttctcggatgaggacctggcgtggttcggtctggaaggcgacgaggacacgcttgcccgccactggctgcaccacggtgcaaaactcgtcgttgtcacccgtggcgccaagggtgccgtgggttacagcgccaatctcaaggtggaagtggcctccgagcgcgtcgaagtggtcgatacggtcggcgccggcgatacgttcgatgccggcattcttgcttcgctgaaaatgcagggcctgctgaccaaagcgcaggtggcttcgctgagcgaagagcagatcagaaaagctttggcgcttggcgcgaaagccgctgcggtcactgtctcgcgggctggcgcaaatccgcctttcgcgcatgaaatcgg

SEQ ID NO: 35468 - DNA, 852 bp, Agrobacterium tumefaciens
caggcacggctgctcgcgcaggctttgccctttatgcagaaatacgaaaacaagacaatcgtggtgaaatatggcggtcacgccatgggcgattccacgcttggcaaggctttcgcggaagatatcgccctgttgaagcagtccggcatcaaccccatcgtcgtccatggcggcggcccgcagatcggtgcgatgctgtcgaagatgggcattgaatcgaaattcgagggcggcctgcgcgtcaccgatgccaagacagtcgaaattgttgaaatggttctggccggctcgatcaacaaggaaatcgtcgccctcatcaaccagacaggcgaatgggccattgggctgtgtggcaaggacggcaacatggtcttcgcggaaaaggcgaaaaagaccgttatcgatcccgacagcaatatagagcgcgtgctcgatctcggtttcgtcggtgaagtcgtggaagtcgaccgcaccttgctcgatctgcttgccaaatcggagatgatcccggtcatcgcgcccgtcgctcccggccgtgacggcgccacctacaacatcaatgccgatactttcgccggcgccattgccggtgcgcttcacgccacgcgccttctgttcctcacggatgtgcctggtgttctcgacaaaaacaaggaactcatcaaggaactgaccgtgtctgaggcgcgtgcgctcatcaaggacggcacgatttccggcggcatgatcccgaaggtcgagacctgcatcgatgccatcaaggccggtgtgcagggtgtggtgatcctcaacggcaagacgccgcactccgtgcttctggaaatcttcacggaaggtgccggcacgctcatc

SEQ ID NO: 35469 - DNA, 885 bp, Agrobacterium tumefaciens
atgattactgttttcggctccatcaacatggacctcgtcgccaccgccaaacgcctgcccaagcccggtgaaaccgtgaccggagacaccttctccacggccgccggcggcaagggagccaatcaggcgctggccgcacggcgtgcaggtgttacggtgaagatggccggcgctacgggtgatgatacctttgccgcgccggcgctgaccttgctgcgcgacgcgggtaccgatctgtcattggtgaaaaccgcgcccggcccgacgggaacggcagtgatcctcatcggtgaaggcggagagaacatgatctcggtcattcccgcagcaaatggcgaagtctccgcattcgacgcgacaaaggtcgtgggcgagatggacgcaggcgatattctgatgctgcagttcgaaataccggctgcagccatcgaagcggcgctgacggctgcaaaggcaaagcgcatcaccaccgtcatcaataccgcaccgctgactgcagatggtccccgccttgccggccttgccgatatcgtcatcgccaacgaaaccgagtttgagttgctgatcggcaagaacggcctctccagtggcgaacgagagagcgaactcaaggcccttcacgacaggaccggccagactttgatcgtcacgcttggtgcagatggcgtgatcgccatgcgcaacggcaaggttttcagtgcttccggcctgaagatcgagccggtcgacacggttggtgcgggcgataccttctgtggttatcttgccgccagccttgatcagggaatggatttcgaaaaggcgctgaagcgcgccgccgttgcaggttcactcgcctgcacgcgcgccggcgcccagccttccattccgcaggcagcggaagtg

SEQ ID NO: 35470 - DNA, 837 bp, Agrobacterium tumefaciens
gaaatcgtggatcttatttaccgtgaggcggccaagacgggcgttgacccatggaccgtgcgcatcgcatgcgaaacgcttgcgacgaccaaccgcgttgttatcgccggtgaggttcgggttcccgacacgcttctgaagaaggacaaggacggcaaggtcgtcaaggacgccgccggccacccggtcatcaacccttccaagttcaagtccgccgcccgaaaggcgatccgcgacatcggctacgaacaggatggtttccactggaagaccgccaagatcgacgttctgctgcatccgcagtcggccgatatcgcgcagggcgtggataatgcctccgacaagcagggtgacgagggcgctggcgaccagggcatcatgttcggttacgcttgcaaggaaacgccggacctgatgccggcgccgatctattattctcaccgcatcctgcagctgctggccaccgcccgcaagagcggcgaaggcgaagcggcgaagctcggccccgatgccaagagccaggtgacggttcgttacgtcgacggcaaggcttcggaagccgtatccatcgttctgtccacgcagcacctcgatgccagctgggactcgaagaaggtccgtgaggtcgtcgaaccctatattcgcgaggctctgggcgagttgaagatcgctgacgattgccagtggtatatcaacccgacgggcaagttcgtcatcggcggtcccgatggcgatgccggcctgaccggccgcaagatcatcgtcgacacctatggcggtgctgccccccatggtggtggcgcattctccggcaaggacacgaccaaggtcgaccgt

SEQ ID NO: 35471 - DNA, 2664 bp, Agrobacterium tumefaciens
gagagccgcgcgacggccactccgatgatggagcaatatatcgagatcaaggcgaacaatcccggttcgctgctgttttaccgcatgggcgatttttacgaattgttctttgacgatgcggtcgaagcctcccgcgcgctcggtatcacgctgacgaaacgcggccagcatatggggcacgatattcccatgtgcggcgttcccgttcacgctgccgatgactatctccagaagctcatcctgcgcggctaccgtgtcgccgtctgcgaacagattgaagacccggctgaagcgaagaagcgcggatcgaaatccgtggtcaagcgtgatgtggtgcggctcgtcacgcccggaacgctcactgaagaaaagctgctgtcgccgacggaatccaactatctgatggcgcttgcccgtattcgcggcagtgcggaggcgcagttcgcgctggcctggatcgatatttccaccggcgtcttccgtctggcggaaaccacgctgacgcggcttctcgccgatatctggcgtatcgatccgcgtgagctgatcgttgccgacagcctgttccacgacgaggaactacggccggttttcgatgtgctgggccgtgtcgcggtgccgcagccggccatcctcttcgacagtgcggtggcagaaggccgtattgcgcgttatttcaacgtctcgacgctggatggtttcggaacgttttcacgggtggaaatggcagccgcagcagcagccgtggcctatgtcgaaaagacccagattgccgagcgtccgccgctcggcgcgccggaacgcgaaagtgcggcatcgacgctcttcattgatcccgccacccgcgccaatctggaactggtgaaaacactatccggcgaccgggatggatcgctcctgcacgcgcttaaccgcactgtcactggcggcggtgcgcgacttctggccgaacgactgatgtcgccattgaccgatccggaaaggatcaatgcccgtcttgatgccgtggcctatctcatcgatgacgtctccctgtgcgatggtctgcgtgacgcgctgaaacatgtcgcggatatgcctcgtgcgctttcccgccttgcgctggaacgtggcggcccgcgcgatcttggcgccatccggcagggtctggtttcggccgaaaaaattgcggtcattctcgacggtgggctgctgccggatgagctggcgaaagctctcagggatttgaaagccctgcccggcgctcttgaagccatgctcggctcgatgctggccgacgatctgccgcttctgaaacgcgatggtggtttcctgcgtgagggcgccaatcccgaactcgacgaagttcgcgcactgcgcgaccagtcacgccgggtgatcgccgggttgcagctgcaatatgccgatgagaccggcatcaagtcgctcaagatcaagcataacaacgtgctgggttattttatcgaggtgacggcgggcaatgccgatgtgatgatggcaacggatgaggccaaagcgcgctttatccatcggcagaccatggcgggcgccatgcgcttcacaaccacggagcttgccgatctcgaaagccgcatcgccaatgccgcggccgaggctctgaccatggagctggaagccttcgagcgcatggtcgaggccgtggtgcagcaggcggaggcgatcaaggccggggctctggcgcttgcggtgatcgatgtcgcctcaagcctcgcctatcttgcgaccgaacaggcctattgccgtccgatcgtcgatgcctccatgaccttttcaatcaagggcggccggcacccggttgttgagcaagcgctgcggcggcagtctgccgggccgttcattgcgaataattgcgatctctccgccgtcaatggtggcaagaacggtgcaatctggctgctcaccggcccgaacatgggcggtaaatcgaccttcctgcgccagaatgcgctgatcgccatcctcgcgcagatcggttccttcgttccggcggaggctgcccatatcggcgtcgtagaccggctgttttcgcgcgtcggcgcctccgacgatctggcccgtggacgctcgaccttcatggtggagatggtcgaaaccgccgccattctcaatcaggcgacggatcgctcgctggtgatcctcgacgagatcggccgtggcaccgcaacttttgacgggctttcgatcgcctgggcggccgtcgagcatctgcatgaggtcaatcgttgtcgcggcctcttcgccacgcacttccacgaactgacggtactgtcggaaaaactcggccgcctttccaatgccacgatgcgggtgaaggagtgggaaggtgatgtcatcttcctgcatgaggtcgggccgggcgctgcggatcgttcctatggtattcaggtcgcgcgacttgcgggcctgcctgcctcagtggtggagcgtgcccgtgaggtgctgacgaagctcgaggatgccgaccgcaagaacccggccagccagctgatcgacgatctgccgctgttccagattgccgtccgccgcgaggaaacccgcaaggcggggccatcgaaagtggaggaggccctgaagagcttcaacccggacgaaatgacgccgcgtgaggcattggacgcgctctatgcgttgaagaaagaactt

SEQ ID NO: 35472 - DNA, 1296 bp, Agrobacterium tumefaciens
agggttggctgggttctcgtgcgcgaaggcgtcgtgctggctttgccgtccgatgacctgcctgccccggcacaattgttgaaagccgcgctgaaacctttcgcccgcagcaaggcaaaacgggcgcagcgcagcgaccggctagccgtggcggtcgagcggcttgggccttcctatgtgaagatgggccagtttctggccacccggccggatgtggtgggcgccgatttcgccgacgatcttgcgagccttcaggaccgcatggcttttttcccggccgctgcggcgaaggccaatatcgaaggttcgctcggacgatcaatttcggagctttatagagaattcggcgacccgatcgccgccgcctccatcgcccaggtgcacccggccatggtggatacaccaaagggaccgcgcaaggtggccgtcaaggtcattcgacccggcgtgcgtcagcgtttccagaacgatctcgaggcgatgtatctgattgccgacctgcagcagcgtttcgttcgctccgcccgtcgcctgcggccggtggaagtgacacgcacgctggagcagacgaccaagatcgagatggatctgcggctcgaggccgccgcactttccgaacttgcggaaaataccagacaagatcccggcttccgtgttcccgaagtggattgggaacgcaccggccgcgacgtcgtcaccatggaatggatcgacggcgtcaagatgtcggatatcgagggactgaaggcagccggccacgacctgaacaagctggccgatacgctgatccagtccttcctgcggcatacgctgcgcgacggttttttccatgccgacatgcatcccggcaacctcttcgtcgatgcgaagggcgagatcgtcgccgtggatatgggcattgccggtcggctcggcaaaaaggaacgccgcttccttgccgaaatcctctatggcttcatcacgcgtgactacatgcgggtggcggaagtgcatttcgaggccggttacgtgccgggccatcacgacaaggccagcttcgcccaggcgatccgcgccattggcgaaccaatccacggccagccggccgagacgatctcgatgggcaagctcctgactctgctgttcgaagtgaccgagcttttcgacatggaaacgcggccggaactggtgatgctgcaaaagaccatggtggtggtggaaggcgtgtcgcgcatgctcaatccgcgcttcaatatgtggaaggcggccgatccggtcgtcggcggctggatccgtgacaatctcggtcccaaacgc

SEQ ID NO: 35473 - DNA, 690 bp, Agrobacterium tumefaciens
atgccaactctctatcactccccgatgtcgaccgcatcccggttcgttcgtctgatccttgcggaatacggcttccagaccgatctcgtggaggagcagccgtgggaaagacggcgggagtttctggcgctcaatcctgctggcaccctgccggtctatctcgatgacaatatgcgctccctcagcgggccttatgtgctggccgaatttctggacgaaacccatggggttttgaagcgcgaccggcggcttctggcggaagacccgtttcagcgcgcggaaatccgtcgcctgacggaatggtttctgcagaagatggaaaatgacgtgacccggccgctggtgcgcgaaagggtctataaattgcaaatgaccgcggcgcagggtggcggaccaccggattccaagctgctgcgcaccgcgcgcaacaatattcgccagcacatcaaatatctggagtggctggccggttcgcgcacctggctggccggcgatcggctgagctacgccgatcttgccgcagcggccggtgtttcggtgctggattatctcggcgagatcaactggctcgaagcgccgattgccaaggaatggtatcagcgggtgaaatcccgcccctccttccggccgtttctcagcgaacgcattccgcgtcttgccccctcttcccactacgccgatctggatttc

SEQ ID NO: 35474 - DNA, 1077 bp, Agrobacterium tumefaciens
atgactgaacttgataccttgaaatcgcaactgatgtcggagatcgccgccgctgccgatgagccggccatcgaggccgtgcgcgtctccgcgctcggcaagaagggctcggtttcggagcttctgaagacgcttggcagcatgacgccggaggagcgccagacccgtggcgctgccatcaaccagctgaagaccgaaatcaccgaccttatcggcgagcgcaagaacgcgctgaaggatgcggccatcgccgcccggctgaaggcggaaacggtggatgtcagcctgccggtgcgccagtcgcctaccgaacgtggccgtatccatccgatcagccagatcgtcgatgaaatcaccgccatcttcgcggatatgggtttctcgatcgccgaaggtcctgacatcgagaccgactattacaacttcacggcactgaatttccctgaaggccatccggcacgcgagatgcacgacaccttcttcttccagccggacgaaaaaggcgagcgcaaggtgctgcgcacccacacctcgccggtgcagatccgcaccatggaaagccagaagccgccgatccgcatcgtcattcctggcaagacctatcgtcaggattccgatgccacccattcgccgatgttccatcaggttgagggtcttgtcatcgacaagaaggcgcatgtcggcaatctgcgctgggtgctggaagagttctgcaagaccttcttcgaggtcgatagcgtcgtcatgcgcttccgcccgtctttcttccccttcacggaaccgagcttcgaggtggacatccagtgcgaccgttccggccccatcgtcaagttcggcgaaggcaaggactggatggaaatcctcggctgcggcatggtgcaccccaatgtgctgcgcgccggcggactggatccggatgaatatcagggctttgcctggggcatgggcctcgaccgcatcgccatgctgaaatacggcatgccggacctgcgcgatttcttcaacgccgatgtccgctggatgaaccattacggcttccgcccgctcgacatgccgacgctgttcggcggtctgagc

SEQ ID NO: 35475 - DNA, 1440 bp, Agrobacterium tumefaciens
atcggtcatttcattaatggcaagcatgtgccgggcgccagcggccgcacatcgaatgtctataacccggcaaccggcgaagtgcaggcaactgtcgcgcttgcaagcgacgccgagctgcgcgccgccgtggaaagcgccaaggcggcacagccgaagtgggccgccaccaacccgcagcgccgcgcccgcgttttcttcaagttcgtcgaacttctgaaccgcgacctcaacgagcttgcggttcttctctccagcgagcacggcaagaccgtcgaggattccaagggtgatatcatccgcggcctcgaagtctgcgaattcgtctgcggcattccgcatctgcagaagggtgagttcaccgaaggcgccggccctgccatcgacatgtattcgatccgccagccggtcggcatcggcgcgggtatcaccccgttcaacttccccggcatgatcccgatgtggatgttcgcgccggcgatcgcctgtggcaatgccttcatcctcaagccttccgagcgcgatccgtcgctgccaatccggcttgccgaactgatgatcgaagccggccttccggctggcatgctcaacgtcgtcaacggcgacaagggtgctgtcgacgctatccttaccgacccggatatcggcgcggtctccttcgtcggctcgacgccgatcgcccgctatgtttacggcaccgccgccatgaacggcaagcgcgcgcaatgcttcggcggcgcgaagaaccacatgatcatcatgccggatgccgatctcgatcaggccgtgaacgcattgatgggcgctggttacggttcggccggcgagcgctgcatggccgtttccgttgcggttccggtcggtgaagatacggccaatcgtcttgtcgaaaagctcattccgcagatcgaaagcctcagaatcggcccctacacagacgacaaggccgatatgggcccgctcgtcaccaaggaagcccagacgcgcgtcaggggcctgatcgacagcggtgtcgagcagggtgcgaagctgctggtcgacggccgtgatttcaaacttcagggttatgaggatggctatttcgtcggcggctgcctgtttgaccacgtcacccccgacatggacatctacaagacggaaattttcggaccggttctgtccgtcgttcgtgccaagaactacgaagatgcgctggaactgccgatgaagcacgaatatggcaatggcgtcgcgatctacacccgtgacggcgacgctgcccgtgacttcgcaagccgtatcaatatcggcatgatcggcatcaacgttccgatcccggttccgctcgcctatcactccttcggcggctggaaggcttcaagcttcggcgatctcaaccagcacggcacggattccatcaagttctggacgaaaaccaaaacgatcacctcgcgctggccg

SEQ ID NO: 35476 - DNA, 510 bp, Agrobacterium tumefaciens
atgggagtgagcggctccggcaagtccacggtcgcagagggactggcggagaagctgggtatcgccttcattgaaggcgacaagctgcacccgaaatccaatgtcgacaagatgtcggaaggcattccgctgaccgacgacgaccgctggccatggctcgatctgatcggcgcggaactgcgcaatggcagtgaaggcaagggcgttttggtttcctgctccgccctcaagaaaatctatcgcgaccgccttcgtgaggcgaccggtggcccactcgccttcgtttatcttgatggcagcctggagcttctcagccggcgcatgggtgaacgcaagggtcatttcatgccgctctcgctgcttcagacccagcttgccacgctggaagtgccgaccggggaaccgggtgtcgtcacggtcagcatcgattccacacctgaggagatcgtagcgaatgcgctggctggcctgaagacgctaaaattctagagcacgtccggtctaaacgga

SEQ ID NO: 35477 - DNA, 795 bp, Agrobacterium tumefaciens
aaactggtggtggtcggcgcagcgggccgtatgggacaggcactgatccgtctcattcaccagacacccggcgttcagctgcatgccgcagtggcgcgtgaaggttcggcttttgttggccgcgatgccggcgagatcgccggtcttggccccatcggcatcgaaatcaccagcgatcccttacaggcatttctgcatgccgaaggggtgatcgatttcacctcaccggcaaccagcatcacctttgccggccttgccgcgcaggcccgtatcgtgcacgtcgtcggcacgactggttgctcgccgcaagacgaggaaaagttcaaggcggcgtcgcgccatgcccgcatcgtcaagtcaggcaatatgagcctcggcgtcaacctgctcagcgttctcacccagcaggcggcgcaggcgctggatgcgcagaactgggatatcgaaattctggaaatgcaccacaagcacaaggtcgatgcgccctcgggcaccgcgctgctgctgggcgaagccgccgccgccggccgcaaggtcgatctcaccgccgcctccgtgcgcgtgcgtgacggacacacgggcgcacgtgaggccggtaccatcggttttgccacgctgcgtggcggctcggtcatcggtgaacattcggtgatcttcgccggcgaaggcgagcgcgtcgagctttcccattatgccggcgaccgctccatcttcgcacgcggcgcgatcacggcagcagtctgggccttcgacaagaagcccggtttctattccatgctggatgtgctcggcctt

SEQ ID NO: 35478 - DNA, 765 bp, Agrobacterium tumefaciens
gacgcaccgcttctgaaagtccgggacgtttccaaatattacggcgaccgcgccggttgccgcaacgtctccttcgagctttatccgggcgaggtgctggcgatcgtcggtgaatccggttccggcaaaaccacgttgctcaactgcatttccacccggctgatgccaacggcgggcagcgtggaatatcgcatgcgcgatggctcggtgcgcgacctctatcatatgggtgaggccgaacggcgttttctgatgcgcaccgactggggtttcgtacaccagaacccggcggatggactgcgcatggcggtgtctgccggcgccaatgtcggcgagcggctgatggccgtgggtaaccggcattacggtaatatcaggcaatcggcgagcgaatggctggagcgggtggaaatcggcaccgaccgtatcgacgaccagccgcgcgccttttccggcggcatgcgccagcgcctgcagattgcccgcaacctcgtcacctcgccgcgccttgtcttcatggatgaaccgaccggcggcctcgatgtttcggtgcaggcacgcctgctcgatctcgtgcgcggtctcgtcaacgatctcggccttgcggtcgtcgtcgtcacccatgatctcgcggttgcgcggctgttatcccatcgcatgatggtgatgaagggcggcgacgtcatcgaacatggcctcaccgaccgggtgctggatgatccgcgtgagccctacacgcaattgcttgtttcctccattttgcag

SEQ ID NO: 35479 - DNA, 990 bp, Agrobacterium tumefaciens
aaaatcatgaaattctcaatcgcagaggcggaggatctcgtatcctctatctttgagcgcaatggcgttctgccgcaaaatgcccgttctgtggcaaaggcgctggtcgcctccgaggcggctggccagggcggccatggttttcgccgtattcccgtttatgtccgtcaggcgcgggttggaaaggtggacggtcaggcgcgtcccgtggtgaggcgcgtgaagccgggcgtgctctcgatcgacgccaatcatggttatgcctatccggcgatcgactgcgctcttgaagaattgcctgaaatggcccgacagcagggcattgcgctggcagcgatccatcgctcccaccatgcaggcgtcatggctctgacggtcgagcgttttgcggaaatgggccttgtcgcgctcatgttcgccaatgcaccagcctccatggctccctggggcggccacacgccgctttatggcaccaaccccatcgcctttgcggcccccattggcggcgccgatccgctcgtcatcgatctggccctgtcaaaggtcgcgcgcggcaagatcatggcggcacgacagaagggtgaaaccattcccggcgactgggcgctcgatagaaacggccggccgacgaccgatccagaggaggccattgccggaaccatggtccccgcgggtgaagccaagggcgctgctctggcgctgatggtggagatcatggcagctgcggtgactggtggaaatttcgcattccaggcatcgtcccttctggatgataagggtgcgccgccctccctcggccatacgatcatcgccatcgacccggtatcctctggcggcgcagcctttaccgagcggctggccctcatcgcgggtgagatcgaaaagcaggaaaatgtgcggttgcccggtcgccgcagccagggcatccgcaagcaggcgctcgaaagcggcattgcgatcgaaagcgacattctggccgaaatccaatcg

SEQ ID NO: 35480 - DNA, 1212 bp, Agrobacterium tumefaciens
atgagacgagttgttgtcaccggcctcggtattgtttcctccatcggcggtgatgccgctgaggtcaccgcgtcgctgcgccaagccaagtccggcatttcattttcgccggattttgccgagcacggtttcaaatgccaggtctggggcaagccctctctcgacccgaccgatctggtcgaccgccgcgccatgcgcttcctgtcgcagggtggcgcgtggaaccatgtggccatgaagcaggcgatcgccgattccggtctcgaagagagcgatatcagcggcaatgagcgcactggcatcatcatgggttcgggcggcccttccacccgcaccatcgtcgaagccgccgatattacgctcaagaacaacagcccgaagcgcatcggccccttcgccgtgccgaaggccatgtcatcgaccgcctcggccacgctcgcgacctggttcaagatccacggcgtcaactattcgatctcgtcggcctgctccacctcggcgcattgcatcggcaacgccgccgagatgatccagtggggcaaacaggacgtgatgtttgcgggcggccatgaggatctcgactggtcgatgtccaacctcttcgacgccatgggcgcaatgtcgtccaaatacaatgaaacacccggcgtcgcctcgcgcgcctatgacgtcaaccgcgacggtttcgtgatcgccggcggtgcaggcgtgctggttctcgaagaactggaacatgccaaggcgcgcggcgccaagatttacgccgagatcgtcggttatggcgcaacctctgatggttacgacatggtggctccttcaggcgaaggcgcgatccgctgcatgcgtcaggcgcttgccaccgtcaagggtgacattgactacatcaacacccacggcacctccacgccggttggcgacagcaaggaaatcggcgcgatccgcgaagtcttcggcgacaagattccgcatatccagtcgaccaagtcgctcaccggccattcgcttggtgctgctggcgtgcaggaatcgatctacggcctgttgatgatgcaggaacgtttcatcggcgaaagcgcgcatatttccgaactcgatccggaatttgcgggcgttccgattgttcgcagccgcatcgacgacgccaagatcgacaccatcctttccaattccttcggcttcggcggcaccaacgccacgctcgtcttccagcgt

SEQ ID NO: 35481 - DNA, 771 bp, Agrobacterium tumefaciens
ggcatcatgcaaggtaagcgcggcctcatcatgggcgtcgctaacaatcactcgatcgcctggggtatttccaaggcacttgcggcacagggcgcggaactggccttcacctatcagggtgaagcgcttggcaagcgcgtgaaaccgctcgccgcggaactgggctcggacttcatcgtaccttgcgatgtcgaggatatcgcttctgtggatgcgctttttgcgacgatccgcgaaaaatggggcgcgctggatttcgtcgtgcacgccatcggcttttccgacaagaacgagctgaagggtctctacgccaacacgacgcgcgagaatttcagccgcaccatggtcatttcctgtttctccttcacggaaatcgccaagcgcgccgctgaactgatgaccaatggcggctccatgctgacgctgacctataatggttcgcagcgcgtcattccaaactacaacgtcatgggcgtcgccaaggcggctctcgaggcatccgtgcgttatctcgccgccgattacggcccgcgcgatatccgcgtcaacgccatctcggccggcccggtccgcacgctggcgggtgccggcatttcggatgcgcgcgcaatttacgcgtggaaccagaaaaacgcaccgttgcggcgaacggctgacatcgacgacatcggcggctccgcactttacctgctgtccagcctgtcgcgcggcgtgaccggcgaatgtcattacgtggattgcggttacaatatcacctcgacgcccacgctt

SEQ ID NO: 35482 - DNA, 1719 bp, Agrobacterium tumefaciens
cagcgcgcctggctcgccggctttctggccgggctccactcccgcaccgccatcggtctggagacctccgtcgccgccgctgcccccaaatcggcggccagcgtgttgaacatccttgtcggcacccagacgggcaatgccgaagcgcttgccatggatatcgccgctgcggcgcgcactcagggcatgcagccggtggtgacggctctggatgacgtctccatggacagcctcggctccatgaagcgggtcatcgtcgtcacttcgacctatggcgaaggcgagatgcctgacaatgcccagctgttctgggaggcgcttgctgctgacagcgcgccgcggctggacgagatgaatttcgccgtacttgccttgggtgataccggttatgacgggttctgccaggcgggtaagcttatcgacacgcgttttgaacagctcggcggcaggcgcatgaaagcgcgtatcgactgcgatatcgactttgaggatgcagccgctgcgtggatcggtgaggccctgccgcttgcgctggccgtcgatggcggcaaggaagccgctgtcaccatgcccgacatcgccgcgcagccaacgcgggcaaaatcgggctggagccgcaagaacccctatccagcgacggtaggcgttaatcgccgcctgtccggttccggctcgtccaaggaaatccgccactacgaattcgatctccgcgaaagcgggctcgattatgaggcgggtgacgcgcttggtgttgttccgcttaacaatccgaaactggccggcgcgcttctcggccatttcggagcggtcggagacagccaagtcgccgggctggaccggccggttggcgatgcgcttctcaacatctacgagatttcaacgccctcacgcgaactggtggctgaaatcggcaagcgcgctgggcatgaagaactttcccatatccttgcgaatggcgacaaggagcagctggccgcctttctctggagcaaggatattctcgacctgctcaatctaggcggaaagccgctcttcgagcttgccgaattcgtcaccttcctgaaacccttgcagcaccgcgcctattccatctcctcaagccctctgcttgcgaaagacagcgtgcatctgacgatcgccagcgtgcggtatcgcgccgagggccgggagcgtggcggcgtatgctccacctatctcgcagatcgggtggaggctgggcagagcgccggtattttcgtttcgcccaacaaggcattccgtgtcccgcaggacgataatgcgcctgttatcatggttggaccgggcacgggtattgcgccgtttcgggcctttttgcaggaacggcaggcacgcggcgccaggggcaagaactggctgtttttcggcgaccagcaccggcaatcggacttcatctatgaaaacgaacttggcgacatgagccgcgacggcgtgctgacacgcctcgaccttgctttttcacgggatcaggcggagaaaatctatgtccagacccgcatgcggcagaacggtaaggcgctttatcaatggctggaggagggcggttatttctacgtctgcggcgatgcgacccgtatggccaaggatgtcgatgacgccctgcacagcatcataagcgatgaggccggcatctccgccgaggccgcaagcgactatgtcaaccggctaaagcgtgaaaaacgctatctgcgcgacgtctat

SEQ ID NO: 35483 - DNA, 618 bp, Agrobacterium tumefaciens
acgacgatgccgaccgaggaaacggctctgcccggccgtgaagaggcacttgcagtgccggaaacccatttcgtgaatggccggcctttgaaggggccttatcccgatggtttggaaatcatctatctcggcatgggctgcttctggggcgcagagcggctgttctggaaaacgccgggcgtatgggtgacggcggttggatatgccggcggctttacccgcaacccgacctaccacgaaacaacgaccggccagacgggccacgccgaagtggtgaaggtggtctacgatccggccgtgatctcactgtcgggcctgctcaagatattcttcgaggagcacgatccgactcaaggcatgcgacagggcaacgatgtcggtacgacctatcgttccgccatttatgcgacgacggaaggccaactgcagcaggcgcagaaggcgcgggatgctttccagcaggctctggatgaggccggccacggccacgccatcaccaccgaaatcggcccgcttgaaacattttattatgccgaggactatcatcagcaatatcttgccaagaacccgggcggctactgcgggctgcggggaaccggcgtaagctgtaatataggc

SEQ ID NO: 35484 - DNA, 1887 bp, Agrobacterium tumefaciens
atggcaaaagtaatcggtatcgaccttggcacgaccaactcctgcgtcgcagtgatggatggcaaggacacgaaagtaattgaaaacgcagaaggcgcgcggaccacgccgtcgatggtggcattttccgacgatggcgaacgccttgtcggccagccggccaagcgccaggcagtcaccaacccgaccaacaccctgtttgcggtcaagcgccttatcggccgccgttatgaagacccgaccgtcgagaaggacaaggcactcgtccccttcgaaatcgtcaagggcgacaatggcgacgcctgggtgaaggctcaggacaagaattattccccttcgcagatttccgcgatgatccttcaaaagatgaaggaaacggctgaatcctatctcggcgaaaaggtcgagaaggccgtcatcaccgttccggcctactttaacgacgcccagcgtcaggccaccaaggatgccggccgcatcgccggtctcgatgttctgcgtatcatcaacgagccgacggcagcagccctcgcttacggcctcgacaagaaggaaggcaagaccattgccgtttacgaccttggcggcggcacgttcgatatttccgttctggaaatcggcgacggcgtctttgaagtgaagtcgaccaacggtgataccttcctcggtggtgaagacttcgacatgcgtctggtcgaatatctggccggcgagttcaagaaggatcagggcatcgacctgaagaacgacaagctcgctctgcagcgcctcaaggaagctgccgaaaaggcgaagatcgaactttcgtcctcgcagcagaccgaaatcaacctgccgttcatcacggctgatgcttccggtccgaagcacctgacgctgaagctgacccgcgccaagttcgaaagcctggttgacgatctggtgcaacgcactgtcgccccttgcaaggcagcactgaaggatgccggcgttaccgcggccgagatcgacgaagtcgttctcgtcggcggcatgagccgcatgcctaaggttcaggaagtcgtcaagcagctgttcggcaaggagccgcacaagggcgtgaacccggatgaagtggttgccatgggcgccgctattcaggccggcgttctgcagggcgacgtcaaggacgttctgctgctcgacgtgaccccgctgtcgctcggcatcgaaacgctgggtggcgtcttcacgcgtctgatcgatcgcaacaccacgatcccgacgaagaagagccagaccttctcgactgccgaagacaaccagtcggccgtgaccatccgcgtttcgcagggtgagcgcgaaatggcacaggacaacaagctgctcggccagttcgacctcgtcggtctgccgccgtcgccacgcggcgttccgcagatcgaagtgaccttcgatatcgacgccaacggcatcgtgcaggtatccgccaaggacaagggcaccggcaaggagcagcagatccgcatccaggcctccggtggtctctccgacgccgacatcgaaaagatggtgaaggacgccgaagccaatgccgaggccgacaagaagcgtcgcgccggtgtcgaagccaagaaccaggccgaaagcctcattcactccaccgaaaagtcggtgaaggaatatggcgacaaggtttccgagaccgaccgcaaggcgatcgaagacgccattgccagcctgaagaccgctgtcgaagccgccgagcctgacgcagacgacattcaggccaagacccagaccctcatggaagtctccatgaagcttggtcaggccatctacgaagcacagcaggccgaggccggtgatgcttccgcagaaggcaaggatgacgtcgtcgatgccgactatgaagaaatcaaggacgac

SEQ ID NO: 35485 - DNA, 2463 bp, Agrobacterium tumefaciens
cagcagcgtccgggttcctcccagtcgcagcaacgctccggctcgtccgcgccccagcagcgccaggccgaccgtccgcgtggcaatgttctgcatgatctttcggcaggcgaaatggaagcccgtcgccgcgcgctgatggaagcgcaggctcgcgacgtggttgaagccaagcagcgcgccgaagatgaagcccgccgcaaggtcgaggaagaacagcgtatcgccgccgaaaaaatggaagcagcaaaccgcgccgccgaagaggctgcggccgccaaggtggctgcaagccagcctgccgctgaagtaagagccgagcctgccagcgaaaggccggctgcggccgccgcgccggcgcctcgcactgacgcccgcccgcagtctgcggccgccgctccccgttccgctcccgccacacccgacgctgccgctccgcgcggacgccgtaccggtggtgacgatgaggacgatcgtggtgccgtgcgtcgcggcagcagccttccggcccgcggcaaggtcgtggctccggctccggccaagcccgctgctcgtctcaagacggaagaagaacgccgtcgtggcaagctgaccgtcacatccaatctggaggaagacggcacgccgcgcggccgctccatggcatccatgcgccgccggcaggagaaattccgccgcagccagatgcaggaaacccgcgaaaaggttttgcgcgaggtcatcctgccggaaaccatcaccattcaggaattgtcgcagcgtatgtccgaacgggccgttgacgtcatcaagttcctgatgaaggaaggccagatgttgaagccgggcgacgtgatcgacgccgatctggccgaactgatcgcggtcgaattcggccacaccgtcaagcgcgtgtctgaatccgacgtcgaagaaggcatcttcaaccagacggacgatgaaggcgagatggtttcccgtccgccggtcgtcaccatcatgggtcacgtcgaccacggcaagacgtcgctgctcgacgccatccgtcaggcaaatgtggtttccggtgaagccggtggcatcacccagcatatcggcgcctatcaggtcgagaagaacggtcacaagatcaccttcatcgacacgcccggccacgccgcctttacggccatgcgtgcccgtggtgcgcaggcaaccgacattgccgttctggttgttgccgcagacgacagcgtgatgccgcagacgatcgagtccatcaatcacgccaaggcagccggtgttccgatcgtcgttgcgatcaacaagatcgacaagcacgaggcaaacccggacaaggttcgccagcagctgctgcagcacgaagtgttcgtggaatcgatgggtggtgaagttcttgacgtcgaagtatcggccaagaacaagctcaatctcgacaagctgctcgaggcgatcctgcttcaggccgaaatcctcgatctgaaggcagatccgagccgcacggcggaaggcacggtcatcgaggccgaactggaccgtggacgtggcgccgtcgccaccgttctcgtgcagaagggtacactgaagcccggccagatcatcgtcgccggcgaccagtggggccgtgtgcgcgcgctcgtcaacgacaagggcgaccacgtcaaggaagccggtccggccatgccggtcgaaattctcggcctttccggcacgccctcggccggtgaccgttttgcggtcgtcgaaaacgaaagccgcgcccgcgagatttccgagtaccgccagcgtctggcccgcgacaaggctgtcgctcgtcagaccggccagcgcggctcgctcgaacagatgatgagccagttgcagacttcaggattgaaggaattcccgctggtcatcaaggcggacgtgcagggttcggtcgaagccattatcgcttcgctcgacaagctcggcacagacgaagtccgcgctcgtgtcgttcactctggtgctggtgccatcacggaatcggatatctcgcttgccgaggcatcgaacgccgcgatcatcggcttcaacgttcgcgccaacgcacaggcacgtacggcgtccgaacgcgccggtatcgaaatccgctactacaacatcatctacgatctggtggatgacgtgaaggcggcgatgtcgggtctgctttcgccggaacgtcgcgagaccttcctcggcaatgccgaaattctcgaggtgttcaacatcaccaaggtcggcaaggtcgcgggttgccgcgttgtcgagggcaaggtggaacgtggtgcgggtgtgcgtctggtgcgcgacaacgtcgtcatccacgaaggcaagctcaagaccctcaagcgcttcaaggacgaagtcaacgaagtgccggtcggtcaggagtgcggtatggccttcgaaaactacgaagacatccgcgccggcgacaccatcgagtgcttccgcgtcgaacacatcacgagaacgctc

SEQ ID NO: 35486 - DNA, 939 bp, Agrobacterium tumefaciens
aaattcgacgtactgactgtcggcaatgccatcgtcgacatcatctcccgctgcgatgatcgctttctcaacgacaatgccatcaccaagggtgcgatgaacctgatcgacgcggaacgcgccgaactgctttattcgctgatgggaccggcgctcgaagcctccggcggcagcgcgggcaacacggcggcgggcgttgcgaatttcggcggcaaggccgcttatttcggcaaggtggccgaagaccagctcggcgaaatcttccagcacgatatccgcgcccagggcgtctatttcgaaaccaaaccggaaggcacattcccgccgacagcacgttcgatgatcttcgtgaccgaagacggcgaacgctcgatgaatacctatctcggtgcctgcgtcgatctcggcccggaagacgtagaagatgacgtggtggcgaagaccaaggtcacctatttcgaaggttacctgtgggatccgccgcgtgccaaggatgccattcgcgaatgcgcccgcattgcccatgaaaacggccgcgaagtctccatgacgctctccgacagcttctgcgtcggccgctaccgcgacgagtttctggacctgatgcggtctggcacggtggacatcgtcttcgccaacaagcaggaagcgctttcgctttacgaaaccgaggattttgagctggcgctgacgaaaatcgccgccgattgcaagatcgccgcggtgacgatgagcgaagaaggcgccgtcatcctgcgcggcacggaacgtgtgaaggtggaagcctatcccgtgcatgacgtggtcgatacgacgggtgcgggcgatcttttcgccgcaggtttcctcttcggttatacgcaggaccgttcgcttgaagattgcggcaaactcggctgccttgcggcggctgccgtcattcagcaggtcggaccacgc

SEQ ID NO: 35487 - DNA, 2142 bp, Agrobacterium tumefaciens
cagcccgtagccgcaagccagaaaccggttgatacgggactggattatcacgcgctgaacgcgatgctgaacctttatgacgagaacggaaagatccagctcgacaaggaccgtctggctgcccggcaatatttcctccagcacgtcaaccagaacaccgtcttcttccataatctgcgggagaagctcgattatctggtaacggagggatattacgagcaggaagtgctggaccagtactccttcaatttcgtccgtgacctctatgacgaggcctattcccggaagtttcgttttccgaccttcctcggcgcgttcaaatattacacgtcttatacgctgaagaccttcgacggaaaacgttatctcgagcgttacgaggaccgggtctgcatggtggcgctggctcttgcgcgcggcgacgagcagctggcccgtgatctcatggacgagatcatttccggccgttttcagccggcaaccccgacattcctcaacgccggcaagaaaagccgcggcgagctggtctcgtgttttctgctgcgcgtggaagacaatatggaaagcattggccgctcgatcaattcggctctccagctttccaagcgtggcggcggtgtggcgctgtccctgaccaatattcgcgaattcggggcaccgatcaagcagatcgaaaaccagtcttccggcgtcattcctgtcatgaagcttctggaagacagcttttcctacgccaaccagttgggtgcacgccagggcgcgggcgcggtctatctgcatgcccaccaccctgatatcatgcgtttcctcgataccaaacgcgaaaatgctgacgaaaaaatccgtatcaagaccctgtcgctcggcgtcgtcatccccgacattaccttcgagctcgcccgcaacaatgaggatatgtacctgttctcgccctatgatgtggagcgggtctatggcgtgccgttgacggagatctcggtcaccgaaaaatatcacgagatggttgccgacagccgcatccgcaagaagaagatcaaggcacgtgaattcttccaggtgatcgccgaaatccagttcgaaagcggttacccctacatcatgttcgaggatacggtgaaccgcgccaatccggtcgccggccgcatcagcatgagcaatctctgctcggaaattttgcaggtcagcgaagcgagcgagttcaacgccgatctctcctatagccatatgggcaaggatatctcgtgcaatctcggctcgctcaacattgcctctgccatggactccgctgatttcggcaagacgatcgagacctccatccgggcactgaccgccgtatcggacatgagtcatatttcctccgttccttcggtggaaaagggcaatgatgccagccacgccatcggccttggccagatgaacctgcacggttatctggcgcgtgagcgcatcttctacggttcggaggaaggtatcgacttcaccaatatctatttctacaccgtgacctatcacgccatccgtgccagcaaccggctcgccgtggaacggggccagagtttcaagggctttgagaactccaaatatgcctcgggcgactatttcgacaaatataccgaccgggaatggttgcccgcgacggaaaaggtccgcgacctgttcgaaaaggccggtattgccattccgacgcaggaagactggacggcgttgaaacaggacgtcatggcatcaggcctctataaccagaaccttcaggccgtgccgccgacgggctcgatctcctatatcaaccactccacttcttccattcatccgatcgtttcgaaaatcgaaattcgtaaagagggtaagatcggtcgcgtttattacccggcttcctatctctcgaacgataatctcgaatattatcaggatgcctatgagatcgggccggaaaagatcatcgacacctatgcggcggccacccagcatgtcgatcagggcctgtcgctgacgttattcttccgcgataccgccacgacgcgcgatatcaaccgggcgcagatttacgcctggagacgaggcatcaagaccatctattacattcggttgcgccagatggcgctggaaggcacgcaggttcagggctgcgtttcctgcacgctc

SEQ ID NO: 35488 - DNA, 763 bp, Agrobacterium tumefaciens
atggcaaaagaacctatcctcacagcgcgcaatctcgttaaacgctacggtcgcgtgaccgcactcgataatgctgacttcgatctttatccgggcgaaatcctcgcggtcatcggtgataacggcgccggaaaatcctcgctcatcaaggcgatttccggtgcggtgacgcccgatgaaggggaaatcaggctcgaaggccagcccgtccagttccgttcgcccattgaggcgcgcaaggcgggtattgaaacggtctatcagaaccttgcgctctcgccggcgctttccatagctgacaatatgtttctgggccgggagatccgtaaacccggcattcagggcagcctgttccgcgcgctcgaccgtccggcaatggagaaattcgcccgcgagaaactgtccgaactcggcctgatgacgatccagaacatcaaccaggcggtggaaaccctttcgggtggccagcgtcagggtgtggctgtggcgcgtgcggcagccttcggctccaaggtcgtcatcctcgacgaaccgacggcggcgcttggcgtcaaggaaagccgccgcgtgctggagcttattctcgatgtgcgctcacgcggtctgccgatcgttctgatctcgcacaacatgccgcatgtgttcgaggttgcggatcgcatccatattcatcggctgggcaaacgcctttgcgtcatcaatccgaaggactattcgatgtcggatgccgtcgccttcatgaccggtgccaaggaagcgcccc

SEQ ID NO: 35489 - DNA, 489 bp, Agrobacterium tumefaciens
atgaccgaagatagctcccttacactggaaagaccccccgtcgtcatcatccgcggcgcgcgcaagaccgatctgcccgagctcaacgagatgatcaccctgcttgcctcctaccacggcgatgcggcggccatcacgccggccaagctggagcgcgacctgttcggcccgctcccctgggtgcatgggctggtggccgaagccgatgacgcgctgatcggttacgccctgcttttgccgctctacagggcgcaggaaggccggcgcggcctggagctgcatcatctcttcgtgcgtgacggtcatcgcggccatggcaccggccagcatctggtgtcccgtgcgcgggatatcgccaagcgccttggttgtgactatctttccgtcagcgccacgaccggcaatgtggcggcgcatcgtttctacgaaaacatggatttcgcgccgcggccggtcaccggcatgcgctacatgcagtccatcgcctga

SEQ ID NO: 35490 - DNA, 1212 bp, Mesorhizobium loti
atggcgaagatcaaggtggcgaacccggtcgtcgagctcgacggcgacgagatgacccgcatcatctggcagttcatcaaggacaagctgatccacccttatctcgacctgaagctcgaatattacgatctcggcatcgagcatcgtgacgccaccaacgaccaggtgaccatcgattcggccaacgccatcaagaaatacggcgtcggcgtgaagtgcgcgacgatcacccccgacgaacagcgcgtcgaggagttcaagctgaagaagatgtggaagtcgccgaatggcaccatccgcaacatccttggcggcaccatcttccgcgagccgatcatcatgaagaacgtgccgcgcctggtgcccggctggaccaagccgatcatcgtcggccgccacgccttcggcgaccagtaccgcgccaccgatttccgcttccccggcaagggcaagctgacgatcaagttcgtcggtgaagacggaaaggtcatcgagcatgacgtgttcgacgcacccggcgccggcgtcgccatggccatgtacaatctcgacgagtcgatccgcgagtttgcccgcgcctcgctgaattacggcctgctgcgcaactatccggtctatctgtcgaccaagaacaccatcctgaaagcctatgacggccgcttcaaggacattttccaggaagtctacgaggctgaattcgaggccgacttcaagtcgaagaagctgtggtacgaacaccgcctgatcgacgacatggtggcgtccagtctgaaatggtcgggcggctatgtctgggcctgcaagaactatgacggcgacgtccagtccgataccgtggcgcaaggtttcggctcgctcggccttatgacttcggtgctgatgacgccggacggcaagacggtggaagccgaagccgcgcacggcaccgtaacccgccactaccgccagcaccagaagggcgaggaaacctcgaccaattcgatcgcctcgatcttcgcctggacgcgcgggctggcccaccgcgccaagctcgacgacaatgcggagctgaagcgctttgccgagacgctggaaaaggtctgtatccagaccgtcgagtccggcttcatgaccaaggacctgtcgctgttgatcggtcccgatcagccctggctctcgaccaccggcttcctcgacaagatcgacgaaaacttgcagaaggcgatggcgtaa

SEQ ID NO: 35491 - DNA, 522 bp, Mesorhizobium loti
atgacagacaaggtccagaccaagaccagcgatatcgtcatccgccccggacgaatcgatgacgccgaaaccatccacgccgcgcttctcaaactcggcgcccatatcggcgcgcatcaggagatcacgtccacttcagatgatctccgccgctacggcttcggcgacaagccggccttctccacgctgatcgccgaagttggcggcgaattcgccggtctttgcctgtatttcccgatcttttcgacctggatggggcggcccggcgtttatgtgcaggacctctatgtcgaggacaggttccgcggccgcaagatcggcgagcggctgttgcggcgtgtggccgcggaatgccgcaaagaaggtggtgtctatctcaggctgtcggtcgacaccgacaatgaaggtgccaaagccttctatgaaaggctgggcatcgcctggtcgagttacgaacagacgcagaaaatcatcggcgatgccttttttgccttcgccgacgcgccggaggagcaggaatga

SEQ ID NO: 35492 - DNA, 1386 bp, Mesorhizobium loti
atgtcgaagacccagaccgccgaccaaatcaccgaggcgcgccgagaatcgcatctgttctacctgtccagcctgcgccggccgctgatcgatcgcgccgagggtatctacatgtggacgcaagacgggcgccgcttcatcgacggatcaagcggcccgatggtcgccaatatcggccattccaaccgcaatgtgctcgatgccatgaagcggcagatggaccgcgccaccttcgcctatcgcctgcacttcgaaaacgagccggcggaggaactcgcgcgggaactcgcgaagaaactgccggagggcatggaccgcatcttcttcgtctccggtggctcggaagcgacggaatcctgcatcaagctggcacggcaatgggctgttgccaccggccaggccagccgctggaaggtgatcacgcgcttcccctcctatcatggcggcacgctgggttcactctcgatcaccggcgacgacgccctggccgaaaccttcgagccgatgatgcgggtgatgccgaccgtgccggcgcccaccgcctggcgcgaccgcgacaatctttcgatggagcagcgcggtgtccgctatgccgacatgctggaggaaaaaatcctcgcggaaggaccggaaagtgtcgtcgccttcatcatggagccgatcggcggtgcggcgactgcggcgctggtggcgccggacagctactatgcgcgcactcgcgagatctgcgaccactacggcatcctgctcatccatgacgaagtgatgtgcggcgccggccgcaccgggaaattcctcggcggcgaccactggaactgcaagcccgacatcgtcgcgctgtcgaaggggctgggttctggctatgccccgctcggcgcactggcggccccgatgcggctggtgcagccgctgcttgcttccggcggcttccagcatggccatacctatgccggcaatccgctggcctgcgccgctgggcttgccgtgctcggcgaaatggaccggctcgacttgatcgccaatgccgccgccatgggcgacgtgctgatggacgggctgaaggggctggcgaagcgcttcccgttcattgcagacgtacgcggcaagggcctgctgaccggtgccgagatggtcgccgatccggagacgctgaggccgatcgagcaaggcaagaaagccacgcagcgcctgctcgacctcgcttatgagcgcgggctgatcatctatggccgccgggtcaagggcggcgtcgacggcgacaatttcatggtcgcgccaccgatgatcgtcaccagcgaacaggtcggcgagatcatttccatcatcggcgactcgctggaggttctggcttcagagctcgacctgccggtcgaaggccgggggtaa

SEQ ID NO: 35493 - DNA, 1005 bp, Mesorhizobium loti
atgctgatatcgatcctgtcatggctgctggccgtgctgttcctgctggcggtcctggggatcgcctgcctggcgctggcgacgctttggatcgccatgaaagcccaagcactggtgccgccggtcggaaaattcatcgagatcgacggcaaccgcatccactatgtcgatgtgggcgaggggcggccgatcgtcttcctgcacgggcttggcgcgcaactccatcacttccggcgcactttgttcggacatttcggcccgggttatcgcctgatcgcgctcgatcgtccgggatcgggctattcgacgcgcgcgagcggcaccaccggccgcttgcctgaacaggcggcgctggtgcgccgcttcatcgaaaaattgcaactggaaaggccgctggtcgtgggccactcgctgggtggcgccgtcacattgaccctggccgtggaacatcccgaggcaatttcgggcatcgccttgctggcgccgctgacgcatctggaaaccagggcgcggcaaagatttgacctgctgtacatcccctcccgcgtgcagcgctggatcatggcctataccgtggcgatacccctgagcctgcgctatgcgcggccgacaatggaattcatcttcgcgccgcaggcttttccgacggactacatggtcgaaggcggcggctggctcgggctgcgaccagtccatttccaggcgacatcggccgatgtcgtggccgtcgaagaggatctcggccgcatcgagcagcgctacggcgagattgtcatgcctgccggcatcctcttcggaaccgccgaccgtgtcatcgacatccgcatccatggcgagccgatgcgaggcaagatcgcggggctcgattttgaacccgtcgacggcgtcggccatatgccgcagttcgtcgaacccaagcgggtgattggcttcatcgagcggattgccgtccgcgcgtttccatcaccgcagcctcacgacaatttcaatgaaccaaccggctga

SEQ ID NO: 35494 - DNA, 1503 bp, Mesorhizobium loti
atgacaataacgatagatacaaacgccagctggcgcgacatcgcgcgggtgagcgaaggcgaatccctggcgcttagccaggcagcatgggagaggatcgcctttgcgcaccagatcgtcgcggccatcgtcgaaaaaggcatccgcgcctatggcgtcaataccggggtcggcgccttggcaagcaaggtcgtggcgcctgccctgcaaaagaaactgtcgcgcaatatcattcgcagtcacgcctgcggcgtaggtgacctcgtgccgagacgcggcgtgcgcgccatcattgccgctcaagtggctaatttcgcgcatggccgttcgggcgttagccctgcgatcgtccgcaatttgctcacctttatcgagcgcgactgcgttcccgacgtgccctcccggggatcggccgggtatttgacgcacaacgcgcatgtagcactggtcttgatcggcgaaggcagtgcaaccgtggcaggccgcccgatgagcgggctcgaggcgttggctgaaatgggtctggagccattggagcttggcgccaaggaaggcttgagcctggtcaacggcacggcgtgcgcaaccggcctgacaagcattgcggtgctgcgcgcggagcgtttgttgggatgggctgacgcggcggcggctttgacgctcgaagccgcgggcgcgcaaatgccggcttttggcgaacaaatcctggcgatgaggccctcacccggcattcaggacgtgggcagatcactgcgcggctggcttcatggcagcgaacttatcgcgctggcccatggcagtcgcacgcaggacgcactcagtcttcgcgccgtgccgcatgttcatggcgccgcccgggaggtgctggaccggtcctccgagctggtcgaccgcgaactggctgccgtcaccgacaatcccgcggtattcgggtccttgagcgatcctcaggttgtttcagaggcgcatgcggtagcgcccgccctcgggcaggccgccgacggcctgaccatcgccttggctcaggtggccggaatgagcgagcgtcggatcgatcgtctcgtcaatccgcttgtcaacaatttgccggccttccttgccgatgaggacggagccaattccggcttcatgatcgcccagtacacggccacctcgctcagcaacgtcaatcggcgtctggccgccccggcggcgaccgacggcggcgtcacatccggcctgcaagaggattttcttgcgcatccaaccgtcgcagccaacaagctgctggcggttatcgacaacgccgaatacatcctggcgatcgaactcatggcagccgcgcaggcccatgattttctggcgcggcgcggtgcccgcgcgcctggtactgacaccatctaccaactggtccgggaaaatatcgcgcactattccgacgatcggcctctgtcccgggatatggaagccttgcgcaccttcatccgcgaaatggacgtgccggcctgtccgcagcacagctag

SEQ ID NO: 35495 - DNA, 441 bp, Mesorhizobium loti
atgcgctatctgcacaccatggtccgcgtcgccgacgtcgatgcctcgctcgatttctactgcaacaagctcgggctgaaggaggtccgccgctacgaaaacgagcagggccgtttcacgctgatcttcctcgccgcctccgaagacgagcaaagcggcatcaacgacaaggcgccgctgatcgaactcacctacaactgggatccggaagactacaagggcgggcgcaatttcggccacctcgcctatgaggtcgatgacatctacgccacctgccagcatctgatggacaatggcgtcaccatcaaccggccgccgcgcgacggcaatatggccttcatccggtcgccggacggcatctccatcgagcttctgcagaagggcccggcgaaagccaaggccgaaccctgggcttcgatggccaacaccggaagctggtag

SEQ ID NO: 35496 - DNA, 1344 bp, Mesorhizobium loti
atgttccagaagatcctcatcgccaatcgcggcgaaatcgcgcttcgggtgctgcgcgcctgcaaggaactcggcatccagacggtggtggtgcattcgaccgccgacgccgacgccatgcatgtgcggcttgccgacgagagcgtctgcattggcccgccgccatcgcgcgacagctatctcaacatccatcagatcgtcgcggcctgcgagatcaccggcgccgacgcagtgcatccgggctatggattcctgtctgagaatgccaagttcgccgacatattggccgcgcacaacatcaccttcatcggcccgtccggcgatcatatccgcatcatgggcgacaagatcgaggccaagcgcaccgccaagcgcctcggcattccggtggtgcccggttccgacggcgcggtgaccgaggagaaggaagccaagcgcatcgccgccgaaatcggctatcccgtgatcatcaaggcttcggccggcggcggcgggcgcggcatgaaggtcgcgcacagcgaggccgacctcgaggtcgccctgcagacggcgcgctcggaagcaggcgcggcttttggcgacgacgccgtctacatcgagaagtacctgcagaagccgcggcacatcgaagtgcaagtgttcggcgacggatttggccgcggcgtgcattttggtgagcgcgactgttcgctgcaacggcgtcaccagaaggtctgggaagaggccaattcgccggcgctcaacgccgaggagcggtcccgcatcggcggcatctgcgccaaggccattgccgatctcggctattccggcgccggcacgatcgagttcctctacgagaatggcgagttctatttcatcgagatgaacacgcgcctgcaggtcgagcatccggtgacggaagcaatcaccggcatcgatctcgtgcatgaacagatccgcgtcgcttccggcggcggtctttcggtcaagcaggaagacatcaagttcaatggccacgccatcgaatgccgtatcaatgccgaggatccgcgcaccttcaccccctcgcccggcaccatcacgcatttccacacgccaggcggtctcggcatccgcgtcgattccggcgtctattccggctacaagatcccgccctattacgacagcctgatcggcaagctgatcgtgcatgggcgcaaccgcgtcgaatgcatgatgcggctgcgccgggcgctggatgaattcgtcgtcgacggcatcaagacgacgttgccgctgtttcgcgatctggtcggcaatgccgacatcgccaatggcgactatgacatccactggctggaaaaatacctggccaaggaagagtag

SEQ ID NO: 35497 - DNA, 435 bp, Mesorhizobium loti
ttgaaaacggttttcgtcctgaacggtcccaatctcaacgcgctcggcaagcgcgagccgggcatctatggcggcaagacgcttgccgcgatcgctgacgactgcaagcaggccggcgcgtcgctcgggctcgggatcgatttccgccagtcgaaccacgagggtgacctcgtcgactggatccaggaagccggcgacaaggctgccggcatcgtcatcaatccaggcgcctacagccacacctcgatcgcgatccacgacgccatccgttcgatcgcgccgctgccggtcgccgaagttcacctttccaacatccatgcgcgggaatcattccgccacgtctccatggtcgcgccggtcgccgtcggcatgatctgtggctttgggccgctcggctacacgctggcgctacaggcgctggccgcacgcctatga

SEQ ID NO: 35498 - DNA, 1584 bp, Mesorhizobium loti
ttgtcctcagacaccacgatcgctccagaagcgttgaccttttcagacctcggcctgtcgccgaaggtcctttccgcagtcaccgatgccggctataccgtgccgacgccgatccaggcgggcgccatcccacacgccttgctcggcaaggatattttgggcatagcccagaccggcaccggcaagacagcctccttcgtgctgccgatgctgacccgactggaaaagggccgcgcccgcgcccgtatgccgcgcaccctgattctcgaaccgacgcgtgagcttgccgcgcaggtcgaggaaaacttcgtcaaatacggcaagaaccacaagctcaacatcgcgctgttaattggcggtgtttccttcgacgagcaggacaagaagctggagcgcggcgccgacgtgctgatcgccacgcctggccgtctgctcgaccatcgcgagcgcggcaagcttttgctcaacggcgttgagatcctcgtcatcgacgaggccgaccggatgctcgacatgggcttcattcccgatatcgagcgcatctgcgagatgatcccgttcacccggcagacgctgttcttctcggcgaccatgccgccggaaatcaccaagctgacggagaagtttctgcacgcgccggtgcgtgtcgaagtttcgaaggccgcgtcggctgccaccaacatcacccaacggctggtcaaatccggctcgaagccctgggacaagcgcgagacgttgcgcaacctcatcaaagctgaagacgcggagttgaagaacgccatcatcttctgcaaccgcaaggtcgaggtgtcggagctgttccgctcgctgctgaaatatgatttcgatgccggcgctctgcatggcgacatggaccagcgcgcccgcatgcagatgctggccaatttccgtgacggcaagcttcgctacctcgtggcttctgacgttgccgcgcgcggcctcgacatccccgatgtcagccacgtcttcaactatgacgtgccgatccatgccgaggactatgtccaccgcatcggccgcaccggccgcgccgggcgctccggcaagtccttcactatcgcgaccaagtccgacaccaaatatatcgacgccatcgaacggctgatcggcaacaagatcgaatggcatgacggtgacctgtcgaccgtggtcgccagcgaaggcgaggacgatgctccgcgccggggcaaaggcgcaccgcgtcgcgccggccgcaaggacgacgatcgcaaggacaggggcgagcgcaagaagggcggcgaacgccgtgccagacacagcgaggaagatgccgcggtcgcacagcaagaacagcccgatgtggctgagacggccgtcgccgatatcagcgagcggcgcgcgcgcaaggaggcgatccgttcggaaaacaccgaacgcaaatcctccgatcgcaacgaaccgcgcgcaccggaacggggtgacacccggccgcagcgcgacaacagccgccctgcccgccatcgccaccaggaagacaacgacaccaccgttggcttcggcgacgacatgccggccttcatgcgcatcgtcgccaaggtctga

SEQ ID NO: 35499 - DNA, 879 bp, Mesorhizobium loti
atggctattttggtaaccggcagcaccgggacgatcggctcccaggtcctggcccacctgcaggggcacaacgtcgaggttcgcgccctgacacgctcccctgagacggcgcaatttcctgctggcgtgacggcggttcgcggcgacctcgccgatccggactcggtccgcgcggcgctgcggggcgtcagcactctgttcctgctggccccgaatgtcgccgatgaactgacgcaggccatgctgaccctgacggtcgcccgcgaggcgggcgtcaaaggcatcgtctatctctcggtgttcggcggcgacggctatgccgacgtgccgcattttgcgggcaagtacacggtcgagcgcatgatcgaggcgctcgacctgcccgcgacgatcctgcggcccgcctatttcatccagaacgatctccgtcagaaggacgggcttctgaagaccggcgtctatggctcgccgattggcaagaaaggcgtctcgatggtcgatatccgcgacatcggcgaagcagccgcgatcgaactgcttcgccgtgagcaggccgcgacgccgctcggccgcgagacctacgccttggttggtccggacagcctgaccggcgaaggtatcgccaccatctggagggaggcgctcggccgcgcgatccgccatggcggcgacgatctcgtcgtcatggagcagcgcacgaagacgatgctgcccgcctggcatgcgctcgacctgcgcctgatgttcagccgctatcagacggaaggcgcggtggcgaccgctgacgacatcgagcgcttgaccaaactgctcggccacgcgccccgctcctataccgcttttgccagggatgccgccgcccagtggacgaagggctga

SEQ ID NO: 35500 - DNA, 4137 bp, Mesorhizobium loti
atggcccagacccagactttcaatggccgcagacgcgtacgcaagttcttcggaaagattccggaagttgcggagatgccgaacctgatcgaggttcagaaggcatcctatgaccagttcctgatggtggacgagcccaagggcggccgtccggacgagggactgcaggctgttttcaagtcggtcttcccgatctccgatttttccggctcctcgatgctggagttcgtgaagtacgagttcgaaggaccgaaattcgacgttgacgaatgccgtcagcgcgacctgacctatgccgcgccgctgaaggtgacgctgcgcctcatcgtgttcgatatcgacgaggataccggcgccaagtcgatcaaggacatcaaggagcaggacgtctacatgggcgacatgccgctcatgaccttgaacggcaccttcatcgtcaacggcaccgagcgcgtcatcgtctcgcagatgcaccgttcgccgggcgtcttcttcgaccacgacaaaggcaagtcgcactcgtcgggcaagcttctgtttgccgcgcgcgtcattccctatcgcggctcgtggctcgacatcgagttcgattccaaggacgtcgtgcacgcccgcatcgaccgccgccgcaagattccggtgacgtcgctgttgatggcgctcggcatggatggcgaagagatcctgtcgaccttctacaacaagatcacctatgtgcgcgccggcgaccactggcgtattccgttcaacgtcgagcgtttccgcggcctcaaggccgtcggcgacctggtcgatgccgatacgggcgagatcgttgtcgaggccggcaagaagatcaccgcccgtcaggcgcgccagctcggtgagaagggcctgaaggcgatcaaggcgaccgacgaggatctgctcggcaactacctggccgaggacatcgtcaattacgccaccggcgagatcttccttgaagccggcgacgagatcgacgagaagaccctgaaggtgctgcttggcaccggcgagcaggagatcaaggttctcgacatcgaccacgtcaatgtcggcgcctatatccgcaacacgctcaacgtcgacaagaacgagagccgccaggacgcgctgttcgacatctatcgtgtcatgcgcccgggcgagccgccgacgctcgagaccgccgaagccatgttcaactcgctgttcttcgactcagagcgctatgacctgtcggctgtcggccgcgtcaagatgaacatgcgcctcgagctcaaggccgaggacaccgtgcgcgtgctgcgcaaggaagacatcctggccgtggtcaagacgctggtcgaactgcgcgacggcaagggcgagatcgacgacatcgacaatctcggcaaccgccgcgtgcgttccgtcggcgagttgatggagaaccagtaccgcgtcggcctgttgcgcatggagcgcgcgatcaaggagcgtatgtcctcgatcgagatcgacacggtgatgccgcaggacctgatcaacgccaagccggcggccgccgccgtgcgcgagttcttcggttcctcgcagctgtcgcagttcatggaccagaccaacccgctgtcggagatcacccacaagcgccgcctgtcggcgcttggaccaggcggtctgacccgcgagcgcgccggcttcgaagtgcgcgacgtgcacccgacgcattacggccgtatctgcccgatcgagacgccggaaggcccgaatatcggtctgatcaactcgctggccaccttcgcgcgcgtcaacaagtacggctttatcgagagcccgtaccgcaagatcgtcgatggcaagctgaccaatgacgtcgtctatctctcggcgatggaagaagccaagcaccatgtcgcgcaggccaacgccgagctcgacaagaatggcggcttcgtcgacgagttcgtcatttgccgcagtgccggcgaagtgatgatggcgccgcgcgagaatgtcgacctgatggacgtgtcgcccaagcagatggtgtcggtggccgcggccctgatcccgttcctggaaaacgacgacgccaaccgtgcgctgatgggctcgaacatgcagcgtcaggccgtgccgctggtgcgcgccgaggcgccgtttgtcggcaccggcatggagccgatcgttgcccgtgactccggcgccgccatcggcgcccgccgcggcggcatcgtcgaccaggtggacgcgacgcgtatcgttatccgcgcgacggaagatctcgatccgggcaagtccggcgtcgacatctaccggctgatgaagttccagcgttcgaaccagaacacctgcatcaaccagcgtccgctggtgcgcatgggtgaccgggtcaacaagggcgacatcatcgccgacggtccgtcgaccgagctcggtgatttggcgctcggccgcaacgtgctggtcgcgttcatgccgtggaacggctacaactacgaggactcgatcctgctctccgagcgcatcgtcgccgacgacgtcttcacctcgatccacatcgaggagttcgaggtcatggcgcgcgataccaagcttggtccggaggaaatcacccgcgacattccgaacgtttcggaagaagcgctgaagaacctcgacgaagccggcatcgtctatatcggcgcggaagtgcagccgggcgacatcctggtcggcaagatcacgccgaagggcgagagcccgatgacgccggaagaaaagcttctgcgcgccatcttcggtgaaaaggcttccgacgtgcgcgacacttcgatgcgcatgcctccgggtactttcggcaccgtcgtcgaggtgcgcgtgttcaatcgccacggtgtggagaaggacgagcgcgccatggcgatcgagcgcgaggagatcgaacgcctcgccaaggaccgcgacgacgagcaggccattttggaccgcaacgtctacgcgcgtctttccgacgtgctcgtcggcaaggaagcgatcgctggaccgaagggcttcaagaagggctcgacgctgtccaaggacacgctcgacgagtatccgcgttcgcagtggtggcagtttgccgtggagaatgaaaagctccagagcgaactggaagccctgcgtggccagtacgacgactccaagaaggcgctcgaacagcgcttcatggacaaggtcgagaaggtgcagcgcggcgacgaaatgcctccgggcgtcatgaagatggtcaaggtcttcgtggcggtgaagcgcaagatgcagccgggcgacaagatggccggccgtcacggcaacaagggtgtcgtgtcgcgcatcgttccggtcgaggacatgcctttcctcgaggacggcacgcatgccgatatcgtgctcaacccgctgggtgtgccgagccgcatgaatgtcgggcagatcctggaaacgcatctgggctgggcctgcgcgggcatgggcaagaagatcggcgagctgatcgacacctacaaggcggcgggcgacatcaagccgctgcgcaagacgctggaaagcttcatgccggccaatgaccgcaacgagccgatccgcgagtatgacgacgagagcattgttcgcctcagcgagcagatgcgccgcggcgtctcgatcgcgaccccggtgttcgacggtgcgcacgaggctgacatcaacatcatgctggagcaggcgggcctgcacaccagcggtcagtcgcagctctatgacggacgcacgggcgagccgttcgatcgcaaggtgacgatgggctatatctacatgctcaagcttcaccacctggtggacgacaagatccacgcgcgttcgatcggtccgtactcgctcgtcacccagcagccgctgggcggcaaggcgcagttcggtggccagcgcttcggcgaaatggaggtctgggcgctggaagcctacggcgccgcctacacgctgcaggaaatgctgacggtgaagtcggacgacgtcgccggccgcaccaaggtctacgaggcgatcgtgcgcggcgacgacacgttcgaggccgggattccggagagcttcaacgtgctcgtcaaggaaatgcggtctctcggcctcaatgtcgagctggagaacaccaagctcgacgacgcccctgtccggctgcccgacgcggccgagtaa

SEQ ID NO: 35501 - DNA, 834 bp, Mesorhizobium loti
atggcactgaaaaaattcaacccggtaacgccgagcacccgccagctggtcatcgtcgaccgctcgggcctttacaagggcaagcccgtcaagggtctgaccgagggcctgaccaagtcgggcggccgcaacaattacggccgcatcaccgcccgcttcatcggcggtggtcacaagcgttcgtaccgcatcatcgacttcaagcgccgcaagttcgacgtcgtcggcacggtcgagcgcattgaatacgatccgaaccgcaccgccttcatcgcgctgatcaagtacgatgatggtgagctgtcctacatcatcgccccgcagcgccttgccgccggcgacaagatcgtggctggcgaagcggtcgacgtaaagccgggcaatgcgatgccgctggcctcgatgccggtcggcacgatcgtccacaacatcgagctgaagccgggcaagggcggtcaggtcgcccgttcggctggcggttacgctcagctcgtcggtcgcgaccagggcatggcgatcctgcgcctcaactcgggtgagcagcgtgtcgttcacggctcctgcatggccaccgtcggtgccgtgtcgaaccccgaccacggcaacatcaacgacggcaaggccggccgcacggtttggcgcggcaagcgtccgcacaatcgcggcgtgaccatgaacccggtcgaccatccgcacggcggtggtgaaggccgcacctccggcggccgccatccggtcagcccgtggggcaagccgaccaagggcaagaagacgcggtccaacaaggcgaccgacaagttcatcctgcgctcgcgccatcagcgcaagagctaa

SEQ ID NO: 35502 - DNA, 1041 bp, Mesorhizobium loti
atgacgaaatacaagctcgagtacatttggctcgatggttacaccccggtccccaaccttcgcggcaagacgcagatcaaggaattcgccgaattcccgacgctcgaacagctgccgctgtggggcttcgacggttcctcgaccatgcaggccgaaggccgcagctccgattgcgtgttgaagccggtggcgctttacccggatccggcccgcaccaacggcattctcgtcatgtgcgaggtcatgatgcccgacggcgtcaccccgcatgaatcgaacagccgcgcgaccatcctcgacgacgaggacgcctggtttggtttcgagcaagagtacttcttctacaaggacggccgcccgctcggcttcccggagagcggttatcccgcgccgcagggcccttactacaccggcgtcggctacaagaacgtcggcgacgtcgcgcgcaagatcgtcgaagagcatctcgaccagtgcctcgcggccggcatcaaccatgaaggcatcaacgccgaagtggccaagggccagtgggaattccagattttcggcaagggctccaagaaggccgccgaccagatctggatggcgcgctacctgctcctgcgtctgaccgagacttacggcatcgacatcgagttccactgcaagccgctcggcgacaccgactggaacggctcgggcatgcactgcaatttctcgaccaagttcatgcgcgaagtcggcggcaaggcctatttcgaagccctgatggcgcagttcgacaaaaacctgatggaccacatcgccgtctacgggccggacaacgacaagcgcctgaccggcaagcacgagaccgcgccgtggaacaagtttagctatggcgtcgccgaccgtggcgcatcgatccgcgtgccgcactccttcgtcaagaatgactacaagggctatctggaagaccgtcgtccgaactcccagggcgacccctaccagatcgcttcgcaggtgctgaagacgatctcgcaggttgcgaccgacgcgaaggtctcggccgccgcctga

SEQ ID NO: 35503 - DNA, 1404 bp, Mesorhizobium loti
ttgcccagcaacgtcaccgcggaactctccggtttcgcagcgctgggaatcacgggtgcgctgctcaaggccacccacaatgccggattcaccgaaccgaagccgatccagatgcaggcaatcccgccgcagctggaaggccgtgacattttcggcatcgcgcagaccggctccggcaagaccgcggcctttgcgctgcccatcctgtcgaagatcatcgcgctcggcaccaagcggcgcgccaagacgacccgcgcgctgatcctggcgccgacccgcgaactcgccgtgcagatcgaggataccatcaagatcctcgccaagggcgcccatgtctcgacggcactcgtgctgggaggcgtctcgcgcttcagccaggtgaagaaggttgctcccggcgtcgatatcctgattgccacgcccggccggttgaccgacctggtgcgcgagggcgacctcatcctctccgataccaaatggctggtgctggacgagggcgaccgcatgctcgacatgggcttcatcaacgacgtcaagcgcatcgccaaggcgaccgcgcctgaccgccagacggcgctgttctcggccaccatgccggacgagatcgccgaactggcaaagggcctgttgaagaaccccgtccgcatcgaagtctcgccgcaaagcaccgcggcggctgagatcgtccagggcgtcgtcttcgcccgcaccaagcagaagcgccaggtgctgtcgacgatgctcgcagacgaggcgatgaagtccgtcatcattttttcccgtaccaagcatggcgccgacagggtgaccaaggacctcgagcgcgatggcttcaaggccgccgtcatccatggcaacaagtcgcagaatgcccgtcagaaggcgctgaacgatttccgtgagggatcggtccgcattctggtcgcgacggacatcgcggcgcgcggcatcgacgtacccggcatcagccatgtcgtgaatttcgacctgccggacgaggctgaaagctacgtccaccgcatcggccgcaccggccgcaacggcatggacggcatcgcgatcacgctttgcgatccttcggagaacagcaagctgcgccaggtcgagcgcatcatccgcaccaagctgccgatcgttgccgaccatctcggcagccccgatccgcagcgcaatccggctgaaaagaacgagcgcttcgagcccgccaatgatcgcaacgaccgcaatggccgtcgcgacggcaggcggccgggcggcgagaacaagggcaacggctttggcaagaagcgcttcggcgacaagccggcctttgccggtgagcgcaagccggaaggcgccaagcccttcaagggcaacaacaagcgccgtttcggcggcaagcgtccggcagcgcgggctgcttaa

SEQ ID NO: 35504 - DNA, 822 bp, Mesorhizobium loti
atgacactctatcgggccgatccgaaacacggcgtcgcctgggtcacgggcggcagcagcggcattggccgctcgctggccagggatctggcgtcccagggctatgcggtggcggtaacggcactggacgatgatccgatcgacacgctcatcgtcgagaccgcgcagatgccgggcagcgtcacggcctttccctgcgacgtcacggacgagccgcgcatggcaagaacggtggccgcgatcgagaaggagctcggccctatcgtgctcgccgtcttcaatgccggaaactacatttcgacgcctggagaagccctcgtcgtcaaggactttcgccgcactttcgaagttaattatttcggcatcatcaacggcttggtgccggtcgttgagtatatgcgcgtgcgatcgcgcggccatgtcgtgctggtcggatcggttaccgcctatttcggctggccaaccactgccgcctatggcggcaccaaggcggcgatcaacatcctggccgagtcgctgaagtatgatttcgacaagatgaacatccgcgtccaggtgataaaccccggctttgtcgacacgccgctgaccgaaaagaacatgctgccgatgccgggcctgatgcccgtcacccgcgcgacgcgccgcatgatcaaggcaatcaaatctggcggcttcgaagtcacctttccttaccgaacgagctggccgctgaaatttctcgctttgttgcccaggccgataagccgatgggtgatcagcttgatgaccagctggaaggcacggccgctgcattacgagcgcaagccacccaacgaatag

SEQ ID NO: 35505 - DNA, 882 bp, Mesorhizobium loti
atggcccaggacagtcctttcaccgtcgatgcggactggctgcaggcgcgcctgggcgagcccggcctgaccatcgtggacgcatcctggtacctgccggcgcaaaagcgcgacgcgcgcgccgaatataatgcagcgcacatcccgggcgcccgtttcctggatcaggacgcggtgtcggatcccgacgctgctttgccgcacacgctgccttcgcctcagcatttcgcgcaatatgttggttcgatgggcgtgtccgccgatgacaccattgtcgtctatgatggtcccggctttttctcggcaccccgggcatggtggatgttccgcattatgggtgttttccagacctatatcctggatggcggattcgacgcctggaaaacggccggccggccggtaacggccgagccgacgaagatcgcgccaagcgtgttccatgccgatttcgacgccggccgcgtcgccagcctcgccgacatgcgccggatcgtcgagaccagcgccagccagattgccgacgcccgtggacccggccgcttcaccggcgccgagcccgagccccgcgcgggtatccgctccggccatatgccgggagcgcgcaacgtaccgtactccgccctgtcggaaaacggcatgctgttgtcgaaggaccgtttgcgcaaggtgatcgaggaggccggcattgacctgtcgaagcccgtcgtcacatcttgcggctccggtgtcaccgccgcggtggttacgctggcgctggagacgcttggccacaccgacaacaggctctatgacggctcatggacggaatggggcgggctctccgacacgcctgtcgtgaccggccccgcgacgcccggtcccgctaagaccggcaaggaatga

SEQ ID NO: 35506 - DNA, 1275 bp, Mesorhizobium loti
atgaccgccatcatcgacattgtcggacgtgaaatcctggacagccgtggaaacccgaccgtcgaggtcgatgttgtacttgaagacggttcgatgggccgcgccgcggtgccgtcgggcgcctcgaccggcgcccatgaagccgtcgagcttcgcgacggcggcgcccgctatctcggcaagggcgtgctcaaggccgtagaggcggtcaatggcgagctgttcgaagcgatcggcggcatggaagccgaaaaccagatccatatcgatcagaccatgatcgagcttgatggcacgcccaacaagagccggctcggcgccaatgccattctcggcgtttcgctggcggtggccaaggccgcggccgatgccgccggcctgccgctctatcgctatgtcggcggcaccaaggcgcacattctgcctgtgccgatgatgaacatcatcaatggcggcgcccatgccgacaatccgatcgacttccaggaattcatgatcctgccggtcggcgcgccgactttgcgtgaaggcgtgcgctggggctcggaaatcttccacacgctgcgcaagaagctgaaggatgccggccacaacaccaatgtcggcgacgagggcggctttgccccgaacctgaagagcgcgccggtggcgctcgatttcatcatggaatcgatcgagaaggccggcttcaagccgggcgaggaaatcgcgctcggcctcgattgcgccgcgaccgagttcttcaaggacggcaattacgtctatgaaggcgagaagaagacgcgcgatcccaaggcccaggccaagtaccttgccaagctcgccgccgactatccgatcgtctcgatcgaggacggccttgccgaggacgactgggaaggctggaaatatctgaccgacttgatcggcaagaagacacagctggtcggcgacgaccttttcgtcaccaacacggcgcggctgcgcgacggcatccgcatgggcgttgccaattcgatcctggtcaaggtcaaccagatcggctcgctgacggaaacgctcgatgccgtcgagaccgcgcacaaggctggctacaccgccgtcatgtcgcaccgttcgggcgagaccgaggattcgaccatcgccgatctcgccgtcgccaccaattgcgggcagatcaagaccggctcgctgtcgcgctccgaccgcatggccaaatacaaccagctgatccgcatcgaggaagagcttggcaagcaggcgcgttacgccggcaagtcggtgatcaagggctga

SEQ ID NO: 35507 - DNA, 1038 bp, Mesorhizobium loti
atggccaccgcagccagaaaagcgcctgccaaatcgaaatccgaaggcaaatcagggctttccgcgcccaagcctgctgaattcaccaaggacgaagagcttgccgcctatcggcacatgctgctcatccgccgcttcgaggaaaaggccggccagctctacggcatgggcttcatcggcggcttctgccatctctatatcggccaggaggctgtcgtcaccggcatgaagatggcgctgatcgacggcgaccagatgatcacagcctatcgcgaccacggccacatgctagccatggagctttcgccgcgtggtgtcatggccgagctgaccggacgccgtggcggcctgtccaagggcaagggcggctccatgcacatgttctctaaggagaagcatttttacggcggccacggcattgtcggcgcgcaggtgtcgctcggcaccggcctggccttcgccaatcgctaccgcgacaacaacaacgtctcgctgacctatttcggcgacggcgccgccaaccagggccaggtctatgaaagcttcaacatggcctcgctgtggaaactgccggtgatctacatcatcgagaacaaccgctacgccatgggcacctcggtgtcgcgatcttcggccgaaaccaatttttcgcatcgcggcgcttcgttcaagattccgggcatccaggtcgacggcatggatgtgcgtgcggtcaaatccgccggcgatcaggcgaccgaatggtgccgcgccggcaacgggccgatcattctcgaaatgcagacctaccgctaccgcggtcactcgatgtctgacccggcgaaataccgctcgaaggaagaagtgcagaagatgcgctcagagcatgacccgatcgaacaggtcaaggctcggttgaccgagaagaagtgggcgaccgaggacgagctcaagaccatcgacaaggaggttcgcgacatcgtcgccgacgccgccgaatttgcccagaacgatgcggagccggatccgtccgagctctggaccgatatcgtattgtaa

SEQ ID NO: 35508 - DNA, 1386 bp, Mesorhizobium loti
atgccgatcgaaattctcatgcccgctctctcgccaaccatggaagagggcaatctttccaagtggttgaagaacgagggcgacaaggtcgtcgccggcgacgtcatcgccgagatcgagaccgacaaggcgacgatggaggtcgaagccgtcgatgagggcacgctcgccaagatcgtggttcccgccggcaccgagggcgtcaaggtcaacgcggtgatcgccgtgcttgcggttgaaggcgaagacaccgacaaggccggcgaaggcatcggcgaagagcccgccaaggctgaaacggcttcaccggcaccagttgctgccaagagcgaggccgccgcaccagtcgcggcagcaccgaagaccgagatcgccgccgatcctgacatccctgccggcaccgaaatggtctcgaccacggtacgcgaagcactgcgcgatgccatggccgaagagatgcgccgcgacggcgatgtcttcgtcatgggcgaggaggtcgccgaataccagggcgcctacaagatcacccaaggcttgctgcaggaattcgggccgcgtcgcgtcgtcgacacgccgatcaccgagcatggttttgccggcgtcggcgtcggtgcggcgatggctgggctgaagccgatcgtcgagttcatgaccttcaatttcgccatgcaggcgatcgaccagatcatcaattcggccgccaagacgctttacatgtccggcggccagatgggcgcgccgatcgtattccgcggaccgaacggggccgctgcccgcgtcgccgcccagcactcgcagtgctacgccgcctggtacagccacattccgggcctgaaggtggtgatgccgtatacggccgctgacgccaagggcctgctcaaggcggcgatccgcgacccgaacccggtcatctttctcgagaacgaaatcctctacggccagtccttcgacgtgccgaagcttgatgatttcgtgctgccgatcggcaaggcccgcatccacaagcaaggcaaggacgtcaccatcgtctccttcggcatcggcatgacctacgcggtcaaggcggaagcggaattgcgcggcctgggcatcgacgccgagatcatcgatttgcgcaccatccgcccgctcgacctcgacaccatcatcgcctcggtcaagaagaccaaccggctggtcgtcgttgaagaaggcttcccgcagagctcggtcggcgaccacatcgccaaccaggtgtcgcagcgcgctttcgatttccttgacgcgccggttatcaccattgccggcaaggatgtgccgatgccctatgcggccaacctcgaaaagctggctttgccgaatgtcggcgaggtcatcgaggcggtcaaagccgtcacatatcgctga

SEQ ID NO: 35509 - DNA, 1362 bp, Mesorhizobium loti
atgccaatcaacatcaccatgccggcgctctcgcccacgatggaagagggcaatctgtcgaaatggctggtcaaggaaggcgacaaggtttcacccggagacgtcatcgccgagatcgagaccgacaaggcgacgatggaggtcgaggccgtcgatgagggcacggtggccaagctcgtcgttcccgccggtaccgaaggcgtcaaggtcaatgcgctgatcgccgtgcttgcggccgagggcgaggatgcgagcgccgccgcaaaaagtggtggcggtgccgcaccggcgaaagccgaggctccgaaagcggacgctcccaaggctgaggcaccaaaggctgaacctgctgccgcagccgctcccaaggcagagccggctccggtcgccaatggccacgcggctggcgagcgcaccttcgcttcgccgctcgcgcgccgcatcgccaaggaggccggcgtcgacgtgtcggccgtgaccggcaccggcccgcatggccgtgtggtgaaggccgatgtcgatgcagcgattgccggcggtggtgccaaggcagccctcgccgccaaggctccggccggtgcgccggcggctcccgcgccggctgtgaagccgatgtcggacgaccaggtgctgaagctgttcgagcaaggctcctacgaactcgtcccgcacgacaatatgcgcaagaccatcgcgcgccggctggtcgaggccaagtccaccatcccgcatttctacctgacgctcgactgcgaactcgatgcgttgctggccttgcgcacgcagatcaatgccgccgcaccgatgaagaagaccgaaaagggtgacgtgcctgcctacaagctgtcggtcaacgacatggtgatcaaggcgatggcgatggcgctgaaggcggtgccggatgccaatgcctcgtggaccgaaaccgccatggtcaagcacaagcacgccgatgtcggcgttgccgtgtcgatccccggcggcctgatcacgccgatcatccgtaaggcggacgaaaaaacgctgtcgaccatttccaacgagatgaaggacctggccagccgcgcgcgcagccgcaagctgaagccggaagagtatcagggcggcacgacggcggtctccaatctcggcatgttcggcatcaaggactttgccgccgtcatcaatccgccgcatgcgacgatcctggcggtcggcgccggtgaagagcgggctgtggtcaagaatggcgagctcaaaatcgccaccgtgatgtcggtgacgctgtcgaccgatcatcgcgccgttgatggcgcgctcggcgccgagctgctggtcgccttcaagcggctgatcgagaacccgatgggcatgctggtctag

SEQ ID NO: 35510 - DNA, 1446 bp, Mesorhizobium loti
gtggctgagaactacgacgtcatcatcatcggctcgggccccggcggctatgtcacggcggtgcgttccgcccagctcggcttcaagacggcgattgtcgagcgcgagcatctcggcggcatctgcctcaactggggctgcatcccgaccaaggcgctgctgcgttcggccgagatcatgcactattccgaccatctgaaggactatggcctgaagctcgatggcaaggtcagcgtcgacacgtcggccgtggtcgaccgctcgcgcaaagtctcgctgcggctcaatggcggcgttgccttcctgatgaagaagaacaaggtcgacgtcatctggggcgaagccaagctgtcgaagcccggtgaggtcgtcgtctccaagacggccaagacgccgatggagccgcagccgccggtaccgaagggcgtcaagggcgagggcacctataccgccaagcacatcatcctggcgaccggcgcgcggccgcgcgcgctgccgggcatcgagccggacggcaagctcatctggacctatttcgaggccatggtgccgaaggaaatgccgaagtcgctgctggtgatgggctcgggcgccatcggcatcgaatttgcctccttctaccgcaccatgggcgccgacgtgacggtggtcgaactgttgccggcggtgatgccggtcgaggatgccgaggtctcgaaattcgcgcaaaaacagttcgagaagcaaggcatgaagatcattctcgaagccaaggtgaccaaggtcgagaagggcgccaactcggtcaccgcgcatgtcgagatgaaggacggcaaggtcgagaagatcaccgccgaccgcatgatctcggccgtcggtgtccagggcaatatcgagaatctcggccttgaagcgctcggcgtgaagaccgaccgcggctgcattgtcgtcgacggctatggcaagaccaatgtaccaggcatctacgccatcggcgatgtcgccggcccgcccatgcttgcccacaaggccgagcatgagggcgtcgtgtgcgtggaaaagatcgctggtttccccggcgtgcacgccatcgacaagctcaagatcccgggctgcacctactgcaatccgcaggtcgcctccgtcggcctgacggaagccaaggccaaggccgaaggcaaggatatccgcgtcggccgcttccagttcgcggctaacggcaaggcgatcgcgcttggcgaggaccagggcttcatcaagaccatcttcgacaagaagaccggtcagctgctcggcgcccatatggtcggcgccgaggtgaccgaactgatccagggctttgtcgtggcgatgaacctcgagacgaccgaggaagagctgatgcacaccatcttcccgcatccgacgctgtcggagatgatgaaggaaagcgtgctcgacgcctatggccgcgccttgaacgcatga

SEQ ID NO: 35511 - DNA, 1185 bp, Mesorhizobium loti
atgttcgaagacctgcagccagctcccgccgacaagatcctggccctcatcggcctctatcgcgccgatccgcgtcccaacaaggtcgacctcggcgtcggcgtctacaaggatcgcgacggcaagaccccagtgatgcgcgccgtgcgtgaggctgaaaagcggctgctgaacagccaggacaccaagacctatctcgggctcgccggcgacaccggcttcaacgcggtgatggccaagctcgccttcggcccgggcgcggacatgacgcgcattcgggcggcccaggcgcctggcggctccggtgcgcttcgcctggtggcggagctgctcaagcggacccgttcggacgccacgatctggctgtcggacccaacctggccgaaccatatgccggtgatgcgcgctgccggcctgcagatccgcgaatatccctatttcgacgcggcctccggtgctgttcgcttcgacgacatgctggcggcgttgcggacggccaagagcggcgacgtggtgctgctgcacggctgctgccacaatccaaccggcgccaatctggatgcggcgcagtggcaggccgtcaccgatctgatggtcgagcgcggcctgctgccattcgtcgacatcgcctatcagggctttggcgacggcctcgaggccgacgctcttggcctgcgcctgctggcggcgaaagttccggaaatggttgttgcctcgagctgctcgaagaatttcgccgtctaccgcgaccgtgtcggcgcagcgatggttttggccagggacagcgcgcaggctgacgtggcgatgagccagatgctgtcggcggcgcgcgccatgtattcgatgccgccggaccatggtgccgcggcggtgcgcatcgtgctcgaagacgcaagcctgcgcgccgactgggaagccgaattggaagagatgcgcctgcgcatgctgaggcttcgcgtggctttcgccgaggcgctgcgccggcagtccaactccgaccgcttcgacttcgtcgccagccaccgcggcatgttctcacggcttggcctgacggaagcgcaggtcgagcggctgcgcgccgagcacggcgtgtacatggtcggcgatagccgcatcaacgtcgctggactgccggaggatggcatggacgcgctcgccaaggcgatcgtctccgtgctcgactga

SEQ ID NO: 35512 - DNA, 1578 bp, Mesorhizobium loti
atgggaggcactgtgagtgcaaatcatgatggggcgaacctgctcgaggttcgtggcctgaccaagatattcggcacgttgactgcgtgcgaccatatcgatctcaacatcgccaaaggtgaaatccacgcgctgctcggcgagaacggcgccggcaagtcgacgctggtcaagatgctgttcggctcgctggagcccaattccggcgagattttctggaacggccaggcggtgcggatcaccagcccgggtgccgccaagaagctcggcatcggcatggtgttccagcatttttcgctgttcgaggcgctgaccgcggccgagaacatcgcgctgtcgctcgatgacggctcgccgatcagcagcatcgcggcaaaggcgagggcgctttcctacagttacggcctgccgctcgatccggactcgctggtcggcgacctgtcggtcggtgagcgccagcgcatcgagatcatccgctgcctgctgcagacgccgcaactcatcatccttgacgagccgacctcggtgctgacgccgcaggaagcagacaagctgttcgagacgctggagcggctgcgcgcggaaggcaaatcgatcctctacatttcgcaccggctggaagaggtcaaacgcatctgcgaccgcgccaccgtgttgcggcatggcaaggtggtcggccattgcaacccgcgcgaggagacagccgcctcgctcgcgcgcatgatggtcggcaacgaggtgcaggccgtggtgcgtgcacccgtcgaagggatcgagaccgcgcagccgctgcttgaaatccgtagcctcactcgcaagccggcgacgccgttctccattccgctcaaggccatcagcctcaacgtccgcgccggcgaggtgatcggcattgccggtgtcgccggcaacggccagggcgagttcttcgaatccgtctccggcgaagtgttgcagcaggacgccgcctcggtgcgcatccgcggcaaggatgccggtgggctgaccatcaccggacggcgcctgctgggggccgccttcgtgccggaagagcgcctcggccatggtgccgcaccgcgcatgaaactttcggaaaaccttttgctgtcgcgccatgccacggacggcaaggcgtttgtcggcaccggtggaatggtcaagagcggcgccatttacgcggcctcgcaacgcatcatcgaggcgatggacgtgcgcaagagcgcgccggatccggaagcggcagcactttcgggcggaaacctgcagaaattcatcgtcggccgcgaactcgaccgccggcccagcgtcatggtggtgaaccagccgacttggggcgtcgacgccggcgccgcagcccacatccgccaagcgctgatcgaactgtcgcggagcggatcggcggtgctggtgatcagccaggacctcgacgagctgttcgagatttcggacgcgatcgcggtcatgcacaacggcgaactgtccaagccgatgccgatcgccgaagcaaccttcgagaaggtcggcctgctgatgggcggcgccgagcccggccacgccgaacatacgctggagacggcatga

SEQ ID NO: 35513 - DNA, 747 bp, Mesorhizobium loti
atgtcttccagcaatttgaacggcaaggcggcactcgtcaccggcggcagccggggcattggcgcggcgattgcgcgaaggctcgcggcagatggcgccgatgtcgcgctgacctatgtgcatggcgaggaacaggcccgctcggtcgtcgccgagattgaagccaagggcggccgcgccatcgcgatcagggcagataaccgcgatgctgaggccatagacagggccgttgacgagaccgccgccgccttcggccggctcgacatattggtcaacagtgccggcatctggcgcgcggcacccatcgacacattgtcgttagccgacttcgacgaaaccatgtcggtcaatctcagagccccgttcatcgcctcgaaagcggctgcggcacatatgggcgagggtggccgaatcatctcgatcggcagcaatctcgccgaacgcgtcaccgacaccaacctcggcgcctattccgccagcaaggcggcgctggtcggcttgaccaaggcactcgcacgcgacctcggttcgcgcggcatcaccgccaatgtcgtccatcccggttcgaccgacaccgacatgaacccggcggatggaccgcatgccgaacaccagcgccaaaagatggcgacgccgcgattcggcaaggccgatgacatcgccggcatggttgcctggctcgccggtccggaaggacgtttcgtcacgggcgcggcgttgaccatcgatggcggcgccaacgcctga

SEQ ID NO: 35514 - DNA, 2145 bp, Mesorhizobium loti
atgctgcgcgccgcccgctatcacggtgtcgagctcgacccgaacgaattcagggccgcgagcgcggttccggccgccgccgatctgtcgcagtgggcgcaggacgccggcatgtggtcacgtgctgtgcgcatccgctggtcgcaccttttgcgcttccaggacgccggaccggtcgtcctgttgttcaacgacggcggcgcggctctcctcaccggggcgagcgccgagcgaaacgtcgtcttcctgaaaagtgcggatgcacccgaagatggtgaagccgtcgccatcgacgagttgcggctgtcgcaggtgtggaccggcgaggcactgctgctgcgcgccacacgatcctatgtcgcggcggacgcgcccttcacccttcgctggctcgccgaactggtgcggctcgaaagtcacgctctgcgcgatatcaccatcgcctcgttcacgctgagtgtccttaccatcctgccgccgcttatcgtcatgacggtggtcaacaaggtgctgcagttcaacagcatttcgacgctggtgctgttgtcggcggtgatcgccgtggttttcgcctatgagacactgcttggccatgcacggcggctgatcatcaatgtcgtcggcgcccgtttggataccaagttgcagctgcacgtcttcagccggctgttacgcctgccgctcgactatttcgaacggcatccggccggcgagacgatgtatcacctcgcccaggtctatcgcatccgcgagttcctgacgggaaaactcctcagcacgttcctggatatgatcacgctgtgcgtgctggtaccggtcatgttctacatcaacaccgccctcgcctggatcgtgctggcctgcgcggtggtgatcatgctgatcatcctcgccttcctcatgccgctgcgccgcagataccagcgagtagtagacgccgagacctggaagtcggcggcgctcggcgaaacagtcgtcggcatcaagacggtgaaggcgctcggtctcgagccgcagcgcaaggcgctttgggacgagcgggtggcggaagcgggaaaggcgcgtctcgccttcggacagctggcaagctggccgcagaccctggtcacgccgatcgaacgcgtgatggtgctcggcaccatgctgatcggcgcctatctcgcgatgaacgaccgcaccggctacatggtcggcggcttgttcgccttcatgatgatcgcccagcgtgtggcccagccgctggttggcctggcccgattggttgaagactacgaggaggtcggtgcggcgatcggcgaggcagcgtcagtcctcaaccggccgctggagagcagttcgaattccaccggcctgagacccaggctggtcggcgaggtcgtgttcagcgacctgacctttagctatatcgccaccaagataccggcgctcgaccgggtcagcttccacattcccgccggcagcatgtttggcattgttgggcgcagcgggtcgggaaaatcgacagtcgcccgcctcctgcaggggatcaaccgcgactacagtggtttcctcaagcttgatggcgtcgacctcaaggaaatcaacctgcgccatctgcgccaggggcttggcgtggtgctgcaggacaactttctgttccgcgggtcgatccgcgacaacatcatcgccgggcgcccgggcctgacgctttccgacgccatgcgcgccgcgcacctcgccggcgcccaggaattcatcgagcggatgccgaatggctacgacacctacatcgaggaaggttcgcccaatctgtcaggcggtcagaagcagcggctggcgatcgcgcgcgcgctcatccacgatccgactattctcatcctcgacgaagcgaccagcgcactcgacccggagagcgaggcggttgtcagcgccaacctcatgcgcatcgccagcgggcgcacgatgatcatcgtttcgcaccggctcgcctcgctgaccgagtgcgacaacatcctcgtcatggatcagggtaaggtcctcgacgtcgcgccgcatgcgaccttgctcgaacgatgtgcactctatcgccagttgtggtcgcagcagaaccggcacctcgacggccgccacggccgcccggtcgccgtcccgccgcggttggtttga

SEQ ID NO: 35515 - DNA, 771 bp, Mesorhizobium loti
atgacgccaggaattcgcccgcttgtcgccggcaactggaaaatgaacggcaccagcgcttcgctgaacgagctcaggatgatcggcaacgggttcatgagcgggctcgacgcggagaccgaggcgctggtctgcgttcccgcgacgctgctttcccatgcagccgagattctgtcgcgcacgccggtccatgcgggcggcgaggattgccacaccaaggaaagcggcgcctacaccggctgtatctcggcggaaatgctgaaggacgccggcgcgagccatgttattgtcggccattccgaatgccgcgaacaacgcggcgaggacgatgcgacggtccaggccaaggccgccgccgcatggcgcgccgggctcgtggccatcatttgcatcggcgagacgcagcagcagcgtgaggcgggcgccacgctcgaggtgctgtcgcgccaggtcgcaggttcggtgccgccgagtgccacgccatccaacaccgtcattgcctatgagccggtgtgggcgatcggcaccggcctgacgccgaccgcggccgatgtggccgaagcgcatgcgcatatccgcgaaaggctgtcggagaaacttggtgcctctgccgccaagacgcgcattctctacggtggctcggtcaagccgtccaacgcggtggaactgctgggcgtcaggaatgtcgatggcgcgctggttggcggcgccagcctgaaagcggccgatttcctcggtatcgccgaggcctatcgcagcatttcaggctga

SEQ ID NO: 35516 - DNA, 1626 bp, Mesorhizobium loti
atgcttgggccttcagcgcatatcgacacgttcacgcgcgatcatctgccgccgccggatcaatggccggatttcctgctcgatggcttcgactatcctgaacatctcaacgtcggcgtcgaattgaccgacaggctggtcgagaagggtcttggcgaccacacggccttgatcggcaatggccgccgccgcacctacaaggaactgtccgactggacgaacaggctggcccacgcgctggtcgagaattacgacgtcaagccgggcaaccgggtgctgatccgctccgccaacaaccccgcaatggtcgcctgctggcttgccgccaccaaagtcggcgcggtggtcgtcaacaccatgccgatgctgcgcaccggcgagctcaccaagatcgtcgacaaggcggaaataaccatcgcgctctgcgacaccaggctgatggacgagatgaccgcctgcgccaaggacagcaccttcctgaagcaggtcatcggcttcgacggcaccgccaaccatgatgccgagcttgatcgcgccgcgctcgacaagccggtcaccttcaccgccgtcaacaccggccgcgacgacgtcgccttgctcggcttcacctcgggcacgacgggcgtgccgaaggcgaccatgcacttccaccgcgatctcctgatcatcgccgatgcctatgcccgggaaatcctccaggtcacgccggacgacatcttcgtcggctcgccgccgctcgccttcaccttcggccttggcggcctcgccatcttccccctgcgcttcggtgcagcggcaacattgctggaacaagcaacgccgcccaacatgatccacatcatcgagacctacaaagcgaccatctccttcaccgcgccgaccgcctatcgcgccatgctgaaggccatggatgaaggcgctgacctgtcatcgctgcgcgtcgccgtttcggccggcgagacattgccggctccggttttcgaggaatggaccgagaagaccggcaagccgatcctcgacggcatcggcgccaccgaaatgctgcacatcttcatctccaaccgctttgacgacaggaagccagcgtcgaccggcaagcctgtgggcggctacgaagcgcgcatcgtcgacgacgcgatgcgcgaggtgccgcgcggcgagaccgggcggctggcggtgcgcggcccgaccggctgccgctacatggccgacgacaggcagaaggagtatgtgcgcgacggctggaacctgaccggcgacactttcacccaggacgaggacggtttcttccatttcgccgcgcgttccgacgatatgatcgtcagcgccggctacaacattgccgggcctgaggtcgaggcggcactgctgtcgcatcccgatgtcgccgaatgcgcggtcatcggcgcagaggatggcgaacgcggccagatcgtcgaggcgcatgtcgtgctggtgcaaggcgtggcgcccgatgcgttgaccgtcaagcgcctgcaggaccacgtcaaggcaatgatcgcgccctacaaatatccgcgctcgatcaaattcatcgccgccctgcccaagacccagaccggcaagatccagcgcttccggctgcgcacggagaaaatcaattga

SEQ ID NO: 35517 - DNA, 798 bp, Mesorhizobium loti
atgtcgttcaacgagcgcatgtcctacagcgactatctgcacctggaaaaagtgctggaggcacagacgccgctgtcgtcggcgcatgacgagatgctgttcatcatccagcaccagacctcggagctctggatgaaactcgctctgcatgagatcggcgccgccatccgctccattcgcgctgaccggctcgagccgagcttcaagatgctgtcgcgcgtcgcccggattttcgagcagctcaacaatgcctgggacgtgctgcgcacgatgactccaagcgaatacaccgagttccgcgacgcgctcggccagtcctctggcttccagtcctggcagtaccgcgccatcgagttcatggccggcaaccgcaacctggcaatgctcggaccccacaaacaccggccggacctcagcggcaagctggaggcaatcctggccgagccgtcgctctatgatgaagcgttgctgcttctggcgcgcaacgggttcgacatcggcgccgacgccaggcgcacggactggcgcgagacgcgcaccgagaacgaagaagtcctggtcgcctggcagaccgtctaccgcgatccgcagcgctactggatgttctatgagctggccgagaagctggtggatttcgaagactatttccgccgctggcgtttcaatcacgtcacgacggtcgagcgcatcattggcctgaagcgcggcaccggcggcacctcaggcgcatcctatctgaagaagatgctcgaggtcgtgctgtttcccgaactgtggacggtccgcacgcggctctga

SEQ ID NO: 35518 - DNA, 1425 bp, Mesorhizobium loti
atgtccgacaaggtcgtcacccgttttgccccctcgcccaccggctatctgcatatcggcggcgcgcgcacggcgctgttcaactggctctatgccaagcacaccggcggcaccatgctgctgcgcatcgaggacaccgaccgcgagcgttcgaccgccgccgccacggccgccatcctcgacggcctctcctggcttggtcttggctgggacggcgacgcggtctcgcaatttgagcgcgcgccacgccaccgcgaggtcgcggaagaactcgttcgcatgggcaaggcctattacagctacgaaacgccggccgagctggaggcgatgcgcgaggcagcacgggccaagggcctgccgccgcgctacaacggccagtggcgcgaccgcaccccctcagaggcgcctgcaggcgtcaagggcgccatccgcatcaaggcgccgactgagggcgagacgatcgtccacgatcgtgtgcagggcgaagtgcgcttccccaacaaggatctcgacgacttcatcatcctgcgttcggacggcaacccgacctacatgcatgccgtcgtcgtcgacgaccacgacatgggtgtcacgcatatcatccgcggcgacgaccacctgaccaatgccgcccgccagaccgtgatctacaacgccatgggctgggacgtgccgtccatgtcgcacatcccgctgatccatggcgcagacggcgccaagctgtcgaagcgccacggcgcgctcggcgtcgaagcctatcgagccatgggctacctgccggaggcattgctcaactatctcgcgcgcctgggctggagccacggcgatgacgagatcatgtcgatcaaggacatgatctcctggttcgatatcggcgacgtcaacaagggcgctgcccgcttcgacttcgccaagctggaggcgatcaacggcgcacatatgcgccgcatggccgacgcgcagctgttggacatcttcatcgccactttgccctatctcgagggcggcccggcgatggccgcgcgcctcaacgaacacaacaaggcgcagttgctggcggcccttccgggtctgaaggagcgcgccaagacgctggtcgagctcgtcgatggcgccgccttcctgttcgccacgcgcccgctgccggtcgacgagaaggcggccctcctgctcaatgacggtgcccgcaagatcctgcgcggcgctcacgaagctttgaacgcgctttccggcgactggacggcggccgcggcggaagccgcggtccgcgactatgcgctggccggtggccacaagcttggcgccgtggcccaaccgttgcgggccgcgctgaccggcaaaagcacctcgcccggcgtgttcgacgtgcttgccgtgcttgggcgcgaggaaagcctggcgcgcatagcggatcaaatcgattag

SEQ ID NO: 35519 - DNA, 1302 bp, Mesorhizobium loti
gtgggcggcgcgaaccaagaggctacggcaacgcttcaattcgctggcaagacccatgaattcaaggtgcgaagcggctccgtcggacccgacgtcatcgacatcgcctcgctctacagcacgaccggcgccttcacctacgaccccggcttcacttcgacggcaagctgcgagtccgaaatcaccttcatcgacggcgacgccggtattctcctccaccgcggctatccgatcgaccagttggccgaacacggcgacttcctcgaagtctgctacctcctgctctacggcgaattgccgaccaaggcgcagaaggacgatttcgattaccgcgtgacgcgccacaccatggtgcacgagcagatgtcgcgcttcttcaccggtttccgccgcgacgcgcacccgatggcggtgatgtgcggcgtggtgggcgcgctgtcggccttctatcacgactccaccgacatctcggacccctaccagcgcatggtcgcctcgatgcgtctgatcgccaagatgccgacgatcgcggccatggcctacaagtaccacatcggccagcccttcatttacccaaagaacgatctcggcttcgcggcaaacttcctgcatatgtgctttgccgtgccgtgcgaagagtacaagatcaacccggtgctggcgcgcgccatggagcgcatcttcatcctgcacgcagatcacgagcagaacgcctcgacctcgacggttcgcctcgccggctcgtcgggcgccaacccgttcgcctgcatcgccgccggcatcgcttgcttgtggggcccggcccatggcggtgccaatgaagcggcgctcaacatgctgggcgagatcggccatgtcgatcacatcccggagttcatcgcccgcgccaaggacaagaacgacccgttccggctgatgggctttggccaccgcgtctacaagaactacgatcctcgtgcgaaaatcatgcagaagacggcgcacgaggttctgggcgaactcggcatcaaggacgatccgctgctcgacatcgccatggaactggaaaagatcgcgctgaccgatccctatttcatcgagaagaagctgtatccgaatgtcgacttctattccggcatcacgctgaaggcgctgggcttccccaccaccatgttcaccgttctgttcgcggtcgcccgcaccgtcggctggatcgcgcagtggaaagagatgatcgaggacccgcgccagaagattggccgcccgcgccagctctacacgggtgcgccggagcgcgactacgtgccgatcgccaagcgctga

SEQ ID NO: 35520 - DNA, 459 bp, Mesorhizobium loti
atggtggcggcgacgacgctggaagcggtcgacataatggggctgatgaagctcctgccacaccgctatcccttcctgatgatcgaccgcatcatcgacatcgatggtgacgattccgccatcggcatcaagaacgtcaccatcaacgagccgcattttcaggggcatttcccggagcagccggtgatgccgggcgtgctgatcgtcgaagccatggcgcagacggcaggcgccatctgcatccgcagcctcggggcgtcgaagccgtcgctggtctatttcctgaccatcgacaacgccaaattccgcaaaccggtcgttcccggcgaccagttgaagattcacgtcaaaaaaatcaagaagcgcggcaacctgctcaaattcgcctgtgaagccctggtcgatggcaccaaggcggccgaggccgagatttcagccatgatggtcaccggcgactga

SEQ ID NO: 35521 - DNA, 2469 bp, Mesorhizobium loti
atgccggctttctcccaaggcctggaaaaggcgcttcaccaggcgctgacgctcgccaatgagcggcaccatgaatacgcaacccttgaacatctgctgctcgcgttgatcgacgacaccgaagcggccgccgtcatgcgcgcctgcaacgtcgatctcgacgagctgaagcacactgttctcacctatatcgacaccgagctcgacaatctggtcaccggctacgacgaggattccaagccgaccgccggcttccagcgcgtcatccagcgcgcggtgatccatgtccagtcgtcgggccgagaggaagtgtctggcgccaacgtgctcgtcgccatcttcgccgagcgcgagagccatgccgcctacttcctgcaggaacagcagatgacccgctacgacgcggtcaactacatctcgcacggcatcgccaagcgccccggcgcatcggaaacgcgctcgccgcgcggcgccgatgacgagcagggcggccagaacggcgccgagccgcaagaggaaggcggcaagaaaaagcagcagcaggacgcgctgacggcttattgcgtcaacctcaacaacaaggccaaggccggcaagatcgatccgctgatcggtcgcgagtcggaaatcaaccgcaccatccaggtgctgtgccgccgctccaagaacaacccgctctatgtcggcgatcccggcgtcggcaagacggcgatcgccgaaggtcttgccaagcgcatcgtcgagggcgacgttcccgaagtgctgcacaatgccaccatcttcgcgctcgacatgggcacgctgctggccggcacgcgctaccgcggcgatttcgaggaacggctgaagcaggtcgtcaaggaactcgaggactatccgggtgcggtgctgttcatcgacgagatccacacggtgatcggcgcaggggccacctcaggcggcgccatggacgcgtcgaacctgttgaagccggctctgtcgtcgggtgctatccgctgcatcggctcgaccacctacaaggagttccgccagttcttcgagaaggaccgcgctctggtgcggcgcttccagaagatcgacgtcaacgaaccgaccatcgaggacgccatcgagatcatgaagggcctgaagccctatttcgaggagttccacaaggtccgctacacctcggaagccatcaaggcctcggtcgaactgtcggcgcgctacatcaacgaccgcaagctgccggacaaggcgatcgacgtgatcgacgagaccggcgcctcgcagatgctggtgccggaagccaagcgcaagaagaccatcggcatcaaggagatcgaagcaacgatcgccaccatggcgcgtatcccgccgaagacggtttcggccgatgacgagaaggtgctgcaaggcctcgatatcgagctgaagcgcgtcgtctatggtcaggataccgccatcacggcactgacctcggcgatcaagctggcccgtgccggcctgcgcgaaccggaaaagccgatcggctcgtacctgttctcgggtccgaccggcgtcggcaagacggaagtcgccaagcagctcgccgcctcgctcggcgtcgagctgatccgcttcgacatgtcggaatatatggaacgccacaccgtttcgcggctgatcggcgcgcctcccggctatgtcggtttcgaccagggtggcttgctcacggacggcgtcgaccagcatccgcactgcgtgctgctgctcgacgaggtcgagaaggcgcatccggacctgtttaacatcctgttgcaggtcatggaccacggcaagctgaccgaccacaacggcaagcagatcgacttccgcaatgtcatcctgatcatgaccaccaatgcgggcgcatccgatgcgcagcgcgcggcgatcggtttcgggtcgaccaagcgcgaaggcgacgatgtcgaggcgatcaaccggctgttcacgccggaattccgcaaccgtctcgatgcgatcatcccgttcggttcgctgccggtgccggtcatccatcaggtggtgcagaagttcgtcatgcagctcgaggcgcagctctccgagcgtggcgttaccttcgacctgtcgccggatgcgatcgcctggctggccgacaagggttatgacgagcgcatgggcgctcggccgctcggccgtgtgatccaggagcacatcaaaaagccgctggctgacgaggtgctgttcggcaagctcaagaagggcggcacggtgcgtgtcaccgtcgagaagaaggaaaccggcgagaccggcctgaagctcgaatcgctggccgacgaggcgccggtgaagccgaagaaggaagagccggaagacgcgccgaagccgcccaaggccgtggccaagaagcctgccgccaagaaggtcgtggcgcagaagccggagcccaagggcaaggatggcggcaagcgcagcctggtcccgcaactgccgcgcaagggctga

SEQ ID NO: 35522 - DNA, 981 bp, Mesorhizobium loti
atgaccgacgcttcgtccctgccactctaccctcaccgccatcttctgggcatcagcgatctttcgcccgccgacatcgagctgttgctcgaccgggcggatcgggccgtcgcgatttcgcggcagtccgaaaagaagacctcgacgctgcgcggccgcacccagatcaatctcttctacgaggcctcgacccgcacgcagtcctctttcgagctggccggaaagcggctcggcgccgatgtcatgaacatgtcggtggcaagttcttccgtgaagaagggcgaaacgctcatcgacacggcgatgacgctgaacgccatgcggcccgatatattgatcatccgccatcagtcggcgggtgctgccgccctgctggcgcagaaagtcggctgctcggtcgtcaatgccggcgacggcgcgcatgaacacccgacccaggcgctgctcgacgcgctaaccatccgccgcgccaaggggccgctgtcgaagctgatcgtggcgatctgcggcgacatcctgcattcgcgcgtggcgcgctccaacatcatgctgctcaacgcgcttggcgcgcaggtgcgcgtggtggcgccttcgacgctgctaccgtccggcatagagaagatgggcgtcatcgtcacgcgctcgatggccgaaggcctcaaggacgccgacgtggtgatgatgctgcgcctgcagcgcgagcgcatggaaggcgccttcgtgccttcggtgcgcgaatatttccgctatttcggcctcgatgccgagaagctgaaggccgccaagggtgacgcgctggtgatgcatcccggcccgatgaaccgcggcgtcgaaatcgcctcggaaatcgccgacggcccgcaaagcgtgatccaggagcaggtggagatgggcgtcgccgtgcgcatggcggtgatggaagcgctgctcgacccccgtcgtaatcaagagggccgcaaacaggagggtcgcggcgcatga

SEQ ID NO: 35523 - DNA, 792 bp, Mesorhizobium loti
atgatctctctctcgccaaacctcgccgtgcctgtcgttccgcaagggccatgcagcctgttcctcgatatcgacggcacgcttctcgaacatgccgcgcatcccgatgcggtggttgtcggtgatgaattgcgcaccctgctggtgcggctcgaagcgcaactggacggagcactggcgttcatcacgggacgctcgatcgccgccgtcgaccatctcttccggcctctcaggctgcgcgccgcggggctttacggcctcgagcacaggctggcgcgcgatggtccggtcgaggcggccagcgagccggctgatattgcagctcttgccaacgaaatcgcgacggaactggacaatgcagatgtctatatcgagcgcaagggacccatcctggccattcatacacgcgcggcaccgcatttgcttcaacgcgcgacggagttggtcgaacaggcactagacagattgcctgcgggataccgggttttggccggaaatgccggtgtggaactgatgccgctggaggcggcgaagggagcagccatccggcgcttcatgcaaattccggctttcaggggacggcgcccggtgttcctcggggacgatacatccgacgagaacgggttcgagaccgtcaacgaattggacggcatctcggttcgcataaagccgcagggatcgacagctgcaccttttgcactggccggcgtggacgcggccttggcctggctggacgagatgagcaggagcgagaccgcgaaagcggcgacgctggccgcaatgcccaaatga

SEQ ID NO: 35524 - DNA, 1563 bp, Mesorhizobium loti
gtgcaatggtcgcccgaaacgctgcgtcacatcctggcgaccgaacttcccgatgcccaggtgatcgtcgtctcaaaccgtgaaccgtatatccacaaccgcgagggcgacgacatccagctggtcgtacccgccagcgggctcgtctccgccctggagccgatcacgcgtgcctgcgcgggcacctggatcgcctatggcggtggttcggccgacaagctggttgtcgacaagaacgaccggatcgaggtgccgccggacaacccttcctacacgctgcgccgtgtctggctgagcgaggaagaacagcaaggctattatctcggctttgccaatgaaggcctctggccgctgtgccatatcgccttcacccggccgatattccgcgcctcggattgggaggcctacgaggcggtcaaccgcaaattcgccgacaccgtcgtcgcggaagcccgcaacgaacggcccatcgtgctggtccaggattatcatttcgcgctgctgccgcgaatgatccgtgaacggctgccggaggcgatcatcatcaccttctggcatattccgtggccgaattccgaggtgttcagcatctgcccatggcgcgaaaagattctcgacggcctgctcggcagttctatcgtcggtttccacacccagttccattgcaacaacttcatcgacagcgtcgaccgtttcctggaaagccggatcgagcgcgaggattcggccatttcctatggcggccagatcagcctggtccatgcctatccgatctcaatcgagtggccgccggcgcaattgggcaaactgcctgacgtggcgcaatgccgccggcaggttcgcgagaaattcggcctggccgaaaatgtcaagctgtgcgtgggcgtcgaacgtctcgactacaccaaaggcatcctcgatcgcttcaacgcgctcgacgaactgctgacgcttcatcccgaatggatcggcaaggtggcgttcctgcagatcgctgcgcccagccgcggcacgttgcctgcctatcaacaattgtacgaggagtgcctgcgccatgccgaggatctcaaccagcgctatggtcgcgaaggctacacaccagtcctgatgataacggaacatcactcgcagcagcaggtctacgaaatctaccgtgcagccgacgtttgcatggtcaccagtctgcatgacggcatgaacctggttgccaaggagtttgtcgcggcgcgtgaggacgaacagggcgtgctgttgctcagcatgttcgccggcgcctccaaagagctgctggacgcactgatcgtcaatccctatgacgcggctatgatgggagatgccttgctgcaggccttgaccatgtcgcaggaagagcaaagccagcgcatgcgacgcatgcgcgagatcgtacgcgacaacaacgtctatcggtgggccggcagcatgcttctcgatgcggcgcgcttgcgcaagcgcgacgcggtcgatcgcgccgtcagcgccgctccagcggccccagccaatgtcatatcgctgctcgatcgcagacgcgtggcggcgctatga

SEQ ID NO: 35525 - DNA, 1491 bp, Mesorhizobium loti
atgagcggttttgtgctggcaatcgaccagggaacgacatcgaccagggcgatcctattcgatggccagatgaaagtcgccggcagcggccagaaggaattcgcgcagcactatccggcctccggctgggtcgagcatgacccggaagagatttgggcgagtgttgtgacgaccgtgaaggctgcgctgaagaatgccggcaaagccgcgtcggatgtcgccgccatcggcatcaccaatcagcgcgagaccgtcgtcgtctgggacagggcgacgggcaagccgatccacaatgccatcgtctggcaggaccgccgcaccgcgccgctctgccagaaactgaagaagcaggggctggagaagaaattcacgcgcaagaccggcttgctgctcgatccctatttctcgggcaccaagatcgcctggatactcgacaaggtgaagggcggcaggaagcgcgccgagaaaggcgaattgctggccggcaccatcgacagttttctgatctggcggctgaccggcggcaaggtccacgccaccgacgccaccaacgcctcgcgcacgctggtctacaacatcgcggaaaacgcctgggacgacgagcttttggccattctcaacattccggcgaaactgctgccgcaggtcaaggactgcgccgatgactatggagtgaccgagagagatctgttcggtgccgagataaggatcctcggcgttgccggtgaccagcatgccgcgaccatcggccaggcctgcttcgagccgggcatgatgaaatccacctatggcaccggctgcttcgcgctgctcaacaccggcagcgatctggtgcgttcgaagaaccggcttttgacgaccatcgcctatcggctgaacggcaagaccacctatgcgctggaaggttcgatcttcatcgcaggggctgccgtgcaatggctgcgcgacggcatcaaggtgatcggcaaggccgagcagagcggcaaactggctgatgaggccgacccgacgcaaaacgtctatctggtgccggctttcgtcggcctcggcgcgccgcactgggatgccgaggcgcgcggtgccatcttcggactgacccgcaattccggaccggcagaatttgcccgcgccgctctggaggccgttgcctaccagacccgcgacctgctcgacgccatgcgcaaggactggaagggcacttcggccaaaacggtgctgagggtcgatggcggcatggtggcgtcggattggaccatgcagcggctggccgacatactcgacgcgccggtcgatcgcccgaccatccttgagacgaccgcgctgggcgcggcctggcttgccggctcgaaggctggtgtctggcccaaggcgaaggaattcgccaagagctgggcgcttgagcggcggttcaagccggagatggatatcgccacacgatccgccaagctggcaggctggcgcgatgctgtgcgcaggacgctaagcgcataa

SEQ ID NO: 35526 - DNA, 1527 bp, Mesorhizobium loti
gtggacacgtcttcagtccgggacattttcgtcataggtggcggtatcaacggttgcggcatagcccgcgatgccgttgggagggggttttcggtttttctcgccgagatgaacgacctcgccagcggaacctcctccggttcgaccaagctgatccatggcggcctgcgttatctcgaattctacgagttccgcctggtgcgcgaggcgctgatggagcgcgaggttttgtggaagaacgcgccgcacatcatctggccgatgcgcttcgtgctgccctatgccaagggcctgcgtccggcctggctgatccggctcggcctgttcctgtacgaccacattggcggacgcaaattgctgccggcgaccaggacactcgacatggcaagcgatccggccggcaagcctttgaagccgttgttcaaaaaggcgttcgaatattccgatggctgggtcaacgatgcgcggctggtggcgctcaacgcacgcgatgccgcagatcgtggtgcaacgatccggacccgcacgaaggtggtcggcgcgcgccgtgaaaacggcctttggacaatcaagatcgagaatctgcagaacggcgagaccgaagagatcaaggcgcggctgctggtcaatgcagccgggccgtgggtcgatcacgtgctctccggtgtcgtcggcctcaacgatgtgcacaatgtccgcctggtgcagggcagccatatcgtcatcgccaagaagttcgacgatccgcgcgcctatttcttccagaacaaggatggccgcatcatcttcgccatcccctacgaggacgagttcacgctgatcggcaccaccgaccgggattatcccggcgatccgcacgatgtgaagatcagcgacaccgagatcgattatctctgcgctgcggccagcgagtattttgcgcaaccggtcaagcgctccgacatcgtctggacctattcggccgtgcgcccgctctatgatgacggcgcctccaaggcgcaggaagcgacgcgcgactatgtgctgaaggccgatggcggcgagggtaccgctccgatcgtcaatgccttcggcggcaaaatcaccacctaccgccggctgtcggaatcgatgctggagaagatcgaaggttttctcggcaagcgcggcaagccgtggacatcggacgcgccgctgccgggcggcgatttcccggcgaccggtttcgacgcgcaggtggcgaagttgaagacagcctatcctttcctcgacgcgcgcctggcccgtcggctgacgcggctttacgggacgcgggctcagcgtctgcttggccttgccaaatcgaatgccgaactcggccgcaatttcggcggcgatctctatgaggccgaagttcgctatctcgttgaaaacgaatgggctcttacggcggaagacgtgctgtggcgccgcaccaagcgcggcctgcatctcagccgcgaacacgtcgcggcactcgatgaattcatgcgcggcataagccggcggcacgtcgcggccgccgaatga

SEQ ID NO: 35527 - DNA, 1413 bp, Mesorhizobium loti
atgaacaatgacgagttccggcagtggtcgcgacgtgccgccgactggggcgccgactatcgcaattcattgcgcgagcggccggtgcggccgctggtcgaaccgggtgacattttcaggagcattgacgcctcgccgccggaagacgccgaacccatggacaggatcttcgccgacttcgaagagaagatcgtgccgggcatgacgcattggcagcacccgcgcttcttcgcctatttcccggccaatgcggcgccggtttcggtggtggctgagtatctcgtctccgcaatggccgcgcagtgcatgctttggcagacctcgccggcggcgaccgaactcgagacccgcaccgtcgactggatgcgccaggcacttggtcttcccgagggattttccggcgtcatccaggattcggcttcgtcggcgacactcaatgccgtgctgaccatgcgcgagcgggcgctggattggcaaggcaacaaaaaggggttggccgggcagggccagttgcgcatctattcctcggatcaggtgcacacgtcgatcgaccgggcgatctgggtgtcgggcatcggcgaggacaatctggtgcgcattcccgtcggcggccggttccgctccatggatacagcagctctggaagcggcaatcgtcgctgaccgcgcggctggaatgctgcctgccggcatcataggcagcgtcggtggaaccagcatcggcggcacggacgacatcgccgcggtcgccggcgtggcgcgccggcatgggctctattttcatgtcgatgccgcttgggccgggtcggccatgatctgcccggagtatcgtcatttctgggccggcgccgaacaggctgattctgtcgtcttcaacccgcacaaatggctgggcgcgcagtttgactgctccatccagttcttgcgacagccggaagacctggtgcgtacgctggcgatcaagcccgaattcctcaagacgcacggacgtgacggcatcatcaactattccgaatggtcggtaccgctcggccgccggtttcgcgccctgaaattgtggttcctgctgcgtgcccacgggctggaaaacctgcgcgccatggtccgcaaccatgtgacctggagcgagggccttgccgcgcggctggcaaaggagccggatttcgagatcgtcagcgaaccgatgctgtcgctgttttcattccggcacagggcgccctcaagcgccgatgcggacgagcacaatctgcggctggtcaatgcgatcaacgacgatggccgcatctacctgacgcaaacgagggtcgacgggcaggtggcgatccgcttccaggtcggccagttcgaggcgaccgcaggcgatgtcgattcggcttttgccgtcattaccgaaatcgcgcgcggcatggcctga

SEQ ID NO: 35528 - DNA, 6375 bp, Mesorhizobium loti
atggcaaagaaaccaacgacgaccacgagaaatctcgatagcgacgtggccagagaactggaaaaagcgctcgatctcgacctcagcggcgacatcggcagcggcgatctcgatatcgcggcttcgatggaagatctggaagcgcagatatcccaggccgccgacgagctggcacgcgagggacgcgaccagaggccggcactcgccgccaatcaggccgcccccattgccaatcaggcggcgaatcccgcgccgaaggccaagcctgccgaactgcgccccgtggagacgcgcaatggcaacggtacgcagcccacggggtttgcgccggccaatgacgatcgccagaaggattacaagaccctcctgcacagcctcaacaggcgcgcctccaacaccgtctactggatcgttgcctttgtctcgctcgcctggatcgcgggcgccggcgggctcgccaacctgctgtttggaccgagcatctggaggatcggcactctcgatcagttcctcgcccgtcccgagctgattggcctcgccgtagcggcgatcgtgccgatcatcctgttctgggccttcgcggccatgattcgccgcgcccaggacatgcgcattgccgcccagtcgatgacggaagtggccttccgcctgacagagccagaaaacatggcgcaggatcgcgtcatgatgatcggccaggccgttcgccgcgaggtggccgccatgggcgaaggcatcgaacgtacgctggcccgcgccgtggagttggaaacgctggtccacagcgaagtcaaccagatcgagcgctcctattcggaaaacgaaacccgcatccgttcgctcgtcgacgggctcggcagcgagcgcgaggcggtcgtcacccatgccgagcgcgtccgcgcctcgatcgccggcgcgcatgagacgctcagggatgaaatcggcgccgccagcgacatcatccgcgactccatcctcaatgcgtcgaccaagctgtcgatgacgatcaccaattccggcgacacgcttatcgaccgcatcaatgaaagctcgatgtcgatcttcgattcggtcgaaggccggctcgacaccatcaccgacaagttgtcgacctccggcgaggccttcgccagcctgcttgacacgcgcatcgccaagctgacggacacgacggacggcctgacccggtcgctgaccgatctgctcgacgatcgcaccaccggcatggtttcgcttctcggcggcgccgcgcgcaccctcaattcggaattcgaagccagcctcaacggcatcgagcgcacgctggccgaacgcggccaggcgctgatcagcgaattccagacccgcgccgaggcgctggacaccggcacgcagaagctcaacgccgcgctcgaggcccgcgcccgccagatcaacgagacgctggtcgagcgcgcccgcgaaatcgcccacaccttcgccgagagcaaggacacgctggccgcgatgatcgatcagggcaagacccagatcggcgccgatatggcagacatcgtcacctcgacatcgagcatgctggaggcccgcgccagcgactttgccggtcgcatggaagcggcgcgtcatgtagtctcgcgttccttcgacagcgacatccagcggctcgccgacgcccgtgtcggcattgaggaagccgtcgaaaaccacagccgcaagctgtccgaaagccgcgaccgcatggcggccgccatgcaggcggacctggagaaattcgccgaaagccgcgacggcatcgatgccgcggtgaccaaccaggtgcagaagctggccgaaggccgcagcctgatcgcgcgcgccctcgaagaggatttgcgcaaggtcaacgaatcgcgcgccgcaatcgacgcgtcgctcggcagccacctcgaaaggctggaagaaggccgcaaccggctttcgctggctctcaacgaagactccggaaaactcgtgcaagcgcgtacgatcattgatgaaatggtcgccggtcatgttggaaaactcgccgagggccgcaacatcctgtcgcgcgccctggaagccgacctcggcaaactgtccgacagccgcgccagcattgacggactggttgccggtcaggtcgagaagatcgccgaaggccgtgcggtgctcgccaaggccttggaaaatgatattgccggcatcaagagcctgatcgaggtgcattcggcaaagctcgtggaagaccgtagccaactcggccgttcgctcgaggacgatctatctggcattaggggcttgcttgacgatcactcggtcaagctcgccaacgaccgcagcctgctgtcgcagacgctggaagccgacctagccaagctggccgaaagccgctcgagcattgacggcctcgtcgccggtcaggtcgagaagctggccgagggccgcgacattctcaagcgcgcgctggaatcggacctcagcaccatcaagggtgtcatatcgagtcagtcggaaaggctggcggaggatcgcggacagctttcgcgggtcctcgaagccgacttgcagaatgtgaacagcgtcatcgccgaccacatgaacaggctcgttcaggatcgttcgactttgtcgaaggctctcgaggacgacctcgccaagctggccgacagccgctccagcatcgacgggctggtcgctggtcaggtcgagaagctggccgaaggccgcgacattctcaagcgcgccctcgaagccgacctcaacaccatcaagaacaccgttgccgaccagtcgcagaagctggtcgacgaccgcgcccagttcgccagggcgctcgaagccgatctcgaaagtgtcaacagcctcgtcaacagccattccgagcggctcgtccaggatcgttcgaccctgtcgaaggcgctggaagtcgacctcgacaacgtcaacggcctgatcaacagccatgccgagcgactcgtccaggaccgttcgacgctgtcgaaggcgctggaagccgacctcgaaagcgtcagcggcctggtcaacagccatgccgacaggcttgtccaggaacgctcgaccctgtccagggcgctcgaggacgatcttgccaagctggccgaaagccgttcgagcatcgacggcctggtcgccggccaggtggagaaactggccgaaggccgcgacgttctcaggcgcgccctcgaagccgatctcgccaagctcgccgaaagccgctccagcatcgacggtctggtcgccggccaggtggaaaaactggccgaaggccgcgacattctcaagcgcgccctcgaggccgacctgcagaagctgagcgaaagccgcggcgatatcgatggcgtcatcgccggccatgtcggcaagctggccgaaggccgcaacatgctgagccgcgcgctggaagacgatctcggcaagctcgccgagacccgcaaggacgtcgaccgctcgctgtccggtcatatcgaccagatcgctgccaggagcaccgacatttcggccgcgatcgccgccgatgtggaaaagatcgagcaggcgttcagccgtcagaccgggatcatcgaggaacgtgccggaaccatggagcgcgcgctctcgaccggcgtcgacaatgtccgcagcgtgctcgaaaagagcgcggtcttcgtcgccggcgccttgcgcgaaaaggtcctggaagtcaccagcacgctgcatgagcaggccggtgcggccttcagcgacgccgatcgcaagatcgccgagcgcgccgaacagacctccgcagcgcttttggcacgagccgaggacatcgcccgcaccttcgaggaagccgatcgccgcctccacgcccgcgccgaagatacgtccaacgccctgctcgcccgtgccgacgacacctccagctcgctgctggcgcgtgcccacgaaaccgccgatcagctggccgcccgtgccggcgagatcgccggcagcttcgagctggcggaccagaagctcgccgcccgcgcccaggacaccgctgaccagctggccgcccgcgcaagcgagattgcaggcacgttcgacgcagccgaccagaaactggtcgcccgcgccatcgagacggcgcagtcgctggccgcccgcgccggcgacatcctgcgcaacttcgagagcgccgaccagcggctcggcatgcgcatcggcgaatcggccgaggcgctcgccgcccgcgcaaccgaccttggccgcatcttcgatgccgccgatcagcaactggtctcgcgcattgccgaaggctcggatgctctgtccaaccgtgcgtccgagatcggccgcatcttcgacgaggccgaccagcgcctggtctcgcgcatcgccgacagctcttcgacgatcggcgagcacgcgcagagcatcgtcggagctttcgccagcaccgagcagaaggtcgccgaccgtgcgcgccagaccggccaggaactggccgtgcacgcccgcgaaatcgagcaggcacttgccggcgccgacgagcgtcttgcgtcgaccgcggcggccgcggccgcccgtgtcgaggagcagatcgccagcgtcgagaaccgcctcgcccacaccaccgaaacaatgggccagaggctcaacgagcaggtgtctagcgccgaggcgcaactcgtttcgcgcgccaatgtgatcgccgagaccttcactgctgttggccagcatatcggccagagcaccaacgacgccgccaagacgatcggcgccaacacccgcgaactcaacaccatgctcgcggcgcggtcggccgaaatgtcgaagatcctcgacgaaaccgcgcggcctttggtcgagcgcttcgcccagggcggctcggaactgcaaaagagcatggaagaggtcaccgaacgcgccaccgagaagctgcgcagcgaaaatgccgccctggtcaacgcgctcgccaaccgcaccgccgagactttgtcggcggtcgaaggcgcccgctcgtctctgtccgacagcgttgccgatctcatcggccgcatgaccaagtccagctcgcagctcggccagctgatcgagcaggccgcggtcaatctcggccaggtcgacgaacgcctgaccggcagcacgcagagcttcgctgctacaaccgaaaaggcggcgcagacctttgccagctcggcgcgtctggtcgattcgaacacgacaaggctgacggaactgtcatcgtcgaccttgcgcgaagtggcctcgatcgccaccaagttcgacgagcacagccgcctgctggccagcgcctcggacctgttgagctcggcccagagcaacctcgagcacacgctggaaaggcagtcgtcgctggaagacctcgccgtcggcctggtcaagaagtcggaagatctcgaaagggtcatgcgctcgttcgagaacctcgtcggccagacgctgcagaacgccgaaggcaagacgatggagtcggccgacaagatccgcaatgccatcaccgacgtggtcgattcggcaaccaagcgcttcgccgacgccaccgatgagatgcggcgcaccgcgagctcgatcaagagcgaactcgacctcacccgcgccgagctcaagaaaggcgtcatcgagatgccggaagaggcgaaggaatcgacctctgccatccgccgcgccgtttccgagcagatcaacgcgctgaaggagctttcggacatcgttgcgaagtccggtcgcggcggcggcgatacctcggagccacgcaatctgcgcccggctccgcaagcccaggcggcacgtccggccgagccgccgcgtcggccgccggctccgcagccggagcttcgcacgcctcagccgccgttgggcggcaccgcactgcgcggcacgctcgatctcgagcgtccggcagagccgcgccagcgtcccgaagccggcgcccgcacgccgcagggcggctgggtgcgcgacctcctgaccgcggcgtcgaacgatgcggatctccggccggcaaccccaccctcgccgcctgcggaagcgccgcgcgcggcccctgcccagcgctcgccgctgcatgtcgtggaatcgctgaactcgctgtccgtcgacatcgcacgggctatcgaccacgatgcttcgatcgagttgtggaaccgctatcggcgtggcgaacgggatgtgttcacgcgccggctctacacgctaaagggccagcagacattcgacgaaatccgccgcaagtatcagggcgaggccgaattccgcgccgccgtcgaccgttactgcgacgacttcgagaagctgctcaaggatgtctcgcgcaacgaccgcgacaacatcatggcgcagacctacctgacgtcggacaccggcaaggtctacacgatgctggcccacgccagcgggcggttgcactaa

SEQ ID NO: 35529 - DNA, 780 bp, Mesorhizobium loti
atggatcttggtatccgcggaaagaaggccatagtctgcgcttcgagcaaggggcttggaaagggctgcgccatggcgctggccgaggccggttgcgatatcgtcgtcaacggccgcaacgccgaactggtggccaagaccgctgcggagctgcgcgagcgttttgacgtgacggtgacggaagtcgtcggcgacgtttcgaaaccggacgtgcagaaggcgctgctcgccgcctgcccggaacccgacatcctcgtcaacaacaatggcggcccgccgctgcgcgatttccgcgaactcgatcgcgcgaaaattctcgaaggcgtgacccagaacatggtgacgccaatcgagctggtgcaagccgtcctcgacggcatggcgaagcgtggcttcggccgcatcgtcaacatcacctcgctgtcggtctatgttcctattccaggtctcgacctgtcgtcgggcgcgcgggccggcctgacctccttcctcgcgggggtggcgcggacggtgatcgaccgcaacgtcaccatcaacagcctcttgcccggcaagctcgacaccgaccggctgcgcggcccgcacgaggctggcacatcagaggcccccgccgcggcagccgcgcgcaagacccgcatcagcgccgatgtgccggccaagcggctcggcacgccggaggaattcggccagatctgcgccttcctctgctcggtccatgccggctatctcacgggccagaacataccggtcgatggcggcctctacgtcagcgccttctga

SEQ ID NO: 35530 - DNA, 1374 bp, Mesorhizobium loti
atgacagttaccgttcgtttcgccccgtcgccgaccggccgcatccatatcggcaatgcgcgcaccgctctgttcaactggctgtttgcgctcaacaacaagggccgcttcatccagcgcttcgacgacaccgacattggccgctcgaagcaggaattcgccgacgccatcctctacgacctacattggctgggcattttcccggatgccaccgaatatcagtcgcggcgcttcgaggtctatgacgcggcggtcgagcggctgaaggcggctggcgttctctacgcctgctacgaaacgccggaagaactcgatctgaggcgcaaggtgcgccgtacgcgcggcctgccgccggtctatggccgcgaggccttggcgctgacacatgagcaggtagccgaataccaggccgatggccgccggccgcactggcgcttcctgcttcccaatttcaccggcgatccgctgcagcccgaacgcaccgaggttcattggaaagacctggtgcgtggcgaggaaacggtcgatctcgcttcgctctccgacccagtgctggtgcgcgaggacggcacctatctctacacgctgccatccgtcgtcgacgacatcgagatgggcgtcagccacgtcatcaggggtgacgaccatgtcaccaacaccggcgtgcagatcgccttgttcaaggcgctgggcaccgagccgcctgtcttcggccaccacaatctcttgaccaccgtgtcaggcgaggggctctcgaagcgcaccggggcactctccatcgaaagcctgcgcgaggatggcatcgagccgatggccgtcgcgtcgctcgccgtgctggtcggcacttcggagaatgtcgcggccgcgcatgatctcaccgaacttgccggccatttcgacccggccgcgacctcgaaatcatcggccaagttcgatccggacgaactgttcgtgctcaaccgcgtgctgatgcaccacatgccgttcgacgaggcgcgcgacaggctgatggtgctgggcatctcgggcgaacaggccgagccgttctggctggcggtgcgcggcaatctcgaccggctcgccgatgcggtgggctggtggcgcatcctgcgcgaggggccgcaggacagaccggagttctccgacgacgatcgtgacttcctcggacaggctttcgaagtcttgcccgaagagccctggaacggaaccgtctggaaggactggaccggcaagatcagggaagcgaccgggcgcaagggcaaggggctgttcatgccgctgaggcttgcccttactggactgccttcggggccggagcttgcagatttattgccgctgatgggtcgggaaggaacgttggcccgacgaccctga

SEQ ID NO: 35531 - DNA, 1806 bp, Mesorhizobium loti
atggctcatttcaagatcgatttgcgcgcgagcgcctttcgcagcgttcttggtttcacgctcacccattggcggcgccagccctggcggctttcgctgatcatgggtggtttcctgctgtcgacgctggccgacgtcctgacgccgctctattccggcagactggtcgacgccgtcgccagcagcgccggcgcgaacgccgtcgcctggaatgccgcgatgacggcgttttcgatattgatggcgcttgccttgacgggcgtcgtgctgcgcaacctggcgttcatgggtatagtcgaactgacgctgaagatgatggctgacatcgccgccgatgccttccatcgcgtccagcgcttttccaccgactggcacgccaacagcttcgccggctcgaccgtgcgcaaggtgacgcgcggcatgtgggcgctcgacctgctcaacgacaccatcctgatcgcgttgctgccgtccgtcgtcatgctcgtcggctcgacgctgctgctcggctggttctggccgctgatgggcgtggtcgttgccgcaggctcggtgctgttcatcatggtgacggcgatgctgtcgcttggctatgtcgcgccggcggcgcggctcgccaacacctgggacacgcgccttggcggttcgctcgccgatgcggtgagctgcaacgccgtggtcaagggctttggcgccgaggagcgcgaagagcggcgccttgccaaggtggtcgccaaatggcgggcgcgcacgcggcgcacctgggtgcgcggcaccatcaacggcaccacgcaaggggcgctgctgctggtcatgcgcgcggccgtcatcggcctgtcgctgctcttgtggtcttggggtcaggcgagcgccggcgacgttgccttcgtgctaacctcgttctttgtgctgcagggctatctcagggatatcggcacgcatatccgcaatctgcagcgttcgatcaacgacatggaggaactggtcgatttccagtccgaaccgctcggcatcgaggaccggcccggcgccaggccgatccggatcacgcaagggtcgatcagcttcgacagggtcacctttcactacggcaatcaccggtcgccgctctatcgcgacttttcggtcgatatcgcgccgggtgaacgcgtcggactcgtcggtcactccggttcgggcaagacgaccttcgtcaagctgatccagcggctctatgacgtcaatgcgggcaggatcctggtcgacggccaggatatctctcaagtggcgcaggcgtcgctgcgcgggcagatcgcgatcgtccagcaggagccgatcctgttccatcgctcgctggccgaaaacatcgcctatgccaggccgagcgcgacgcaggaagagatcgagcatgccgctaggctggcgagcgcgcatgatttcatctccagcctgccgaaaggctatggcacgttggtcggcgaacgcggcgtcaaactgtcggggggcgagcggcagcgtgtggcgatcgcgcgcgctttcctggccgatgcacgcatcctgattctggacgaggcgacatcgagcctcgattcggaatcggaggtgctgatccagcaggcgatggagcggctgatggtcggccgcaccacgctggtcatcgcgcaccggttgtcgacggtgcgggcgctcgacaggctgctggtcttcgatcgcggcaacattgtcgaggaaggctcgcacgacgagctgatccggctgaagggcggcatctaccgccgcctgttcgagcgtcaggcgctcgaactgaccaagggactggtcatctga

SEQ ID NO: 35532 - DNA, 1374 bp, Mesorhizobium loti
atgacgaaatggtcgccgaattcgtggagagcaaagccgatcaagcaggttcctgcctatccggaccttgccgcgctgaagaacaccgaagcccagctcgccaccttcccgccattggtctttgccggtgaggcacgcaagctgaagaagcagctcgcggccgtcgctgccggcgaagccttcctgctccagggcggcgattgcgccgagagctttgccgagcatggcgccgacaacatccgcgacttcttccgtgtcttcctgcagatgtcggtcgtgctgaccttcgctggcgcgcagccggtggtgaaggtcggacgcgtcgccggccagttcgccaagccgcgctcgtccgacaatgagaccaagggcgaggtgacgctgccgagctatcgcggcgacatcatcaacggcatcgaattcgacgccaaatcgcgtattccggatcccgcacgccaggaaatggcctatcgccagtcggcggcgacgctcaaccttctgcgcgccttcgcgcagggcggctatgccaacctggagaatgtgcatagctggatgctcggcttcgtctccgacagcccgcagggcgagaaatacgagtcgctcgccaaccgcatcaccgagacgatggacttcatgaaggccgtcggcatcacttcggaaaccaattatgcgctgcgcgagaccgatttctacaccagccacgaggccttgctgctcggttatgaggaagcactgacccgcgttgattcgacctccggcgactggtatgccacgtcaggccatatgatctggatcggcgaccgcacgcgccagcccgatcatgcccatgtcgagtattgccgcggcatcaagaacccgctcggcctgaaatgcggcccgtcgctgaccgctgacggcttgctggagctgatcgacctgctcaaccccgagaacgagcccggccggctgacgctgatcgcccgctttggttcggacaaggtcgccgaccatctgccgaagctggtgcgcgcggtgcagaaggaaggccgcagcgtggtctggtcgtcggacccgatgcatggcaacacgatcgaggcggccggctacaagacgcggccgttcgaccgcatcctgaaggaagtgcagaccttcttcgaggtgcaccgcgccgaaggcacgcatccgggcggcatccatgtcgagatgaccggcaagaacgtcaccgaatgcacgggcggcgcgcgcgccatcacggccgaggaattgcaggaccgctaccacacccattgcgacccgcgcctcaatgccgaccaggcgatcgaactggccttcctggtgtcggacctcttgaagaagagccatccggtgcagcacaggcaggccgtcaacggctga

SEQ ID NO: 35533 - DNA, 1824 bp, Mesorhizobium loti
atgtgcggtatcgttggaatcgtcggccactcgcaggttgcgccgctcatcgtcgatgcgctgaagcggcttgagtatcgcggttatgactcggccggcgtcgccaccatcgagcatggcgagctcgcccgccgtcgcgccgaaggcaaattgatcaacctcgagcgccggctcaaggaggagccgctcgacggcacgatcggcatcggccacacacgctgggccacccatggcgtgcccaacgagaccaatgcgcatccgcatttttccgacggcgtcgccatcgtccacaacggcatcatcgagaactttgccgagctgcgcgacgagctggtccgcgacggctatgccttctcctcgcagaccgatacagaggtcgtggcgcatctggtggcgcgcgagttggccaaggggctgaagccggtcgaggccgcgcatcaggcgctgaagcggctggaaggcgcctttgcgctggccatcatgttcaagggcgacgaggacctgatcgtcggcgcccgcaacggcccgccactggccgtcggccatggcgatggcgagatgttcttgggctcggacgccatcgcgctggcgccattcaccaattcgatcacctatctcgaggacggcgactgggcggtggtgcgccgcgacagcgtcgccatcttcgacatcgacggcaaaaaggtcgagcgcaagcgccagcaatcgctgtcgacctccttcatggtcgacaagggcaaccgccggcatttcatggagaaggaaatccatgaacagcccgaggtgatctcgcacacgctggcgcattatgtcgatttcgtctccggcgtttcgaagccgctcgacctgccgttcgacttcgccaagatcggccggctggcgatttcggcttgcggcaccgcctatctcgccggcctgatcggcaaatactggttcgagcgctatgcgcggctgccggtcgacatcgatgtcgcctcggagttccgctaccgcgaaatgccgctgtcggccaacgatgccgccttcttcatctcgcagtcgggcgagaccgccgacacgctggcctcgctgcgttattgccgcaaggccggcatgaagatcggcgccgtcgtcaatgtgcgcgaatcgaccatggcgcgcgaatccgacgtcgtgctgccgacactcgccggccccgagatcggcgtcgcctcgaccaaggctttcacttgccagctgtcggtgctggcctcgcttgcggtgcgcgccggcgtggcgcgcggggtgatttcgcaggagcaggaaaagaccctggtgcgcgcgctttcggaagcgccgcgctatgccaaccaggtgctcaagctcgaagagcagatcgagcggatcgcgcgcgaactgtcgcgctacaaggacgtgctctatctcggccgcgacaccaatttcccgctggccatggaaggcgcgctgaaactcaaggaaatctcctatatccacgccgagggctatgcggcgggcgaattgaagcatgggccgatcgcgctgatcgacgagaacatgccggtcattgtcattgcgccgcatgaccgcattttcgagaagaccgtgtcgaacatgcaggaagtggcggcgcgtggcggcaagatcatcctgatcaccgacagcaaaggggcggcgcaggtgagcgtcaagacgatggagacgatcatcctgccggacgtgccggaaatcatctcgccgatcatctatgcgctgccgatccagatgctggcctatttcgccgccgtgttcatgggcaccgatgtcgaccagccgcgcaatctggcgaaatccgtgacggtggaatag

SEQ ID NO: 35534 - DNA, 2013 bp, Mesorhizobium loti
atgttcacgaaaatcctgatcgccaaccgtggcgagatcgcctgtcgcgtcatcaagacggcgcgcaagatggggattgccacggtcgctgtctattccgatgccgatcgcgatgccgtgcatgtcgagatggccgacgaggcggtgcatatcgggccttcgcccgccgcgcagagttatcttgtccctgaaaagatcatcgccgcctgcaaggaaaccggggctcaggccgtgcatcccggttatggcttcctgtccgaacgcgccgccttctgcgaggcgctggagaaggaaggcatcgtcttcatcggtccgaagcccaaggcgatcaaggcgatgggcgacaagatcgaatcgaagaaattcgccaacgccgccaaggtttcgaccgtgcccggctggctcggcgtcatcgagaatgccgaccatgccgaaaagatcgccggcgagatcggctatcccgtgatgatcaaggcctcggccggcggcggcggcaagggcatgcgcatcgcctggaaccagtcggaagtgcgcgacggcttcgaccgggcgcgctcggaagccaagagctcgttcggcgatgaccgcgtgttcatcgaaaaattcgtcgtcgatccgcgccatatcgaaatccaggtgctggccgacgcgcatggcaatgcgctctatctcggcgagcgtgaatgctcgatccaacgccgcaaccaaaaggtcgcggaagaggcgccgtcgccattcctcgacgccaagacgcgcaaggccatgggcgagcagtcggtggcgctagccagggccgtcgactatcagagtgccggcacggtcgagttcatcgtcgacaaggacaagaacttctatttccttgaaatgaatacacgattgcaggtcgagcatccggtgacggagctcgtcaccggcatcgatctggtcgagcagatgatccgcgtcgccgccggcgaaaaactctctttgaagcaaagcgacatcaagctgaatggctgggccgtggaaagccggctctatgccgaggatccctatcgcaatttcctgccgtcgatcggccggctgacgcgctaccggccgccggaggaggggcaattcggcgatgtcgtcatccgcaacgataccggcgtcaccgaaggctccgagatttcgatgttctatgacccgatgctcgccaaattgtgtacctgggctccgacgcgcatcgaggcgatcgatgccatgtcggaagtgctcgacagttttgtggtcgatggcatcgagcacaatatcccgttcctggccgcgctgatgcagcatccgcgctggcgggaaggggcaatatcgaccggcttcatagccgaggaatatcccgacggttttgcgcctgtcgtgccgaacagccgggaaaaggccgtgctggcctcgatcgtgaccgcggtggaactgctgcgccgcgaccggctcgaccggctgggcgggcggttggcgccgcattcgggagtactcaagcgcgattgggtcgtgaggctcggcgacgactatctccaggcgtccatcctcgaaggcatgatttccattccgatggagatcgacctgtcgatcgatggcggcaaggcgctgaccgtttcatccgactggcggccaggcgacctgatctggcgcggcacggtcggcaagcgctccgtcgtcgcccagatccggcctgtcgccaacggtcttcgcatcgcctggaaaggcatgtcggtgaccgcgcgcgccatgctgccgcgcatcgccgagctggagcggcttatgccggagaaggtggcgccggacacgtcgaaactgctgctttgcccgatgcccggcctcgtcgtgtcgatcgctgtcaccgagggccaggaggtgaaggccggcgagaccttagccgtggtcgaggcgatgaagatggaaaacgtgctgcgcgccgaacgcgatctcgtcgtgtcgaaattgaacgccaagccgggcgacagtctggccgtcgacgcggtgatcatggaattcgcctga

SEQ ID NO: 35535 - DNA, 1128 bp, Mesorhizobium loti
atgaagacccgcgccgctgtcgctgtcgccgccggaaagccgctggagatcatggaggtcgacctcgacggtccgcgcgaaggcgaggttctggtcgagatcaaggcgaccggcatctgccacaccgacgagttcaccttgtcgggcgccgatcccgaagggctgttcccggccattctcggccatgagggcgccggtgtcgtggtcgatgtcggcaagggtgtcacctcggtcaagaagggcgaccatgtcatcccgctctatacgccggaatgccggcagtgcccgtcctgcttgtcgagaaagaccaatctgtgcacggcgatccgcgccacgcaggggcaaggcttgatgccggacggctcgtcgcgcttctcgatcggcaaggacaagatctttcactatatgggctgctcgaccttctccaacttcaccgttctgcccgagatcgcgctggccaaggttaacccggacgcccccttcgacaagatctgctacatcggctgcggcgtcaccaccggcatcggcgccgtcatcaacaccgccaaggttgagcaaggcgcgaccgctgtcgtcttcggcctcggcggcatcggcctcaacgtcatccagggcctgaagctcgccggtgccgacatgatcatcggcgtcgacctcaacaacgacaagaaggcctggggcgagcggttcggcatgacgcatttcgtcaatccgaaggagatcgacggcgacatcgtccctcacctcgtcaacatgaccaagcgcggcgccgaccagatcggcggcgccgactacacgttcgactgcaccggcaacaccaaggtgatgcgccaggcgctggaagcctcgcaccgcggttggggcaagtcggtcgtcatcggcgtcgccggcgccggccaggagatctcgacgcgtccgttccagctggtcaccggtcgcacctggatgggcaccgccttcggcggcgcgcgcggccgcaccgacgtgccgcggatcgtcgactggtacatggacggcaagatccagatcgatccgatgatcacccatttgctgaagctggaagacatcaacaaggggttcgacctcatgcatgagggcaagtcgatccgtagcgtcgtggtttactga

SEQ ID NO: 35536 - DNA, 378 bp, Mesorhizobium loti
atgaacctcatggcaaagacctatttcacatcagatcacgaatggctccgcgttgagggcggcatcgccaccgtcggcatcaccgactacgcgcaggagcagctcggcgacctcgtcttcgtcgaactgccggaaacgggcaagaagctgaccaagggcgacaccgccgtcgtggtcgaatccgtcaaggcggcttccgacgtttacgcgccggtcgacggcgagatcaccgaggccaacggcacgctgtcttccgacccgtcgctggtcaactcggcggcaaccggcgccggctggctgtggaagatgaggcttgccgacgaaagccagctcgccggcctcatggatgaggccgcctacaaagcccatatcgcctga

SEQ ID NO: 35537 - DNA, 594 bp, Mesorhizobium loti
atggaaaagccggtcaccgaccgaccgagcgaagccgaggtcgaggcggccgtgcgcacattgctgcgctggaccggcgacaatccggaccgcgaggggctgatcgatacgcccaagcgcgtggccaaggccttccgcgaaatgttcggcggctacgacatgtgcccggccgaggagctcggccgcaccttcgaggaggtcgccggctacgacgatctcgtcatagtgaaggatattcacttccattcgcattgcgagcaccacatggtgccgatcatcggcaaggcgcatgtcggctatctgccggatggcaaggtcgtcggcctgtcgaagatcgcgcgcgtcgtcgatatcttcgcccatcgcctgcagacgcaggaagcactgaccgcgcaaatcgccggcgtcatccaggatgtgctcaatccgcgcggcgtcgccgtcatgattgaggccgagcacatgtgcatggccatgcgcggcatccgcaagcagggctccaccaccctcacctccaccttcaccggcgttttcaaggatacgcccgaggagcaggttcgtttcgtcaccatggttcgcggcggcggggcataa

SEQ ID NO: 35538 - DNA, 1314 bp, Mesorhizobium loti
atggctgaagctctgcgtgttggaattgccggacttggcacggtgggtgcagcggtggcgcgggtgctgcgcgacaaggcggcggagctgacccggcaatgcgggcgcgacatcgtcgtgtcggcggtttcggcgcgcgacccgaaacgcgaccgtggcgtcgatgtcagcgccgcaaaatggttcgacgatccggtcaagatggcgcagagcgccgagatcgatgtgttcatcgaactgatcggcggcgacgaggggccggcgcgcctgtcggtgaaggcggcgctcgaagccggccgccacgtcgttaccgccaacaaggcgctgcttgccaagcatggcgtggcgctggccgagatcgccgagaagaagggcgtgctgctcaactacgaggcggcggtggcgggcggcattcccgtcatcaagacgatgcgcgaggcgatggccggcaactcggtcacccgcgtgttcggcattctcaacggcacctgcaactacatcctgacccgcatggaggccgagggcatctcgttcgatgcctgcctgaaggatgcgcagcggctgggctacgccgaggccgatccgaccttcgacatcgagggccatgacaccgcgcacaagctgtcgatcctgaccagccttgccttcggcaccaagatcgccgccaacgacatctatatggaaggcatctccaacatcacacaggccgacatccgcgccgccggcgatctcggctaccggatcaagctgctcggcgttgcccagcgcaccgatagcggtatcgagcagcgcgtgcatccgaccatggtgccgaccgcctccgttatcgcgcaagtgcatggcgtcaccaatgcggtggcgatcgagaccgatatccttggcgaattgctgctctccggccctggcgccggcggcaacgccaccgcctctgccgtgatcggcgacatcgccgacatagccaagagccgccccggcttccagcatggtccggtctttggcctgccggcgaaggagctcaggccctacaagaaggcgcagatgcgcagccatgccggcggctacttcatccggctaaccgtgcatgatcgcattggcgtcttcgccgcgatcgccaagcgcatggccgacaacgatatttcactggaatcgatcgtccagcacgcagtcaacggcgaagcggcggcgcagaagacggtgatcctcgtcacccacgagaccaccgaggccgccgtgcgcaaggccgtcgacggcatcaccaaggacggtcacctgaccgacaagccgcaggtcatccgcatcgagcgggcagggtaa

SEQ ID NO: 35539 - DNA, 1212 bp, Mesorhizobium loti
atggaagagtttcacaaggtccgccggcttccgccttacgtgttcgagcaggtcaaccggctcaaggccagcgcccgttcgcgcggcgccgacattatcgacctcggcatgggcaatccggacctgccgacgcccaaggccatcgtcgacaaattgtgcgaagtggtgcgcgatccgcgcacgcatcgctattcctcctcgcgcggcattcccggcctgcgccgcgctcaggccgcctattatcagcgccgcttcggcgtgaagctcaaccccgacacgcaagtggtggccacgctcggctcaaaggaaggcttcgccaacatggcgcaggcgatcaccgcgcctggcgacgtcatcctgtgcccgaacccgacctatccgatccatgccttcggcttcatcatgtcgggcggcgtcatccgctcgctgcaggtcgagccggacgatggtttcattccagcgctggaacgcggcgttcgccactcgatccccaagccgctggcgttgatcctcaactatccgtcgaacccgacggcactggtcgcttcgctcgacttctacaaggacgtggtggcgttcgcgaagaagaacgacatcatcatcctgtccgaccttgcctattcggagatctatttcgacggcaacccgccaccttcggtgttgcaggtgcccggcgccatcgatgtctgcgtcgagttcacctcgatgtcgaagaccttctccatgcccggctggcgcatgggttttgcagtcggcaatgagcggctgatctcggcgctgacgcgggtgaagtcctatctcgactacggcgccttcacgccgatccaggtggcggcggcccatgcgctcaacggcgacgaaatcgcagaggtgcgcgaggtctaccacaagcgccgcgacgtgatggtcgattccttcgggcgcgccggctggaacattccggccccggccgcctcgatgttcgcctgggcgccgatccccgaaccgttcaagcatctgggctcgctcgaattctccaagctgctcatcgagcacgccgacgtggcggtggcgcccggtgtcggcttcggcgagcatggcgacgatttcgtgcgcctggcgctggtggagaacgagcaccggatccgccaggcggcgcgcaacatcaagcgcttcctgtcgaccagcgccaagcagcccaacaatgtggtgccgctgtccgcccaccggtaa

SEQ ID NO: 35540 - DNA, 1614 bp, Mesorhizobium loti
atgtgggattacataattgtcggcgcgggctcggccggttgcgtgctggcaaaccgcctgtcagaggatcctgacgtcaaggtcctgctgctggaggctggcagccgggattggaatccgatgatccatattcccggcggcatcggcaagctgttcgggccgggcgtcaactggcggttccacacggtgccgcagaagaacctcgacaaccgctccatctggtatccgcaaggcaagacccttggcggctcaagctcgatcaacgcgatgatctacatccgatgccaaaaggaagactatgacaattgggcagcactcggaaacgacggatgggcttatgaggatgtcttgccctatttccgtaaatccgaggacaatgatcggctcgccaatcgctatcacgggctgggcggtccgctcgcagtttcggatcaggtcggtccgcacccattgacccgggcatttgtccgtgccgtgcaacaatatggcctgccgttcaatcccgacttcaacggcgacaccatgtatggcgccggcttctaccaggtcacctgtcgcgatggccgccgccgctcgtccgccgtctcctatctgcatcccgtcagcaggcggcccaacttgacagtcaggacccatgcccgagtcacaaggatcgttgtcgagaacggccgcgccgtcggcgtcgaactttccgagggcaaatcgcggaaagtactccgggccgaaagcgaggtaatcgtatcggcaggagccatcaactcgccgcgcctgctgatgctgtccggtatcggcccggccgacaagttgcaagctctcgggatcgctccggtcgccgatctcagcggtgtcggtcggaacctccaggatcatctctgcaccaatgtccatctgacgctcaaggacccaatcagctatgacggccaggatcgctatcccaaggcgctcctgcacggcattcgctggctgctctatcgcaatggccctgccgcctcggtcattgtcgagggcggcggcttcttccagagcgagggagcgaagcggcccgaccttcagattcacatcgcgccggcgatggtggtacgcggcggtcagacgcggctcgacgggcatggttttaccatcaactcgacattccttcgaccacgtagcatcggctcggtggaggtccgctcttcgaaccccgccgacgagccgctggttgaccccaactatctttctgacccatacgatcgcggcatggcattgaaatcagtacggatcatccgggacgtgctggcgcaaagcgaaatcgccaagttcgtcaaggtcgagcggctgcctgggccggctgcgaagaccgacgaggaattgatggcctacatcaggcaatatgcctgctgcgactatcaccctgttggcacctgcaagatgggcgtcgacgagaccgcagtcgtcgatcccgaactgcgtgtgcgcggagtcgacggactgcgggtgatcgactcatcgatcatgccggtgctgatcagcggcaacaccaatggaccgacgatgatgatcggcgaaaaaggcgccgatctggtgaagggcgtccagtctggtcgctccgcacaagcgatcgcggcagtcgcgtaa

SEQ ID NO: 35541 - DNA, 966 bp, Mesorhizobium loti
atgatgagcgacaagaaaccgtttgctgcccatggcgtcattcccgcctgcctgatgccgttcaccgccgatctggctgtcgatgagagtgcctaccgcaagcacctcgctgacgtctcctcggtcgaaggcatttccggcatcacgatcaatggtcatgcggccgaagtgcacgcgctcaccatcgacgagcaataccgcgcgatagtggtagccaaggatgtgttgcaggatcaggttccgaccattgtcggtgtctacacaaactccagcctcgaggcagcgcgcatcgccgcctatgctgagcaagagggggcggacgcgctgctggttttcccgccggacttcatgacgctcggtgggcacctgcggccagagatgatcgtcgagcatctgaagcgcattaccgatgcgtccaaccttcccatcatcctgttccagtatccgctggcatcgaaccttgcttacccgcttcagacattgctcgacctctgccgtcgttttccctcgatcgtcgcgattaaagaccagtgcggcgatggcaatttgcatgaacgtcagatccgcgaattgaaagctctcgaccgaccggtcaacaccctcaccacccacagcgcctggttgctcggctcgctgacgcttggctgcgacgggctcctgtcgggtgccggcagcgtcatcgccagccttcaggtcgcgctgtaccgtgccgtgcaggcaaacaatctcaagactgccaaggcaatcaatgaccgcatctatccgacggtacgggccttttatgacgcgccgcttctcgatatgcacaatcgcatgaaagaggcgctggtgctgctcgggcgactggacgaagctcacgtccggcccccattgatgaagccagaccccgccgagatcgagaagattcggggactgctgaatgctgccggattgagcgcggagacgctttacaggaaggtcgcctag

SEQ ID NO: 35542 - DNA, 1488 bp, Mesorhizobium loti
ttggcagtgaggaacgacgtgagcacgcgcagctaccaacaattcatcggcgggcggtttgtcgacggctcaggttccggttcgatcgagcgccgatcgccggccacaggtgacctggtcgcccgatatgctgatggcacgcccgaggacgtcgatcttgcagtcgaggcggcccgcatcgctttcgaggacgggccgtggccgcgtatgagcggcatggagcgcgccgaggtcctgaaccgtcttgccgatttgatccgcaccaatcgcgacaggctggtcaggattgaggtcgaggaggtcggcaagccagttcgttttgcgcgcggcgatattgacggtgcagccggcctgacacgttatgcagcttcgctggccatgcagatggcgggcctgacctacacgaacatcggcgatggcaagacggcgctgatcagccgcgaagcagtgggcgtcgtggcgctggtcacgccatggaatttcccggcgctgatcctgtcgcagaaagtcccgttcgcgctcgctgccggctgcactgtggtgctgaagccatccgagttcacgccaggctccgcgttcgaaatcgccgcgcttgcggcggaggccggcgtgccggccggcgccttcaatgtcgtcagcggttatggcgcaaccgccggcgaccacctgacggggcatatgggcatcgacttcgtttccttcaccggttcgacgcgcaccggcagccgcgtcgtcggcaacacgtcccgtcatctggtcaaatcctcggtcgaactgggcggcaagtcggccaatatcgtctttgccgatgcggatctggaagccgcggcggacggtgcgctgatgggcgtgttcttcaacaatggcgagtgctgcgtttcgggttctcggctgttcgtgcagtcctccattgccgacgacttcatcgccaaagtgatcgcgcgctcccgcaagatgaaggtcggcgatccgttcgacgacgacacggatgtcggcgcgctgatcgaccgcaaccatctggccaaggtgaccggcttcgtcaaaagcgggatcgaggaaggcgcccaactggtgctcggcggcaacgtagcggcaggggcggtaggtcattttcacgaagcgaccattttcgaccgggtcgagccgcatatgaccatcttccgcgaagagatctttggcccggtgctcagcatcacacgcttcgatacggtggatgacgcggtgcggttggccaatgatactgcctatggcctgtccaactacatctggtcgaagaatatcgacacggtccttaccgtcgccaagcggttgaagagcggctgggtgcaggccaacacaatcatcgacggcgccccgcaactgccgctcactggggtgaagggatccggcttcggctacgagatgggccaggccggctttgaagagttcacccaactcaagacgcttctcattcagaccgggccgcgcgctccggtgtttccggtctga

SEQ ID NO: 35543 - DNA, 831 bp, Mesorhizobium loti
atgctggaacaggtttccccggctgcaatcggcgctgctatgcccgagaaagcagcgtccatcaaccgcgggcttgccattgtgacgggaggccgtcgtggcatcgggcgagccatctgttgtgaactcgcgcaggcgggtttcgacatcgctgtcattgatatcgtcgacgatgagaatgccagcgagactgtcaatcttgtccgcaggcacgggcgaaatgctgccttttatcgcaaggacatatccgaaacctcggacaatacggccttgatagagcgcatcgaagccgatctggggggggccacttgcctggtcaacaacgctggcgtccaggtttcagtgcgtggcgatctactcgatgtttccgaggagagcttcgaccggctcgtcggtatcaatctgcgcggcacgttcttcttcacccaggccgtcgctcgcgcgatgatttcccggccgcatgtccggctcgaacgatcggtcgtgacgatcacctctgcgaacgcaggcttggtctcgccggaaaaagggccgtactgcatatccaaggctggactgtcgatggcttcccagcagttcgccattcgtctggcggatacaggcatccgggtgcacgagattcgcccaggcctgatccagaccgacatgaccgcagacgtctatgagaaatattcggcgcaggtcgaagccggacaactctcggcaatcagacggtgggggcagcctgaagacattgcccgcggggtggcgacgctggccgtcggcggcatgccattcagcaccggggacatctaccacatcggcggcggcatgcagatgcatcgcctgtga

SEQ ID NO: 35544 - DNA, 948 bp, Mesorhizobium loti
atggccaatgtcgcgattgtcggaagtgggttcatcgggcgggcctgggcgatcagtttcgcccgcgccggccatgatgtgcgcatgtgggaccagtcgcctgccgcgacgggtggcgcgcgcgactacatagagggcgtgctcggcgatctcgccgcgaacgacctactgcgcgggcaatccgtcgacaccgtgcttggccgcatcgccaccgtcggcgatctggcggaagcgctggccgatgccgcccatgtccaggagaacacgcctgaaaacctcgatgtgaagcgggaggtgttctcgctgatcgataggcttgctgggccgcaaacgatcatcgccagttccacctcggcgctgttgccgtcgaaattcaccgaccacctgcaggggcggcaccgctgcctggtcgtgcatccgatcaacccgccctatctcattccggcggcagaggtggtgccggcgccttggacctccgccgagacgctggagaagacgcgcgccttcctcatcgatgccggccacgcgccgctggtgatgaggcgcgagctcgacggcttcatcatgaaccgcctgcaaggggccttgctggaggaggctttccggcttgtcgcggacggctacgccagtgtcgaggatgtcgatatcggcatccgcgacggcttggcgctgcgctggtccttcatgggaccgttcgagaccatcgacctcaacgcgcccggcggcgtgcgcgactatgtcgatcgttaccagggcatttattccaacatcttcccgcagatgctgcgccgcgtcgactgggcgggcgaggtcatggcaaccgtcgaggccgagcgcagcaagcgcctgccaaggggaagcctgggtgaccggcaggtctggcgggatcgccggctgatggcgctggcggcgcacaagaagaaatcggatcaggagttcggacaatga

SEQ ID NO: 35545 - DNA, 795 bp, Mesorhizobium loti
atgaaaatcgtcacctggaacatcaacggcgttcgcgcccgcatcggcaatctgacccattggctgaccgagagcgcgcccgacattgtctgcctgcaggagatcaagacggtcgacgagcagttcccgcgcgccgagatcgaggcgctgggctacaatgtcgaaaccaatggccagaagggtttcaacggcgtcgcgctgctgtcgaagctgcgctttgacgaagtcatcagaggccttccgggcgacgacaccgatgagcaggcgcgcttcatcgaaggtgtgttctcgaccgacaagggcgcgctgcgggtcgcctctctctatctgccgaacggcaatccgatcgatgacgagaagaaattcccctacaagctgaactggatggcgcggctggagcgctgggccgaagagcggctgaagctggaagaggcgctggtgctggccggcgactacaacgtcattcccgagccgatcgacgcgcgttttccggagaactggctgggtgacgcgctgttccagccgcagacgcggcaggcctttcgccggctgctcaacctcggtttcaccgaagcggtgcgcgcggtcaccgatgcccccgacacctacaccttctgggattatcaggccggcgcctggcagaagaacaacggcatccgcatcgaccatctgctgctgtcgccggaggccgccaaccgcttctcgtcggcctcgatcgaaaaacatgtgcgcgcctgggaaaagccgtccgatcacgtgccggtggcgatcgatctcgccttgcagccggcctga

SEQ ID NO: 35546 - DNA, 651 bp, Mesorhizobium loti
atgagcgacatcgtcctgcacaattactaccgttcctccacctcctaccgggtgcgcatcgcgctggagatgaaggggctgagctatgactatgtcccgcatcatttgcgccatggcgaacatctggaaccagcctatctcgcggtcaatccgcaggggctggtgccggcattggtgctcgacgacggcacgctgttgacgcagtcgctggcgatcatcgaatatctcgacgagatccatcccgcgccgccgctgctgccgaaggacccgcttggccgggcgcgcgtacgaatgctggcgcagatgatcgcctgcgacatccacccggtgaacaatctgcgcgtgctgacctcgctgcgcactttgttcggcgccggcgaccaggacatcaccaactggttccgccactgggtgaacgaaggcttccagccgcttgaaaagattctggcttcctcgcctcagaccggaacattctgccacggcgaggcggcggggctggccgatatctgcctggcggcacagatcaccagcaacgcccgtttcggcgtcgacctgacgccttacccgacgatcacccgcatcaacgccgcctgcatggcgctgccagccttccagaaagccgctccgcagaaccagatggatgccgaatag

SEQ ID NO: 35547 - DNA, 1041 bp, Mesorhizobium loti
atgaaagccgtcgtcttcgagaaattcggcgaagcgccgacgatccagaccgtccccgatccgaagccggctgccgatggcgtcgtcatcaaggtcgaggcgacagggctgtgccgcagcgactggcatggctggatgggccatgatgacggcatcaccttgccgcacgttcccggacatgaacttgcaggcgtcgtcgtcgccgccggcaagcaggtcagccgctggaaggccggcgaccgcgtgacggtgccgtttgccgtcggctgcggccgctgcttcgaatgcagctctggcaaccatcaggtctgcgagcaccagacgcagcccggcttcaccggctggggctcgttcgccgaatatgtcggcatcgagcatgccgacaccaacctcgtgcgcctgcccgacgagatggaatacgccaccgccgccagcctcggctgccgtttcgtcacctcgtttcgcgccattgtcgaccaggggcgggtcaagcccggcgaatgggtggcggtgcatggctgcggcggcgtcggcctgtcggcaatcatgatcgccagttcgatgggcgccaacgtgatcgccatcgacctcaccgacgagaagctggagttcgccagaaaaatcggcgccgtggcgacgatcaatgcgtcgacgacgccgaatgtggtcaaggcggtcaagcagatcgccaatggcggcgcgcatatgtcgatggacgcgctcggccaccccaccacctcgttcaactcgatcgccaatctgcgccggcgcggccgccatgtgcaggtcggcctgatgctgggcgagcacgcccgcccgcaagtgccgatggacaagatcatcgccttcgagctcgagatcctcggcagccacggcatgcaggcctatcgctaccaggcgatgatggacatgatccgcaacggcaagctcaagcccgaactgctggtcggcaagaagatcagcctcgacgaggcgcccgcggccttgatggcaatgggtggcttcgagggcattggcattggggttgtgacgaaattctga

SEQ ID NO: 35548 - DNA, 3654 bp, Mesorhizobium loti
gtgaccgccggcccgctccctgacgctcgctccacgggacccgccatgccgctcgacaccatccgccagcagatccgcgccaactatctgcccgacgaagatgaggccgtgaaacgattggccgaggcgacagggctttcggctgcggatcgcgacgcgatctcggcgcgagccgccgatctggtgcgggcggtgcgcggctcgtccgatccccggctgatggaggttttcctctcggcctacggcctttccaccaaggagggcgtggcgctgatgtgcctggccgaggcgctgctgcgcgtgcccgacaccgagacgatggacgatctcatcgccgacaagatcgcgccgcatgactggtcggcgcattcgggtggttcgagctcgatcttcgtcaacgcctcgacctgggcgctgatgctgaccggccgcgtgctggacgagggcgagggcggtatcgaaggcacgttgcgctccatggtgcgcaggctgggcgagccggtcatccgcaaggcggtggccgccgccatgcgcgagatgggcgaacagttcgtgctcggccgcaccattgcagaagccgtcaagcgcggccggccgatgacacagaagggctacctctattccttcgacatgctgggcgaggcggcccgcaccgaggccgatgcactgcgctaccacaaggcctatgccgacgcgatttcgtcgctcgatgccggctccaatggtcccgacatcaggcaaaaccacggcatctcggtcaagctttcggcgctgcatccgcgctacgaagtggcgcagaaggaagagatgctgcctgtcatggccgagcggctgctgtcgctggcgcttgcggccagacattcgcgcatgggtctcaacatcgacgccgaggaggccgatcgcttggatctgtcgctcgacgtcatcgagcgcgtgctggccgagccggaactcgccggctggaacggctttggcgtggtcgtgcaagcgtatgggccgcgcgcggccttcgtcatcgactggctctatgctctggccaggaaatacgaccgcaccatcatggtgcggctggtcaagggcgcctattgggacaccgagatcaagcgggcgcagacgctcggacttgccggctatcccgtcttcacccgcaaggccaacaccgacgtttcctacatggcttgcgcgaagaaactgcttggcatgaccgaccgcatctatccgcaattcgccacccacaacgcccacaccgtcgcggccatcctgtcgatggccacgaaccgcgattccttcgaattccagcgcctgcatggcatgggcgaggcgttgcacgagacggtgcgccaggccgaaggcacgcgctgccgcatctatgcgccagtcggcgcgcattcggacctgctggcctatctggtccgccggctgctcgagaacggcgccaactcctccttcgtgcaccaactgaccgacgaggatgtcgagccggaagacatcgcgcgcgatccgctcgaaacggtcgaaagccaaggccctgccgccaatccggcgattgccaggccgtcgcagatttttggcgcaggccgccgcaattccagaggtttcgacatcaccgacacggtgacgctggcggccatcgacaaggccagggcggcgttcgccgggccggaccgctggcatgccaagccgatcacgcgggccgccggctatggcaagccgcacccggtcgtcaatccggccaagcccgatgaagtggtcgggacggttcacgaggccgccgccaagcaggtcgcgatcgccgtgcgcatcgcggtggaggcgcagccggcctgggcgaagcgtcccgttggcgaacgcgccgccatcctcaaccgcgccgccgatctctatgaagccaatgcggtcgagttcttcgcgctcgccacccgcgaggccggcaaatcgctggccgatggtgtggcggaagtgcgcgaggccgtcgacttcctgcgctactacgccgccgaggcggcaaacgccgagacgggcacgcaggcgcgcggcgcgatcgtctgtatttcgccgtggaatttcccgttggcgatcttcaccggccagatcgcggcagcactcgttaccggcaattcggtcatcgccaagccggccgaacagacaccgctgattgccttccgcgccgtcgagttgctgcgcgaggccggcgtgccggaagacatcatccaactgctgcccggcgacggcccatcggtcggcggaccgctgaccgccgacccacgcattgccggcgtctgcttcaccggctcgaccgaagtcgccaagctgatcgagaaacagctggccgagaccgcggcacccgacgccatgctgatcgccgagaccggtggtttgaacgccatgatcgtcgattccaccgcgctgcccgagcaggcggtgcgcgatatactggcctctgccttccagagtgccggccagcgctgctcggcgctgcgcgtgctctacgtgcagaaggacgtcgagaagaagatgctggacatgctgaagggcgccatggaggcgctcaacatcggggatccctggcggatttcgactgatgtcggtccggtcatcgatgatgaggcgcaggcctctatccgtgactattgcaccaggaaaggtctcgaggggcggctgatcgccaagctcgaggcgccgaaggacgggcgcttcgtcgcgccgcatgtcttccgggtcaagggcatcgaggagatggagcgcgaagtgttcgggccggtgctgcacgtcgccagcttcgacgccgatgagatcgatgctgtcatcgctgccatcaaccgcaagggctatggcctgaccttcggcctgcacacccgcatcgaaggtcgcgtccagcatttcgtcgacggcatccatgctggcaacatctacgtcaaccgcaaccagatcggcgccgtggtcggttcccagccctttggcggcgaggggctttccggcaccgggccgaaggctggcggcccgcattatctgcgccgcttccgcaaggggccggaagccggcacagaggttggcgagggccacaaggtgacggcgaccgaactggccgacaatctgcccgatccggccctcggcggctggtcgacgcgcccggaccggatcgccatcctgaggaagcatctgcgcggcaagggcgctgccgccatcggcgctgccgctgcaatcgatttcggccaggtcgacctgcccggcccgaccggcgaggccaatacgctgtcgctgtcgccgcgcgggcgggtgttgtgcctggggccggatgccgagacgctgctcgcccagaccatccaggcgctcgccgccggcaatgcagtgctggccgtggcccctggggcgccggccgccttgtcggcgctgaccggcaagggcttgccgctcgcggcgatagatggccgccccgatccggtcgaggcgcgcgcgctgcgcgtcgatgtcgtcgctttctcgggtacgccggaggccgcgcgcatcgtgcgccaggtgatcgccgacaggaccggcccgatcgtgccgctggtcagcgaggtgctcaatccggccgcctatgcgcatgagcgcgcggtctgtgtcgacaccacggccgcgggcggcaatgccagcctgcttgccgcggcctag

SEQ ID NO: 35549 - DNA, 921 bp, Mesorhizobium loti
atggcgggaaacggtgtcgcctcgatcggtgaatgcatgctcgaactttcgggccagaccggcccgaactggtgcatgggttttgccggcgacacgttcaacacgctgtgggcgctgcatgcgttgagcgaggaccggccggcaacctatgtctcggccttcggcgatgaccccttttcgcagggccagatcggcttcttcgccgaaaacggcatcggcatcggctccagcccggtgataccaggtgcgcggcccggcctctacgcgatcacgctgaccggcgccgagcgctccttcacctactggcgcggcgacgccgccgcccggcagcttgcctcggatcccgctgcactgtcgaaaaaccttgaaaatcaggcgcttgtgtacttttccggaatcactttggcaattctggacgatgcctcgcgcaaaacactgctggaagccgtgaccaaggcgcgcgccgctggctcgctgatcgccttcgatcccaattatcggccacggctttggcgcaaccgcgaaagcgcgcaggcagcaatcgtcgaggcactcggcgtcaccgacgtcgctctgccgaccttccccgacgagcagatgctgtttggtgatgagacaccgcgggcgaccgccgagcggcttggacaatgggtcggcgaagtcatcgtcaagaacggcgaacagccggcgctgattgccgagagcggaacattgcacgacgtgccggcgatccatgtcgcggcccccgtcgacaccaccggcgccggcgactccttcaatggcggctatctcgcggcgcgtcttgccggccatgggcctcaggaagcggcaagccgggcgcatcgcgtcgctgccgccgtggtccaggttcgcggcgccctggcgccgttcgagacgctacgggcggcgttcgacagctga

SEQ ID NO: 35550 - DNA, 1458 bp, Mesorhizobium loti
atgcttcagaaaaccagccatttcatgcggcaggccaatctcatcaacggcgaatgggtgcaggccgacagcggccagacggtcgacgtcaacaaccccgccaccggcctcaagatcggcaccgtgccgaagtcgggcaaggccgagacccgccgcgccatcgaggccgcggacgccgccttcaagacctggcgcaagacgaccgcgctcgagcgttcgaagctcttgcgcaagctgcatgacgcgatgatggacaatcaggacgtgctggccgagctcttgaccatcgagcagggcaagtcactgttcgaatcgaagggcgagatcggctcggcagcggcctacatattgtggttcgccgaggaaggccgccgcacctatggcgacgtcgtgccgtcgccatgggcggaccgccgcatcctggtgaccaaggaaccggtcggcgtcatcgccgccatcacgccgtggaatttcccgtcctcgatgctggcccgcaagctcggcccggccctcgccgccggctgcaccgccgtggtgaagcccgcctcgcagacgccttactcgggcctcgcctggggcgcgctcgccgaggaagtcggcttccccaagggcgtcgtcaacatcctgaccggttctgccagtgagatcggcgacgagatctgcgccaatccgctggtgtcgaagatcacgttcaccggatcaaccgaagtcggcaagctgctcatccagaagtcgtcagtcaccgtcaagaaagtgtcgatggagctcggcggcaatgcgccgtttatcgtcttcgacgatgccgacatcgagcgcgcggtggccggcgcgatcaccgccaaataccgcaattccggccagacctgcgtctgcaccaaccgcttcctcgtccaggctggcgtctatgacaagttcgtcgagaagctggccgccgccagcaacgggctgaaggtcggttccggcctcgaggaaggcgtgcagcagggaccgctgatcgacgagaaggcggtcgagaaggtcgaggaactgatcgccgacgcaacctccaagggcggcaagattgtcgccggcggcaagcgtcatgcgctgggcggctcgttcttccagccaacagtgatcgccaatgcgacgcccaagatgcgcttcatgaaggaagagatctttggcccggtcgcgccggtgttcaagttcgagaccgaagcggaagccatcgcgctcgccaacgacaccgaattcggcctcgcctgctatttctacaccggcgatctcggccgtgctttccgtgtcatggaagggctgaaatacggcatggtcggtgtcaatgaaggcctcatcaccacgccagaagcgccattcggcggcgtcaaggaatcgggcctcggcaaggaaggcggacatcagggcatcgaggactacctcgataccaaatatgtctgtatcggcggcctcggcctctga

SEQ ID NO: 35551 - DNA, 1251 bp, Mesorhizobium loti
atgggcaggcccgtcgtcgccgtcaccggtatcggcgtggtcacttcgctcggcgtcggcaaggctgacaattgggcggcgctgacctcgggcaagtcgggcatccacccgatcacccgctttccggtcgatcatctcaacacccgcatttccggcatggtcgacttcctggactcaagctcgaagggcgccagccccctgacctacgagttggccgaaaccgccgcgcatgaagccgtggccgaatccggtctcgattccagcgatttcggcgggcctctcttcctcgcctcgccaccggtcgagctcgactggcacgaacgcttctcgctctacaattccgacaagcaggatgctggcgccgaacggttgcttcgcgtggcccgcgcgctgaaggagctcgacattttcgagaccactcagttcggctcgatcgccgaccggctcgccgaccgtttcggcacgcgcggcctgcctatcacgctgtcgaccgcctgtgcctccggcgccaccgccatccagctcggcgtcgaggcgatccgccgcggcgaatgcgaccgggcgctgtcgatcggcgccgacggttcggcgaccgccgaggcgctgatccgcttctcgctgctgtcggcgctgtcgacccacaatgacatcccggaaaaggcgtcaaaaccgttttccaaggaccgcgatggttttgtcctcgccgaaggttcgggcgcgctggtgctggaatcgctggaggcagcccttgcccgtgacgccaccgttcttggcattctgcgcggctgcggcgaaaaggccgatgatttccaccgcacccgctccaagcctgacggttcgccggcaatcgcggcggttcgcgccgcccttgccgatgcgggcctgagcaaggacgagatcgactacgtcaacgcccatggcacctcgacgccggaaaacgacaagatggagcacctgtcgctgtcgaccgtgttcggcgagcgcatcagctcgatgccggtctcgtcgaacaagtcgatgatcggccacacgctgtcggcggcaggcgccgtcgaggcagcgttctcgctgatgacaatgcgcgaaggcgtcattccaccgaccatcaattacgacaatcccgacccggcgatcgtgctcgacgtggtgcccaacaagaagcgcaatgccgaggttcgcagcgttctgtcgaactccttcggcttcggcggccagaacacttgccttgtcatggcgcgggaaccggtctaa

SEQ ID NO: 35552 - DNA, 1029 bp, Mesorhizobium loti
atgcgcgcactgcaacttatcgaggaccgccgtcttgaaacggtggacctgccgcctcccccgccacccgcgctcggcgaagtcacgctgcgcatcagggcggtggcgctgaaccacatcgacgtctggggctggcgcggcatggccttcgccaagcgcaagctgccgctggtcgtcggcgccgaagcctccggcgaggtcgaggcggtcggccccggcgtgtccagcctgctgcccggacaattggtgtcgatctatggcgcgcgcacctgcggcctttgccgtgcctgccgcgaaggccgcgacaatctttgcgaacatgtttccggggtccacggcttccacctcgacgggtttgcgcaggagaagatcaacctgccggcgcgcctgttggtccccgccccgcccggcgtgagcgacatcggcgccgcggtggcccccgtcaccttcggcacggtcgagcacatgctgttcgacaacgccaggcttcagccgggcgaaaccatcctcgtccatgccggcggctccggcattggctcggcggcgatccagctggccaagcggatgggctgcaccattatcaccaccgtcggttccaacgacaagatcgacaaggccaaggcgctcggcgccgaccacgtcatcaactaccgcgaagaccgcttcgaaggcgtcgtgcgcaagctaaccaagaagaagggcgtcgacgtcgtcttcgaacatgtcggcgccgacacctttgccggctcgatgctgtgcctgaagcgcggcggccgcctagtgacctgcggctcgacatcaggcgtgtcgacgcaaatcaacctgatgcagctcttccagcagcaattgaagctgctcggctccttcggctgccgcatggagaacatggccaacgccatgcagaaaatggcggcgggacaggtcgcgccggtcatcgacaccgaagtcggcttcgacgatatcgacgcagcgctaaagcgcatggaaggccgcgacgtcttcggcaagatcatcctgcgcgtcgcctga

SEQ ID NO: 35553 - DNA, 1167 bp, Mesorhizobium loti
atggacgccgcggtcgatgcgagcaccagccagttcgaactcaacgaggaacagcgcgccatccaggagatggcgcaggccttcgccgccgaccgcgtcgcgccgaatgcgctcgactgggatcgcaggaagcattttcccgccgatgtgatccgcgagaccgggccgctcggcctcggcggcatctatgtcagggacgacgtcggcggctccgccctcggccgcctcgacgccgtgctgatcttcgaggcgctgtcgcatgccgatccgggcttttcgtccttcatctcgatccacaatatggtggcctcgatgatcgaccgcttcggcaacgacgagcagcgccagcgcttcctgccgaagctcacctcgatggaatggctggcgagctattgcctgaccgagccgggctccggatcggatgccgcggcgctcaagacgcgcgcggtgaagagcggcggcgactatgtcctcaacggcgccaaacaattcatctcgggcgccggcgacagcgatgtctatgctgtcatggtgcgcaccggcgccgacgggccgaaaggcatttccaccattgtggtaccgaaggatgcgcccggcctctccttcggcgccaacgagcacaagatgggctggcacatgcagtcgacccgccaggtcatattcgaggactgcaaggtgccggcggaaaaccttctgtcgggtgaaggcgccggtttcggcatcgccatggccgggctcgatggcggccggctgaacatcgccgcctgttcgctgggcggcgcccagtcggcgctcgacaaggcgctgtcctacaccgccgaacgcaaggccttcggctcgaagatcaaccagttccaggcgctgcagttcaggctggcggatatggagaccgagctgcaggcagcgcgcatcttcctctatgccgccgcctccaagctcgaccgcaaggcgccggacgccggcaaatggtctgccatggccaagcgcttcgtcaccgacaccggcttcaacgtcgccaacaatgcgctgcagttgctcggcggttacggctatctgcacgactatggcatcgagaagctggtgcgcgacctgcgcgtccatcagatcctcgaaggcaccaacgagatcatgcgcgtcatcatcgcgcgtgccttgatcggtcgctga

SEQ ID NO: 35554 - DNA, 1380 bp, Mesorhizobium loti
atgacctatcagaattattcgctgaagcagcttcagcagatcgacgccgcgcatcatctccatcccttcaccgaccacaaggaattgcgcgaggcgggttcgcgcatcatcacccacgccaatggcccgttcatctacgattccgaagggacggaattgctcgacggcatggccggcctgtggtgcgtcaacatcggctatggccgcgacgaactcgccgaggccgcttacgcgcagatgaaggaactgccttactacaattccttcttcaaatgctcgacgccgaccccggtgctgttgtccaagaaactggccgagatcgcgccgaagaacgtcaatcaggtcttctacggctcctccggctcggaagccaacgacaccgccttgcgtcttgtccgccactactgggtgatcgagggcaaacccgagaagaaccgcgtcatctcgcgcaagatggcctatcacggctcgaccatcgccggcacgtcgctcggcggcatggatgccatgcacaagcagctcaacggagcggtgcccaacatcgtgcatgtgatgatgccctatgcctatgagctggcgctgccgggtgagagcgaccatgatttcggcctgcgcgcggccaaatcggtcgaggatgccatcctcgaggccggcgtcgacaaggtcgcggccttcatcggcgagccggtaatgggcgcgggcggcgtcaagatcccgccggcgagctattggcctgaggtgcagcgcatctgccgcaaatacgatgtgctgctgatgctggacgaggtcatcaccggctatggccgtaccggcgaatggttcgcagcccagaccttcggcatcgaaccggacaccatcaccacggccaaggcgctgacctcgggctatcagccgctgtcggcgctgctggtcggcgaccgcatcacctcgacgctggtcgagaagggcggcgagttcaaccacggctacacctattccggccaccccgtggcctgcgccgtcgccttgaagaacctggagatcatcgagcaggaaggcctggtcgaccgcgtcaggaacgacaccgggccctatttcgccaaggcgctgcaggagtgtatcgccgggcatgacctggtcggcgaggtgcgttcgatcgggctgatgggcgcgatcgagatcgtcaaggacaaggcgaccaaggaacggttcctgccgtcgggaagtgcggcggtgacggtgcgcgaccatgccatcgccaacggcatgatgctgcgcgccaccggtgacacgatgatcctgtcgccgccgctgatctggacccgcgacacgatcgacatggcctgcgagcgcataggcaaggcgctggatctggcgcaggccgatctgcgcaagcggtaa

SEQ ID NO: 35555 - DNA, 1023 bp, Mesorhizobium loti
atgaccaccaccaatccgatcgatgccctgctggctgaaaagggcgtgctgctggccgatggcgccaccggcaccaatctgttcgcgatgggtctggaggccggcgaggcgccggagctgctgaacgaaacggcgcccgacaccatcaccaacctgcaccagaatttcgtcgatgccggcgccgacatcatcctgaccaactccttcggcggcacccgccaccggctgaagctccaccatgcgcaggatcgcgtgcatgcgctcaacaagcgcgccgccgagattgcccgcgccgtcgccgacaaggccggccgcaaggtgatcgtcgccggctccgtcggcccgaccggcgaattgctggtgccgcttggcgccatgacctatgacgaggcggtcgacgcctttgccgagcagatcgagggtctcaagcaaggcggcgccgaagtcgcctggatcgagaccatgtcggcgcccgacgagatccgcgccgccgccgaagcggcgatccgcgttggcctcccctacacctataccggctccttcgacacagccggccgcaccatgatgggcctgctgccgaaggaaatccatggcgtcgttgacgggctgtccgaagcaccgctcggcgttggcgccaattgcggcgtcggcgcttcagacatcctggcctcgctgctcgacatgaccgaggcgaagccgcaggcgacggtgatcgtcaagggcaattgcggcattccggaattccgcggtactgagatccattattccggcacgccggaactgatggccgactatgttcgcctcgccgtcgatgccggcgccaagattgtcggtggttgctgcggcacttcgttccagcaccttgccgccatgcgcaaggcactcgacgcccacaccaaggcgggtcgtccgacggtcgagacgatcgtcgagcgcatcggtccgatgcgcaacaaggtggcgacggaaaacaccgccgagaccagcgaggcccgccgcgagcgccgccgcagccgggcctga

SEQ ID NO: 35556 - DNA, 750 bp, Mesorhizobium loti
atggagcaggcaatgacgaagcaggacctcaggatcaagacccgtgacggcgtggcgaaggcgggcctgttccgctcggccaagacctcctcggccagagccggtgtcattctctaccaggacgccttcggtccgcgtccggcgctcgacggcatagccgagcggctggcgggcgaaggttatgcggtgctggtgcctgacctcttctaccgcaatgcgccctatggtccgttcgacgccaagaccgccttcaccgaggaaaacagcaaggcagcgctgatggcgctggtcaccggcacgacacagcagatgaccatcagcgacggcgaggcctttctcgatgcgctcgccggcgaaggtgttaggggactgatcggcactgtcggctattgcatgggcggcgcgcgggcgctcaacgccgctgcggcctatcccgagaggatcagggccgccgcaagtttccatggcggcaatctcgccagcgatgccgccgacagcccgcaccgcaaggctgcatccatcaaggcgcgtgtctatgtcggcatggccggcgtcgacaggagtttcccgccagagcagtcgacacggctggaggaggcgctgcgcaacgccgaagtcgaccacacgatcgagaactatgtcggcatggcgcatggctggtgcgtgcctgaccacagcgtctacaaccaagccggcgccgaacggcattggcaaaggctgatcacgctgtttgcggagacgctcgggtaa

SEQ ID NO: 35557 - DNA, 1473 bp, Mesorhizobium loti
atgaccgtcatggccaagcccgaacagacgaatgcgcgcaccctggtgagcgcgccggcactgtcgcccgcagcaatagccaagcccgatctgatcagtgtcgagcaggccaaggcgatggacgtggctggaatgaccgacctgttcaaggcgcatctcaatcccggccagctgcatttcatgaagctgctcggcttccacaagatcaagatcgagcgtgccgaaggcatgttctacatcgaccagaacggccgcaagatcctcgatttcttcggtggcttcggttcgctggccttcggccacaaccacccacgtatcctggacgcacgcaaaaaattccaggaggagaagcgccaggaaatcgccatcgccttcatgtcgcaatatgcggcagcgctggcgcacaacctcgccaaatgctcacccggcgatctcgacatggtgttcttgggctcgtccggctcggaggcgatggaagcggcggtgaagctcgccgaacgcgccgccggcccgaagcggccgaaggtggtctatgccgagaattccttccacggcaagaccaagggcgtgctcggcatcaccgacggccagctctaccgcgccgatttcaaggtggccgacaatacggtgcgcattcccttcggtgacatcgaggcggtggagcggctgttccgcagcgatccggaggtcggcgtcatcgtgctcgaaaccatccagggcggtggcggcatcatccaggcggaggcgcaatactggcagaagctgcgcgcgctctgcgaccagtatggcgtgctgtgggtggccgatgaagtgcagtgcggctatggccgctcgggccgcttctatgccttcgaacattacggcgtcgtgcctgacgtgaccgcgctggccaagtcgctcggcggcggcaaggcggctgtcggtgccatgatcgccaggcgtgaaatctatatgaaggcctatggcacgcccaagacggcgatgatccatgccatggcgacctttggcggcatgggcgaggcgtgcgttacctcgatcgaggcgctcaacgtgctttatgacgaggggctgatcgacaacgccgccgtcaccggcgactatctgctgcagcggctacgggcgctcaaggaaaagtacccgaagatcatcaaggacgtgcgcggcaagggccttatggtcggcctcgagttccacgacttctcgcagaccctgccgatggtgctgcgcccgatcgtcagcgtgctcgacgacaagctgaagggctcgctgtccggctttgtcggcgcgctgctgctgcgcgactacgacgtgctcgtcgccttcaccgaatacaaccgcaacgtcatccggctcgagccgccgctgatctgccagcgcgagcatgtcgaccgcttcgtcgatgccttcgacagcctgctgtcgcgcggcatcgtgtcgatcgtgaaggatttcgtcaaaagccaggtccgttaa

SEQ ID NO: 35558 - DNA, 906 bp, Mesorhizobium loti
atgaagaatgtcatcctcaccgatggtggcatgggccaggaactggtccggcgcagcaaatccgagccgacgccgttgtggtcagccagggtcctgatcgacgaacccgatctggtgcgcgacctgcatgccgaattcattcgcgccggcgcccgcgtgatcaccatcaacacctattcggcgacacctgagcggctagcgcgcgagggtgccgaggacctgttcaagccgctgcagaagcgcggcatcgaattggccaggcaagcgtgtgacgaggccggcgaggcagcgatcgccggctgcctgtcgccgcttttcggcagctacgccccggcgctgaccatttcctatcaggagacgctcgacatctaccgccgtatcgttgccgagcaggcggatggcgtcgatctcttcctctgcgaaaccatggcctcgtccgatgaggcgcgggcggccgtcaccgcggcatcggaaagcggcaagccggtctgggtgtcgtggacgctcgccgatcacggcacgccgcggctgcgcagcggcgaaacaatagccgccgcggcaagcgcgctcgatggcctgccgatagcggcgcggctgctcaactgctgccggccggaaacgatcgccgccgccttgcctgaactgatcgacctcggcggcccggttggcgcctatgccaatggcttcacctccacggaggcgctcaagcacggcggtaccgtcgatgtgctgcacgcccgccacgacctcgccccggacgcctatgccgagcaagcgatcggctgggtggaggcaggtgctgacatcgtcggcggctgctgcgaagtcggaccgccgcacattgccgcgctgcgcgatcgactgcagcaggacagttacgaaatttcgggggttttgcatgcctag

SEQ ID NO: 35559 - DNA, 1182 bp, Mesorhizobium loti
atgcctagaccatcgtctcgcatttccggcatcgtgccttcgggcaaggatggctgggaggttcacttcgctgcctggacgcgcaaggaagccggtgaggacatcatcatgctgtcggtcggcgatcacgacttcgacacgccctcgcaaacgatcgaggcctgcgtgaccgcggttcgcggcagcaaccaccactacaccccgctgcccggcctgccgcgcctgcgccaggcaatggcggccgcctccagcgcctgcaccggcatcgagacgacgcctgatcaagtgatcgccacgccgggcggccaggccgccctctatgcggccgtgcaggccgttctcgaccagggcgaccatgccatcgtggtggcaccctattatgccacctaccccaacacgttcagcgccgccggagccagtttcaccgtcgtcgagacgccggccgaagacgggtttcagcctcgcgccgacatgatccgcgcggcactcaggcccaacacccgcgccatcctgatcaacacgccgaacaatccgacgggtgcggtctattcgcgcgagcggctggaacagctggcgcaaatctgccgcgagcatgacctctggctgctgtctgacgaggtctactggacgctgggtggcggcgagcatgtctcgccacgctcgctgcccggcatggcagagcgcacgctggtcatcaattccatgtccaagagccacggcatgaccggctggcgcatgggctggctgaccggtccgcaggacatgatcacgctgctcatcaacctcaatctggtgacgacctacggcttgccggccttcatctcgattgcctgcgccgaggcgctcgagaaccgttacggcgtcaaggagatcgccgagcgctatgcggcgcgccggaccgtcctgctggatgccgtgcgcggcatgaacaatgtcagcgtgcgcggttccgaaggcggcatgtatgtcatgctcgacatatccgatgtcgagccggacgacgagaaattcgcctgggcccttctcgaccaggagaaggtcggcgtgatgcccggctccagcttcggcgaagcggccgccggccacatccgcatcagcctctgccagccggagcccgtactgcaggaggccgccgctcggctgcgccgttttgcttccacctatcgccgcgaggccgcatga

SEQ ID NO: 35560 - DNA, 1047 bp, Mesorhizobium loti
atgaagcttcttgaaggagcggtggaccatggtggaagtcttggccgggcgagggcgcttttccccaacgctcttcagcctttcgtcgacctttcgaccggtatcaacccgcactcctacccgcttttcgagctgcccgccacctcgctgtggcgattgccggaagcggcacgggcgcgtgaactgacggagatcgcggccggcacctatggcgcgccgtcgccggccaatgtcgtcgcggcgcccggcacgcagatcctgctgccgcgcgtggcatcgctggtcaggcccggcaaggcattggtgctggggccgacctatgccgaacatgcacgtgcagcggcgattgccgggcatcaggtgaccgaagtcagcgattttgcggcgctggcggatgccgaccttgctatcatcgtcaatccgaacaatcccgacggtcgcgtcatcgagcgcgaccggctgctggcactggccgccgggctacgcgccagaggcgggctgctggtcgtcgacgaggccttcatggatgtcggcccgcgtgaacacagcctcgccggtgatgtcgatcagcgcgggctcgtcgtgctgcgttccttcggcaagttctttgggttggccggcctgcggcttggcttcgcgctttccgatgcagcgacggttggctggctggaaacgcaattcgggccgtgggccgtcgccggtccagcgctggactatggcattcgcgcgcttgccgatattggctggcaggatgcgatgcgcgcgtccctggccgagggcgcggcgcggctcgatgcactcttcggccgtttcggcgtgcctgtagcgggcggcaccacattgttccgctatttcagcctgccggatgccgccagcctgttttcagcgcttggcaaacgcggcgtcctgcttcggcatttctgcgatcggccgcatgtcctgcgcgccggcctgccggggtgtcaggaggaatggcggcggctcgaatcggcccttgccgaatgggcgacgcggcgcgaggatcgacaaaaaggttcaaaacaatga

SEQ ID NO: 35561 - DNA, 1185 bp, Mesorhizobium loti
atggacattcacgaatatcaggccaaggaactgctcgcccggcacggcgtgcatgtgccgcgcggcgggctggcctacagccccgaacaggcgacctacagggcgcgcgagatcggcggcggcaaatgggtcttgaaggcgcaggttcattccggcgcgcgcggcaaggccggcggcataaaactgtgcgccaatgacgaggagatctcgagcgccgccgaagccatgctcgggcgcaagctggtgacgcagcagaccggaccgcgcggcaagctgatctcccggctctatctcgaggaagccgtcgatatcgcccaggagctctatgtcggcttcgtgctcgaccgcaaggaagagcgcgtcatgatcgtggcctcggccgccggcggcatggagatcgaggatattgtcgagaaagaacccaattccatcctgcgcacatcggtcgatcccggcgtcggcatgcagcgcttccaggcgcgcgagatcgccttcgggctcggcctcgaccacaacctgatcggcaaggcgaccgaaaccatcttcagctgctaccaggtgttccgcgactacgacgcctcgatgctggagatcaatccgctggtggtgacgcgcgacggcaatctgatcgcgctcgacgccaagatgtctttcgacgagaacgccctgttccgccggcctgaaatctccgagctgcgcgacaagagccaggaagacccgcgcgagactttcgccagcgaccgcggcctctcctatgtcggcctcgacggcaatataggctgcatcatcaatggagcggggctcgccatggcgacaatggacatgatcaagatcgccggcggcgaaccggccaacttcctcgacattggcggcggcgcctcgcccgagcgggtggcgaaatccttccgtgccgtgctcggcgacaagaatgtcgagaccatcctggtcaacatcttcgccggcatcaaccgctgcgactgggtcgccgaaggcgtgatcaaggcgatacgcgaagtcggcgtcaacgtgccgctggtggtgcgtctctccggcaccaaggccgaggaaggccgccgcatactggccgattccggcgaggcggtgatcgtcgccgacacgctggccgaagccgccgaaaaagccgtcgccgcctggcgcgcggccgccaagaaaaaagcagcctga

SEQ ID NO: 35562 - DNA, 900 bp, Mesorhizobium loti
atggcaatcctgctcaaccgcagcacccgcgtcatcgtccagggtttcaccggcaagatcggcagcttccacgccgaggacatgaaacgctatggcaccaagctggtcggcggcgtcacccccggcaagggcggccagacgcatctcggcctgcccgtcttcaacacggtcaagggcgccgtgcgcgagacccgcgccgaggcgagcatcgtcttcgtgccgccacccttcgccgccgattcgatcatggaagccgcggacgccggcatcaaactctgcgtctgcatcaccgacggcatcccctcgcaggacatgatgcaggtcaagcgctacatgcgccgctatcgtttcgaggaccgcatgaggctgatcggcccgaactgcgccggcatgatcacgccgggacaggcactgatgggcatcatgccgggcagcatctatctgcccggccgcgtcggcattgtcggccgctccggcacactcggctacgaggccgcctcgcagatgaaggcgcttggcatcggcgtgtcgaccagcgtcggcatcggcggcgacccgatcaacggctcctccttcaaggacatcctgaagctgttcgagcaggacgacgagaccgacgccgtggtgatgatcggcgagatcggcggcccgcaagaggcggaagccgcgatctgggcgcgcgacaacatgcgcaagccgcttatcgcctacattgccggcctctccgccccgaaaggccgccgcatgggccacgccggcgccatcatctccgccttcggcgagtcggcgcaggagaaggtcgagatcctgaaggaggccggcgtgatcatcgtgccgacaccgtcatcgtttggcgaggtggtggcggatacgctggcacggatgaagaaggcggcgtga

SEQ ID NO: 35563 - DNA, 2082 bp, Mesorhizobium loti
atggcaaagctcaaggtcgacgggaaagagatcactgtacccgaccactacacgctgctgcaggcggcggaagacgcgggcgcggaagtgccgcgcttctgcttccatgagcggctgtcgatcgccggcaattgccgcatgtgcctgatcgaggtgaagggcgggccgcccaagccgcaggcctcctgcgccatgggcgtgcgcgatttgcgccccggccccaatggcgagccgccggaaatcttcaccaacacgccgatggtcaagaaggcccgggaaggcgtgatggagttcctgctgatcaaccatccgctggattgcccgatctgcgaccagggcggcgagtgcgacctgcaggaccaggcgatggccttcggcgtcgattcctcgcgctatcacgagaacaagcgggcggtcgaagacaagtatatcggcccgctggtcaagacggtgatgaaccgctgcatccattgcacgcgctgcgtccgcttcaccacggaagtcgccggcatttccgaactcggcctgatcggccgtggcgaggatgcggagatcaccacctatctcgaacaggcgatgacctcggaattgcagggcaatgtcatcgatctctgcccagtcggcgcgctgacctccaaacccttcgccttccaggcgcggccgtgggaactgaccaagaccgaatccatcgacgtcatggacgccgtcggctcggcgatccgcatcgacagccgtggccgcgaagtgatgcgcatcctgccgcgcgtcaacgagcaggtgaacgaggagtggatttccgacaagacccgcttcatctgggacgggttgcgcacgcagcgcctcgaccgtccctatgtgcgcaaggacggcaggctggttgcggcaagctgggccgaagcgttcgcgacaatcaaggacgcggtgtcgaagacgacgccagagaagatcggtgccattgccggagatctcgcggctgtcgaggaaatctatgcgctcaagttgctgatggcttcgctcggctccaagaatgtcgattgccgccaggatggcgccgcactcgatccggagcttggacgcgccagctacatcttcaacccgaccatcgaaggtatcgagcaggccgacgcggtgctgatcattggcgccaatccgcgtttcgaagcctcggtgctcaacgcccgcatccgtaagcgctggcgggtcggcaacctgccggtcggcgtcatcggcgatgtcggcgacacgcgctacgaatatgaattgctcggcgccgggccggattcgctcaaggatctggccgacggcaacggcaagttcttccagacgctgaagaaggcgacgcatccgctgatcatcgtcggccagggcgcgctggcgcgcgccgacggcgcggccgtgctcggccaggcggcgaagctcgccactgccgtgaatgccgcccgcgccgactggaacggctttgccgtgctgcacaatgcggcggccagggtcggcggcctcgatctcggtttcgtgccgggcgagggcggcaaggatgtcgccggcatgctgggcgaaacggacgtgctgttcctgctcggcgccgacgagatcgacatgggcaagaccggcggtgccttcgtcgtctacatcggcacgcatggcgaccacggcgcgcatcgcgccaatgtcatcctgccggcagctgcctacacggaaaagtcgggcacctacgtcaacaccgaagggcgcgtgcagcagaccaaccgcgccggcttcgccccgggcgacgcgcgcgaggactgggcgattctgcgggccctgtccgacgtgctgggcaagaaactgccattcgattcgctgccgcaactgcgcgccaaactctatggcgagtacccgcatctggcccgcatcgatcaggtcgcggccggcaatgccgaggacatcgccggcgtggcgaagctcggtgggcggctgaacaaaggcaccttcacctccccggtcaaggatttctatctgaccaacccgatcgcgcgggcatcggccgtgatggcggaatgctcggcactggccaagagcggcttcaagcaggcggcggaataa

SEQ ID NO: 35564 - DNA, 3381 bp, Mesorhizobium loti
atgcatatcctcaccacgacctccgcctcgctcgacgacctcgccgagccggtcgatctgcggcagacgccggcggatatcgtggccttgtccttcaccgacagcgacctcgccggactggcggccgcctggaaagcggatgccagccgcctgccctcgatgcggctggcggcgctccgcgacctgcgccatcccatgtccgtcgacctctgggtcgacagcgtcgcgcgccgcgccaagatcatcctggtgcgcatcctcggcggctacgactggtggcgctatggctgcgaccagctggcctcgaccgcccgagagcgcggcatccagctggcgctgttgccgggcgagagccacgacgaggatttgcgcctgatcgaagcctcgacgctgccgcgccaggaattggacgcgctgctcggctatttccgcgagggcggcccggccaatatgggcgcgctggtgcagaggctggccaggctggctgggcaggacgcggccgttgttgagccggtggcggtgccaaaggccggctactaccagccaggccgcggcgtcgtccccctccccctcgagagggagggaaaggtcgcgcccattctcttctaccgctcgatgctgctggccgccgacgtcgcgcccatcgacgtccttttcgacgcgctgcggcagcgcggcatgacgcctgtccccatcttcgtctccagcctcaaagacccgacatccctggccttcgcggaaaccgccctcgccacgctcagacccgccgccatcatcaccgccaccgccttcgcctccggtgctgaaccgggcgtcgaaaccctgttcgaccgcgccggcgtgccggtcttccaggtcatcgtcgccaccacccgccgcgacgtctgggaaaacaaccagcgcggcctggcgcccgccgacctcgccatgcatgtcgtgctgccagaactggacggccgcatcctcgccggcgcgatttccttcaagggcgaaagcgatgtcgatcccgcccttggccaccgcgccttcgccaaccggccggaaccggatcgagtggcgcaggtcgctgaccgcgtggcagccttcatcaagctgcaggagacgccccgcgccgagcgcaagctggccgtcctgatccccgactatcccagcgcccctggccgcaccggctacgccgtcggcctcgatgtgccgtccagcgtgctggccatgctgcatgacctgaaggagcagggctatggcgttgaggggattccgcaatcgccgcgggcgttgctggatctattggagcggggcggcgacgggctagggttggaagactatgtcggactctcgaaagagttgcccgccgaggtaatgactgccgttgaggcggcgtggggaaaagcagaagaagagacaggtttgcgcgaggggggcgcctcgcacaagccttcgctatcgagcaaaaaacacttccctttccgcgccacgaccttcggcaacatcaccgtagccctcgccccagaccgcggccgctccgccgatcgccgcgccgactatcacgacccgacactcgcgccccgccacgccctgctcgccttcggcctgtggctgcgcaaatcgctcggcgtgcatgcgctcatccatgtcggcgcccatggcacgctggaatggctgccgggcaagaccgttgcactgtcgcagacctgcttccccgagatcgtcaccggcgcattgcccgtcatctatcccttcatcgtctccaatcccggcgaggcggcgcaggccaagcggcgcattgccgccgtcacccttggccatctgccgccgccgctgaccggtgcgggacttgacgaaaaccagcacaagctcgaacgcctggtcgacgaatacgcccaggccgacggcctcgaccgccgccgccgcgaccgtctggccaggctgatcgtcgacacggcgcaaaagaccggcctcgccgccgaagccggtgtcgccaggaccgacgcgcccgacgaggcgctgcgccgcatcgacgcctggctctgcgatctcaaggacttcgccatcaaggacgggttgcatatttacggccgcgcacccgacgatgagtccgacgccatgcgccgccaaagcgccgaggctgaaaaggccgcactgcttgccgcgctcgatggccgccacgtcaaggccgggccggccggcgcgccggcgcggggccgctccgacgtgctgcccaccggccgcaatttgttcacgtcggatccccgcaccatgccgacgccgaccgcctatgatctgggcaaggcggcggccgaagaagtggtgcgcggctatctgcaatcgcatggcgactggccgcgttccctggtcatcgacctctggggttcggcctcgttgcgcaccggcggcgaggagatcgcgcaaggcctggcgctgatgggctgccggccgcaatgggatgccgccaccggccgcatcacaggcatcgaagtgctgccgccggccacgctcggccgcccgcgcgtcgacgtcacctggcgcatatcgggcctgttccgcgacatgttcccaacccagatcgcgctgatcgacgccgccgccaacgccgtcgccgcccgcgacgaggaggattcggaaaacccgctcgcggcccggacccgagcggatggcaagatcagcccgcgcattttcggcacctcacccggcacctatggcgccggcgtcgaggatctcctgtctagcggcgactgggcggcgcgcgaagagatcggccgcgcgtatctcgacgccacctcacacgcctatggcggcgccggcggcgaaggcatctcggcgcccggcgccttcgaaacccgcatcgccgaagccgatcttctggtccacactggcgacgaccccggccgcgacatcctcgaaggctccgccgacgtcgcctttatcggcggcttttcggctgcgcttgccgcgcttggccggaatgccgatgtcatcgtgctcgatacgacagacccgcaaaagccgaagccgcgctcggtcagcgaggccgtatcgcgggtggtgcgcgcccgcgcgatcaatccccgcttcatatccggccagatgcggcacggcccgcgcggcgcctccgaattcgccgagacggtcgaccgactggtcggcttcgccgaaaccacgcacgccatatcgggcgcgctgatcgaggccgtgcacgacgcctatgtcggcgacgcggacgttcgcgccttcatccttcgggaaaatccggcagccgccaaagtcattgccgaacgtttcctgtcggcgcgccggcgcggactctggcatcccttgcgcaattccatcgacgacgatctcgccgcgctgattgccgaggccgaggcgctgggagtggcggcatga

SEQ ID NO: 35565 - DNA, 1497 bp, Mesorhizobium loti
atgaacgccttctcacgtcgcggcgcctgtccggccctgtcggcgccgatgcagaccggcgacgggctgttggtgcggctcaacgcggtctatgtgggattgtcgccgaagctgtcgatcggtctggccgaatccgccctgcggcatggcaacggcatcatggaagtgacagcgcgtggaagcctgcagatacgcggactgaccagggaaagcgctgcactgctcgcggcggaagtcgatgcgctgggcattgcggtgcgcaccggagtgccggtggagacagggccgctggcgggcatcgacccgcgggagatcgccgatccgcgaccgctggctgagcggatcagggcggcggttgaagaggccgggctgacgccaagactggggccgaaggtgtctgtcgtggtggatggcggcgggcagctaacactggatgcggtgacggccgatgtgcggttgaaagcgttgcggagtggtgccggggttcggtggcaggtgtctgttgcgggtgatgggcagagtgcaagattgctggtcgcggcggaagaccacgcggcccgcgatgtcacggttgcggtgctcagaatggtggccgagaaaggccgcgaggctcacgcaagagatttgtcggagcggcaattagtatctctcgcaggctggcattctgtggcgcccccctctgtcctgccggacatctcccccacgaggggggagatcagcagcttcgccgccggctccctttctgaaaccatgccgcatgtttcggcgcctggagttggcgaaaccggcggcgcaggcataatctcccccctcgtgggggagatgtccggcaggacagaggggggcgcctcgcgcaaacctatcggccttttccccatagccggcgacactttcactctcggtataggcctcccctacggcagcatgccggcggataaaatcatcgaccttgcgcaaagcgccgtcaccctcggcaccagcgaaatccgcctcgccccgggccgcgccctgctcttcctcggccaaccatccgccgccaaccaatccctccaaaccatcgccgccgccctcggcttcgtcacctccccttccgacccgcgcacgcgcatcgccgcctgccccggcacgccggcctgcgcctccggccgcatcgccacccgcaccatcgccgagacgatcgccgccgaaaacgccgacaccctcgacttcacgctgcacatttccggctgcgccaagggctgcgcgcatcccggtccggcggcgctcacaatcgtcggcggcgaaaatggagccggacttgtcgtgaacgcgacggcaaaggcccttcctgcgggctacaggccgggctatgacgccgcgcgcggtatcggtcgcgtcgcggcggtgatccgcagcgcacgatttcaaggcgagaccgccgctgcttgcctgacaaggctcgggccggcggcaatcgccgaggcttaccgacaggcccaaactaaaaaacggaaatga

SEQ ID NO: 35566 - DNA, 894 bp, Mesorhizobium loti
atgaccgaaacccttctcgtcaccggtgctgccggccagctcggccgcggcgtcatccgctatctcatggacacgcataaagttccgccggcaaagattatcgccaccacccgcaatccggaaaacgtggccgatctggcggcgcgtggcgtcgttgtcagggccgccgacttcaacgacgcaacctcgctggaaaacgcattcaagggcgccgacagggtgctgatcatttcgaccagcgatctcgatctcaagaccggcagacgcctgaagcagcatgaggccgcggtggccgctgcgaagaaagcaggcgtttcacatttgctctacacctcgatgcccaatccggagcctgtttcgccagtgctgtttgccggcgaccactacggcactgagcaggcgatcaaggccagcggcatcgcctatacgatcttccgcaacggctggtaccaggagaacctgttcatagccctgccgcacgccattgcgtcgggacagtggtacacgtcggcgggcgatggccgcatcgcccatggctcacgcgacgacatggccgcggccatcgccgcgggcctcgcctccggttcgaccgacagcaagacctacacgctgaccggcccgcaggcctatacgacagccgaaatcgccgccctggtgagcgaagtcaccggcaagccgctggaggtcattcagctgcccgacgaggccctgacggaaggcgtgaaggcggccggcgttcctgaggagttcgctcgcgtcatcgtgtctttcgacgccaacacgcggtccggccgcatcgccatggcgactgacgcggtcgaaacgctttccggcaggaagccgcggacgctgaagcagttcctcgaagccaacaaggccgcactggctggttga

SEQ ID NO: 35567 - DNA, 1782 bp, Mesorhizobium loti
atgagcaacggacaaagtgaacggcgcgagatgacaggcgccgaaatggtggtgcaggcgctgaaggacaatggcgtcaagcatgtcttcggctacccgggcggcgcggttctcccgatctatgacgagatcttccagcaggacgacgtcgagcacattctcgtgcggcacgagcaaggtgccgggcatgcggccgagggctatgcgcgctcgaccggcaaggccggcgtcatgctggtgacgtcaggccccggcgcgaccaatgcggtgacgccgctgcaggatgcgctgatggattcgatcccgctggtctgcctgacgggccaggtgccgacctccttgatcggctccgacgcgttccaggaatgcgacacggtcggtattacgcgcccctgcaccaagcacaactggctggtgaaggacgtcaacgagctcgccgcgaccatccatgaggctttccacgtcgcgaccacgggccgtccggggccggttgtggtcgacatccccaaggacgtgcagttcgccaagggtttctacgtcccgccgcagatcgcgccgcgcaccagctaccagcccaaggttcagggcgacctggagaagatcaaggccgcggtcgagctgatggccagcgccaagaagccgatcatctattcgggcggcggcgtgatcaattccggtccggaagcgagccatctgctgcgcgaactggtcgaccttaccggtttcccgatcacctcgacgctgatggggctcggcgcctatccggcgtcgggcaagaactgggtcggcatgctcggcatgcacggcacctacgaggccaacatggccatgcatgattgcgacgtgatgatctgcatcggcgcgcgcttcgacgaccgcatcaccggccggctcaatgcgttctcgccgaactcgaagaagatccacatcgacatcgacccgtcctcgatcaacaagaacgtgcacaccgaggtgccgatcatcggcgatgtcggccgggtgctggaggatatggtgcggctgtggcgggcaaccgccaaggccgacaagaaggcgctctatccctggtgggagcagatcgcaaaatggcgtgggcgcgattcactcgcctacaagatgaaccacgacgtgatcatgccgcaatacgccatccagcggctctacgaactgaccaaggacaaggacacctacatcaccaccgaagtcggccaacaccagatgtgggcggcgcagcactatcatttcgaaaagccgaaccgctggatgacctcaggcggtctgggcacgatgggctatggcctgccggcggcactcggcgtgcagatcgcgcatcccgatgcgctggtcatcgacattgccggcgacgcctcggtgcagatgacgatgcaggagatgagtgccgcggtgcagtacaaggcgccgatcaagatcttcatcctcaacaaccagtatatgggcatggtgcggcaatggcagcagctcttgcacggcaaccggctgtcgcattcctacaccgaggcgatgcctgactttgtcaagctggcggaggcctatggcggccatggcatacgctgcgagaagccggacgagctggacgacgccatcaaggagatgatctcggtccggaaacccgtgctgttcgactgccgcgtggcgaacctcgccaactgcttcccgatgatcccgtccggcaaggcgcataacgagatgctgttgccggacgaggccaccgacgaggccgtggccaacgccatcgacgccaagggcagggaactggtttaa

SEQ ID NO: 35568 - DNA, 519 bp, Mesorhizobium loti
atgcatgtggcaatctacgtcgccatcgccgagaacggcgtgatcgggcgggacggcggactgccctggcggctttcgaccgatctcaagcgcttcaaggccgacacgatgggcaaacccatcatcatgggccgcaagacttatgaaggcatcggccggccgctgccgggcaggctcaacttcgtcgtcacccgtgacaagacctggcgcgccgagggcgtcgaggtggcgcatacgctggaggccgcgattcagctggcaacggtgcgcgtccgctgcatgagcggcgtggacgaggcctgcatcatcggcggcggtgagatctatgcccaggcgctgccgctggccgaccggctgcacgtcacccatgtgctggccgccgtcgacggcgacgcgcatttcccgccgatcgacgctgagacatggcgcatggtcagttcgcaggaggttccggccggggaaaaggacagccacgcaacgcgctattcggtttacgagcgccgccgccagatactttga

SEQ ID NO: 35569 - DNA, 1728 bp, Mesorhizobium loti
atggacttcggcggtgtagatggtgagacggcgctgtttcacatagtccagccccatgcccatcgcctcgaaggcctcgtccgagcagcggtcgaacagcacgttgtaataggccatgttgagatggccgttgtagtcgatccagtccttctcgatgtccatgggcttggagacgaagggggcggggatggacatggaaacttccttgttctggtgctggacacggcctggtgggtgagactacgcatccataatcgcataacaagcgtggacgctggtccattcgcggaggaattcatggctctgagcgacctcaatccggtcgaacgcaatgaggaaggcatcgcggcggtgctcggcatcctcaagcagcagctgggcgagcgctttcagaccggccaggcgatccgcgcccagcatgcgcacaccaccacctatataccgacccaggcgccagatggtgtcgctttccccgagacgaccgccgaggtgcaggagatcgtgcgcgcctgcgccgcgcatcgcgtgccggtgatcgcctttggcgtcggctcctcgctggaaggccacaccaacgcgcccggcggcggcatctcggtcgatacatcgcgcatgaaccgcatccttgcggtcaatccgcaggatctcgactgcacggtcgaacccggcgtgacgcgcgaggacctgaaccgtcatctgcgcgacaccggcctgttcttcccgatcgatcctggcgccaatgcctcgctcggcggcatggcggcgacgcgggcgtccggcaccaatgcggtgcgctacggcaccatgcgcgagaacgtgctgtcgctgacggccgtcatggccgacggcgagacagtgacgaccggcaagcgggcgaaaaagagctcggccggctacgatctgacgcggctgctggtcggctcggaaggcacgctcggcatcatcacctcgctgacgctgaagctgcaaggcattccgcaggcgatctcgggcggcgtctgcccgtttccaagtgtcgaggcggcctgcaacgccgtcatcgcgacgatccagatgggcattccggtggcgcgcatcgagctggtcaacgcgctgcagatgcgggcgatgaagaattattccaagctcgattatcccgagagcccgtgcctgttcgtcgagttccacggcagcgatgccggcgtggccgaacaggccgagacctttggcatgattgccgaggaaaatggcggcgggccgttcctgtggaccagcgtcgccgaggaacgcaccaaactgtggaaggccaggcacgatgcctactgggcctcgctgacgctgcggccgggcgccaagggcctgtcgaccgatgtctgcgtgccgatctcgcgctttgccgaatgcgtcaccgagaccgaggccgatatcgccgaaatgggcttgatcgcgccgatcgtcggccatgccggcgacggcaatttccacgtgctggtgctgatggatgtcaacgaccccaaggagatcgcgctgtcggagaaattcgtcgcgcggctcaacctgcgggcgatcgccatggacggcacctgcaccggcgagcatggcatcggccagggcaagatcggcttcctgcggcccgaactcggccacggtgtcgatatcatgcgttccatcaagcaggcgctcgacccgcaaaacatcatgaatcccggcaagatattgccggctgtggggtggatcggtcgaggttag

SEQ ID NO: 35570 - DNA, 2358 bp, Mesorhizobium loti
atggccgcgcgagcgcgcaacagtcgaaggagtatcatcttggctgtcaccatcacctccttcgttctctttctcctcggtctggcgcttggtggcggtggcatctggctggcttcgctggggggcagttggtactacatcgtcgtcggcctcgccttcctgatcgccgcctggctgctctaccggcgccgttccacggcgctctggctctatgcggcgattgtgctcggcacgctggcctgggcggtctgggaaatcggcttcgactggtgggagctcggcccgcgcggcggcatcatcgtgctggtcgggctgtggctgctgacgccgtgggcaaggcggggccttgccgggcctgacgggcgcgcgccgctgatcctggccgtgctggcatcgctggcggtggccggctattcgatgaccgccgacccgaaaggcattgacggcgcgctcgacaccgacaaggtgattcccaaagccaatctgggtaatgatgtgccggctggcgagtggcactattacggacgcacgcagtttggccaacgctattcgccgctcgaccagatcacgccggacaatgtcgccaatctgcagccggcatggacctatcgcaccggcgatgtgaaggggcccgacgacatcggcgagaccacctatcaggtgacgccgctgaagatcggcgacacgctctacatctgcacgccgcataatttcgccatcgcggtggacgccgcgaccggaaaggaaaaatggcgctacgatcccaagatcaagctcgacaaggaccgccagcaccagacctgccgcggcgtgtcctactatgccgataccgccatcgccgccggccagccctgcgcgacccgcatctacctgccgacctcggatgcgcggctgatcgcgctcgacgccgccagcggtcaggtctgtccggccttcgccgagggcggcacgctgaaccttctgaccaacatgccctatccgaaatcgggctactactattcgacctcggcgccgctgatatcaggcagcaagatcatcgtcggcggcgcggtcaacgacaactattcgacgcaggagccgtcgggggtcatccgcgcctatgatgtcggcaccggcgccctggtgtggaagtgggattccggcaacccggaccagacgacgccgctggcggcgggccagacctataccgccaactcgcccaacatgtggtcgacgccgagcgccgacgagaagcttgggctgctctatgtgccactcggcaaccagacgccggaccagctcggcgccgggcgtagcgccaatgtcgagaaattctcctcctcgatcgccgcgctcgacctcaacaccgggcagttgcgctgggtgcggcagaccgtgcaccatgacctctgggacatggacgtgccggcgcagccgagcctgattgacatcaccaaggccgacggcacagtggtgccggcgctggtcgggccgaccaagcagggcgacctctatgtgcttgaccggcgcaccggcgaaccgcttgttgcagtcaaggaagtgccggcgcccggcggcgccgtcgagggcgatcacacgtcgccgacgcaaccggtgtcggatctctccttcagcccgaagccgctgacggatgccgacatgtggggcatcaccatgttcgaccagatggcctgcaggattgccttccacaagctgcgctacgaaggccgttacacgccgccgtcggtgcagggatcgctgatctaccccggcaatttcggagtcttcaactggggcggggtggcagtcgatccggtgcggcaggtgatgttcggcatgccgacctatctggcgtttacgtcgagactcgtgccccgcgcggacgtaccgccgccgggcgatgacaccaagggcagcgagcaggggctgaaccgcaacgagggcgcgccctacgcagtggtgatggggccgttcctgtcgcctctcggcattccctgccaggcgccaccctggggttatgtcgcgggcgcggatctgcggaccggcaccatcgcctacaagcatcgcaacggtaccgtctacgatatgacgccgctgccgctgccgctgaaggtcggcgtgccgggcattggcgggccgatcatcactgccggcggcgtcgccttcctgggtgccgcggtcgacaactatctgcgcgcctatgacctgacgtcgggccggcaactctggcaggccaggctgcccgccggcggccagtcgacgccgatgacctatacggtcgccgacgggcgccagttcgtggtcatcgtcgccggcggccacggctcggtcggcaccaagccgggggattatgtgatggcttacgcgctgccgaaatag

SEQ ID NO: 35571 - DNA, 2454 bp, Mesorhizobium loti
atggctgcccgcggcggccagaacagtccgcccgattatctgaaggggctgaatccggaacaaaggctggcggtggagaccaccgaaggcccggttctggtgctggccggcgccggcaccggcaagacgcgggtgctcaccacccgcatcgcccacatccttgccaccggcaaggccttcccatcgcagatcctcgccgtgaccttcaccaacaaggccgcgcgcgagatgaagcagcgcatcggcatcctgatcggcgaaggcaatgtcgagggcatgccctggctcggcaccttccattcgatcggcgtgaagcttttgcgccgtcatgccgagcttgccggcttgcgttccgacttcaccatcctcgacaccgacgatgtcgtgcggctgatcaagcagttgatccaggccgagggcctcgacgacaagcgctggccggccaagcagttcgcgcagatgatcgacggctggaagaacaagggccaaggcccggccgatatcgccgagggcgacgcgcgcagcttcgccaacggcaagggccgcgagctctacaaggcctatcaggagcggctgcagacgctgaacgcctgcgatttcggcgacctgctctgccaccccatccgcatcttccgcgccaatccggacgtgctgaaggactaccaccggcgcttcaaatacatcctcgtcgacgaataccaagacaccaacaccgcccagtacatgtggctgcgcctgctggcacagagggcagaaggccgcgccaccgttaatatctgctgcgtcggcgacgacgaccagtccatctatggctggcgcggcgccgaggtcgacaacatcctgcgcttcgacaaggattttcccggcgccaccatcataaggctggagcgcaactaccgctcgaccgcgcacatccttggcgctgcctcccacctcatcgcccacaatgagggccgtttcggcaagacgctgttcaccgaccgcaacgaccccgaggatggcaaggtcaatgtccacgccgcctgggattccgaggaggaagcccgcgccatcggcgagaccatcgaggcctatcagcgccagaagcataatctcaacgacatggctatcctggtgcgcgcgtccttccagatgcgcgccttcgaggaccgcttcatcacgctcggcctcaactatcgcgtcatcggcggtccgcgcttctatgagcgcatggaaatccgcgacgcgctggccttcttccgcgtcgttgccaacagcggcgacgacctcgccttcgagcgcatcgtcaacgtgccgaagcgcggcctgggcgaagccaccatccgccagatccacgacacggcgcgcgccctgcgcatcccgatgctggaggccgccggcaacctcgccgaaagcgacgaactgaagccgaagccgcgcgccgcattgcgcgaagtggccgccaatttcgagcgctggcagaaggcgctggaaaccaagccgcacaccgagctcgccgagaccattctcgaggagagcggctacaccgacatgtggaagaacgaccgctcggccgaggcgccgggacggctggagaacctcaaggaactgatccgctcgatggaggagtacgagtcgctgcgctccttcctcgaacatgtcgcgctggtcatggatgccgagcagaatgccgggcaggacgccgtctcgatcatgacgctgcattcggccaagggcctcgaattcgagacggtttttctccccggctgggaggaaggcctgtttccccaccagcgcgcgctcgatgaaggcggccgctccgggctggaggaagagcgccggctcgcctatgtcggcctcacccgggccaagaagaacctgcatatctggttcgtctccaaccgcctcatccatgggctctggcaatcgaccatcccgtcgcgcttcctcgaggaactgcctgaatcccatgtcgagatcgccgaaagcggcaattcctatggcggctacggcaacccctatggcggcggctccttcgcctccggccgtggcggccgccagaatccgtacggcgcctcgcgcttcgacaatgtcggcgccaacaccgaaaaatccggcgccttctccaacacctattcgacacccggctggcagcgcgcgcaggccaaccgcacggaagcgaccgaccgcaactggggcacgcgctccggccatcaggtcgagcgcatcggctatggtgagaccgactcgggctacggcgccggccgcaccagcgtaaagggccgcaccatcgacggcgaactggtcgccaaatccgtcgcagacaagccctcgcccttcagcgtcggcgaccgcgtcttccaccagaaattcggcaacggcaacatctcggccatagaaggcaacaagctgaccatcgacttcgacaaggccggccagaaacgcgtgctggacgggttcgtcgcggcggtgtga

SEQ ID NO: 35572 - DNA, 1116 bp, Mesorhizobium loti
atgtccgagacggcaaattcacgcgccgccgaactttctcatttgcgcagccgcgatttcgccaacggcgatccgatccccttgccgctgaccatggcttcgatctttcacacgccgggcgtcgagaccggggtcgatcaatatggccgctacgacaatccaacctggcgcgccgtggaacatgtgctcggccatttggaagacgcgcaatgcgtgagttttccctctggaatgggcgcgatttcctcggtgtttttcgcgctcctgaaatcaggcgaccgcgtgctcctgccggcggacggttatcacgcgacgcgcgcgatggccgaacgcttcctgaagccgctcggcatcacctgcgataccaggccgacgccgaccttccttgacggcggtttcaaaggctattcgctggtcttcgtggaaaccccatccaatccgcggctggatatctgcgacatctcggcgatcgccaaggctgtccacgaacaaggcggggcccttgtcgtcgacaacacgacgatgacgccattcggtcagcgtccgctcgacttcggcgccgatatcgtcgtctccgccgacaccaaggcggtcaacggccattcggatgtactgttcggccacgtcgccagccgcgacgctgacatcatatccaaggtgacgaactggcgcgcaatggccggcggcattcccggaccgttcgaagcctggctggtgcatcgcggcctcgaaacactggaggtgcgcttcgaccgcatgtgctcgtccgccgaaacgatcgcgcagcggttgaaggaacatcgcgcggtgcgcggcctgcgttttcccggcctgaacggcgacccgtcgcacaacctttcccgcgcccagatggagcgcttcggcttcctcatctccttcgaactcgcctcggaggacaaagccgaggatttcatcaacaattgcccattgatagaggccgcgacctccttcggcggcgtccacacttcggccgaacgacgctcgaagcgaggcgatgccgtaccgcccggctttgttcgcctgtcggtcggctgcgaaccggtggaagagctctggaaggccatcgagacgtcgctgaacgggatcggcggctaa

SEQ ID NO: 35573 - DNA, 732 bp, Mesorhizobium loti
atgtcccagtctctgcacggcaaaaccgcaatcgtcaccggcagttcgcgcggcatcggccgggcgatcgccgaagggctcgcggctgagggcgctgccgtcgtcgtcaattatgtcggcaaccagaaagccgcggatgaggtcgtcgccggcatcgccggcaagggaggaaaggcaatcgccatccaggccgacatatcaagcgtttcggatgtccgccgcttgtttgacgagaccgagagcaggctgggcgcgatcgacatcgtcgtcgccaatgttggcgtcgccgtcatcaaaccgctgaccgaagcaaccgaagccgatttcgaccttgtcttcggcaccaatgccaagggcaccttcttcacgctgcaggaagcagcgcgccgggtaagggatggcggccgtatcatcgccgtctccaccggcggcacaaagatgttcttcacccagacggcgctctacctcggcagcaagggcgcagtcgaacagttcgtccgcgtgctctcgcgtgaactcggatcgcgcggcatcaccgtcaatgcgctgtcgccgggcttcactgacacagacctgctccccgagcgcgatcgcgccgtggcggccggcatgtcgcccttcggcaggatcggcgcgccgcacgacgttgccgatgtcgcggtcttcctggccagcgacgaggcccgctggctgaccggcgacaacatccaggccggcggtggcgtggcgtaa

SEQ ID NO: 35574 - DNA, 1221 bp, Mesorhizobium loti
atgcagcgattcgagaatgcccgcgaggcggcactggcgcttcgtcctgacgatccggtctattgctttcgcccgcaggtgctgaaggccgatgccaggcagttcatgggcatgttccccggcaagaccgcctatgcggtcaagaccaatggcgagcagatcgtgctgaagaccttggtcgaggccggcgtcactgccttcgacgtcgcttcgcccggcgaattcgctgccgtgcgcgcggtctctcccgatgccgagatgctctacatgcacccggtcaaggcgcagtcggatatcaaactggcgctggagaaatacggcatccgcgtcatttcgctcgaccatgaggacgagatcaccaagctgacgcgggtggtgcgggcgctcgacatcgacccgggctcgatcagcgtgttcgtgcgcatccagacgaaagggtcggcggcctacgaactgtcgaagaagtttggcgccgggccggcctatgcggtcgaactcgccgagcggctgaaccgcaccggctacaaggtcggcctgtgtttccatgtcggcagccagatcgaggatcccgacacgtatgagcgggcgctggcctcggccgactgggtgcgcaaccggctgacattcgacatcgccggtctcgatgtcggcggcggctttccggccgaatacggccatgatcccaaccgcaagcagatcgagatgccgtcgctcggccagatcatgtcgcggctttccggcgacctgaaggaatatcagttcgaccagatgccgctggtggccgagccgggcagggtgatcgtggcgcgctgcctgtcgctgatcgtgcgcgtgctcctgcgcaagggcaagcggctctacatcaatgacggcatctgggcatcgctgtcggattcatggaccggcaagatcacgctgccggcacgcttcattcccgatccggcgatcaggacccgcaatggcgctgaaaagaacgtcgtgccgttcaaggtctgcggcgcgacctgcgattccgtcgacatcctgtccaggccgttctggctgccggaaaccgtcgacaccggcgactggatcgagatcggccatatcggcgcctactcgctgtcgctccgcacacgcttcaacggcttctatcccgacacattcgtcgaggtgacgacgccgttcgacgagggcgacgcgccgcagggcttcgccagcctggagacgatggcggattag
